United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 102

SEQ ID NO: 3629057 - RNA, 22 nt, Salmonella enterica enterica serovar Typhi
guggccaggaauaaaggucaca

SEQ ID NO: 3629058 - RNA, 18 nt, Salmonella enterica enterica serovar Typhi
guggcccagcgcgguggc

SEQ ID NO: 3629059 - RNA, 19 nt, Salmonella enterica enterica serovar Typhi
guggcccgcacugccgagu

SEQ ID NO: 3629060 - RNA, 14 nt, Salmonella enterica enterica serovar Typhi
guggccgacuuauc

SEQ ID NO: 3629061 - RNA, 15 nt, Salmonella enterica enterica serovar Typhi
guggccgcgcaaggc

SEQ ID NO: 3629062 - RNA, 12 nt, Salmonella enterica enterica serovar Typhi
guggccguggug

SEQ ID NO: 3629063 - RNA, 18 nt, Salmonella enterica enterica serovar Typhi
guggcgaacaggcucagc

SEQ ID NO: 3629064 - RNA, 14 nt, Salmonella enterica enterica serovar Typhi
guggcgaccagcag

SEQ ID NO: 3629065 - RNA, 21 nt, Salmonella enterica enterica serovar Typhi
guggcgagauaagccgucaua

SEQ ID NO: 3629066 - RNA, 18 nt, Salmonella enterica enterica serovar Typhi
guggcgcaaccgauagcu

SEQ ID NO: 3629067 - RNA, 20 nt, Salmonella enterica enterica serovar Typhi
guggcgcaguuuacgcagcg

SEQ ID NO: 3629068 - RNA, 19 nt, Salmonella enterica enterica serovar Typhi
guggcgcggacgcuuaccg

SEQ ID NO: 3629069 - RNA, 18 nt, Salmonella enterica enterica serovar Typhi
guggcgcugcgcuuaccg

SEQ ID NO: 3629070 - RNA, 18 nt, Salmonella enterica enterica serovar Typhi
guggcgcugugcuuaccg

SEQ ID NO: 3629071 - RNA, 19 nt, Salmonella enterica enterica serovar Typhi
guggcgcugugcuuacucg

SEQ ID NO: 3629072 - RNA, 13 nt, Salmonella enterica enterica serovar Typhi
guggcgcuguucu

SEQ ID NO: 3629073 - RNA, 22 nt, Salmonella enterica enterica serovar Typhi
guggcgcuguucuugcugcugc

SEQ ID NO: 3629074 - RNA, 18 nt, Salmonella enterica enterica serovar Typhi
guggcgcuucgcuuaccg

SEQ ID NO: 3629075 - RNA, 23 nt, Salmonella enterica enterica serovar Typhi
guggcgcuuuccggcgcuuccug

SEQ ID NO: 3629076 - RNA, 18 nt, Salmonella enterica enterica serovar Typhi
guggcggauacgcuucca

SEQ ID NO: 3629077 - RNA, 15 nt, Salmonella enterica enterica serovar Typhi
guggcgguaccggca

SEQ ID NO: 3629078 - RNA, 15 nt, Salmonella enterica enterica serovar Typhi
guggcguuuucauua

SEQ ID NO: 3629079 - RNA, 17 nt, Salmonella enterica enterica serovar Typhi
guggcuaauuucaauuu

SEQ ID NO: 3629080 - RNA, 20 nt, Salmonella enterica enterica serovar Typhi
guggcugaggccgcucgcca

SEQ ID NO: 3629081 - RNA, 21 nt, Salmonella enterica enterica serovar Typhi
guggcugaggccgcucgccau

SEQ ID NO: 3629082 - RNA, 18 nt, Salmonella enterica enterica serovar Typhi
guggcuuaccguaugcaa

SEQ ID NO: 3629083 - RNA, 23 nt, Salmonella enterica enterica serovar Typhi
gugggagguauccuccugccagg

SEQ ID NO: 3629084 - RNA, 23 nt, Salmonella enterica enterica serovar Typhi
gugggauugcaguagaucgacau

SEQ ID NO: 3629085 - RNA, 14 nt, Salmonella enterica enterica serovar Typhi
gugggccguuccgc

SEQ ID NO: 3629086 - RNA, 17 nt, Salmonella enterica enterica serovar Typhi
gugggcgugucgccggg

SEQ ID NO: 3629087 - RNA, 15 nt, Salmonella enterica enterica serovar Typhi
gugggcuaugcucca

SEQ ID NO: 3629088 - RNA, 18 nt, Salmonella enterica enterica serovar Typhi
guggggccuaaugagcca

SEQ ID NO: 3629089 - RNA, 17 nt, Salmonella enterica enterica serovar Typhi
guggggcuaagugagca

SEQ ID NO: 3629090 - RNA, 13 nt, Salmonella enterica enterica serovar Typhi
gugggguucccga

SEQ ID NO: 3629091 - RNA, 14 nt, Salmonella enterica enterica serovar Typhi
guggguaaauccgc

SEQ ID NO: 3629092 - RNA, 17 nt, Salmonella enterica enterica serovar Typhi
gugguaggcuucaaccg

SEQ ID NO: 3629093 - RNA, 18 nt, Salmonella enterica enterica serovar Typhi
guggucaucgcggccagc

SEQ ID NO: 3629094 - RNA, 21 nt, Salmonella enterica enterica serovar Typhi
guggucgcggcucaccagcug

SEQ ID NO: 3629095 - RNA, 20 nt, Salmonella enterica enterica serovar Typhi
guggucgucagccgugagca

SEQ ID NO: 3629096 - RNA, 23 nt, Salmonella enterica enterica serovar Typhi
guggugcgcauccggaaucgccg

SEQ ID NO: 3629097 - RNA, 20 nt, Salmonella enterica enterica serovar Typhi
gugguggauauccagcauaa

SEQ ID NO: 3629098 - RNA, 21 nt, Salmonella enterica enterica serovar Typhi
gugguggucauccgcccggca

SEQ ID NO: 3629099 - RNA, 12 nt, Salmonella enterica enterica serovar Typhi
guggugugccug

SEQ ID NO: 3629100 - RNA, 21 nt, Salmonella enterica enterica serovar Typhi
gugguuaugaucgucaacgca

SEQ ID NO: 3629101 - RNA, 15 nt, Salmonella enterica enterica serovar Typhi
gugguucgccaucca

SEQ ID NO: 3629102 - RNA, 16 nt, Salmonella enterica enterica serovar Typhi
gugguuuccggcagcu

SEQ ID NO: 3629103 - RNA, 13 nt, Salmonella enterica enterica serovar Typhi
guguaaaaauuuu

SEQ ID NO: 3629104 - RNA, 14 nt, Salmonella enterica enterica serovar Typhi
guguaaaagccagc

SEQ ID NO: 3629105 - RNA, 12 nt, Salmonella enterica enterica serovar Typhi
guguaauaaccg

SEQ ID NO: 3629106 - RNA, 21 nt, Salmonella enterica enterica serovar Typhi
guguaauaaccguggcggcag

SEQ ID NO: 3629107 - RNA, 13 nt, Salmonella enterica enterica serovar Typhi
guguaccagcagc

SEQ ID NO: 3629108 - RNA, 14 nt, Salmonella enterica enterica serovar Typhi
guguaccagcagcg

SEQ ID NO: 3629109 - RNA, 15 nt, Salmonella enterica enterica serovar Typhi
guguagagauucugc

SEQ ID NO: 3629110 - RNA, 15 nt, Salmonella enterica enterica serovar Typhi
guguauaccaaaaau

SEQ ID NO: 3629111 - RNA, 18 nt, Salmonella enterica enterica serovar Typhi
guguaucgcccugccagc

SEQ ID NO: 3629112 - RNA, 11 nt, Salmonella enterica enterica serovar Typhi
gugucaaagcg

SEQ ID NO: 3629113 - RNA, 20 nt, Salmonella enterica enterica serovar Typhi
gugucagacaccgggcuauu

SEQ ID NO: 3629114 - RNA, 18 nt, Salmonella enterica enterica serovar Typhi
gugucaucauuacaggcg

SEQ ID NO: 3629115 - RNA, 19 nt, Salmonella enterica enterica serovar Typhi
gugucaucauuacaggcga

SEQ ID NO: 3629116 - RNA, 19 nt, Salmonella enterica enterica serovar Typhi
gugucaugcgguuaaacca

SEQ ID NO: 3629117 - RNA, 15 nt, Salmonella enterica enterica serovar Typhi
guguccaucaggcuu

SEQ ID NO: 3629118 - RNA, 14 nt, Salmonella enterica enterica serovar Typhi
guguccgccugcug

SEQ ID NO: 3629119 - RNA, 18 nt, Salmonella enterica enterica serovar Typhi
guguccguaagcggcgga

SEQ ID NO: 3629120 - RNA, 20 nt, Salmonella enterica enterica serovar Typhi
gugucgccggggcgcuggcg

SEQ ID NO: 3629121 - RNA, 19 nt, Salmonella enterica enterica serovar Typhi
gugucguuuucacuuguuc

SEQ ID NO: 3629122 - RNA, 15 nt, Salmonella enterica enterica serovar Typhi
gugucucgucgccag

SEQ ID NO: 3629123 - RNA, 22 nt, Salmonella enterica enterica serovar Typhi
gugucuucccugaccagcgacg

SEQ ID NO: 3629124 - RNA, 12 nt, Salmonella enterica enterica serovar Typhi
gugugaccagcg

SEQ ID NO: 3629125 - RNA, 13 nt, Salmonella enterica enterica serovar Typhi
gugugaucgccgc

SEQ ID NO: 3629126 - RNA, 21 nt, Salmonella enterica enterica serovar Typhi
gugugccugcgcuuacggcca

SEQ ID NO: 3629127 - RNA, 16 nt, Salmonella enterica enterica serovar Typhi
gugugcggaugcgcca

SEQ ID NO: 3629128 - RNA, 18 nt, Salmonella enterica enterica serovar Typhi
guguggucgcggcucacc

SEQ ID NO: 3629129 - RNA, 17 nt, Salmonella enterica enterica serovar Typhi
gugugguuucaagcggc

SEQ ID NO: 3629130 - RNA, 14 nt, Salmonella enterica enterica serovar Typhi
guguguaccagcag

SEQ ID NO: 3629131 - RNA, 19 nt, Salmonella enterica enterica serovar Typhi
guguguaccagcagcgcca

SEQ ID NO: 3629132 - RNA, 15 nt, Salmonella enterica enterica serovar Typhi
guguuaaucauuuuc

SEQ ID NO: 3629133 - RNA, 17 nt, Salmonella enterica enterica serovar Typhi
guguucaugcagccaua

SEQ ID NO: 3629134 - RNA, 18 nt, Salmonella enterica enterica serovar Typhi
guguucaugcgcggcgga

SEQ ID NO: 3629135 - RNA, 17 nt, Salmonella enterica enterica serovar Typhi
guguucucccugcucgg

SEQ ID NO: 3629136 - RNA, 21 nt, Salmonella enterica enterica serovar Typhi
guguugaaauaguuacuguuu

SEQ ID NO: 3629137 - RNA, 14 nt, Salmonella enterica enterica serovar Typhi
guguugauugaaac

SEQ ID NO: 3629138 - RNA, 22 nt, Salmonella enterica enterica serovar Typhi
guguuggaugaaccauaucaaa

SEQ ID NO: 3629139 - RNA, 18 nt, Salmonella enterica enterica serovar Typhi
guguuguaaaacgcgccc

SEQ ID NO: 3629140 - RNA, 20 nt, Salmonella enterica enterica serovar Typhi
guguuguacagcaauaaaag

SEQ ID NO: 3629141 - RNA, 17 nt, Salmonella enterica enterica serovar Typhi
guguuuacgccgccauc

SEQ ID NO: 3629142 - RNA, 13 nt, Salmonella enterica enterica serovar Typhi
guguuucagcagc

SEQ ID NO: 3629143 - RNA, 19 nt, Salmonella enterica enterica serovar Typhi
guguuucaucucaucaaug

SEQ ID NO: 3629144 - RNA, 22 nt, Salmonella enterica enterica serovar Typhi
guguuucucaacauacgccgcc

SEQ ID NO: 3629145 - RNA, 18 nt, Salmonella enterica enterica serovar Typhi
guguuuggccgccggaaa

SEQ ID NO: 3629146 - RNA, 19 nt, Salmonella enterica enterica serovar Typhi
guguuuuuuaauauauuca

SEQ ID NO: 3629147 - RNA, 21 nt, Salmonella enterica enterica serovar Typhi
guuaaaaaucgcuauauugcu

SEQ ID NO: 3629148 - RNA, 20 nt, Salmonella enterica enterica serovar Typhi
guuaaaccaggcgaacccca

SEQ ID NO: 3629149 - RNA, 18 nt, Salmonella enterica enterica serovar Typhi
guuaaagcccugacagaa

SEQ ID NO: 3629150 - RNA, 20 nt, Salmonella enterica enterica serovar Typhi
guuaaauagugacuucugcu

SEQ ID NO: 3629151 - RNA, 21 nt, Salmonella enterica enterica serovar Typhi
guuaaauccucccaucgagcc

SEQ ID NO: 3629152 - RNA, 17 nt, Salmonella enterica enterica serovar Typhi
guuaaauucauauuuaa

SEQ ID NO: 3629153 - RNA, 17 nt, Salmonella enterica enterica serovar Typhi
guuaacaauauugcgcu

SEQ ID NO: 3629154 - RNA, 15 nt, Salmonella enterica enterica serovar Typhi
guuaacagaaugcug

SEQ ID NO: 3629155 - RNA, 18 nt, Salmonella enterica enterica serovar Typhi
guuaacagaaugcugaac

SEQ ID NO: 3629156 - RNA, 23 nt, Salmonella enterica enterica serovar Typhi
guuaacagacccgcuuucgcgua

SEQ ID NO: 3629157 - RNA, 23 nt, Salmonella enterica enterica serovar Typhi
guuaacccacaacgcgccaaccg

SEQ ID NO: 3629158 - RNA, 17 nt, Salmonella enterica enterica serovar Typhi
guuaaccgucuggcugc

SEQ ID NO: 3629159 - RNA, 22 nt, Salmonella enterica enterica serovar Typhi
guuaacgacccaucaauaacga

SEQ ID NO: 3629160 - RNA, 19 nt, Salmonella enterica enterica serovar Typhi
guuaacgcagcaucgccau

SEQ ID NO: 3629161 - RNA, 19 nt, Salmonella enterica enterica serovar Typhi
guuaacgccguuaccagca

SEQ ID NO: 3629162 - RNA, 23 nt, Salmonella enterica enterica serovar Typhi
guuaacucaagcgaauccagauc

SEQ ID NO: 3629163 - RNA, 14 nt, Salmonella enterica enterica serovar Typhi
guuaacucaaggua

SEQ ID NO: 3629164 - RNA, 21 nt, Salmonella enterica enterica serovar Typhi
guuaacuggauauuccaguua

SEQ ID NO: 3629165 - RNA, 14 nt, Salmonella enterica enterica serovar Typhi
guuaagcauuucgc

SEQ ID NO: 3629166 - RNA, 21 nt, Salmonella enterica enterica serovar Typhi
guuaaggcaucaauaccuguc

SEQ ID NO: 3629167 - RNA, 23 nt, Salmonella enterica enterica serovar Typhi
guuaaggccgcaaacagcacgcc

SEQ ID NO: 3629168 - RNA, 14 nt, Salmonella enterica enterica serovar Typhi
guuaauaaugaaca

SEQ ID NO: 3629169 - RNA, 19 nt, Salmonella enterica enterica serovar Typhi
guuaauacaguggaaagua

SEQ ID NO: 3629170 - RNA, 20 nt, Salmonella enterica enterica serovar Typhi
guuaauauacauucauuuua

SEQ ID NO: 3629171 - RNA, 21 nt, Salmonella enterica enterica serovar Typhi
guuaaucacuuuuaccggcgu

SEQ ID NO: 3629172 - RNA, 14 nt, Salmonella enterica enterica serovar Typhi
guuaaucauuuucu

SEQ ID NO: 3629173 - RNA, 22 nt, Salmonella enterica enterica serovar Typhi
guuaaucauuuucuuugcagcu

SEQ ID NO: 3629174 - RNA, 17 nt, Salmonella enterica enterica serovar Typhi
guuaauccaaauccgca

SEQ ID NO: 3629175 - RNA, 23 nt, Salmonella enterica enterica serovar Typhi
guuaauccuuagaauguuuuuua

SEQ ID NO: 3629176 - RNA, 22 nt, Salmonella enterica enterica serovar Typhi
guuaauggccugaugacgcugc

SEQ ID NO: 3629177 - RNA, 21 nt, Salmonella enterica enterica serovar Typhi
guuaaugguaccaauagccuu

SEQ ID NO: 3629178 - RNA, 16 nt, Salmonella enterica enterica serovar Typhi
guuaauucuggcaaua

SEQ ID NO: 3629179 - RNA, 17 nt, Salmonella enterica enterica serovar Typhi
guuaauuucaucgccgc

SEQ ID NO: 3629180 - RNA, 14 nt, Salmonella enterica enterica serovar Typhi
guuaauuugauuua

SEQ ID NO: 3629181 - RNA, 12 nt, Salmonella enterica enterica serovar Typhi
guuaauuuuccc

SEQ ID NO: 3629182 - RNA, 18 nt, Salmonella enterica enterica serovar Typhi
guuacaaauagcggcaca

SEQ ID NO: 3629183 - RNA, 20 nt, Salmonella enterica enterica serovar Typhi
guuaccauccauuaaaaucu

SEQ ID NO: 3629184 - RNA, 19 nt, Salmonella enterica enterica serovar Typhi
guuacccagccugauggcg

SEQ ID NO: 3629185 - RNA, 23 nt, Salmonella enterica enterica serovar Typhi
guuacccaugagcgaaacuccag

SEQ ID NO: 3629186 - RNA, 14 nt, Salmonella enterica enterica serovar Typhi
guuaccccaucauu

SEQ ID NO: 3629187 - RNA, 19 nt, Salmonella enterica enterica serovar Typhi
guuaccccaucauugacuu

SEQ ID NO: 3629188 - RNA, 23 nt, Salmonella enterica enterica serovar Typhi
guuaccccgaagcgcccaugaau

SEQ ID NO: 3629189 - RNA, 23 nt, Salmonella enterica enterica serovar Typhi
guuaccccuuuuucaauuuccag

SEQ ID NO: 3629190 - RNA, 14 nt, Salmonella enterica enterica serovar Typhi
guuaccgccgagca

SEQ ID NO: 3629191 - RNA, 16 nt, Salmonella enterica enterica serovar Typhi
guuaccggcuccggca

SEQ ID NO: 3629192 - RNA, 17 nt, Salmonella enterica enterica serovar Typhi
guuaccguaagcgggau

SEQ ID NO: 3629193 - RNA, 20 nt, Salmonella enterica enterica serovar Typhi
guuaccguauucugcgguau

SEQ ID NO: 3629194 - RNA, 20 nt, Salmonella enterica enterica serovar Typhi
guuacgcacgccagauaaau

SEQ ID NO: 3629195 - RNA, 21 nt, Salmonella enterica enterica serovar Typhi
guuacgcacgccagauaaauc

SEQ ID NO: 3629196 - RNA, 19 nt, Salmonella enterica enterica serovar Typhi
guuacgcauuucaagcagg

SEQ ID NO: 3629197 - RNA, 14 nt, Salmonella enterica enterica serovar Typhi
guuacggaaaaaau

SEQ ID NO: 3629198 - RNA, 16 nt, Salmonella enterica enterica serovar Typhi
guuacggaaaaaauac

SEQ ID NO: 3629199 - RNA, 23 nt, Salmonella enterica enterica serovar Typhi
guuacggcugaagcugccguccc

SEQ ID NO: 3629200 - RNA, 13 nt, Salmonella enterica enterica serovar Typhi
guuacgggaacag

SEQ ID NO: 3629201 - RNA, 15 nt, Salmonella enterica enterica serovar Typhi
guuacuauuuuucac

SEQ ID NO: 3629202 - RNA, 14 nt, Salmonella enterica enterica serovar Typhi
guuacucgauggca

SEQ ID NO: 3629203 - RNA, 16 nt, Salmonella enterica enterica serovar Typhi
guuacucuuccaccau

SEQ ID NO: 3629204 - RNA, 20 nt, Salmonella enterica enterica serovar Typhi
guuacucuuccuccccaggc

SEQ ID NO: 3629205 - RNA, 22 nt, Salmonella enterica enterica serovar Typhi
guuacucuuccuccccaggcgc

SEQ ID NO: 3629206 - RNA, 17 nt, Salmonella enterica enterica serovar Typhi
guuacucuucugaccau

SEQ ID NO: 3629207 - RNA, 21 nt, Salmonella enterica enterica serovar Typhi
guuagaaaauacugcuagaac

SEQ ID NO: 3629208 - RNA, 17 nt, Salmonella enterica enterica serovar Typhi
guuagagauauaccagc

SEQ ID NO: 3629209 - RNA, 20 nt, Salmonella enterica enterica serovar Typhi
guuagauuagguacguacau

SEQ ID NO: 3629210 - RNA, 16 nt, Salmonella enterica enterica serovar Typhi
guuagcauuauuuuua

SEQ ID NO: 3629211 - RNA, 23 nt, Salmonella enterica enterica serovar Typhi
guuagccacaaugacaugucgga

SEQ ID NO: 3629212 - RNA, 12 nt, Salmonella enterica enterica serovar Typhi
guuagccccuua

SEQ ID NO: 3629213 - RNA, 20 nt, Salmonella enterica enterica serovar Typhi
guuagccggaagauccuguu

SEQ ID NO: 3629214 - RNA, 18 nt, Salmonella enterica enterica serovar Typhi
guuagcgaacguccagcg

SEQ ID NO: 3629215 - RNA, 23 nt, Salmonella enterica enterica serovar Typhi
guuagcgagguucccgccgccau

SEQ ID NO: 3629216 - RNA, 17 nt, Salmonella enterica enterica serovar Typhi
guuagcguaucgacaaa

SEQ ID NO: 3629217 - RNA, 19 nt, Salmonella enterica enterica serovar Typhi
guuagcgucauccggcaua

SEQ ID NO: 3629218 - RNA, 13 nt, Salmonella enterica enterica serovar Typhi
guuagcucuuuca

SEQ ID NO: 3629219 - RNA, 21 nt, Salmonella enterica enterica serovar Typhi
guuagcuguauccacccgguu

SEQ ID NO: 3629220 - RNA, 13 nt, Salmonella enterica enterica serovar Typhi
guuaggaaagcag

SEQ ID NO: 3629221 - RNA, 20 nt, Salmonella enterica enterica serovar Typhi
guuaggcaagcugguaaaug

SEQ ID NO: 3629222 - RNA, 21 nt, Salmonella enterica enterica serovar Typhi
guuagggcgcggcugguaaga

SEQ ID NO: 3629223 - RNA, 16 nt, Salmonella enterica enterica serovar Typhi
guuaggguagaaaaag

SEQ ID NO: 3629224 - RNA, 14 nt, Salmonella enterica enterica serovar Typhi
guuaguaguagcug

SEQ ID NO: 3629225 - RNA, 17 nt, Salmonella enterica enterica serovar Typhi
guuaguuucuauuaaau

SEQ ID NO: 3629226 - RNA, 21 nt, Salmonella enterica enterica serovar Typhi
guuauaaauccccgccgccau

SEQ ID NO: 3629227 - RNA, 15 nt, Salmonella enterica enterica serovar Typhi
guuauauuacuggcu

SEQ ID NO: 3629228 - RNA, 17 nt, Salmonella enterica enterica serovar Typhi
guuaucaaaaaaaacca

SEQ ID NO: 3629229 - RNA, 14 nt, Salmonella enterica enterica serovar Typhi
guuaucccugcuga

SEQ ID NO: 3629230 - RNA, 16 nt, Salmonella enterica enterica serovar Typhi
guuaucgaauccagca

SEQ ID NO: 3629231 - RNA, 18 nt, Salmonella enterica enterica serovar Typhi
guuaucgaggcgcuggcg

SEQ ID NO: 3629232 - RNA, 17 nt, Salmonella enterica enterica serovar Typhi
guuaucgcgcacgcgcc

SEQ ID NO: 3629233 - RNA, 17 nt, Salmonella enterica enterica serovar Typhi
guuaucguagugccaca

SEQ ID NO: 3629234 - RNA, 14 nt, Salmonella enterica enterica serovar Typhi
guuaucucgccagg

SEQ ID NO: 3629235 - RNA, 12 nt, Salmonella enterica enterica serovar Typhi
guuaugcaucug

SEQ ID NO: 3629236 - RNA, 16 nt, Salmonella enterica enterica serovar Typhi
guuaugcauugcugau

SEQ ID NO: 3629237 - RNA, 11 nt, Salmonella enterica enterica serovar Typhi
guuaugccauc

SEQ ID NO: 3629238 - RNA, 21 nt, Salmonella enterica enterica serovar Typhi
guuaugccaucuaacacaaau

SEQ ID NO: 3629239 - RNA, 20 nt, Salmonella enterica enterica serovar Typhi
guuaugcgcaucaccguuac

SEQ ID NO: 3629240 - RNA, 17 nt, Salmonella enterica enterica serovar Typhi
guuauguguuucuacgc

SEQ ID NO: 3629241 - RNA, 15 nt, Salmonella enterica enterica serovar Typhi
guuauuaaguuuuac

SEQ ID NO: 3629242 - RNA, 15 nt, Salmonella enterica enterica serovar Typhi
guuauucauucaccc

SEQ ID NO: 3629243 - RNA, 14 nt, Salmonella enterica enterica serovar Typhi
guuauucgaugcgg

SEQ ID NO: 3629244 - RNA, 23 nt, Salmonella enterica enterica serovar Typhi
guuauucgcccaaaugcacugca

SEQ ID NO: 3629245 - RNA, 21 nt, Salmonella enterica enterica serovar Typhi
guuauugucaugcuaaaacag

SEQ ID NO: 3629246 - RNA, 22 nt, Salmonella enterica enterica serovar Typhi
guuauugugguguuccauugcu

SEQ ID NO: 3629247 - RNA, 18 nt, Salmonella enterica enterica serovar Typhi
guuauuugccucuggcca

SEQ ID NO: 3629248 - RNA, 17 nt, Salmonella enterica enterica serovar Typhi
guuauuuucaaaaacaa

SEQ ID NO: 3629249 - RNA, 19 nt, Salmonella enterica enterica serovar Typhi
guuauuuucaaaaacaagg

SEQ ID NO: 3629250 - RNA, 23 nt, Salmonella enterica enterica serovar Typhi
guucaaaaaugauguguuucagc

SEQ ID NO: 3629251 - RNA, 20 nt, Salmonella enterica enterica serovar Typhi
guucaaaacgcuaacgcguu

SEQ ID NO: 3629252 - RNA, 19 nt, Salmonella enterica enterica serovar Typhi
guucaaauucuucccggcg

SEQ ID NO: 3629253 - RNA, 22 nt, Salmonella enterica enterica serovar Typhi
guucaaauucuucccggcggaa

SEQ ID NO: 3629254 - RNA, 20 nt, Salmonella enterica enterica serovar Typhi
guucaaccugcgcugacggc

SEQ ID NO: 3629255 - RNA, 22 nt, Salmonella enterica enterica serovar Typhi
guucaauaugccaggcauuuuc

SEQ ID NO: 3629256 - RNA, 20 nt, Salmonella enterica enterica serovar Typhi
guucaauucauagagcgcgu

SEQ ID NO: 3629257 - RNA, 13 nt, Salmonella enterica enterica serovar Typhi
guucaccggcggc

SEQ ID NO: 3629258 - RNA, 18 nt, Salmonella enterica enterica serovar Typhi
guucacgaucaccuggug

SEQ ID NO: 3629259 - RNA, 18 nt, Salmonella enterica enterica serovar Typhi
guucacgcagcgcaucca

SEQ ID NO: 3629260 - RNA, 20 nt, Salmonella enterica enterica serovar Typhi
guucacgccgccauccggca

SEQ ID NO: 3629261 - RNA, 17 nt, Salmonella enterica enterica serovar Typhi
guucacuaacgcggcau

SEQ ID NO: 3629262 - RNA, 17 nt, Salmonella enterica enterica serovar Typhi
guucacuccuaagagaa

SEQ ID NO: 3629263 - RNA, 19 nt, Salmonella enterica enterica serovar Typhi
guucagaaauguauucucc

SEQ ID NO: 3629264 - RNA, 20 nt, Salmonella enterica enterica serovar Typhi
guucagaaauguauucuccc

SEQ ID NO: 3629265 - RNA, 15 nt, Salmonella enterica enterica serovar Typhi
guucagacguagcgc

SEQ ID NO: 3629266 - RNA, 11 nt, Salmonella enterica enterica serovar Typhi
guucagccagc

SEQ ID NO: 3629267 - RNA, 13 nt, Salmonella enterica enterica serovar Typhi
guucagccgauaa

SEQ ID NO: 3629268 - RNA, 13 nt, Salmonella enterica enterica serovar Typhi
guucagccgccag

SEQ ID NO: 3629269 - RNA, 18 nt, Salmonella enterica enterica serovar Typhi
guucagcgacaggcuguc

SEQ ID NO: 3629270 - RNA, 16 nt, Salmonella enterica enterica serovar Typhi
guucagcgccugaaug

SEQ ID NO: 3629271 - RNA, 19 nt, Salmonella enterica enterica serovar Typhi
guucagcuacuucaggcug

SEQ ID NO: 3629272 - RNA, 18 nt, Salmonella enterica enterica serovar Typhi
guucagcucgauccggca

SEQ ID NO: 3629273 - RNA, 19 nt, Salmonella enterica enterica serovar Typhi
guucaggcacgugcauaaa

SEQ ID NO: 3629274 - RNA, 11 nt, Salmonella enterica enterica serovar Typhi
guucagguuuu

SEQ ID NO: 3629275 - RNA, 20 nt, Salmonella enterica enterica serovar Typhi
guucaguuaaauaaacaaaa

SEQ ID NO: 3629276 - RNA, 12 nt, Salmonella enterica enterica serovar Typhi
guucaguuucaa

SEQ ID NO: 3629277 - RNA, 12 nt, Salmonella enterica enterica serovar Typhi
guucaguuuuuc

SEQ ID NO: 3629278 - RNA, 16 nt, Salmonella enterica enterica serovar Typhi
guucauaagucaucca

SEQ ID NO: 3629279 - RNA, 18 nt, Salmonella enterica enterica serovar Typhi
guucauaagucauccaga

SEQ ID NO: 3629280 - RNA, 14 nt, Salmonella enterica enterica serovar Typhi
guucauaauccgga

SEQ ID NO: 3629281 - RNA, 22 nt, Salmonella enterica enterica serovar Typhi
guucaucaggcaauaaacauca

SEQ ID NO: 3629282 - RNA, 21 nt, Salmonella enterica enterica serovar Typhi
guucaucaggccugcaaaccu

SEQ ID NO: 3629283 - RNA, 15 nt, Salmonella enterica enterica serovar Typhi
guucaucauccugca

SEQ ID NO: 3629284 - RNA, 20 nt, Salmonella enterica enterica serovar Typhi
guucaucgccacaugcggca

SEQ ID NO: 3629285 - RNA, 20 nt, Salmonella enterica enterica serovar Typhi
guucaucgugaaauuauucc

SEQ ID NO: 3629286 - RNA, 15 nt, Salmonella enterica enterica serovar Typhi
guucaucuaucgcca

SEQ ID NO: 3629287 - RNA, 19 nt, Salmonella enterica enterica serovar Typhi
guucaucuaucgccagcgc

SEQ ID NO: 3629288 - RNA, 23 nt, Salmonella enterica enterica serovar Typhi
guucaucucuucccgucgcagca

SEQ ID NO: 3629289 - RNA, 19 nt, Salmonella enterica enterica serovar Typhi
guucaugaaccacgccaac

SEQ ID NO: 3629290 - RNA, 22 nt, Salmonella enterica enterica serovar Typhi
guucaugcaauuccgcuuucuu

SEQ ID NO: 3629291 - RNA, 15 nt, Salmonella enterica enterica serovar Typhi
guucaugcacucgcg

SEQ ID NO: 3629292 - RNA, 16 nt, Salmonella enterica enterica serovar Typhi
guucaugcuggucagc

SEQ ID NO: 3629293 - RNA, 20 nt, Salmonella enterica enterica serovar Typhi
guucauucccgccaauaacc

SEQ ID NO: 3629294 - RNA, 21 nt, Salmonella enterica enterica serovar Typhi
guucauucccgccaauaacca

SEQ ID NO: 3629295 - RNA, 12 nt, Salmonella enterica enterica serovar Typhi
guucauucgcca

SEQ ID NO: 3629296 - RNA, 21 nt, Salmonella enterica enterica serovar Typhi
guucauugaugaugaagcugc

SEQ ID NO: 3629297 - RNA, 15 nt, Salmonella enterica enterica serovar Typhi
guucauugcuuucuu

SEQ ID NO: 3629298 - RNA, 18 nt, Salmonella enterica enterica serovar Typhi
guuccacacguccauccg

SEQ ID NO: 3629299 - RNA, 18 nt, Salmonella enterica enterica serovar Typhi
guuccaccgccaauaaaa

SEQ ID NO: 3629300 - RNA, 12 nt, Salmonella enterica enterica serovar Typhi
guuccaccugcg

SEQ ID NO: 3629301 - RNA, 20 nt, Salmonella enterica enterica serovar Typhi
guuccagauaauccagcguc

SEQ ID NO: 3629302 - RNA, 21 nt, Salmonella enterica enterica serovar Typhi
guuccagcagcucaucaauaa

SEQ ID NO: 3629303 - RNA, 16 nt, Salmonella enterica enterica serovar Typhi
guuccagccgccaggc

SEQ ID NO: 3629304 - RNA, 13 nt, Salmonella enterica enterica serovar Typhi
guuccaggcgcgc

SEQ ID NO: 3629305 - RNA, 16 nt, Salmonella enterica enterica serovar Typhi
guuccaguaaggucca

SEQ ID NO: 3629306 - RNA, 17 nt, Salmonella enterica enterica serovar Typhi
guuccaucacuuccugu

SEQ ID NO: 3629307 - RNA, 18 nt, Salmonella enterica enterica serovar Typhi
guuccauuccagaacgaa

SEQ ID NO: 3629308 - RNA, 22 nt, Salmonella enterica enterica serovar Typhi
guuccauuccagaaucuggccg

SEQ ID NO: 3629309 - RNA, 15 nt, Salmonella enterica enterica serovar Typhi
guucccaugcuucca

SEQ ID NO: 3629310 - RNA, 21 nt, Salmonella enterica enterica serovar Typhi
guucccaugcuuccagccguu

SEQ ID NO: 3629311 - RNA, 15 nt, Salmonella enterica enterica serovar Typhi
guuccccagccgcuu

SEQ ID NO: 3629312 - RNA, 16 nt, Salmonella enterica enterica serovar Typhi
guuccccgugcccggc

SEQ ID NO: 3629313 - RNA, 17 nt, Salmonella enterica enterica serovar Typhi
guucccgcgccagcguc

SEQ ID NO: 3629314 - RNA, 15 nt, Salmonella enterica enterica serovar Typhi
guucccggcaacagu

SEQ ID NO: 3629315 - RNA, 20 nt, Salmonella enterica enterica serovar Typhi
guucccuacgcccaggucgc

SEQ ID NO: 3629316 - RNA, 14 nt, Salmonella enterica enterica serovar Typhi
guuccgaaauaaau

SEQ ID NO: 3629317 - RNA, 21 nt, Salmonella enterica enterica serovar Typhi
guuccgccagacucagccagg

SEQ ID NO: 3629318 - RNA, 20 nt, Salmonella enterica enterica serovar Typhi
guuccgccaggcgagcacac

SEQ ID NO: 3629319 - RNA, 20 nt, Salmonella enterica enterica serovar Typhi
guuccgccccgccuuccgcg

SEQ ID NO: 3629320 - RNA, 23 nt, Salmonella enterica enterica serovar Typhi
guuccgcgacaaugauuugcaac

SEQ ID NO: 3629321 - RNA, 13 nt, Salmonella enterica enterica serovar Typhi
guuccgcuaccug

SEQ ID NO: 3629322 - RNA, 18 nt, Salmonella enterica enterica serovar Typhi
guuccgcuaccugcgagc

SEQ ID NO: 3629323 - RNA, 18 nt, Salmonella enterica enterica serovar Typhi
guuccgcuuuucuggcuu

SEQ ID NO: 3629324 - RNA, 21 nt, Salmonella enterica enterica serovar Typhi
guuccucguccugauccggcu

SEQ ID NO: 3629325 - RNA, 21 nt, Salmonella enterica enterica serovar Typhi
guuccugcgggaacagauaaa

SEQ ID NO: 3629326 - RNA, 22 nt, Salmonella enterica enterica serovar Typhi
guuccugcgggaacagauaaau

SEQ ID NO: 3629327 - RNA, 14 nt, Salmonella enterica enterica serovar Typhi
guucgacggagauu

SEQ ID NO: 3629328 - RNA, 15 nt, Salmonella enterica enterica serovar Typhi
guucgauaaucccgg

SEQ ID NO: 3629329 - RNA, 16 nt, Salmonella enterica enterica serovar Typhi
guucgauacuauaacg

SEQ ID NO: 3629330 - RNA, 15 nt, Salmonella enterica enterica serovar Typhi
guucgaucagcuggc

SEQ ID NO: 3629331 - RNA, 19 nt, Salmonella enterica enterica serovar Typhi
guucgcauauucugcgaaa

SEQ ID NO: 3629332 - RNA, 15 nt, Salmonella enterica enterica serovar Typhi
guucgccagugacaa

SEQ ID NO: 3629333 - RNA, 14 nt, Salmonella enterica enterica serovar Typhi
guucgccauccaga

SEQ ID NO: 3629334 - RNA, 20 nt, Salmonella enterica enterica serovar Typhi
guucgcccuucaucuuccag

SEQ ID NO: 3629335 - RNA, 19 nt, Salmonella enterica enterica serovar Typhi
guucgcgaauuucacgcag

SEQ ID NO: 3629336 - RNA, 15 nt, Salmonella enterica enterica serovar Typhi
guucgcgcaguucau

SEQ ID NO: 3629337 - RNA, 17 nt, Salmonella enterica enterica serovar Typhi
guucgcgcaguucaucc

SEQ ID NO: 3629338 - RNA, 13 nt, Salmonella enterica enterica serovar Typhi
guucgcggcuggu

SEQ ID NO: 3629339 - RNA, 23 nt, Salmonella enterica enterica serovar Typhi
guucgcuuucauacgacgacggu

SEQ ID NO: 3629340 - RNA, 18 nt, Salmonella enterica enterica serovar Typhi
guucggagaucagcggau

SEQ ID NO: 3629341 - RNA, 15 nt, Salmonella enterica enterica serovar Typhi
guucggauaaacgcu

SEQ ID NO: 3629342 - RNA, 16 nt, Salmonella enterica enterica serovar Typhi
guucggguuuuccugc

SEQ ID NO: 3629343 - RNA, 23 nt, Salmonella enterica enterica serovar Typhi
guucgguauaugaaucaucagaa

SEQ ID NO: 3629344 - RNA, 18 nt, Salmonella enterica enterica serovar Typhi
guucgguaucgcgccagg

SEQ ID NO: 3629345 - RNA, 14 nt, Salmonella enterica enterica serovar Typhi
guucguagcccaua

SEQ ID NO: 3629346 - RNA, 17 nt, Salmonella enterica enterica serovar Typhi
guucgucuuccggauaa

SEQ ID NO: 3629347 - RNA, 14 nt, Salmonella enterica enterica serovar Typhi
guucuaacaggaag

SEQ ID NO: 3629348 - RNA, 21 nt, Salmonella enterica enterica serovar Typhi
guucuaucagguaucccgcca

SEQ ID NO: 3629349 - RNA, 13 nt, Salmonella enterica enterica serovar Typhi
guucucacccaug

SEQ ID NO: 3629350 - RNA, 20 nt, Salmonella enterica enterica serovar Typhi
guucucgcgccgccugcacg

SEQ ID NO: 3629351 - RNA, 21 nt, Salmonella enterica enterica serovar Typhi
guucucgcgccgccugcacgg

SEQ ID NO: 3629352 - RNA, 19 nt, Salmonella enterica enterica serovar Typhi
guucugagcggauucgacu

SEQ ID NO: 3629353 - RNA, 18 nt, Salmonella enterica enterica serovar Typhi
guucugaggcuauuguca

SEQ ID NO: 3629354 - RNA, 19 nt, Salmonella enterica enterica serovar Typhi
guucugcgccauuuccagc

SEQ ID NO: 3629355 - RNA, 22 nt, Salmonella enterica enterica serovar Typhi
guucugcugauaauacugccgc

SEQ ID NO: 3629356 - RNA, 15 nt, Salmonella enterica enterica serovar Typhi
guucuggcugcgcuu

SEQ ID NO: 3629357 - RNA, 19 nt, Salmonella enterica enterica serovar Typhi
guucuugcugcugcugaug

SEQ ID NO: 3629358 - RNA, 13 nt, Salmonella enterica enterica serovar Typhi
guucuuucaccau

SEQ ID NO: 3629359 - RNA, 22 nt, Salmonella enterica enterica serovar Typhi
guucuuucaccauuaagacagg

SEQ ID NO: 3629360 - RNA, 13 nt, Salmonella enterica enterica serovar Typhi
guucuuucauuuu

SEQ ID NO: 3629361 - RNA, 18 nt, Salmonella enterica enterica serovar Typhi
guucuuugauuagcucau

SEQ ID NO: 3629362 - RNA, 16 nt, Salmonella enterica enterica serovar Typhi
guucuuuucuuucagc

SEQ ID NO: 3629363 - RNA, 20 nt, Salmonella enterica enterica serovar Typhi
guugaaaaaacgggcccgcg

SEQ ID NO: 3629364 - RNA, 14 nt, Salmonella enterica enterica serovar Typhi
guugaaauccucua

SEQ ID NO: 3629365 - RNA, 14 nt, Salmonella enterica enterica serovar Typhi
guugaacauuucau

SEQ ID NO: 3629366 - RNA, 22 nt, Salmonella enterica enterica serovar Typhi
guugaacauuucaucuaucugc

SEQ ID NO: 3629367 - RNA, 17 nt, Salmonella enterica enterica serovar Typhi
guugaaccgucaucagc

SEQ ID NO: 3629368 - RNA, 18 nt, Salmonella enterica enterica serovar Typhi
guugaacguuuucugagc

SEQ ID NO: 3629369 - RNA, 19 nt, Salmonella enterica enterica serovar Typhi
guugaacguuuucugagcg

SEQ ID NO: 3629370 - RNA, 20 nt, Salmonella enterica enterica serovar Typhi
guugaagcgaccagcgcgcc

SEQ ID NO: 3629371 - RNA, 19 nt, Salmonella enterica enterica serovar Typhi
guugaauaucgcuuuuucu

SEQ ID NO: 3629372 - RNA, 16 nt, Salmonella enterica enterica serovar Typhi
guugaauauuggcauc

SEQ ID NO: 3629373 - RNA, 23 nt, Salmonella enterica enterica serovar Typhi
guugaccaguccgcacgccugca

SEQ ID NO: 3629374 - RNA, 21 nt, Salmonella enterica enterica serovar Typhi
guugacgccccauguggccag

SEQ ID NO: 3629375 - RNA, 14 nt, Salmonella enterica enterica serovar Typhi
guugacgcuucaag

SEQ ID NO: 3629376 - RNA, 15 nt, Salmonella enterica enterica serovar Typhi
guugacugccaggua

SEQ ID NO: 3629377 - RNA, 19 nt, Salmonella enterica enterica serovar Typhi
guugacuuaaaaagcggau

SEQ ID NO: 3629378 - RNA, 15 nt, Salmonella enterica enterica serovar Typhi
guugagcgcauuugc

SEQ ID NO: 3629379 - RNA, 17 nt, Salmonella enterica enterica serovar Typhi
guugagcgcuugcugcg

SEQ ID NO: 3629380 - RNA, 16 nt, Salmonella enterica enterica serovar Typhi
guugaggaaauucuga

SEQ ID NO: 3629381 - RNA, 19 nt, Salmonella enterica enterica serovar Typhi
guugaggaaauucugacgc

SEQ ID NO: 3629382 - RNA, 20 nt, Salmonella enterica enterica serovar Typhi
guugauaaaacacucuuuuu

SEQ ID NO: 3629383 - RNA, 23 nt, Salmonella enterica enterica serovar Typhi
guugauacagaaaaccggcaaau

SEQ ID NO: 3629384 - RNA, 19 nt, Salmonella enterica enterica serovar Typhi
guugauaugcaguucauca

SEQ ID NO: 3629385 - RNA, 17 nt, Salmonella enterica enterica serovar Typhi
guugaucguaaaaugaa

SEQ ID NO: 3629386 - RNA, 18 nt, Salmonella enterica enterica serovar Typhi
guugaugauuacugcuga

SEQ ID NO: 3629387 - RNA, 13 nt, Salmonella enterica enterica serovar Typhi
guugauggagguu

SEQ ID NO: 3629388 - RNA, 20 nt, Salmonella enterica enterica serovar Typhi
guugauucgcuaauaauucu

SEQ ID NO: 3629389 - RNA, 18 nt, Salmonella enterica enterica serovar Typhi
guugauugaaacucgcca

SEQ ID NO: 3629390 - RNA, 16 nt, Salmonella enterica enterica serovar Typhi
guugcagcccaccggc

SEQ ID NO: 3629391 - RNA, 15 nt, Salmonella enterica enterica serovar Typhi
guugcaguuuacgag

SEQ ID NO: 3629392 - RNA, 16 nt, Salmonella enterica enterica serovar Typhi
guugccagcggccagg

SEQ ID NO: 3629393 - RNA, 19 nt, Salmonella enterica enterica serovar Typhi
guugccaggguucaaccug

SEQ ID NO: 3629394 - RNA, 21 nt, Salmonella enterica enterica serovar Typhi
guugccaggguucaaccugau

SEQ ID NO: 3629395 - RNA, 14 nt, Salmonella enterica enterica serovar Typhi
guugccaguacagc

SEQ ID NO: 3629396 - RNA, 18 nt, Salmonella enterica enterica serovar Typhi
guugccaugauccaucuc

SEQ ID NO: 3629397 - RNA, 19 nt, Salmonella enterica enterica serovar Typhi
guugcccaguacggcgcga

SEQ ID NO: 3629398 - RNA, 20 nt, Salmonella enterica enterica serovar Typhi
guugcccauuuuccucccau

SEQ ID NO: 3629399 - RNA, 23 nt, Salmonella enterica enterica serovar Typhi
guugccgcccguuuuuuccagcg

SEQ ID NO: 3629400 - RNA, 19 nt, Salmonella enterica enterica serovar Typhi
guugccguguccuuguccg

SEQ ID NO: 3629401 - RNA, 11 nt, Salmonella enterica enterica serovar Typhi
guugccuucga

SEQ ID NO: 3629402 - RNA, 17 nt, Salmonella enterica enterica serovar Typhi
guugccuuugucaucca

SEQ ID NO: 3629403 - RNA, 17 nt, Salmonella enterica enterica serovar Typhi
guugcgacuguucauca

SEQ ID NO: 3629404 - RNA, 21 nt, Salmonella enterica enterica serovar Typhi
guugcgacuguucaucaaaga

SEQ ID NO: 3629405 - RNA, 21 nt, Salmonella enterica enterica serovar Typhi
guugcgcagcguuuccagacu

SEQ ID NO: 3629406 - RNA, 16 nt, Salmonella enterica enterica serovar Typhi
guugcgcccaggccaa

SEQ ID NO: 3629407 - RNA, 13 nt, Salmonella enterica enterica serovar Typhi
guugcgccgccag

SEQ ID NO: 3629408 - RNA, 14 nt, Salmonella enterica enterica serovar Typhi
guugcgcugguugg

SEQ ID NO: 3629409 - RNA, 15 nt, Salmonella enterica enterica serovar Typhi
guugcggauaaccga

SEQ ID NO: 3629410 - RNA, 18 nt, Salmonella enterica enterica serovar Typhi
guugcggauaugcgucuu

SEQ ID NO: 3629411 - RNA, 12 nt, Salmonella enterica enterica serovar Typhi
guugcggcauca

SEQ ID NO: 3629412 - RNA, 15 nt, Salmonella enterica enterica serovar Typhi
guugcguaaauaaau

SEQ ID NO: 3629413 - RNA, 17 nt, Salmonella enterica enterica serovar Typhi
guugcgucaccgggcug

SEQ ID NO: 3629414 - RNA, 17 nt, Salmonella enterica enterica serovar Typhi
guugcgucagcguaccg

SEQ ID NO: 3629415 - RNA, 20 nt, Salmonella enterica enterica serovar Typhi
guugcguucccuacgcccag

SEQ ID NO: 3629416 - RNA, 21 nt, Salmonella enterica enterica serovar Typhi
guugcguuggaagugcguuaa

SEQ ID NO: 3629417 - RNA, 14 nt, Salmonella enterica enterica serovar Typhi
guugcuacgcgcca

SEQ ID NO: 3629418 - RNA, 14 nt, Salmonella enterica enterica serovar Typhi
guugcuccagcauc

SEQ ID NO: 3629419 - RNA, 21 nt, Salmonella enterica enterica serovar Typhi
guugcuccuguaagucaggua

SEQ ID NO: 3629420 - RNA, 14 nt, Salmonella enterica enterica serovar Typhi
guugcugcaaaaga

SEQ ID NO: 3629421 - RNA, 18 nt, Salmonella enterica enterica serovar Typhi
guugcuguuccagccgcc

SEQ ID NO: 3629422 - RNA, 21 nt, Salmonella enterica enterica serovar Typhi
guugcuuaccuuguucuucca

SEQ ID NO: 3629423 - RNA, 21 nt, Salmonella enterica enterica serovar Typhi
guugcuucuguccuuucugcu

SEQ ID NO: 3629424 - RNA, 22 nt, Salmonella enterica enterica serovar Typhi
guugcuuuauaaaaagcacauc

SEQ ID NO: 3629425 - RNA, 20 nt, Salmonella enterica enterica serovar Typhi
guuggaugaaccauaucaaa

SEQ ID NO: 3629426 - RNA, 18 nt, Salmonella enterica enterica serovar Typhi
guuggcaacgucuugcca

SEQ ID NO: 3629427 - RNA, 19 nt, Salmonella enterica enterica serovar Typhi
guuggcauggucagcauaa

SEQ ID NO: 3629428 - RNA, 21 nt, Salmonella enterica enterica serovar Typhi
guuggcauucgaauccuccug

SEQ ID NO: 3629429 - RNA, 23 nt, Salmonella enterica enterica serovar Typhi
guuggcauucuuacgauacccca

SEQ ID NO: 3629430 - RNA, 19 nt, Salmonella enterica enterica serovar Typhi
guuggcgacauacgcgcuc

SEQ ID NO: 3629431 - RNA, 18 nt, Salmonella enterica enterica serovar Typhi
guuggcgccaaaaccgcu

SEQ ID NO: 3629432 - RNA, 18 nt, Salmonella enterica enterica serovar Typhi
guuggcguaaaucaggcc

SEQ ID NO: 3629433 - RNA, 17 nt, Salmonella enterica enterica serovar Typhi
guuggcguaccaucagc

SEQ ID NO: 3629434 - RNA, 19 nt, Salmonella enterica enterica serovar Typhi
guuggcugcgcucagaaac

SEQ ID NO: 3629435 - RNA, 18 nt, Salmonella enterica enterica serovar Typhi
guuggcuugaucaacgcc

SEQ ID NO: 3629436 - RNA, 23 nt, Salmonella enterica enterica serovar Typhi
guugggcagaaacguaccugaga

SEQ ID NO: 3629437 - RNA, 18 nt, Salmonella enterica enterica serovar Typhi
guuggggauaaccagaaa

SEQ ID NO: 3629438 - RNA, 13 nt, Salmonella enterica enterica serovar Typhi
guugguauucaac

SEQ ID NO: 3629439 - RNA, 23 nt, Salmonella enterica enterica serovar Typhi
guugguauugcgaaacggcagcg

SEQ ID NO: 3629440 - RNA, 23 nt, Salmonella enterica enterica serovar Typhi
guuggucacaaaggccagcagca

SEQ ID NO: 3629441 - RNA, 23 nt, Salmonella enterica enterica serovar Typhi
guuguacggaugggguaucgcca

SEQ ID NO: 3629442 - RNA, 15 nt, Salmonella enterica enterica serovar Typhi
guuguagcacagccc

SEQ ID NO: 3629443 - RNA, 16 nt, Salmonella enterica enterica serovar Typhi
guuguaggcucaaagu

SEQ ID NO: 3629444 - RNA, 15 nt, Salmonella enterica enterica serovar Typhi
guuguaguuaucgcc

SEQ ID NO: 3629445 - RNA, 23 nt, Salmonella enterica enterica serovar Typhi
guuguccccucaugacuuuuuuc

SEQ ID NO: 3629446 - RNA, 19 nt, Salmonella enterica enterica serovar Typhi
guuguccggcgaccuuauu

SEQ ID NO: 3629447 - RNA, 16 nt, Salmonella enterica enterica serovar Typhi
guugucgagguuauaa

SEQ ID NO: 3629448 - RNA, 15 nt, Salmonella enterica enterica serovar Typhi
guugucucaaaaaau

SEQ ID NO: 3629449 - RNA, 20 nt, Salmonella enterica enterica serovar Typhi
guugucuucaccuugcugcg

SEQ ID NO: 3629450 - RNA, 14 nt, Salmonella enterica enterica serovar Typhi
guugucuucaucua

SEQ ID NO: 3629451 - RNA, 15 nt, Salmonella enterica enterica serovar Typhi
guugucuuugcugcc

SEQ ID NO: 3629452 - RNA, 17 nt, Salmonella enterica enterica serovar Typhi
guugugcauuccaggug

SEQ ID NO: 3629453 - RNA, 16 nt, Salmonella enterica enterica serovar Typhi
guugugguuaaacaca

SEQ ID NO: 3629454 - RNA, 15 nt, Salmonella enterica enterica serovar Typhi
guuguuccagcagcu

SEQ ID NO: 3629455 - RNA, 17 nt, Salmonella enterica enterica serovar Typhi
guuguuccgcgcugaug

SEQ ID NO: 3629456 - RNA, 21 nt, Salmonella enterica enterica serovar Typhi
guuguuuuauuaccuccugca

SEQ ID NO: 3629457 - RNA, 12 nt, Salmonella enterica enterica serovar Typhi
guuuaaaccacu

SEQ ID NO: 3629458 - RNA, 20 nt, Salmonella enterica enterica serovar Typhi
guuuaaacucccggcuaaac

SEQ ID NO: 3629459 - RNA, 16 nt, Salmonella enterica enterica serovar Typhi
guuuaaaucgcuaagc

SEQ ID NO: 3629460 - RNA, 20 nt, Salmonella enterica enterica serovar Typhi
guuuaaaucgcuaagcagaa

SEQ ID NO: 3629461 - RNA, 21 nt, Salmonella enterica enterica serovar Typhi
guuuaacugaacuuccguaaa

SEQ ID NO: 3629462 - RNA, 13 nt, Salmonella enterica enterica serovar Typhi
guuuaagcggaua

SEQ ID NO: 3629463 - RNA, 14 nt, Salmonella enterica enterica serovar Typhi
guuuaaucacgcca

SEQ ID NO: 3629464 - RNA, 12 nt, Salmonella enterica enterica serovar Typhi
guuuaaucgccc

SEQ ID NO: 3629465 - RNA, 14 nt, Salmonella enterica enterica serovar Typhi
guuuaauuucugac

SEQ ID NO: 3629466 - RNA, 19 nt, Salmonella enterica enterica serovar Typhi
guuuacccagcgaaugcug

SEQ ID NO: 3629467 - RNA, 21 nt, Salmonella enterica enterica serovar Typhi
guuuacgagugcguucuucca

SEQ ID NO: 3629468 - RNA, 15 nt, Salmonella enterica enterica serovar Typhi
guuuacgccgccauc

SEQ ID NO: 3629469 - RNA, 20 nt, Salmonella enterica enterica serovar Typhi
guuuacgccgccauccggca

SEQ ID NO: 3629470 - RNA, 13 nt, Salmonella enterica enterica serovar Typhi
guuuuuauacauu

SEQ ID NO: 3629471 - RNA, 15 nt, Salmonella enterica enterica serovar Typhi
guuuuuauuuuucuu

SEQ ID NO: 3629472 - RNA, 14 nt, Salmonella enterica enterica serovar Typhi
guuuuucaucauca

SEQ ID NO: 3629473 - RNA, 19 nt, Salmonella enterica enterica serovar Typhi
guuuuuccccguugcucau

SEQ ID NO: 3629474 - RNA, 16 nt, Salmonella enterica enterica serovar Typhi
guuuuucccgcuggcu

SEQ ID NO: 3629475 - RNA, 13 nt, Salmonella enterica enterica serovar Typhi
guuuuucccggau

SEQ ID NO: 3629476 - RNA, 16 nt, Salmonella enterica enterica serovar Typhi
guuuuucgaaaauuuc

SEQ ID NO: 3629477 - RNA, 14 nt, Salmonella enterica enterica serovar Typhi
guuuuucuuccugu

SEQ ID NO: 3629478 - RNA, 15 nt, Salmonella enterica enterica serovar Typhi
guuuuugaacauugc

SEQ ID NO: 3629479 - RNA, 13 nt, Salmonella enterica enterica serovar Typhi
guuuuugaaccau

SEQ ID NO: 3629480 - RNA, 17 nt, Salmonella enterica enterica serovar Typhi
guuuuugucuccucaug

SEQ ID NO: 3629481 - RNA, 15 nt, Salmonella enterica enterica serovar Typhi
guuuuuuaauauaag

SEQ ID NO: 3629482 - RNA, 21 nt, Salmonella enterica enterica serovar Typhi
guuuuuuaaugagaaauuuua

SEQ ID NO: 3629483 - RNA, 14 nt, Salmonella enterica enterica serovar Typhi
guuuuuuccagcgc

SEQ ID NO: 3629484 - RNA, 16 nt, Salmonella enterica enterica serovar Typhi
guuuuuuuaugcguuu

SEQ ID NO: 3629485 - RNA, 18 nt, Salmonella enterica enterica serovar Typhi
uaaaaaaaagccgaccug

SEQ ID NO: 3629486 - RNA, 21 nt, Salmonella enterica enterica serovar Typhi
uaaaaaaaccucuaccuacac

SEQ ID NO: 3629487 - RNA, 22 nt, Salmonella enterica enterica serovar Typhi
uaaaaaaaccucuaccuacaca

SEQ ID NO: 3629488 - RNA, 16 nt, Salmonella enterica enterica serovar Typhi
uaaaaaaauaaaaaag

SEQ ID NO: 3629489 - RNA, 19 nt, Salmonella enterica enterica serovar Typhi
uaaaaaaauaaaaaaggca

SEQ ID NO: 3629490 - RNA, 18 nt, Salmonella enterica enterica serovar Typhi
uaaaaaacaccugucugu

SEQ ID NO: 3629491 - RNA, 11 nt, Salmonella enterica enterica serovar Typhi
uaaaaaacagg

SEQ ID NO: 3629492 - RNA, 16 nt, Salmonella enterica enterica serovar Typhi
uaaaaaacaggcgcag

SEQ ID NO: 3629493 - RNA, 19 nt, Salmonella enterica enterica serovar Typhi
uaaaaaacaucauaauaau

SEQ ID NO: 3629494 - RNA, 21 nt, Salmonella enterica enterica serovar Typhi
uaaaaaaggccgcuuaauaau

SEQ ID NO: 3629495 - RNA, 22 nt, Salmonella enterica enterica serovar Typhi
uaaaaaaggccgcuuaauaaua

SEQ ID NO: 3629496 - RNA, 21 nt, Salmonella enterica enterica serovar Typhi
uaaaaaaggggagucgguacu

SEQ ID NO: 3629497 - RNA, 18 nt, Salmonella enterica enterica serovar Typhi
uaaaaaagucacuuacuu

SEQ ID NO: 3629498 - RNA, 12 nt, Salmonella enterica enterica serovar Typhi
uaaaaaaugaga

SEQ ID NO: 3629499 - RNA, 20 nt, Salmonella enterica enterica serovar Typhi
uaaaaaccagaauuuccaga

SEQ ID NO: 3629500 - RNA, 21 nt, Salmonella enterica enterica serovar Typhi
uaaaaaccaggcaaaaauagg

SEQ ID NO: 3629501 - RNA, 16 nt, Salmonella enterica enterica serovar Typhi
uaaaaacccugccgaa

SEQ ID NO: 3629502 - RNA, 18 nt, Salmonella enterica enterica serovar Typhi
uaaaaacccuuucauucg

SEQ ID NO: 3629503 - RNA, 18 nt, Salmonella enterica enterica serovar Typhi
uaaaaagaccaugaacac

SEQ ID NO: 3629504 - RNA, 17 nt, Salmonella enterica enterica serovar Typhi
uaaaaagcguacaaaaa

SEQ ID NO: 3629505 - RNA, 16 nt, Salmonella enterica enterica serovar Typhi
uaaaaagcugcauaau

SEQ ID NO: 3629506 - RNA, 10 nt, Salmonella enterica enterica serovar Typhi
uaaaaaggaa

SEQ ID NO: 3629507 - RNA, 11 nt, Salmonella enterica enterica serovar Typhi
uaaaaaggaca

SEQ ID NO: 3629508 - RNA, 21 nt, Salmonella enterica enterica serovar Typhi
uaaaaaggugagcgcaaugcu

SEQ ID NO: 3629509 - RNA, 22 nt, Salmonella enterica enterica serovar Typhi
uaaaaauaacgcgauaaucccc

SEQ ID NO: 3629510 - RNA, 17 nt, Salmonella enterica enterica serovar Typhi
uaaaaauauuucagcag

SEQ ID NO: 3629511 - RNA, 22 nt, Salmonella enterica enterica serovar Typhi
uaaaaaucauccuucgggcgau

SEQ ID NO: 3629512 - RNA, 18 nt, Salmonella enterica enterica serovar Typhi
uaaaaaugaggugaaaca

SEQ ID NO: 3629513 - RNA, 22 nt, Salmonella enterica enterica serovar Typhi
uaaaacaaaaaaacggccucaa

SEQ ID NO: 3629514 - RNA, 18 nt, Salmonella enterica enterica serovar Typhi
uaaaacauuccugacauu

SEQ ID NO: 3629515 - RNA, 18 nt, Salmonella enterica enterica serovar Typhi
uaaaaccagggaagcuac

SEQ ID NO: 3629516 - RNA, 14 nt, Salmonella enterica enterica serovar Typhi
uaaaacgcauacug

SEQ ID NO: 3629517 - RNA, 19 nt, Salmonella enterica enterica serovar Typhi
uaaaacgcgcccaacggau

SEQ ID NO: 3629518 - RNA, 18 nt, Salmonella enterica enterica serovar Typhi
uaaaacgguaugaaacau

SEQ ID NO: 3629519 - RNA, 22 nt, Salmonella enterica enterica serovar Typhi
uaaaacguuauuggcaggaugu

SEQ ID NO: 3629520 - RNA, 17 nt, Salmonella enterica enterica serovar Typhi
uaaaacuggcuaucgcc

SEQ ID NO: 3629521 - RNA, 14 nt, Salmonella enterica enterica serovar Typhi
uaaaagacgccaug

SEQ ID NO: 3629522 - RNA, 22 nt, Salmonella enterica enterica serovar Typhi
uaaaagagagcgccaaaaagaa

SEQ ID NO: 3629523 - RNA, 17 nt, Salmonella enterica enterica serovar Typhi
uaaaagcccuuaucgcc

SEQ ID NO: 3629524 - RNA, 22 nt, Salmonella enterica enterica serovar Typhi
uaaaagcccuuaucgccccagc

SEQ ID NO: 3629525 - RNA, 21 nt, Salmonella enterica enterica serovar Typhi
uaaaagcgauaaagacagguu

SEQ ID NO: 3629526 - RNA, 16 nt, Salmonella enterica enterica serovar Typhi
uaaaagcggauaagau

SEQ ID NO: 3629527 - RNA, 13 nt, Salmonella enterica enterica serovar Typhi
uaaaaguuagccc

SEQ ID NO: 3629528 - RNA, 17 nt, Salmonella enterica enterica serovar Typhi
uaaaaguuagccccuua

SEQ ID NO: 3629529 - RNA, 23 nt, Salmonella enterica enterica serovar Typhi
uaaaauaaacacuaaaucauaau

SEQ ID NO: 3629530 - RNA, 18 nt, Salmonella enterica enterica serovar Typhi
uaaaauaccgccugccga

SEQ ID NO: 3629531 - RNA, 21 nt, Salmonella enterica enterica serovar Typhi
uaaaauacgcucaauauacuu

SEQ ID NO: 3629532 - RNA, 14 nt, Salmonella enterica enterica serovar Typhi
uaaaaucaacgcuc

SEQ ID NO: 3629533 - RNA, 12 nt, Salmonella enterica enterica serovar Typhi
uaaaauccugca

SEQ ID NO: 3629534 - RNA, 19 nt, Salmonella enterica enterica serovar Typhi
uaaaauccuuuuucaugca

SEQ ID NO: 3629535 - RNA, 12 nt, Salmonella enterica enterica serovar Typhi
uaaaaucgccaa

SEQ ID NO: 3629536 - RNA, 20 nt, Salmonella enterica enterica serovar Typhi
uaaaaucggggucuuccagc

SEQ ID NO: 3629537 - RNA, 23 nt, Salmonella enterica enterica serovar Typhi
uaaaaucuaagagccugucccac

SEQ ID NO: 3629538 - RNA, 10 nt, Salmonella enterica enterica serovar Typhi
uaaaaugacc

SEQ ID NO: 3629539 - RNA, 19 nt, Salmonella enterica enterica serovar Typhi
uaaaaugaccgucgaccag

SEQ ID NO: 3629540 - RNA, 13 nt, Salmonella enterica enterica serovar Typhi
uaaaauggacauu

SEQ ID NO: 3629541 - RNA, 12 nt, Salmonella enterica enterica serovar Typhi
uaaaaugucugu

SEQ ID NO: 3629542 - RNA, 16 nt, Salmonella enterica enterica serovar Typhi
uaaaauuauauucuaa

SEQ ID NO: 3629543 - RNA, 23 nt, Salmonella enterica enterica serovar Typhi
uaaaauuauuggcuuuguaaaua

SEQ ID NO: 3629544 - RNA, 18 nt, Salmonella enterica enterica serovar Typhi
uaaaauuccaauauuuau

SEQ ID NO: 3629545 - RNA, 15 nt, Salmonella enterica enterica serovar Typhi
uaaaauugaacggac

SEQ ID NO: 3629546 - RNA, 13 nt, Salmonella enterica enterica serovar Typhi
uaaaauugaauua

SEQ ID NO: 3629547 - RNA, 17 nt, Salmonella enterica enterica serovar Typhi
uaaaauugcucagccaa

SEQ ID NO: 3629548 - RNA, 15 nt, Salmonella enterica enterica serovar Typhi
uaaacaaaacaacaa

SEQ ID NO: 3629549 - RNA, 14 nt, Salmonella enterica enterica serovar Typhi
uaaacaaugcaggu

SEQ ID NO: 3629550 - RNA, 20 nt, Salmonella enterica enterica serovar Typhi
uaaacaauuugcccagcgcu

SEQ ID NO: 3629551 - RNA, 19 nt, Salmonella enterica enterica serovar Typhi
uaaacaccauacgacgauc

SEQ ID NO: 3629552 - RNA, 20 nt, Salmonella enterica enterica serovar Typhi
uaaacaccggggcauuucca

SEQ ID NO: 3629553 - RNA, 15 nt, Salmonella enterica enterica serovar Typhi
uaaacacguuaucug

SEQ ID NO: 3629554 - RNA, 17 nt, Salmonella enterica enterica serovar Typhi
uaaacacguuaucugac

SEQ ID NO: 3629555 - RNA, 19 nt, Salmonella enterica enterica serovar Typhi
uaaacacucuccaccaaau

SEQ ID NO: 3629556 - RNA, 13 nt, Salmonella enterica enterica serovar Typhi
uaaauagcaggca

SEQ ID NO: 3629557 - RNA, 21 nt, Salmonella enterica enterica serovar Typhi
uaaauagcgcuggcgccgcaa

SEQ ID NO: 3629558 - RNA, 19 nt, Salmonella enterica enterica serovar Typhi
uaaauaggcgccgccgaca

SEQ ID NO: 3629559 - RNA, 19 nt, Salmonella enterica enterica serovar Typhi
uaaauaguaaauagaaaau

SEQ ID NO: 3629560 - RNA, 18 nt, Salmonella enterica enterica serovar Typhi
uaaauauaagaucuauuu

SEQ ID NO: 3629561 - RNA, 12 nt, Salmonella enterica enterica serovar Typhi
uaaauauucauc

SEQ ID NO: 3629562 - RNA, 16 nt, Salmonella enterica enterica serovar Typhi
uaaauauucaucaaaa

SEQ ID NO: 3629563 - RNA, 20 nt, Salmonella enterica enterica serovar Typhi
uaaauauucaucaaaaugca

SEQ ID NO: 3629564 - RNA, 16 nt, Salmonella enterica enterica serovar Typhi
uaaauauugauggacg

SEQ ID NO: 3629565 - RNA, 19 nt, Salmonella enterica enterica serovar Typhi
uaaaucaauagauuauucg

SEQ ID NO: 3629566 - RNA, 20 nt, Salmonella enterica enterica serovar Typhi
uaaaucaauagauuauucgu

SEQ ID NO: 3629567 - RNA, 18 nt, Salmonella enterica enterica serovar Typhi
uaaaucagcgauaaccag

SEQ ID NO: 3629568 - RNA, 13 nt, Salmonella enterica enterica serovar Typhi
uaaaucauaauuu

SEQ ID NO: 3629569 - RNA, 17 nt, Salmonella enterica enterica serovar Typhi
uaaaucauccugcggca

SEQ ID NO: 3629570 - RNA, 21 nt, Salmonella enterica enterica serovar Typhi
uaaaucauuacuuauauuuau

SEQ ID NO: 3629571 - RNA, 21 nt, Salmonella enterica enterica serovar Typhi
uaaaucauuuguacaaaaaau

SEQ ID NO: 3629572 - RNA, 17 nt, Salmonella enterica enterica serovar Typhi
uaaauccacauuccaga

SEQ ID NO: 3629573 - RNA, 12 nt, Salmonella enterica enterica serovar Typhi
uaaauccagcgc

SEQ ID NO: 3629574 - RNA, 14 nt, Salmonella enterica enterica serovar Typhi
uaaauccauauucu

SEQ ID NO: 3629575 - RNA, 21 nt, Salmonella enterica enterica serovar Typhi
uaaauccguuaagcccugaau

SEQ ID NO: 3629576 - RNA, 16 nt, Salmonella enterica enterica serovar Typhi
uaaaucgcgcaaauau

SEQ ID NO: 3629577 - RNA, 17 nt, Salmonella enterica enterica serovar Typhi
uaaaucgcgcaaauauu

SEQ ID NO: 3629578 - RNA, 19 nt, Salmonella enterica enterica serovar Typhi
uaaaucgcgcaaauauuac

SEQ ID NO: 3629579 - RNA, 21 nt, Salmonella enterica enterica serovar Typhi
uaaaucgcgcaaauauuacaa

SEQ ID NO: 3629580 - RNA, 16 nt, Salmonella enterica enterica serovar Typhi
uaaaucgcuaagcaga

SEQ ID NO: 3629581 - RNA, 22 nt, Salmonella enterica enterica serovar Typhi
uaaaucuacccaauugaauuua

SEQ ID NO: 3629582 - RNA, 21 nt, Salmonella enterica enterica serovar Typhi
uaaaucugccgucaucgacuu

SEQ ID NO: 3629583 - RNA, 16 nt, Salmonella enterica enterica serovar Typhi
uaaaugcauagcccca

SEQ ID NO: 3629584 - RNA, 17 nt, Salmonella enterica enterica serovar Typhi
uaaaugccacuauagau

SEQ ID NO: 3629585 - RNA, 16 nt, Salmonella enterica enterica serovar Typhi
uaaaugucaggaucag

SEQ ID NO: 3629586 - RNA, 22 nt, Salmonella enterica enterica serovar Typhi
uaaaugucugaauauuaaaguu

SEQ ID NO: 3629587 - RNA, 14 nt, Salmonella enterica enterica serovar Typhi
uaaauuaacaccca

SEQ ID NO: 3629588 - RNA, 21 nt, Salmonella enterica enterica serovar Typhi
uaaauuaacgcgaauccgcca

SEQ ID NO: 3629589 - RNA, 14 nt, Salmonella enterica enterica serovar Typhi
uaaauuacuuauga

SEQ ID NO: 3629590 - RNA, 13 nt, Salmonella enterica enterica serovar Typhi
uaaauucgcuacg

SEQ ID NO: 3629591 - RNA, 17 nt, Salmonella enterica enterica serovar Typhi
uaaauugccugauggcg

SEQ ID NO: 3629592 - RNA, 12 nt, Salmonella enterica enterica serovar Typhi
uaaauugguuau

SEQ ID NO: 3629593 - RNA, 20 nt, Salmonella enterica enterica serovar Typhi
uaaauuuaacucguccuguu

SEQ ID NO: 3629594 - RNA, 14 nt, Salmonella enterica enterica serovar Typhi
uaaauuuacucagu

SEQ ID NO: 3629595 - RNA, 22 nt, Salmonella enterica enterica serovar Typhi
uaaauuucaacccgaucgccau

SEQ ID NO: 3629596 - RNA, 17 nt, Salmonella enterica enterica serovar Typhi
uaaauuuccgcagccag

SEQ ID NO: 3629597 - RNA, 18 nt, Salmonella enterica enterica serovar Typhi
uaaauuuccgcagccaga

SEQ ID NO: 3629598 - RNA, 21 nt, Salmonella enterica enterica serovar Typhi
uaaauuuccucuugucaggca

SEQ ID NO: 3629599 - RNA, 19 nt, Salmonella enterica enterica serovar Typhi
uaaauuuguuuaucauccu

SEQ ID NO: 3629600 - RNA, 17 nt, Salmonella enterica enterica serovar Typhi
uaacaaaucacaaggaa

SEQ ID NO: 3629601 - RNA, 15 nt, Salmonella enterica enterica serovar Typhi
uaacaaaucauuucc

SEQ ID NO: 3629602 - RNA, 20 nt, Salmonella enterica enterica serovar Typhi
uaacaaauuaaauccugaaa

SEQ ID NO: 3629603 - RNA, 16 nt, Salmonella enterica enterica serovar Typhi
uaacaacauugaggcu

SEQ ID NO: 3629604 - RNA, 17 nt, Salmonella enterica enterica serovar Typhi
uaacaaccagaauaaug

SEQ ID NO: 3629605 - RNA, 18 nt, Salmonella enterica enterica serovar Typhi
uaacaaccagaauaaugg

SEQ ID NO: 3629606 - RNA, 22 nt, Salmonella enterica enterica serovar Typhi
uaacaacccgacgacguucgau

SEQ ID NO: 3629607 - RNA, 21 nt, Salmonella enterica enterica serovar Typhi
uaacaaccgggaucuuuuuca

SEQ ID NO: 3629608 - RNA, 15 nt, Salmonella enterica enterica serovar Typhi
uaacaacuguuuuuc

SEQ ID NO: 3629609 - RNA, 21 nt, Salmonella enterica enterica serovar Typhi
uaacaauauuaaauaaauagu

SEQ ID NO: 3629610 - RNA, 20 nt, Salmonella enterica enterica serovar Typhi
uaacaauccccgucacagcg

SEQ ID NO: 3629611 - RNA, 14 nt, Salmonella enterica enterica serovar Typhi
uaacaaugccucga

SEQ ID NO: 3629612 - RNA, 14 nt, Salmonella enterica enterica serovar Typhi
uaacaauuuaucag

SEQ ID NO: 3629613 - RNA, 15 nt, Salmonella enterica enterica serovar Typhi
uaacaauuuaucaga

SEQ ID NO: 3629614 - RNA, 18 nt, Salmonella enterica enterica serovar Typhi
uaacaauuuaucagacaa

SEQ ID NO: 3629615 - RNA, 19 nt, Salmonella enterica enterica serovar Typhi
uaacacacaguugccuucg

SEQ ID NO: 3629616 - RNA, 14 nt, Salmonella enterica enterica serovar Typhi
uaacacggcuggca

SEQ ID NO: 3629617 - RNA, 16 nt, Salmonella enterica enterica serovar Typhi
uaacacggcuggcaau

SEQ ID NO: 3629618 - RNA, 21 nt, Salmonella enterica enterica serovar Typhi
uaacagacgcaucuuuuuccc

SEQ ID NO: 3629619 - RNA, 22 nt, Salmonella enterica enterica serovar Typhi
uaacagacgcaucuuuuucccg

SEQ ID NO: 3629620 - RNA, 19 nt, Salmonella enterica enterica serovar Typhi
uaacagagagggaaaaaaa

SEQ ID NO: 3629621 - RNA, 13 nt, Salmonella enterica enterica serovar Typhi
uaacagccagcgg

SEQ ID NO: 3629622 - RNA, 16 nt, Salmonella enterica enterica serovar Typhi
uaacagcgcgaccagc

SEQ ID NO: 3629623 - RNA, 21 nt, Salmonella enterica enterica serovar Typhi
uaacagcgcgaccaggaaacc

SEQ ID NO: 3629624 - RNA, 17 nt, Salmonella enterica enterica serovar Typhi
uaacagcuggcuugcca

SEQ ID NO: 3629625 - RNA, 23 nt, Salmonella enterica enterica serovar Typhi
uaacagcuggcuugccagcagau

SEQ ID NO: 3629626 - RNA, 18 nt, Salmonella enterica enterica serovar Typhi
uaacaggcaccagcguau

SEQ ID NO: 3629627 - RNA, 21 nt, Salmonella enterica enterica serovar Typhi
uaacaggcgccggggcagcaa

SEQ ID NO: 3629628 - RNA, 16 nt, Salmonella enterica enterica serovar Typhi
uaacaguucaaacggc

SEQ ID NO: 3629629 - RNA, 17 nt, Salmonella enterica enterica serovar Typhi
uaacauaaauaguauua

SEQ ID NO: 3629630 - RNA, 23 nt, Salmonella enterica enterica serovar Typhi
uaacauaaauaguauuaguugau

SEQ ID NO: 3629631 - RNA, 20 nt, Salmonella enterica enterica serovar Typhi
uaacauaagugauacaugcu

SEQ ID NO: 3629632 - RNA, 14 nt, Salmonella enterica enterica serovar Typhi
uaacauacaaaaag

SEQ ID NO: 3629633 - RNA, 17 nt, Salmonella enterica enterica serovar Typhi
uaacauagcuaccgcgc

SEQ ID NO: 3629634 - RNA, 17 nt, Salmonella enterica enterica serovar Typhi
uaacauauagcagcagu

SEQ ID NO: 3629635 - RNA, 23 nt, Salmonella enterica enterica serovar Typhi
uaacauaucgacauaaguaaaua

SEQ ID NO: 3629636 - RNA, 18 nt, Salmonella enterica enterica serovar Typhi
uaacaucaaguacagcuu

SEQ ID NO: 3629637 - RNA, 17 nt, Salmonella enterica enterica serovar Typhi
uaacaucaccuuucauu

SEQ ID NO: 3629638 - RNA, 16 nt, Salmonella enterica enterica serovar Typhi
uaacaucguaaaucaa

SEQ ID NO: 3629639 - RNA, 18 nt, Salmonella enterica enterica serovar Typhi
uaacaucuuccaugccuu

SEQ ID NO: 3629640 - RNA, 19 nt, Salmonella enterica enterica serovar Typhi
uaacaugcuggauucaguu

SEQ ID NO: 3629641 - RNA, 19 nt, Salmonella enterica enterica serovar Typhi
uaacucaagcgaauccaga

SEQ ID NO: 3629642 - RNA, 18 nt, Salmonella enterica enterica serovar Typhi
uaacuccaugcccacaca

SEQ ID NO: 3629643 - RNA, 22 nt, Salmonella enterica enterica serovar Typhi
uaacuccuucuaauuccaggau

SEQ ID NO: 3629644 - RNA, 17 nt, Salmonella enterica enterica serovar Typhi
uaacucuuaauuauaaa

SEQ ID NO: 3629645 - RNA, 19 nt, Salmonella enterica enterica serovar Typhi
uaacucuuccgcaaucaca

SEQ ID NO: 3629646 - RNA, 19 nt, Salmonella enterica enterica serovar Typhi
uaacucuuuuucagcaaau

SEQ ID NO: 3629647 - RNA, 20 nt, Salmonella enterica enterica serovar Typhi
uaacucuuuuucagcaaaua

SEQ ID NO: 3629648 - RNA, 18 nt, Salmonella enterica enterica serovar Typhi
uaacugaagguuuuuccc

SEQ ID NO: 3629649 - RNA, 17 nt, Salmonella enterica enterica serovar Typhi
uaacugacaauuuccag

SEQ ID NO: 3629650 - RNA, 23 nt, Salmonella enterica enterica serovar Typhi
uaacugcaccuuuuuuuccagcg

SEQ ID NO: 3629651 - RNA, 19 nt, Salmonella enterica enterica serovar Typhi
uaacugcauuacauucaua

SEQ ID NO: 3629652 - RNA, 12 nt, Salmonella enterica enterica serovar Typhi
uaacugcccguc

SEQ ID NO: 3629653 - RNA, 19 nt, Salmonella enterica enterica serovar Typhi
uaacugccuuauccggccu

SEQ ID NO: 3629654 - RNA, 12 nt, Salmonella enterica enterica serovar Typhi
uaacugcugcuc

SEQ ID NO: 3629655 - RNA, 15 nt, Salmonella enterica enterica serovar Typhi
uaacuggcaaucaug

SEQ ID NO: 3629656 - RNA, 22 nt, Salmonella enterica enterica serovar Typhi
uaacuuaaacgccggauuccag

SEQ ID NO: 3629657 - RNA, 19 nt, Salmonella enterica enterica serovar Typhi
uaacuuagcaacugccggc

SEQ ID NO: 3629658 - RNA, 13 nt, Salmonella enterica enterica serovar Typhi
uaacuuauccacu

SEQ ID NO: 3629659 - RNA, 16 nt, Salmonella enterica enterica serovar Typhi
uaacuucacgccaucg

SEQ ID NO: 3629660 - RNA, 21 nt, Salmonella enterica enterica serovar Typhi
uaacuucggcaaauucuuuuc

SEQ ID NO: 3629661 - RNA, 22 nt, Salmonella enterica enterica serovar Typhi
uaacuucggcaaauucuuuuca

SEQ ID NO: 3629662 - RNA, 15 nt, Salmonella enterica enterica serovar Typhi
uaacuucugcaggga

SEQ ID NO: 3629663 - RNA, 21 nt, Salmonella enterica enterica serovar Typhi
uaacuugacuuugcucuccuu

SEQ ID NO: 3629664 - RNA, 22 nt, Salmonella enterica enterica serovar Typhi
uaacuuucccgcuauccaucau

SEQ ID NO: 3629665 - RNA, 14 nt, Salmonella enterica enterica serovar Typhi
uaagaaaaaacugg

SEQ ID NO: 3629666 - RNA, 20 nt, Salmonella enterica enterica serovar Typhi
uaagaaaaaacuggugcagg

SEQ ID NO: 3629667 - RNA, 21 nt, Salmonella enterica enterica serovar Typhi
uaagaaacugcuguagcacau

SEQ ID NO: 3629668 - RNA, 16 nt, Salmonella enterica enterica serovar Typhi
uaagaaagauaaaaua

SEQ ID NO: 3629669 - RNA, 18 nt, Salmonella enterica enterica serovar Typhi
uaagaacuccaaauaccg

SEQ ID NO: 3629670 - RNA, 12 nt, Salmonella enterica enterica serovar Typhi
uaagaagaacca

SEQ ID NO: 3629671 - RNA, 15 nt, Salmonella enterica enterica serovar Typhi
uaagaaguaaacaga

SEQ ID NO: 3629672 - RNA, 19 nt, Salmonella enterica enterica serovar Typhi
uaagaaguaaacagaauca

SEQ ID NO: 3629673 - RNA, 22 nt, Salmonella enterica enterica serovar Typhi
uaagaagucugugagaaaagcg

SEQ ID NO: 3629674 - RNA, 13 nt, Salmonella enterica enterica serovar Typhi
uaagaaucgaugu

SEQ ID NO: 3629675 - RNA, 19 nt, Salmonella enterica enterica serovar Typhi
uaagaauuauuaccaauga

SEQ ID NO: 3629676 - RNA, 22 nt, Salmonella enterica enterica serovar Typhi
uaagaccauacuuugcauugcc

SEQ ID NO: 3629677 - RNA, 23 nt, Salmonella enterica enterica serovar Typhi
uaagacgcuacgcgucgccaucc

SEQ ID NO: 3629678 - RNA, 20 nt, Salmonella enterica enterica serovar Typhi
uaagacgcuuacaucgccau

SEQ ID NO: 3629679 - RNA, 19 nt, Salmonella enterica enterica serovar Typhi
uaagagaccgguuauugag

SEQ ID NO: 3629680 - RNA, 17 nt, Salmonella enterica enterica serovar Typhi
uaagagccugucccacc

SEQ ID NO: 3629681 - RNA, 16 nt, Salmonella enterica enterica serovar Typhi
uaagauagcaggcgau

SEQ ID NO: 3629682 - RNA, 18 nt, Salmonella enterica enterica serovar Typhi
uaagauauccugcuugcc

SEQ ID NO: 3629683 - RNA, 19 nt, Salmonella enterica enterica serovar Typhi
uaagaucggguggccuaac

SEQ ID NO: 3629684 - RNA, 18 nt, Salmonella enterica enterica serovar Typhi
uaagaucuuccggcguca

SEQ ID NO: 3629685 - RNA, 15 nt, Salmonella enterica enterica serovar Typhi
uaagauuuaaaacaa

SEQ ID NO: 3629686 - RNA, 16 nt, Salmonella enterica enterica serovar Typhi
uaagauuuaaaacaag

SEQ ID NO: 3629687 - RNA, 18 nt, Salmonella enterica enterica serovar Typhi
uaagauuuaaaacaagca

SEQ ID NO: 3629688 - RNA, 18 nt, Salmonella enterica enterica serovar Typhi
uaagcaacguuuccgcua

SEQ ID NO: 3629689 - RNA, 21 nt, Salmonella enterica enterica serovar Typhi
uaagcaauccauuuuaaauac

SEQ ID NO: 3629690 - RNA, 14 nt, Salmonella enterica enterica serovar Typhi
uaagcaauuaauau

SEQ ID NO: 3629691 - RNA, 19 nt, Salmonella enterica enterica serovar Typhi
uaagcacggggguuuugug

SEQ ID NO: 3629692 - RNA, 21 nt, Salmonella enterica enterica serovar Typhi
uaagcauccaggaaguaaauu

SEQ ID NO: 3629693 - RNA, 23 nt, Salmonella enterica enterica serovar Typhi
uaagcauuagcgccauccggcac

SEQ ID NO: 3629694 - RNA, 14 nt, Salmonella enterica enterica serovar Typhi
uaagccaccagauc

SEQ ID NO: 3629695 - RNA, 14 nt, Salmonella enterica enterica serovar Typhi
uaagccagcgauga

SEQ ID NO: 3629696 - RNA, 21 nt, Salmonella enterica enterica serovar Typhi
uaagccaguccugccaccagc

SEQ ID NO: 3629697 - RNA, 20 nt, Salmonella enterica enterica serovar Typhi
uaagccaguucucaaucgcc

SEQ ID NO: 3629698 - RNA, 21 nt, Salmonella enterica enterica serovar Typhi
uaagcccauggcaggcagcac

SEQ ID NO: 3629699 - RNA, 23 nt, Salmonella enterica enterica serovar Typhi
uaagcccauggcaggcagcacaa

SEQ ID NO: 3629700 - RNA, 15 nt, Salmonella enterica enterica serovar Typhi
uaagccgcguucugu

SEQ ID NO: 3629701 - RNA, 19 nt, Salmonella enterica enterica serovar Typhi
uaagccggcaggcagcgcc

SEQ ID NO: 3629702 - RNA, 20 nt, Salmonella enterica enterica serovar Typhi
uaagccggcaggcagcgcca

SEQ ID NO: 3629703 - RNA, 22 nt, Salmonella enterica enterica serovar Typhi
uaagccggcaggcagcgccagc

SEQ ID NO: 3629704 - RNA, 16 nt, Salmonella enterica enterica serovar Typhi
uaagccgucauaaaau

SEQ ID NO: 3629705 - RNA, 17 nt, Salmonella enterica enterica serovar Typhi
uaagcgaauccagcgcc

SEQ ID NO: 3629706 - RNA, 14 nt, Salmonella enterica enterica serovar Typhi
uaagcgaaugcugu

SEQ ID NO: 3629707 - RNA, 14 nt, Salmonella enterica enterica serovar Typhi
uaagcgacgaaucc

SEQ ID NO: 3629708 - RNA, 22 nt, Salmonella enterica enterica serovar Typhi
uaagcgcaauauuguuaaccag

SEQ ID NO: 3629709 - RNA, 14 nt, Salmonella enterica enterica serovar Typhi
uaagcgcagcgcca

SEQ ID NO: 3629710 - RNA, 17 nt, Salmonella enterica enterica serovar Typhi
uaagcgcagcgccaccg

SEQ ID NO: 3629711 - RNA, 14 nt, Salmonella enterica enterica serovar Typhi
uaagcgcagcguca

SEQ ID NO: 3629712 - RNA, 16 nt, Salmonella enterica enterica serovar Typhi
uaagcgccgucauccg

SEQ ID NO: 3629713 - RNA, 14 nt, Salmonella enterica enterica serovar Typhi
uaagcgcuagcgcc

SEQ ID NO: 3629714 - RNA, 14 nt, Salmonella enterica enterica serovar Typhi
uaagcgcucaggca

SEQ ID NO: 3629715 - RNA, 21 nt, Salmonella enterica enterica serovar Typhi
uaagcgcuuuggucaggcuaa

SEQ ID NO: 3629716 - RNA, 15 nt, Salmonella enterica enterica serovar Typhi
uaagcggcagcgcca

SEQ ID NO: 3629717 - RNA, 13 nt, Salmonella enterica enterica serovar Typhi
uaagcggccuaua

SEQ ID NO: 3629718 - RNA, 19 nt, Salmonella enterica enterica serovar Typhi
uaagcggcggaccagcgug

SEQ ID NO: 3629719 - RNA, 22 nt, Salmonella enterica enterica serovar Typhi
uaagcggguauacuuaacccug

SEQ ID NO: 3629720 - RNA, 17 nt, Salmonella enterica enterica serovar Typhi
uaagcggguugcacauu

SEQ ID NO: 3629721 - RNA, 21 nt, Salmonella enterica enterica serovar Typhi
uaagcgucacccggcaauuca

SEQ ID NO: 3629722 - RNA, 14 nt, Salmonella enterica enterica serovar Typhi
uaagcgugcaaccc

SEQ ID NO: 3629723 - RNA, 11 nt, Salmonella enterica enterica serovar Typhi
uaagcguucag

SEQ ID NO: 3629724 - RNA, 16 nt, Salmonella enterica enterica serovar Typhi
uaagcuaguaaagaaa

SEQ ID NO: 3629725 - RNA, 23 nt, Salmonella enterica enterica serovar Typhi
uaagcuaguaaagaaauuuugca

SEQ ID NO: 3629726 - RNA, 16 nt, Salmonella enterica enterica serovar Typhi
uaaucaggacaucaaa

SEQ ID NO: 3629727 - RNA, 16 nt, Salmonella enterica enterica serovar Typhi
uaaucaggagggcugc

SEQ ID NO: 3629728 - RNA, 18 nt, Salmonella enterica enterica serovar Typhi
uaaucaggagggcugccc

SEQ ID NO: 3629729 - RNA, 17 nt, Salmonella enterica enterica serovar Typhi
uaaucaggcauccugcc

SEQ ID NO: 3629730 - RNA, 19 nt, Salmonella enterica enterica serovar Typhi
uaaucaggcgagagaagaa

SEQ ID NO: 3629731 - RNA, 22 nt, Salmonella enterica enterica serovar Typhi
uaaucaggcgagagaagaauuc

SEQ ID NO: 3629732 - RNA, 20 nt, Salmonella enterica enterica serovar Typhi
uaaucaucaccguuuuccag

SEQ ID NO: 3629733 - RNA, 13 nt, Salmonella enterica enterica serovar Typhi
uaaucaucacgcu

SEQ ID NO: 3629734 - RNA, 19 nt, Salmonella enterica enterica serovar Typhi
uaaucaucacgcuauggcc

SEQ ID NO: 3629735 - RNA, 14 nt, Salmonella enterica enterica serovar Typhi
uaaucaugaacguu

SEQ ID NO: 3629736 - RNA, 22 nt, Salmonella enterica enterica serovar Typhi
uaaucaugaacguuaucggcau

SEQ ID NO: 3629737 - RNA, 18 nt, Salmonella enterica enterica serovar Typhi
uaauccaacauuaucaaa

SEQ ID NO: 3629738 - RNA, 21 nt, Salmonella enterica enterica serovar Typhi
uaauccagaggguaauuucuu

SEQ ID NO: 3629739 - RNA, 11 nt, Salmonella enterica enterica serovar Typhi
uaauccagcgu

SEQ ID NO: 3629740 - RNA, 23 nt, Salmonella enterica enterica serovar Typhi
uaaucccgcggcggacagcggca

SEQ ID NO: 3629741 - RNA, 11 nt, Salmonella enterica enterica serovar Typhi
uaaucccuugc

SEQ ID NO: 3629742 - RNA, 13 nt, Salmonella enterica enterica serovar Typhi
uaauccgcuccac

SEQ ID NO: 3629743 - RNA, 15 nt, Salmonella enterica enterica serovar Typhi
uaauccggcaacugc

SEQ ID NO: 3629744 - RNA, 18 nt, Salmonella enterica enterica serovar Typhi
uaauccgugaauguccug

SEQ ID NO: 3629745 - RNA, 15 nt, Salmonella enterica enterica serovar Typhi
uaauccuuauuuaau

SEQ ID NO: 3629746 - RNA, 22 nt, Salmonella enterica enterica serovar Typhi
uaauccuuguccauguaaacuc

SEQ ID NO: 3629747 - RNA, 14 nt, Salmonella enterica enterica serovar Typhi
uaaucgaaauaaag

SEQ ID NO: 3629748 - RNA, 17 nt, Salmonella enterica enterica serovar Typhi
uaaucgaaucgccucaa

SEQ ID NO: 3629749 - RNA, 19 nt, Salmonella enterica enterica serovar Typhi
uaaucgacaacgcguuuau

SEQ ID NO: 3629750 - RNA, 16 nt, Salmonella enterica enterica serovar Typhi
uaaucgauaagccagc

SEQ ID NO: 3629751 - RNA, 19 nt, Salmonella enterica enterica serovar Typhi
uaaucgauaagccagcgau

SEQ ID NO: 3629752 - RNA, 15 nt, Salmonella enterica enterica serovar Typhi
uaaucgauacuaaaa

SEQ ID NO: 3629753 - RNA, 17 nt, Salmonella enterica enterica serovar Typhi
uaaucgauauaauuuua

SEQ ID NO: 3629754 - RNA, 18 nt, Salmonella enterica enterica serovar Typhi
uaaucgccagcagcgcga

SEQ ID NO: 3629755 - RNA, 21 nt, Salmonella enterica enterica serovar Typhi
uaaucgccauugcaauaccgg

SEQ ID NO: 3629756 - RNA, 15 nt, Salmonella enterica enterica serovar Typhi
uaaucgccugccagc

SEQ ID NO: 3629757 - RNA, 18 nt, Salmonella enterica enterica serovar Typhi
uaaucgcgagaaaauaga

SEQ ID NO: 3629758 - RNA, 21 nt, Salmonella enterica enterica serovar Typhi
uaaucgcgauacugccgccca

SEQ ID NO: 3629759 - RNA, 15 nt, Salmonella enterica enterica serovar Typhi
uaaucgcuucaauca

SEQ ID NO: 3629760 - RNA, 21 nt, Salmonella enterica enterica serovar Typhi
uaaucggccaggauggcccgg

SEQ ID NO: 3629761 - RNA, 22 nt, Salmonella enterica enterica serovar Typhi
uaaucguauucauugccguaaa

SEQ ID NO: 3629762 - RNA, 23 nt, Salmonella enterica enterica serovar Typhi
uaaucguuagcgagguucccgcc

SEQ ID NO: 3629763 - RNA, 14 nt, Salmonella enterica enterica serovar Typhi
uaaucuaaaauuau

SEQ ID NO: 3629764 - RNA, 16 nt, Salmonella enterica enterica serovar Typhi
uaaucuaaaauuauuu

SEQ ID NO: 3629765 - RNA, 18 nt, Salmonella enterica enterica serovar Typhi
uaaucuaaaauuauuuuu

SEQ ID NO: 3629766 - RNA, 17 nt, Salmonella enterica enterica serovar Typhi
uaaucucaaacuuggcc

SEQ ID NO: 3629767 - RNA, 14 nt, Salmonella enterica enterica serovar Typhi
uaaucuggccuacg

SEQ ID NO: 3629768 - RNA, 11 nt, Salmonella enterica enterica serovar Typhi
uaaucuuccac

SEQ ID NO: 3629769 - RNA, 17 nt, Salmonella enterica enterica serovar Typhi
uaaugaacaccagcaac

SEQ ID NO: 3629770 - RNA, 16 nt, Salmonella enterica enterica serovar Typhi
uaaugaagcauaaaaa

SEQ ID NO: 3629771 - RNA, 13 nt, Salmonella enterica enterica serovar Typhi
uaaugaauuuaau

SEQ ID NO: 3629772 - RNA, 15 nt, Salmonella enterica enterica serovar Typhi
uaaugaauuuaauau

SEQ ID NO: 3629773 - RNA, 16 nt, Salmonella enterica enterica serovar Typhi
uaaugacgauaaauaa

SEQ ID NO: 3629774 - RNA, 17 nt, Salmonella enterica enterica serovar Typhi
uaaugacgauaaauaag

SEQ ID NO: 3629775 - RNA, 19 nt, Salmonella enterica enterica serovar Typhi
uaaugacgauaaauaagag

SEQ ID NO: 3629776 - RNA, 18 nt, Salmonella enterica enterica serovar Typhi
uaaugacuuuuaaagacu

SEQ ID NO: 3629777 - RNA, 22 nt, Salmonella enterica enterica serovar Typhi
uaaugagcacuuuccacaucgg

SEQ ID NO: 3629778 - RNA, 23 nt, Salmonella enterica enterica serovar Typhi
uaaugagccagauggauaaccug

SEQ ID NO: 3629779 - RNA, 21 nt, Salmonella enterica enterica serovar Typhi
uaaugaucagcaaaauagugu

SEQ ID NO: 3629780 - RNA, 16 nt, Salmonella enterica enterica serovar Typhi
uaaugauccacaccgg

SEQ ID NO: 3629781 - RNA, 23 nt, Salmonella enterica enterica serovar Typhi
uaaugauuaucuuuuuuagucuc

SEQ ID NO: 3629782 - RNA, 22 nt, Salmonella enterica enterica serovar Typhi
uaaugauucuguguuuuuucgu

SEQ ID NO: 3629783 - RNA, 17 nt, Salmonella enterica enterica serovar Typhi
uaaugcaauaaacuaag

SEQ ID NO: 3629784 - RNA, 18 nt, Salmonella enterica enterica serovar Typhi
uaaugcacaauacgccga

SEQ ID NO: 3629785 - RNA, 14 nt, Salmonella enterica enterica serovar Typhi
uaaugccaucauca

SEQ ID NO: 3629786 - RNA, 22 nt, Salmonella enterica enterica serovar Typhi
uaaugcccggcccgucaucuuc

SEQ ID NO: 3629787 - RNA, 19 nt, Salmonella enterica enterica serovar Typhi
uaaugccgacccaccugac

SEQ ID NO: 3629788 - RNA, 20 nt, Salmonella enterica enterica serovar Typhi
uaaugccgccguacaaaccc

SEQ ID NO: 3629789 - RNA, 18 nt, Salmonella enterica enterica serovar Typhi
uaaugccuaucuugauau

SEQ ID NO: 3629790 - RNA, 17 nt, Salmonella enterica enterica serovar Typhi
uaaugccuguguaucgc

SEQ ID NO: 3629791 - RNA, 18 nt, Salmonella enterica enterica serovar Typhi
uaaugcgccaggcagcac

SEQ ID NO: 3629792 - RNA, 22 nt, Salmonella enterica enterica serovar Typhi
uaaugcgccccggcggcguaca

SEQ ID NO: 3629793 - RNA, 21 nt, Salmonella enterica enterica serovar Typhi
uaaugcgcguugccgccaaca

SEQ ID NO: 3629794 - RNA, 16 nt, Salmonella enterica enterica serovar Typhi
uaaugcuaucccaggc

SEQ ID NO: 3629795 - RNA, 16 nt, Salmonella enterica enterica serovar Typhi
uaaugcuuuccagcca

SEQ ID NO: 3629796 - RNA, 21 nt, Salmonella enterica enterica serovar Typhi
uaauggauucucgcgccgggg

SEQ ID NO: 3629797 - RNA, 15 nt, Salmonella enterica enterica serovar Typhi
uaauggcaauaauac

SEQ ID NO: 3629798 - RNA, 18 nt, Salmonella enterica enterica serovar Typhi
uaauggcauaacgcugua

SEQ ID NO: 3629799 - RNA, 12 nt, Salmonella enterica enterica serovar Typhi
uaauggccuaca

SEQ ID NO: 3629800 - RNA, 22 nt, Salmonella enterica enterica serovar Typhi
uaauggcgaagcccgccuccac

SEQ ID NO: 3629801 - RNA, 18 nt, Salmonella enterica enterica serovar Typhi
uaauggcgcgaaaacagc

SEQ ID NO: 3629802 - RNA, 17 nt, Salmonella enterica enterica serovar Typhi
uaauggcuuucaccguc

SEQ ID NO: 3629803 - RNA, 18 nt, Salmonella enterica enterica serovar Typhi
uaaugguggcaaccugac

SEQ ID NO: 3629804 - RNA, 20 nt, Salmonella enterica enterica serovar Typhi
uaaugguugugccaguaauc

SEQ ID NO: 3629805 - RNA, 17 nt, Salmonella enterica enterica serovar Typhi
uaauguaaaaaaauaaa

SEQ ID NO: 3629806 - RNA, 18 nt, Salmonella enterica enterica serovar Typhi
uaauguaaaaaaauaaaa

SEQ ID NO: 3629807 - RNA, 16 nt, Salmonella enterica enterica serovar Typhi
uaauguaaaacaagag

SEQ ID NO: 3629808 - RNA, 18 nt, Salmonella enterica enterica serovar Typhi
uaauguaaaacaagagaa

SEQ ID NO: 3629809 - RNA, 19 nt, Salmonella enterica enterica serovar Typhi
uaauguaaaggugagcucu

SEQ ID NO: 3629810 - RNA, 13 nt, Salmonella enterica enterica serovar Typhi
uaaugucaucauc

SEQ ID NO: 3629811 - RNA, 13 nt, Salmonella enterica enterica serovar Typhi
uacaccagacgau

SEQ ID NO: 3629812 - RNA, 18 nt, Salmonella enterica enterica serovar Typhi
uacaccccuucuggagaa

SEQ ID NO: 3629813 - RNA, 14 nt, Salmonella enterica enterica serovar Typhi
uacaccgccauaua

SEQ ID NO: 3629814 - RNA, 22 nt, Salmonella enterica enterica serovar Typhi
uacaccgccuagcgucccggca

SEQ ID NO: 3629815 - RNA, 18 nt, Salmonella enterica enterica serovar Typhi
uacaccuucacauuggca

SEQ ID NO: 3629816 - RNA, 12 nt, Salmonella enterica enterica serovar Typhi
uacaccuuugcc

SEQ ID NO: 3629817 - RNA, 15 nt, Salmonella enterica enterica serovar Typhi
uacacgccuuccucc

SEQ ID NO: 3629818 - RNA, 17 nt, Salmonella enterica enterica serovar Typhi
uacacgccuuccuccag

SEQ ID NO: 3629819 - RNA, 16 nt, Salmonella enterica enterica serovar Typhi
uacacgcgaauagcca

SEQ ID NO: 3629820 - RNA, 20 nt, Salmonella enterica enterica serovar Typhi
uacacgcgaauagccagaca

SEQ ID NO: 3629821 - RNA, 20 nt, Salmonella enterica enterica serovar Typhi
uacacguauaaacgccgccg

SEQ ID NO: 3629822 - RNA, 21 nt, Salmonella enterica enterica serovar Typhi
uacagaauccggcgcucauca

SEQ ID NO: 3629823 - RNA, 22 nt, Salmonella enterica enterica serovar Typhi
uacagacaucaucgaacgccgc

SEQ ID NO: 3629824 - RNA, 13 nt, Salmonella enterica enterica serovar Typhi
uacagaugcugua

SEQ ID NO: 3629825 - RNA, 17 nt, Salmonella enterica enterica serovar Typhi
uacagcaauaaaaggaa

SEQ ID NO: 3629826 - RNA, 19 nt, Salmonella enterica enterica serovar Typhi
uacagcacgacguagccca

SEQ ID NO: 3629827 - RNA, 13 nt, Salmonella enterica enterica serovar Typhi
uacagcacgccgg

SEQ ID NO: 3629828 - RNA, 15 nt, Salmonella enterica enterica serovar Typhi
uacagcacuucccgc

SEQ ID NO: 3629829 - RNA, 13 nt, Salmonella enterica enterica serovar Typhi
uacagccaccaug

SEQ ID NO: 3629830 - RNA, 19 nt, Salmonella enterica enterica serovar Typhi
uacagccagguugccagaa

SEQ ID NO: 3629831 - RNA, 20 nt, Salmonella enterica enterica serovar Typhi
uacagcccgccagcaccagg

SEQ ID NO: 3629832 - RNA, 21 nt, Salmonella enterica enterica serovar Typhi
uacagccgacuauuccgcaaa

SEQ ID NO: 3629833 - RNA, 16 nt, Salmonella enterica enterica serovar Typhi
uacagccgcgaugcua

SEQ ID NO: 3629834 - RNA, 18 nt, Salmonella enterica enterica serovar Typhi
uacagccugcgugaaucc

SEQ ID NO: 3629835 - RNA, 19 nt, Salmonella enterica enterica serovar Typhi
uacagcgucgacagccccc

SEQ ID NO: 3629836 - RNA, 19 nt, Salmonella enterica enterica serovar Typhi
uacagcguuaacgacgcuc

SEQ ID NO: 3629837 - RNA, 19 nt, Salmonella enterica enterica serovar Typhi
uacagcuuaaucaccagcg

SEQ ID NO: 3629838 - RNA, 18 nt, Salmonella enterica enterica serovar Typhi
uacaggaauuccaguccu

SEQ ID NO: 3629839 - RNA, 22 nt, Salmonella enterica enterica serovar Typhi
uacaggacaagcagugcuggca

SEQ ID NO: 3629840 - RNA, 14 nt, Salmonella enterica enterica serovar Typhi
uacaggacagaugu

SEQ ID NO: 3629841 - RNA, 21 nt, Salmonella enterica enterica serovar Typhi
uacaggauauacuucaucagg

SEQ ID NO: 3629842 - RNA, 17 nt, Salmonella enterica enterica serovar Typhi
uacaggccgauauauug

SEQ ID NO: 3629843 - RNA, 14 nt, Salmonella enterica enterica serovar Typhi
uacaggcgcagggc

SEQ ID NO: 3629844 - RNA, 17 nt, Salmonella enterica enterica serovar Typhi
uacaggcgcaucagaaa

SEQ ID NO: 3629845 - RNA, 19 nt, Salmonella enterica enterica serovar Typhi
uacaggcgcaucagaaaaa

SEQ ID NO: 3629846 - RNA, 16 nt, Salmonella enterica enterica serovar Typhi
uacaggcggaaaucaa

SEQ ID NO: 3629847 - RNA, 18 nt, Salmonella enterica enterica serovar Typhi
uacaggcgguaagcgucg

SEQ ID NO: 3629848 - RNA, 18 nt, Salmonella enterica enterica serovar Typhi
uacaggggauuguuaacg

SEQ ID NO: 3629849 - RNA, 22 nt, Salmonella enterica enterica serovar Typhi
uacagguugugcaucuccugac

SEQ ID NO: 3629850 - RNA, 13 nt, Salmonella enterica enterica serovar Typhi
uacaguagcaggg

SEQ ID NO: 3629851 - RNA, 16 nt, Salmonella enterica enterica serovar Typhi
uacaguaguuuucauc

SEQ ID NO: 3629852 - RNA, 14 nt, Salmonella enterica enterica serovar Typhi
uacaguggaaagua

SEQ ID NO: 3629853 - RNA, 19 nt, Salmonella enterica enterica serovar Typhi
uacaguguaaaaauuuuug

SEQ ID NO: 3629854 - RNA, 18 nt, Salmonella enterica enterica serovar Typhi
uacaguuaccacacaugc

SEQ ID NO: 3629855 - RNA, 16 nt, Salmonella enterica enterica serovar Typhi
uacaguuugucaucag

SEQ ID NO: 3629856 - RNA, 20 nt, Salmonella enterica enterica serovar Typhi
uacauaccccgcauuuaaca

SEQ ID NO: 3629857 - RNA, 16 nt, Salmonella enterica enterica serovar Typhi
uacauagaaaauauau

SEQ ID NO: 3629858 - RNA, 21 nt, Salmonella enterica enterica serovar Typhi
uacauagaaaauauaugacaa

SEQ ID NO: 3629859 - RNA, 22 nt, Salmonella enterica enterica serovar Typhi
uacauaguucuggcuuugcgcc

SEQ ID NO: 3629860 - RNA, 15 nt, Salmonella enterica enterica serovar Typhi
uacauaucuauauuu

SEQ ID NO: 3629861 - RNA, 18 nt, Salmonella enterica enterica serovar Typhi
uacauauuguuuucuauu

SEQ ID NO: 3629862 - RNA, 16 nt, Salmonella enterica enterica serovar Typhi
uacaucagaaaacagc

SEQ ID NO: 3629863 - RNA, 15 nt, Salmonella enterica enterica serovar Typhi
uacaucagaguaauu

SEQ ID NO: 3629864 - RNA, 21 nt, Salmonella enterica enterica serovar Typhi
uacauccagaaggcaaaaugc

SEQ ID NO: 3629865 - RNA, 18 nt, Salmonella enterica enterica serovar Typhi
uacauccaucacuccuua

SEQ ID NO: 3629866 - RNA, 16 nt, Salmonella enterica enterica serovar Typhi
uacauccaugccaucc

SEQ ID NO: 3629867 - RNA, 18 nt, Salmonella enterica enterica serovar Typhi
uacauccaugccauccag

SEQ ID NO: 3629868 - RNA, 18 nt, Salmonella enterica enterica serovar Typhi
uacaucuacuucagcacg

SEQ ID NO: 3629869 - RNA, 18 nt, Salmonella enterica enterica serovar Typhi
uacaucuuccauuuuggu

SEQ ID NO: 3629870 - RNA, 12 nt, Salmonella enterica enterica serovar Typhi
uacaugaauaau

SEQ ID NO: 3629871 - RNA, 15 nt, Salmonella enterica enterica serovar Typhi
uacaugaauaauaau

SEQ ID NO: 3629872 - RNA, 12 nt, Salmonella enterica enterica serovar Typhi
uacaugacgcuc

SEQ ID NO: 3629873 - RNA, 16 nt, Salmonella enterica enterica serovar Typhi
uacaugaggauuuuga

SEQ ID NO: 3629874 - RNA, 16 nt, Salmonella enterica enterica serovar Typhi
uacaugcccgucuggg

SEQ ID NO: 3629875 - RNA, 15 nt, Salmonella enterica enterica serovar Typhi
uacaugcuacaggca

SEQ ID NO: 3629876 - RNA, 17 nt, Salmonella enterica enterica serovar Typhi
uacauuauugcacauaa

SEQ ID NO: 3629877 - RNA, 18 nt, Salmonella enterica enterica serovar Typhi
uacauucuguuugucuuu

SEQ ID NO: 3629878 - RNA, 14 nt, Salmonella enterica enterica serovar Typhi
uacauucuguuuuc

SEQ ID NO: 3629879 - RNA, 14 nt, Salmonella enterica enterica serovar Typhi
uacauugccggaug

SEQ ID NO: 3629880 - RNA, 20 nt, Salmonella enterica enterica serovar Typhi
uacauugggucguaauauuc

SEQ ID NO: 3629881 - RNA, 22 nt, Salmonella enterica enterica serovar Typhi
uacauuucacccuauaagcugc

SEQ ID NO: 3629882 - RNA, 24 nt, Salmonella enterica enterica serovar Typhi
uacauuuucguaaaauauauauuu

SEQ ID NO: 3629883 - RNA, 22 nt, Salmonella enterica enterica serovar Typhi
uacauuuuguauucgcagggcu

SEQ ID NO: 3629884 - RNA, 21 nt, Salmonella enterica enterica serovar Typhi
uacauuuuuacaguuaccaca

SEQ ID NO: 3629885 - RNA, 19 nt, Salmonella enterica enterica serovar Typhi
uaccaaacccuuuggcaaa

SEQ ID NO: 3629886 - RNA, 20 nt, Salmonella enterica enterica serovar Typhi
uaccaaauauuucuuugucg

SEQ ID NO: 3629887 - RNA, 21 nt, Salmonella enterica enterica serovar Typhi
uaccaauaagaacuuuaucac

SEQ ID NO: 3629888 - RNA, 15 nt, Salmonella enterica enterica serovar Typhi
uaccaauacccagcg

SEQ ID NO: 3629889 - RNA, 18 nt, Salmonella enterica enterica serovar Typhi
uaccaauacccagcgcca

SEQ ID NO: 3629890 - RNA, 18 nt, Salmonella enterica enterica serovar Typhi
uaccacacaugcaaaaaa

SEQ ID NO: 3629891 - RNA, 16 nt, Salmonella enterica enterica serovar Typhi
uaccacagaaaucgcc

SEQ ID NO: 3629892 - RNA, 11 nt, Salmonella enterica enterica serovar Typhi
uaccacaucag

SEQ ID NO: 3629893 - RNA, 19 nt, Salmonella enterica enterica serovar Typhi
uaccacccgcuaugaagac

SEQ ID NO: 3629894 - RNA, 16 nt, Salmonella enterica enterica serovar Typhi
uaccaccugccaaagc

SEQ ID NO: 3629895 - RNA, 15 nt, Salmonella enterica enterica serovar Typhi
uaccaccuuaucgag

SEQ ID NO: 3629896 - RNA, 19 nt, Salmonella enterica enterica serovar Typhi
uaccacgcacaugggcguc

SEQ ID NO: 3629897 - RNA, 12 nt, Salmonella enterica enterica serovar Typhi
uaccggcaacgc

SEQ ID NO: 3629898 - RNA, 17 nt, Salmonella enterica enterica serovar Typhi
uaccggcaacgccgggg

SEQ ID NO: 3629899 - RNA, 14 nt, Salmonella enterica enterica serovar Typhi
uaccggcaccagca

SEQ ID NO: 3629900 - RNA, 17 nt, Salmonella enterica enterica serovar Typhi
uaccggcaccagcaaug

SEQ ID NO: 3629901 - RNA, 16 nt, Salmonella enterica enterica serovar Typhi
uaccggcauuacccag

SEQ ID NO: 3629902 - RNA, 18 nt, Salmonella enterica enterica serovar Typhi
uaccggcgaaauagcguu

SEQ ID NO: 3629903 - RNA, 22 nt, Salmonella enterica enterica serovar Typhi
uaccggcuaucagccgccggug

SEQ ID NO: 3629904 - RNA, 15 nt, Salmonella enterica enterica serovar Typhi
uaccguaaaaugcug

SEQ ID NO: 3629905 - RNA, 19 nt, Salmonella enterica enterica serovar Typhi
uaccguaaauuuguuuauc

SEQ ID NO: 3629906 - RNA, 15 nt, Salmonella enterica enterica serovar Typhi
uaccguaaccgcagc

SEQ ID NO: 3629907 - RNA, 19 nt, Salmonella enterica enterica serovar Typhi
uaccguaagcuuucugaau

SEQ ID NO: 3629908 - RNA, 18 nt, Salmonella enterica enterica serovar Typhi
uaccguaggccggauaag

SEQ ID NO: 3629909 - RNA, 21 nt, Salmonella enterica enterica serovar Typhi
uaccguauugccagaucuguu

SEQ ID NO: 3629910 - RNA, 20 nt, Salmonella enterica enterica serovar Typhi
uaccgucagauucugcggua

SEQ ID NO: 3629911 - RNA, 17 nt, Salmonella enterica enterica serovar Typhi
uaccgucgccgacaacg

SEQ ID NO: 3629912 - RNA, 21 nt, Salmonella enterica enterica serovar Typhi
uaccgugcaaaaucacgcggc

SEQ ID NO: 3629913 - RNA, 20 nt, Salmonella enterica enterica serovar Typhi
uaccgugugcagugacagag

SEQ ID NO: 3629914 - RNA, 22 nt, Salmonella enterica enterica serovar Typhi
uaccguuucaacugccccuugu

SEQ ID NO: 3629915 - RNA, 15 nt, Salmonella enterica enterica serovar Typhi
uaccguuuuccaguc

SEQ ID NO: 3629916 - RNA, 18 nt, Salmonella enterica enterica serovar Typhi
uaccuacgcgauaaaaaa

SEQ ID NO: 3629917 - RNA, 20 nt, Salmonella enterica enterica serovar Typhi
uaccuauuuguuccggcaag

SEQ ID NO: 3629918 - RNA, 21 nt, Salmonella enterica enterica serovar Typhi
uaccucaaaaaccaguugcca

SEQ ID NO: 3629919 - RNA, 14 nt, Salmonella enterica enterica serovar Typhi
uaccuccuggcguu

SEQ ID NO: 3629920 - RNA, 13 nt, Salmonella enterica enterica serovar Typhi
uaccucgccgacg

SEQ ID NO: 3629921 - RNA, 17 nt, Salmonella enterica enterica serovar Typhi
uaccucgcgcuuauccg

SEQ ID NO: 3629922 - RNA, 24 nt, Salmonella enterica enterica serovar Typhi
uaccugaagccauccucacgcaac

SEQ ID NO: 3629923 - RNA, 19 nt, Salmonella enterica enterica serovar Typhi
uaccugauccagcucuucu

SEQ ID NO: 3629924 - RNA, 22 nt, Salmonella enterica enterica serovar Typhi
uaccugauccagcucuucuucg

SEQ ID NO: 3629925 - RNA, 12 nt, Salmonella enterica enterica serovar Typhi
uaccugaugagc

SEQ ID NO: 3629926 - RNA, 17 nt, Salmonella enterica enterica serovar Typhi
uaccugaugagcaggcc

SEQ ID NO: 3629927 - RNA, 18 nt, Salmonella enterica enterica serovar Typhi
uaccugaugagcaggcca

SEQ ID NO: 3629928 - RNA, 18 nt, Salmonella enterica enterica serovar Typhi
uaccugaugucauucuuu

SEQ ID NO: 3629929 - RNA, 21 nt, Salmonella enterica enterica serovar Typhi
uaccugcaaaaacgccagacc

SEQ ID NO: 3629930 - RNA, 22 nt, Salmonella enterica enterica serovar Typhi
uaccugcacuuuaagcggcagc

SEQ ID NO: 3629931 - RNA, 18 nt, Salmonella enterica enterica serovar Typhi
uaccugcgcaaucaugac

SEQ ID NO: 3629932 - RNA, 13 nt, Salmonella enterica enterica serovar Typhi
uaccuguauuaug

SEQ ID NO: 3629933 - RNA, 19 nt, Salmonella enterica enterica serovar Typhi
uaccugucguacgccuaaa

SEQ ID NO: 3629934 - RNA, 22 nt, Salmonella enterica enterica serovar Typhi
uaccuuacggacugcggccugc

SEQ ID NO: 3629935 - RNA, 21 nt, Salmonella enterica enterica serovar Typhi
uaccuucgcguuuaucaccaa

SEQ ID NO: 3629936 - RNA, 16 nt, Salmonella enterica enterica serovar Typhi
uaccuucuauuuuucc

SEQ ID NO: 3629937 - RNA, 13 nt, Salmonella enterica enterica serovar Typhi
uaccuucugccgc

SEQ ID NO: 3629938 - RNA, 22 nt, Salmonella enterica enterica serovar Typhi
uaccuugucggguggcgcuagc

SEQ ID NO: 3629939 - RNA, 23 nt, Salmonella enterica enterica serovar Typhi
uacgaaccugauuguuuuaccca

SEQ ID NO: 3629940 - RNA, 20 nt, Salmonella enterica enterica serovar Typhi
uacgaauuuuaucuuccggc

SEQ ID NO: 3629941 - RNA, 19 nt, Salmonella enterica enterica serovar Typhi
uacgacacccgauacacgc

SEQ ID NO: 3629942 - RNA, 20 nt, Salmonella enterica enterica serovar Typhi
uacgacacccgauacacgcc

SEQ ID NO: 3629943 - RNA, 16 nt, Salmonella enterica enterica serovar Typhi
uacgaccgcagaaaca

SEQ ID NO: 3629944 - RNA, 17 nt, Salmonella enterica enterica serovar Typhi
uacgaccggucagccgg

SEQ ID NO: 3629945 - RNA, 17 nt, Salmonella enterica enterica serovar Typhi
uacgacgcgccaccauc

SEQ ID NO: 3629946 - RNA, 18 nt, Salmonella enterica enterica serovar Typhi
uacgagaaccaacugcca

SEQ ID NO: 3629947 - RNA, 19 nt, Salmonella enterica enterica serovar Typhi
uacgagcauccagaucggc

SEQ ID NO: 3629948 - RNA, 16 nt, Salmonella enterica enterica serovar Typhi
uacgagugacauuauu

SEQ ID NO: 3629949 - RNA, 19 nt, Salmonella enterica enterica serovar Typhi
uacgagugacauuauucac

SEQ ID NO: 3629950 - RNA, 19 nt, Salmonella enterica enterica serovar Typhi
uacgagugcguucuuccac

SEQ ID NO: 3629951 - RNA, 18 nt, Salmonella enterica enterica serovar Typhi
uacgauagcaauuaauaa

SEQ ID NO: 3629952 - RNA, 16 nt, Salmonella enterica enterica serovar Typhi
uacgaucgccaccgca

SEQ ID NO: 3629953 - RNA, 16 nt, Salmonella enterica enterica serovar Typhi
uacgcaaaaaaagcca

SEQ ID NO: 3629954 - RNA, 16 nt, Salmonella enterica enterica serovar Typhi
uacgcaaaucaccguc

SEQ ID NO: 3629955 - RNA, 21 nt, Salmonella enterica enterica serovar Typhi
uacgcaccagcucuacaucgc

SEQ ID NO: 3629956 - RNA, 17 nt, Salmonella enterica enterica serovar Typhi
uacgcacgccagauaaa

SEQ ID NO: 3629957 - RNA, 23 nt, Salmonella enterica enterica serovar Typhi
uacgcagauaacuuccuuugccu

SEQ ID NO: 3629958 - RNA, 16 nt, Salmonella enterica enterica serovar Typhi
uacgcagcaggcagac

SEQ ID NO: 3629959 - RNA, 18 nt, Salmonella enterica enterica serovar Typhi
uacgcagcgccuucgcuu

SEQ ID NO: 3629960 - RNA, 22 nt, Salmonella enterica enterica serovar Typhi
uacgcauaaugcgccccgcaac

SEQ ID NO: 3629961 - RNA, 13 nt, Salmonella enterica enterica serovar Typhi
uacgcaucaccag

SEQ ID NO: 3629962 - RNA, 14 nt, Salmonella enterica enterica serovar Typhi
uacgcaucaccagg

SEQ ID NO: 3629963 - RNA, 18 nt, Salmonella enterica enterica serovar Typhi
uacgcaucaccaggcaau

SEQ ID NO: 3629964 - RNA, 18 nt, Salmonella enterica enterica serovar Typhi
uacgccaaugaacucgcc

SEQ ID NO: 3629965 - RNA, 20 nt, Salmonella enterica enterica serovar Typhi
uacgccacggcaauuuacaa

SEQ ID NO: 3629966 - RNA, 16 nt, Salmonella enterica enterica serovar Typhi
uacgccagacagcauu

SEQ ID NO: 3629967 - RNA, 16 nt, Salmonella enterica enterica serovar Typhi
uacgccagcagacagg

SEQ ID NO: 3629968 - RNA, 15 nt, Salmonella enterica enterica serovar Typhi
uacgccagccuaucg

SEQ ID NO: 3629969 - RNA, 16 nt, Salmonella enterica enterica serovar Typhi
uacgccaucaggcaug

SEQ ID NO: 3629970 - RNA, 22 nt, Salmonella enterica enterica serovar Typhi
uacgccaucaggcauggcagca

SEQ ID NO: 3629971 - RNA, 14 nt, Salmonella enterica enterica serovar Typhi
uacgcccacgcggc

SEQ ID NO: 3629972 - RNA, 22 nt, Salmonella enterica enterica serovar Typhi
uacgcccagccgugaaugguca

SEQ ID NO: 3629973 - RNA, 20 nt, Salmonella enterica enterica serovar Typhi
uacgcccaucagcccgcaaa

SEQ ID NO: 3629974 - RNA, 14 nt, Salmonella enterica enterica serovar Typhi
uacgccccugcugg

SEQ ID NO: 3629975 - RNA, 13 nt, Salmonella enterica enterica serovar Typhi
uacgccgccgccc

SEQ ID NO: 3629976 - RNA, 19 nt, Salmonella enterica enterica serovar Typhi
uacgccguccggcgaacaa

SEQ ID NO: 3629977 - RNA, 13 nt, Salmonella enterica enterica serovar Typhi
uacgccugucgca

SEQ ID NO: 3629978 - RNA, 15 nt, Salmonella enterica enterica serovar Typhi
uacgccugucgcaac

SEQ ID NO: 3629979 - RNA, 12 nt, Salmonella enterica enterica serovar Typhi
uacgccuuaucc

SEQ ID NO: 3629980 - RNA, 16 nt, Salmonella enterica enterica serovar Typhi
uacgccuuauccggcc

SEQ ID NO: 3629981 - RNA, 21 nt, Salmonella enterica enterica serovar Typhi
uacgcgaugagauaauaaaug

SEQ ID NO: 3629982 - RNA, 15 nt, Salmonella enterica enterica serovar Typhi
uacucuuccugcugc

SEQ ID NO: 3629983 - RNA, 19 nt, Salmonella enterica enterica serovar Typhi
uacucuuggagagcaucau

SEQ ID NO: 3629984 - RNA, 21 nt, Salmonella enterica enterica serovar Typhi
uacucuuggagagcaucaucu

SEQ ID NO: 3629985 - RNA, 19 nt, Salmonella enterica enterica serovar Typhi
uacucuuugaacagccaga

SEQ ID NO: 3629986 - RNA, 13 nt, Salmonella enterica enterica serovar Typhi
uacucuuuuuccg

SEQ ID NO: 3629987 - RNA, 23 nt, Salmonella enterica enterica serovar Typhi
uacugaacaagcgaucgccagcu

SEQ ID NO: 3629988 - RNA, 19 nt, Salmonella enterica enterica serovar Typhi
uacugaauaacagcaccau

SEQ ID NO: 3629989 - RNA, 16 nt, Salmonella enterica enterica serovar Typhi
uacugaccggcccguu

SEQ ID NO: 3629990 - RNA, 17 nt, Salmonella enterica enterica serovar Typhi
uacugagcgccucugau

SEQ ID NO: 3629991 - RNA, 18 nt, Salmonella enterica enterica serovar Typhi
uacugauaaaggauaaua

SEQ ID NO: 3629992 - RNA, 14 nt, Salmonella enterica enterica serovar Typhi
uacugauauugcaa

SEQ ID NO: 3629993 - RNA, 17 nt, Salmonella enterica enterica serovar Typhi
uacugcaacgccagaug

SEQ ID NO: 3629994 - RNA, 20 nt, Salmonella enterica enterica serovar Typhi
uacugcaacgccagaugcgu

SEQ ID NO: 3629995 - RNA, 15 nt, Salmonella enterica enterica serovar Typhi
uacugcauuuucaau

SEQ ID NO: 3629996 - RNA, 15 nt, Salmonella enterica enterica serovar Typhi
uacugccaaccauua

SEQ ID NO: 3629997 - RNA, 22 nt, Salmonella enterica enterica serovar Typhi
uacugccgcccaucgccacagc

SEQ ID NO: 3629998 - RNA, 20 nt, Salmonella enterica enterica serovar Typhi
uacugccgccgugggauugc

SEQ ID NO: 3629999 - RNA, 21 nt, Salmonella enterica enterica serovar Typhi
uacugcgcucuaucaccgccc

SEQ ID NO: 3630000 - RNA, 21 nt, Salmonella enterica enterica serovar Typhi
uacugcggguguccguuccug

SEQ ID NO: 3630001 - RNA, 13 nt, Salmonella enterica enterica serovar Typhi
uacugcuauuagc

SEQ ID NO: 3630002 - RNA, 18 nt, Salmonella enterica enterica serovar Typhi
uacugcuguccgccagca

SEQ ID NO: 3630003 - RNA, 14 nt, Salmonella enterica enterica serovar Typhi
uacuggaaaaaacg

SEQ ID NO: 3630004 - RNA, 17 nt, Salmonella enterica enterica serovar Typhi
uacuggagcucgcgaug

SEQ ID NO: 3630005 - RNA, 19 nt, Salmonella enterica enterica serovar Typhi
uacuggauaaccgcuucga

SEQ ID NO: 3630006 - RNA, 17 nt, Salmonella enterica enterica serovar Typhi
uacuggaucgcuccauu

SEQ ID NO: 3630007 - RNA, 23 nt, Salmonella enterica enterica serovar Typhi
uacuggccacggagugcgcggcg

SEQ ID NO: 3630008 - RNA, 15 nt, Salmonella enterica enterica serovar Typhi
uacuggcgauuuuca

SEQ ID NO: 3630009 - RNA, 22 nt, Salmonella enterica enterica serovar Typhi
uacuggcgauuuucauagcugg

SEQ ID NO: 3630010 - RNA, 15 nt, Salmonella enterica enterica serovar Typhi
uacuggcuaucuuua

SEQ ID NO: 3630011 - RNA, 22 nt, Salmonella enterica enterica serovar Typhi
uacuggcuaucuuuaugucagu

SEQ ID NO: 3630012 - RNA, 21 nt, Salmonella enterica enterica serovar Typhi
uacugucgcgcggcgucccua

SEQ ID NO: 3630013 - RNA, 19 nt, Salmonella enterica enterica serovar Typhi
uacugucuuguggaacacc

SEQ ID NO: 3630014 - RNA, 16 nt, Salmonella enterica enterica serovar Typhi
uacugugcccagagcg

SEQ ID NO: 3630015 - RNA, 21 nt, Salmonella enterica enterica serovar Typhi
uacugugggccguuccgcaac

SEQ ID NO: 3630016 - RNA, 17 nt, Salmonella enterica enterica serovar Typhi
uacuguggugugccugc

SEQ ID NO: 3630017 - RNA, 20 nt, Salmonella enterica enterica serovar Typhi
uacuguuuuugcuuuaauau

SEQ ID NO: 3630018 - RNA, 22 nt, Salmonella enterica enterica serovar Typhi
uacuguuuuugcuuuaauauuc

SEQ ID NO: 3630019 - RNA, 16 nt, Salmonella enterica enterica serovar Typhi
uacuuaaaauugaauu

SEQ ID NO: 3630020 - RNA, 18 nt, Salmonella enterica enterica serovar Typhi
uacuuaauucugcugccu

SEQ ID NO: 3630021 - RNA, 14 nt, Salmonella enterica enterica serovar Typhi
uacuuauauuuauu

SEQ ID NO: 3630022 - RNA, 15 nt, Salmonella enterica enterica serovar Typhi
uacuuauauuuauuu

SEQ ID NO: 3630023 - RNA, 15 nt, Salmonella enterica enterica serovar Typhi
uacuucaggcugcca

SEQ ID NO: 3630024 - RNA, 17 nt, Salmonella enterica enterica serovar Typhi
uacuucgcuuuguuuuc

SEQ ID NO: 3630025 - RNA, 19 nt, Salmonella enterica enterica serovar Typhi
uacuucguagacucaggcg

SEQ ID NO: 3630026 - RNA, 16 nt, Salmonella enterica enterica serovar Typhi
uacuucugacagugac

SEQ ID NO: 3630027 - RNA, 23 nt, Salmonella enterica enterica serovar Typhi
uacuucuucaguuccgccagacu

SEQ ID NO: 3630028 - RNA, 21 nt, Salmonella enterica enterica serovar Typhi
uacuuucacuaccacuuucuu

SEQ ID NO: 3630029 - RNA, 11 nt, Salmonella enterica enterica serovar Typhi
uacuuuccagc

SEQ ID NO: 3630030 - RNA, 19 nt, Salmonella enterica enterica serovar Typhi
uacuuugcgcccagauaau

SEQ ID NO: 3630031 - RNA, 17 nt, Salmonella enterica enterica serovar Typhi
uacuuuggccuaacagu

SEQ ID NO: 3630032 - RNA, 13 nt, Salmonella enterica enterica serovar Typhi
uacuuuuuuaaau

SEQ ID NO: 3630033 - RNA, 18 nt, Salmonella enterica enterica serovar Typhi
uacuuuuuuaaauguuuu

SEQ ID NO: 3630034 - RNA, 23 nt, Salmonella enterica enterica serovar Typhi
uacuuuuuuaaauguuuuuucau

SEQ ID NO: 3630035 - RNA, 13 nt, Salmonella enterica enterica serovar Typhi
uagaaaaaauuaa

SEQ ID NO: 3630036 - RNA, 14 nt, Salmonella enterica enterica serovar Typhi
uagaaaaaauuaaa

SEQ ID NO: 3630037 - RNA, 16 nt, Salmonella enterica enterica serovar Typhi
uagaaaaaauuaaaaa

SEQ ID NO: 3630038 - RNA, 18 nt, Salmonella enterica enterica serovar Typhi
uagaaaaaauuaaaaaua

SEQ ID NO: 3630039 - RNA, 17 nt, Salmonella enterica enterica serovar Typhi
uagaaaaagguaacuau

SEQ ID NO: 3630040 - RNA, 19 nt, Salmonella enterica enterica serovar Typhi
uagaaaaggucgucaggcc

SEQ ID NO: 3630041 - RNA, 22 nt, Salmonella enterica enterica serovar Typhi
uagaaaauaauucauauuagcu

SEQ ID NO: 3630042 - RNA, 14 nt, Salmonella enterica enterica serovar Typhi
uagaaaauauauug

SEQ ID NO: 3630043 - RNA, 23 nt, Salmonella enterica enterica serovar Typhi
uagaaacucuuuaaagcgcugcg

SEQ ID NO: 3630044 - RNA, 22 nt, Salmonella enterica enterica serovar Typhi
uagaaagauuucaucaggcuga

SEQ ID NO: 3630045 - RNA, 22 nt, Salmonella enterica enterica serovar Typhi
uagaaagucuuuuguuuuucuc

SEQ ID NO: 3630046 - RNA, 22 nt, Salmonella enterica enterica serovar Typhi
uagaaauugcagggugcagcaa

SEQ ID NO: 3630047 - RNA, 14 nt, Salmonella enterica enterica serovar Typhi
uagaaccacuuauu

SEQ ID NO: 3630048 - RNA, 14 nt, Salmonella enterica enterica serovar Typhi
uagaacccaaagcc

SEQ ID NO: 3630049 - RNA, 16 nt, Salmonella enterica enterica serovar Typhi
uagaacggaaguugca

SEQ ID NO: 3630050 - RNA, 16 nt, Salmonella enterica enterica serovar Typhi
uagaagccacaaucug

SEQ ID NO: 3630051 - RNA, 20 nt, Salmonella enterica enterica serovar Typhi
uagaagcucaugugcagcau

SEQ ID NO: 3630052 - RNA, 14 nt, Salmonella enterica enterica serovar Typhi
uagaaguuaugcau

SEQ ID NO: 3630053 - RNA, 15 nt, Salmonella enterica enterica serovar Typhi
uagaauagcgccgug

SEQ ID NO: 3630054 - RNA, 16 nt, Salmonella enterica enterica serovar Typhi
uagaauaggaaauaau

SEQ ID NO: 3630055 - RNA, 18 nt, Salmonella enterica enterica serovar Typhi
uagaaucccaccaauugc

SEQ ID NO: 3630056 - RNA, 13 nt, Salmonella enterica enterica serovar Typhi
uagaaucuauuau

SEQ ID NO: 3630057 - RNA, 18 nt, Salmonella enterica enterica serovar Typhi
uagaaucugguuguuucg

SEQ ID NO: 3630058 - RNA, 15 nt, Salmonella enterica enterica serovar Typhi
uagaaugcuucuucg

SEQ ID NO: 3630059 - RNA, 18 nt, Salmonella enterica enterica serovar Typhi
uagaaugcuucuucgcca

SEQ ID NO: 3630060 - RNA, 17 nt, Salmonella enterica enterica serovar Typhi
uagaauuaucugaaagu

SEQ ID NO: 3630061 - RNA, 14 nt, Salmonella enterica enterica serovar Typhi
uagaauuuucacuu

SEQ ID NO: 3630062 - RNA, 11 nt, Salmonella enterica enterica serovar Typhi
uagacaaacag

SEQ ID NO: 3630063 - RNA, 18 nt, Salmonella enterica enterica serovar Typhi
uagacaacaucccagaaa

SEQ ID NO: 3630064 - RNA, 21 nt, Salmonella enterica enterica serovar Typhi
uagacaacaucccagaaaaug

SEQ ID NO: 3630065 - RNA, 16 nt, Salmonella enterica enterica serovar Typhi
uagacaauugcugcgu

SEQ ID NO: 3630066 - RNA, 19 nt, Salmonella enterica enterica serovar Typhi
aaaacccgcagccggauag

SEQ ID NO: 3630067 - RNA, 16 nt, Salmonella enterica enterica serovar Typhi
aaaaccgagcaacaga

SEQ ID NO: 3630068 - RNA, 16 nt, Salmonella enterica enterica serovar Typhi
aaaaccggcaaauacc

SEQ ID NO: 3630069 - RNA, 20 nt, Salmonella enterica enterica serovar Typhi
aaaaccggccagcgucauca

SEQ ID NO: 3630070 - RNA, 14 nt, Salmonella enterica enterica serovar Typhi
aaaaccguucugag

SEQ ID NO: 3630071 - RNA, 14 nt, Salmonella enterica enterica serovar Typhi
aaaacgaaaaaccc

SEQ ID NO: 3630072 - RNA, 23 nt, Salmonella enterica enterica serovar Typhi
aaaacgcccccugccagcgcuga

SEQ ID NO: 3630073 - RNA, 21 nt, Salmonella enterica enterica serovar Typhi
aaaacgccgccuugcggcggc

SEQ ID NO: 3630074 - RNA, 15 nt, Salmonella enterica enterica serovar Typhi
aaaacgcgcaaaacu

SEQ ID NO: 3630075 - RNA, 19 nt, Salmonella enterica enterica serovar Typhi
aaaacgcgcucgccagcgc

SEQ ID NO: 3630076 - RNA, 22 nt, Salmonella enterica enterica serovar Typhi
aaaacgcgcucgccagcgcugu

SEQ ID NO: 3630077 - RNA, 21 nt, Salmonella enterica enterica serovar Typhi
aaaacgcguuagcguuuugaa

SEQ ID NO: 3630078 - RNA, 21 nt, Salmonella enterica enterica serovar Typhi
aaaacgcucucuuuucuuacu

SEQ ID NO: 3630079 - RNA, 14 nt, Salmonella enterica enterica serovar Typhi
aaaacggaacaccg

SEQ ID NO: 3630080 - RNA, 17 nt, Salmonella enterica enterica serovar Typhi
aaaacggcuaccgucau

SEQ ID NO: 3630081 - RNA, 13 nt, Salmonella enterica enterica serovar Typhi
aaaacgguuuuca

SEQ ID NO: 3630082 - RNA, 22 nt, Salmonella enterica enterica serovar Typhi
aaaacguuauuggcaggaugua

SEQ ID NO: 3630083 - RNA, 15 nt, Salmonella enterica enterica serovar Typhi
aaaacuaauccucuu

SEQ ID NO: 3630084 - RNA, 17 nt, Salmonella enterica enterica serovar Typhi
aaaacuaccguaccagc

SEQ ID NO: 3630085 - RNA, 13 nt, Salmonella enterica enterica serovar Typhi
aaaacuauuucaa

SEQ ID NO: 3630086 - RNA, 17 nt, Salmonella enterica enterica serovar Typhi
aaaacugacuaaaaauc

SEQ ID NO: 3630087 - RNA, 11 nt, Salmonella enterica enterica serovar Typhi
aaaacugcacc

SEQ ID NO: 3630088 - RNA, 15 nt, Salmonella enterica enterica serovar Typhi
aaaacuggaaaacaa

SEQ ID NO: 3630089 - RNA, 22 nt, Salmonella enterica enterica serovar Typhi
aaaacuggaaaacaagugcaga

SEQ ID NO: 3630090 - RNA, 18 nt, Salmonella enterica enterica serovar Typhi
aaaacuggugcaggcggu

SEQ ID NO: 3630091 - RNA, 14 nt, Salmonella enterica enterica serovar Typhi
aaaacuuauuuuau

SEQ ID NO: 3630092 - RNA, 22 nt, Salmonella enterica enterica serovar Typhi
aaaacuuauuuuauuuuuauau

SEQ ID NO: 3630093 - RNA, 19 nt, Salmonella enterica enterica serovar Typhi
aaaacuuuaacacuaacua

SEQ ID NO: 3630094 - RNA, 11 nt, Salmonella enterica enterica serovar Typhi
aaaagaaaaaa

SEQ ID NO: 3630095 - RNA, 20 nt, Salmonella enterica enterica serovar Typhi
aaaagaaaaaacuuauuucu

SEQ ID NO: 3630096 - RNA, 11 nt, Salmonella enterica enterica serovar Typhi
aaaagaaaaca

SEQ ID NO: 3630097 - RNA, 21 nt, Salmonella enterica enterica serovar Typhi
aaaagaauagccggauaaaau

SEQ ID NO: 3630098 - RNA, 23 nt, Salmonella enterica enterica serovar Typhi
aaaagaaugucccaguaauaucg

SEQ ID NO: 3630099 - RNA, 19 nt, Salmonella enterica enterica serovar Typhi
aaaagacgcuuuucagcgu

SEQ ID NO: 3630100 - RNA, 17 nt, Salmonella enterica enterica serovar Typhi
aaaagagcuuauuuuga

SEQ ID NO: 3630101 - RNA, 15 nt, Salmonella enterica enterica serovar Typhi
aaaagaguaaaguua

SEQ ID NO: 3630102 - RNA, 23 nt, Salmonella enterica enterica serovar Typhi
aaaagaguaaaguuauucacgua

SEQ ID NO: 3630103 - RNA, 15 nt, Salmonella enterica enterica serovar Typhi
aaaagauaaaaaaau

SEQ ID NO: 3630104 - RNA, 17 nt, Salmonella enterica enterica serovar Typhi
aaaagauauuauaaaau

SEQ ID NO: 3630105 - RNA, 13 nt, Salmonella enterica enterica serovar Typhi
aaaagcaaagagg

SEQ ID NO: 3630106 - RNA, 13 nt, Salmonella enterica enterica serovar Typhi
aaaagcaauaauc

SEQ ID NO: 3630107 - RNA, 21 nt, Salmonella enterica enterica serovar Typhi
aaaagcacaucagcaaaugaa

SEQ ID NO: 3630108 - RNA, 18 nt, Salmonella enterica enterica serovar Typhi
aaaagccaagcacaaaaa

SEQ ID NO: 3630109 - RNA, 18 nt, Salmonella enterica enterica serovar Typhi
aaaagcccgcccagcauu

SEQ ID NO: 3630110 - RNA, 16 nt, Salmonella enterica enterica serovar Typhi
aaaagccgugaauaaa

SEQ ID NO: 3630111 - RNA, 18 nt, Salmonella enterica enterica serovar Typhi
aaaagccugcacauugca

SEQ ID NO: 3630112 - RNA, 14 nt, Salmonella enterica enterica serovar Typhi
aaaagcgacgcugu

SEQ ID NO: 3630113 - RNA, 15 nt, Salmonella enterica enterica serovar Typhi
aaaagcgcccagcgc

SEQ ID NO: 3630114 - RNA, 15 nt, Salmonella enterica enterica serovar Typhi
aaaagcgccccuggg

SEQ ID NO: 3630115 - RNA, 15 nt, Salmonella enterica enterica serovar Typhi
aaaagcgcgggcugg

SEQ ID NO: 3630116 - RNA, 14 nt, Salmonella enterica enterica serovar Typhi
aaaagcggauaaga

SEQ ID NO: 3630117 - RNA, 19 nt, Salmonella enterica enterica serovar Typhi
aaaagcugcgaucaaguuu

SEQ ID NO: 3630118 - RNA, 12 nt, Salmonella enterica enterica serovar Typhi
aaaagcugguau

SEQ ID NO: 3630119 - RNA, 18 nt, Salmonella enterica enterica serovar Typhi
aaaagcuggugaaacguu

SEQ ID NO: 3630120 - RNA, 19 nt, Salmonella enterica enterica serovar Typhi
aaaagcuguagcauaaaug

SEQ ID NO: 3630121 - RNA, 16 nt, Salmonella enterica enterica serovar Typhi
aaaaggauacagcgcc

SEQ ID NO: 3630122 - RNA, 22 nt, Salmonella enterica enterica serovar Typhi
aaaaggcagagcgcgcucugcc

SEQ ID NO: 3630123 - RNA, 22 nt, Salmonella enterica enterica serovar Typhi
aaaaggcagauucuucugccuu

SEQ ID NO: 3630124 - RNA, 18 nt, Salmonella enterica enterica serovar Typhi
aaaaggcgguucccgggc

SEQ ID NO: 3630125 - RNA, 21 nt, Salmonella enterica enterica serovar Typhi
aaaaggucgacauuuaaugag

SEQ ID NO: 3630126 - RNA, 19 nt, Salmonella enterica enterica serovar Typhi
aaaagguggguuccagcgc

SEQ ID NO: 3630127 - RNA, 20 nt, Salmonella enterica enterica serovar Typhi
aaaagguuagguuaaauagu

SEQ ID NO: 3630128 - RNA, 16 nt, Salmonella enterica enterica serovar Typhi
aaaaguaccagcgcga

SEQ ID NO: 3630129 - RNA, 23 nt, Salmonella enterica enterica serovar Typhi
aaaaguaucucgccaguaaagac

SEQ ID NO: 3630130 - RNA, 15 nt, Salmonella enterica enterica serovar Typhi
aaaagucauuuucau

SEQ ID NO: 3630131 - RNA, 18 nt, Salmonella enterica enterica serovar Typhi
aaaaguuguugaccaaca

SEQ ID NO: 3630132 - RNA, 19 nt, Salmonella enterica enterica serovar Typhi
aaaaguuguugaccaacaa

SEQ ID NO: 3630133 - RNA, 11 nt, Salmonella enterica enterica serovar Typhi
aaaauaaaaaa

SEQ ID NO: 3630134 - RNA, 13 nt, Salmonella enterica enterica serovar Typhi
aaaauaaaaaagg

SEQ ID NO: 3630135 - RNA, 18 nt, Salmonella enterica enterica serovar Typhi
aaaauaaacacuaaauca

SEQ ID NO: 3630136 - RNA, 21 nt, Salmonella enterica enterica serovar Typhi
aaaauaacaauauuaaauaaa

SEQ ID NO: 3630137 - RNA, 13 nt, Salmonella enterica enterica serovar Typhi
aaaauaauaaaaa

SEQ ID NO: 3630138 - RNA, 23 nt, Salmonella enterica enterica serovar Typhi
aaaauaauagguacggggcaucu

SEQ ID NO: 3630139 - RNA, 13 nt, Salmonella enterica enterica serovar Typhi
aaaauaauccgcu

SEQ ID NO: 3630140 - RNA, 14 nt, Salmonella enterica enterica serovar Typhi
aaaauaauugauaa

SEQ ID NO: 3630141 - RNA, 15 nt, Salmonella enterica enterica serovar Typhi
aaaauaccccagcgc

SEQ ID NO: 3630142 - RNA, 20 nt, Salmonella enterica enterica serovar Typhi
aaaauaccccaggggcauau

SEQ ID NO: 3630143 - RNA, 14 nt, Salmonella enterica enterica serovar Typhi
aaaauaccggcagc

SEQ ID NO: 3630144 - RNA, 21 nt, Salmonella enterica enterica serovar Typhi
aaaauagcccggcuucccauc

SEQ ID NO: 3630145 - RNA, 21 nt, Salmonella enterica enterica serovar Typhi
aaaauagccgaaacuuauacu

SEQ ID NO: 3630146 - RNA, 23 nt, Salmonella enterica enterica serovar Typhi
aaaauagccgaaacuuauacuga

SEQ ID NO: 3630147 - RNA, 10 nt, Salmonella enterica enterica serovar Typhi
aaaauagcgg

SEQ ID NO: 3630148 - RNA, 22 nt, Salmonella enterica enterica serovar Typhi
aaaauagugcggccaaauugcu

SEQ ID NO: 3630149 - RNA, 17 nt, Salmonella enterica enterica serovar Typhi
aaaauaguucagcgcag

SEQ ID NO: 3630150 - RNA, 19 nt, Salmonella enterica enterica serovar Typhi
aaaauaguuggugggugau

SEQ ID NO: 3630151 - RNA, 23 nt, Salmonella enterica enterica serovar Typhi
aaaauauacaccugacggcagcc

SEQ ID NO: 3630152 - RNA, 20 nt, Salmonella enterica enterica serovar Typhi
aaaauaucauuaaaucaaaa

SEQ ID NO: 3630153 - RNA, 13 nt, Salmonella enterica enterica serovar Typhi
aaaauauccugua

SEQ ID NO: 3630154 - RNA, 24 nt, Salmonella enterica enterica serovar Typhi
aaaauaucggccugaaugcucuca

SEQ ID NO: 3630155 - RNA, 13 nt, Salmonella enterica enterica serovar Typhi
aaaaucagcaauc

SEQ ID NO: 3630156 - RNA, 17 nt, Salmonella enterica enterica serovar Typhi
aaaauccccaccugacu

SEQ ID NO: 3630157 - RNA, 19 nt, Salmonella enterica enterica serovar Typhi
aaaauccggaucaucuuuu

SEQ ID NO: 3630158 - RNA, 21 nt, Salmonella enterica enterica serovar Typhi
aaaauccucuaccggaaaaca

SEQ ID NO: 3630159 - RNA, 19 nt, Salmonella enterica enterica serovar Typhi
aaaauccugcacuuccagc

SEQ ID NO: 3630160 - RNA, 18 nt, Salmonella enterica enterica serovar Typhi
aaaauccuucuuccauuc

SEQ ID NO: 3630161 - RNA, 19 nt, Salmonella enterica enterica serovar Typhi
aaaauccuuguugauaaaa

SEQ ID NO: 3630162 - RNA, 22 nt, Salmonella enterica enterica serovar Typhi
aaaauccuuuuucaugcaauaa

SEQ ID NO: 3630163 - RNA, 23 nt, Salmonella enterica enterica serovar Typhi
aaaaucggcgggcaucauaucca

SEQ ID NO: 3630164 - RNA, 22 nt, Salmonella enterica enterica serovar Typhi
aaaaucggggucuuccagcaga

SEQ ID NO: 3630165 - RNA, 23 nt, Salmonella enterica enterica serovar Typhi
aaaaucuggcgagagcauugccu

SEQ ID NO: 3630166 - RNA, 21 nt, Salmonella enterica enterica serovar Typhi
aaaaucugguggccggaggag

SEQ ID NO: 3630167 - RNA, 14 nt, Salmonella enterica enterica serovar Typhi
aaaaugaauaccaa

SEQ ID NO: 3630168 - RNA, 20 nt, Salmonella enterica enterica serovar Typhi
aaaaugaggacacaguaaug

SEQ ID NO: 3630169 - RNA, 18 nt, Salmonella enterica enterica serovar Typhi
aaaaugcauugauaggcu

SEQ ID NO: 3630170 - RNA, 15 nt, Salmonella enterica enterica serovar Typhi
aaaaugcgcaaagca

SEQ ID NO: 3630171 - RNA, 16 nt, Salmonella enterica enterica serovar Typhi
aaaauggaaaauaaua

SEQ ID NO: 3630172 - RNA, 21 nt, Salmonella enterica enterica serovar Typhi
aaaauggaugcgcccacaaug

SEQ ID NO: 3630173 - RNA, 23 nt, Salmonella enterica enterica serovar Typhi
aaaauggggaucgucugcaaaac

SEQ ID NO: 3630174 - RNA, 19 nt, Salmonella enterica enterica serovar Typhi
aaaauggucugccaguagc

SEQ ID NO: 3630175 - RNA, 22 nt, Salmonella enterica enterica serovar Typhi
aaaaugucuuuucgguauuuau

SEQ ID NO: 3630176 - RNA, 20 nt, Salmonella enterica enterica serovar Typhi
aaaaugugcaaagagaccgg

SEQ ID NO: 3630177 - RNA, 22 nt, Salmonella enterica enterica serovar Typhi
aaaauguuuuuguuguuaauuu

SEQ ID NO: 3630178 - RNA, 22 nt, Salmonella enterica enterica serovar Typhi
aaaauuaacgacaaaaauacca

SEQ ID NO: 3630179 - RNA, 14 nt, Salmonella enterica enterica serovar Typhi
aaaauuaaucccaa

SEQ ID NO: 3630180 - RNA, 18 nt, Salmonella enterica enterica serovar Typhi
aaaauuacuucguagacu

SEQ ID NO: 3630181 - RNA, 20 nt, Salmonella enterica enterica serovar Typhi
aaaauuauuggcuuuguaaa

SEQ ID NO: 3630182 - RNA, 15 nt, Salmonella enterica enterica serovar Typhi
aaaauuauuuuaaau

SEQ ID NO: 3630183 - RNA, 19 nt, Salmonella enterica enterica serovar Typhi
aaaauuauuuuuacuuaaa

SEQ ID NO: 3630184 - RNA, 22 nt, Salmonella enterica enterica serovar Typhi
aaaauuauuuuuacuuaaaauu

SEQ ID NO: 3630185 - RNA, 16 nt, Salmonella enterica enterica serovar Typhi
aaaauucaaaaaagca

SEQ ID NO: 3630186 - RNA, 18 nt, Salmonella enterica enterica serovar Typhi
aaaauucccggcggaaau

SEQ ID NO: 3630187 - RNA, 14 nt, Salmonella enterica enterica serovar Typhi
aaaauugaauuaag

SEQ ID NO: 3630188 - RNA, 18 nt, Salmonella enterica enterica serovar Typhi
aaaauuuugcauaaauaa

SEQ ID NO: 3630189 - RNA, 15 nt, Salmonella enterica enterica serovar Typhi
aaacaaaccaaacug

SEQ ID NO: 3630190 - RNA, 19 nt, Salmonella enterica enterica serovar Typhi
aaacaacaaaguauaaagc

SEQ ID NO: 3630191 - RNA, 14 nt, Salmonella enterica enterica serovar Typhi
aaacaagccgccaa

SEQ ID NO: 3630192 - RNA, 24 nt, Salmonella enterica enterica serovar Typhi
aaacaagccgccaacgccagcagc

SEQ ID NO: 3630193 - RNA, 22 nt, Salmonella enterica enterica serovar Typhi
aaacaagugcagaagcaauccu

SEQ ID NO: 3630194 - RNA, 12 nt, Salmonella enterica enterica serovar Typhi
aaacaauauccc

SEQ ID NO: 3630195 - RNA, 12 nt, Salmonella enterica enterica serovar Typhi
aaacacagccau

SEQ ID NO: 3630196 - RNA, 12 nt, Salmonella enterica enterica serovar Typhi
aaacaccaacaa

SEQ ID NO: 3630197 - RNA, 18 nt, Salmonella enterica enterica serovar Typhi
aaacaccggggcauuucc

SEQ ID NO: 3630198 - RNA, 22 nt, Salmonella enterica enterica serovar Typhi
aaacagaccggagcgugcuuca

SEQ ID NO: 3630199 - RNA, 11 nt, Salmonella enterica enterica serovar Typhi
aaacagaugcu

SEQ ID NO: 3630200 - RNA, 15 nt, Salmonella enterica enterica serovar Typhi
aaacagcagaacaac

SEQ ID NO: 3630201 - RNA, 21 nt, Salmonella enterica enterica serovar Typhi
aaacagcagcgcggcacacag

SEQ ID NO: 3630202 - RNA, 16 nt, Salmonella enterica enterica serovar Typhi
aaacagccaaucauaa

SEQ ID NO: 3630203 - RNA, 14 nt, Salmonella enterica enterica serovar Typhi
aaacagccagcagc

SEQ ID NO: 3630204 - RNA, 15 nt, Salmonella enterica enterica serovar Typhi
aaacagccgccaugg

SEQ ID NO: 3630205 - RNA, 23 nt, Salmonella enterica enterica serovar Typhi
aaacagcgccaguuuuuccuguu

SEQ ID NO: 3630206 - RNA, 20 nt, Salmonella enterica enterica serovar Typhi
aaacagcgccccgacaaaac

SEQ ID NO: 3630207 - RNA, 14 nt, Salmonella enterica enterica serovar Typhi
aaacagcuguaaau

SEQ ID NO: 3630208 - RNA, 15 nt, Salmonella enterica enterica serovar Typhi
aaacaggaaaaacau

SEQ ID NO: 3630209 - RNA, 20 nt, Salmonella enterica enterica serovar Typhi
aaacaggccugcggaaaaag

SEQ ID NO: 3630210 - RNA, 15 nt, Salmonella enterica enterica serovar Typhi
aaacagguaaaacaa

SEQ ID NO: 3630211 - RNA, 19 nt, Salmonella enterica enterica serovar Typhi
aaacagguacuuacccaga

SEQ ID NO: 3630212 - RNA, 17 nt, Salmonella enterica enterica serovar Typhi
aaacagugaaaaaacgg

SEQ ID NO: 3630213 - RNA, 18 nt, Salmonella enterica enterica serovar Typhi
aaacaguuuugucaucag

SEQ ID NO: 3630214 - RNA, 13 nt, Salmonella enterica enterica serovar Typhi
aaacauaagcaaa

SEQ ID NO: 3630215 - RNA, 16 nt, Salmonella enterica enterica serovar Typhi
aaacauauaauuaaca

SEQ ID NO: 3630216 - RNA, 16 nt, Salmonella enterica enterica serovar Typhi
aaacauauagcaguuu

SEQ ID NO: 3630217 - RNA, 15 nt, Salmonella enterica enterica serovar Typhi
aaacauauaucucua

SEQ ID NO: 3630218 - RNA, 14 nt, Salmonella enterica enterica serovar Typhi
aaacaucagccauu

SEQ ID NO: 3630219 - RNA, 18 nt, Salmonella enterica enterica serovar Typhi
aaacaucagcgcaugccc

SEQ ID NO: 3630220 - RNA, 15 nt, Salmonella enterica enterica serovar Typhi
aaacaucaugcccaa

SEQ ID NO: 3630221 - RNA, 24 nt, Salmonella enterica enterica serovar Typhi
aaacaucauggcuuaaaacgauuu

SEQ ID NO: 3630222 - RNA, 14 nt, Salmonella enterica enterica serovar Typhi
aaacaucccgauaa

SEQ ID NO: 3630223 - RNA, 17 nt, Salmonella enterica enterica serovar Typhi
aaacaucgcccuccagc

SEQ ID NO: 3630224 - RNA, 22 nt, Salmonella enterica enterica serovar Typhi
aaacaucgcugauauuguugaa

SEQ ID NO: 3630225 - RNA, 20 nt, Salmonella enterica enterica serovar Typhi
aaacaugguggagucugaaa

SEQ ID NO: 3630226 - RNA, 17 nt, Salmonella enterica enterica serovar Typhi
aaacaugucaaaauccu

SEQ ID NO: 3630227 - RNA, 16 nt, Salmonella enterica enterica serovar Typhi
aaaccaaacaccagau

SEQ ID NO: 3630228 - RNA, 14 nt, Salmonella enterica enterica serovar Typhi
aaaccaaacagcga

SEQ ID NO: 3630229 - RNA, 15 nt, Salmonella enterica enterica serovar Typhi
aaaccaaacuuaucu

SEQ ID NO: 3630230 - RNA, 13 nt, Salmonella enterica enterica serovar Typhi
aaaccaacagccg

SEQ ID NO: 3630231 - RNA, 20 nt, Salmonella enterica enterica serovar Typhi
aaaccaauacgcauuagcuu

SEQ ID NO: 3630232 - RNA, 16 nt, Salmonella enterica enterica serovar Typhi
aaaccacgcugaggcg

SEQ ID NO: 3630233 - RNA, 14 nt, Salmonella enterica enterica serovar Typhi
aaaccagcauaaua

SEQ ID NO: 3630234 - RNA, 16 nt, Salmonella enterica enterica serovar Typhi
aaaccagcauaauauu

SEQ ID NO: 3630235 - RNA, 20 nt, Salmonella enterica enterica serovar Typhi
aaaccagcuuuucauuuguu

SEQ ID NO: 3630236 - RNA, 18 nt, Salmonella enterica enterica serovar Typhi
aaaccaggcacugcaggc

SEQ ID NO: 3630237 - RNA, 20 nt, Salmonella enterica enterica serovar Typhi
aaacuucccgcgcagugcag

SEQ ID NO: 3630238 - RNA, 23 nt, Salmonella enterica enterica serovar Typhi
aaacuuucauuucacuuguucuu

SEQ ID NO: 3630239 - RNA, 10 nt, Salmonella enterica enterica serovar Typhi
aaagaaaaac

SEQ ID NO: 3630240 - RNA, 18 nt, Salmonella enterica enterica serovar Typhi
aaagaaaacuuucauuuc

SEQ ID NO: 3630241 - RNA, 19 nt, Salmonella enterica enterica serovar Typhi
aaagaaaacuuucauuuca

SEQ ID NO: 3630242 - RNA, 14 nt, Salmonella enterica enterica serovar Typhi
aaagaaaaugccag

SEQ ID NO: 3630243 - RNA, 15 nt, Salmonella enterica enterica serovar Typhi
aaagaaacgcugauc

SEQ ID NO: 3630244 - RNA, 14 nt, Salmonella enterica enterica serovar Typhi
aaagaaagcauuaa

SEQ ID NO: 3630245 - RNA, 12 nt, Salmonella enterica enterica serovar Typhi
aaagaaaucacc

SEQ ID NO: 3630246 - RNA, 12 nt, Salmonella enterica enterica serovar Typhi
aaagaaauuuaa

SEQ ID NO: 3630247 - RNA, 18 nt, Salmonella enterica enterica serovar Typhi
aaagaacguguuuuucca

SEQ ID NO: 3630248 - RNA, 21 nt, Salmonella enterica enterica serovar Typhi
aaagaagaaaccgcagaaaaa

SEQ ID NO: 3630249 - RNA, 12 nt, Salmonella enterica enterica serovar Typhi
aaagaagaauaa

SEQ ID NO: 3630250 - RNA, 13 nt, Salmonella enterica enterica serovar Typhi
aaagaagggcagg

SEQ ID NO: 3630251 - RNA, 19 nt, Salmonella enterica enterica serovar Typhi
aaagaaguggacuuccauu

SEQ ID NO: 3630252 - RNA, 19 nt, Salmonella enterica enterica serovar Typhi
aaagaaguuagauauuaau

SEQ ID NO: 3630253 - RNA, 18 nt, Salmonella enterica enterica serovar Typhi
aaagaaugaaaaaaaaau

SEQ ID NO: 3630254 - RNA, 22 nt, Salmonella enterica enterica serovar Typhi
aaagaaugucccaguaauaucg

SEQ ID NO: 3630255 - RNA, 16 nt, Salmonella enterica enterica serovar Typhi
aaagacagcaggcuuu

SEQ ID NO: 3630256 - RNA, 16 nt, Salmonella enterica enterica serovar Typhi
aaagaccuccgcccgg

SEQ ID NO: 3630257 - RNA, 14 nt, Salmonella enterica enterica serovar Typhi
aaagaccuucuugc

SEQ ID NO: 3630258 - RNA, 19 nt, Salmonella enterica enterica serovar Typhi
aaagacggcagcgccaucc

SEQ ID NO: 3630259 - RNA, 23 nt, Salmonella enterica enterica serovar Typhi
aaagagaacgacgcauaaaaaau

SEQ ID NO: 3630260 - RNA, 18 nt, Salmonella enterica enterica serovar Typhi
aaagagagcgccaaaaag

SEQ ID NO: 3630261 - RNA, 19 nt, Salmonella enterica enterica serovar Typhi
aaagagcguaucgccggcg

SEQ ID NO: 3630262 - RNA, 22 nt, Salmonella enterica enterica serovar Typhi
aaagagguugacgcuucaaggc

SEQ ID NO: 3630263 - RNA, 14 nt, Salmonella enterica enterica serovar Typhi
aaagauuggcaucu

SEQ ID NO: 3630264 - RNA, 22 nt, Salmonella enterica enterica serovar Typhi
aaagauuuaucaauuuuuaaaa

SEQ ID NO: 3630265 - RNA, 20 nt, Salmonella enterica enterica serovar Typhi
aaagauuuguuucaucgccu

SEQ ID NO: 3630266 - RNA, 17 nt, Salmonella enterica enterica serovar Typhi
aaagcaaucgccagcgc

SEQ ID NO: 3630267 - RNA, 18 nt, Salmonella enterica enterica serovar Typhi
aaagcacagccccagcac

SEQ ID NO: 3630268 - RNA, 21 nt, Salmonella enterica enterica serovar Typhi
aaagcacaucagcaaaugaac

SEQ ID NO: 3630269 - RNA, 17 nt, Salmonella enterica enterica serovar Typhi
aaagcacggguagcuag

SEQ ID NO: 3630270 - RNA, 11 nt, Salmonella enterica enterica serovar Typhi
aaagcacugcu

SEQ ID NO: 3630271 - RNA, 18 nt, Salmonella enterica enterica serovar Typhi
aaagcacugcugcugaaa

SEQ ID NO: 3630272 - RNA, 21 nt, Salmonella enterica enterica serovar Typhi
aaagcacugcugcugaaagaa

SEQ ID NO: 3630273 - RNA, 23 nt, Salmonella enterica enterica serovar Typhi
aaagcacugcugcugaaagaaga

SEQ ID NO: 3630274 - RNA, 17 nt, Salmonella enterica enterica serovar Typhi
aaagcacuucucgcgca

SEQ ID NO: 3630275 - RNA, 16 nt, Salmonella enterica enterica serovar Typhi
aaagcagaggucugca

SEQ ID NO: 3630276 - RNA, 14 nt, Salmonella enterica enterica serovar Typhi
aaagcagcggcggu

SEQ ID NO: 3630277 - RNA, 12 nt, Salmonella enterica enterica serovar Typhi
aaagcagugcag

SEQ ID NO: 3630278 - RNA, 15 nt, Salmonella enterica enterica serovar Typhi
aaagcauuaaaucau

SEQ ID NO: 3630279 - RNA, 15 nt, Salmonella enterica enterica serovar Typhi
aaagccaguuucucu

SEQ ID NO: 3630280 - RNA, 18 nt, Salmonella enterica enterica serovar Typhi
aaagcccaucaccgccag

SEQ ID NO: 3630281 - RNA, 22 nt, Salmonella enterica enterica serovar Typhi
aaagccccggcucaagccaggu

SEQ ID NO: 3630282 - RNA, 23 nt, Salmonella enterica enterica serovar Typhi
aaagccccuuccucgggaggggc

SEQ ID NO: 3630283 - RNA, 13 nt, Salmonella enterica enterica serovar Typhi
aaagccgaccugg

SEQ ID NO: 3630284 - RNA, 18 nt, Salmonella enterica enterica serovar Typhi
aaagccgaugacaucuca

SEQ ID NO: 3630285 - RNA, 18 nt, Salmonella enterica enterica serovar Typhi
aaagccgccauccggcau

SEQ ID NO: 3630286 - RNA, 20 nt, Salmonella enterica enterica serovar Typhi
aaagccgccauccggcauuu

SEQ ID NO: 3630287 - RNA, 13 nt, Salmonella enterica enterica serovar Typhi
aaagccgcgcggu

SEQ ID NO: 3630288 - RNA, 24 nt, Salmonella enterica enterica serovar Typhi
aaagccgcgucgcaccugcucuuu

SEQ ID NO: 3630289 - RNA, 17 nt, Salmonella enterica enterica serovar Typhi
aaagccggcggaaaaaa

SEQ ID NO: 3630290 - RNA, 18 nt, Salmonella enterica enterica serovar Typhi
aaagccgguuuucguuaa

SEQ ID NO: 3630291 - RNA, 23 nt, Salmonella enterica enterica serovar Typhi
aaagccgugaauaaaaccggcau

SEQ ID NO: 3630292 - RNA, 22 nt, Salmonella enterica enterica serovar Typhi
aaagccucugauuucgacgaua

SEQ ID NO: 3630293 - RNA, 17 nt, Salmonella enterica enterica serovar Typhi
aaagccucuuuugcauu

SEQ ID NO: 3630294 - RNA, 20 nt, Salmonella enterica enterica serovar Typhi
aaagccugcacauugcaggc

SEQ ID NO: 3630295 - RNA, 19 nt, Salmonella enterica enterica serovar Typhi
aaagcgaauaacauaauau

SEQ ID NO: 3630296 - RNA, 13 nt, Salmonella enterica enterica serovar Typhi
aaagcgaauaauu

SEQ ID NO: 3630297 - RNA, 14 nt, Salmonella enterica enterica serovar Typhi
aaagcgaccucuug

SEQ ID NO: 3630298 - RNA, 19 nt, Salmonella enterica enterica serovar Typhi
aaagcgacucauccacaua

SEQ ID NO: 3630299 - RNA, 22 nt, Salmonella enterica enterica serovar Typhi
aaagcgcucguuauaauugccc

SEQ ID NO: 3630300 - RNA, 14 nt, Salmonella enterica enterica serovar Typhi
aaagcggacacugu

SEQ ID NO: 3630301 - RNA, 15 nt, Salmonella enterica enterica serovar Typhi
aaagcggccuuuuuu

SEQ ID NO: 3630302 - RNA, 13 nt, Salmonella enterica enterica serovar Typhi
aaagcggcgaaua

SEQ ID NO: 3630303 - RNA, 14 nt, Salmonella enterica enterica serovar Typhi
aaagcggcuguagc

SEQ ID NO: 3630304 - RNA, 19 nt, Salmonella enterica enterica serovar Typhi
aaagcgucaguaaaagccc

SEQ ID NO: 3630305 - RNA, 17 nt, Salmonella enterica enterica serovar Typhi
aaagcguugcaggcgau

SEQ ID NO: 3630306 - RNA, 17 nt, Salmonella enterica enterica serovar Typhi
aaagcguuggcgugcga

SEQ ID NO: 3630307 - RNA, 17 nt, Salmonella enterica enterica serovar Typhi
aaagcuauucacaccuu

SEQ ID NO: 3630308 - RNA, 15 nt, Salmonella enterica enterica serovar Typhi
aaagcugcaccagga

SEQ ID NO: 3630309 - RNA, 12 nt, Salmonella enterica enterica serovar Typhi
aaagcugccuuu

SEQ ID NO: 3630310 - RNA, 17 nt, Salmonella enterica enterica serovar Typhi
aaagcugcgaucaaguu

SEQ ID NO: 3630311 - RNA, 20 nt, Salmonella enterica enterica serovar Typhi
aaagcuggauaucacgcgcg

SEQ ID NO: 3630312 - RNA, 19 nt, Salmonella enterica enterica serovar Typhi
aaagcuguugugucccggc

SEQ ID NO: 3630313 - RNA, 19 nt, Salmonella enterica enterica serovar Typhi
aaaggacguucuucuccca

SEQ ID NO: 3630314 - RNA, 12 nt, Salmonella enterica enterica serovar Typhi
aaaggaucgauu

SEQ ID NO: 3630315 - RNA, 15 nt, Salmonella enterica enterica serovar Typhi
aaaggaucgauuaag

SEQ ID NO: 3630316 - RNA, 13 nt, Salmonella enterica enterica serovar Typhi
aaaggcagaagaa

SEQ ID NO: 3630317 - RNA, 17 nt, Salmonella enterica enterica serovar Typhi
aaaggcagacagagaaa

SEQ ID NO: 3630318 - RNA, 16 nt, Salmonella enterica enterica serovar Typhi
aaaggccuggcugaga

SEQ ID NO: 3630319 - RNA, 20 nt, Salmonella enterica enterica serovar Typhi
aaaggcgccgcuucccccgg

SEQ ID NO: 3630320 - RNA, 23 nt, Salmonella enterica enterica serovar Typhi
aaaggcguagaucucuaucggca

SEQ ID NO: 3630321 - RNA, 22 nt, Salmonella enterica enterica serovar Typhi
aaaggcuugcaggaugucgaua

SEQ ID NO: 3630322 - RNA, 12 nt, Salmonella enterica enterica serovar Typhi
aaaggcuuuaaa

SEQ ID NO: 3630323 - RNA, 20 nt, Salmonella enterica enterica serovar Typhi
aaauauagccauuuaaugau

SEQ ID NO: 3630324 - RNA, 21 nt, Salmonella enterica enterica serovar Typhi
aaauauagccauuuaaugaug

SEQ ID NO: 3630325 - RNA, 16 nt, Salmonella enterica enterica serovar Typhi
aaauauauaauuuaua

SEQ ID NO: 3630326 - RNA, 13 nt, Salmonella enterica enterica serovar Typhi
aaauauaugacaa

SEQ ID NO: 3630327 - RNA, 21 nt, Salmonella enterica enterica serovar Typhi
aaauaucauucgcgucauacu

SEQ ID NO: 3630328 - RNA, 10 nt, Salmonella enterica enterica serovar Typhi
aaauauccua

SEQ ID NO: 3630329 - RNA, 13 nt, Salmonella enterica enterica serovar Typhi
aaauaucucuccc

SEQ ID NO: 3630330 - RNA, 16 nt, Salmonella enterica enterica serovar Typhi
aaauaugaaagagaaa

SEQ ID NO: 3630331 - RNA, 22 nt, Salmonella enterica enterica serovar Typhi
aaauaugagguugucuuugcug

SEQ ID NO: 3630332 - RNA, 17 nt, Salmonella enterica enterica serovar Typhi
aaauaugcggagccucu

SEQ ID NO: 3630333 - RNA, 12 nt, Salmonella enterica enterica serovar Typhi
aaauauggcggg

SEQ ID NO: 3630334 - RNA, 22 nt, Salmonella enterica enterica serovar Typhi
aaauauugagguauaggaaaau

SEQ ID NO: 3630335 - RNA, 20 nt, Salmonella enterica enterica serovar Typhi
aaauauugauuaaucgucau

SEQ ID NO: 3630336 - RNA, 18 nt, Salmonella enterica enterica serovar Typhi
aaauauuggcggcaaaga

SEQ ID NO: 3630337 - RNA, 21 nt, Salmonella enterica enterica serovar Typhi
aaauauuggcggcaaagaaaa

SEQ ID NO: 3630338 - RNA, 14 nt, Salmonella enterica enterica serovar Typhi
aaauauuucuuugu

SEQ ID NO: 3630339 - RNA, 15 nt, Salmonella enterica enterica serovar Typhi
aaaucaaacagaaua

SEQ ID NO: 3630340 - RNA, 16 nt, Salmonella enterica enterica serovar Typhi
aaaucaaacagaauau

SEQ ID NO: 3630341 - RNA, 13 nt, Salmonella enterica enterica serovar Typhi
aaaucaaauaaga

SEQ ID NO: 3630342 - RNA, 18 nt, Salmonella enterica enterica serovar Typhi
aaaucaacauuauuaaaa

SEQ ID NO: 3630343 - RNA, 21 nt, Salmonella enterica enterica serovar Typhi
aaaucacagggggaacauuua

SEQ ID NO: 3630344 - RNA, 15 nt, Salmonella enterica enterica serovar Typhi
aaaucacgcuggaua

SEQ ID NO: 3630345 - RNA, 21 nt, Salmonella enterica enterica serovar Typhi
aaaucacuggagcgcauuuua

SEQ ID NO: 3630346 - RNA, 21 nt, Salmonella enterica enterica serovar Typhi
aaaucagcaaucguuggcgua

SEQ ID NO: 3630347 - RNA, 16 nt, Salmonella enterica enterica serovar Typhi
aaaucagcauuacccc

SEQ ID NO: 3630348 - RNA, 21 nt, Salmonella enterica enterica serovar Typhi
aaaucagcccggacaucaucc

SEQ ID NO: 3630349 - RNA, 15 nt, Salmonella enterica enterica serovar Typhi
aaaucaggaaaaagg

SEQ ID NO: 3630350 - RNA, 20 nt, Salmonella enterica enterica serovar Typhi
aaaucagugaacacccugcc

SEQ ID NO: 3630351 - RNA, 17 nt, Salmonella enterica enterica serovar Typhi
aaaucagugauggauuu

SEQ ID NO: 3630352 - RNA, 15 nt, Salmonella enterica enterica serovar Typhi
aaaucauaccagcga

SEQ ID NO: 3630353 - RNA, 24 nt, Salmonella enterica enterica serovar Typhi
aaaucaucaaucgcuaucugacag

SEQ ID NO: 3630354 - RNA, 13 nt, Salmonella enterica enterica serovar Typhi
aaaucaucaaugg

SEQ ID NO: 3630355 - RNA, 19 nt, Salmonella enterica enterica serovar Typhi
aaaucaucaauggcgauuu

SEQ ID NO: 3630356 - RNA, 16 nt, Salmonella enterica enterica serovar Typhi
aaaucauccugcggca

SEQ ID NO: 3630357 - RNA, 21 nt, Salmonella enterica enterica serovar Typhi
aaaucaucgcgcugauauuuu

SEQ ID NO: 3630358 - RNA, 23 nt, Salmonella enterica enterica serovar Typhi
aaaucaucgcgcugauauuuuua

SEQ ID NO: 3630359 - RNA, 16 nt, Salmonella enterica enterica serovar Typhi
aaaucauuacuuauau

SEQ ID NO: 3630360 - RNA, 22 nt, Salmonella enterica enterica serovar Typhi
aaaucauuacuuauauuuauuu

SEQ ID NO: 3630361 - RNA, 22 nt, Salmonella enterica enterica serovar Typhi
aaaucauuuguacaaaaaaugu

SEQ ID NO: 3630362 - RNA, 12 nt, Salmonella enterica enterica serovar Typhi
aaauccaauaga

SEQ ID NO: 3630363 - RNA, 20 nt, Salmonella enterica enterica serovar Typhi
aaauccagcagaauaacauc

SEQ ID NO: 3630364 - RNA, 17 nt, Salmonella enterica enterica serovar Typhi
aaauccagggaaaccau

SEQ ID NO: 3630365 - RNA, 19 nt, Salmonella enterica enterica serovar Typhi
aaauccagggaaaccaugu

SEQ ID NO: 3630366 - RNA, 22 nt, Salmonella enterica enterica serovar Typhi
aaauccagggaaaccauguuga

SEQ ID NO: 3630367 - RNA, 21 nt, Salmonella enterica enterica serovar Typhi
aaauccaucucaggccgacaa

SEQ ID NO: 3630368 - RNA, 19 nt, Salmonella enterica enterica serovar Typhi
aaauccaugagaagaaaaa

SEQ ID NO: 3630369 - RNA, 23 nt, Salmonella enterica enterica serovar Typhi
aaaucccccaacgucaccaucaa

SEQ ID NO: 3630370 - RNA, 17 nt, Salmonella enterica enterica serovar Typhi
aaaucccggcgauuaau

SEQ ID NO: 3630371 - RNA, 19 nt, Salmonella enterica enterica serovar Typhi
aaaucccggcgauuaauaa

SEQ ID NO: 3630372 - RNA, 12 nt, Salmonella enterica enterica serovar Typhi
aaaucccugauc

SEQ ID NO: 3630373 - RNA, 21 nt, Salmonella enterica enterica serovar Typhi
aaauccgcgcucggucacuuc

SEQ ID NO: 3630374 - RNA, 22 nt, Salmonella enterica enterica serovar Typhi
aaauccgcgcucggucacuuca

SEQ ID NO: 3630375 - RNA, 17 nt, Salmonella enterica enterica serovar Typhi
aaauccggaucaucuuu

SEQ ID NO: 3630376 - RNA, 19 nt, Salmonella enterica enterica serovar Typhi
aaauccggcugccugccgg

SEQ ID NO: 3630377 - RNA, 17 nt, Salmonella enterica enterica serovar Typhi
aaauccucauuaguuca

SEQ ID NO: 3630378 - RNA, 20 nt, Salmonella enterica enterica serovar Typhi
aaauccuccauaaauaacau

SEQ ID NO: 3630379 - RNA, 18 nt, Salmonella enterica enterica serovar Typhi
aaauccucccaucgagcc

SEQ ID NO: 3630380 - RNA, 13 nt, Salmonella enterica enterica serovar Typhi
aaauccuccggcg

SEQ ID NO: 3630381 - RNA, 13 nt, Salmonella enterica enterica serovar Typhi
aaauccugcucca

SEQ ID NO: 3630382 - RNA, 18 nt, Salmonella enterica enterica serovar Typhi
aaaucgacagcgacggcg

SEQ ID NO: 3630383 - RNA, 12 nt, Salmonella enterica enterica serovar Typhi
aaaucgccauca

SEQ ID NO: 3630384 - RNA, 16 nt, Salmonella enterica enterica serovar Typhi
aaaucgcccaggccug

SEQ ID NO: 3630385 - RNA, 13 nt, Salmonella enterica enterica serovar Typhi
aaaucgcgagccu

SEQ ID NO: 3630386 - RNA, 17 nt, Salmonella enterica enterica serovar Typhi
aaaucgcgagccuucaa

SEQ ID NO: 3630387 - RNA, 16 nt, Salmonella enterica enterica serovar Typhi
aaaucgcgcaaauauu

SEQ ID NO: 3630388 - RNA, 19 nt, Salmonella enterica enterica serovar Typhi
aaaucgcgcaaauauuaca

SEQ ID NO: 3630389 - RNA, 21 nt, Salmonella enterica enterica serovar Typhi
aaaucgcuauauugcugcgca

SEQ ID NO: 3630390 - RNA, 19 nt, Salmonella enterica enterica serovar Typhi
aaaucggggucuuccagca

SEQ ID NO: 3630391 - RNA, 21 nt, Salmonella enterica enterica serovar Typhi
aaaucggggucuuccagcaga

SEQ ID NO: 3630392 - RNA, 22 nt, Salmonella enterica enterica serovar Typhi
aaaucgguaaucaugucguaga

SEQ ID NO: 3630393 - RNA, 15 nt, Salmonella enterica enterica serovar Typhi
aaaucgucaucagau

SEQ ID NO: 3630394 - RNA, 20 nt, Salmonella enterica enterica serovar Typhi
aaaucguuuucuaacgaggu

SEQ ID NO: 3630395 - RNA, 19 nt, Salmonella enterica enterica serovar Typhi
aaaucugccgucaucgacu

SEQ ID NO: 3630396 - RNA, 20 nt, Salmonella enterica enterica serovar Typhi
aaaucugccgucaucgacuu

SEQ ID NO: 3630397 - RNA, 20 nt, Salmonella enterica enterica serovar Typhi
aaaucuggugauaaagcaga

SEQ ID NO: 3630398 - RNA, 23 nt, Salmonella enterica enterica serovar Typhi
aaaucuuucuccugguuuuucca

SEQ ID NO: 3630399 - RNA, 17 nt, Salmonella enterica enterica serovar Typhi
aaaucuuuuucgcugua

SEQ ID NO: 3630400 - RNA, 18 nt, Salmonella enterica enterica serovar Typhi
aaaugaaaugcccauaaa

SEQ ID NO: 3630401 - RNA, 13 nt, Salmonella enterica enterica serovar Typhi
aaaugaauaccaa

SEQ ID NO: 3630402 - RNA, 18 nt, Salmonella enterica enterica serovar Typhi
aaaugacgcccugcgcca

SEQ ID NO: 3630403 - RNA, 22 nt, Salmonella enterica enterica serovar Typhi
aaaugacgccggguaaacgcag

SEQ ID NO: 3630404 - RNA, 13 nt, Salmonella enterica enterica serovar Typhi
aaaugacgccugu

SEQ ID NO: 3630405 - RNA, 12 nt, Salmonella enterica enterica serovar Typhi
aaaugagaacac

SEQ ID NO: 3630406 - RNA, 21 nt, Salmonella enterica enterica serovar Typhi
aaaugaggacacaguaaugag

SEQ ID NO: 3630407 - RNA, 13 nt, Salmonella enterica enterica serovar Typhi
aaaugaggugaaa

SEQ ID NO: 3630408 - RNA, 14 nt, Salmonella enterica enterica serovar Typhi
aacaaacacagcca

SEQ ID NO: 3630409 - RNA, 17 nt, Salmonella enterica enterica serovar Typhi
aacaaacauaagcaaau

SEQ ID NO: 3630410 - RNA, 23 nt, Salmonella enterica enterica serovar Typhi
aacaaagguuuguuuaauuuugu

SEQ ID NO: 3630411 - RNA, 14 nt, Salmonella enterica enterica serovar Typhi
aacaaauaaaucca

SEQ ID NO: 3630412 - RNA, 16 nt, Salmonella enterica enterica serovar Typhi
aacaaaucgacagcca

SEQ ID NO: 3630413 - RNA, 11 nt, Salmonella enterica enterica serovar Typhi
aacaaaugaag

SEQ ID NO: 3630414 - RNA, 18 nt, Salmonella enterica enterica serovar Typhi
aacaacacgaucgaugcc

SEQ ID NO: 3630415 - RNA, 21 nt, Salmonella enterica enterica serovar Typhi
aacaaccagaauaauggggau

SEQ ID NO: 3630416 - RNA, 14 nt, Salmonella enterica enterica serovar Typhi
aacaacuguuuuuc

SEQ ID NO: 3630417 - RNA, 15 nt, Salmonella enterica enterica serovar Typhi
aacaagcaaaccuau

SEQ ID NO: 3630418 - RNA, 14 nt, Salmonella enterica enterica serovar Typhi
aacaagccgccaac

SEQ ID NO: 3630419 - RNA, 19 nt, Salmonella enterica enterica serovar Typhi
aacaaucgcaccaggccac

SEQ ID NO: 3630420 - RNA, 19 nt, Salmonella enterica enterica serovar Typhi
aacaaugccauuauugcau

SEQ ID NO: 3630421 - RNA, 17 nt, Salmonella enterica enterica serovar Typhi
aacaaugggauaaaaug

SEQ ID NO: 3630422 - RNA, 17 nt, Salmonella enterica enterica serovar Typhi
aacaauuugcccagcgc

SEQ ID NO: 3630423 - RNA, 21 nt, Salmonella enterica enterica serovar Typhi
aacacaaacaauuuacgcagc

SEQ ID NO: 3630424 - RNA, 16 nt, Salmonella enterica enterica serovar Typhi
aacacaaucaggcgca

SEQ ID NO: 3630425 - RNA, 16 nt, Salmonella enterica enterica serovar Typhi
aacacacuuucugcuu

SEQ ID NO: 3630426 - RNA, 22 nt, Salmonella enterica enterica serovar Typhi
aacacauaacgcccgacaaucg

SEQ ID NO: 3630427 - RNA, 13 nt, Salmonella enterica enterica serovar Typhi
aacaccagacuga

SEQ ID NO: 3630428 - RNA, 12 nt, Salmonella enterica enterica serovar Typhi
aacaccagauca

SEQ ID NO: 3630429 - RNA, 21 nt, Salmonella enterica enterica serovar Typhi
aacaccagccgcaucuuauau

SEQ ID NO: 3630430 - RNA, 17 nt, Salmonella enterica enterica serovar Typhi
aacaccagcgauccaga

SEQ ID NO: 3630431 - RNA, 19 nt, Salmonella enterica enterica serovar Typhi
aacaccagggauuuugcuu

SEQ ID NO: 3630432 - RNA, 21 nt, Salmonella enterica enterica serovar Typhi
aacacccaauauagaguccug

SEQ ID NO: 3630433 - RNA, 16 nt, Salmonella enterica enterica serovar Typhi
aacacccacaccaucg

SEQ ID NO: 3630434 - RNA, 18 nt, Salmonella enterica enterica serovar Typhi
aacaccgcauggcuggca

SEQ ID NO: 3630435 - RNA, 22 nt, Salmonella enterica enterica serovar Typhi
aacaccgccgcgcugaucgcca

SEQ ID NO: 3630436 - RNA, 15 nt, Salmonella enterica enterica serovar Typhi
aacaccggggcauuu

SEQ ID NO: 3630437 - RNA, 23 nt, Salmonella enterica enterica serovar Typhi
aacaccguuggcgucaaauccau

SEQ ID NO: 3630438 - RNA, 20 nt, Salmonella enterica enterica serovar Typhi
aacaccucagccacccacug

SEQ ID NO: 3630439 - RNA, 23 nt, Salmonella enterica enterica serovar Typhi
aacaccucagccacccacugacg

SEQ ID NO: 3630440 - RNA, 20 nt, Salmonella enterica enterica serovar Typhi
aacaccuuuggggaaaggua

SEQ ID NO: 3630441 - RNA, 16 nt, Salmonella enterica enterica serovar Typhi
aacacgacgcugccac

SEQ ID NO: 3630442 - RNA, 15 nt, Salmonella enterica enterica serovar Typhi
aacacgauaaaacgc

SEQ ID NO: 3630443 - RNA, 21 nt, Salmonella enterica enterica serovar Typhi
aacacgccgccuaucgccagc

SEQ ID NO: 3630444 - RNA, 13 nt, Salmonella enterica enterica serovar Typhi
aacacgccgcgcu

SEQ ID NO: 3630445 - RNA, 16 nt, Salmonella enterica enterica serovar Typhi
aacacgccgcgcugga

SEQ ID NO: 3630446 - RNA, 15 nt, Salmonella enterica enterica serovar Typhi
aacacggacucgccu

SEQ ID NO: 3630447 - RNA, 16 nt, Salmonella enterica enterica serovar Typhi
aacacuaaaucauaau

SEQ ID NO: 3630448 - RNA, 20 nt, Salmonella enterica enterica serovar Typhi
aacacucacaaaacuauuuu

SEQ ID NO: 3630449 - RNA, 13 nt, Salmonella enterica enterica serovar Typhi
aacacucuccacc

SEQ ID NO: 3630450 - RNA, 17 nt, Salmonella enterica enterica serovar Typhi
aacagaaaaaaugcacc

SEQ ID NO: 3630451 - RNA, 18 nt, Salmonella enterica enterica serovar Typhi
aacagaaaagaucgcugc

SEQ ID NO: 3630452 - RNA, 14 nt, Salmonella enterica enterica serovar Typhi
aacagaaaccauaa

SEQ ID NO: 3630453 - RNA, 18 nt, Salmonella enterica enterica serovar Typhi
aacagaagccugcguuau

SEQ ID NO: 3630454 - RNA, 17 nt, Salmonella enterica enterica serovar Typhi
aacagaauuaacgcaga

SEQ ID NO: 3630455 - RNA, 17 nt, Salmonella enterica enterica serovar Typhi
aacagacaauaccaggg

SEQ ID NO: 3630456 - RNA, 14 nt, Salmonella enterica enterica serovar Typhi
aacagaccgccaug

SEQ ID NO: 3630457 - RNA, 19 nt, Salmonella enterica enterica serovar Typhi
aacagagagggaaaaaaau

SEQ ID NO: 3630458 - RNA, 22 nt, Salmonella enterica enterica serovar Typhi
aacagagagggaaaaaaauccu

SEQ ID NO: 3630459 - RNA, 22 nt, Salmonella enterica enterica serovar Typhi
aacagagcgccggcaaagccau

SEQ ID NO: 3630460 - RNA, 13 nt, Salmonella enterica enterica serovar Typhi
aacagaguaaccc

SEQ ID NO: 3630461 - RNA, 13 nt, Salmonella enterica enterica serovar Typhi
aacagauaaaugu

SEQ ID NO: 3630462 - RNA, 16 nt, Salmonella enterica enterica serovar Typhi
aacagcaaugcccaaa

SEQ ID NO: 3630463 - RNA, 14 nt, Salmonella enterica enterica serovar Typhi
aacagcaauguuuc

SEQ ID NO: 3630464 - RNA, 14 nt, Salmonella enterica enterica serovar Typhi
aacagcaccagcag

SEQ ID NO: 3630465 - RNA, 21 nt, Salmonella enterica enterica serovar Typhi
aacagcauaaacguuaccaua

SEQ ID NO: 3630466 - RNA, 18 nt, Salmonella enterica enterica serovar Typhi
aacagcauaauaaagcag

SEQ ID NO: 3630467 - RNA, 13 nt, Salmonella enterica enterica serovar Typhi
aacagccagaagc

SEQ ID NO: 3630468 - RNA, 14 nt, Salmonella enterica enterica serovar Typhi
aacagccagaagcc

SEQ ID NO: 3630469 - RNA, 15 nt, Salmonella enterica enterica serovar Typhi
aacagccagcagcgc

SEQ ID NO: 3630470 - RNA, 18 nt, Salmonella enterica enterica serovar Typhi
aacagccauuuuaaaaau

SEQ ID NO: 3630471 - RNA, 16 nt, Salmonella enterica enterica serovar Typhi
aacagcccgauaaaca

SEQ ID NO: 3630472 - RNA, 20 nt, Salmonella enterica enterica serovar Typhi
aacagcgaucacgccgucca

SEQ ID NO: 3630473 - RNA, 23 nt, Salmonella enterica enterica serovar Typhi
aacagcgaucacgccguccagca

SEQ ID NO: 3630474 - RNA, 16 nt, Salmonella enterica enterica serovar Typhi
aacagcgccaucagga

SEQ ID NO: 3630475 - RNA, 17 nt, Salmonella enterica enterica serovar Typhi
aacagcgccaucaggaa

SEQ ID NO: 3630476 - RNA, 17 nt, Salmonella enterica enterica serovar Typhi
aacagcgccggcagcag

SEQ ID NO: 3630477 - RNA, 20 nt, Salmonella enterica enterica serovar Typhi
aacagcgccggcagcaguuc

SEQ ID NO: 3630478 - RNA, 18 nt, Salmonella enterica enterica serovar Typhi
aacagcgcugguagcacc

SEQ ID NO: 3630479 - RNA, 16 nt, Salmonella enterica enterica serovar Typhi
aacagcggcaggcgga

SEQ ID NO: 3630480 - RNA, 21 nt, Salmonella enterica enterica serovar Typhi
aacagcgggguaaagccuuua

SEQ ID NO: 3630481 - RNA, 21 nt, Salmonella enterica enterica serovar Typhi
aacagcguaccuuuaucuuga

SEQ ID NO: 3630482 - RNA, 20 nt, Salmonella enterica enterica serovar Typhi
aacagcgucauccaguguua

SEQ ID NO: 3630483 - RNA, 20 nt, Salmonella enterica enterica serovar Typhi
aacaggccaaacccugcgcc

SEQ ID NO: 3630484 - RNA, 15 nt, Salmonella enterica enterica serovar Typhi
aacaggccugcggaa

SEQ ID NO: 3630485 - RNA, 19 nt, Salmonella enterica enterica serovar Typhi
aacaggcgcaggcauuaaa

SEQ ID NO: 3630486 - RNA, 23 nt, Salmonella enterica enterica serovar Typhi
aacaggcgcaggcauuaaaaaaa

SEQ ID NO: 3630487 - RNA, 23 nt, Salmonella enterica enterica serovar Typhi
aacaggcugcguaacgcgccgga

SEQ ID NO: 3630488 - RNA, 22 nt, Salmonella enterica enterica serovar Typhi
aacaggcugucugccaugccuu

SEQ ID NO: 3630489 - RNA, 15 nt, Salmonella enterica enterica serovar Typhi
aacaggcuucccaau

SEQ ID NO: 3630490 - RNA, 16 nt, Salmonella enterica enterica serovar Typhi
aacaggcuuuucaggc

SEQ ID NO: 3630491 - RNA, 18 nt, Salmonella enterica enterica serovar Typhi
aacagggggcgcaucacu

SEQ ID NO: 3630492 - RNA, 16 nt, Salmonella enterica enterica serovar Typhi
aacagggguuccggca

SEQ ID NO: 3630493 - RNA, 13 nt, Salmonella enterica enterica serovar Typhi
aaccaucggcaaa

SEQ ID NO: 3630494 - RNA, 21 nt, Salmonella enterica enterica serovar Typhi
aaccauucccguaaaagaaga

SEQ ID NO: 3630495 - RNA, 15 nt, Salmonella enterica enterica serovar Typhi
aaccauuuccucugc

SEQ ID NO: 3630496 - RNA, 16 nt, Salmonella enterica enterica serovar Typhi
aacccacaagaaaugc

SEQ ID NO: 3630497 - RNA, 15 nt, Salmonella enterica enterica serovar Typhi
aacccaccagcaggg

SEQ ID NO: 3630498 - RNA, 13 nt, Salmonella enterica enterica serovar Typhi
aacccaccagcgc

SEQ ID NO: 3630499 - RNA, 14 nt, Salmonella enterica enterica serovar Typhi
aacccaccagcgcc

SEQ ID NO: 3630500 - RNA, 19 nt, Salmonella enterica enterica serovar Typhi
aacccaccagcgccaggcc

SEQ ID NO: 3630501 - RNA, 15 nt, Salmonella enterica enterica serovar Typhi
aacccaccugccagu

SEQ ID NO: 3630502 - RNA, 17 nt, Salmonella enterica enterica serovar Typhi
aacccagauaucagucu

SEQ ID NO: 3630503 - RNA, 21 nt, Salmonella enterica enterica serovar Typhi
aacccagcaaaucgcccauca

SEQ ID NO: 3630504 - RNA, 15 nt, Salmonella enterica enterica serovar Typhi
aacccauauuccugc

SEQ ID NO: 3630505 - RNA, 19 nt, Salmonella enterica enterica serovar Typhi
aacccauauucgucuucau

SEQ ID NO: 3630506 - RNA, 15 nt, Salmonella enterica enterica serovar Typhi
aaccccaaacaccaa

SEQ ID NO: 3630507 - RNA, 15 nt, Salmonella enterica enterica serovar Typhi
aaccccaaaucagca

SEQ ID NO: 3630508 - RNA, 19 nt, Salmonella enterica enterica serovar Typhi
aaccccacccacugauaaa

SEQ ID NO: 3630509 - RNA, 16 nt, Salmonella enterica enterica serovar Typhi
aaccccagcugcggca

SEQ ID NO: 3630510 - RNA, 22 nt, Salmonella enterica enterica serovar Typhi
aaccccaggucagcaguuuuuc

SEQ ID NO: 3630511 - RNA, 15 nt, Salmonella enterica enterica serovar Typhi
aaccccaucccggca

SEQ ID NO: 3630512 - RNA, 16 nt, Salmonella enterica enterica serovar Typhi
aaccccgauaaaccag

SEQ ID NO: 3630513 - RNA, 17 nt, Salmonella enterica enterica serovar Typhi
aaccccugcccgcgauc

SEQ ID NO: 3630514 - RNA, 13 nt, Salmonella enterica enterica serovar Typhi
aaccccugcucgc

SEQ ID NO: 3630515 - RNA, 19 nt, Salmonella enterica enterica serovar Typhi
aacccgauaagcuuccgcc

SEQ ID NO: 3630516 - RNA, 16 nt, Salmonella enterica enterica serovar Typhi
aacccgaucgccaucc

SEQ ID NO: 3630517 - RNA, 21 nt, Salmonella enterica enterica serovar Typhi
aacccgaucgccauccugcac

SEQ ID NO: 3630518 - RNA, 23 nt, Salmonella enterica enterica serovar Typhi
aacccgaucgccauccugcaccg

SEQ ID NO: 3630519 - RNA, 16 nt, Salmonella enterica enterica serovar Typhi
aacccgauucugccag

SEQ ID NO: 3630520 - RNA, 15 nt, Salmonella enterica enterica serovar Typhi
aacccgccgccauca

SEQ ID NO: 3630521 - RNA, 17 nt, Salmonella enterica enterica serovar Typhi
aacccgccgccaucaac

SEQ ID NO: 3630522 - RNA, 15 nt, Salmonella enterica enterica serovar Typhi
aacccgccuucaguc

SEQ ID NO: 3630523 - RNA, 16 nt, Salmonella enterica enterica serovar Typhi
aacccgcuacgcguga

SEQ ID NO: 3630524 - RNA, 12 nt, Salmonella enterica enterica serovar Typhi
aacccggcauuu

SEQ ID NO: 3630525 - RNA, 14 nt, Salmonella enterica enterica serovar Typhi
aacccggcugccau

SEQ ID NO: 3630526 - RNA, 15 nt, Salmonella enterica enterica serovar Typhi
aacccucaucgguca

SEQ ID NO: 3630527 - RNA, 19 nt, Salmonella enterica enterica serovar Typhi
aacccucgaaugugaauuc

SEQ ID NO: 3630528 - RNA, 20 nt, Salmonella enterica enterica serovar Typhi
aacccugguuugcuggaaau

SEQ ID NO: 3630529 - RNA, 19 nt, Salmonella enterica enterica serovar Typhi
aaccgaaagaagaaaccau

SEQ ID NO: 3630530 - RNA, 21 nt, Salmonella enterica enterica serovar Typhi
aaccgaacaauaugcgcauca

SEQ ID NO: 3630531 - RNA, 16 nt, Salmonella enterica enterica serovar Typhi
aaccgacccaaaaaug

SEQ ID NO: 3630532 - RNA, 20 nt, Salmonella enterica enterica serovar Typhi
aaccgacggugcucaugaca

SEQ ID NO: 3630533 - RNA, 19 nt, Salmonella enterica enterica serovar Typhi
aaccgagguucaccagcgc

SEQ ID NO: 3630534 - RNA, 14 nt, Salmonella enterica enterica serovar Typhi
aaccgcaaaugcca

SEQ ID NO: 3630535 - RNA, 15 nt, Salmonella enterica enterica serovar Typhi
aaccgcaaaugccau

SEQ ID NO: 3630536 - RNA, 13 nt, Salmonella enterica enterica serovar Typhi
aaccgcagaaaaa

SEQ ID NO: 3630537 - RNA, 17 nt, Salmonella enterica enterica serovar Typhi
aaccgcagaaaaagccc

SEQ ID NO: 3630538 - RNA, 19 nt, Salmonella enterica enterica serovar Typhi
aaccgcagaaaaagccccc

SEQ ID NO: 3630539 - RNA, 14 nt, Salmonella enterica enterica serovar Typhi
aaccgccagucacc

SEQ ID NO: 3630540 - RNA, 17 nt, Salmonella enterica enterica serovar Typhi
aaccgccuccaggccgg

SEQ ID NO: 3630541 - RNA, 20 nt, Salmonella enterica enterica serovar Typhi
aaccgcgaucgaugugauaa

SEQ ID NO: 3630542 - RNA, 22 nt, Salmonella enterica enterica serovar Typhi
aaccgcgcggcguucugcgcca

SEQ ID NO: 3630543 - RNA, 14 nt, Salmonella enterica enterica serovar Typhi
aaccgcgcguaaau

SEQ ID NO: 3630544 - RNA, 23 nt, Salmonella enterica enterica serovar Typhi
aaccgcuaaugaggaaaaagccg

SEQ ID NO: 3630545 - RNA, 15 nt, Salmonella enterica enterica serovar Typhi
aaccgcuacccggca

SEQ ID NO: 3630546 - RNA, 15 nt, Salmonella enterica enterica serovar Typhi
aaccgcuuuuccugc

SEQ ID NO: 3630547 - RNA, 20 nt, Salmonella enterica enterica serovar Typhi
aaccggaccagcacaaaaaa

SEQ ID NO: 3630548 - RNA, 19 nt, Salmonella enterica enterica serovar Typhi
aaccggacgauuuaagcuu

SEQ ID NO: 3630549 - RNA, 16 nt, Salmonella enterica enterica serovar Typhi
aaccggcaaccaaagu

SEQ ID NO: 3630550 - RNA, 14 nt, Salmonella enterica enterica serovar Typhi
aaccggcaacucgc

SEQ ID NO: 3630551 - RNA, 15 nt, Salmonella enterica enterica serovar Typhi
aaccggcaugaagac

SEQ ID NO: 3630552 - RNA, 23 nt, Salmonella enterica enterica serovar Typhi
aaccggcgauguuggcgcccuga

SEQ ID NO: 3630553 - RNA, 20 nt, Salmonella enterica enterica serovar Typhi
aaccggucagguagcagacc

SEQ ID NO: 3630554 - RNA, 22 nt, Salmonella enterica enterica serovar Typhi
aaccgguggucaucgcggccag

SEQ ID NO: 3630555 - RNA, 22 nt, Salmonella enterica enterica serovar Typhi
aaccgguuugucauucgccuca

SEQ ID NO: 3630556 - RNA, 20 nt, Salmonella enterica enterica serovar Typhi
aaccguaaacgccugcacca

SEQ ID NO: 3630557 - RNA, 17 nt, Salmonella enterica enterica serovar Typhi
aaccguagauuuucauc

SEQ ID NO: 3630558 - RNA, 14 nt, Salmonella enterica enterica serovar Typhi
aaccguagcguugc

SEQ ID NO: 3630559 - RNA, 15 nt, Salmonella enterica enterica serovar Typhi
aaccguccacaucca

SEQ ID NO: 3630560 - RNA, 16 nt, Salmonella enterica enterica serovar Typhi
aaccguccacauccag

SEQ ID NO: 3630561 - RNA, 13 nt, Salmonella enterica enterica serovar Typhi
aaccgucggcaau

SEQ ID NO: 3630562 - RNA, 21 nt, Salmonella enterica enterica serovar Typhi
aaccgucggcgccggcgucga

SEQ ID NO: 3630563 - RNA, 21 nt, Salmonella enterica enterica serovar Typhi
aaccgucgggcgucgccugcc

SEQ ID NO: 3630564 - RNA, 15 nt, Salmonella enterica enterica serovar Typhi
aaccgugcuucacgg

SEQ ID NO: 3630565 - RNA, 17 nt, Salmonella enterica enterica serovar Typhi
aaccguggcaccccucu

SEQ ID NO: 3630566 - RNA, 17 nt, Salmonella enterica enterica serovar Typhi
aaccguggccuccggca

SEQ ID NO: 3630567 - RNA, 14 nt, Salmonella enterica enterica serovar Typhi
aaccguuaugaauc

SEQ ID NO: 3630568 - RNA, 22 nt, Salmonella enterica enterica serovar Typhi
aaccguucaucuaucgccagcg

SEQ ID NO: 3630569 - RNA, 16 nt, Salmonella enterica enterica serovar Typhi
aaccguugcgcccauc

SEQ ID NO: 3630570 - RNA, 17 nt, Salmonella enterica enterica serovar Typhi
aaccguugcgcccauca

SEQ ID NO: 3630571 - RNA, 16 nt, Salmonella enterica enterica serovar Typhi
aaccguuggggaaaau

SEQ ID NO: 3630572 - RNA, 17 nt, Salmonella enterica enterica serovar Typhi
aaccguuggggaaaaua

SEQ ID NO: 3630573 - RNA, 22 nt, Salmonella enterica enterica serovar Typhi
aaccguuuuaccuucugccgcg

SEQ ID NO: 3630574 - RNA, 13 nt, Salmonella enterica enterica serovar Typhi
aaccuaaccaaac

SEQ ID NO: 3630575 - RNA, 13 nt, Salmonella enterica enterica serovar Typhi
aaccuaucaggcg

SEQ ID NO: 3630576 - RNA, 15 nt, Salmonella enterica enterica serovar Typhi
aaccuauugaaaaua

SEQ ID NO: 3630577 - RNA, 22 nt, Salmonella enterica enterica serovar Typhi
aaccuauugaaaauaaaugaua

SEQ ID NO: 3630578 - RNA, 16 nt, Salmonella enterica enterica serovar Typhi
aaccuauuuugcaaaa

SEQ ID NO: 3630579 - RNA, 16 nt, Salmonella enterica enterica serovar Typhi
aacgccguuaccagca

SEQ ID NO: 3630580 - RNA, 13 nt, Salmonella enterica enterica serovar Typhi
aacgccuccaccg

SEQ ID NO: 3630581 - RNA, 23 nt, Salmonella enterica enterica serovar Typhi
aacgccuccauuuuggggaaaau

SEQ ID NO: 3630582 - RNA, 22 nt, Salmonella enterica enterica serovar Typhi
aacgccuccugccgaugccgcc

SEQ ID NO: 3630583 - RNA, 20 nt, Salmonella enterica enterica serovar Typhi
aacgccugauccggccuaca

SEQ ID NO: 3630584 - RNA, 19 nt, Salmonella enterica enterica serovar Typhi
aacgccugaugcugcgcau

SEQ ID NO: 3630585 - RNA, 13 nt, Salmonella enterica enterica serovar Typhi
aacgccugcacca

SEQ ID NO: 3630586 - RNA, 20 nt, Salmonella enterica enterica serovar Typhi
aacgccuuauccgaccuaca

SEQ ID NO: 3630587 - RNA, 15 nt, Salmonella enterica enterica serovar Typhi
aacgcgaaauaauca

SEQ ID NO: 3630588 - RNA, 14 nt, Salmonella enterica enterica serovar Typhi
aacgcgacaacgcc

SEQ ID NO: 3630589 - RNA, 14 nt, Salmonella enterica enterica serovar Typhi
aacgcgaccagcgc

SEQ ID NO: 3630590 - RNA, 23 nt, Salmonella enterica enterica serovar Typhi
aacgcgagaagaagaauuauuau

SEQ ID NO: 3630591 - RNA, 21 nt, Salmonella enterica enterica serovar Typhi
aacgcgccaaguaaauuugcu

SEQ ID NO: 3630592 - RNA, 16 nt, Salmonella enterica enterica serovar Typhi
aacgcgccacgcgcca

SEQ ID NO: 3630593 - RNA, 14 nt, Salmonella enterica enterica serovar Typhi
aacgcgccaucuuu

SEQ ID NO: 3630594 - RNA, 17 nt, Salmonella enterica enterica serovar Typhi
aacgcgcgacuuaucuu

SEQ ID NO: 3630595 - RNA, 20 nt, Salmonella enterica enterica serovar Typhi
aacgcggcuuuaaguuuuuc

SEQ ID NO: 3630596 - RNA, 20 nt, Salmonella enterica enterica serovar Typhi
aacgcguacggcuucaaucg

SEQ ID NO: 3630597 - RNA, 16 nt, Salmonella enterica enterica serovar Typhi
aacgcguccaacuggc

SEQ ID NO: 3630598 - RNA, 16 nt, Salmonella enterica enterica serovar Typhi
aacgcgucuucaucag

SEQ ID NO: 3630599 - RNA, 20 nt, Salmonella enterica enterica serovar Typhi
aacgcgucuucaucagccag

SEQ ID NO: 3630600 - RNA, 15 nt, Salmonella enterica enterica serovar Typhi
aacgcucuuaccgcu

SEQ ID NO: 3630601 - RNA, 20 nt, Salmonella enterica enterica serovar Typhi
aacgcucuuaccgcuaaaau

SEQ ID NO: 3630602 - RNA, 22 nt, Salmonella enterica enterica serovar Typhi
aacgcucuuaccgcuaaaauac

SEQ ID NO: 3630603 - RNA, 13 nt, Salmonella enterica enterica serovar Typhi
aacgcugcaaagu

SEQ ID NO: 3630604 - RNA, 14 nt, Salmonella enterica enterica serovar Typhi
aacgcugcgcaaca

SEQ ID NO: 3630605 - RNA, 17 nt, Salmonella enterica enterica serovar Typhi
aacgcugcgccgcgcca

SEQ ID NO: 3630606 - RNA, 14 nt, Salmonella enterica enterica serovar Typhi
aacgcugcgcuaca

SEQ ID NO: 3630607 - RNA, 22 nt, Salmonella enterica enterica serovar Typhi
aacgcuggccgcaaauccacug

SEQ ID NO: 3630608 - RNA, 18 nt, Salmonella enterica enterica serovar Typhi
aacgcuggugcugugccu

SEQ ID NO: 3630609 - RNA, 18 nt, Salmonella enterica enterica serovar Typhi
aacgcuguaccggcaggu

SEQ ID NO: 3630610 - RNA, 23 nt, Salmonella enterica enterica serovar Typhi
aacgcuguugccgcugcuggcgu

SEQ ID NO: 3630611 - RNA, 14 nt, Salmonella enterica enterica serovar Typhi
aacgcuuaaagcgu

SEQ ID NO: 3630612 - RNA, 15 nt, Salmonella enterica enterica serovar Typhi
aacgcuuauccggcc

SEQ ID NO: 3630613 - RNA, 21 nt, Salmonella enterica enterica serovar Typhi
aacgcuucacaaccugaaaga

SEQ ID NO: 3630614 - RNA, 20 nt, Salmonella enterica enterica serovar Typhi
aacgcuuuagugccgccauu

SEQ ID NO: 3630615 - RNA, 23 nt, Salmonella enterica enterica serovar Typhi
aacgcuuugcgauagcccggcau

SEQ ID NO: 3630616 - RNA, 13 nt, Salmonella enterica enterica serovar Typhi
aacggaaccaaau

SEQ ID NO: 3630617 - RNA, 22 nt, Salmonella enterica enterica serovar Typhi
aacggaccggcaaucgccugca

SEQ ID NO: 3630618 - RNA, 22 nt, Salmonella enterica enterica serovar Typhi
aacggaucaugguugaaaaaag

SEQ ID NO: 3630619 - RNA, 20 nt, Salmonella enterica enterica serovar Typhi
aacggaugcgccaucccaug

SEQ ID NO: 3630620 - RNA, 17 nt, Salmonella enterica enterica serovar Typhi
aacggauugugaaauuc

SEQ ID NO: 3630621 - RNA, 23 nt, Salmonella enterica enterica serovar Typhi
aacggcaaaucgcgguaaaaagc

SEQ ID NO: 3630622 - RNA, 20 nt, Salmonella enterica enterica serovar Typhi
aacggcaauuuuuacaaauu

SEQ ID NO: 3630623 - RNA, 15 nt, Salmonella enterica enterica serovar Typhi
aacggcaccagcaac

SEQ ID NO: 3630624 - RNA, 20 nt, Salmonella enterica enterica serovar Typhi
aacggcaccggaaccggcau

SEQ ID NO: 3630625 - RNA, 13 nt, Salmonella enterica enterica serovar Typhi
aacggcagccagc

SEQ ID NO: 3630626 - RNA, 12 nt, Salmonella enterica enterica serovar Typhi
aacggccagcaa

SEQ ID NO: 3630627 - RNA, 15 nt, Salmonella enterica enterica serovar Typhi
aacggccagcaaaau

SEQ ID NO: 3630628 - RNA, 12 nt, Salmonella enterica enterica serovar Typhi
aacggccagcgc

SEQ ID NO: 3630629 - RNA, 13 nt, Salmonella enterica enterica serovar Typhi
aacggcccggcgu

SEQ ID NO: 3630630 - RNA, 13 nt, Salmonella enterica enterica serovar Typhi
aacggcgagcuuu

SEQ ID NO: 3630631 - RNA, 19 nt, Salmonella enterica enterica serovar Typhi
aacggcgcguccagccagc

SEQ ID NO: 3630632 - RNA, 20 nt, Salmonella enterica enterica serovar Typhi
aacggcgcuggcguacgcau

SEQ ID NO: 3630633 - RNA, 14 nt, Salmonella enterica enterica serovar Typhi
aacggcguaccaga

SEQ ID NO: 3630634 - RNA, 12 nt, Salmonella enterica enterica serovar Typhi
aacggcucugca

SEQ ID NO: 3630635 - RNA, 17 nt, Salmonella enterica enterica serovar Typhi
aacggcugacgcccauc

SEQ ID NO: 3630636 - RNA, 18 nt, Salmonella enterica enterica serovar Typhi
aacggcugacgcccauca

SEQ ID NO: 3630637 - RNA, 17 nt, Salmonella enterica enterica serovar Typhi
aacggcuuuccagcagc

SEQ ID NO: 3630638 - RNA, 18 nt, Salmonella enterica enterica serovar Typhi
aacggcuuuccagcagcc

SEQ ID NO: 3630639 - RNA, 14 nt, Salmonella enterica enterica serovar Typhi
aacgggccacugcu

SEQ ID NO: 3630640 - RNA, 15 nt, Salmonella enterica enterica serovar Typhi
aacgggcccggcuuu

SEQ ID NO: 3630641 - RNA, 16 nt, Salmonella enterica enterica serovar Typhi
aacgguaaguugaaag

SEQ ID NO: 3630642 - RNA, 12 nt, Salmonella enterica enterica serovar Typhi
aacggucaggau

SEQ ID NO: 3630643 - RNA, 23 nt, Salmonella enterica enterica serovar Typhi
aacgguccagguucaucacuuuc

SEQ ID NO: 3630644 - RNA, 21 nt, Salmonella enterica enterica serovar Typhi
aacggucgguaaucgccugca

SEQ ID NO: 3630645 - RNA, 16 nt, Salmonella enterica enterica serovar Typhi
aacgguucauccagca

SEQ ID NO: 3630646 - RNA, 18 nt, Salmonella enterica enterica serovar Typhi
aacgguucauccagcagc

SEQ ID NO: 3630647 - RNA, 23 nt, Salmonella enterica enterica serovar Typhi
aacguaaagcuggccuucagguu

SEQ ID NO: 3630648 - RNA, 14 nt, Salmonella enterica enterica serovar Typhi
aacguaaauaccca

SEQ ID NO: 3630649 - RNA, 16 nt, Salmonella enterica enterica serovar Typhi
aacguaaauacccagg

SEQ ID NO: 3630650 - RNA, 19 nt, Salmonella enterica enterica serovar Typhi
aacguaaauacccaggcca

SEQ ID NO: 3630651 - RNA, 22 nt, Salmonella enterica enterica serovar Typhi
aacguaaauacccaggccauca

SEQ ID NO: 3630652 - RNA, 19 nt, Salmonella enterica enterica serovar Typhi
aacguaaucaucaugcugc

SEQ ID NO: 3630653 - RNA, 15 nt, Salmonella enterica enterica serovar Typhi
aacguaccugagaga

SEQ ID NO: 3630654 - RNA, 19 nt, Salmonella enterica enterica serovar Typhi
aacguagcccauugucauc

SEQ ID NO: 3630655 - RNA, 13 nt, Salmonella enterica enterica serovar Typhi
aacguagcgcguc

SEQ ID NO: 3630656 - RNA, 14 nt, Salmonella enterica enterica serovar Typhi
aacguagcgucauc

SEQ ID NO: 3630657 - RNA, 21 nt, Salmonella enterica enterica serovar Typhi
aacguaugugauuagcccacc

SEQ ID NO: 3630658 - RNA, 12 nt, Salmonella enterica enterica serovar Typhi
aacguauuauua

SEQ ID NO: 3630659 - RNA, 21 nt, Salmonella enterica enterica serovar Typhi
aacgucagcuggaaugcccac

SEQ ID NO: 3630660 - RNA, 18 nt, Salmonella enterica enterica serovar Typhi
aacgucaguggaaaacag

SEQ ID NO: 3630661 - RNA, 21 nt, Salmonella enterica enterica serovar Typhi
aacgucaguggaaaacagcau

SEQ ID NO: 3630662 - RNA, 23 nt, Salmonella enterica enterica serovar Typhi
aacgucauugcgaucuccuuuaa

SEQ ID NO: 3630663 - RNA, 15 nt, Salmonella enterica enterica serovar Typhi
aacguccagcggcca

SEQ ID NO: 3630664 - RNA, 12 nt, Salmonella enterica enterica serovar Typhi
aacgugcagaug

SEQ ID NO: 3630665 - RNA, 13 nt, Salmonella enterica enterica serovar Typhi
aacuggugaaaca

SEQ ID NO: 3630666 - RNA, 21 nt, Salmonella enterica enterica serovar Typhi
aacuguagaaugcuauaugca

SEQ ID NO: 3630667 - RNA, 15 nt, Salmonella enterica enterica serovar Typhi
aacuguauccguaau

SEQ ID NO: 3630668 - RNA, 23 nt, Salmonella enterica enterica serovar Typhi
aacuguauccguaauaugaugca

SEQ ID NO: 3630669 - RNA, 13 nt, Salmonella enterica enterica serovar Typhi
aacugucagauca

SEQ ID NO: 3630670 - RNA, 23 nt, Salmonella enterica enterica serovar Typhi
aacugucguauuuauuuucugaa

SEQ ID NO: 3630671 - RNA, 14 nt, Salmonella enterica enterica serovar Typhi
aacugucugaauca

SEQ ID NO: 3630672 - RNA, 18 nt, Salmonella enterica enterica serovar Typhi
aacugugcgacaaccugc

SEQ ID NO: 3630673 - RNA, 17 nt, Salmonella enterica enterica serovar Typhi
aacuguuaggccggaca

SEQ ID NO: 3630674 - RNA, 13 nt, Salmonella enterica enterica serovar Typhi
aacuguuaucaua

SEQ ID NO: 3630675 - RNA, 18 nt, Salmonella enterica enterica serovar Typhi
aacuguuaucauagacug

SEQ ID NO: 3630676 - RNA, 16 nt, Salmonella enterica enterica serovar Typhi
aacuguucagccagca

SEQ ID NO: 3630677 - RNA, 14 nt, Salmonella enterica enterica serovar Typhi
aacuguucagcggu

SEQ ID NO: 3630678 - RNA, 17 nt, Salmonella enterica enterica serovar Typhi
aacuuaaacgccggauu

SEQ ID NO: 3630679 - RNA, 18 nt, Salmonella enterica enterica serovar Typhi
aacuuaaauuaaugauua

SEQ ID NO: 3630680 - RNA, 18 nt, Salmonella enterica enterica serovar Typhi
aacuuacaagugucguga

SEQ ID NO: 3630681 - RNA, 23 nt, Salmonella enterica enterica serovar Typhi
aacuuaguguccacucgcucauu

SEQ ID NO: 3630682 - RNA, 15 nt, Salmonella enterica enterica serovar Typhi
aacuuauccgccauc

SEQ ID NO: 3630683 - RNA, 15 nt, Salmonella enterica enterica serovar Typhi
aacuuauugauuuuc

SEQ ID NO: 3630684 - RNA, 18 nt, Salmonella enterica enterica serovar Typhi
aacuuauuuuauuuuuau

SEQ ID NO: 3630685 - RNA, 24 nt, Salmonella enterica enterica serovar Typhi
aacuucacauuuuuaucagcuauu

SEQ ID NO: 3630686 - RNA, 22 nt, Salmonella enterica enterica serovar Typhi
aacuucacgccaucgacaaagg

SEQ ID NO: 3630687 - RNA, 18 nt, Salmonella enterica enterica serovar Typhi
aacuucaucguuacgcca

SEQ ID NO: 3630688 - RNA, 20 nt, Salmonella enterica enterica serovar Typhi
aacuucaugguacagaucca

SEQ ID NO: 3630689 - RNA, 16 nt, Salmonella enterica enterica serovar Typhi
aacuuccaccaccucc

SEQ ID NO: 3630690 - RNA, 22 nt, Salmonella enterica enterica serovar Typhi
aacuuccaccaccuccugcugg

SEQ ID NO: 3630691 - RNA, 16 nt, Salmonella enterica enterica serovar Typhi
aacuucgcgguuagaa

SEQ ID NO: 3630692 - RNA, 19 nt, Salmonella enterica enterica serovar Typhi
aacuucuccgccaucaguu

SEQ ID NO: 3630693 - RNA, 17 nt, Salmonella enterica enterica serovar Typhi
aacuucucgcaggccaa

SEQ ID NO: 3630694 - RNA, 13 nt, Salmonella enterica enterica serovar Typhi
aacuucugcaggg

SEQ ID NO: 3630695 - RNA, 20 nt, Salmonella enterica enterica serovar Typhi
aacuugacuuugcucuccuu

SEQ ID NO: 3630696 - RNA, 16 nt, Salmonella enterica enterica serovar Typhi
aacuugauuccuggcu

SEQ ID NO: 3630697 - RNA, 23 nt, Salmonella enterica enterica serovar Typhi
aacuugccguuuuucucaucaag

SEQ ID NO: 3630698 - RNA, 22 nt, Salmonella enterica enterica serovar Typhi
aacuuguaaaaaugccugugcc

SEQ ID NO: 3630699 - RNA, 16 nt, Salmonella enterica enterica serovar Typhi
aacuuuaacacuaacu

SEQ ID NO: 3630700 - RNA, 12 nt, Salmonella enterica enterica serovar Typhi
aacuuucagaau

SEQ ID NO: 3630701 - RNA, 12 nt, Salmonella enterica enterica serovar Typhi
aacuuucauuuc

SEQ ID NO: 3630702 - RNA, 16 nt, Salmonella enterica enterica serovar Typhi
aacuuucauuucacuu

SEQ ID NO: 3630703 - RNA, 11 nt, Salmonella enterica enterica serovar Typhi
aacuuuccaac

SEQ ID NO: 3630704 - RNA, 19 nt, Salmonella enterica enterica serovar Typhi
aacuuuccugccuucugaa

SEQ ID NO: 3630705 - RNA, 19 nt, Salmonella enterica enterica serovar Typhi
aacuuugcgccauuucaau

SEQ ID NO: 3630706 - RNA, 18 nt, Salmonella enterica enterica serovar Typhi
aacuuuuggugcccaucg

SEQ ID NO: 3630707 - RNA, 17 nt, Salmonella enterica enterica serovar Typhi
aacuuuuucuuaagcug

SEQ ID NO: 3630708 - RNA, 20 nt, Salmonella enterica enterica serovar Typhi
aagaaaaaacuuauuucuau

SEQ ID NO: 3630709 - RNA, 14 nt, Salmonella enterica enterica serovar Typhi
aagaaaaaagugau

SEQ ID NO: 3630710 - RNA, 12 nt, Salmonella enterica enterica serovar Typhi
aagaaaaagaag

SEQ ID NO: 3630711 - RNA, 13 nt, Salmonella enterica enterica serovar Typhi
aagaaaaagaagc

SEQ ID NO: 3630712 - RNA, 22 nt, Salmonella enterica enterica serovar Typhi
aagaaaaaggagccuuacggcu

SEQ ID NO: 3630713 - RNA, 20 nt, Salmonella enterica enterica serovar Typhi
aagaaaacuuucauuucacu

SEQ ID NO: 3630714 - RNA, 21 nt, Salmonella enterica enterica serovar Typhi
aagaaacaauccguuauuuca

SEQ ID NO: 3630715 - RNA, 12 nt, Salmonella enterica enterica serovar Typhi
aagaaaccauua

SEQ ID NO: 3630716 - RNA, 18 nt, Salmonella enterica enterica serovar Typhi
aagaaaccgcagaaaaag

SEQ ID NO: 3630717 - RNA, 15 nt, Salmonella enterica enterica serovar Typhi
aagaaacugugguua

SEQ ID NO: 3630718 - RNA, 19 nt, Salmonella enterica enterica serovar Typhi
aagaaagacgcugaaaagc

SEQ ID NO: 3630719 - RNA, 15 nt, Salmonella enterica enterica serovar Typhi
aagaaauguccauaa

SEQ ID NO: 3630720 - RNA, 22 nt, Salmonella enterica enterica serovar Typhi
aagaaauguccauaaauagauc

SEQ ID NO: 3630721 - RNA, 22 nt, Salmonella enterica enterica serovar Typhi
aagaaauuuugcacuguuuuua

SEQ ID NO: 3630722 - RNA, 14 nt, Salmonella enterica enterica serovar Typhi
aagaacagcgucgc

SEQ ID NO: 3630723 - RNA, 22 nt, Salmonella enterica enterica serovar Typhi
aagaacagggggcgcaucacug

SEQ ID NO: 3630724 - RNA, 16 nt, Salmonella enterica enterica serovar Typhi
aagaacgguuggaaua

SEQ ID NO: 3630725 - RNA, 20 nt, Salmonella enterica enterica serovar Typhi
aagaacuuaggauaauuccc

SEQ ID NO: 3630726 - RNA, 16 nt, Salmonella enterica enterica serovar Typhi
aagaagaaaccgcaga

SEQ ID NO: 3630727 - RNA, 12 nt, Salmonella enterica enterica serovar Typhi
aagaagaggcga

SEQ ID NO: 3630728 - RNA, 18 nt, Salmonella enterica enterica serovar Typhi
aagaagcacgacacaaaa

SEQ ID NO: 3630729 - RNA, 23 nt, Salmonella enterica enterica serovar Typhi
aagaaggguauagagcaggucaa

SEQ ID NO: 3630730 - RNA, 17 nt, Salmonella enterica enterica serovar Typhi
aagaagguuaauauaca

SEQ ID NO: 3630731 - RNA, 21 nt, Salmonella enterica enterica serovar Typhi
aagaagucugugagaaaagcg

SEQ ID NO: 3630732 - RNA, 13 nt, Salmonella enterica enterica serovar Typhi
aagaauacccuuu

SEQ ID NO: 3630733 - RNA, 16 nt, Salmonella enterica enterica serovar Typhi
aagaauagccugggca

SEQ ID NO: 3630734 - RNA, 21 nt, Salmonella enterica enterica serovar Typhi
aagaauagcgcuuuccugcgu

SEQ ID NO: 3630735 - RNA, 19 nt, Salmonella enterica enterica serovar Typhi
aagaaucgauguaguuguu

SEQ ID NO: 3630736 - RNA, 17 nt, Salmonella enterica enterica serovar Typhi
aagaaucgccagucgca

SEQ ID NO: 3630737 - RNA, 14 nt, Salmonella enterica enterica serovar Typhi
aagaaugaaaaaaa

SEQ ID NO: 3630738 - RNA, 17 nt, Salmonella enterica enterica serovar Typhi
aagaauguccaucucuu

SEQ ID NO: 3630739 - RNA, 17 nt, Salmonella enterica enterica serovar Typhi
aagaauuauuaccaaug

SEQ ID NO: 3630740 - RNA, 20 nt, Salmonella enterica enterica serovar Typhi
aagaauuauuaucaauuuca

SEQ ID NO: 3630741 - RNA, 14 nt, Salmonella enterica enterica serovar Typhi
aagaauuucaauca

SEQ ID NO: 3630742 - RNA, 20 nt, Salmonella enterica enterica serovar Typhi
aagaauuugaacucuuucag

SEQ ID NO: 3630743 - RNA, 19 nt, Salmonella enterica enterica serovar Typhi
aagacaaaagcuggugaaa

SEQ ID NO: 3630744 - RNA, 16 nt, Salmonella enterica enterica serovar Typhi
aagacaacguaaacgg

SEQ ID NO: 3630745 - RNA, 16 nt, Salmonella enterica enterica serovar Typhi
aagacaccccagccua

SEQ ID NO: 3630746 - RNA, 23 nt, Salmonella enterica enterica serovar Typhi
aagacagguuuacguagcagcgc

SEQ ID NO: 3630747 - RNA, 23 nt, Salmonella enterica enterica serovar Typhi
aagacauucacauauauuucugu

SEQ ID NO: 3630748 - RNA, 22 nt, Salmonella enterica enterica serovar Typhi
aagaccaauaaaacgcccccug

SEQ ID NO: 3630749 - RNA, 13 nt, Salmonella enterica enterica serovar Typhi
aagaccagauuaa

SEQ ID NO: 3630750 - RNA, 16 nt, Salmonella enterica enterica serovar Typhi
aagcauagcgucauca

SEQ ID NO: 3630751 - RNA, 19 nt, Salmonella enterica enterica serovar Typhi
aagcauagcgucaucaaca

SEQ ID NO: 3630752 - RNA, 18 nt, Salmonella enterica enterica serovar Typhi
aagcauggcguuaaugcg

SEQ ID NO: 3630753 - RNA, 20 nt, Salmonella enterica enterica serovar Typhi
aagcaugguuaacuccuucu

SEQ ID NO: 3630754 - RNA, 13 nt, Salmonella enterica enterica serovar Typhi
aagcauuagcgcc

SEQ ID NO: 3630755 - RNA, 13 nt, Salmonella enterica enterica serovar Typhi
aagccacacugca

SEQ ID NO: 3630756 - RNA, 13 nt, Salmonella enterica enterica serovar Typhi
aagccaccagauc

SEQ ID NO: 3630757 - RNA, 21 nt, Salmonella enterica enterica serovar Typhi
aagccacuugaaguaugaaag

SEQ ID NO: 3630758 - RNA, 17 nt, Salmonella enterica enterica serovar Typhi
aagccagacgcgcagca

SEQ ID NO: 3630759 - RNA, 20 nt, Salmonella enterica enterica serovar Typhi
aagccagcacggcuucacgu

SEQ ID NO: 3630760 - RNA, 19 nt, Salmonella enterica enterica serovar Typhi
aagccagccaaauagcgcc

SEQ ID NO: 3630761 - RNA, 15 nt, Salmonella enterica enterica serovar Typhi
aagccaggcuuuaaa

SEQ ID NO: 3630762 - RNA, 20 nt, Salmonella enterica enterica serovar Typhi
aagccagguugcgcccggcg

SEQ ID NO: 3630763 - RNA, 19 nt, Salmonella enterica enterica serovar Typhi
aagccauccaucuccggca

SEQ ID NO: 3630764 - RNA, 23 nt, Salmonella enterica enterica serovar Typhi
aagccaucuucgguaauacaauc

SEQ ID NO: 3630765 - RNA, 19 nt, Salmonella enterica enterica serovar Typhi
aagccauugccgcgacaaa

SEQ ID NO: 3630766 - RNA, 21 nt, Salmonella enterica enterica serovar Typhi
aagcccaccgcgaacauugga

SEQ ID NO: 3630767 - RNA, 12 nt, Salmonella enterica enterica serovar Typhi
aagcccacgccc

SEQ ID NO: 3630768 - RNA, 12 nt, Salmonella enterica enterica serovar Typhi
aagcccagcacg

SEQ ID NO: 3630769 - RNA, 16 nt, Salmonella enterica enterica serovar Typhi
aagcccaucagcgcca

SEQ ID NO: 3630770 - RNA, 12 nt, Salmonella enterica enterica serovar Typhi
aagcccauggca

SEQ ID NO: 3630771 - RNA, 18 nt, Salmonella enterica enterica serovar Typhi
aagccccccgcacagcac

SEQ ID NO: 3630772 - RNA, 21 nt, Salmonella enterica enterica serovar Typhi
aagccccccgcacagcacaua

SEQ ID NO: 3630773 - RNA, 23 nt, Salmonella enterica enterica serovar Typhi
aagccccuuccucgggaggggcu

SEQ ID NO: 3630774 - RNA, 23 nt, Salmonella enterica enterica serovar Typhi
aagcccgauaagcaagcgccauc

SEQ ID NO: 3630775 - RNA, 15 nt, Salmonella enterica enterica serovar Typhi
aagccgacccgcauc

SEQ ID NO: 3630776 - RNA, 15 nt, Salmonella enterica enterica serovar Typhi
aagccgaccuuauuc

SEQ ID NO: 3630777 - RNA, 17 nt, Salmonella enterica enterica serovar Typhi
aagccgcauuacaaaca

SEQ ID NO: 3630778 - RNA, 18 nt, Salmonella enterica enterica serovar Typhi
aagccgcauuacaaacag

SEQ ID NO: 3630779 - RNA, 19 nt, Salmonella enterica enterica serovar Typhi
aagccgcgucgcaccugcu

SEQ ID NO: 3630780 - RNA, 23 nt, Salmonella enterica enterica serovar Typhi
aagccggauagcguagcgccauc

SEQ ID NO: 3630781 - RNA, 19 nt, Salmonella enterica enterica serovar Typhi
aagccggcaggcagcgcca

SEQ ID NO: 3630782 - RNA, 22 nt, Salmonella enterica enterica serovar Typhi
aagccggcaggcagcgccagcg

SEQ ID NO: 3630783 - RNA, 16 nt, Salmonella enterica enterica serovar Typhi
aagccggcggaaaaaa

SEQ ID NO: 3630784 - RNA, 22 nt, Salmonella enterica enterica serovar Typhi
aagccgggucagcccccaguuu

SEQ ID NO: 3630785 - RNA, 22 nt, Salmonella enterica enterica serovar Typhi
aagccggucguaaugagcacuu

SEQ ID NO: 3630786 - RNA, 15 nt, Salmonella enterica enterica serovar Typhi
aagccgucggcgcca

SEQ ID NO: 3630787 - RNA, 16 nt, Salmonella enterica enterica serovar Typhi
aagccuacaccuuacu

SEQ ID NO: 3630788 - RNA, 19 nt, Salmonella enterica enterica serovar Typhi
aagccugauacuuuuacuc

SEQ ID NO: 3630789 - RNA, 14 nt, Salmonella enterica enterica serovar Typhi
aagccuggucaccu

SEQ ID NO: 3630790 - RNA, 16 nt, Salmonella enterica enterica serovar Typhi
aagccuugcugaauca

SEQ ID NO: 3630791 - RNA, 23 nt, Salmonella enterica enterica serovar Typhi
aagccuuucuguucuuugauuag

SEQ ID NO: 3630792 - RNA, 14 nt, Salmonella enterica enterica serovar Typhi
aagcgaaaauaaac

SEQ ID NO: 3630793 - RNA, 13 nt, Salmonella enterica enterica serovar Typhi
aagcgaagcgcca

SEQ ID NO: 3630794 - RNA, 22 nt, Salmonella enterica enterica serovar Typhi
aagcgaagcgucauccggcaau

SEQ ID NO: 3630795 - RNA, 20 nt, Salmonella enterica enterica serovar Typhi
aagcgaauaauuaacccaca

SEQ ID NO: 3630796 - RNA, 16 nt, Salmonella enterica enterica serovar Typhi
aagcgaauacucacuu

SEQ ID NO: 3630797 - RNA, 17 nt, Salmonella enterica enterica serovar Typhi
aagcgaauccagcgccg

SEQ ID NO: 3630798 - RNA, 23 nt, Salmonella enterica enterica serovar Typhi
aagcgauguauuuauccacgccg

SEQ ID NO: 3630799 - RNA, 17 nt, Salmonella enterica enterica serovar Typhi
aagcgcaaaauagcagc

SEQ ID NO: 3630800 - RNA, 13 nt, Salmonella enterica enterica serovar Typhi
aagcgcagcgcca

SEQ ID NO: 3630801 - RNA, 20 nt, Salmonella enterica enterica serovar Typhi
aagcgcagcgccauccggca

SEQ ID NO: 3630802 - RNA, 13 nt, Salmonella enterica enterica serovar Typhi
aagcgcaguguua

SEQ ID NO: 3630803 - RNA, 22 nt, Salmonella enterica enterica serovar Typhi
aagcgcauccagcucuuucaau

SEQ ID NO: 3630804 - RNA, 15 nt, Salmonella enterica enterica serovar Typhi
aagcgccaucaggca

SEQ ID NO: 3630805 - RNA, 15 nt, Salmonella enterica enterica serovar Typhi
aagcgcccgauaaua

SEQ ID NO: 3630806 - RNA, 15 nt, Salmonella enterica enterica serovar Typhi
aagcgcccguagcuc

SEQ ID NO: 3630807 - RNA, 12 nt, Salmonella enterica enterica serovar Typhi
aagcgccgcgau

SEQ ID NO: 3630808 - RNA, 14 nt, Salmonella enterica enterica serovar Typhi
aagcgccugcugcg

SEQ ID NO: 3630809 - RNA, 19 nt, Salmonella enterica enterica serovar Typhi
aagcgccugcugcgcaaca

SEQ ID NO: 3630810 - RNA, 16 nt, Salmonella enterica enterica serovar Typhi
aagcgccuguucaaca

SEQ ID NO: 3630811 - RNA, 15 nt, Salmonella enterica enterica serovar Typhi
aagcgcgccgaaaau

SEQ ID NO: 3630812 - RNA, 12 nt, Salmonella enterica enterica serovar Typhi
aagcgcgggcug

SEQ ID NO: 3630813 - RNA, 14 nt, Salmonella enterica enterica serovar Typhi
aagcgcuagcgcca

SEQ ID NO: 3630814 - RNA, 15 nt, Salmonella enterica enterica serovar Typhi
aagcgcuggcuggcg

SEQ ID NO: 3630815 - RNA, 18 nt, Salmonella enterica enterica serovar Typhi
aagcgcuuuggucaggcu

SEQ ID NO: 3630816 - RNA, 16 nt, Salmonella enterica enterica serovar Typhi
aagcggaccaaugcug

SEQ ID NO: 3630817 - RNA, 20 nt, Salmonella enterica enterica serovar Typhi
aagcggaccaaugcuggcag

SEQ ID NO: 3630818 - RNA, 17 nt, Salmonella enterica enterica serovar Typhi
aagcggacugccuaacu

SEQ ID NO: 3630819 - RNA, 14 nt, Salmonella enterica enterica serovar Typhi
aagcggcagacgug

SEQ ID NO: 3630820 - RNA, 14 nt, Salmonella enterica enterica serovar Typhi
aagcggcagcgcca

SEQ ID NO: 3630821 - RNA, 21 nt, Salmonella enterica enterica serovar Typhi
aagcggcagcgccauccggca

SEQ ID NO: 3630822 - RNA, 20 nt, Salmonella enterica enterica serovar Typhi
aagcggcgucacguucgucg

SEQ ID NO: 3630823 - RNA, 16 nt, Salmonella enterica enterica serovar Typhi
aagcggcugucaucaa

SEQ ID NO: 3630824 - RNA, 13 nt, Salmonella enterica enterica serovar Typhi
aagcgguaaaucg

SEQ ID NO: 3630825 - RNA, 19 nt, Salmonella enterica enterica serovar Typhi
aagcgguaaggcaccgguu

SEQ ID NO: 3630826 - RNA, 15 nt, Salmonella enterica enterica serovar Typhi
aagcgguuaucggca

SEQ ID NO: 3630827 - RNA, 16 nt, Salmonella enterica enterica serovar Typhi
aagcguaacagcgcua

SEQ ID NO: 3630828 - RNA, 16 nt, Salmonella enterica enterica serovar Typhi
aagcguagcgccauca

SEQ ID NO: 3630829 - RNA, 20 nt, Salmonella enterica enterica serovar Typhi
aagcguagcgccaucaggca

SEQ ID NO: 3630830 - RNA, 20 nt, Salmonella enterica enterica serovar Typhi
aagcguagcgccauccggca

SEQ ID NO: 3630831 - RNA, 15 nt, Salmonella enterica enterica serovar Typhi
aagcgucagcauggu

SEQ ID NO: 3630832 - RNA, 15 nt, Salmonella enterica enterica serovar Typhi
aagcgucaggcgaag

SEQ ID NO: 3630833 - RNA, 13 nt, Salmonella enterica enterica serovar Typhi
aagcgucaguaaa

SEQ ID NO: 3630834 - RNA, 18 nt, Salmonella enterica enterica serovar Typhi
aagcgucaguaaaagccc

SEQ ID NO: 3630835 - RNA, 19 nt, Salmonella enterica enterica serovar Typhi
aagcgucaguaaaagcccg

SEQ ID NO: 3630836 - RNA, 17 nt, Salmonella enterica enterica serovar Typhi
aaggcgcuagccgcauc

SEQ ID NO: 3630837 - RNA, 17 nt, Salmonella enterica enterica serovar Typhi
aaggcgcuugcgccauc

SEQ ID NO: 3630838 - RNA, 21 nt, Salmonella enterica enterica serovar Typhi
aaggcgcuugcgccaucaucc

SEQ ID NO: 3630839 - RNA, 23 nt, Salmonella enterica enterica serovar Typhi
aaggcggacaacgcauauuauga

SEQ ID NO: 3630840 - RNA, 15 nt, Salmonella enterica enterica serovar Typhi
aaggcggcaaagaua

SEQ ID NO: 3630841 - RNA, 16 nt, Salmonella enterica enterica serovar Typhi
aaggcggcaaagauaa

SEQ ID NO: 3630842 - RNA, 17 nt, Salmonella enterica enterica serovar Typhi
aaggcggcaaagauaau

SEQ ID NO: 3630843 - RNA, 17 nt, Salmonella enterica enterica serovar Typhi
aaggcguaaccgccauc

SEQ ID NO: 3630844 - RNA, 22 nt, Salmonella enterica enterica serovar Typhi
aaggcguaugaaugaaacaguc

SEQ ID NO: 3630845 - RNA, 15 nt, Salmonella enterica enterica serovar Typhi
aaggcguucacaccg

SEQ ID NO: 3630846 - RNA, 20 nt, Salmonella enterica enterica serovar Typhi
aaggcguucacgccgccauc

SEQ ID NO: 3630847 - RNA, 17 nt, Salmonella enterica enterica serovar Typhi
aaggcguugaugaaggu

SEQ ID NO: 3630848 - RNA, 23 nt, Salmonella enterica enterica serovar Typhi
aaggcuaccgcugggaugaccug

SEQ ID NO: 3630849 - RNA, 19 nt, Salmonella enterica enterica serovar Typhi
aaggcuaccgggcaaacau

SEQ ID NO: 3630850 - RNA, 14 nt, Salmonella enterica enterica serovar Typhi
aaggcuccauauca

SEQ ID NO: 3630851 - RNA, 15 nt, Salmonella enterica enterica serovar Typhi
aaggcucucuuacca

SEQ ID NO: 3630852 - RNA, 14 nt, Salmonella enterica enterica serovar Typhi
aagggaaaagccau

SEQ ID NO: 3630853 - RNA, 22 nt, Salmonella enterica enterica serovar Typhi
aagggaagaucauuaucaauag

SEQ ID NO: 3630854 - RNA, 20 nt, Salmonella enterica enterica serovar Typhi
aagggauaagaaagauaaaa

SEQ ID NO: 3630855 - RNA, 15 nt, Salmonella enterica enterica serovar Typhi
aagggcaauaucaug

SEQ ID NO: 3630856 - RNA, 15 nt, Salmonella enterica enterica serovar Typhi
aagggcaccugggca

SEQ ID NO: 3630857 - RNA, 12 nt, Salmonella enterica enterica serovar Typhi
aagggcgcugcc

SEQ ID NO: 3630858 - RNA, 14 nt, Salmonella enterica enterica serovar Typhi
aagggcgcugccag

SEQ ID NO: 3630859 - RNA, 22 nt, Salmonella enterica enterica serovar Typhi
aaggggcaggcgucaaaacagg

SEQ ID NO: 3630860 - RNA, 15 nt, Salmonella enterica enterica serovar Typhi
aaggggccguagaaa

SEQ ID NO: 3630861 - RNA, 13 nt, Salmonella enterica enterica serovar Typhi
aaggguaagcaau

SEQ ID NO: 3630862 - RNA, 16 nt, Salmonella enterica enterica serovar Typhi
aagggugcccgccugg

SEQ ID NO: 3630863 - RNA, 23 nt, Salmonella enterica enterica serovar Typhi
aagguaaacgcgaccagcgcgcc

SEQ ID NO: 3630864 - RNA, 17 nt, Salmonella enterica enterica serovar Typhi
aagguaacgcgaaaaaa

SEQ ID NO: 3630865 - RNA, 11 nt, Salmonella enterica enterica serovar Typhi
aagguaacuau

SEQ ID NO: 3630866 - RNA, 13 nt, Salmonella enterica enterica serovar Typhi
aagguauguuugu

SEQ ID NO: 3630867 - RNA, 15 nt, Salmonella enterica enterica serovar Typhi
aagguauugauuuuu

SEQ ID NO: 3630868 - RNA, 17 nt, Salmonella enterica enterica serovar Typhi
aagguauugauuuuuaa

SEQ ID NO: 3630869 - RNA, 17 nt, Salmonella enterica enterica serovar Typhi
aaggucaaacaccugaa

SEQ ID NO: 3630870 - RNA, 12 nt, Salmonella enterica enterica serovar Typhi
aaggucacgccg

SEQ ID NO: 3630871 - RNA, 17 nt, Salmonella enterica enterica serovar Typhi
aaggucacuacgcggcu

SEQ ID NO: 3630872 - RNA, 21 nt, Salmonella enterica enterica serovar Typhi
aaggucagguuaugcgcgcca

SEQ ID NO: 3630873 - RNA, 11 nt, Salmonella enterica enterica serovar Typhi
aaggucgauau

SEQ ID NO: 3630874 - RNA, 20 nt, Salmonella enterica enterica serovar Typhi
aaggucgcauccgcguuagc

SEQ ID NO: 3630875 - RNA, 13 nt, Salmonella enterica enterica serovar Typhi
aaggugagaaaaa

SEQ ID NO: 3630876 - RNA, 14 nt, Salmonella enterica enterica serovar Typhi
aaggugagaaaaag

SEQ ID NO: 3630877 - RNA, 19 nt, Salmonella enterica enterica serovar Typhi
aaggugagcauugcgcuca

SEQ ID NO: 3630878 - RNA, 14 nt, Salmonella enterica enterica serovar Typhi
aaggugagcucuuu

SEQ ID NO: 3630879 - RNA, 20 nt, Salmonella enterica enterica serovar Typhi
aagguguuuacgccgccauc

SEQ ID NO: 3630880 - RNA, 14 nt, Salmonella enterica enterica serovar Typhi
aagguuauccgccg

SEQ ID NO: 3630881 - RNA, 16 nt, Salmonella enterica enterica serovar Typhi
aagguucccugcgcca

SEQ ID NO: 3630882 - RNA, 21 nt, Salmonella enterica enterica serovar Typhi
aagguucuggcauuggcaucu

SEQ ID NO: 3630883 - RNA, 13 nt, Salmonella enterica enterica serovar Typhi
aagguugccgcaa

SEQ ID NO: 3630884 - RNA, 13 nt, Salmonella enterica enterica serovar Typhi
aagguuuuucccg

SEQ ID NO: 3630885 - RNA, 15 nt, Salmonella enterica enterica serovar Typhi
aaguaaaaugcccug

SEQ ID NO: 3630886 - RNA, 14 nt, Salmonella enterica enterica serovar Typhi
aaguaagcgccagc

SEQ ID NO: 3630887 - RNA, 13 nt, Salmonella enterica enterica serovar Typhi
aaguaauaaaaua

SEQ ID NO: 3630888 - RNA, 22 nt, Salmonella enterica enterica serovar Typhi
aaguaccagcgcgaacauuaca

SEQ ID NO: 3630889 - RNA, 15 nt, Salmonella enterica enterica serovar Typhi
aaguagcagagaaaa

SEQ ID NO: 3630890 - RNA, 17 nt, Salmonella enterica enterica serovar Typhi
aaguauaguggcgacaa

SEQ ID NO: 3630891 - RNA, 17 nt, Salmonella enterica enterica serovar Typhi
aaguaucagcgcgcuuu

SEQ ID NO: 3630892 - RNA, 19 nt, Salmonella enterica enterica serovar Typhi
aaguaugccgcacaaaauu

SEQ ID NO: 3630893 - RNA, 18 nt, Salmonella enterica enterica serovar Typhi
aaguauucgaugguguua

SEQ ID NO: 3630894 - RNA, 21 nt, Salmonella enterica enterica serovar Typhi
aagucaacugcucuaccaacu

SEQ ID NO: 3630895 - RNA, 17 nt, Salmonella enterica enterica serovar Typhi
aagucauccagacuaac

SEQ ID NO: 3630896 - RNA, 14 nt, Salmonella enterica enterica serovar Typhi
aagucaucugccag

SEQ ID NO: 3630897 - RNA, 18 nt, Salmonella enterica enterica serovar Typhi
aagucaucugccaguuau

SEQ ID NO: 3630898 - RNA, 19 nt, Salmonella enterica enterica serovar Typhi
aagucaucuguucaacuuu

SEQ ID NO: 3630899 - RNA, 20 nt, Salmonella enterica enterica serovar Typhi
aagucaucuguucaacuuuu

SEQ ID NO: 3630900 - RNA, 15 nt, Salmonella enterica enterica serovar Typhi
aagucccagaaagua

SEQ ID NO: 3630901 - RNA, 13 nt, Salmonella enterica enterica serovar Typhi
aaguccuucuccu

SEQ ID NO: 3630902 - RNA, 23 nt, Salmonella enterica enterica serovar Typhi
aaguccuucuccuucgccaaaau

SEQ ID NO: 3630903 - RNA, 16 nt, Salmonella enterica enterica serovar Typhi
aaguccuucuuccccc

SEQ ID NO: 3630904 - RNA, 17 nt, Salmonella enterica enterica serovar Typhi
aaguccuucuucccccu

SEQ ID NO: 3630905 - RNA, 20 nt, Salmonella enterica enterica serovar Typhi
aagucgaaauuuucuucuuc

SEQ ID NO: 3630906 - RNA, 20 nt, Salmonella enterica enterica serovar Typhi
aagucgcaauauaaauauca

SEQ ID NO: 3630907 - RNA, 18 nt, Salmonella enterica enterica serovar Typhi
aagucgccacccggcuuu

SEQ ID NO: 3630908 - RNA, 17 nt, Salmonella enterica enterica serovar Typhi
aagucgggaaagggcgg

SEQ ID NO: 3630909 - RNA, 15 nt, Salmonella enterica enterica serovar Typhi
aagucugugagaaaa

SEQ ID NO: 3630910 - RNA, 21 nt, Salmonella enterica enterica serovar Typhi
aagucugugagaaaagcgaaa

SEQ ID NO: 3630911 - RNA, 21 nt, Salmonella enterica enterica serovar Typhi
aagugaagaaucuguauaaaa

SEQ ID NO: 3630912 - RNA, 22 nt, Salmonella enterica enterica serovar Typhi
aagugaguaaacgcucaagcaa

SEQ ID NO: 3630913 - RNA, 23 nt, Salmonella enterica enterica serovar Typhi
aagugauacaugcuacaggcaag

SEQ ID NO: 3630914 - RNA, 21 nt, Salmonella enterica enterica serovar Typhi
aagugauacggcgugaucacu

SEQ ID NO: 3630915 - RNA, 18 nt, Salmonella enterica enterica serovar Typhi
aagugcagaagcaauccu

SEQ ID NO: 3630916 - RNA, 21 nt, Salmonella enterica enterica serovar Typhi
aagugcauguaaauaaggcug

SEQ ID NO: 3630917 - RNA, 18 nt, Salmonella enterica enterica serovar Typhi
aagugcgaaauuuaauau

SEQ ID NO: 3630918 - RNA, 22 nt, Salmonella enterica enterica serovar Typhi
aaguuaaucagcgccgucgcca

SEQ ID NO: 3630919 - RNA, 20 nt, Salmonella enterica enterica serovar Typhi
aaguuagccccuuaucaaag

SEQ ID NO: 3630920 - RNA, 16 nt, Salmonella enterica enterica serovar Typhi
aaguuauccagcgccc

SEQ ID NO: 3630921 - RNA, 18 nt, Salmonella enterica enterica serovar Typhi
aaguuaucccugcugagu

SEQ ID NO: 3630922 - RNA, 18 nt, Salmonella enterica enterica serovar Typhi
aauaauguaaaaaaauaa

SEQ ID NO: 3630923 - RNA, 15 nt, Salmonella enterica enterica serovar Typhi
aauaauuaacccaca

SEQ ID NO: 3630924 - RNA, 15 nt, Salmonella enterica enterica serovar Typhi
aauaauugagcgcaa

SEQ ID NO: 3630925 - RNA, 14 nt, Salmonella enterica enterica serovar Typhi
aauaauuuuguuaa

SEQ ID NO: 3630926 - RNA, 24 nt, Salmonella enterica enterica serovar Typhi
aauacaauccgccgcaauagccaa

SEQ ID NO: 3630927 - RNA, 15 nt, Salmonella enterica enterica serovar Typhi
aauacaauucaacuc

SEQ ID NO: 3630928 - RNA, 16 nt, Salmonella enterica enterica serovar Typhi
aauacaauucaacuca

SEQ ID NO: 3630929 - RNA, 18 nt, Salmonella enterica enterica serovar Typhi
aauacaauucaacucacu

SEQ ID NO: 3630930 - RNA, 17 nt, Salmonella enterica enterica serovar Typhi
aauacacgauaaaccuc

SEQ ID NO: 3630931 - RNA, 20 nt, Salmonella enterica enterica serovar Typhi
aauacacgguaaauucuuua

SEQ ID NO: 3630932 - RNA, 21 nt, Salmonella enterica enterica serovar Typhi
aauacaggguuugucagcaua

SEQ ID NO: 3630933 - RNA, 23 nt, Salmonella enterica enterica serovar Typhi
aauacaucaacaaagggcaccug

SEQ ID NO: 3630934 - RNA, 22 nt, Salmonella enterica enterica serovar Typhi
aauaccaaagcccgcaaacaga

SEQ ID NO: 3630935 - RNA, 13 nt, Salmonella enterica enterica serovar Typhi
aauaccacaaauu

SEQ ID NO: 3630936 - RNA, 20 nt, Salmonella enterica enterica serovar Typhi
aauaccacaaauuuugauaa

SEQ ID NO: 3630937 - RNA, 15 nt, Salmonella enterica enterica serovar Typhi
aauaccacaucagac

SEQ ID NO: 3630938 - RNA, 21 nt, Salmonella enterica enterica serovar Typhi
aauaccacuucggcagaaaaa

SEQ ID NO: 3630939 - RNA, 14 nt, Salmonella enterica enterica serovar Typhi
aauaccagcggcaa

SEQ ID NO: 3630940 - RNA, 18 nt, Salmonella enterica enterica serovar Typhi
aauaccagcguaauccuc

SEQ ID NO: 3630941 - RNA, 16 nt, Salmonella enterica enterica serovar Typhi
aauaccaggcacuuga

SEQ ID NO: 3630942 - RNA, 19 nt, Salmonella enterica enterica serovar Typhi
aauaccaggcggcuuuuuc

SEQ ID NO: 3630943 - RNA, 18 nt, Salmonella enterica enterica serovar Typhi
aauacccgacucuuuuuu

SEQ ID NO: 3630944 - RNA, 19 nt, Salmonella enterica enterica serovar Typhi
aauacccgacucuuuuuuc

SEQ ID NO: 3630945 - RNA, 14 nt, Salmonella enterica enterica serovar Typhi
aauacccuucacgg

SEQ ID NO: 3630946 - RNA, 16 nt, Salmonella enterica enterica serovar Typhi
aauaccgaaauccgcu

SEQ ID NO: 3630947 - RNA, 11 nt, Salmonella enterica enterica serovar Typhi
aauaccgccca

SEQ ID NO: 3630948 - RNA, 13 nt, Salmonella enterica enterica serovar Typhi
aauaccgcccauc

SEQ ID NO: 3630949 - RNA, 16 nt, Salmonella enterica enterica serovar Typhi
aauaccggauaugcau

SEQ ID NO: 3630950 - RNA, 13 nt, Salmonella enterica enterica serovar Typhi
aauaccggcauca

SEQ ID NO: 3630951 - RNA, 17 nt, Salmonella enterica enterica serovar Typhi
aauaccgguuauccaua

SEQ ID NO: 3630952 - RNA, 20 nt, Salmonella enterica enterica serovar Typhi
aauaccgguuauccauauga

SEQ ID NO: 3630953 - RNA, 17 nt, Salmonella enterica enterica serovar Typhi
aauaccguaagaccaga

SEQ ID NO: 3630954 - RNA, 18 nt, Salmonella enterica enterica serovar Typhi
aauaccgugcacgcugcg

SEQ ID NO: 3630955 - RNA, 14 nt, Salmonella enterica enterica serovar Typhi
aauaccgugcagga

SEQ ID NO: 3630956 - RNA, 18 nt, Salmonella enterica enterica serovar Typhi
aauaccucaaaugcugaa

SEQ ID NO: 3630957 - RNA, 22 nt, Salmonella enterica enterica serovar Typhi
aauaccuccuggcguuaucauc

SEQ ID NO: 3630958 - RNA, 19 nt, Salmonella enterica enterica serovar Typhi
aauaccugccugucacgca

SEQ ID NO: 3630959 - RNA, 15 nt, Salmonella enterica enterica serovar Typhi
aauaccuggaauauc

SEQ ID NO: 3630960 - RNA, 19 nt, Salmonella enterica enterica serovar Typhi
aauaccuuaguaaaaccga

SEQ ID NO: 3630961 - RNA, 14 nt, Salmonella enterica enterica serovar Typhi
aauacgaaaauccu

SEQ ID NO: 3630962 - RNA, 19 nt, Salmonella enterica enterica serovar Typhi
aauacgaaauugagaauua

SEQ ID NO: 3630963 - RNA, 20 nt, Salmonella enterica enterica serovar Typhi
aauacgagugacauuauuca

SEQ ID NO: 3630964 - RNA, 18 nt, Salmonella enterica enterica serovar Typhi
aauacgcaagccgaacuc

SEQ ID NO: 3630965 - RNA, 18 nt, Salmonella enterica enterica serovar Typhi
aauacgccgccagcaaua

SEQ ID NO: 3630966 - RNA, 12 nt, Salmonella enterica enterica serovar Typhi
aauacgcggcac

SEQ ID NO: 3630967 - RNA, 20 nt, Salmonella enterica enterica serovar Typhi
aauacgcuccagcuggcugg

SEQ ID NO: 3630968 - RNA, 17 nt, Salmonella enterica enterica serovar Typhi
aauacgcuguagcuggc

SEQ ID NO: 3630969 - RNA, 21 nt, Salmonella enterica enterica serovar Typhi
aauacgggcuuaaucaguucg

SEQ ID NO: 3630970 - RNA, 24 nt, Salmonella enterica enterica serovar Typhi
aauacgguuagccagugggcguca

SEQ ID NO: 3630971 - RNA, 23 nt, Salmonella enterica enterica serovar Typhi
aauacguaauaccugaagcccuu

SEQ ID NO: 3630972 - RNA, 20 nt, Salmonella enterica enterica serovar Typhi
aauacgucucgaguaaucac

SEQ ID NO: 3630973 - RNA, 18 nt, Salmonella enterica enterica serovar Typhi
aauacguuuauucuuuuc

SEQ ID NO: 3630974 - RNA, 19 nt, Salmonella enterica enterica serovar Typhi
aauacucccggcgcuggac

SEQ ID NO: 3630975 - RNA, 21 nt, Salmonella enterica enterica serovar Typhi
aauacuccugcaacagaagag

SEQ ID NO: 3630976 - RNA, 20 nt, Salmonella enterica enterica serovar Typhi
aauacugaagucgaaauuuu

SEQ ID NO: 3630977 - RNA, 12 nt, Salmonella enterica enterica serovar Typhi
aauacugauaaa

SEQ ID NO: 3630978 - RNA, 21 nt, Salmonella enterica enterica serovar Typhi
aauacugcaacggcgaggugc

SEQ ID NO: 3630979 - RNA, 23 nt, Salmonella enterica enterica serovar Typhi
aauacugcacgccgcguuuuagc

SEQ ID NO: 3630980 - RNA, 16 nt, Salmonella enterica enterica serovar Typhi
aauacuggaaaaaacg

SEQ ID NO: 3630981 - RNA, 19 nt, Salmonella enterica enterica serovar Typhi
aauacuggaccccagauaa

SEQ ID NO: 3630982 - RNA, 15 nt, Salmonella enterica enterica serovar Typhi
aauagaacccaaagc

SEQ ID NO: 3630983 - RNA, 14 nt, Salmonella enterica enterica serovar Typhi
aauagaacgcucgc

SEQ ID NO: 3630984 - RNA, 16 nt, Salmonella enterica enterica serovar Typhi
aauagaacgucgcgcg

SEQ ID NO: 3630985 - RNA, 18 nt, Salmonella enterica enterica serovar Typhi
aauagaauaggaaauaau

SEQ ID NO: 3630986 - RNA, 19 nt, Salmonella enterica enterica serovar Typhi
aauagacgagcgaaaaacu

SEQ ID NO: 3630987 - RNA, 13 nt, Salmonella enterica enterica serovar Typhi
aauagagaaaaua

SEQ ID NO: 3630988 - RNA, 14 nt, Salmonella enterica enterica serovar Typhi
aauagagaaaauaa

SEQ ID NO: 3630989 - RNA, 18 nt, Salmonella enterica enterica serovar Typhi
aauagagaaaauaacaau

SEQ ID NO: 3630990 - RNA, 17 nt, Salmonella enterica enterica serovar Typhi
aauagagagaaucgggu

SEQ ID NO: 3630991 - RNA, 14 nt, Salmonella enterica enterica serovar Typhi
aauagaguaaugac

SEQ ID NO: 3630992 - RNA, 15 nt, Salmonella enterica enterica serovar Typhi
aauagaguaaugaca

SEQ ID NO: 3630993 - RNA, 16 nt, Salmonella enterica enterica serovar Typhi
aauagaguaaugacaa

SEQ ID NO: 3630994 - RNA, 20 nt, Salmonella enterica enterica serovar Typhi
aauagagugcgauuugacau

SEQ ID NO: 3630995 - RNA, 18 nt, Salmonella enterica enterica serovar Typhi
aauagauaugaaagaagg

SEQ ID NO: 3630996 - RNA, 18 nt, Salmonella enterica enterica serovar Typhi
aauagcaauuauauugcg

SEQ ID NO: 3630997 - RNA, 18 nt, Salmonella enterica enterica serovar Typhi
aauagcacaucagccaac

SEQ ID NO: 3630998 - RNA, 20 nt, Salmonella enterica enterica serovar Typhi
aauagccagaaugccagcgc

SEQ ID NO: 3630999 - RNA, 13 nt, Salmonella enterica enterica serovar Typhi
aauagccagcccc

SEQ ID NO: 3631000 - RNA, 15 nt, Salmonella enterica enterica serovar Typhi
aauagccagccccag

SEQ ID NO: 3631001 - RNA, 22 nt, Salmonella enterica enterica serovar Typhi
aauagccccucaauuauguauu

SEQ ID NO: 3631002 - RNA, 13 nt, Salmonella enterica enterica serovar Typhi
aauagccugggca

SEQ ID NO: 3631003 - RNA, 19 nt, Salmonella enterica enterica serovar Typhi
aauagccugggcaaggcug

SEQ ID NO: 3631004 - RNA, 19 nt, Salmonella enterica enterica serovar Typhi
aauagcgccacgcgaugca

SEQ ID NO: 3631005 - RNA, 14 nt, Salmonella enterica enterica serovar Typhi
aauagcgccagaca

SEQ ID NO: 3631006 - RNA, 22 nt, Salmonella enterica enterica serovar Typhi
aauagcgcuacauccgccagcc

SEQ ID NO: 3631007 - RNA, 17 nt, Salmonella enterica enterica serovar Typhi
aaucacaaaauggcuga

SEQ ID NO: 3631008 - RNA, 16 nt, Salmonella enterica enterica serovar Typhi
aaucacauacagcacu

SEQ ID NO: 3631009 - RNA, 20 nt, Salmonella enterica enterica serovar Typhi
aaucacauacagcacuuccc

SEQ ID NO: 3631010 - RNA, 12 nt, Salmonella enterica enterica serovar Typhi
aaucacaucgcc

SEQ ID NO: 3631011 - RNA, 14 nt, Salmonella enterica enterica serovar Typhi
aaucaccagcccga

SEQ ID NO: 3631012 - RNA, 15 nt, Salmonella enterica enterica serovar Typhi
aaucaccgccagcaa

SEQ ID NO: 3631013 - RNA, 16 nt, Salmonella enterica enterica serovar Typhi
aaucaccugcaucacg

SEQ ID NO: 3631014 - RNA, 17 nt, Salmonella enterica enterica serovar Typhi
aaucaccugccagggug

SEQ ID NO: 3631015 - RNA, 14 nt, Salmonella enterica enterica serovar Typhi
aaucacgcaucacu

SEQ ID NO: 3631016 - RNA, 18 nt, Salmonella enterica enterica serovar Typhi
aaucacgcaucacuuuug

SEQ ID NO: 3631017 - RNA, 23 nt, Salmonella enterica enterica serovar Typhi
aaucacgcguaucuggucaucgu

SEQ ID NO: 3631018 - RNA, 13 nt, Salmonella enterica enterica serovar Typhi
aaucacguaaucg

SEQ ID NO: 3631019 - RNA, 18 nt, Salmonella enterica enterica serovar Typhi
aaucacuaagaccagcau

SEQ ID NO: 3631020 - RNA, 14 nt, Salmonella enterica enterica serovar Typhi
aaucacugacggaa

SEQ ID NO: 3631021 - RNA, 18 nt, Salmonella enterica enterica serovar Typhi
aaucacugccgccacgcc

SEQ ID NO: 3631022 - RNA, 20 nt, Salmonella enterica enterica serovar Typhi
aaucacuuaucaaaccagcu

SEQ ID NO: 3631023 - RNA, 16 nt, Salmonella enterica enterica serovar Typhi
aaucacuuuuaccggc

SEQ ID NO: 3631024 - RNA, 15 nt, Salmonella enterica enterica serovar Typhi
aaucagaagaaauau

SEQ ID NO: 3631025 - RNA, 22 nt, Salmonella enterica enterica serovar Typhi
aaucagauacggcuccagcaca

SEQ ID NO: 3631026 - RNA, 17 nt, Salmonella enterica enterica serovar Typhi
aaucagauugccacagg

SEQ ID NO: 3631027 - RNA, 23 nt, Salmonella enterica enterica serovar Typhi
aaucagcacauucagcagcgccc

SEQ ID NO: 3631028 - RNA, 23 nt, Salmonella enterica enterica serovar Typhi
aaucagccaaagcgagguaaaaa

SEQ ID NO: 3631029 - RNA, 17 nt, Salmonella enterica enterica serovar Typhi
aaucagcgauaaccaga

SEQ ID NO: 3631030 - RNA, 22 nt, Salmonella enterica enterica serovar Typhi
aaucagcgccgucgccaucacc

SEQ ID NO: 3631031 - RNA, 13 nt, Salmonella enterica enterica serovar Typhi
aaucaggaaaaag

SEQ ID NO: 3631032 - RNA, 17 nt, Salmonella enterica enterica serovar Typhi
aaucaggaaagagccgc

SEQ ID NO: 3631033 - RNA, 23 nt, Salmonella enterica enterica serovar Typhi
aaucaggcacaacccaaaggcca

SEQ ID NO: 3631034 - RNA, 22 nt, Salmonella enterica enterica serovar Typhi
aaucaggcaucccguuuucguc

SEQ ID NO: 3631035 - RNA, 17 nt, Salmonella enterica enterica serovar Typhi
aaucaggugaauaccaa

SEQ ID NO: 3631036 - RNA, 13 nt, Salmonella enterica enterica serovar Typhi
aaucauaaagcgc

SEQ ID NO: 3631037 - RNA, 16 nt, Salmonella enterica enterica serovar Typhi
aaucauauaagaaaua

SEQ ID NO: 3631038 - RNA, 18 nt, Salmonella enterica enterica serovar Typhi
aaucaucaccguuuucca

SEQ ID NO: 3631039 - RNA, 21 nt, Salmonella enterica enterica serovar Typhi
aaucaucagaccgauaaauac

SEQ ID NO: 3631040 - RNA, 22 nt, Salmonella enterica enterica serovar Typhi
aaucaucagaccgauaaauacc

SEQ ID NO: 3631041 - RNA, 16 nt, Salmonella enterica enterica serovar Typhi
aaucaucaggcuggcg

SEQ ID NO: 3631042 - RNA, 17 nt, Salmonella enterica enterica serovar Typhi
aaucauccugauuuuac

SEQ ID NO: 3631043 - RNA, 12 nt, Salmonella enterica enterica serovar Typhi
aaucauccugcg

SEQ ID NO: 3631044 - RNA, 22 nt, Salmonella enterica enterica serovar Typhi
aaucaucgaggccaccaaaaau

SEQ ID NO: 3631045 - RNA, 13 nt, Salmonella enterica enterica serovar Typhi
aaucaugucaaau

SEQ ID NO: 3631046 - RNA, 15 nt, Salmonella enterica enterica serovar Typhi
aaucauguuuuucuc

SEQ ID NO: 3631047 - RNA, 16 nt, Salmonella enterica enterica serovar Typhi
aaucauuaauacacug

SEQ ID NO: 3631048 - RNA, 20 nt, Salmonella enterica enterica serovar Typhi
aaucauugcgcuaaaaucca

SEQ ID NO: 3631049 - RNA, 15 nt, Salmonella enterica enterica serovar Typhi
aaucauugcguucag

SEQ ID NO: 3631050 - RNA, 14 nt, Salmonella enterica enterica serovar Typhi
aauccaaauccgca

SEQ ID NO: 3631051 - RNA, 22 nt, Salmonella enterica enterica serovar Typhi
aauccaacgaaacucagcggcc

SEQ ID NO: 3631052 - RNA, 18 nt, Salmonella enterica enterica serovar Typhi
aauccacaaccggcuggc

SEQ ID NO: 3631053 - RNA, 19 nt, Salmonella enterica enterica serovar Typhi
aauccacuccguguugcug

SEQ ID NO: 3631054 - RNA, 21 nt, Salmonella enterica enterica serovar Typhi
aauccacuggucgucugaaag

SEQ ID NO: 3631055 - RNA, 21 nt, Salmonella enterica enterica serovar Typhi
aauccagaauguuccugcaau

SEQ ID NO: 3631056 - RNA, 22 nt, Salmonella enterica enterica serovar Typhi
aauccagaauguuccugcaaua

SEQ ID NO: 3631057 - RNA, 15 nt, Salmonella enterica enterica serovar Typhi
aauccagcagaauaa

SEQ ID NO: 3631058 - RNA, 14 nt, Salmonella enterica enterica serovar Typhi
aauccagcaggcug

SEQ ID NO: 3631059 - RNA, 14 nt, Salmonella enterica enterica serovar Typhi
aauccaggaauuuu

SEQ ID NO: 3631060 - RNA, 17 nt, Salmonella enterica enterica serovar Typhi
aauccaggaauuuuccc

SEQ ID NO: 3631061 - RNA, 12 nt, Salmonella enterica enterica serovar Typhi
aauccaggugga

SEQ ID NO: 3631062 - RNA, 15 nt, Salmonella enterica enterica serovar Typhi
aauccauaccugacg

SEQ ID NO: 3631063 - RNA, 22 nt, Salmonella enterica enterica serovar Typhi
aauccauaccugacgcacaggc

SEQ ID NO: 3631064 - RNA, 18 nt, Salmonella enterica enterica serovar Typhi
aauccauagccaacacau

SEQ ID NO: 3631065 - RNA, 13 nt, Salmonella enterica enterica serovar Typhi
aauccaucccccu

SEQ ID NO: 3631066 - RNA, 18 nt, Salmonella enterica enterica serovar Typhi
aauccaugagaagaaaaa

SEQ ID NO: 3631067 - RNA, 17 nt, Salmonella enterica enterica serovar Typhi
aaucccacgccgcugau

SEQ ID NO: 3631068 - RNA, 15 nt, Salmonella enterica enterica serovar Typhi
aaucccauuagccac

SEQ ID NO: 3631069 - RNA, 15 nt, Salmonella enterica enterica serovar Typhi
aaucccccaacguca

SEQ ID NO: 3631070 - RNA, 17 nt, Salmonella enterica enterica serovar Typhi
aaucccccugccacaac

SEQ ID NO: 3631071 - RNA, 15 nt, Salmonella enterica enterica serovar Typhi
aauccccgaaagccg

SEQ ID NO: 3631072 - RNA, 20 nt, Salmonella enterica enterica serovar Typhi
aauccccggcgaaagaaaau

SEQ ID NO: 3631073 - RNA, 23 nt, Salmonella enterica enterica serovar Typhi
aaucccgaaucacuuacuaaggu

SEQ ID NO: 3631074 - RNA, 21 nt, Salmonella enterica enterica serovar Typhi
aaucccgcaucacccgcauau

SEQ ID NO: 3631075 - RNA, 16 nt, Salmonella enterica enterica serovar Typhi
aaucccgccgcuggcg

SEQ ID NO: 3631076 - RNA, 22 nt, Salmonella enterica enterica serovar Typhi
aaucccggcgauuaauaaaauc

SEQ ID NO: 3631077 - RNA, 14 nt, Salmonella enterica enterica serovar Typhi
aaucccuucuuuua

SEQ ID NO: 3631078 - RNA, 14 nt, Salmonella enterica enterica serovar Typhi
aauccgcgcccugg

SEQ ID NO: 3631079 - RNA, 19 nt, Salmonella enterica enterica serovar Typhi
aauccgcuaacgaugucau

SEQ ID NO: 3631080 - RNA, 17 nt, Salmonella enterica enterica serovar Typhi
aauccgcuccacauccu

SEQ ID NO: 3631081 - RNA, 13 nt, Salmonella enterica enterica serovar Typhi
aauccggcugccu

SEQ ID NO: 3631082 - RNA, 21 nt, Salmonella enterica enterica serovar Typhi
aauccggcugccugccggauu

SEQ ID NO: 3631083 - RNA, 16 nt, Salmonella enterica enterica serovar Typhi
aauccguuaagcccug

SEQ ID NO: 3631084 - RNA, 17 nt, Salmonella enterica enterica serovar Typhi
aauccguuaagcccuga

SEQ ID NO: 3631085 - RNA, 15 nt, Salmonella enterica enterica serovar Typhi
aauccucacugccga

SEQ ID NO: 3631086 - RNA, 12 nt, Salmonella enterica enterica serovar Typhi
aauccugcaccc

SEQ ID NO: 3631087 - RNA, 15 nt, Salmonella enterica enterica serovar Typhi
aauccugcgcuggcu

SEQ ID NO: 3631088 - RNA, 13 nt, Salmonella enterica enterica serovar Typhi
aauccuuccuuuc

SEQ ID NO: 3631089 - RNA, 12 nt, Salmonella enterica enterica serovar Typhi
aauccuucuucc

SEQ ID NO: 3631090 - RNA, 16 nt, Salmonella enterica enterica serovar Typhi
aauccuucuuccauuc

SEQ ID NO: 3631091 - RNA, 23 nt, Salmonella enterica enterica serovar Typhi
aaucgacagccagcauuuccagc

SEQ ID NO: 3631092 - RNA, 21 nt, Salmonella enterica enterica serovar Typhi
aaucgacaugucggcgaaaau

SEQ ID NO: 3631093 - RNA, 15 nt, Salmonella enterica enterica serovar Typhi
aaugaccucaagaau

SEQ ID NO: 3631094 - RNA, 16 nt, Salmonella enterica enterica serovar Typhi
aaugaccucaagaaua

SEQ ID NO: 3631095 - RNA, 11 nt, Salmonella enterica enterica serovar Typhi
aaugacgcccu

SEQ ID NO: 3631096 - RNA, 13 nt, Salmonella enterica enterica serovar Typhi
aaugacgcccugc

SEQ ID NO: 3631097 - RNA, 17 nt, Salmonella enterica enterica serovar Typhi
aaugacgcccugcgcca

SEQ ID NO: 3631098 - RNA, 15 nt, Salmonella enterica enterica serovar Typhi
aaugacggaccaaca

SEQ ID NO: 3631099 - RNA, 22 nt, Salmonella enterica enterica serovar Typhi
aaugacggacgcagaccaaagu

SEQ ID NO: 3631100 - RNA, 21 nt, Salmonella enterica enterica serovar Typhi
aaugacgggcuacgucgucga

SEQ ID NO: 3631101 - RNA, 13 nt, Salmonella enterica enterica serovar Typhi
aaugacuuuuuau

SEQ ID NO: 3631102 - RNA, 14 nt, Salmonella enterica enterica serovar Typhi
aaugagaaaaggaa

SEQ ID NO: 3631103 - RNA, 18 nt, Salmonella enterica enterica serovar Typhi
aaugagaaaaggaagaau

SEQ ID NO: 3631104 - RNA, 17 nt, Salmonella enterica enterica serovar Typhi
aaugagagacggagaaa

SEQ ID NO: 3631105 - RNA, 24 nt, Salmonella enterica enterica serovar Typhi
aaugagcggaacgcguuccacgau

SEQ ID NO: 3631106 - RNA, 21 nt, Salmonella enterica enterica serovar Typhi
aaugaggacggcccgcugucu

SEQ ID NO: 3631107 - RNA, 22 nt, Salmonella enterica enterica serovar Typhi
aaugaguagaacguauuauuau

SEQ ID NO: 3631108 - RNA, 15 nt, Salmonella enterica enterica serovar Typhi
aaugauaaugccgcu

SEQ ID NO: 3631109 - RNA, 18 nt, Salmonella enterica enterica serovar Typhi
aaugauaccaauuugagc

SEQ ID NO: 3631110 - RNA, 18 nt, Salmonella enterica enterica serovar Typhi
aaugauauuuaaaacugg

SEQ ID NO: 3631111 - RNA, 15 nt, Salmonella enterica enterica serovar Typhi
aaugaucaauggcgc

SEQ ID NO: 3631112 - RNA, 12 nt, Salmonella enterica enterica serovar Typhi
aaugaucagacg

SEQ ID NO: 3631113 - RNA, 15 nt, Salmonella enterica enterica serovar Typhi
aaugauccacggcgu

SEQ ID NO: 3631114 - RNA, 15 nt, Salmonella enterica enterica serovar Typhi
aaugauccgaugcgc

SEQ ID NO: 3631115 - RNA, 19 nt, Salmonella enterica enterica serovar Typhi
aaugaucguaugcagccag

SEQ ID NO: 3631116 - RNA, 22 nt, Salmonella enterica enterica serovar Typhi
aaugaugacucauuaaaaaaac

SEQ ID NO: 3631117 - RNA, 17 nt, Salmonella enterica enterica serovar Typhi
aaugaugccccagaaca

SEQ ID NO: 3631118 - RNA, 22 nt, Salmonella enterica enterica serovar Typhi
aaugauggcgagaguuugugau

SEQ ID NO: 3631119 - RNA, 20 nt, Salmonella enterica enterica serovar Typhi
aaugauguccagaaugcaaa

SEQ ID NO: 3631120 - RNA, 14 nt, Salmonella enterica enterica serovar Typhi
aaugauuaaaauaa

SEQ ID NO: 3631121 - RNA, 16 nt, Salmonella enterica enterica serovar Typhi
aaugauuaaaauaaau

SEQ ID NO: 3631122 - RNA, 17 nt, Salmonella enterica enterica serovar Typhi
aaugauuacggaacaaa

SEQ ID NO: 3631123 - RNA, 23 nt, Salmonella enterica enterica serovar Typhi
aaugauuacggaacaaaacggaa

SEQ ID NO: 3631124 - RNA, 12 nt, Salmonella enterica enterica serovar Typhi
aaugauuuccgc

SEQ ID NO: 3631125 - RNA, 13 nt, Salmonella enterica enterica serovar Typhi
aaugauuugcuuu

SEQ ID NO: 3631126 - RNA, 20 nt, Salmonella enterica enterica serovar Typhi
aaugcaauauuacaaagcag

SEQ ID NO: 3631127 - RNA, 15 nt, Salmonella enterica enterica serovar Typhi
aaugcacaauacgcc

SEQ ID NO: 3631128 - RNA, 16 nt, Salmonella enterica enterica serovar Typhi
aaugcaggcguuuuau

SEQ ID NO: 3631129 - RNA, 18 nt, Salmonella enterica enterica serovar Typhi
aaugcauagccccagcgc

SEQ ID NO: 3631130 - RNA, 19 nt, Salmonella enterica enterica serovar Typhi
aaugcauagccccagcgca

SEQ ID NO: 3631131 - RNA, 19 nt, Salmonella enterica enterica serovar Typhi
aaugcauugauaggcugcu

SEQ ID NO: 3631132 - RNA, 14 nt, Salmonella enterica enterica serovar Typhi
aaugcauuggccag

SEQ ID NO: 3631133 - RNA, 18 nt, Salmonella enterica enterica serovar Typhi
aaugccacgauccccguc

SEQ ID NO: 3631134 - RNA, 13 nt, Salmonella enterica enterica serovar Typhi
aaugccacugccc

SEQ ID NO: 3631135 - RNA, 23 nt, Salmonella enterica enterica serovar Typhi
aaugccagaaaucgcucaugcgc

SEQ ID NO: 3631136 - RNA, 13 nt, Salmonella enterica enterica serovar Typhi
aaugccagcgccg

SEQ ID NO: 3631137 - RNA, 13 nt, Salmonella enterica enterica serovar Typhi
aaugccaugcugg

SEQ ID NO: 3631138 - RNA, 13 nt, Salmonella enterica enterica serovar Typhi
aaugcccacgccg

SEQ ID NO: 3631139 - RNA, 19 nt, Salmonella enterica enterica serovar Typhi
aaugcccagcgcaaucacg

SEQ ID NO: 3631140 - RNA, 14 nt, Salmonella enterica enterica serovar Typhi
aaugcccaggcggc

SEQ ID NO: 3631141 - RNA, 21 nt, Salmonella enterica enterica serovar Typhi
aaugcccgacgcgccgccagc

SEQ ID NO: 3631142 - RNA, 12 nt, Salmonella enterica enterica serovar Typhi
aaugcccggcgc

SEQ ID NO: 3631143 - RNA, 17 nt, Salmonella enterica enterica serovar Typhi
aaugcccgguauuuuuu

SEQ ID NO: 3631144 - RNA, 16 nt, Salmonella enterica enterica serovar Typhi
aaugcccguugacgaa

SEQ ID NO: 3631145 - RNA, 20 nt, Salmonella enterica enterica serovar Typhi
aaugccgauagucuccgcca

SEQ ID NO: 3631146 - RNA, 14 nt, Salmonella enterica enterica serovar Typhi
aaugccgccgauac

SEQ ID NO: 3631147 - RNA, 20 nt, Salmonella enterica enterica serovar Typhi
aaugccgccguacaaacccu

SEQ ID NO: 3631148 - RNA, 13 nt, Salmonella enterica enterica serovar Typhi
aaugccgcuggcg

SEQ ID NO: 3631149 - RNA, 16 nt, Salmonella enterica enterica serovar Typhi
aaugccggaucaggcg

SEQ ID NO: 3631150 - RNA, 22 nt, Salmonella enterica enterica serovar Typhi
aaugccgggcaaaaaacggaac

SEQ ID NO: 3631151 - RNA, 14 nt, Salmonella enterica enterica serovar Typhi
aaugccugaccaac

SEQ ID NO: 3631152 - RNA, 24 nt, Salmonella enterica enterica serovar Typhi
aaugccuuauccggccugcaggca

SEQ ID NO: 3631153 - RNA, 14 nt, Salmonella enterica enterica serovar Typhi
aaugccuuccugug

SEQ ID NO: 3631154 - RNA, 14 nt, Salmonella enterica enterica serovar Typhi
aaugcgauagguga

SEQ ID NO: 3631155 - RNA, 21 nt, Salmonella enterica enterica serovar Typhi
aaugcgcaaaauucacaccaa

SEQ ID NO: 3631156 - RNA, 19 nt, Salmonella enterica enterica serovar Typhi
aaugcgcaaucccggagag

SEQ ID NO: 3631157 - RNA, 16 nt, Salmonella enterica enterica serovar Typhi
aaugcgccagcggcca

SEQ ID NO: 3631158 - RNA, 17 nt, Salmonella enterica enterica serovar Typhi
aaugcgccgucaggcuu

SEQ ID NO: 3631159 - RNA, 15 nt, Salmonella enterica enterica serovar Typhi
aaugcgcuagcuggc

SEQ ID NO: 3631160 - RNA, 19 nt, Salmonella enterica enterica serovar Typhi
aaugcgcuuuuuuugcccu

SEQ ID NO: 3631161 - RNA, 21 nt, Salmonella enterica enterica serovar Typhi
aaugcguccgccagaugcacc

SEQ ID NO: 3631162 - RNA, 20 nt, Salmonella enterica enterica serovar Typhi
aaugcgucggcaccauuccc

SEQ ID NO: 3631163 - RNA, 20 nt, Salmonella enterica enterica serovar Typhi
aaugcucauuauuuggauua

SEQ ID NO: 3631164 - RNA, 15 nt, Salmonella enterica enterica serovar Typhi
aaugcuccaauaaau

SEQ ID NO: 3631165 - RNA, 23 nt, Salmonella enterica enterica serovar Typhi
aaugcugacgcguuuuuucauga

SEQ ID NO: 3631166 - RNA, 18 nt, Salmonella enterica enterica serovar Typhi
aaugcuggugcaucuggg

SEQ ID NO: 3631167 - RNA, 20 nt, Salmonella enterica enterica serovar Typhi
aaugcuucuucgccagcuuc

SEQ ID NO: 3631168 - RNA, 13 nt, Salmonella enterica enterica serovar Typhi
aaugcuuuaaaug

SEQ ID NO: 3631169 - RNA, 15 nt, Salmonella enterica enterica serovar Typhi
aaugcuuucaauacu

SEQ ID NO: 3631170 - RNA, 10 nt, Salmonella enterica enterica serovar Typhi
aaugcuuucc

SEQ ID NO: 3631171 - RNA, 13 nt, Salmonella enterica enterica serovar Typhi
aauggaaaauaau

SEQ ID NO: 3631172 - RNA, 18 nt, Salmonella enterica enterica serovar Typhi
aauggaaaauaauaaucg

SEQ ID NO: 3631173 - RNA, 14 nt, Salmonella enterica enterica serovar Typhi
aauggaacugccug

SEQ ID NO: 3631174 - RNA, 23 nt, Salmonella enterica enterica serovar Typhi
aauggauucaugguacucaacau

SEQ ID NO: 3631175 - RNA, 21 nt, Salmonella enterica enterica serovar Typhi
aauggauuuuccguuaagcug

SEQ ID NO: 3631176 - RNA, 18 nt, Salmonella enterica enterica serovar Typhi
aauggcaaguaaaauagc

SEQ ID NO: 3631177 - RNA, 18 nt, Salmonella enterica enterica serovar Typhi
aauggcaggcagcagaua

SEQ ID NO: 3631178 - RNA, 20 nt, Salmonella enterica enterica serovar Typhi
aauggccagaugaaacugca

SEQ ID NO: 3631179 - RNA, 13 nt, Salmonella enterica enterica serovar Typhi
aauuuuuugauug

SEQ ID NO: 3631180 - RNA, 16 nt, Salmonella enterica enterica serovar Typhi
acaaaaaaaccgcuca

SEQ ID NO: 3631181 - RNA, 18 nt, Salmonella enterica enterica serovar Typhi
acaaaaaaacggccucaa

SEQ ID NO: 3631182 - RNA, 21 nt, Salmonella enterica enterica serovar Typhi
acaaaaagcgcgccgaaaaua

SEQ ID NO: 3631183 - RNA, 16 nt, Salmonella enterica enterica serovar Typhi
acaaaaaguaguucca

SEQ ID NO: 3631184 - RNA, 21 nt, Salmonella enterica enterica serovar Typhi
acaaaaccgcuaaugaggaaa

SEQ ID NO: 3631185 - RNA, 14 nt, Salmonella enterica enterica serovar Typhi
acaaaagaaagcaa

SEQ ID NO: 3631186 - RNA, 23 nt, Salmonella enterica enterica serovar Typhi
acaaaagcgguuaagauacauau

SEQ ID NO: 3631187 - RNA, 23 nt, Salmonella enterica enterica serovar Typhi
acaaaaggcuggaacagauguuu

SEQ ID NO: 3631188 - RNA, 19 nt, Salmonella enterica enterica serovar Typhi
acaaaauaaagugaaauaa

SEQ ID NO: 3631189 - RNA, 13 nt, Salmonella enterica enterica serovar Typhi
acaaaauggcuga

SEQ ID NO: 3631190 - RNA, 22 nt, Salmonella enterica enterica serovar Typhi
acaaaauuuugcauaaauaaug

SEQ ID NO: 3631191 - RNA, 19 nt, Salmonella enterica enterica serovar Typhi
acaaaauuuuuuaucaggu

SEQ ID NO: 3631192 - RNA, 15 nt, Salmonella enterica enterica serovar Typhi
acaaacaaauaaauc

SEQ ID NO: 3631193 - RNA, 14 nt, Salmonella enterica enterica serovar Typhi
acaaacacagccau

SEQ ID NO: 3631194 - RNA, 12 nt, Salmonella enterica enterica serovar Typhi
acaaacagcgcc

SEQ ID NO: 3631195 - RNA, 23 nt, Salmonella enterica enterica serovar Typhi
acaaacagcgccccgacaaaacg

SEQ ID NO: 3631196 - RNA, 16 nt, Salmonella enterica enterica serovar Typhi
acaaacagugaaaaaa

SEQ ID NO: 3631197 - RNA, 16 nt, Salmonella enterica enterica serovar Typhi
acaaaccacugcugua

SEQ ID NO: 3631198 - RNA, 19 nt, Salmonella enterica enterica serovar Typhi
acaaaccagacgcguaacc

SEQ ID NO: 3631199 - RNA, 18 nt, Salmonella enterica enterica serovar Typhi
acaaaccccacccacuga

SEQ ID NO: 3631200 - RNA, 16 nt, Salmonella enterica enterica serovar Typhi
acaaacgcaccgccaa

SEQ ID NO: 3631201 - RNA, 17 nt, Salmonella enterica enterica serovar Typhi
acaaacgccaccgccac

SEQ ID NO: 3631202 - RNA, 22 nt, Salmonella enterica enterica serovar Typhi
acaaacgccgucacaaagccca

SEQ ID NO: 3631203 - RNA, 14 nt, Salmonella enterica enterica serovar Typhi
acaaacgcuuuuuu

SEQ ID NO: 3631204 - RNA, 23 nt, Salmonella enterica enterica serovar Typhi
acaaacugcgcuagccgccgugu

SEQ ID NO: 3631205 - RNA, 16 nt, Salmonella enterica enterica serovar Typhi
acaaagaauucuucug

SEQ ID NO: 3631206 - RNA, 19 nt, Salmonella enterica enterica serovar Typhi
acaaagacgaauaaggaau

SEQ ID NO: 3631207 - RNA, 11 nt, Salmonella enterica enterica serovar Typhi
acaaagagcuc

SEQ ID NO: 3631208 - RNA, 15 nt, Salmonella enterica enterica serovar Typhi
acaaagagcucccca

SEQ ID NO: 3631209 - RNA, 16 nt, Salmonella enterica enterica serovar Typhi
acaaagcccaccgcga

SEQ ID NO: 3631210 - RNA, 12 nt, Salmonella enterica enterica serovar Typhi
acaaagccgacg

SEQ ID NO: 3631211 - RNA, 16 nt, Salmonella enterica enterica serovar Typhi
acaaagccugcuggaa

SEQ ID NO: 3631212 - RNA, 19 nt, Salmonella enterica enterica serovar Typhi
acaaagcguggggaaaacc

SEQ ID NO: 3631213 - RNA, 21 nt, Salmonella enterica enterica serovar Typhi
acaaaggcagccaacaaagag

SEQ ID NO: 3631214 - RNA, 20 nt, Salmonella enterica enterica serovar Typhi
acaaagguugcgccaaagca

SEQ ID NO: 3631215 - RNA, 23 nt, Salmonella enterica enterica serovar Typhi
acaaagguugcgccaaagcaauc

SEQ ID NO: 3631216 - RNA, 13 nt, Salmonella enterica enterica serovar Typhi
acaaauaaaucca

SEQ ID NO: 3631217 - RNA, 14 nt, Salmonella enterica enterica serovar Typhi
acaaauaaauccau

SEQ ID NO: 3631218 - RNA, 15 nt, Salmonella enterica enterica serovar Typhi
acaaauaacuuuccu

SEQ ID NO: 3631219 - RNA, 19 nt, Salmonella enterica enterica serovar Typhi
acaaauagcacacaaacga

SEQ ID NO: 3631220 - RNA, 16 nt, Salmonella enterica enterica serovar Typhi
acaaaucaaacucacc

SEQ ID NO: 3631221 - RNA, 16 nt, Salmonella enterica enterica serovar Typhi
acaaaucgacagccag

SEQ ID NO: 3631222 - RNA, 22 nt, Salmonella enterica enterica serovar Typhi
acaaaucgggcgggcauuauac

SEQ ID NO: 3631223 - RNA, 19 nt, Salmonella enterica enterica serovar Typhi
acaaaucuguuaucuggau

SEQ ID NO: 3631224 - RNA, 20 nt, Salmonella enterica enterica serovar Typhi
acaaaugaccucaagaauau

SEQ ID NO: 3631225 - RNA, 19 nt, Salmonella enterica enterica serovar Typhi
acaaauuccggcacaaccu

SEQ ID NO: 3631226 - RNA, 14 nt, Salmonella enterica enterica serovar Typhi
acaaauucgcuaau

SEQ ID NO: 3631227 - RNA, 20 nt, Salmonella enterica enterica serovar Typhi
acaaauuguuuaaaaacagg

SEQ ID NO: 3631228 - RNA, 17 nt, Salmonella enterica enterica serovar Typhi
acaaauuuugauaaaaa

SEQ ID NO: 3631229 - RNA, 21 nt, Salmonella enterica enterica serovar Typhi
acaacaaaguauaaagcuggu

SEQ ID NO: 3631230 - RNA, 23 nt, Salmonella enterica enterica serovar Typhi
acaacacacguaacaaccagaau

SEQ ID NO: 3631231 - RNA, 15 nt, Salmonella enterica enterica serovar Typhi
acaacacgcuuuuca

SEQ ID NO: 3631232 - RNA, 20 nt, Salmonella enterica enterica serovar Typhi
acaacacgcuuuucagcgcc

SEQ ID NO: 3631233 - RNA, 13 nt, Salmonella enterica enterica serovar Typhi
acaacacggcggc

SEQ ID NO: 3631234 - RNA, 17 nt, Salmonella enterica enterica serovar Typhi
acaacacucacaaaacu

SEQ ID NO: 3631235 - RNA, 15 nt, Salmonella enterica enterica serovar Typhi
acaacauaaaggggu

SEQ ID NO: 3631236 - RNA, 23 nt, Salmonella enterica enterica serovar Typhi
acaacauaucgccggggaaaaua

SEQ ID NO: 3631237 - RNA, 17 nt, Salmonella enterica enterica serovar Typhi
acaacaucccagaaaau

SEQ ID NO: 3631238 - RNA, 17 nt, Salmonella enterica enterica serovar Typhi
acaacauguuucuugug

SEQ ID NO: 3631239 - RNA, 14 nt, Salmonella enterica enterica serovar Typhi
acaacauugaggcu

SEQ ID NO: 3631240 - RNA, 20 nt, Salmonella enterica enterica serovar Typhi
acaaccagcgaaaugacggc

SEQ ID NO: 3631241 - RNA, 23 nt, Salmonella enterica enterica serovar Typhi
acaaccaggauucaacgcgugau

SEQ ID NO: 3631242 - RNA, 18 nt, Salmonella enterica enterica serovar Typhi
acaaccaucacugaaccc

SEQ ID NO: 3631243 - RNA, 20 nt, Salmonella enterica enterica serovar Typhi
acaaccgcccccaacugagc

SEQ ID NO: 3631244 - RNA, 15 nt, Salmonella enterica enterica serovar Typhi
acaaccuccacgccc

SEQ ID NO: 3631245 - RNA, 19 nt, Salmonella enterica enterica serovar Typhi
acaaccuccacgcccagcg

SEQ ID NO: 3631246 - RNA, 13 nt, Salmonella enterica enterica serovar Typhi
acaaccugcccuu

SEQ ID NO: 3631247 - RNA, 16 nt, Salmonella enterica enterica serovar Typhi
acaacgcauauuauga

SEQ ID NO: 3631248 - RNA, 20 nt, Salmonella enterica enterica serovar Typhi
acaacgccgguacgcagcag

SEQ ID NO: 3631249 - RNA, 11 nt, Salmonella enterica enterica serovar Typhi
acaacgcuucu

SEQ ID NO: 3631250 - RNA, 17 nt, Salmonella enterica enterica serovar Typhi
acaacggccagcaaaau

SEQ ID NO: 3631251 - RNA, 17 nt, Salmonella enterica enterica serovar Typhi
acaacggcgaccuucac

SEQ ID NO: 3631252 - RNA, 19 nt, Salmonella enterica enterica serovar Typhi
acaacuucuaauuuuucca

SEQ ID NO: 3631253 - RNA, 21 nt, Salmonella enterica enterica serovar Typhi
acaacuucuaauuuuuccagc

SEQ ID NO: 3631254 - RNA, 23 nt, Salmonella enterica enterica serovar Typhi
acaagaacuuaaauuaaugauua

SEQ ID NO: 3631255 - RNA, 12 nt, Salmonella enterica enterica serovar Typhi
acaagaauuuau

SEQ ID NO: 3631256 - RNA, 16 nt, Salmonella enterica enterica serovar Typhi
acaagaauuuaucgca

SEQ ID NO: 3631257 - RNA, 22 nt, Salmonella enterica enterica serovar Typhi
acaagaggaguguaacgccgaa

SEQ ID NO: 3631258 - RNA, 20 nt, Salmonella enterica enterica serovar Typhi
acaagcagaaauacugugcc

SEQ ID NO: 3631259 - RNA, 11 nt, Salmonella enterica enterica serovar Typhi
acaagcaguua

SEQ ID NO: 3631260 - RNA, 19 nt, Salmonella enterica enterica serovar Typhi
acaagccccccgcacagca

SEQ ID NO: 3631261 - RNA, 20 nt, Salmonella enterica enterica serovar Typhi
acaagccgccaacgccagca

SEQ ID NO: 3631262 - RNA, 22 nt, Salmonella enterica enterica serovar Typhi
acaaggcgguacgccgccaucc

SEQ ID NO: 3631263 - RNA, 16 nt, Salmonella enterica enterica serovar Typhi
acaaggcuuuuggcuu

SEQ ID NO: 3631264 - RNA, 19 nt, Salmonella enterica enterica serovar Typhi
acacauuuucaaugcacgc

SEQ ID NO: 3631265 - RNA, 14 nt, Salmonella enterica enterica serovar Typhi
acaccaacaaagug

SEQ ID NO: 3631266 - RNA, 18 nt, Salmonella enterica enterica serovar Typhi
acaccaacggcgacgccc

SEQ ID NO: 3631267 - RNA, 23 nt, Salmonella enterica enterica serovar Typhi
acaccaaugucauauuugugagc

SEQ ID NO: 3631268 - RNA, 12 nt, Salmonella enterica enterica serovar Typhi
acaccacgcagg

SEQ ID NO: 3631269 - RNA, 15 nt, Salmonella enterica enterica serovar Typhi
acaccacgcaggcga

SEQ ID NO: 3631270 - RNA, 13 nt, Salmonella enterica enterica serovar Typhi
acaccagaaugcu

SEQ ID NO: 3631271 - RNA, 19 nt, Salmonella enterica enterica serovar Typhi
acaccagacugaugaugaa

SEQ ID NO: 3631272 - RNA, 12 nt, Salmonella enterica enterica serovar Typhi
acaccagcgccg

SEQ ID NO: 3631273 - RNA, 18 nt, Salmonella enterica enterica serovar Typhi
acaccaggaguuaaaccu

SEQ ID NO: 3631274 - RNA, 20 nt, Salmonella enterica enterica serovar Typhi
acaccagggauuuugcuuuu

SEQ ID NO: 3631275 - RNA, 17 nt, Salmonella enterica enterica serovar Typhi
acaccagucgaccgcag

SEQ ID NO: 3631276 - RNA, 15 nt, Salmonella enterica enterica serovar Typhi
acaccaucccgcucu

SEQ ID NO: 3631277 - RNA, 14 nt, Salmonella enterica enterica serovar Typhi
acaccauuucacaa

SEQ ID NO: 3631278 - RNA, 15 nt, Salmonella enterica enterica serovar Typhi
acaccauuucacaaa

SEQ ID NO: 3631279 - RNA, 15 nt, Salmonella enterica enterica serovar Typhi
acacccauagcagcu

SEQ ID NO: 3631280 - RNA, 19 nt, Salmonella enterica enterica serovar Typhi
acacccggcuuuugcuuuc

SEQ ID NO: 3631281 - RNA, 15 nt, Salmonella enterica enterica serovar Typhi
acacccucugcgccu

SEQ ID NO: 3631282 - RNA, 12 nt, Salmonella enterica enterica serovar Typhi
acacccugcccc

SEQ ID NO: 3631283 - RNA, 13 nt, Salmonella enterica enterica serovar Typhi
acaccgagacaga

SEQ ID NO: 3631284 - RNA, 23 nt, Salmonella enterica enterica serovar Typhi
acaccgcaggccggauaaggcau

SEQ ID NO: 3631285 - RNA, 16 nt, Salmonella enterica enterica serovar Typhi
acaccgcauggcuggc

SEQ ID NO: 3631286 - RNA, 22 nt, Salmonella enterica enterica serovar Typhi
acaccgccuagcgucccggcaa

SEQ ID NO: 3631287 - RNA, 19 nt, Salmonella enterica enterica serovar Typhi
acaccggaauucuguucag

SEQ ID NO: 3631288 - RNA, 13 nt, Salmonella enterica enterica serovar Typhi
acaccggccugcc

SEQ ID NO: 3631289 - RNA, 18 nt, Salmonella enterica enterica serovar Typhi
acaccggcgccagcucug

SEQ ID NO: 3631290 - RNA, 22 nt, Salmonella enterica enterica serovar Typhi
acaccggcggcgccaucgccuc

SEQ ID NO: 3631291 - RNA, 20 nt, Salmonella enterica enterica serovar Typhi
acaccgggagaaaacgcggc

SEQ ID NO: 3631292 - RNA, 18 nt, Salmonella enterica enterica serovar Typhi
acaccguagaucgccagc

SEQ ID NO: 3631293 - RNA, 23 nt, Salmonella enterica enterica serovar Typhi
acaccguuuaucguuaccggcuc

SEQ ID NO: 3631294 - RNA, 15 nt, Salmonella enterica enterica serovar Typhi
acaccugaaccagcg

SEQ ID NO: 3631295 - RNA, 12 nt, Salmonella enterica enterica serovar Typhi
acacgauaguga

SEQ ID NO: 3631296 - RNA, 13 nt, Salmonella enterica enterica serovar Typhi
acacgauggcaaa

SEQ ID NO: 3631297 - RNA, 16 nt, Salmonella enterica enterica serovar Typhi
acacgcagacccaggc

SEQ ID NO: 3631298 - RNA, 18 nt, Salmonella enterica enterica serovar Typhi
acacgccacaaacugcgc

SEQ ID NO: 3631299 - RNA, 18 nt, Salmonella enterica enterica serovar Typhi
acacgccuuccuccagca

SEQ ID NO: 3631300 - RNA, 17 nt, Salmonella enterica enterica serovar Typhi
acacgcgaauagccaga

SEQ ID NO: 3631301 - RNA, 14 nt, Salmonella enterica enterica serovar Typhi
acacgcucauguuc

SEQ ID NO: 3631302 - RNA, 17 nt, Salmonella enterica enterica serovar Typhi
acacgcuggaagagaac

SEQ ID NO: 3631303 - RNA, 14 nt, Salmonella enterica enterica serovar Typhi
acacggcgcucagg

SEQ ID NO: 3631304 - RNA, 12 nt, Salmonella enterica enterica serovar Typhi
acacggcggcua

SEQ ID NO: 3631305 - RNA, 16 nt, Salmonella enterica enterica serovar Typhi
acacggugugccgcca

SEQ ID NO: 3631306 - RNA, 17 nt, Salmonella enterica enterica serovar Typhi
acacggugugccgccau

SEQ ID NO: 3631307 - RNA, 19 nt, Salmonella enterica enterica serovar Typhi
acacgguuauaaccggaca

SEQ ID NO: 3631308 - RNA, 12 nt, Salmonella enterica enterica serovar Typhi
acacguaacaac

SEQ ID NO: 3631309 - RNA, 18 nt, Salmonella enterica enterica serovar Typhi
acacguauaaacgccgcc

SEQ ID NO: 3631310 - RNA, 17 nt, Salmonella enterica enterica serovar Typhi
acacuaacgcucuucuc

SEQ ID NO: 3631311 - RNA, 22 nt, Salmonella enterica enterica serovar Typhi
acacuaacuaauuguuuguaga

SEQ ID NO: 3631312 - RNA, 13 nt, Salmonella enterica enterica serovar Typhi
acacuauauugcg

SEQ ID NO: 3631313 - RNA, 11 nt, Salmonella enterica enterica serovar Typhi
acacucaacca

SEQ ID NO: 3631314 - RNA, 15 nt, Salmonella enterica enterica serovar Typhi
acacucaaccaacca

SEQ ID NO: 3631315 - RNA, 15 nt, Salmonella enterica enterica serovar Typhi
acacucgcggauaau

SEQ ID NO: 3631316 - RNA, 13 nt, Salmonella enterica enterica serovar Typhi
acacucucuccag

SEQ ID NO: 3631317 - RNA, 14 nt, Salmonella enterica enterica serovar Typhi
acacugaaacuccg

SEQ ID NO: 3631318 - RNA, 15 nt, Salmonella enterica enterica serovar Typhi
acacugaagccuggu

SEQ ID NO: 3631319 - RNA, 18 nt, Salmonella enterica enterica serovar Typhi
acacuucucaacauugac

SEQ ID NO: 3631320 - RNA, 16 nt, Salmonella enterica enterica serovar Typhi
acacuuucgcccggcg

SEQ ID NO: 3631321 - RNA, 17 nt, Salmonella enterica enterica serovar Typhi
acacuuucgcccggcgc

SEQ ID NO: 3631322 - RNA, 20 nt, Salmonella enterica enterica serovar Typhi
acagaaaaaaugcaccgccu

SEQ ID NO: 3631323 - RNA, 16 nt, Salmonella enterica enterica serovar Typhi
acagaaaccauaaaca

SEQ ID NO: 3631324 - RNA, 13 nt, Salmonella enterica enterica serovar Typhi
acagaacugauuu

SEQ ID NO: 3631325 - RNA, 17 nt, Salmonella enterica enterica serovar Typhi
acagaagcugagaaaag

SEQ ID NO: 3631326 - RNA, 22 nt, Salmonella enterica enterica serovar Typhi
acagaaucaacgccacaccgag

SEQ ID NO: 3631327 - RNA, 13 nt, Salmonella enterica enterica serovar Typhi
acagaaucaucag

SEQ ID NO: 3631328 - RNA, 18 nt, Salmonella enterica enterica serovar Typhi
acagaaucaucaggcuau

SEQ ID NO: 3631329 - RNA, 14 nt, Salmonella enterica enterica serovar Typhi
acagaaucgcgaua

SEQ ID NO: 3631330 - RNA, 14 nt, Salmonella enterica enterica serovar Typhi
acagaauuaacgca

SEQ ID NO: 3631331 - RNA, 16 nt, Salmonella enterica enterica serovar Typhi
acagaauuaacgcaga

SEQ ID NO: 3631332 - RNA, 18 nt, Salmonella enterica enterica serovar Typhi
acagaauuaacgcagaau

SEQ ID NO: 3631333 - RNA, 14 nt, Salmonella enterica enterica serovar Typhi
acagacaaggugga

SEQ ID NO: 3631334 - RNA, 23 nt, Salmonella enterica enterica serovar Typhi
acagaccccgcaucgcccgcucc

SEQ ID NO: 3631335 - RNA, 14 nt, Salmonella enterica enterica serovar Typhi
acagacgcaggccg

SEQ ID NO: 3631336 - RNA, 17 nt, Salmonella enterica enterica serovar Typhi
acagacuucauuuucca

SEQ ID NO: 3631337 - RNA, 16 nt, Salmonella enterica enterica serovar Typhi
acagagaagcugugcc

SEQ ID NO: 3631338 - RNA, 19 nt, Salmonella enterica enterica serovar Typhi
acagaggaugccugcgcau

SEQ ID NO: 3631339 - RNA, 18 nt, Salmonella enterica enterica serovar Typhi
acagagucguuagcagaa

SEQ ID NO: 3631340 - RNA, 16 nt, Salmonella enterica enterica serovar Typhi
acagauaagcgucugc

SEQ ID NO: 3631341 - RNA, 14 nt, Salmonella enterica enterica serovar Typhi
acagauaauuaaua

SEQ ID NO: 3631342 - RNA, 15 nt, Salmonella enterica enterica serovar Typhi
acagauacuggaagu

SEQ ID NO: 3631343 - RNA, 19 nt, Salmonella enterica enterica serovar Typhi
acagauagcccugagccca

SEQ ID NO: 3631344 - RNA, 23 nt, Salmonella enterica enterica serovar Typhi
acagauagcccugagcccacagc

SEQ ID NO: 3631345 - RNA, 16 nt, Salmonella enterica enterica serovar Typhi
acagauaugaaaugag

SEQ ID NO: 3631346 - RNA, 20 nt, Salmonella enterica enterica serovar Typhi
acagauaugaaaugagacca

SEQ ID NO: 3631347 - RNA, 15 nt, Salmonella enterica enterica serovar Typhi
acagaugccuuguaa

SEQ ID NO: 3631348 - RNA, 21 nt, Salmonella enterica enterica serovar Typhi
acagaugccuuguaagccgga

SEQ ID NO: 3631349 - RNA, 23 nt, Salmonella enterica enterica serovar Typhi
acagauucccagugcgcggucau

SEQ ID NO: 3631350 - RNA, 13 nt, Salmonella enterica enterica serovar Typhi
acagguuaacucc

SEQ ID NO: 3631351 - RNA, 16 nt, Salmonella enterica enterica serovar Typhi
acagguucgaaucccg

SEQ ID NO: 3631352 - RNA, 22 nt, Salmonella enterica enterica serovar Typhi
acagguugcguaacgccacaua

SEQ ID NO: 3631353 - RNA, 12 nt, Salmonella enterica enterica serovar Typhi
acaguacgcccg

SEQ ID NO: 3631354 - RNA, 15 nt, Salmonella enterica enterica serovar Typhi
acaguacgccgaggg

SEQ ID NO: 3631355 - RNA, 21 nt, Salmonella enterica enterica serovar Typhi
acaguagagggggaccucauc

SEQ ID NO: 3631356 - RNA, 20 nt, Salmonella enterica enterica serovar Typhi
acaguagcaggggcuggaga

SEQ ID NO: 3631357 - RNA, 21 nt, Salmonella enterica enterica serovar Typhi
acaguauuuguucagacacau

SEQ ID NO: 3631358 - RNA, 22 nt, Salmonella enterica enterica serovar Typhi
acagucaaacacgaccagcgac

SEQ ID NO: 3631359 - RNA, 14 nt, Salmonella enterica enterica serovar Typhi
acagugaguacgca

SEQ ID NO: 3631360 - RNA, 21 nt, Salmonella enterica enterica serovar Typhi
acagugauuacaaaaugugca

SEQ ID NO: 3631361 - RNA, 20 nt, Salmonella enterica enterica serovar Typhi
acagugauuuacuccaaaaa

SEQ ID NO: 3631362 - RNA, 18 nt, Salmonella enterica enterica serovar Typhi
acaguggaaaguaccaaa

SEQ ID NO: 3631363 - RNA, 19 nt, Salmonella enterica enterica serovar Typhi
acaguuaccacacaugcaa

SEQ ID NO: 3631364 - RNA, 13 nt, Salmonella enterica enterica serovar Typhi
acaguucaaacgg

SEQ ID NO: 3631365 - RNA, 20 nt, Salmonella enterica enterica serovar Typhi
acaguucaaacggcccggcg

SEQ ID NO: 3631366 - RNA, 18 nt, Salmonella enterica enterica serovar Typhi
acaguucccggcaacagu

SEQ ID NO: 3631367 - RNA, 18 nt, Salmonella enterica enterica serovar Typhi
acaguugcgacugauaac

SEQ ID NO: 3631368 - RNA, 12 nt, Salmonella enterica enterica serovar Typhi
acaguuugucaa

SEQ ID NO: 3631369 - RNA, 17 nt, Salmonella enterica enterica serovar Typhi
acauaaaaugguuauug

SEQ ID NO: 3631370 - RNA, 20 nt, Salmonella enterica enterica serovar Typhi
acauaaaaugguuauugcuu

SEQ ID NO: 3631371 - RNA, 14 nt, Salmonella enterica enterica serovar Typhi
acauaaauccggau

SEQ ID NO: 3631372 - RNA, 24 nt, Salmonella enterica enterica serovar Typhi
acauaaccggcaaccaaaguccaa

SEQ ID NO: 3631373 - RNA, 21 nt, Salmonella enterica enterica serovar Typhi
acauaacgcgauagauaccau

SEQ ID NO: 3631374 - RNA, 17 nt, Salmonella enterica enterica serovar Typhi
acauaauauuccagcgu

SEQ ID NO: 3631375 - RNA, 19 nt, Salmonella enterica enterica serovar Typhi
acauaauauuccagcgugc

SEQ ID NO: 3631376 - RNA, 14 nt, Salmonella enterica enterica serovar Typhi
acauaauggagaac

SEQ ID NO: 3631377 - RNA, 17 nt, Salmonella enterica enterica serovar Typhi
acauacaaagagaaaau

SEQ ID NO: 3631378 - RNA, 17 nt, Salmonella enterica enterica serovar Typhi
acauacaccggcgccag

SEQ ID NO: 3631379 - RNA, 23 nt, Salmonella enterica enterica serovar Typhi
acauacaccggcgccagcucugc

SEQ ID NO: 3631380 - RNA, 13 nt, Salmonella enterica enterica serovar Typhi
acauaccgcagau

SEQ ID NO: 3631381 - RNA, 19 nt, Salmonella enterica enterica serovar Typhi
acauaccgucaccacgcgc

SEQ ID NO: 3631382 - RNA, 20 nt, Salmonella enterica enterica serovar Typhi
acauacgccgccagccacug

SEQ ID NO: 3631383 - RNA, 20 nt, Salmonella enterica enterica serovar Typhi
acauacugcuuuuucggcuc

SEQ ID NO: 3631384 - RNA, 22 nt, Salmonella enterica enterica serovar Typhi
acauacuguuaugggucgcuuc

SEQ ID NO: 3631385 - RNA, 15 nt, Salmonella enterica enterica serovar Typhi
acauagaaaauauau

SEQ ID NO: 3631386 - RNA, 21 nt, Salmonella enterica enterica serovar Typhi
acauagaaaauauaugacaac

SEQ ID NO: 3631387 - RNA, 12 nt, Salmonella enterica enterica serovar Typhi
acauagcaucca

SEQ ID NO: 3631388 - RNA, 14 nt, Salmonella enterica enterica serovar Typhi
acauagcuaaauaa

SEQ ID NO: 3631389 - RNA, 15 nt, Salmonella enterica enterica serovar Typhi
acauagcuauauuua

SEQ ID NO: 3631390 - RNA, 19 nt, Salmonella enterica enterica serovar Typhi
acauaggcaauauccuccg

SEQ ID NO: 3631391 - RNA, 13 nt, Salmonella enterica enterica serovar Typhi
acauagggcaucg

SEQ ID NO: 3631392 - RNA, 14 nt, Salmonella enterica enterica serovar Typhi
acauauaauuaaca

SEQ ID NO: 3631393 - RNA, 18 nt, Salmonella enterica enterica serovar Typhi
acauauagcaguuuucac

SEQ ID NO: 3631394 - RNA, 22 nt, Salmonella enterica enterica serovar Typhi
acauauaggcauuaauggcgau

SEQ ID NO: 3631395 - RNA, 17 nt, Salmonella enterica enterica serovar Typhi
acauaucccauacguuu

SEQ ID NO: 3631396 - RNA, 20 nt, Salmonella enterica enterica serovar Typhi
acauaucgacauaaguaaau

SEQ ID NO: 3631397 - RNA, 18 nt, Salmonella enterica enterica serovar Typhi
acauaucgcaauugauac

SEQ ID NO: 3631398 - RNA, 12 nt, Salmonella enterica enterica serovar Typhi
acauaugaagga

SEQ ID NO: 3631399 - RNA, 16 nt, Salmonella enterica enterica serovar Typhi
acauauuccagaagcg

SEQ ID NO: 3631400 - RNA, 15 nt, Salmonella enterica enterica serovar Typhi
acauauuguuuucua

SEQ ID NO: 3631401 - RNA, 19 nt, Salmonella enterica enterica serovar Typhi
acauauuguuuucuauuuu

SEQ ID NO: 3631402 - RNA, 21 nt, Salmonella enterica enterica serovar Typhi
acauauuugcgugucaucaaa

SEQ ID NO: 3631403 - RNA, 22 nt, Salmonella enterica enterica serovar Typhi
acauauuugcgugucaucaaaa

SEQ ID NO: 3631404 - RNA, 23 nt, Salmonella enterica enterica serovar Typhi
acauauuugcgugucaucaaaau

SEQ ID NO: 3631405 - RNA, 12 nt, Salmonella enterica enterica serovar Typhi
acauauuuuuau

SEQ ID NO: 3631406 - RNA, 22 nt, Salmonella enterica enterica serovar Typhi
acauauuuuuaugcacgcuaua

SEQ ID NO: 3631407 - RNA, 13 nt, Salmonella enterica enterica serovar Typhi
acauauuuuuguu

SEQ ID NO: 3631408 - RNA, 13 nt, Salmonella enterica enterica serovar Typhi
acaucaagagaaa

SEQ ID NO: 3631409 - RNA, 12 nt, Salmonella enterica enterica serovar Typhi
acaucaagccca

SEQ ID NO: 3631410 - RNA, 16 nt, Salmonella enterica enterica serovar Typhi
acaucaagcccacaca

SEQ ID NO: 3631411 - RNA, 16 nt, Salmonella enterica enterica serovar Typhi
acaucaauagcgcuac

SEQ ID NO: 3631412 - RNA, 19 nt, Salmonella enterica enterica serovar Typhi
acaucacgcaaaugcagcg

SEQ ID NO: 3631413 - RNA, 15 nt, Salmonella enterica enterica serovar Typhi
acaucacguucgcgc

SEQ ID NO: 3631414 - RNA, 19 nt, Salmonella enterica enterica serovar Typhi
acaucagaaaaaagccaag

SEQ ID NO: 3631415 - RNA, 14 nt, Salmonella enterica enterica serovar Typhi
acaucagaaaacag

SEQ ID NO: 3631416 - RNA, 16 nt, Salmonella enterica enterica serovar Typhi
acaucagagguaauua

SEQ ID NO: 3631417 - RNA, 13 nt, Salmonella enterica enterica serovar Typhi
acaucagauaaac

SEQ ID NO: 3631418 - RNA, 15 nt, Salmonella enterica enterica serovar Typhi
acaucagcaaaugaa

SEQ ID NO: 3631419 - RNA, 18 nt, Salmonella enterica enterica serovar Typhi
acaucagccagcagcuca

SEQ ID NO: 3631420 - RNA, 15 nt, Salmonella enterica enterica serovar Typhi
acaucaucaggccug

SEQ ID NO: 3631421 - RNA, 16 nt, Salmonella enterica enterica serovar Typhi
acaucaugcuugcuuu

SEQ ID NO: 3631422 - RNA, 13 nt, Salmonella enterica enterica serovar Typhi
acaucauuaucca

SEQ ID NO: 3631423 - RNA, 13 nt, Salmonella enterica enterica serovar Typhi
acauccacauagg

SEQ ID NO: 3631424 - RNA, 12 nt, Salmonella enterica enterica serovar Typhi
acauccacuggu

SEQ ID NO: 3631425 - RNA, 14 nt, Salmonella enterica enterica serovar Typhi
acauccagcgccag

SEQ ID NO: 3631426 - RNA, 15 nt, Salmonella enterica enterica serovar Typhi
acaucccagacaaaa

SEQ ID NO: 3631427 - RNA, 22 nt, Salmonella enterica enterica serovar Typhi
acaucccgauaauggcgccgau

SEQ ID NO: 3631428 - RNA, 21 nt, Salmonella enterica enterica serovar Typhi
acauccgauuucauggucauc

SEQ ID NO: 3631429 - RNA, 23 nt, Salmonella enterica enterica serovar Typhi
acauccgcuuuugguuuuucaac

SEQ ID NO: 3631430 - RNA, 13 nt, Salmonella enterica enterica serovar Typhi
acauccucuccug

SEQ ID NO: 3631431 - RNA, 15 nt, Salmonella enterica enterica serovar Typhi
acauccucuccugaa

SEQ ID NO: 3631432 - RNA, 17 nt, Salmonella enterica enterica serovar Typhi
acauccugugaaguaaa

SEQ ID NO: 3631433 - RNA, 20 nt, Salmonella enterica enterica serovar Typhi
acauccugugaaguaaaaaa

SEQ ID NO: 3631434 - RNA, 11 nt, Salmonella enterica enterica serovar Typhi
acaucgccauu

SEQ ID NO: 3631435 - RNA, 22 nt, Salmonella enterica enterica serovar Typhi
acaucgccguuccauuccagaa

SEQ ID NO: 3631436 - RNA, 19 nt, Salmonella enterica enterica serovar Typhi
acaucgccugguaaggcaa

SEQ ID NO: 3631437 - RNA, 16 nt, Salmonella enterica enterica serovar Typhi
acaucgcgucgaggaa

SEQ ID NO: 3631438 - RNA, 15 nt, Salmonella enterica enterica serovar Typhi
acaucgcucccggca

SEQ ID NO: 3631439 - RNA, 16 nt, Salmonella enterica enterica serovar Typhi
acaucgcucccggcac

SEQ ID NO: 3631440 - RNA, 14 nt, Salmonella enterica enterica serovar Typhi
acaucgcuccggca

SEQ ID NO: 3631441 - RNA, 20 nt, Salmonella enterica enterica serovar Typhi
acaucggagauuucauccuc

SEQ ID NO: 3631442 - RNA, 18 nt, Salmonella enterica enterica serovar Typhi
acaucggauuauuuucac

SEQ ID NO: 3631443 - RNA, 12 nt, Salmonella enterica enterica serovar Typhi
acaucguaaauc

SEQ ID NO: 3631444 - RNA, 15 nt, Salmonella enterica enterica serovar Typhi
acaucguaaaucaaa

SEQ ID NO: 3631445 - RNA, 22 nt, Salmonella enterica enterica serovar Typhi
acaucguaaaucaaaugagaau

SEQ ID NO: 3631446 - RNA, 19 nt, Salmonella enterica enterica serovar Typhi
acaucguguauaccaaaaa

SEQ ID NO: 3631447 - RNA, 11 nt, Salmonella enterica enterica serovar Typhi
acaucuacuuc

SEQ ID NO: 3631448 - RNA, 23 nt, Salmonella enterica enterica serovar Typhi
acaucucaucggcuuuuuuguau

SEQ ID NO: 3631449 - RNA, 22 nt, Salmonella enterica enterica serovar Typhi
acaucucuucguguaacgcaua

SEQ ID NO: 3631450 - RNA, 12 nt, Salmonella enterica enterica serovar Typhi
acaucuuccagg

SEQ ID NO: 3631451 - RNA, 15 nt, Salmonella enterica enterica serovar Typhi
acaucuuccaugccu

SEQ ID NO: 3631452 - RNA, 16 nt, Salmonella enterica enterica serovar Typhi
acaucuuccaugccuu

SEQ ID NO: 3631453 - RNA, 15 nt, Salmonella enterica enterica serovar Typhi
acaucuucggcguug

SEQ ID NO: 3631454 - RNA, 15 nt, Salmonella enterica enterica serovar Typhi
acaugaauaauaaua

SEQ ID NO: 3631455 - RNA, 14 nt, Salmonella enterica enterica serovar Typhi
acaugaccgcacag

SEQ ID NO: 3631456 - RNA, 16 nt, Salmonella enterica enterica serovar Typhi
acaugaccgcacagca

SEQ ID NO: 3631457 - RNA, 19 nt, Salmonella enterica enterica serovar Typhi
acaugaccgcacagcagac

SEQ ID NO: 3631458 - RNA, 16 nt, Salmonella enterica enterica serovar Typhi
acaugacgccgaaaua

SEQ ID NO: 3631459 - RNA, 19 nt, Salmonella enterica enterica serovar Typhi
acaugauaaguuucucuuc

SEQ ID NO: 3631460 - RNA, 14 nt, Salmonella enterica enterica serovar Typhi
acaugcaauaccgg

SEQ ID NO: 3631461 - RNA, 19 nt, Salmonella enterica enterica serovar Typhi
acaugcccaccggaccuaa

SEQ ID NO: 3631462 - RNA, 11 nt, Salmonella enterica enterica serovar Typhi
acaugccgcca

SEQ ID NO: 3631463 - RNA, 21 nt, Salmonella enterica enterica serovar Typhi
acaugccggugcgagaaaaag

SEQ ID NO: 3631464 - RNA, 22 nt, Salmonella enterica enterica serovar Typhi
acaugccggugcgagaaaaagc

SEQ ID NO: 3631465 - RNA, 16 nt, Salmonella enterica enterica serovar Typhi
acaugccguuaauaau

SEQ ID NO: 3631466 - RNA, 18 nt, Salmonella enterica enterica serovar Typhi
acaugcguaccugcgcgc

SEQ ID NO: 3631467 - RNA, 21 nt, Salmonella enterica enterica serovar Typhi
acaugcuacaggcaaguuuaa

SEQ ID NO: 3631468 - RNA, 22 nt, Salmonella enterica enterica serovar Typhi
acauggcgaaaaucggcaggcc

SEQ ID NO: 3631469 - RNA, 20 nt, Salmonella enterica enterica serovar Typhi
acauggcggucgccauaugu

SEQ ID NO: 3631470 - RNA, 14 nt, Salmonella enterica enterica serovar Typhi
acaugggcaggaac

SEQ ID NO: 3631471 - RNA, 12 nt, Salmonella enterica enterica serovar Typhi
acauguccagau

SEQ ID NO: 3631472 - RNA, 20 nt, Salmonella enterica enterica serovar Typhi
acauguccuacacucaauac

SEQ ID NO: 3631473 - RNA, 20 nt, Salmonella enterica enterica serovar Typhi
acaugucggcgaaaauccuu

SEQ ID NO: 3631474 - RNA, 16 nt, Salmonella enterica enterica serovar Typhi
acauguugugucggcc

SEQ ID NO: 3631475 - RNA, 18 nt, Salmonella enterica enterica serovar Typhi
acauuaaucgccauugca

SEQ ID NO: 3631476 - RNA, 15 nt, Salmonella enterica enterica serovar Typhi
acauuacaauguaca

SEQ ID NO: 3631477 - RNA, 11 nt, Salmonella enterica enterica serovar Typhi
acauuacccau

SEQ ID NO: 3631478 - RNA, 22 nt, Salmonella enterica enterica serovar Typhi
acauuacccauaucgcggguaa

SEQ ID NO: 3631479 - RNA, 22 nt, Salmonella enterica enterica serovar Typhi
acauuagagaguaaaaccggca

SEQ ID NO: 3631480 - RNA, 17 nt, Salmonella enterica enterica serovar Typhi
acauuauuaaaaugucu

SEQ ID NO: 3631481 - RNA, 16 nt, Salmonella enterica enterica serovar Typhi
acauuauugcacauaa

SEQ ID NO: 3631482 - RNA, 15 nt, Salmonella enterica enterica serovar Typhi
acauuauugucuuug

SEQ ID NO: 3631483 - RNA, 20 nt, Salmonella enterica enterica serovar Typhi
acauucaaaccuucaagaau

SEQ ID NO: 3631484 - RNA, 13 nt, Salmonella enterica enterica serovar Typhi
acauucagcacau

SEQ ID NO: 3631485 - RNA, 15 nt, Salmonella enterica enterica serovar Typhi
acauucaggcgguaa

SEQ ID NO: 3631486 - RNA, 18 nt, Salmonella enterica enterica serovar Typhi
acauucauugccgccagu

SEQ ID NO: 3631487 - RNA, 21 nt, Salmonella enterica enterica serovar Typhi
acauuccauuuuucgaucuuc

SEQ ID NO: 3631488 - RNA, 20 nt, Salmonella enterica enterica serovar Typhi
acauuccugacauuuauauu

SEQ ID NO: 3631489 - RNA, 21 nt, Salmonella enterica enterica serovar Typhi
acauugaguaaauaaaucagc

SEQ ID NO: 3631490 - RNA, 19 nt, Salmonella enterica enterica serovar Typhi
acauugccggauggcggcg

SEQ ID NO: 3631491 - RNA, 14 nt, Salmonella enterica enterica serovar Typhi
acauugccggcauc

SEQ ID NO: 3631492 - RNA, 18 nt, Salmonella enterica enterica serovar Typhi
acauugcuguggaaaauc

SEQ ID NO: 3631493 - RNA, 20 nt, Salmonella enterica enterica serovar Typhi
acauugcuguggaaaaucug

SEQ ID NO: 3631494 - RNA, 22 nt, Salmonella enterica enterica serovar Typhi
acauuggcaaaccccugcucgc

SEQ ID NO: 3631495 - RNA, 18 nt, Salmonella enterica enterica serovar Typhi
acauugucagcugaacag

SEQ ID NO: 3631496 - RNA, 18 nt, Salmonella enterica enterica serovar Typhi
acauugucgaacugcacg

SEQ ID NO: 3631497 - RNA, 16 nt, Salmonella enterica enterica serovar Typhi
acauuuaagauuuaaa

SEQ ID NO: 3631498 - RNA, 12 nt, Salmonella enterica enterica serovar Typhi
acauuuauauua

SEQ ID NO: 3631499 - RNA, 17 nt, Salmonella enterica enterica serovar Typhi
acauuuaucuuccggca

SEQ ID NO: 3631500 - RNA, 19 nt, Salmonella enterica enterica serovar Typhi
acauuucagcgcagaauuu

SEQ ID NO: 3631501 - RNA, 20 nt, Salmonella enterica enterica serovar Typhi
acauuucccgagccggguua

SEQ ID NO: 3631502 - RNA, 18 nt, Salmonella enterica enterica serovar Typhi
acauuuuuacaguuacca

SEQ ID NO: 3631503 - RNA, 13 nt, Salmonella enterica enterica serovar Typhi
accaaaacaguac

SEQ ID NO: 3631504 - RNA, 21 nt, Salmonella enterica enterica serovar Typhi
accaaaauggcaaguaaaaua

SEQ ID NO: 3631505 - RNA, 22 nt, Salmonella enterica enterica serovar Typhi
accaaacccuuuggcaaaaaag

SEQ ID NO: 3631506 - RNA, 12 nt, Salmonella enterica enterica serovar Typhi
accaaagccagg

SEQ ID NO: 3631507 - RNA, 14 nt, Salmonella enterica enterica serovar Typhi
accaaagccaggcc

SEQ ID NO: 3631508 - RNA, 21 nt, Salmonella enterica enterica serovar Typhi
accaaagccaggccgccagca

SEQ ID NO: 3631509 - RNA, 16 nt, Salmonella enterica enterica serovar Typhi
accaaagucaaacuga

SEQ ID NO: 3631510 - RNA, 14 nt, Salmonella enterica enterica serovar Typhi
accaacaacagaua

SEQ ID NO: 3631511 - RNA, 14 nt, Salmonella enterica enterica serovar Typhi
accaacaucauuau

SEQ ID NO: 3631512 - RNA, 13 nt, Salmonella enterica enterica serovar Typhi
accaaccaacagg

SEQ ID NO: 3631513 - RNA, 18 nt, Salmonella enterica enterica serovar Typhi
accaacccagccugcgau

SEQ ID NO: 3631514 - RNA, 17 nt, Salmonella enterica enterica serovar Typhi
accaaccgccagucacc

SEQ ID NO: 3631515 - RNA, 18 nt, Salmonella enterica enterica serovar Typhi
accaacgaccaucaagca

SEQ ID NO: 3631516 - RNA, 20 nt, Salmonella enterica enterica serovar Typhi
accaacgccgcuuuaccgcc

SEQ ID NO: 3631517 - RNA, 20 nt, Salmonella enterica enterica serovar Typhi
accaacgucgugccagugau

SEQ ID NO: 3631518 - RNA, 22 nt, Salmonella enterica enterica serovar Typhi
accaacgucgugccagugaugc

SEQ ID NO: 3631519 - RNA, 17 nt, Salmonella enterica enterica serovar Typhi
accaacguuuuuccuug

SEQ ID NO: 3631520 - RNA, 18 nt, Salmonella enterica enterica serovar Typhi
accaacguuuuuccuuga

SEQ ID NO: 3631521 - RNA, 21 nt, Salmonella enterica enterica serovar Typhi
accaacuuuuccuaauuuuua

SEQ ID NO: 3631522 - RNA, 16 nt, Salmonella enterica enterica serovar Typhi
accagagacauugccu

SEQ ID NO: 3631523 - RNA, 20 nt, Salmonella enterica enterica serovar Typhi
accagaucaacaugguguuu

SEQ ID NO: 3631524 - RNA, 20 nt, Salmonella enterica enterica serovar Typhi
accagcaaugauaacggcgc

SEQ ID NO: 3631525 - RNA, 22 nt, Salmonella enterica enterica serovar Typhi
accagcaaugauaacggcgcca

SEQ ID NO: 3631526 - RNA, 14 nt, Salmonella enterica enterica serovar Typhi
accagcacaaaaaa

SEQ ID NO: 3631527 - RNA, 14 nt, Salmonella enterica enterica serovar Typhi
accagcacagccca

SEQ ID NO: 3631528 - RNA, 12 nt, Salmonella enterica enterica serovar Typhi
accagcagcaga

SEQ ID NO: 3631529 - RNA, 11 nt, Salmonella enterica enterica serovar Typhi
accagcagcau

SEQ ID NO: 3631530 - RNA, 23 nt, Salmonella enterica enterica serovar Typhi
accagcaggugcggauaguccug

SEQ ID NO: 3631531 - RNA, 21 nt, Salmonella enterica enterica serovar Typhi
accagcaggugguacaucaaa

SEQ ID NO: 3631532 - RNA, 12 nt, Salmonella enterica enterica serovar Typhi
accagcauaaua

SEQ ID NO: 3631533 - RNA, 12 nt, Salmonella enterica enterica serovar Typhi
accagcauaaug

SEQ ID NO: 3631534 - RNA, 15 nt, Salmonella enterica enterica serovar Typhi
accagccacugcgcc

SEQ ID NO: 3631535 - RNA, 13 nt, Salmonella enterica enterica serovar Typhi
accagccaugcca

SEQ ID NO: 3631536 - RNA, 18 nt, Salmonella enterica enterica serovar Typhi
accagcccaugaaggagc

SEQ ID NO: 3631537 - RNA, 14 nt, Salmonella enterica enterica serovar Typhi
accagccccacggu

SEQ ID NO: 3631538 - RNA, 19 nt, Salmonella enterica enterica serovar Typhi
accagccccacgguacgac

SEQ ID NO: 3631539 - RNA, 20 nt, Salmonella enterica enterica serovar Typhi
accagccgagugcuuaugua

SEQ ID NO: 3631540 - RNA, 18 nt, Salmonella enterica enterica serovar Typhi
accagccgauaacucuuc

SEQ ID NO: 3631541 - RNA, 18 nt, Salmonella enterica enterica serovar Typhi
accagccgcaucuuauau

SEQ ID NO: 3631542 - RNA, 19 nt, Salmonella enterica enterica serovar Typhi
accagccuaccugccgcca

SEQ ID NO: 3631543 - RNA, 14 nt, Salmonella enterica enterica serovar Typhi
accagccugccguc

SEQ ID NO: 3631544 - RNA, 15 nt, Salmonella enterica enterica serovar Typhi
accagccugccgucu

SEQ ID NO: 3631545 - RNA, 13 nt, Salmonella enterica enterica serovar Typhi
accagcgacggcc

SEQ ID NO: 3631546 - RNA, 15 nt, Salmonella enterica enterica serovar Typhi
accagcgacggccag

SEQ ID NO: 3631547 - RNA, 15 nt, Salmonella enterica enterica serovar Typhi
accagcgaugcgcgc

SEQ ID NO: 3631548 - RNA, 22 nt, Salmonella enterica enterica serovar Typhi
accagcgaugcgcgcgcguuau

SEQ ID NO: 3631549 - RNA, 17 nt, Salmonella enterica enterica serovar Typhi
accagcgcauugacgau

SEQ ID NO: 3631550 - RNA, 15 nt, Salmonella enterica enterica serovar Typhi
accagcgccauaauc

SEQ ID NO: 3631551 - RNA, 18 nt, Salmonella enterica enterica serovar Typhi
accagcgccauaauccag

SEQ ID NO: 3631552 - RNA, 15 nt, Salmonella enterica enterica serovar Typhi
accagcgccugcgcu

SEQ ID NO: 3631553 - RNA, 12 nt, Salmonella enterica enterica serovar Typhi
accagcgcgcca

SEQ ID NO: 3631554 - RNA, 15 nt, Salmonella enterica enterica serovar Typhi
accagcgcgccaucc

SEQ ID NO: 3631555 - RNA, 18 nt, Salmonella enterica enterica serovar Typhi
accagcgcgccauccuga

SEQ ID NO: 3631556 - RNA, 15 nt, Salmonella enterica enterica serovar Typhi
accagcgcggcgcca

SEQ ID NO: 3631557 - RNA, 17 nt, Salmonella enterica enterica serovar Typhi
accagcgcuauccaggc

SEQ ID NO: 3631558 - RNA, 17 nt, Salmonella enterica enterica serovar Typhi
accagcggaauccccgc

SEQ ID NO: 3631559 - RNA, 16 nt, Salmonella enterica enterica serovar Typhi
accagcggcaccagca

SEQ ID NO: 3631560 - RNA, 17 nt, Salmonella enterica enterica serovar Typhi
accagcggcaccagcac

SEQ ID NO: 3631561 - RNA, 22 nt, Salmonella enterica enterica serovar Typhi
accagcgguugcauaaaauccu

SEQ ID NO: 3631562 - RNA, 17 nt, Salmonella enterica enterica serovar Typhi
accagcgugcgcucagg

SEQ ID NO: 3631563 - RNA, 18 nt, Salmonella enterica enterica serovar Typhi
accagcugacgacgccag

SEQ ID NO: 3631564 - RNA, 20 nt, Salmonella enterica enterica serovar Typhi
accagcugacgacgccagcc

SEQ ID NO: 3631565 - RNA, 21 nt, Salmonella enterica enterica serovar Typhi
accagcugacgacgccagccc

SEQ ID NO: 3631566 - RNA, 15 nt, Salmonella enterica enterica serovar Typhi
accagcugacgcagc

SEQ ID NO: 3631567 - RNA, 18 nt, Salmonella enterica enterica serovar Typhi
accagcugacgcagcagu

SEQ ID NO: 3631568 - RNA, 18 nt, Salmonella enterica enterica serovar Typhi
accagcuuguuauccauc

SEQ ID NO: 3631569 - RNA, 21 nt, Salmonella enterica enterica serovar Typhi
accagcuuguuauccaucagc

SEQ ID NO: 3631570 - RNA, 17 nt, Salmonella enterica enterica serovar Typhi
accaggaugccaaccac

SEQ ID NO: 3631571 - RNA, 23 nt, Salmonella enterica enterica serovar Typhi
accaggauggccagcaccagcau

SEQ ID NO: 3631572 - RNA, 15 nt, Salmonella enterica enterica serovar Typhi
accaggcaaaccagc

SEQ ID NO: 3631573 - RNA, 18 nt, Salmonella enterica enterica serovar Typhi
accaggcaaugccccgcc

SEQ ID NO: 3631574 - RNA, 15 nt, Salmonella enterica enterica serovar Typhi
accaggcacugcagg

SEQ ID NO: 3631575 - RNA, 20 nt, Salmonella enterica enterica serovar Typhi
accaggcagcgcgccagcgc

SEQ ID NO: 3631576 - RNA, 15 nt, Salmonella enterica enterica serovar Typhi
accaggcaugcagcu

SEQ ID NO: 3631577 - RNA, 13 nt, Salmonella enterica enterica serovar Typhi
accaggcggcguu

SEQ ID NO: 3631578 - RNA, 16 nt, Salmonella enterica enterica serovar Typhi
accaggucgccagcgg

SEQ ID NO: 3631579 - RNA, 22 nt, Salmonella enterica enterica serovar Typhi
accaggucguccguugccaccc

SEQ ID NO: 3631580 - RNA, 22 nt, Salmonella enterica enterica serovar Typhi
accaggucuuaccuauuuuaaa

SEQ ID NO: 3631581 - RNA, 14 nt, Salmonella enterica enterica serovar Typhi
accaguaaccgcca

SEQ ID NO: 3631582 - RNA, 15 nt, Salmonella enterica enterica serovar Typhi
accaguaaccgccac

SEQ ID NO: 3631583 - RNA, 17 nt, Salmonella enterica enterica serovar Typhi
accaguaccgucauuuc

SEQ ID NO: 3631584 - RNA, 23 nt, Salmonella enterica enterica serovar Typhi
accaguccggcagaaagcagcag

SEQ ID NO: 3631585 - RNA, 15 nt, Salmonella enterica enterica serovar Typhi
accagucggcaaaga

SEQ ID NO: 3631586 - RNA, 23 nt, Salmonella enterica enterica serovar Typhi
accagucggcaaagaccaauaaa

SEQ ID NO: 3631587 - RNA, 15 nt, Salmonella enterica enterica serovar Typhi
accaguggcggggca

SEQ ID NO: 3631588 - RNA, 21 nt, Salmonella enterica enterica serovar Typhi
accaguucacuccuaagagaa

SEQ ID NO: 3631589 - RNA, 18 nt, Salmonella enterica enterica serovar Typhi
accaguugaccaaacagc

SEQ ID NO: 3631590 - RNA, 15 nt, Salmonella enterica enterica serovar Typhi
accaguugcgucagc

SEQ ID NO: 3631591 - RNA, 17 nt, Salmonella enterica enterica serovar Typhi
accauaaacaaaacaac

SEQ ID NO: 3631592 - RNA, 19 nt, Salmonella enterica enterica serovar Typhi
accauaaaugaaaccucaa

SEQ ID NO: 3631593 - RNA, 13 nt, Salmonella enterica enterica serovar Typhi
accauaaugaucg

SEQ ID NO: 3631594 - RNA, 22 nt, Salmonella enterica enterica serovar Typhi
accauaauugagaucauaauga

SEQ ID NO: 3631595 - RNA, 14 nt, Salmonella enterica enterica serovar Typhi
accauaauuuccgg

SEQ ID NO: 3631596 - RNA, 21 nt, Salmonella enterica enterica serovar Typhi
accauaccgcuuaacagcgua

SEQ ID NO: 3631597 - RNA, 22 nt, Salmonella enterica enterica serovar Typhi
accauaccggugcgccccagca

SEQ ID NO: 3631598 - RNA, 18 nt, Salmonella enterica enterica serovar Typhi
accauacuaaugcugccc

SEQ ID NO: 3631599 - RNA, 16 nt, Salmonella enterica enterica serovar Typhi
accauacugaccaaca

SEQ ID NO: 3631600 - RNA, 16 nt, Salmonella enterica enterica serovar Typhi
accauacugacuuaau

SEQ ID NO: 3631601 - RNA, 17 nt, Salmonella enterica enterica serovar Typhi
accauacugacuuaaua

SEQ ID NO: 3631602 - RNA, 18 nt, Salmonella enterica enterica serovar Typhi
accauacugacuuaauaa

SEQ ID NO: 3631603 - RNA, 23 nt, Salmonella enterica enterica serovar Typhi
accauacugcucaagaauacccu

SEQ ID NO: 3631604 - RNA, 12 nt, Salmonella enterica enterica serovar Typhi
accauagcagcc

SEQ ID NO: 3631605 - RNA, 14 nt, Salmonella enterica enterica serovar Typhi
accauaucaaacag

SEQ ID NO: 3631606 - RNA, 13 nt, Salmonella enterica enterica serovar Typhi
accauaugcggca

SEQ ID NO: 3631607 - RNA, 14 nt, Salmonella enterica enterica serovar Typhi
accauaugcggcau

SEQ ID NO: 3631608 - RNA, 17 nt, Salmonella enterica enterica serovar Typhi
accccggcgcggcgcgc

SEQ ID NO: 3631609 - RNA, 13 nt, Salmonella enterica enterica serovar Typhi
accccugacgggc

SEQ ID NO: 3631610 - RNA, 18 nt, Salmonella enterica enterica serovar Typhi
accccuguucaaaauagc

SEQ ID NO: 3631611 - RNA, 20 nt, Salmonella enterica enterica serovar Typhi
accccuucuggagaauaucc

SEQ ID NO: 3631612 - RNA, 21 nt, Salmonella enterica enterica serovar Typhi
acccgaacaacaauacgcguc

SEQ ID NO: 3631613 - RNA, 21 nt, Salmonella enterica enterica serovar Typhi
acccgaccauuuuugacacag

SEQ ID NO: 3631614 - RNA, 16 nt, Salmonella enterica enterica serovar Typhi
acccgaccgucuuugu

SEQ ID NO: 3631615 - RNA, 16 nt, Salmonella enterica enterica serovar Typhi
acccgauaaaaucauc

SEQ ID NO: 3631616 - RNA, 17 nt, Salmonella enterica enterica serovar Typhi
acccgauaccgccagcc

SEQ ID NO: 3631617 - RNA, 20 nt, Salmonella enterica enterica serovar Typhi
acccgauaccgccagcccca

SEQ ID NO: 3631618 - RNA, 20 nt, Salmonella enterica enterica serovar Typhi
acccgauagcgccgcgcuau

SEQ ID NO: 3631619 - RNA, 21 nt, Salmonella enterica enterica serovar Typhi
acccgauagcgccgcgcuauc

SEQ ID NO: 3631620 - RNA, 21 nt, Salmonella enterica enterica serovar Typhi
acccgaucgccauccugcacc

SEQ ID NO: 3631621 - RNA, 22 nt, Salmonella enterica enterica serovar Typhi
acccgaucgccauccugcaccg

SEQ ID NO: 3631622 - RNA, 12 nt, Salmonella enterica enterica serovar Typhi
acccgaugcgag

SEQ ID NO: 3631623 - RNA, 20 nt, Salmonella enterica enterica serovar Typhi
acccgaugcgaguagcaaau

SEQ ID NO: 3631624 - RNA, 19 nt, Salmonella enterica enterica serovar Typhi
acccgcacccgaaagucaa

SEQ ID NO: 3631625 - RNA, 17 nt, Salmonella enterica enterica serovar Typhi
acccgcagccagaacag

SEQ ID NO: 3631626 - RNA, 15 nt, Salmonella enterica enterica serovar Typhi
acccgcagccggaua

SEQ ID NO: 3631627 - RNA, 16 nt, Salmonella enterica enterica serovar Typhi
acccgcccgguuuugu

SEQ ID NO: 3631628 - RNA, 19 nt, Salmonella enterica enterica serovar Typhi
acccgccgccagcaccgcc

SEQ ID NO: 3631629 - RNA, 13 nt, Salmonella enterica enterica serovar Typhi
acccgccggcagc

SEQ ID NO: 3631630 - RNA, 21 nt, Salmonella enterica enterica serovar Typhi
acccgcgaucacuaccgccau

SEQ ID NO: 3631631 - RNA, 17 nt, Salmonella enterica enterica serovar Typhi
acccgcgcucuccggca

SEQ ID NO: 3631632 - RNA, 22 nt, Salmonella enterica enterica serovar Typhi
acccgcuacgcgugaugugccg

SEQ ID NO: 3631633 - RNA, 13 nt, Salmonella enterica enterica serovar Typhi
acccgcuccagaa

SEQ ID NO: 3631634 - RNA, 16 nt, Salmonella enterica enterica serovar Typhi
acccgcuccagaagca

SEQ ID NO: 3631635 - RNA, 19 nt, Salmonella enterica enterica serovar Typhi
acccgcucgcccgccgcaa

SEQ ID NO: 3631636 - RNA, 15 nt, Salmonella enterica enterica serovar Typhi
acccgcuuccaguuu

SEQ ID NO: 3631637 - RNA, 18 nt, Salmonella enterica enterica serovar Typhi
acccgcuuucgcguagcc

SEQ ID NO: 3631638 - RNA, 18 nt, Salmonella enterica enterica serovar Typhi
acccgcuuuuccuguucu

SEQ ID NO: 3631639 - RNA, 16 nt, Salmonella enterica enterica serovar Typhi
acccggagagaaacaa

SEQ ID NO: 3631640 - RNA, 22 nt, Salmonella enterica enterica serovar Typhi
acccggcaaaggaauuacgggc

SEQ ID NO: 3631641 - RNA, 14 nt, Salmonella enterica enterica serovar Typhi
acccggcccggcgc

SEQ ID NO: 3631642 - RNA, 17 nt, Salmonella enterica enterica serovar Typhi
acccggcgcaaacuuca

SEQ ID NO: 3631643 - RNA, 21 nt, Salmonella enterica enterica serovar Typhi
acccgggccaucuuuuuucac

SEQ ID NO: 3631644 - RNA, 19 nt, Salmonella enterica enterica serovar Typhi
acccguuaaauaccagcac

SEQ ID NO: 3631645 - RNA, 22 nt, Salmonella enterica enterica serovar Typhi
acccguuacgcagucagcacug

SEQ ID NO: 3631646 - RNA, 17 nt, Salmonella enterica enterica serovar Typhi
acccguuauucauucac

SEQ ID NO: 3631647 - RNA, 21 nt, Salmonella enterica enterica serovar Typhi
acccguuauucauucacccaa

SEQ ID NO: 3631648 - RNA, 16 nt, Salmonella enterica enterica serovar Typhi
acccguucgaaugaga

SEQ ID NO: 3631649 - RNA, 21 nt, Salmonella enterica enterica serovar Typhi
acccuauaagcugccucuuug

SEQ ID NO: 3631650 - RNA, 18 nt, Salmonella enterica enterica serovar Typhi
acccuauugccacaauau

SEQ ID NO: 3631651 - RNA, 19 nt, Salmonella enterica enterica serovar Typhi
acccuauugccacaauauc

SEQ ID NO: 3631652 - RNA, 16 nt, Salmonella enterica enterica serovar Typhi
acccucgaaugugaau

SEQ ID NO: 3631653 - RNA, 22 nt, Salmonella enterica enterica serovar Typhi
acccugccguuugcgccagccc

SEQ ID NO: 3631654 - RNA, 15 nt, Salmonella enterica enterica serovar Typhi
acccugcugauacac

SEQ ID NO: 3631655 - RNA, 20 nt, Salmonella enterica enterica serovar Typhi
acccuguaggccugauaagc

SEQ ID NO: 3631656 - RNA, 20 nt, Salmonella enterica enterica serovar Typhi
acccuguauuaccugaugag

SEQ ID NO: 3631657 - RNA, 16 nt, Salmonella enterica enterica serovar Typhi
acccuucagauauccc

SEQ ID NO: 3631658 - RNA, 15 nt, Salmonella enterica enterica serovar Typhi
acccuucauacugcg

SEQ ID NO: 3631659 - RNA, 14 nt, Salmonella enterica enterica serovar Typhi
acccuucaugcagc

SEQ ID NO: 3631660 - RNA, 13 nt, Salmonella enterica enterica serovar Typhi
acccuuccuuuuc

SEQ ID NO: 3631661 - RNA, 17 nt, Salmonella enterica enterica serovar Typhi
acccuucuucuggcuca

SEQ ID NO: 3631662 - RNA, 18 nt, Salmonella enterica enterica serovar Typhi
acccuuugaccauuacca

SEQ ID NO: 3631663 - RNA, 19 nt, Salmonella enterica enterica serovar Typhi
acccuuuuccggaugcccc

SEQ ID NO: 3631664 - RNA, 12 nt, Salmonella enterica enterica serovar Typhi
accgaaagcgac

SEQ ID NO: 3631665 - RNA, 18 nt, Salmonella enterica enterica serovar Typhi
accgaaauccgcuuugag

SEQ ID NO: 3631666 - RNA, 13 nt, Salmonella enterica enterica serovar Typhi
accgaaaucuucg

SEQ ID NO: 3631667 - RNA, 16 nt, Salmonella enterica enterica serovar Typhi
accgaaaucuucgccu

SEQ ID NO: 3631668 - RNA, 17 nt, Salmonella enterica enterica serovar Typhi
accgaacagccaggcuu

SEQ ID NO: 3631669 - RNA, 16 nt, Salmonella enterica enterica serovar Typhi
accgacaacguuuuca

SEQ ID NO: 3631670 - RNA, 17 nt, Salmonella enterica enterica serovar Typhi
accgacaauauucgccg

SEQ ID NO: 3631671 - RNA, 21 nt, Salmonella enterica enterica serovar Typhi
accgacaauauucgccgcgau

SEQ ID NO: 3631672 - RNA, 22 nt, Salmonella enterica enterica serovar Typhi
accgacacgugguacacaauca

SEQ ID NO: 3631673 - RNA, 15 nt, Salmonella enterica enterica serovar Typhi
accgacuaucagaaa

SEQ ID NO: 3631674 - RNA, 13 nt, Salmonella enterica enterica serovar Typhi
accgagacagaga

SEQ ID NO: 3631675 - RNA, 14 nt, Salmonella enterica enterica serovar Typhi
accgagcauccgcg

SEQ ID NO: 3631676 - RNA, 20 nt, Salmonella enterica enterica serovar Typhi
accgagcgcaugguagaagu

SEQ ID NO: 3631677 - RNA, 14 nt, Salmonella enterica enterica serovar Typhi
accgaggcaggggc

SEQ ID NO: 3631678 - RNA, 13 nt, Salmonella enterica enterica serovar Typhi
accgauaaauacc

SEQ ID NO: 3631679 - RNA, 18 nt, Salmonella enterica enterica serovar Typhi
accgauaaucaccagccc

SEQ ID NO: 3631680 - RNA, 19 nt, Salmonella enterica enterica serovar Typhi
accgauaaucaccagcccg

SEQ ID NO: 3631681 - RNA, 18 nt, Salmonella enterica enterica serovar Typhi
accgauauuuugcugcac

SEQ ID NO: 3631682 - RNA, 12 nt, Salmonella enterica enterica serovar Typhi
accgaucaucau

SEQ ID NO: 3631683 - RNA, 16 nt, Salmonella enterica enterica serovar Typhi
accgaugcccagcuug

SEQ ID NO: 3631684 - RNA, 21 nt, Salmonella enterica enterica serovar Typhi
accgaugugcguauugagcgc

SEQ ID NO: 3631685 - RNA, 18 nt, Salmonella enterica enterica serovar Typhi
accgauguuggcgacaga

SEQ ID NO: 3631686 - RNA, 16 nt, Salmonella enterica enterica serovar Typhi
accgcacaucacugcc

SEQ ID NO: 3631687 - RNA, 13 nt, Salmonella enterica enterica serovar Typhi
accgcagaaaaag

SEQ ID NO: 3631688 - RNA, 18 nt, Salmonella enterica enterica serovar Typhi
accgcagaaacagauagu

SEQ ID NO: 3631689 - RNA, 14 nt, Salmonella enterica enterica serovar Typhi
accgcagauaacag

SEQ ID NO: 3631690 - RNA, 20 nt, Salmonella enterica enterica serovar Typhi
accgcauacccgacacggcu

SEQ ID NO: 3631691 - RNA, 21 nt, Salmonella enterica enterica serovar Typhi
accgcaucaaugcccagcgca

SEQ ID NO: 3631692 - RNA, 14 nt, Salmonella enterica enterica serovar Typhi
accgcaucacgcga

SEQ ID NO: 3631693 - RNA, 21 nt, Salmonella enterica enterica serovar Typhi
accgcaucacgcgaagcggcg

SEQ ID NO: 3631694 - RNA, 23 nt, Salmonella enterica enterica serovar Typhi
accggcauuucaccgucaauaac

SEQ ID NO: 3631695 - RNA, 15 nt, Salmonella enterica enterica serovar Typhi
accggccacgagcug

SEQ ID NO: 3631696 - RNA, 12 nt, Salmonella enterica enterica serovar Typhi
accggcccagcu

SEQ ID NO: 3631697 - RNA, 14 nt, Salmonella enterica enterica serovar Typhi
accggcccccggcc

SEQ ID NO: 3631698 - RNA, 23 nt, Salmonella enterica enterica serovar Typhi
accggcccgggcacgauggccug

SEQ ID NO: 3631699 - RNA, 14 nt, Salmonella enterica enterica serovar Typhi
accggccgccaucg

SEQ ID NO: 3631700 - RNA, 19 nt, Salmonella enterica enterica serovar Typhi
accggccgccaucgcaauc

SEQ ID NO: 3631701 - RNA, 15 nt, Salmonella enterica enterica serovar Typhi
accggccgcccggac

SEQ ID NO: 3631702 - RNA, 21 nt, Salmonella enterica enterica serovar Typhi
accggcgaacguuggcugggu

SEQ ID NO: 3631703 - RNA, 18 nt, Salmonella enterica enterica serovar Typhi
accggcgacgugacgcgc

SEQ ID NO: 3631704 - RNA, 17 nt, Salmonella enterica enterica serovar Typhi
accggcgauguuggcgc

SEQ ID NO: 3631705 - RNA, 19 nt, Salmonella enterica enterica serovar Typhi
accggcgcgccuuccagca

SEQ ID NO: 3631706 - RNA, 22 nt, Salmonella enterica enterica serovar Typhi
accggcgguugagauuggcccg

SEQ ID NO: 3631707 - RNA, 16 nt, Salmonella enterica enterica serovar Typhi
accggcguaauugcgc

SEQ ID NO: 3631708 - RNA, 17 nt, Salmonella enterica enterica serovar Typhi
accggcguaauugcgcc

SEQ ID NO: 3631709 - RNA, 15 nt, Salmonella enterica enterica serovar Typhi
accggcgucaucauu

SEQ ID NO: 3631710 - RNA, 21 nt, Salmonella enterica enterica serovar Typhi
accggcuccggguugccugau

SEQ ID NO: 3631711 - RNA, 21 nt, Salmonella enterica enterica serovar Typhi
accggcuguauacacuuucca

SEQ ID NO: 3631712 - RNA, 16 nt, Salmonella enterica enterica serovar Typhi
accgggaucgggacau

SEQ ID NO: 3631713 - RNA, 19 nt, Salmonella enterica enterica serovar Typhi
accgggcagacaugaccgc

SEQ ID NO: 3631714 - RNA, 22 nt, Salmonella enterica enterica serovar Typhi
accgggccuccuuuccugugcu

SEQ ID NO: 3631715 - RNA, 17 nt, Salmonella enterica enterica serovar Typhi
accgggccugaugcgcg

SEQ ID NO: 3631716 - RNA, 23 nt, Salmonella enterica enterica serovar Typhi
accgggccugaugcgcguuuagc

SEQ ID NO: 3631717 - RNA, 20 nt, Salmonella enterica enterica serovar Typhi
accgggcgaaagcacuucuc

SEQ ID NO: 3631718 - RNA, 20 nt, Salmonella enterica enterica serovar Typhi
accgggcugcagcccuuacg

SEQ ID NO: 3631719 - RNA, 18 nt, Salmonella enterica enterica serovar Typhi
accggguuaaagcccuga

SEQ ID NO: 3631720 - RNA, 22 nt, Salmonella enterica enterica serovar Typhi
accgguaaauuucacuucgccc

SEQ ID NO: 3631721 - RNA, 15 nt, Salmonella enterica enterica serovar Typhi
accgguaaggcaggc

SEQ ID NO: 3631722 - RNA, 18 nt, Salmonella enterica enterica serovar Typhi
accgguaaucccuucacg

SEQ ID NO: 3631723 - RNA, 16 nt, Salmonella enterica enterica serovar Typhi
accgguaaugauacca

SEQ ID NO: 3631724 - RNA, 19 nt, Salmonella enterica enterica serovar Typhi
accgguacgcaacgcuucu

SEQ ID NO: 3631725 - RNA, 21 nt, Salmonella enterica enterica serovar Typhi
accgguaucgaucacgcgcag

SEQ ID NO: 3631726 - RNA, 14 nt, Salmonella enterica enterica serovar Typhi
accggucagccggu

SEQ ID NO: 3631727 - RNA, 14 nt, Salmonella enterica enterica serovar Typhi
accggugcgcccca

SEQ ID NO: 3631728 - RNA, 16 nt, Salmonella enterica enterica serovar Typhi
accggugcgccccagc

SEQ ID NO: 3631729 - RNA, 20 nt, Salmonella enterica enterica serovar Typhi
accggugcggagcaggcaau

SEQ ID NO: 3631730 - RNA, 15 nt, Salmonella enterica enterica serovar Typhi
accgguuugucauuc

SEQ ID NO: 3631731 - RNA, 23 nt, Salmonella enterica enterica serovar Typhi
accgguuuguuauugaucacggu

SEQ ID NO: 3631732 - RNA, 19 nt, Salmonella enterica enterica serovar Typhi
accguaaaaugcuggugca

SEQ ID NO: 3631733 - RNA, 18 nt, Salmonella enterica enterica serovar Typhi
accguaaacgccugcacc

SEQ ID NO: 3631734 - RNA, 19 nt, Salmonella enterica enterica serovar Typhi
accguaaacgccugcacca

SEQ ID NO: 3631735 - RNA, 13 nt, Salmonella enterica enterica serovar Typhi
accguaaccgcag

SEQ ID NO: 3631736 - RNA, 16 nt, Salmonella enterica enterica serovar Typhi
accguaacuacaauac

SEQ ID NO: 3631737 - RNA, 23 nt, Salmonella enterica enterica serovar Typhi
accguaagcuuucugaauuucac

SEQ ID NO: 3631738 - RNA, 22 nt, Salmonella enterica enterica serovar Typhi
accguaauaguuucgacuuuca

SEQ ID NO: 3631739 - RNA, 15 nt, Salmonella enterica enterica serovar Typhi
accguaaucaucgcg

SEQ ID NO: 3631740 - RNA, 19 nt, Salmonella enterica enterica serovar Typhi
accguauccuuccagcccg

SEQ ID NO: 3631741 - RNA, 18 nt, Salmonella enterica enterica serovar Typhi
accguauuaucaaaucuu

SEQ ID NO: 3631742 - RNA, 18 nt, Salmonella enterica enterica serovar Typhi
accguauugccagaucug

SEQ ID NO: 3631743 - RNA, 15 nt, Salmonella enterica enterica serovar Typhi
accgucaaaacgcgc

SEQ ID NO: 3631744 - RNA, 17 nt, Salmonella enterica enterica serovar Typhi
accgucaaaacgcgcau

SEQ ID NO: 3631745 - RNA, 18 nt, Salmonella enterica enterica serovar Typhi
accgucaauaacgggcac

SEQ ID NO: 3631746 - RNA, 13 nt, Salmonella enterica enterica serovar Typhi
accgucaccacgc

SEQ ID NO: 3631747 - RNA, 17 nt, Salmonella enterica enterica serovar Typhi
accgucaccacgcgcga

SEQ ID NO: 3631748 - RNA, 21 nt, Salmonella enterica enterica serovar Typhi
accgucacugaaccugccuuu

SEQ ID NO: 3631749 - RNA, 14 nt, Salmonella enterica enterica serovar Typhi
accgucagauucug

SEQ ID NO: 3631750 - RNA, 20 nt, Salmonella enterica enterica serovar Typhi
accgucagauucugcgguaa

SEQ ID NO: 3631751 - RNA, 22 nt, Salmonella enterica enterica serovar Typhi
accgucagccccguacaagguc

SEQ ID NO: 3631752 - RNA, 13 nt, Salmonella enterica enterica serovar Typhi
accgucaucgccc

SEQ ID NO: 3631753 - RNA, 13 nt, Salmonella enterica enterica serovar Typhi
accguccacaucc

SEQ ID NO: 3631754 - RNA, 15 nt, Salmonella enterica enterica serovar Typhi
accguccacauccag

SEQ ID NO: 3631755 - RNA, 15 nt, Salmonella enterica enterica serovar Typhi
accguccccagccag

SEQ ID NO: 3631756 - RNA, 17 nt, Salmonella enterica enterica serovar Typhi
accgucgaucucggcca

SEQ ID NO: 3631757 - RNA, 17 nt, Salmonella enterica enterica serovar Typhi
accgucgccgacaacgc

SEQ ID NO: 3631758 - RNA, 18 nt, Salmonella enterica enterica serovar Typhi
accgucguuacccuccug

SEQ ID NO: 3631759 - RNA, 16 nt, Salmonella enterica enterica serovar Typhi
accgucuccaugucac

SEQ ID NO: 3631760 - RNA, 18 nt, Salmonella enterica enterica serovar Typhi
accgucuggcgaggcgcc

SEQ ID NO: 3631761 - RNA, 13 nt, Salmonella enterica enterica serovar Typhi
accgugagcgcgc

SEQ ID NO: 3631762 - RNA, 19 nt, Salmonella enterica enterica serovar Typhi
accgugaugcggacgcuga

SEQ ID NO: 3631763 - RNA, 12 nt, Salmonella enterica enterica serovar Typhi
accgugauuuuu

SEQ ID NO: 3631764 - RNA, 15 nt, Salmonella enterica enterica serovar Typhi
accguggccuccggc

SEQ ID NO: 3631765 - RNA, 16 nt, Salmonella enterica enterica serovar Typhi
accguggucuccgccu

SEQ ID NO: 3631766 - RNA, 16 nt, Salmonella enterica enterica serovar Typhi
accgugugcagugaca

SEQ ID NO: 3631767 - RNA, 22 nt, Salmonella enterica enterica serovar Typhi
accguuaacguuuuacgcugcc

SEQ ID NO: 3631768 - RNA, 14 nt, Salmonella enterica enterica serovar Typhi
accguuauccggca

SEQ ID NO: 3631769 - RNA, 13 nt, Salmonella enterica enterica serovar Typhi
accguucacggcg

SEQ ID NO: 3631770 - RNA, 19 nt, Salmonella enterica enterica serovar Typhi
accguucucaauccgcagc

SEQ ID NO: 3631771 - RNA, 19 nt, Salmonella enterica enterica serovar Typhi
accguucuuccuggggauc

SEQ ID NO: 3631772 - RNA, 16 nt, Salmonella enterica enterica serovar Typhi
accguugcgcccauca

SEQ ID NO: 3631773 - RNA, 23 nt, Salmonella enterica enterica serovar Typhi
accguuggaauaaaucacaacgu

SEQ ID NO: 3631774 - RNA, 23 nt, Salmonella enterica enterica serovar Typhi
accguugucggggcuuuaaugcu

SEQ ID NO: 3631775 - RNA, 17 nt, Salmonella enterica enterica serovar Typhi
accguuuaaacgggcag

SEQ ID NO: 3631776 - RNA, 20 nt, Salmonella enterica enterica serovar Typhi
accguuuaaucgcccugcgg

SEQ ID NO: 3631777 - RNA, 22 nt, Salmonella enterica enterica serovar Typhi
accuaaauaagcgccgaguagc

SEQ ID NO: 3631778 - RNA, 22 nt, Salmonella enterica enterica serovar Typhi
accuaaucccuggcgaauaaaa

SEQ ID NO: 3631779 - RNA, 17 nt, Salmonella enterica enterica serovar Typhi
accuucacauuggcaaa

SEQ ID NO: 3631780 - RNA, 15 nt, Salmonella enterica enterica serovar Typhi
accuucaccggauac

SEQ ID NO: 3631781 - RNA, 15 nt, Salmonella enterica enterica serovar Typhi
accuucacgccgcca

SEQ ID NO: 3631782 - RNA, 21 nt, Salmonella enterica enterica serovar Typhi
accuucaucucuuugcccguc

SEQ ID NO: 3631783 - RNA, 14 nt, Salmonella enterica enterica serovar Typhi
accuucauggcguu

SEQ ID NO: 3631784 - RNA, 19 nt, Salmonella enterica enterica serovar Typhi
accuuccauuaugaugagu

SEQ ID NO: 3631785 - RNA, 22 nt, Salmonella enterica enterica serovar Typhi
accuucccgcgauaaaaacagc

SEQ ID NO: 3631786 - RNA, 15 nt, Salmonella enterica enterica serovar Typhi
accuucgacgagguu

SEQ ID NO: 3631787 - RNA, 11 nt, Salmonella enterica enterica serovar Typhi
accuucgcguu

SEQ ID NO: 3631788 - RNA, 17 nt, Salmonella enterica enterica serovar Typhi
accuucggucccaucgc

SEQ ID NO: 3631789 - RNA, 13 nt, Salmonella enterica enterica serovar Typhi
accuucugugaaa

SEQ ID NO: 3631790 - RNA, 14 nt, Salmonella enterica enterica serovar Typhi
accuucuucacuaa

SEQ ID NO: 3631791 - RNA, 21 nt, Salmonella enterica enterica serovar Typhi
accuucuucacuaaaaacagg

SEQ ID NO: 3631792 - RNA, 14 nt, Salmonella enterica enterica serovar Typhi
accuucuucgccaa

SEQ ID NO: 3631793 - RNA, 19 nt, Salmonella enterica enterica serovar Typhi
accuucuugcucaaaaagc

SEQ ID NO: 3631794 - RNA, 22 nt, Salmonella enterica enterica serovar Typhi
accuugcccuggaauuuuucca

SEQ ID NO: 3631795 - RNA, 16 nt, Salmonella enterica enterica serovar Typhi
accuugcgccucuggu

SEQ ID NO: 3631796 - RNA, 14 nt, Salmonella enterica enterica serovar Typhi
accuuguucuucca

SEQ ID NO: 3631797 - RNA, 15 nt, Salmonella enterica enterica serovar Typhi
accuuguucuuccau

SEQ ID NO: 3631798 - RNA, 12 nt, Salmonella enterica enterica serovar Typhi
accuuuccaguc

SEQ ID NO: 3631799 - RNA, 13 nt, Salmonella enterica enterica serovar Typhi
accuuucuucucu

SEQ ID NO: 3631800 - RNA, 21 nt, Salmonella enterica enterica serovar Typhi
accuuuggaggagagcgucau

SEQ ID NO: 3631801 - RNA, 21 nt, Salmonella enterica enterica serovar Typhi
accuuuucauuggucaguaag

SEQ ID NO: 3631802 - RNA, 22 nt, Salmonella enterica enterica serovar Typhi
accuuuuugauccguuucagaa

SEQ ID NO: 3631803 - RNA, 20 nt, Salmonella enterica enterica serovar Typhi
accuuuuuuuccagcgucug

SEQ ID NO: 3631804 - RNA, 13 nt, Salmonella enterica enterica serovar Typhi
acgaaaaaaaaga

SEQ ID NO: 3631805 - RNA, 14 nt, Salmonella enterica enterica serovar Typhi
acgaaaaaagcgcc

SEQ ID NO: 3631806 - RNA, 11 nt, Salmonella enterica enterica serovar Typhi
acgaaaaauaa

SEQ ID NO: 3631807 - RNA, 12 nt, Salmonella enterica enterica serovar Typhi
acgaaaaauaaa

SEQ ID NO: 3631808 - RNA, 14 nt, Salmonella enterica enterica serovar Typhi
acgaaaaauaaaaa

SEQ ID NO: 3631809 - RNA, 16 nt, Salmonella enterica enterica serovar Typhi
acgaaaaucauccgcu

SEQ ID NO: 3631810 - RNA, 14 nt, Salmonella enterica enterica serovar Typhi
acgaaaauuauuuu

SEQ ID NO: 3631811 - RNA, 16 nt, Salmonella enterica enterica serovar Typhi
acgaaacagauuaaaa

SEQ ID NO: 3631812 - RNA, 22 nt, Salmonella enterica enterica serovar Typhi
acgaaaccggcggcgacuggcu

SEQ ID NO: 3631813 - RNA, 23 nt, Salmonella enterica enterica serovar Typhi
acgaaagcggcgaauauagcuaa

SEQ ID NO: 3631814 - RNA, 20 nt, Salmonella enterica enterica serovar Typhi
acgaaaucgucauugaccgg

SEQ ID NO: 3631815 - RNA, 21 nt, Salmonella enterica enterica serovar Typhi
acgaaauggugugcauggugu

SEQ ID NO: 3631816 - RNA, 21 nt, Salmonella enterica enterica serovar Typhi
acgaacaacaucagacaguac

SEQ ID NO: 3631817 - RNA, 13 nt, Salmonella enterica enterica serovar Typhi
acgaacacggcgu

SEQ ID NO: 3631818 - RNA, 14 nt, Salmonella enterica enterica serovar Typhi
acgaaccgagcggu

SEQ ID NO: 3631819 - RNA, 16 nt, Salmonella enterica enterica serovar Typhi
acgaaccguggccucc

SEQ ID NO: 3631820 - RNA, 18 nt, Salmonella enterica enterica serovar Typhi
acgaacgcuaugcgccag

SEQ ID NO: 3631821 - RNA, 21 nt, Salmonella enterica enterica serovar Typhi
acgaacuccccgacugcugcg

SEQ ID NO: 3631822 - RNA, 19 nt, Salmonella enterica enterica serovar Typhi
acgaagaucgcguacagcg

SEQ ID NO: 3631823 - RNA, 22 nt, Salmonella enterica enterica serovar Typhi
acgaagaucgcguacagcgcca

SEQ ID NO: 3631824 - RNA, 22 nt, Salmonella enterica enterica serovar Typhi
acgaaguccuucacaaacuucu

SEQ ID NO: 3631825 - RNA, 21 nt, Salmonella enterica enterica serovar Typhi
acgaaguuuaauucuuugagc

SEQ ID NO: 3631826 - RNA, 18 nt, Salmonella enterica enterica serovar Typhi
acgaauauucauuuccag

SEQ ID NO: 3631827 - RNA, 17 nt, Salmonella enterica enterica serovar Typhi
acgaaucucgcugccgg

SEQ ID NO: 3631828 - RNA, 18 nt, Salmonella enterica enterica serovar Typhi
acgaaucucgcugccgga

SEQ ID NO: 3631829 - RNA, 19 nt, Salmonella enterica enterica serovar Typhi
acgaauggcggcguuuucc

SEQ ID NO: 3631830 - RNA, 16 nt, Salmonella enterica enterica serovar Typhi
acgaauuuaaauagca

SEQ ID NO: 3631831 - RNA, 18 nt, Salmonella enterica enterica serovar Typhi
acgaauuuaaauagcaau

SEQ ID NO: 3631832 - RNA, 19 nt, Salmonella enterica enterica serovar Typhi
acgaauuuacucgccaaua

SEQ ID NO: 3631833 - RNA, 18 nt, Salmonella enterica enterica serovar Typhi
acgacaacuucuaauuuu

SEQ ID NO: 3631834 - RNA, 21 nt, Salmonella enterica enterica serovar Typhi
acgacacccgauacacgccga

SEQ ID NO: 3631835 - RNA, 16 nt, Salmonella enterica enterica serovar Typhi
acgacacuuuugccga

SEQ ID NO: 3631836 - RNA, 14 nt, Salmonella enterica enterica serovar Typhi
acgacagaauaugc

SEQ ID NO: 3631837 - RNA, 24 nt, Salmonella enterica enterica serovar Typhi
acgaccagaaucaucaugucguca

SEQ ID NO: 3631838 - RNA, 15 nt, Salmonella enterica enterica serovar Typhi
acgaccauaaauagc

SEQ ID NO: 3631839 - RNA, 17 nt, Salmonella enterica enterica serovar Typhi
acgaccaugguucccgc

SEQ ID NO: 3631840 - RNA, 18 nt, Salmonella enterica enterica serovar Typhi
acgaccccgccgagaauu

SEQ ID NO: 3631841 - RNA, 23 nt, Salmonella enterica enterica serovar Typhi
acgacccuuuuuugguuauccag

SEQ ID NO: 3631842 - RNA, 20 nt, Salmonella enterica enterica serovar Typhi
acgaccgccgacaaucguca

SEQ ID NO: 3631843 - RNA, 23 nt, Salmonella enterica enterica serovar Typhi
acgacgaggggcuuugugccgca

SEQ ID NO: 3631844 - RNA, 16 nt, Salmonella enterica enterica serovar Typhi
acgacgccagccagcc

SEQ ID NO: 3631845 - RNA, 22 nt, Salmonella enterica enterica serovar Typhi
acgacgcgguacccaccucuga

SEQ ID NO: 3631846 - RNA, 22 nt, Salmonella enterica enterica serovar Typhi
acgacgucgacgccuuccacuu

SEQ ID NO: 3631847 - RNA, 21 nt, Salmonella enterica enterica serovar Typhi
acgacuccaauaauggagaug

SEQ ID NO: 3631848 - RNA, 19 nt, Salmonella enterica enterica serovar Typhi
acgacugcaaaaagguagu

SEQ ID NO: 3631849 - RNA, 19 nt, Salmonella enterica enterica serovar Typhi
acgacuuuugcaaucgcag

SEQ ID NO: 3631850 - RNA, 18 nt, Salmonella enterica enterica serovar Typhi
acgagaacccacuuugcu

SEQ ID NO: 3631851 - RNA, 19 nt, Salmonella enterica enterica serovar Typhi
acgagaacucggaggcggc

SEQ ID NO: 3631852 - RNA, 18 nt, Salmonella enterica enterica serovar Typhi
acgagaagcgauuagcug

SEQ ID NO: 3631853 - RNA, 16 nt, Salmonella enterica enterica serovar Typhi
acgagaauaagaccaa

SEQ ID NO: 3631854 - RNA, 18 nt, Salmonella enterica enterica serovar Typhi
acgagcgaaaaacugucg

SEQ ID NO: 3631855 - RNA, 20 nt, Salmonella enterica enterica serovar Typhi
acgagcgcgucagcgccucc

SEQ ID NO: 3631856 - RNA, 19 nt, Salmonella enterica enterica serovar Typhi
acgaggccacgcagcgcag

SEQ ID NO: 3631857 - RNA, 13 nt, Salmonella enterica enterica serovar Typhi
acgagugaucccg

SEQ ID NO: 3631858 - RNA, 18 nt, Salmonella enterica enterica serovar Typhi
acgagugcguucuuccac

SEQ ID NO: 3631859 - RNA, 18 nt, Salmonella enterica enterica serovar Typhi
acgaguugcggcaacgug

SEQ ID NO: 3631860 - RNA, 13 nt, Salmonella enterica enterica serovar Typhi
acgauaaaaaaag

SEQ ID NO: 3631861 - RNA, 15 nt, Salmonella enterica enterica serovar Typhi
acgauaaaccucacg

SEQ ID NO: 3631862 - RNA, 15 nt, Salmonella enterica enterica serovar Typhi
acgauaaauaagagu

SEQ ID NO: 3631863 - RNA, 19 nt, Salmonella enterica enterica serovar Typhi
acgauaaauuuucagacac

SEQ ID NO: 3631864 - RNA, 13 nt, Salmonella enterica enterica serovar Typhi
acgccaaaaagug

SEQ ID NO: 3631865 - RNA, 12 nt, Salmonella enterica enterica serovar Typhi
acgccaacgcgc

SEQ ID NO: 3631866 - RNA, 20 nt, Salmonella enterica enterica serovar Typhi
acgccaacguccgccgucag

SEQ ID NO: 3631867 - RNA, 14 nt, Salmonella enterica enterica serovar Typhi
acgccaagcugcaa

SEQ ID NO: 3631868 - RNA, 23 nt, Salmonella enterica enterica serovar Typhi
acgccaauuccuaucaguacgac

SEQ ID NO: 3631869 - RNA, 14 nt, Salmonella enterica enterica serovar Typhi
acgccacaaacugc

SEQ ID NO: 3631870 - RNA, 16 nt, Salmonella enterica enterica serovar Typhi
acgccaccacagucau

SEQ ID NO: 3631871 - RNA, 14 nt, Salmonella enterica enterica serovar Typhi
acgccaccacgccg

SEQ ID NO: 3631872 - RNA, 17 nt, Salmonella enterica enterica serovar Typhi
acgccaccgccaccugc

SEQ ID NO: 3631873 - RNA, 18 nt, Salmonella enterica enterica serovar Typhi
acgccaccgccaccugcc

SEQ ID NO: 3631874 - RNA, 17 nt, Salmonella enterica enterica serovar Typhi
acgccaccgggccguca

SEQ ID NO: 3631875 - RNA, 23 nt, Salmonella enterica enterica serovar Typhi
acgccaccggguuaaagcccuga

SEQ ID NO: 3631876 - RNA, 18 nt, Salmonella enterica enterica serovar Typhi
acgccagaccgacgccaa

SEQ ID NO: 3631877 - RNA, 24 nt, Salmonella enterica enterica serovar Typhi
acgccagacuauccguccucuuuc

SEQ ID NO: 3631878 - RNA, 19 nt, Salmonella enterica enterica serovar Typhi
acgccagccagaauauuag

SEQ ID NO: 3631879 - RNA, 12 nt, Salmonella enterica enterica serovar Typhi
acgccagccagc

SEQ ID NO: 3631880 - RNA, 18 nt, Salmonella enterica enterica serovar Typhi
acgccagccauuaaagaa

SEQ ID NO: 3631881 - RNA, 18 nt, Salmonella enterica enterica serovar Typhi
acgccaggguaauacugg

SEQ ID NO: 3631882 - RNA, 21 nt, Salmonella enterica enterica serovar Typhi
acgccagguagccgacggcca

SEQ ID NO: 3631883 - RNA, 18 nt, Salmonella enterica enterica serovar Typhi
acgccagucuuugcagga

SEQ ID NO: 3631884 - RNA, 14 nt, Salmonella enterica enterica serovar Typhi
acgccagugcgcau

SEQ ID NO: 3631885 - RNA, 16 nt, Salmonella enterica enterica serovar Typhi
acgccaguucccacag

SEQ ID NO: 3631886 - RNA, 21 nt, Salmonella enterica enterica serovar Typhi
acgccaguucccacagcuuca

SEQ ID NO: 3631887 - RNA, 13 nt, Salmonella enterica enterica serovar Typhi
acgccaucgcggc

SEQ ID NO: 3631888 - RNA, 19 nt, Salmonella enterica enterica serovar Typhi
acgccaucgcggcgcaaau

SEQ ID NO: 3631889 - RNA, 20 nt, Salmonella enterica enterica serovar Typhi
acgccaucugugccagccca

SEQ ID NO: 3631890 - RNA, 16 nt, Salmonella enterica enterica serovar Typhi
acgccaucuuucuuuu

SEQ ID NO: 3631891 - RNA, 23 nt, Salmonella enterica enterica serovar Typhi
acgccaugcucauccaacugcgc

SEQ ID NO: 3631892 - RNA, 15 nt, Salmonella enterica enterica serovar Typhi
acgccauggccgcag

SEQ ID NO: 3631893 - RNA, 21 nt, Salmonella enterica enterica serovar Typhi
acgccauucggcguaucggaa

SEQ ID NO: 3631894 - RNA, 22 nt, Salmonella enterica enterica serovar Typhi
acgcccacgcggcgugcgcugc

SEQ ID NO: 3631895 - RNA, 14 nt, Salmonella enterica enterica serovar Typhi
acgcccagccguga

SEQ ID NO: 3631896 - RNA, 12 nt, Salmonella enterica enterica serovar Typhi
acgcccagcgcc

SEQ ID NO: 3631897 - RNA, 22 nt, Salmonella enterica enterica serovar Typhi
acgcccagcgccgagaaaauca

SEQ ID NO: 3631898 - RNA, 17 nt, Salmonella enterica enterica serovar Typhi
acgcccagcuauuuuuc

SEQ ID NO: 3631899 - RNA, 16 nt, Salmonella enterica enterica serovar Typhi
acgcccauuaugccgc

SEQ ID NO: 3631900 - RNA, 18 nt, Salmonella enterica enterica serovar Typhi
acgccccaauaccacaac

SEQ ID NO: 3631901 - RNA, 16 nt, Salmonella enterica enterica serovar Typhi
acgccccacagaccua

SEQ ID NO: 3631902 - RNA, 22 nt, Salmonella enterica enterica serovar Typhi
acgccccccuaccggaaucgcc

SEQ ID NO: 3631903 - RNA, 16 nt, Salmonella enterica enterica serovar Typhi
acgcccccugccagcg

SEQ ID NO: 3631904 - RNA, 20 nt, Salmonella enterica enterica serovar Typhi
acgcccgaccacgcccagcu

SEQ ID NO: 3631905 - RNA, 17 nt, Salmonella enterica enterica serovar Typhi
acgcccgccgccagcau

SEQ ID NO: 3631906 - RNA, 18 nt, Salmonella enterica enterica serovar Typhi
acgcccgccguaacgcgc

SEQ ID NO: 3631907 - RNA, 22 nt, Salmonella enterica enterica serovar Typhi
acgcccgccguaacgcgcaucu

SEQ ID NO: 3631908 - RNA, 13 nt, Salmonella enterica enterica serovar Typhi
acgcccucaauau

SEQ ID NO: 3631909 - RNA, 23 nt, Salmonella enterica enterica serovar Typhi
acgcccuucacgccgaagugcgc

SEQ ID NO: 3631910 - RNA, 19 nt, Salmonella enterica enterica serovar Typhi
acgccgaacaacacggcgg

SEQ ID NO: 3631911 - RNA, 18 nt, Salmonella enterica enterica serovar Typhi
acgccgacgaccggcagc

SEQ ID NO: 3631912 - RNA, 19 nt, Salmonella enterica enterica serovar Typhi
acgccgacucacgcagcgc

SEQ ID NO: 3631913 - RNA, 18 nt, Salmonella enterica enterica serovar Typhi
acgccgaggcauucagcc

SEQ ID NO: 3631914 - RNA, 14 nt, Salmonella enterica enterica serovar Typhi
acgccgcaaacgcc

SEQ ID NO: 3631915 - RNA, 16 nt, Salmonella enterica enterica serovar Typhi
acgccgccaaagcgau

SEQ ID NO: 3631916 - RNA, 17 nt, Salmonella enterica enterica serovar Typhi
acgccgccauccggcac

SEQ ID NO: 3631917 - RNA, 14 nt, Salmonella enterica enterica serovar Typhi
acgccgccgacaug

SEQ ID NO: 3631918 - RNA, 16 nt, Salmonella enterica enterica serovar Typhi
acgccgccgcaggcca

SEQ ID NO: 3631919 - RNA, 15 nt, Salmonella enterica enterica serovar Typhi
acgccgccgcccaga

SEQ ID NO: 3631920 - RNA, 14 nt, Salmonella enterica enterica serovar Typhi
acgccgccuggcau

SEQ ID NO: 3631921 - RNA, 18 nt, Salmonella enterica enterica serovar Typhi
acgccgcgcugcggcguc

SEQ ID NO: 3631922 - RNA, 19 nt, Salmonella enterica enterica serovar Typhi
acgccgcuaucgaccagca

SEQ ID NO: 3631923 - RNA, 22 nt, Salmonella enterica enterica serovar Typhi
acgccgcuggcggaaauaaaca

SEQ ID NO: 3631924 - RNA, 16 nt, Salmonella enterica enterica serovar Typhi
acgccgcuguuuucac

SEQ ID NO: 3631925 - RNA, 18 nt, Salmonella enterica enterica serovar Typhi
acgccgcuguuuucacuc

SEQ ID NO: 3631926 - RNA, 17 nt, Salmonella enterica enterica serovar Typhi
acgccggaccagacgac

SEQ ID NO: 3631927 - RNA, 17 nt, Salmonella enterica enterica serovar Typhi
acgccggagaccggcga

SEQ ID NO: 3631928 - RNA, 14 nt, Salmonella enterica enterica serovar Typhi
acgccggaugcgag

SEQ ID NO: 3631929 - RNA, 19 nt, Salmonella enterica enterica serovar Typhi
acgccggcaacacccgccg

SEQ ID NO: 3631930 - RNA, 18 nt, Salmonella enterica enterica serovar Typhi
acgccgggaaauuuuucg

SEQ ID NO: 3631931 - RNA, 21 nt, Salmonella enterica enterica serovar Typhi
acgccgggcauuaaugguuau

SEQ ID NO: 3631932 - RNA, 14 nt, Salmonella enterica enterica serovar Typhi
acgccgggccugcc

SEQ ID NO: 3631933 - RNA, 21 nt, Salmonella enterica enterica serovar Typhi
acgccggggauaucaaugcgc

SEQ ID NO: 3631934 - RNA, 22 nt, Salmonella enterica enterica serovar Typhi
acgccggggauaucaaugcgcg

SEQ ID NO: 3631935 - RNA, 21 nt, Salmonella enterica enterica serovar Typhi
acgccggugauuuuaaaguaa

SEQ ID NO: 3631936 - RNA, 16 nt, Salmonella enterica enterica serovar Typhi
acgccggugccugccg

SEQ ID NO: 3631937 - RNA, 20 nt, Salmonella enterica enterica serovar Typhi
acgccggugccugccgccuc

SEQ ID NO: 3631938 - RNA, 17 nt, Salmonella enterica enterica serovar Typhi
acgccguacuccagccc

SEQ ID NO: 3631939 - RNA, 17 nt, Salmonella enterica enterica serovar Typhi
acgccguagcugcgcgc

SEQ ID NO: 3631940 - RNA, 22 nt, Salmonella enterica enterica serovar Typhi
acgccguagcugcgcgccgcaa

SEQ ID NO: 3631941 - RNA, 16 nt, Salmonella enterica enterica serovar Typhi
acgccgucacaaagcc

SEQ ID NO: 3631942 - RNA, 21 nt, Salmonella enterica enterica serovar Typhi
acgccgucacaaagcccaccg

SEQ ID NO: 3631943 - RNA, 15 nt, Salmonella enterica enterica serovar Typhi
acgccguccaggcuc

SEQ ID NO: 3631944 - RNA, 18 nt, Salmonella enterica enterica serovar Typhi
acgccguccggcgaacaa

SEQ ID NO: 3631945 - RNA, 22 nt, Salmonella enterica enterica serovar Typhi
acgccguccggcgaacaaacuc

SEQ ID NO: 3631946 - RNA, 14 nt, Salmonella enterica enterica serovar Typhi
acgccgucgacaaa

SEQ ID NO: 3631947 - RNA, 18 nt, Salmonella enterica enterica serovar Typhi
acgccgucgaugauggcg

SEQ ID NO: 3631948 - RNA, 22 nt, Salmonella enterica enterica serovar Typhi
acgccgucgaugauggcggcua

SEQ ID NO: 3631949 - RNA, 13 nt, Salmonella enterica enterica serovar Typhi
acgcuauuuuuca

SEQ ID NO: 3631950 - RNA, 15 nt, Salmonella enterica enterica serovar Typhi
acgcucaaccgguuu

SEQ ID NO: 3631951 - RNA, 15 nt, Salmonella enterica enterica serovar Typhi
acgcucacccaguuu

SEQ ID NO: 3631952 - RNA, 23 nt, Salmonella enterica enterica serovar Typhi
acgcucacgcagauauucauuga

SEQ ID NO: 3631953 - RNA, 23 nt, Salmonella enterica enterica serovar Typhi
acgcucacuuuucuuuccugcaa

SEQ ID NO: 3631954 - RNA, 12 nt, Salmonella enterica enterica serovar Typhi
acgcuccagcag

SEQ ID NO: 3631955 - RNA, 16 nt, Salmonella enterica enterica serovar Typhi
acgcuccggcaggcaa

SEQ ID NO: 3631956 - RNA, 22 nt, Salmonella enterica enterica serovar Typhi
acgcuccgguuuuugcgcgcug

SEQ ID NO: 3631957 - RNA, 15 nt, Salmonella enterica enterica serovar Typhi
acgcuccugcuccug

SEQ ID NO: 3631958 - RNA, 16 nt, Salmonella enterica enterica serovar Typhi
acgcucgaguucuuca

SEQ ID NO: 3631959 - RNA, 19 nt, Salmonella enterica enterica serovar Typhi
acgcucgaguucuucacgc

SEQ ID NO: 3631960 - RNA, 19 nt, Salmonella enterica enterica serovar Typhi
acgcucgcugauggcgaga

SEQ ID NO: 3631961 - RNA, 18 nt, Salmonella enterica enterica serovar Typhi
acgcugaaaacggcauca

SEQ ID NO: 3631962 - RNA, 13 nt, Salmonella enterica enterica serovar Typhi
acgcugaagcuug

SEQ ID NO: 3631963 - RNA, 23 nt, Salmonella enterica enterica serovar Typhi
acgcugaauaucgucaguaugca

SEQ ID NO: 3631964 - RNA, 19 nt, Salmonella enterica enterica serovar Typhi
acgcugaccacgccgccgc

SEQ ID NO: 3631965 - RNA, 18 nt, Salmonella enterica enterica serovar Typhi
acgcugagagaacugcga

SEQ ID NO: 3631966 - RNA, 20 nt, Salmonella enterica enterica serovar Typhi
acgcugauacguaacaugac

SEQ ID NO: 3631967 - RNA, 9 nt, Salmonella enterica enterica serovar Typhi
acgcugaug

SEQ ID NO: 3631968 - RNA, 15 nt, Salmonella enterica enterica serovar Typhi
acgcugaugaaaacc

SEQ ID NO: 3631969 - RNA, 22 nt, Salmonella enterica enterica serovar Typhi
acgcugaugcugugcagacugc

SEQ ID NO: 3631970 - RNA, 17 nt, Salmonella enterica enterica serovar Typhi
acgcugcaaaguuauua

SEQ ID NO: 3631971 - RNA, 21 nt, Salmonella enterica enterica serovar Typhi
acgcugcaaaguuauuacauu

SEQ ID NO: 3631972 - RNA, 16 nt, Salmonella enterica enterica serovar Typhi
acgcugcacacgcugg

SEQ ID NO: 3631973 - RNA, 22 nt, Salmonella enterica enterica serovar Typhi
acgcugcauauaacuuucaaua

SEQ ID NO: 3631974 - RNA, 15 nt, Salmonella enterica enterica serovar Typhi
acgcugcgccgcgcc

SEQ ID NO: 3631975 - RNA, 21 nt, Salmonella enterica enterica serovar Typhi
acgcugcgcguucugcuccag

SEQ ID NO: 3631976 - RNA, 19 nt, Salmonella enterica enterica serovar Typhi
acgcugcgcuuauccggcc

SEQ ID NO: 3631977 - RNA, 20 nt, Salmonella enterica enterica serovar Typhi
acgcugcuccggcuuaaugc

SEQ ID NO: 3631978 - RNA, 20 nt, Salmonella enterica enterica serovar Typhi
acgcuggaaaauuucaguga

SEQ ID NO: 3631979 - RNA, 21 nt, Salmonella enterica enterica serovar Typhi
acgcuggaaaauuucagugaa

SEQ ID NO: 3631980 - RNA, 15 nt, Salmonella enterica enterica serovar Typhi
acgcuggacaauagc

SEQ ID NO: 3631981 - RNA, 14 nt, Salmonella enterica enterica serovar Typhi
acgcuggcacagga

SEQ ID NO: 3631982 - RNA, 18 nt, Salmonella enterica enterica serovar Typhi
acgcuggugcgcgggaga

SEQ ID NO: 3631983 - RNA, 23 nt, Salmonella enterica enterica serovar Typhi
acgcugguuugugugcaggagca

SEQ ID NO: 3631984 - RNA, 23 nt, Salmonella enterica enterica serovar Typhi
acgcuguaacccgccgccaucaa

SEQ ID NO: 3631985 - RNA, 20 nt, Salmonella enterica enterica serovar Typhi
acgcuguagcuggcugccgu

SEQ ID NO: 3631986 - RNA, 17 nt, Salmonella enterica enterica serovar Typhi
acgcugugcgagaccau

SEQ ID NO: 3631987 - RNA, 14 nt, Salmonella enterica enterica serovar Typhi
acgcuguucgcaac

SEQ ID NO: 3631988 - RNA, 14 nt, Salmonella enterica enterica serovar Typhi
acgcuguugccgcu

SEQ ID NO: 3631989 - RNA, 19 nt, Salmonella enterica enterica serovar Typhi
acgcuuaucagcccuacaa

SEQ ID NO: 3631990 - RNA, 20 nt, Salmonella enterica enterica serovar Typhi
acgcuuaucaggccuacaac

SEQ ID NO: 3631991 - RNA, 20 nt, Salmonella enterica enterica serovar Typhi
acgcuuaucaggccuacauc

SEQ ID NO: 3631992 - RNA, 23 nt, Salmonella enterica enterica serovar Typhi
acgcuuaucaggccuacauccgg

SEQ ID NO: 3631993 - RNA, 19 nt, Salmonella enterica enterica serovar Typhi
acgcuuaucaguccccaca

SEQ ID NO: 3631994 - RNA, 14 nt, Salmonella enterica enterica serovar Typhi
acgcuuauccggcu

SEQ ID NO: 3631995 - RNA, 19 nt, Salmonella enterica enterica serovar Typhi
acgcuuaugcugccuacaa

SEQ ID NO: 3631996 - RNA, 18 nt, Salmonella enterica enterica serovar Typhi
acgcuucacgucagcgac

SEQ ID NO: 3631997 - RNA, 16 nt, Salmonella enterica enterica serovar Typhi
acgcuucagagcaggu

SEQ ID NO: 3631998 - RNA, 15 nt, Salmonella enterica enterica serovar Typhi
acgcuucuucgauuu

SEQ ID NO: 3631999 - RNA, 19 nt, Salmonella enterica enterica serovar Typhi
acgcuuguuguaaagaaau

SEQ ID NO: 3632000 - RNA, 20 nt, Salmonella enterica enterica serovar Typhi
acgcuuuacgcuuaucccag

SEQ ID NO: 3632001 - RNA, 22 nt, Salmonella enterica enterica serovar Typhi
acgcuuuaggguaucauuucca

SEQ ID NO: 3632002 - RNA, 21 nt, Salmonella enterica enterica serovar Typhi
acgcuuugcgauagcccggca

SEQ ID NO: 3632003 - RNA, 23 nt, Salmonella enterica enterica serovar Typhi
acgcuuuggcaggccucuaucuu

SEQ ID NO: 3632004 - RNA, 20 nt, Salmonella enterica enterica serovar Typhi
acgcuuuucagcgccagaua

SEQ ID NO: 3632005 - RNA, 21 nt, Salmonella enterica enterica serovar Typhi
acgcuuuuuugcuggcuggcg

SEQ ID NO: 3632006 - RNA, 17 nt, Salmonella enterica enterica serovar Typhi
acggaaaagcauugcuu

SEQ ID NO: 3632007 - RNA, 14 nt, Salmonella enterica enterica serovar Typhi
acggaaaccagaua

SEQ ID NO: 3632008 - RNA, 16 nt, Salmonella enterica enterica serovar Typhi
acggaaaccagauauc

SEQ ID NO: 3632009 - RNA, 14 nt, Salmonella enterica enterica serovar Typhi
acggaaauagcgcc

SEQ ID NO: 3632010 - RNA, 22 nt, Salmonella enterica enterica serovar Typhi
acggaaaugaucagacgcauca

SEQ ID NO: 3632011 - RNA, 19 nt, Salmonella enterica enterica serovar Typhi
acggaacaaaacggaaugu

SEQ ID NO: 3632012 - RNA, 23 nt, Salmonella enterica enterica serovar Typhi
acggaacaacggcacacaggccg

SEQ ID NO: 3632013 - RNA, 23 nt, Salmonella enterica enterica serovar Typhi
acggaacaacggcauacaggccg

SEQ ID NO: 3632014 - RNA, 14 nt, Salmonella enterica enterica serovar Typhi
acggaacccagcaa

SEQ ID NO: 3632015 - RNA, 20 nt, Salmonella enterica enterica serovar Typhi
acggaagucugaccgucagc

SEQ ID NO: 3632016 - RNA, 20 nt, Salmonella enterica enterica serovar Typhi
acggaauggcacagcgcagc

SEQ ID NO: 3632017 - RNA, 19 nt, Salmonella enterica enterica serovar Typhi
acggacauaaaggaaaugc

SEQ ID NO: 3632018 - RNA, 16 nt, Salmonella enterica enterica serovar Typhi
acggaccggcaaucgc

SEQ ID NO: 3632019 - RNA, 15 nt, Salmonella enterica enterica serovar Typhi
acggacucaggccuu

SEQ ID NO: 3632020 - RNA, 22 nt, Salmonella enterica enterica serovar Typhi
acggacuugaucgugccguccg

SEQ ID NO: 3632021 - RNA, 17 nt, Salmonella enterica enterica serovar Typhi
acggagagacaguucag

SEQ ID NO: 3632022 - RNA, 21 nt, Salmonella enterica enterica serovar Typhi
acggagauuaacagcgcgacc

SEQ ID NO: 3632023 - RNA, 19 nt, Salmonella enterica enterica serovar Typhi
acggagcauaauuuuccug

SEQ ID NO: 3632024 - RNA, 23 nt, Salmonella enterica enterica serovar Typhi
acggagcauaauuuuccugucgu

SEQ ID NO: 3632025 - RNA, 21 nt, Salmonella enterica enterica serovar Typhi
acggaggugccagagauaauu

SEQ ID NO: 3632026 - RNA, 22 nt, Salmonella enterica enterica serovar Typhi
acggagugcgcggcgaaaaagc

SEQ ID NO: 3632027 - RNA, 12 nt, Salmonella enterica enterica serovar Typhi
acggauaaaaac

SEQ ID NO: 3632028 - RNA, 19 nt, Salmonella enterica enterica serovar Typhi
acggauacgcugcgucagg

SEQ ID NO: 3632029 - RNA, 17 nt, Salmonella enterica enterica serovar Typhi
acggaucaugguugaaa

SEQ ID NO: 3632030 - RNA, 13 nt, Salmonella enterica enterica serovar Typhi
acggauccagaac

SEQ ID NO: 3632031 - RNA, 15 nt, Salmonella enterica enterica serovar Typhi
acggaugcgccaucc

SEQ ID NO: 3632032 - RNA, 14 nt, Salmonella enterica enterica serovar Typhi
acggcaaaguucca

SEQ ID NO: 3632033 - RNA, 16 nt, Salmonella enterica enterica serovar Typhi
acggcaacgggacggc

SEQ ID NO: 3632034 - RNA, 12 nt, Salmonella enterica enterica serovar Typhi
acggucaggcuc

SEQ ID NO: 3632035 - RNA, 17 nt, Salmonella enterica enterica serovar Typhi
acgguccuggccaggcu

SEQ ID NO: 3632036 - RNA, 19 nt, Salmonella enterica enterica serovar Typhi
acgguccuggccaggcuuc

SEQ ID NO: 3632037 - RNA, 22 nt, Salmonella enterica enterica serovar Typhi
acggucgauuucgcgauaauag

SEQ ID NO: 3632038 - RNA, 23 nt, Salmonella enterica enterica serovar Typhi
acggucggcguaauguugcugca

SEQ ID NO: 3632039 - RNA, 16 nt, Salmonella enterica enterica serovar Typhi
acggugcugaauauua

SEQ ID NO: 3632040 - RNA, 16 nt, Salmonella enterica enterica serovar Typhi
acggugugaucaccgc

SEQ ID NO: 3632041 - RNA, 16 nt, Salmonella enterica enterica serovar Typhi
acggugugccgccauc

SEQ ID NO: 3632042 - RNA, 17 nt, Salmonella enterica enterica serovar Typhi
acggugugccgccauca

SEQ ID NO: 3632043 - RNA, 15 nt, Salmonella enterica enterica serovar Typhi
acgguguggcccagc

SEQ ID NO: 3632044 - RNA, 17 nt, Salmonella enterica enterica serovar Typhi
acgguuaaaaacagcca

SEQ ID NO: 3632045 - RNA, 13 nt, Salmonella enterica enterica serovar Typhi
acgguuucaacuu

SEQ ID NO: 3632046 - RNA, 23 nt, Salmonella enterica enterica serovar Typhi
acgguuuuauccccuucaggaau

SEQ ID NO: 3632047 - RNA, 17 nt, Salmonella enterica enterica serovar Typhi
acgguuuucacuggcau

SEQ ID NO: 3632048 - RNA, 13 nt, Salmonella enterica enterica serovar Typhi
acguaaagcuggc

SEQ ID NO: 3632049 - RNA, 22 nt, Salmonella enterica enterica serovar Typhi
acguaaagcuggccuucagguu

SEQ ID NO: 3632050 - RNA, 13 nt, Salmonella enterica enterica serovar Typhi
acguaaauaccca

SEQ ID NO: 3632051 - RNA, 15 nt, Salmonella enterica enterica serovar Typhi
acguaaauauauaca

SEQ ID NO: 3632052 - RNA, 17 nt, Salmonella enterica enterica serovar Typhi
acguaaauuacuuauga

SEQ ID NO: 3632053 - RNA, 14 nt, Salmonella enterica enterica serovar Typhi
acguaacagacgca

SEQ ID NO: 3632054 - RNA, 15 nt, Salmonella enterica enterica serovar Typhi
acguaaccggcguuc

SEQ ID NO: 3632055 - RNA, 20 nt, Salmonella enterica enterica serovar Typhi
acguaacgguguuucaucuu

SEQ ID NO: 3632056 - RNA, 16 nt, Salmonella enterica enterica serovar Typhi
acguaacgucguaaau

SEQ ID NO: 3632057 - RNA, 20 nt, Salmonella enterica enterica serovar Typhi
acguaacugcgguaaauaau

SEQ ID NO: 3632058 - RNA, 22 nt, Salmonella enterica enterica serovar Typhi
acguaauaaccaccggcgcgcc

SEQ ID NO: 3632059 - RNA, 14 nt, Salmonella enterica enterica serovar Typhi
acguaauauuaagc

SEQ ID NO: 3632060 - RNA, 18 nt, Salmonella enterica enterica serovar Typhi
acguaaucccgccagccu

SEQ ID NO: 3632061 - RNA, 13 nt, Salmonella enterica enterica serovar Typhi
acguaaugugaaa

SEQ ID NO: 3632062 - RNA, 16 nt, Salmonella enterica enterica serovar Typhi
acguaaugugaaaaac

SEQ ID NO: 3632063 - RNA, 23 nt, Salmonella enterica enterica serovar Typhi
acguaccguuggaauaaaucaca

SEQ ID NO: 3632064 - RNA, 15 nt, Salmonella enterica enterica serovar Typhi
acguacggccugcgc

SEQ ID NO: 3632065 - RNA, 12 nt, Salmonella enterica enterica serovar Typhi
acguagcaaaua

SEQ ID NO: 3632066 - RNA, 20 nt, Salmonella enterica enterica serovar Typhi
acguaggccugauaagcgca

SEQ ID NO: 3632067 - RNA, 23 nt, Salmonella enterica enterica serovar Typhi
acgucaagaucgcgcagcaggcc

SEQ ID NO: 3632068 - RNA, 19 nt, Salmonella enterica enterica serovar Typhi
acgucacaauacuuccgcu

SEQ ID NO: 3632069 - RNA, 12 nt, Salmonella enterica enterica serovar Typhi
acgucaccauca

SEQ ID NO: 3632070 - RNA, 23 nt, Salmonella enterica enterica serovar Typhi
acgucagcaucuccuggcgcagc

SEQ ID NO: 3632071 - RNA, 19 nt, Salmonella enterica enterica serovar Typhi
acgucagccgggauaauca

SEQ ID NO: 3632072 - RNA, 20 nt, Salmonella enterica enterica serovar Typhi
acgucagccgggauaaucag

SEQ ID NO: 3632073 - RNA, 12 nt, Salmonella enterica enterica serovar Typhi
acgucagcugga

SEQ ID NO: 3632074 - RNA, 21 nt, Salmonella enterica enterica serovar Typhi
acgucaguacguaaccgcaaa

SEQ ID NO: 3632075 - RNA, 15 nt, Salmonella enterica enterica serovar Typhi
acgucauaacgcgca

SEQ ID NO: 3632076 - RNA, 15 nt, Salmonella enterica enterica serovar Typhi
acgucauaucaucca

SEQ ID NO: 3632077 - RNA, 15 nt, Salmonella enterica enterica serovar Typhi
acgucaucaugcugc

SEQ ID NO: 3632078 - RNA, 22 nt, Salmonella enterica enterica serovar Typhi
acgucauuaccaguugaccaaa

SEQ ID NO: 3632079 - RNA, 18 nt, Salmonella enterica enterica serovar Typhi
acgucauuuuuucaauuu

SEQ ID NO: 3632080 - RNA, 22 nt, Salmonella enterica enterica serovar Typhi
acguccagacucugcgcguaaa

SEQ ID NO: 3632081 - RNA, 20 nt, Salmonella enterica enterica serovar Typhi
acguccauaccgguugcgcg

SEQ ID NO: 3632082 - RNA, 15 nt, Salmonella enterica enterica serovar Typhi
acguccauccgggua

SEQ ID NO: 3632083 - RNA, 18 nt, Salmonella enterica enterica serovar Typhi
acguccucuucuacacga

SEQ ID NO: 3632084 - RNA, 18 nt, Salmonella enterica enterica serovar Typhi
acgucgccuuccugcagg

SEQ ID NO: 3632085 - RNA, 21 nt, Salmonella enterica enterica serovar Typhi
acgucgcgcgccgccugcgcc

SEQ ID NO: 3632086 - RNA, 20 nt, Salmonella enterica enterica serovar Typhi
acgucgcguacaccuuaucu

SEQ ID NO: 3632087 - RNA, 13 nt, Salmonella enterica enterica serovar Typhi
acgucgucccagg

SEQ ID NO: 3632088 - RNA, 23 nt, Salmonella enterica enterica serovar Typhi
acgucguuguccggcugaagcgg

SEQ ID NO: 3632089 - RNA, 13 nt, Salmonella enterica enterica serovar Typhi
acgucugaagaag

SEQ ID NO: 3632090 - RNA, 21 nt, Salmonella enterica enterica serovar Typhi
acgugaaacugauaguuuaaa

SEQ ID NO: 3632091 - RNA, 15 nt, Salmonella enterica enterica serovar Typhi
acgugaccuuucaac

SEQ ID NO: 3632092 - RNA, 17 nt, Salmonella enterica enterica serovar Typhi
acgugacgcgccagcgg

SEQ ID NO: 3632093 - RNA, 14 nt, Salmonella enterica enterica serovar Typhi
acgugacguaucgc

SEQ ID NO: 3632094 - RNA, 19 nt, Salmonella enterica enterica serovar Typhi
acgugagugguagaaacug

SEQ ID NO: 3632095 - RNA, 19 nt, Salmonella enterica enterica serovar Typhi
acgugauaaccaacaggag

SEQ ID NO: 3632096 - RNA, 22 nt, Salmonella enterica enterica serovar Typhi
acgugaugaucguguugcagcc

SEQ ID NO: 3632097 - RNA, 16 nt, Salmonella enterica enterica serovar Typhi
acgugcaauaucgcgg

SEQ ID NO: 3632098 - RNA, 14 nt, Salmonella enterica enterica serovar Typhi
acgugcauaaaacg

SEQ ID NO: 3632099 - RNA, 19 nt, Salmonella enterica enterica serovar Typhi
acgugccguuuaugaccgc

SEQ ID NO: 3632100 - RNA, 19 nt, Salmonella enterica enterica serovar Typhi
acgugcgguauaucacgcc

SEQ ID NO: 3632101 - RNA, 20 nt, Salmonella enterica enterica serovar Typhi
acgugcgguauaucacgcca

SEQ ID NO: 3632102 - RNA, 21 nt, Salmonella enterica enterica serovar Typhi
acgugcugaucccgcgcgccu

SEQ ID NO: 3632103 - RNA, 15 nt, Salmonella enterica enterica serovar Typhi
acguggccagcaugc

SEQ ID NO: 3632104 - RNA, 14 nt, Salmonella enterica enterica serovar Typhi
acguggcuucgccg

SEQ ID NO: 3632105 - RNA, 14 nt, Salmonella enterica enterica serovar Typhi
acguguaauuucau

SEQ ID NO: 3632106 - RNA, 15 nt, Salmonella enterica enterica serovar Typhi
acguguggcgcugug

SEQ ID NO: 3632107 - RNA, 15 nt, Salmonella enterica enterica serovar Typhi
acguuaauacaucau

SEQ ID NO: 3632108 - RNA, 20 nt, Salmonella enterica enterica serovar Typhi
acguuacauuuuccaugccu

SEQ ID NO: 3632109 - RNA, 18 nt, Salmonella enterica enterica serovar Typhi
acguuaccauaauuugau

SEQ ID NO: 3632110 - RNA, 17 nt, Salmonella enterica enterica serovar Typhi
acguuacuugauggaaa

SEQ ID NO: 3632111 - RNA, 14 nt, Salmonella enterica enterica serovar Typhi
acguuaggcgcaaa

SEQ ID NO: 3632112 - RNA, 21 nt, Salmonella enterica enterica serovar Typhi
acguuaucgccgacaaacagu

SEQ ID NO: 3632113 - RNA, 21 nt, Salmonella enterica enterica serovar Typhi
acguuaucugaccuacaggcc

SEQ ID NO: 3632114 - RNA, 21 nt, Salmonella enterica enterica serovar Typhi
acguuaucugccucaacaagu

SEQ ID NO: 3632115 - RNA, 23 nt, Salmonella enterica enterica serovar Typhi
acguuaucuucggucgagcuuuu

SEQ ID NO: 3632116 - RNA, 21 nt, Salmonella enterica enterica serovar Typhi
acguucaccccgucauauuac

SEQ ID NO: 3632117 - RNA, 23 nt, Salmonella enterica enterica serovar Typhi
acguucagcauauccagcgccug

SEQ ID NO: 3632118 - RNA, 22 nt, Salmonella enterica enterica serovar Typhi
acguucagguuuuuuucaucgc

SEQ ID NO: 3632119 - RNA, 20 nt, Salmonella enterica enterica serovar Typhi
acucagcacauucagagcgu

SEQ ID NO: 3632120 - RNA, 15 nt, Salmonella enterica enterica serovar Typhi
acucagccagauacc

SEQ ID NO: 3632121 - RNA, 15 nt, Salmonella enterica enterica serovar Typhi
acucagcggcccaau

SEQ ID NO: 3632122 - RNA, 14 nt, Salmonella enterica enterica serovar Typhi
acucaggcgcaucu

SEQ ID NO: 3632123 - RNA, 17 nt, Salmonella enterica enterica serovar Typhi
acucaggcgcaucugac

SEQ ID NO: 3632124 - RNA, 22 nt, Salmonella enterica enterica serovar Typhi
acucagggugacggaagagaga

SEQ ID NO: 3632125 - RNA, 12 nt, Salmonella enterica enterica serovar Typhi
acucauaauauc

SEQ ID NO: 3632126 - RNA, 13 nt, Salmonella enterica enterica serovar Typhi
acucauccaccuu

SEQ ID NO: 3632127 - RNA, 20 nt, Salmonella enterica enterica serovar Typhi
acucaucgguuaacacauau

SEQ ID NO: 3632128 - RNA, 13 nt, Salmonella enterica enterica serovar Typhi
acucaucuuuauu

SEQ ID NO: 3632129 - RNA, 17 nt, Salmonella enterica enterica serovar Typhi
acucaugacuucacacu

SEQ ID NO: 3632130 - RNA, 19 nt, Salmonella enterica enterica serovar Typhi
acucaugacuucacacugu

SEQ ID NO: 3632131 - RNA, 16 nt, Salmonella enterica enterica serovar Typhi
acucauuaaaaaaaca

SEQ ID NO: 3632132 - RNA, 21 nt, Salmonella enterica enterica serovar Typhi
acucauuaccggcugccgaua

SEQ ID NO: 3632133 - RNA, 14 nt, Salmonella enterica enterica serovar Typhi
acuccagaauauug

SEQ ID NO: 3632134 - RNA, 12 nt, Salmonella enterica enterica serovar Typhi
acuccagacgau

SEQ ID NO: 3632135 - RNA, 22 nt, Salmonella enterica enterica serovar Typhi
acuccagcagaccggcaaaaau

SEQ ID NO: 3632136 - RNA, 20 nt, Salmonella enterica enterica serovar Typhi
acuccagcagacgcugcuuc

SEQ ID NO: 3632137 - RNA, 21 nt, Salmonella enterica enterica serovar Typhi
acuccagcccaucagucccca

SEQ ID NO: 3632138 - RNA, 14 nt, Salmonella enterica enterica serovar Typhi
acuccagcggcagg

SEQ ID NO: 3632139 - RNA, 21 nt, Salmonella enterica enterica serovar Typhi
acuccagugcagaaaguguga

SEQ ID NO: 3632140 - RNA, 16 nt, Salmonella enterica enterica serovar Typhi
acuccauucccagcuc

SEQ ID NO: 3632141 - RNA, 18 nt, Salmonella enterica enterica serovar Typhi
acuccauucccagcucuu

SEQ ID NO: 3632142 - RNA, 21 nt, Salmonella enterica enterica serovar Typhi
acuccauucccagcucuuuca

SEQ ID NO: 3632143 - RNA, 15 nt, Salmonella enterica enterica serovar Typhi
acuccauugucggca

SEQ ID NO: 3632144 - RNA, 17 nt, Salmonella enterica enterica serovar Typhi
acuccccuuuuuuacua

SEQ ID NO: 3632145 - RNA, 14 nt, Salmonella enterica enterica serovar Typhi
acuccccuuuuuuc

SEQ ID NO: 3632146 - RNA, 23 nt, Salmonella enterica enterica serovar Typhi
acucccgcacgcuggcaucaaua

SEQ ID NO: 3632147 - RNA, 19 nt, Salmonella enterica enterica serovar Typhi
acucccuggugacgcgcau

SEQ ID NO: 3632148 - RNA, 14 nt, Salmonella enterica enterica serovar Typhi
acuccgcccuaauc

SEQ ID NO: 3632149 - RNA, 18 nt, Salmonella enterica enterica serovar Typhi
acuccgcgcgcguaagcu

SEQ ID NO: 3632150 - RNA, 19 nt, Salmonella enterica enterica serovar Typhi
acuccggugcccauuccgc

SEQ ID NO: 3632151 - RNA, 18 nt, Salmonella enterica enterica serovar Typhi
acuccuaagagaaaaccc

SEQ ID NO: 3632152 - RNA, 11 nt, Salmonella enterica enterica serovar Typhi
acuccugcaac

SEQ ID NO: 3632153 - RNA, 17 nt, Salmonella enterica enterica serovar Typhi
acuccuuagauuaauca

SEQ ID NO: 3632154 - RNA, 12 nt, Salmonella enterica enterica serovar Typhi
acuccuuuuacc

SEQ ID NO: 3632155 - RNA, 14 nt, Salmonella enterica enterica serovar Typhi
acucgaauuguuaa

SEQ ID NO: 3632156 - RNA, 14 nt, Salmonella enterica enterica serovar Typhi
acucgcacaguaca

SEQ ID NO: 3632157 - RNA, 19 nt, Salmonella enterica enterica serovar Typhi
acucgcacaguacaccugc

SEQ ID NO: 3632158 - RNA, 21 nt, Salmonella enterica enterica serovar Typhi
acucgccuuucuccaugguca

SEQ ID NO: 3632159 - RNA, 16 nt, Salmonella enterica enterica serovar Typhi
acucgcuacgcucgcc

SEQ ID NO: 3632160 - RNA, 17 nt, Salmonella enterica enterica serovar Typhi
acucgcucccuuccccc

SEQ ID NO: 3632161 - RNA, 22 nt, Salmonella enterica enterica serovar Typhi
acucgcuccuugauugcaagaa

SEQ ID NO: 3632162 - RNA, 16 nt, Salmonella enterica enterica serovar Typhi
acucgcugauacgcug

SEQ ID NO: 3632163 - RNA, 15 nt, Salmonella enterica enterica serovar Typhi
acucgcuguggccag

SEQ ID NO: 3632164 - RNA, 19 nt, Salmonella enterica enterica serovar Typhi
acucgcuguggccaggcac

SEQ ID NO: 3632165 - RNA, 16 nt, Salmonella enterica enterica serovar Typhi
acucggcgaucaccac

SEQ ID NO: 3632166 - RNA, 21 nt, Salmonella enterica enterica serovar Typhi
acucgggccagcucuuuucug

SEQ ID NO: 3632167 - RNA, 13 nt, Salmonella enterica enterica serovar Typhi
acucggugccgcu

SEQ ID NO: 3632168 - RNA, 22 nt, Salmonella enterica enterica serovar Typhi
acucggugccgcugcugaccuu

SEQ ID NO: 3632169 - RNA, 15 nt, Salmonella enterica enterica serovar Typhi
acucguaagaggcgu

SEQ ID NO: 3632170 - RNA, 21 nt, Salmonella enterica enterica serovar Typhi
acucguaaucuaaaauuauuu

SEQ ID NO: 3632171 - RNA, 17 nt, Salmonella enterica enterica serovar Typhi
acucgucccgauauaaa

SEQ ID NO: 3632172 - RNA, 19 nt, Salmonella enterica enterica serovar Typhi
acucgugcagugauucgua

SEQ ID NO: 3632173 - RNA, 19 nt, Salmonella enterica enterica serovar Typhi
acucguucccguuuauguu

SEQ ID NO: 3632174 - RNA, 16 nt, Salmonella enterica enterica serovar Typhi
acucuaggcgcugcug

SEQ ID NO: 3632175 - RNA, 14 nt, Salmonella enterica enterica serovar Typhi
acucuaugcaaaag

SEQ ID NO: 3632176 - RNA, 23 nt, Salmonella enterica enterica serovar Typhi
acucuaugcaaaagaaaaaacuu

SEQ ID NO: 3632177 - RNA, 15 nt, Salmonella enterica enterica serovar Typhi
acucucaaugcccau

SEQ ID NO: 3632178 - RNA, 19 nt, Salmonella enterica enterica serovar Typhi
acucucaccgaccugccuu

SEQ ID NO: 3632179 - RNA, 16 nt, Salmonella enterica enterica serovar Typhi
acucucauguucaagc

SEQ ID NO: 3632180 - RNA, 14 nt, Salmonella enterica enterica serovar Typhi
acucuccaccaaau

SEQ ID NO: 3632181 - RNA, 15 nt, Salmonella enterica enterica serovar Typhi
acucucccggcgccc

SEQ ID NO: 3632182 - RNA, 16 nt, Salmonella enterica enterica serovar Typhi
acucucgcagcgaaua

SEQ ID NO: 3632183 - RNA, 12 nt, Salmonella enterica enterica serovar Typhi
acucugaaaaaa

SEQ ID NO: 3632184 - RNA, 20 nt, Salmonella enterica enterica serovar Typhi
acucugacgccgguauucau

SEQ ID NO: 3632185 - RNA, 13 nt, Salmonella enterica enterica serovar Typhi
acucugcaaacgg

SEQ ID NO: 3632186 - RNA, 18 nt, Salmonella enterica enterica serovar Typhi
acucugcgacgccaggcg

SEQ ID NO: 3632187 - RNA, 12 nt, Salmonella enterica enterica serovar Typhi
acucugcgcgua

SEQ ID NO: 3632188 - RNA, 23 nt, Salmonella enterica enterica serovar Typhi
acucugugcguucgcgaauuuca

SEQ ID NO: 3632189 - RNA, 15 nt, Salmonella enterica enterica serovar Typhi
acucuguuauauauu

SEQ ID NO: 3632190 - RNA, 14 nt, Salmonella enterica enterica serovar Typhi
acucuuaauuauaa

SEQ ID NO: 3632191 - RNA, 18 nt, Salmonella enterica enterica serovar Typhi
acucuuaauuauaaagca

SEQ ID NO: 3632192 - RNA, 15 nt, Salmonella enterica enterica serovar Typhi
acucuucacccuucu

SEQ ID NO: 3632193 - RNA, 13 nt, Salmonella enterica enterica serovar Typhi
acucuucaucgcg

SEQ ID NO: 3632194 - RNA, 21 nt, Salmonella enterica enterica serovar Typhi
acucuuccaccacggcaaaaa

SEQ ID NO: 3632195 - RNA, 22 nt, Salmonella enterica enterica serovar Typhi
acucuuccagcugcucuccuug

SEQ ID NO: 3632196 - RNA, 20 nt, Salmonella enterica enterica serovar Typhi
acucuuccccgaucagaaaa

SEQ ID NO: 3632197 - RNA, 21 nt, Salmonella enterica enterica serovar Typhi
acucuuccccgaucagaaaac

SEQ ID NO: 3632198 - RNA, 17 nt, Salmonella enterica enterica serovar Typhi
acucuuccgcaaucaca

SEQ ID NO: 3632199 - RNA, 19 nt, Salmonella enterica enterica serovar Typhi
acucuuccgggcugacaua

SEQ ID NO: 3632200 - RNA, 16 nt, Salmonella enterica enterica serovar Typhi
acucuucgccauuaca

SEQ ID NO: 3632201 - RNA, 19 nt, Salmonella enterica enterica serovar Typhi
acucuuuacccagcgggug

SEQ ID NO: 3632202 - RNA, 19 nt, Salmonella enterica enterica serovar Typhi
acucuuuuccccgacggcc

SEQ ID NO: 3632203 - RNA, 21 nt, Salmonella enterica enterica serovar Typhi
acucuuuuccccgacggccuc

SEQ ID NO: 3632204 - RNA, 23 nt, Salmonella enterica enterica serovar Typhi
acucuuuuuccgcgagagaaaaa

SEQ ID NO: 3632205 - RNA, 16 nt, Salmonella enterica enterica serovar Typhi
acuggccccgcauuuu

SEQ ID NO: 3632206 - RNA, 20 nt, Salmonella enterica enterica serovar Typhi
acuggccguuuucccggcaa

SEQ ID NO: 3632207 - RNA, 18 nt, Salmonella enterica enterica serovar Typhi
acuggccuuuuuuuuacc

SEQ ID NO: 3632208 - RNA, 17 nt, Salmonella enterica enterica serovar Typhi
acuggcgacagccgcgu

SEQ ID NO: 3632209 - RNA, 15 nt, Salmonella enterica enterica serovar Typhi
acuggcgaccgccac

SEQ ID NO: 3632210 - RNA, 15 nt, Salmonella enterica enterica serovar Typhi
acuggcgauuuucau

SEQ ID NO: 3632211 - RNA, 17 nt, Salmonella enterica enterica serovar Typhi
acuggcuuuccugauca

SEQ ID NO: 3632212 - RNA, 18 nt, Salmonella enterica enterica serovar Typhi
acuggcuuuccugaucaa

SEQ ID NO: 3632213 - RNA, 21 nt, Salmonella enterica enterica serovar Typhi
acuggcuuuccugaucaauca

SEQ ID NO: 3632214 - RNA, 20 nt, Salmonella enterica enterica serovar Typhi
acuggguaaggcgcuugccu

SEQ ID NO: 3632215 - RNA, 16 nt, Salmonella enterica enterica serovar Typhi
acugguaaaccgugcg

SEQ ID NO: 3632216 - RNA, 16 nt, Salmonella enterica enterica serovar Typhi
acugguaaccuguucc

SEQ ID NO: 3632217 - RNA, 23 nt, Salmonella enterica enterica serovar Typhi
acugguaaccuguuccucacuga

SEQ ID NO: 3632218 - RNA, 19 nt, Salmonella enterica enterica serovar Typhi
acuggugcccgcaaaaccu

SEQ ID NO: 3632219 - RNA, 21 nt, Salmonella enterica enterica serovar Typhi
acugguggcgagauaagccgu

SEQ ID NO: 3632220 - RNA, 21 nt, Salmonella enterica enterica serovar Typhi
acugguucaacaucagcgcua

SEQ ID NO: 3632221 - RNA, 20 nt, Salmonella enterica enterica serovar Typhi
acuguaaaucugccgucauc

SEQ ID NO: 3632222 - RNA, 13 nt, Salmonella enterica enterica serovar Typhi
acuguaaccggcg

SEQ ID NO: 3632223 - RNA, 21 nt, Salmonella enterica enterica serovar Typhi
acuguacgccacggcuuaaau

SEQ ID NO: 3632224 - RNA, 18 nt, Salmonella enterica enterica serovar Typhi
acuguacgcgggaaauac

SEQ ID NO: 3632225 - RNA, 16 nt, Salmonella enterica enterica serovar Typhi
acuguauucgguggaa

SEQ ID NO: 3632226 - RNA, 23 nt, Salmonella enterica enterica serovar Typhi
acuguauucgguggaaaccgcag

SEQ ID NO: 3632227 - RNA, 16 nt, Salmonella enterica enterica serovar Typhi
acugucaaaaauaaca

SEQ ID NO: 3632228 - RNA, 22 nt, Salmonella enterica enterica serovar Typhi
acugucccagggccaaacuggc

SEQ ID NO: 3632229 - RNA, 19 nt, Salmonella enterica enterica serovar Typhi
acugucuuguggaacacca

SEQ ID NO: 3632230 - RNA, 21 nt, Salmonella enterica enterica serovar Typhi
acugugaggcgucuuccagca

SEQ ID NO: 3632231 - RNA, 15 nt, Salmonella enterica enterica serovar Typhi
acuguggugugccug

SEQ ID NO: 3632232 - RNA, 21 nt, Salmonella enterica enterica serovar Typhi
acugugguuaugguugccgca

SEQ ID NO: 3632233 - RNA, 17 nt, Salmonella enterica enterica serovar Typhi
acuguuagcgaaacugc

SEQ ID NO: 3632234 - RNA, 16 nt, Salmonella enterica enterica serovar Typhi
acuguucacgcagcgc

SEQ ID NO: 3632235 - RNA, 14 nt, Salmonella enterica enterica serovar Typhi
acuguucagcugac

SEQ ID NO: 3632236 - RNA, 17 nt, Salmonella enterica enterica serovar Typhi
acuguucggcggggauc

SEQ ID NO: 3632237 - RNA, 15 nt, Salmonella enterica enterica serovar Typhi
acuguugcaguuuac

SEQ ID NO: 3632238 - RNA, 18 nt, Salmonella enterica enterica serovar Typhi
acuguuuaaugcuuucaa

SEQ ID NO: 3632239 - RNA, 14 nt, Salmonella enterica enterica serovar Typhi
acuguuugcugaca

SEQ ID NO: 3632240 - RNA, 18 nt, Salmonella enterica enterica serovar Typhi
acuguuugucucagguau

SEQ ID NO: 3632241 - RNA, 13 nt, Salmonella enterica enterica serovar Typhi
acuguuuuugcuu

SEQ ID NO: 3632242 - RNA, 22 nt, Salmonella enterica enterica serovar Typhi
acuuaaacgccggauuccagaa

SEQ ID NO: 3632243 - RNA, 20 nt, Salmonella enterica enterica serovar Typhi
acuuaaacguucguccgcac

SEQ ID NO: 3632244 - RNA, 20 nt, Salmonella enterica enterica serovar Typhi
acuuaaaguacuucacaauc

SEQ ID NO: 3632245 - RNA, 14 nt, Salmonella enterica enterica serovar Typhi
acuuaauaucaaua

SEQ ID NO: 3632246 - RNA, 13 nt, Salmonella enterica enterica serovar Typhi
acuuacccagcaa

SEQ ID NO: 3632247 - RNA, 22 nt, Salmonella enterica enterica serovar Typhi
acuuacgcccuauccggccgac

SEQ ID NO: 3632248 - RNA, 13 nt, Salmonella enterica enterica serovar Typhi
acuuacugcuguc

SEQ ID NO: 3632249 - RNA, 22 nt, Salmonella enterica enterica serovar Typhi
acuuacuuucuugccacuggcc

SEQ ID NO: 3632250 - RNA, 21 nt, Salmonella enterica enterica serovar Typhi
acuuagcgccggaauggcgac

SEQ ID NO: 3632251 - RNA, 13 nt, Salmonella enterica enterica serovar Typhi
acuuauacccuug

SEQ ID NO: 3632252 - RNA, 16 nt, Salmonella enterica enterica serovar Typhi
acuuauacugauaaac

SEQ ID NO: 3632253 - RNA, 16 nt, Salmonella enterica enterica serovar Typhi
acuuaucaguaacaga

SEQ ID NO: 3632254 - RNA, 22 nt, Salmonella enterica enterica serovar Typhi
acuuaucggcguguuucaucuc

SEQ ID NO: 3632255 - RNA, 18 nt, Salmonella enterica enterica serovar Typhi
acuuaucucuuuuucucg

SEQ ID NO: 3632256 - RNA, 17 nt, Salmonella enterica enterica serovar Typhi
acuuauuaccacaguca

SEQ ID NO: 3632257 - RNA, 16 nt, Salmonella enterica enterica serovar Typhi
acuuauugcaagaaau

SEQ ID NO: 3632258 - RNA, 11 nt, Salmonella enterica enterica serovar Typhi
acuuauuucua

SEQ ID NO: 3632259 - RNA, 21 nt, Salmonella enterica enterica serovar Typhi
acuuauuuguauugacgccga

SEQ ID NO: 3632260 - RNA, 17 nt, Salmonella enterica enterica serovar Typhi
acuuauuuuauuuuuau

SEQ ID NO: 3632261 - RNA, 23 nt, Salmonella enterica enterica serovar Typhi
acuucaagguucgacucgagcaa

SEQ ID NO: 3632262 - RNA, 18 nt, Salmonella enterica enterica serovar Typhi
acuucaauucagaaaguu

SEQ ID NO: 3632263 - RNA, 18 nt, Salmonella enterica enterica serovar Typhi
acuucaauuuuccagaua

SEQ ID NO: 3632264 - RNA, 20 nt, Salmonella enterica enterica serovar Typhi
acuucacaaacaauuucccc

SEQ ID NO: 3632265 - RNA, 16 nt, Salmonella enterica enterica serovar Typhi
acuucaccucagccaa

SEQ ID NO: 3632266 - RNA, 12 nt, Salmonella enterica enterica serovar Typhi
acuucagauacc

SEQ ID NO: 3632267 - RNA, 19 nt, Salmonella enterica enterica serovar Typhi
acuucagcauacaggucuu

SEQ ID NO: 3632268 - RNA, 23 nt, Salmonella enterica enterica serovar Typhi
acuucagcauacaggucuuuccg

SEQ ID NO: 3632269 - RNA, 15 nt, Salmonella enterica enterica serovar Typhi
acuucaggcugccaa

SEQ ID NO: 3632270 - RNA, 15 nt, Salmonella enterica enterica serovar Typhi
acuucauccggauaa

SEQ ID NO: 3632271 - RNA, 22 nt, Salmonella enterica enterica serovar Typhi
acuuccagaccacuaacccggc

SEQ ID NO: 3632272 - RNA, 20 nt, Salmonella enterica enterica serovar Typhi
acuuccauucccgccgcaau

SEQ ID NO: 3632273 - RNA, 20 nt, Salmonella enterica enterica serovar Typhi
acuuccauucggcgaaagaa

SEQ ID NO: 3632274 - RNA, 21 nt, Salmonella enterica enterica serovar Typhi
acuuccauucggcgaaagaag

SEQ ID NO: 3632275 - RNA, 13 nt, Salmonella enterica enterica serovar Typhi
acuuccccugcca

SEQ ID NO: 3632276 - RNA, 17 nt, Salmonella enterica enterica serovar Typhi
acuuccccuguaacugc

SEQ ID NO: 3632277 - RNA, 15 nt, Salmonella enterica enterica serovar Typhi
acuuccgcaucaaua

SEQ ID NO: 3632278 - RNA, 18 nt, Salmonella enterica enterica serovar Typhi
acuuccgccaccaccgau

SEQ ID NO: 3632279 - RNA, 16 nt, Salmonella enterica enterica serovar Typhi
acuuccggcugcggaa

SEQ ID NO: 3632280 - RNA, 21 nt, Salmonella enterica enterica serovar Typhi
acuuccgguugaccgcauaau

SEQ ID NO: 3632281 - RNA, 17 nt, Salmonella enterica enterica serovar Typhi
acuuccguaaaaagaac

SEQ ID NO: 3632282 - RNA, 15 nt, Salmonella enterica enterica serovar Typhi
acuuccugcgucagg

SEQ ID NO: 3632283 - RNA, 19 nt, Salmonella enterica enterica serovar Typhi
acuuccugcgucaggcugu

SEQ ID NO: 3632284 - RNA, 19 nt, Salmonella enterica enterica serovar Typhi
acuuccuggaugcuuaaaa

SEQ ID NO: 3632285 - RNA, 14 nt, Salmonella enterica enterica serovar Typhi
acuuccuguacaaa

SEQ ID NO: 3632286 - RNA, 15 nt, Salmonella enterica enterica serovar Typhi
acuuccuguaucacu

SEQ ID NO: 3632287 - RNA, 17 nt, Salmonella enterica enterica serovar Typhi
acuuccuuugccuuucu

SEQ ID NO: 3632288 - RNA, 20 nt, Salmonella enterica enterica serovar Typhi
acuucgcgguugcgcccuuc

SEQ ID NO: 3632289 - RNA, 15 nt, Salmonella enterica enterica serovar Typhi
acuucgcuuccugca

SEQ ID NO: 3632290 - RNA, 22 nt, Salmonella enterica enterica serovar Typhi
agaaccguugcgcccaucauca

SEQ ID NO: 3632291 - RNA, 20 nt, Salmonella enterica enterica serovar Typhi
agaacgacgaauaagcugaa

SEQ ID NO: 3632292 - RNA, 21 nt, Salmonella enterica enterica serovar Typhi
agaacgacgcauaaaaaauga

SEQ ID NO: 3632293 - RNA, 14 nt, Salmonella enterica enterica serovar Typhi
agaacgagaggagg

SEQ ID NO: 3632294 - RNA, 13 nt, Salmonella enterica enterica serovar Typhi
agaacgccgggcc

SEQ ID NO: 3632295 - RNA, 19 nt, Salmonella enterica enterica serovar Typhi
agaacgccgggccugccag

SEQ ID NO: 3632296 - RNA, 11 nt, Salmonella enterica enterica serovar Typhi
agaacgcucgc

SEQ ID NO: 3632297 - RNA, 14 nt, Salmonella enterica enterica serovar Typhi
agaacgcucgcgca

SEQ ID NO: 3632298 - RNA, 19 nt, Salmonella enterica enterica serovar Typhi
agaacgcuugucuucggua

SEQ ID NO: 3632299 - RNA, 22 nt, Salmonella enterica enterica serovar Typhi
agaacggauauccagaaucaca

SEQ ID NO: 3632300 - RNA, 22 nt, Salmonella enterica enterica serovar Typhi
agaacgguucauccagcagcag

SEQ ID NO: 3632301 - RNA, 12 nt, Salmonella enterica enterica serovar Typhi
agaacguauuau

SEQ ID NO: 3632302 - RNA, 22 nt, Salmonella enterica enterica serovar Typhi
agaacguugacguuucagucac

SEQ ID NO: 3632303 - RNA, 23 nt, Salmonella enterica enterica serovar Typhi
agaacguugacguuucagucacc

SEQ ID NO: 3632304 - RNA, 21 nt, Salmonella enterica enterica serovar Typhi
agaacguugccgcaggcaacg

SEQ ID NO: 3632305 - RNA, 16 nt, Salmonella enterica enterica serovar Typhi
agaacucacgcucaag

SEQ ID NO: 3632306 - RNA, 14 nt, Salmonella enterica enterica serovar Typhi
agaacucaggcaaa

SEQ ID NO: 3632307 - RNA, 22 nt, Salmonella enterica enterica serovar Typhi
agaacugcaaauaccacaucag

SEQ ID NO: 3632308 - RNA, 14 nt, Salmonella enterica enterica serovar Typhi
agaacuuccgccac

SEQ ID NO: 3632309 - RNA, 16 nt, Salmonella enterica enterica serovar Typhi
agaagaauaagccgga

SEQ ID NO: 3632310 - RNA, 14 nt, Salmonella enterica enterica serovar Typhi
agaagaauuauuau

SEQ ID NO: 3632311 - RNA, 16 nt, Salmonella enterica enterica serovar Typhi
agaagacagaagcuga

SEQ ID NO: 3632312 - RNA, 11 nt, Salmonella enterica enterica serovar Typhi
agaagcaaauu

SEQ ID NO: 3632313 - RNA, 20 nt, Salmonella enterica enterica serovar Typhi
agaagcacgacacaaaagca

SEQ ID NO: 3632314 - RNA, 13 nt, Salmonella enterica enterica serovar Typhi
agaagccaucaaa

SEQ ID NO: 3632315 - RNA, 15 nt, Salmonella enterica enterica serovar Typhi
agaagcccggccaca

SEQ ID NO: 3632316 - RNA, 16 nt, Salmonella enterica enterica serovar Typhi
agaagcuguaacacug

SEQ ID NO: 3632317 - RNA, 13 nt, Salmonella enterica enterica serovar Typhi
agaagcuuaccac

SEQ ID NO: 3632318 - RNA, 15 nt, Salmonella enterica enterica serovar Typhi
agaagcuuaccaccu

SEQ ID NO: 3632319 - RNA, 19 nt, Salmonella enterica enterica serovar Typhi
agaagggcaggggaaagcu

SEQ ID NO: 3632320 - RNA, 16 nt, Salmonella enterica enterica serovar Typhi
agaaggugaguuucgc

SEQ ID NO: 3632321 - RNA, 20 nt, Salmonella enterica enterica serovar Typhi
agaagguuauucgccuuuca

SEQ ID NO: 3632322 - RNA, 17 nt, Salmonella enterica enterica serovar Typhi
agaaguaaacagaauca

SEQ ID NO: 3632323 - RNA, 16 nt, Salmonella enterica enterica serovar Typhi
agaaguagcagagaaa

SEQ ID NO: 3632324 - RNA, 17 nt, Salmonella enterica enterica serovar Typhi
agaaguagcagagaaaa

SEQ ID NO: 3632325 - RNA, 18 nt, Salmonella enterica enterica serovar Typhi
agaaguauggccucuuca

SEQ ID NO: 3632326 - RNA, 22 nt, Salmonella enterica enterica serovar Typhi
agaagucugugagaaaagcgaa

SEQ ID NO: 3632327 - RNA, 14 nt, Salmonella enterica enterica serovar Typhi
agaagugccaguaa

SEQ ID NO: 3632328 - RNA, 23 nt, Salmonella enterica enterica serovar Typhi
agaauaaaaagugcgcacucaga

SEQ ID NO: 3632329 - RNA, 14 nt, Salmonella enterica enterica serovar Typhi
agaauaaaacagcu

SEQ ID NO: 3632330 - RNA, 15 nt, Salmonella enterica enterica serovar Typhi
agaauaagccagguu

SEQ ID NO: 3632331 - RNA, 22 nt, Salmonella enterica enterica serovar Typhi
agaauacacuucucaacauuga

SEQ ID NO: 3632332 - RNA, 23 nt, Salmonella enterica enterica serovar Typhi
agaauacccuuuacacguuccau

SEQ ID NO: 3632333 - RNA, 14 nt, Salmonella enterica enterica serovar Typhi
agaauacgaauauu

SEQ ID NO: 3632334 - RNA, 16 nt, Salmonella enterica enterica serovar Typhi
agaauacuuccugcuc

SEQ ID NO: 3632335 - RNA, 14 nt, Salmonella enterica enterica serovar Typhi
agaauagccggaua

SEQ ID NO: 3632336 - RNA, 17 nt, Salmonella enterica enterica serovar Typhi
agaauagccggauaaaa

SEQ ID NO: 3632337 - RNA, 17 nt, Salmonella enterica enterica serovar Typhi
agaauagcgucaauaau

SEQ ID NO: 3632338 - RNA, 19 nt, Salmonella enterica enterica serovar Typhi
agaauaucggcgucaacgu

SEQ ID NO: 3632339 - RNA, 14 nt, Salmonella enterica enterica serovar Typhi
agaauaugcagugc

SEQ ID NO: 3632340 - RNA, 12 nt, Salmonella enterica enterica serovar Typhi
agaauaugccag

SEQ ID NO: 3632341 - RNA, 15 nt, Salmonella enterica enterica serovar Typhi
agaauauguucuuuc

SEQ ID NO: 3632342 - RNA, 22 nt, Salmonella enterica enterica serovar Typhi
agaauauuggcgaggaacauca

SEQ ID NO: 3632343 - RNA, 16 nt, Salmonella enterica enterica serovar Typhi
agaauauuuuucucag

SEQ ID NO: 3632344 - RNA, 20 nt, Salmonella enterica enterica serovar Typhi
agaaucaccucuuucuccac

SEQ ID NO: 3632345 - RNA, 12 nt, Salmonella enterica enterica serovar Typhi
agaaucacguaa

SEQ ID NO: 3632346 - RNA, 20 nt, Salmonella enterica enterica serovar Typhi
agaaucaguaacacaaucag

SEQ ID NO: 3632347 - RNA, 22 nt, Salmonella enterica enterica serovar Typhi
agaaucauuaauacacugcgua

SEQ ID NO: 3632348 - RNA, 14 nt, Salmonella enterica enterica serovar Typhi
agaaucccgauaau

SEQ ID NO: 3632349 - RNA, 21 nt, Salmonella enterica enterica serovar Typhi
agaauccggcgcucaucagac

SEQ ID NO: 3632350 - RNA, 14 nt, Salmonella enterica enterica serovar Typhi
agaaucgccagcau

SEQ ID NO: 3632351 - RNA, 14 nt, Salmonella enterica enterica serovar Typhi
agaaucucugacag

SEQ ID NO: 3632352 - RNA, 19 nt, Salmonella enterica enterica serovar Typhi
agaaucuguauaaaauauu

SEQ ID NO: 3632353 - RNA, 14 nt, Salmonella enterica enterica serovar Typhi
agaaucuguuucag

SEQ ID NO: 3632354 - RNA, 18 nt, Salmonella enterica enterica serovar Typhi
agaaugaaaaaaaaauua

SEQ ID NO: 3632355 - RNA, 13 nt, Salmonella enterica enterica serovar Typhi
agaaugcccagca

SEQ ID NO: 3632356 - RNA, 15 nt, Salmonella enterica enterica serovar Typhi
agaaugcccagcaag

SEQ ID NO: 3632357 - RNA, 13 nt, Salmonella enterica enterica serovar Typhi
agaaugcccugcu

SEQ ID NO: 3632358 - RNA, 23 nt, Salmonella enterica enterica serovar Typhi
agaaugccgcccauccagagcag

SEQ ID NO: 3632359 - RNA, 18 nt, Salmonella enterica enterica serovar Typhi
agaaugcgagcaaaaccc

SEQ ID NO: 3632360 - RNA, 14 nt, Salmonella enterica enterica serovar Typhi
agaaugcuggucac

SEQ ID NO: 3632361 - RNA, 16 nt, Salmonella enterica enterica serovar Typhi
agaauggaacaauaga

SEQ ID NO: 3632362 - RNA, 16 nt, Salmonella enterica enterica serovar Typhi
agaauggccagcacaa

SEQ ID NO: 3632363 - RNA, 22 nt, Salmonella enterica enterica serovar Typhi
agaauggccagcacaauaacga

SEQ ID NO: 3632364 - RNA, 14 nt, Salmonella enterica enterica serovar Typhi
agaauguccccaua

SEQ ID NO: 3632365 - RNA, 17 nt, Salmonella enterica enterica serovar Typhi
agaauguguucucccug

SEQ ID NO: 3632366 - RNA, 18 nt, Salmonella enterica enterica serovar Typhi
agaauguguucucccugc

SEQ ID NO: 3632367 - RNA, 22 nt, Salmonella enterica enterica serovar Typhi
agaauuauuaccaaugagcugc

SEQ ID NO: 3632368 - RNA, 13 nt, Salmonella enterica enterica serovar Typhi
agaauucgcaaug

SEQ ID NO: 3632369 - RNA, 12 nt, Salmonella enterica enterica serovar Typhi
agaauuuaucgc

SEQ ID NO: 3632370 - RNA, 13 nt, Salmonella enterica enterica serovar Typhi
agaauuuauuucu

SEQ ID NO: 3632371 - RNA, 14 nt, Salmonella enterica enterica serovar Typhi
agaauuucaaucau

SEQ ID NO: 3632372 - RNA, 15 nt, Salmonella enterica enterica serovar Typhi
agaauuuccaguuca

SEQ ID NO: 3632373 - RNA, 16 nt, Salmonella enterica enterica serovar Typhi
agaauuugaacucuuu

SEQ ID NO: 3632374 - RNA, 18 nt, Salmonella enterica enterica serovar Typhi
agaauuuguuuaugccgg

SEQ ID NO: 3632375 - RNA, 23 nt, Salmonella enterica enterica serovar Typhi
agaauuuucacuuauaaauaaag

SEQ ID NO: 3632376 - RNA, 18 nt, Salmonella enterica enterica serovar Typhi
agacgcuggcacuggcag

SEQ ID NO: 3632377 - RNA, 19 nt, Salmonella enterica enterica serovar Typhi
agacgcuggcacuggcagc

SEQ ID NO: 3632378 - RNA, 19 nt, Salmonella enterica enterica serovar Typhi
agacgcuuacaucgccauc

SEQ ID NO: 3632379 - RNA, 21 nt, Salmonella enterica enterica serovar Typhi
agacgcuucauaucgcccagc

SEQ ID NO: 3632380 - RNA, 13 nt, Salmonella enterica enterica serovar Typhi
agacggccaccca

SEQ ID NO: 3632381 - RNA, 12 nt, Salmonella enterica enterica serovar Typhi
agacggcugggc

SEQ ID NO: 3632382 - RNA, 14 nt, Salmonella enterica enterica serovar Typhi
agacgggccaggcg

SEQ ID NO: 3632383 - RNA, 15 nt, Salmonella enterica enterica serovar Typhi
agacgguaaucagac

SEQ ID NO: 3632384 - RNA, 18 nt, Salmonella enterica enterica serovar Typhi
agacgguuucagugauaa

SEQ ID NO: 3632385 - RNA, 19 nt, Salmonella enterica enterica serovar Typhi
agacgucaaacaguuccug

SEQ ID NO: 3632386 - RNA, 17 nt, Salmonella enterica enterica serovar Typhi
agacgugccggaagcga

SEQ ID NO: 3632387 - RNA, 15 nt, Salmonella enterica enterica serovar Typhi
agacguugaacggcg

SEQ ID NO: 3632388 - RNA, 15 nt, Salmonella enterica enterica serovar Typhi
agacguugagcucaa

SEQ ID NO: 3632389 - RNA, 14 nt, Salmonella enterica enterica serovar Typhi
agacuaaaaagcgc

SEQ ID NO: 3632390 - RNA, 20 nt, Salmonella enterica enterica serovar Typhi
agacuauccagccagggauc

SEQ ID NO: 3632391 - RNA, 18 nt, Salmonella enterica enterica serovar Typhi
agacuauccguccucuuu

SEQ ID NO: 3632392 - RNA, 23 nt, Salmonella enterica enterica serovar Typhi
agacuauccguccucuuucccuu

SEQ ID NO: 3632393 - RNA, 13 nt, Salmonella enterica enterica serovar Typhi
agacucagccagg

SEQ ID NO: 3632394 - RNA, 18 nt, Salmonella enterica enterica serovar Typhi
agacucagccaggucugc

SEQ ID NO: 3632395 - RNA, 16 nt, Salmonella enterica enterica serovar Typhi
agacucagcgacugaa

SEQ ID NO: 3632396 - RNA, 12 nt, Salmonella enterica enterica serovar Typhi
agacucaggcgc

SEQ ID NO: 3632397 - RNA, 12 nt, Salmonella enterica enterica serovar Typhi
agacucaucgcc

SEQ ID NO: 3632398 - RNA, 15 nt, Salmonella enterica enterica serovar Typhi
agacuccggcagcau

SEQ ID NO: 3632399 - RNA, 20 nt, Salmonella enterica enterica serovar Typhi
agacucgcucccuuccccca

SEQ ID NO: 3632400 - RNA, 16 nt, Salmonella enterica enterica serovar Typhi
agacugauauccauug

SEQ ID NO: 3632401 - RNA, 14 nt, Salmonella enterica enterica serovar Typhi
agacugcacuuccu

SEQ ID NO: 3632402 - RNA, 16 nt, Salmonella enterica enterica serovar Typhi
agacugcacuuccugc

SEQ ID NO: 3632403 - RNA, 21 nt, Salmonella enterica enterica serovar Typhi
agacugcacuuccugcgucag

SEQ ID NO: 3632404 - RNA, 13 nt, Salmonella enterica enterica serovar Typhi
agacugcccggca

SEQ ID NO: 3632405 - RNA, 16 nt, Salmonella enterica enterica serovar Typhi
agacuggcggugcggu

SEQ ID NO: 3632406 - RNA, 17 nt, Salmonella enterica enterica serovar Typhi
agacugugauggcgguc

SEQ ID NO: 3632407 - RNA, 18 nt, Salmonella enterica enterica serovar Typhi
agacuuaggaaugcccag

SEQ ID NO: 3632408 - RNA, 20 nt, Salmonella enterica enterica serovar Typhi
agacuuagggcggagauacc

SEQ ID NO: 3632409 - RNA, 22 nt, Salmonella enterica enterica serovar Typhi
agacuucaacgccgcacacuca

SEQ ID NO: 3632410 - RNA, 14 nt, Salmonella enterica enterica serovar Typhi
agacuucuucaguc

SEQ ID NO: 3632411 - RNA, 16 nt, Salmonella enterica enterica serovar Typhi
agacuucuucagucag

SEQ ID NO: 3632412 - RNA, 21 nt, Salmonella enterica enterica serovar Typhi
agacuuuggauaaagccaaug

SEQ ID NO: 3632413 - RNA, 17 nt, Salmonella enterica enterica serovar Typhi
agagaaaaaaauccagu

SEQ ID NO: 3632414 - RNA, 18 nt, Salmonella enterica enterica serovar Typhi
agagaaaauaacaauauu

SEQ ID NO: 3632415 - RNA, 15 nt, Salmonella enterica enterica serovar Typhi
agagaaacaacaccg

SEQ ID NO: 3632416 - RNA, 22 nt, Salmonella enterica enterica serovar Typhi
agagaaacaacaccguaaaagg

SEQ ID NO: 3632417 - RNA, 21 nt, Salmonella enterica enterica serovar Typhi
agagaaccaacgcauaaaaac

SEQ ID NO: 3632418 - RNA, 15 nt, Salmonella enterica enterica serovar Typhi
agagaaccaacguca

SEQ ID NO: 3632419 - RNA, 14 nt, Salmonella enterica enterica serovar Typhi
agagaaccugaaca

SEQ ID NO: 3632420 - RNA, 20 nt, Salmonella enterica enterica serovar Typhi
agagaaccugaacaauaauc

SEQ ID NO: 3632421 - RNA, 23 nt, Salmonella enterica enterica serovar Typhi
agagaacgacgcauaaaaaauga

SEQ ID NO: 3632422 - RNA, 22 nt, Salmonella enterica enterica serovar Typhi
agagaacguugccgcaggcaac

SEQ ID NO: 3632423 - RNA, 23 nt, Salmonella enterica enterica serovar Typhi
agagaacguugccgcaggcaacg

SEQ ID NO: 3632424 - RNA, 14 nt, Salmonella enterica enterica serovar Typhi
agagaagucugagc

SEQ ID NO: 3632425 - RNA, 17 nt, Salmonella enterica enterica serovar Typhi
agagaagucugagcgca

SEQ ID NO: 3632426 - RNA, 22 nt, Salmonella enterica enterica serovar Typhi
agagaagucugagcgcaaacau

SEQ ID NO: 3632427 - RNA, 19 nt, Salmonella enterica enterica serovar Typhi
agagaauaacgaugaugaa

SEQ ID NO: 3632428 - RNA, 15 nt, Salmonella enterica enterica serovar Typhi
agagaauggccagca

SEQ ID NO: 3632429 - RNA, 17 nt, Salmonella enterica enterica serovar Typhi
agagaauggccagcaca

SEQ ID NO: 3632430 - RNA, 16 nt, Salmonella enterica enterica serovar Typhi
agagaauuaacagcgc

SEQ ID NO: 3632431 - RNA, 12 nt, Salmonella enterica enterica serovar Typhi
agagacugacaa

SEQ ID NO: 3632432 - RNA, 14 nt, Salmonella enterica enterica serovar Typhi
agagagauggaaca

SEQ ID NO: 3632433 - RNA, 13 nt, Salmonella enterica enterica serovar Typhi
agagagccuuaca

SEQ ID NO: 3632434 - RNA, 19 nt, Salmonella enterica enterica serovar Typhi
agagagcgggccguggcca

SEQ ID NO: 3632435 - RNA, 13 nt, Salmonella enterica enterica serovar Typhi
agagaguaaaacc

SEQ ID NO: 3632436 - RNA, 12 nt, Salmonella enterica enterica serovar Typhi
agagagugagaa

SEQ ID NO: 3632437 - RNA, 12 nt, Salmonella enterica enterica serovar Typhi
agagaguuccuc

SEQ ID NO: 3632438 - RNA, 20 nt, Salmonella enterica enterica serovar Typhi
agagaguucguuaaucucaa

SEQ ID NO: 3632439 - RNA, 16 nt, Salmonella enterica enterica serovar Typhi
agagauaauuuuccca

SEQ ID NO: 3632440 - RNA, 12 nt, Salmonella enterica enterica serovar Typhi
agagauagaacg

SEQ ID NO: 3632441 - RNA, 13 nt, Salmonella enterica enterica serovar Typhi
agagauccagaac

SEQ ID NO: 3632442 - RNA, 15 nt, Salmonella enterica enterica serovar Typhi
agagaucgaccggau

SEQ ID NO: 3632443 - RNA, 17 nt, Salmonella enterica enterica serovar Typhi
agagauucugcaggcca

SEQ ID NO: 3632444 - RNA, 14 nt, Salmonella enterica enterica serovar Typhi
agagcauccgcagc

SEQ ID NO: 3632445 - RNA, 22 nt, Salmonella enterica enterica serovar Typhi
agagccagacgguuaagccggu

SEQ ID NO: 3632446 - RNA, 23 nt, Salmonella enterica enterica serovar Typhi
agagccgcgcagcgcaacgccuu

SEQ ID NO: 3632447 - RNA, 21 nt, Salmonella enterica enterica serovar Typhi
agagccuaucccauuagggcu

SEQ ID NO: 3632448 - RNA, 16 nt, Salmonella enterica enterica serovar Typhi
agagccuuacaggcgc

SEQ ID NO: 3632449 - RNA, 22 nt, Salmonella enterica enterica serovar Typhi
agagcgaacaguacggucaggc

SEQ ID NO: 3632450 - RNA, 17 nt, Salmonella enterica enterica serovar Typhi
agagcgaaugcgcgcca

SEQ ID NO: 3632451 - RNA, 14 nt, Salmonella enterica enterica serovar Typhi
agagcgacaaugaa

SEQ ID NO: 3632452 - RNA, 17 nt, Salmonella enterica enterica serovar Typhi
agagcgccugcaggcga

SEQ ID NO: 3632453 - RNA, 15 nt, Salmonella enterica enterica serovar Typhi
agagcgcgcucugcc

SEQ ID NO: 3632454 - RNA, 20 nt, Salmonella enterica enterica serovar Typhi
agagcgggccguggccagga

SEQ ID NO: 3632455 - RNA, 13 nt, Salmonella enterica enterica serovar Typhi
agagcguauccag

SEQ ID NO: 3632456 - RNA, 20 nt, Salmonella enterica enterica serovar Typhi
agagcuaaucaauaaguuuu

SEQ ID NO: 3632457 - RNA, 16 nt, Salmonella enterica enterica serovar Typhi
agagcuuauuuugacu

SEQ ID NO: 3632458 - RNA, 17 nt, Salmonella enterica enterica serovar Typhi
agagcuugauaaauauc

SEQ ID NO: 3632459 - RNA, 15 nt, Salmonella enterica enterica serovar Typhi
agaggaauguccagc

SEQ ID NO: 3632460 - RNA, 19 nt, Salmonella enterica enterica serovar Typhi
agaggaggagaugucccac

SEQ ID NO: 3632461 - RNA, 23 nt, Salmonella enterica enterica serovar Typhi
agaggaucuggacgccaauuccu

SEQ ID NO: 3632462 - RNA, 14 nt, Salmonella enterica enterica serovar Typhi
agauccuucauuca

SEQ ID NO: 3632463 - RNA, 23 nt, Salmonella enterica enterica serovar Typhi
agauccuucauucagaucaaaaa

SEQ ID NO: 3632464 - RNA, 17 nt, Salmonella enterica enterica serovar Typhi
agaucgaaacgguccag

SEQ ID NO: 3632465 - RNA, 23 nt, Salmonella enterica enterica serovar Typhi
agaucgaaugaaaauguaucaga

SEQ ID NO: 3632466 - RNA, 19 nt, Salmonella enterica enterica serovar Typhi
agaucgacagcgcgcgcga

SEQ ID NO: 3632467 - RNA, 16 nt, Salmonella enterica enterica serovar Typhi
agaucgaccagcgcau

SEQ ID NO: 3632468 - RNA, 17 nt, Salmonella enterica enterica serovar Typhi
agaucgagacgcgucag

SEQ ID NO: 3632469 - RNA, 22 nt, Salmonella enterica enterica serovar Typhi
agaucgcggggcaacagauacg

SEQ ID NO: 3632470 - RNA, 18 nt, Salmonella enterica enterica serovar Typhi
agaucgcguacagcgcca

SEQ ID NO: 3632471 - RNA, 12 nt, Salmonella enterica enterica serovar Typhi
agaucgcugcaa

SEQ ID NO: 3632472 - RNA, 17 nt, Salmonella enterica enterica serovar Typhi
agaucggcauagcggga

SEQ ID NO: 3632473 - RNA, 17 nt, Salmonella enterica enterica serovar Typhi
agaucggcaugauggcg

SEQ ID NO: 3632474 - RNA, 23 nt, Salmonella enterica enterica serovar Typhi
agaucguaagaauaaucauccgc

SEQ ID NO: 3632475 - RNA, 16 nt, Salmonella enterica enterica serovar Typhi
agaucgugcauccgga

SEQ ID NO: 3632476 - RNA, 18 nt, Salmonella enterica enterica serovar Typhi
agaucguuauccagcagc

SEQ ID NO: 3632477 - RNA, 20 nt, Salmonella enterica enterica serovar Typhi
agaucguuauuaaacagaca

SEQ ID NO: 3632478 - RNA, 12 nt, Salmonella enterica enterica serovar Typhi
agaucuaucuga

SEQ ID NO: 3632479 - RNA, 11 nt, Salmonella enterica enterica serovar Typhi
agaucucuaac

SEQ ID NO: 3632480 - RNA, 18 nt, Salmonella enterica enterica serovar Typhi
agaucuucacgcgucagg

SEQ ID NO: 3632481 - RNA, 14 nt, Salmonella enterica enterica serovar Typhi
agaucuuccggcgu

SEQ ID NO: 3632482 - RNA, 21 nt, Salmonella enterica enterica serovar Typhi
agaucuuuauccugcacgaag

SEQ ID NO: 3632483 - RNA, 17 nt, Salmonella enterica enterica serovar Typhi
agaugaaacucgcugug

SEQ ID NO: 3632484 - RNA, 20 nt, Salmonella enterica enterica serovar Typhi
agaugaaacugcauaucgcc

SEQ ID NO: 3632485 - RNA, 18 nt, Salmonella enterica enterica serovar Typhi
agaugaagacaacgucgc

SEQ ID NO: 3632486 - RNA, 22 nt, Salmonella enterica enterica serovar Typhi
agaugacaaagccggauaucgc

SEQ ID NO: 3632487 - RNA, 21 nt, Salmonella enterica enterica serovar Typhi
agaugaccaaagcuauucaca

SEQ ID NO: 3632488 - RNA, 22 nt, Salmonella enterica enterica serovar Typhi
agaugaccguuaguaaucggau

SEQ ID NO: 3632489 - RNA, 18 nt, Salmonella enterica enterica serovar Typhi
agaugauaaucauccggg

SEQ ID NO: 3632490 - RNA, 19 nt, Salmonella enterica enterica serovar Typhi
agaugaugauuuaugaaua

SEQ ID NO: 3632491 - RNA, 23 nt, Salmonella enterica enterica serovar Typhi
agaugcagcggcaguuccggcgu

SEQ ID NO: 3632492 - RNA, 15 nt, Salmonella enterica enterica serovar Typhi
agaugcaggccaagc

SEQ ID NO: 3632493 - RNA, 17 nt, Salmonella enterica enterica serovar Typhi
agaugcccgcagaucug

SEQ ID NO: 3632494 - RNA, 19 nt, Salmonella enterica enterica serovar Typhi
agaugcucaggcaacacga

SEQ ID NO: 3632495 - RNA, 13 nt, Salmonella enterica enterica serovar Typhi
agauggaaaaaaa

SEQ ID NO: 3632496 - RNA, 16 nt, Salmonella enterica enterica serovar Typhi
agauggcaagauuaac

SEQ ID NO: 3632497 - RNA, 16 nt, Salmonella enterica enterica serovar Typhi
agauggcgcuaaaacc

SEQ ID NO: 3632498 - RNA, 20 nt, Salmonella enterica enterica serovar Typhi
agauggcgucacauggcgaa

SEQ ID NO: 3632499 - RNA, 21 nt, Salmonella enterica enterica serovar Typhi
agauggcuaugaagcuggagc

SEQ ID NO: 3632500 - RNA, 22 nt, Salmonella enterica enterica serovar Typhi
agauggucuguaccaccagaau

SEQ ID NO: 3632501 - RNA, 16 nt, Salmonella enterica enterica serovar Typhi
agauguaccagcggca

SEQ ID NO: 3632502 - RNA, 12 nt, Salmonella enterica enterica serovar Typhi
agaugucagauc

SEQ ID NO: 3632503 - RNA, 17 nt, Salmonella enterica enterica serovar Typhi
agaugucagauccuuca

SEQ ID NO: 3632504 - RNA, 17 nt, Salmonella enterica enterica serovar Typhi
agauguuaaaguuuuuc

SEQ ID NO: 3632505 - RNA, 19 nt, Salmonella enterica enterica serovar Typhi
agauguucuaucuuucaga

SEQ ID NO: 3632506 - RNA, 16 nt, Salmonella enterica enterica serovar Typhi
agauguugauacagaa

SEQ ID NO: 3632507 - RNA, 20 nt, Salmonella enterica enterica serovar Typhi
agauguugauacagaaaacc

SEQ ID NO: 3632508 - RNA, 13 nt, Salmonella enterica enterica serovar Typhi
agauguugccgua

SEQ ID NO: 3632509 - RNA, 15 nt, Salmonella enterica enterica serovar Typhi
agauuaaucagcaga

SEQ ID NO: 3632510 - RNA, 20 nt, Salmonella enterica enterica serovar Typhi
agauuacucucuugccagcg

SEQ ID NO: 3632511 - RNA, 21 nt, Salmonella enterica enterica serovar Typhi
agauuacucucuugccagcgc

SEQ ID NO: 3632512 - RNA, 21 nt, Salmonella enterica enterica serovar Typhi
agauuacuucaggcugccaac

SEQ ID NO: 3632513 - RNA, 18 nt, Salmonella enterica enterica serovar Typhi
agauuagccccagcgcca

SEQ ID NO: 3632514 - RNA, 18 nt, Salmonella enterica enterica serovar Typhi
agauuagguacguacauc

SEQ ID NO: 3632515 - RNA, 19 nt, Salmonella enterica enterica serovar Typhi
agauuaugcaguucuucgc

SEQ ID NO: 3632516 - RNA, 19 nt, Salmonella enterica enterica serovar Typhi
agauuauuuuaucaucagc

SEQ ID NO: 3632517 - RNA, 18 nt, Salmonella enterica enterica serovar Typhi
agauucaggccgccagca

SEQ ID NO: 3632518 - RNA, 14 nt, Salmonella enterica enterica serovar Typhi
agauucuucugccu

SEQ ID NO: 3632519 - RNA, 14 nt, Salmonella enterica enterica serovar Typhi
agauugaacgcugg

SEQ ID NO: 3632520 - RNA, 21 nt, Salmonella enterica enterica serovar Typhi
agauugagacaaauaacuuuc

SEQ ID NO: 3632521 - RNA, 16 nt, Salmonella enterica enterica serovar Typhi
agauuggcaucugcaa

SEQ ID NO: 3632522 - RNA, 19 nt, Salmonella enterica enterica serovar Typhi
agauuggcccgcccagcau

SEQ ID NO: 3632523 - RNA, 16 nt, Salmonella enterica enterica serovar Typhi
agauuggugaugcgca

SEQ ID NO: 3632524 - RNA, 15 nt, Salmonella enterica enterica serovar Typhi
agauugucaccguaa

SEQ ID NO: 3632525 - RNA, 17 nt, Salmonella enterica enterica serovar Typhi
agauugucaccguaaua

SEQ ID NO: 3632526 - RNA, 19 nt, Salmonella enterica enterica serovar Typhi
agauugucaccguaauaua

SEQ ID NO: 3632527 - RNA, 21 nt, Salmonella enterica enterica serovar Typhi
agauugugcuuuagcuuuacu

SEQ ID NO: 3632528 - RNA, 20 nt, Salmonella enterica enterica serovar Typhi
agauuguggaacuuuaucgc

SEQ ID NO: 3632529 - RNA, 23 nt, Salmonella enterica enterica serovar Typhi
agauuguuucggauaauucugac

SEQ ID NO: 3632530 - RNA, 13 nt, Salmonella enterica enterica serovar Typhi
agauuuaaaacaa

SEQ ID NO: 3632531 - RNA, 15 nt, Salmonella enterica enterica serovar Typhi
agauuuaaaacaagc

SEQ ID NO: 3632532 - RNA, 17 nt, Salmonella enterica enterica serovar Typhi
agauuuaucaauuuuua

SEQ ID NO: 3632533 - RNA, 15 nt, Salmonella enterica enterica serovar Typhi
agauuuaucuucucu

SEQ ID NO: 3632534 - RNA, 20 nt, Salmonella enterica enterica serovar Typhi
agauuucacaauguuuuugu

SEQ ID NO: 3632535 - RNA, 17 nt, Salmonella enterica enterica serovar Typhi
agauuucaucaggcuga

SEQ ID NO: 3632536 - RNA, 24 nt, Salmonella enterica enterica serovar Typhi
agauuucaucaggcugacgaagaa

SEQ ID NO: 3632537 - RNA, 13 nt, Salmonella enterica enterica serovar Typhi
agauuucuuaauu

SEQ ID NO: 3632538 - RNA, 19 nt, Salmonella enterica enterica serovar Typhi
agauuucuuaauuccucag

SEQ ID NO: 3632539 - RNA, 21 nt, Salmonella enterica enterica serovar Typhi
agauuugaacgucgcgugcga

SEQ ID NO: 3632540 - RNA, 19 nt, Salmonella enterica enterica serovar Typhi
agauuuuucugcgccacca

SEQ ID NO: 3632541 - RNA, 15 nt, Salmonella enterica enterica serovar Typhi
agcaaaaacauuacc

SEQ ID NO: 3632542 - RNA, 20 nt, Salmonella enterica enterica serovar Typhi
agcaaaacaccgcucaauau

SEQ ID NO: 3632543 - RNA, 16 nt, Salmonella enterica enterica serovar Typhi
agcaaaaucacgcaca

SEQ ID NO: 3632544 - RNA, 15 nt, Salmonella enterica enterica serovar Typhi
agcaaaauggcaauu

SEQ ID NO: 3632545 - RNA, 20 nt, Salmonella enterica enterica serovar Typhi
agcaaacauccccgcuugca

SEQ ID NO: 3632546 - RNA, 18 nt, Salmonella enterica enterica serovar Typhi
agcaaaccgacccaaaaa

SEQ ID NO: 3632547 - RNA, 24 nt, Salmonella enterica enterica serovar Typhi
agcacguagcuuauaaaucagcuu

SEQ ID NO: 3632548 - RNA, 14 nt, Salmonella enterica enterica serovar Typhi
agcacguaggccug

SEQ ID NO: 3632549 - RNA, 16 nt, Salmonella enterica enterica serovar Typhi
agcacuaacagcagca

SEQ ID NO: 3632550 - RNA, 21 nt, Salmonella enterica enterica serovar Typhi
agcacuacggauggcccugcc

SEQ ID NO: 3632551 - RNA, 18 nt, Salmonella enterica enterica serovar Typhi
agcacuccccggcuugcg

SEQ ID NO: 3632552 - RNA, 16 nt, Salmonella enterica enterica serovar Typhi
agcacugcugcugaaa

SEQ ID NO: 3632553 - RNA, 17 nt, Salmonella enterica enterica serovar Typhi
agcacugcugcugaaag

SEQ ID NO: 3632554 - RNA, 21 nt, Salmonella enterica enterica serovar Typhi
agcacugcugcugaaagaaga

SEQ ID NO: 3632555 - RNA, 23 nt, Salmonella enterica enterica serovar Typhi
agcacugucccagggccaaacug

SEQ ID NO: 3632556 - RNA, 15 nt, Salmonella enterica enterica serovar Typhi
agcacuucagaacgg

SEQ ID NO: 3632557 - RNA, 16 nt, Salmonella enterica enterica serovar Typhi
agcacuuccggaucgc

SEQ ID NO: 3632558 - RNA, 22 nt, Salmonella enterica enterica serovar Typhi
agcacuucgcugauaccgcccu

SEQ ID NO: 3632559 - RNA, 13 nt, Salmonella enterica enterica serovar Typhi
agcacuucuccac

SEQ ID NO: 3632560 - RNA, 16 nt, Salmonella enterica enterica serovar Typhi
agcacuuugguaaaac

SEQ ID NO: 3632561 - RNA, 15 nt, Salmonella enterica enterica serovar Typhi
agcacuuuuuccucc

SEQ ID NO: 3632562 - RNA, 18 nt, Salmonella enterica enterica serovar Typhi
agcagaaagcaacagcaa

SEQ ID NO: 3632563 - RNA, 19 nt, Salmonella enterica enterica serovar Typhi
agcagaaauacugugccca

SEQ ID NO: 3632564 - RNA, 21 nt, Salmonella enterica enterica serovar Typhi
agcagaaauacugugcccaga

SEQ ID NO: 3632565 - RNA, 16 nt, Salmonella enterica enterica serovar Typhi
agcagaagacggaaac

SEQ ID NO: 3632566 - RNA, 13 nt, Salmonella enterica enterica serovar Typhi
agcagacagguga

SEQ ID NO: 3632567 - RNA, 13 nt, Salmonella enterica enterica serovar Typhi
agcagacgagaaa

SEQ ID NO: 3632568 - RNA, 20 nt, Salmonella enterica enterica serovar Typhi
agcagacucauggacaaaaa

SEQ ID NO: 3632569 - RNA, 13 nt, Salmonella enterica enterica serovar Typhi
agcagacuguaaa

SEQ ID NO: 3632570 - RNA, 20 nt, Salmonella enterica enterica serovar Typhi
agcagaggaaaacguugcug

SEQ ID NO: 3632571 - RNA, 13 nt, Salmonella enterica enterica serovar Typhi
agcagauaagcga

SEQ ID NO: 3632572 - RNA, 20 nt, Salmonella enterica enterica serovar Typhi
agcagauaccagccuucgga

SEQ ID NO: 3632573 - RNA, 15 nt, Salmonella enterica enterica serovar Typhi
agcagauacugcgcg

SEQ ID NO: 3632574 - RNA, 12 nt, Salmonella enterica enterica serovar Typhi
agcagauagccc

SEQ ID NO: 3632575 - RNA, 15 nt, Salmonella enterica enterica serovar Typhi
agcagauagcccgcc

SEQ ID NO: 3632576 - RNA, 20 nt, Salmonella enterica enterica serovar Typhi
agcagauagcccgccagcac

SEQ ID NO: 3632577 - RNA, 16 nt, Salmonella enterica enterica serovar Typhi
agcagaugaacggcaa

SEQ ID NO: 3632578 - RNA, 19 nt, Salmonella enterica enterica serovar Typhi
agcagauuuuuauccgucg

SEQ ID NO: 3632579 - RNA, 22 nt, Salmonella enterica enterica serovar Typhi
agcagcaaaccgauaaucacca

SEQ ID NO: 3632580 - RNA, 15 nt, Salmonella enterica enterica serovar Typhi
agcagcaacccugcc

SEQ ID NO: 3632581 - RNA, 17 nt, Salmonella enterica enterica serovar Typhi
agcagcaacccugccgu

SEQ ID NO: 3632582 - RNA, 10 nt, Salmonella enterica enterica serovar Typhi
agcagcagaa

SEQ ID NO: 3632583 - RNA, 16 nt, Salmonella enterica enterica serovar Typhi
agcagcagcagcgcuu

SEQ ID NO: 3632584 - RNA, 16 nt, Salmonella enterica enterica serovar Typhi
agcagcaggcuggaga

SEQ ID NO: 3632585 - RNA, 15 nt, Salmonella enterica enterica serovar Typhi
agcagcagugaggau

SEQ ID NO: 3632586 - RNA, 16 nt, Salmonella enterica enterica serovar Typhi
agcagcauaaaaccgc

SEQ ID NO: 3632587 - RNA, 23 nt, Salmonella enterica enterica serovar Typhi
agcagcauaaacaucagcgcgga

SEQ ID NO: 3632588 - RNA, 18 nt, Salmonella enterica enterica serovar Typhi
agcagccagaaaaaggga

SEQ ID NO: 3632589 - RNA, 19 nt, Salmonella enterica enterica serovar Typhi
agcagcgaggugauaauca

SEQ ID NO: 3632590 - RNA, 20 nt, Salmonella enterica enterica serovar Typhi
agcagcgaggugauaaucag

SEQ ID NO: 3632591 - RNA, 17 nt, Salmonella enterica enterica serovar Typhi
agcagcgaugacagcag

SEQ ID NO: 3632592 - RNA, 15 nt, Salmonella enterica enterica serovar Typhi
agcagcgcaccugcc

SEQ ID NO: 3632593 - RNA, 12 nt, Salmonella enterica enterica serovar Typhi
agcagcgcauca

SEQ ID NO: 3632594 - RNA, 14 nt, Salmonella enterica enterica serovar Typhi
agcagcgcaucaug

SEQ ID NO: 3632595 - RNA, 17 nt, Salmonella enterica enterica serovar Typhi
agcagcgcaucaugguc

SEQ ID NO: 3632596 - RNA, 16 nt, Salmonella enterica enterica serovar Typhi
agcagcgccagcgaca

SEQ ID NO: 3632597 - RNA, 23 nt, Salmonella enterica enterica serovar Typhi
agcagcggcgguuauccgccagc

SEQ ID NO: 3632598 - RNA, 18 nt, Salmonella enterica enterica serovar Typhi
agcagcggcguaucuucc

SEQ ID NO: 3632599 - RNA, 18 nt, Salmonella enterica enterica serovar Typhi
agcagcguuuugcgcgua

SEQ ID NO: 3632600 - RNA, 16 nt, Salmonella enterica enterica serovar Typhi
agcagcucaacggcag

SEQ ID NO: 3632601 - RNA, 13 nt, Salmonella enterica enterica serovar Typhi
agcagcuccgaaa

SEQ ID NO: 3632602 - RNA, 20 nt, Salmonella enterica enterica serovar Typhi
agcagcugcuuaacuucugc

SEQ ID NO: 3632603 - RNA, 14 nt, Salmonella enterica enterica serovar Typhi
agcagcuucaugca

SEQ ID NO: 3632604 - RNA, 23 nt, Salmonella enterica enterica serovar Typhi
agcaggaaaagaccauccgguuu

SEQ ID NO: 3632605 - RNA, 20 nt, Salmonella enterica enterica serovar Typhi
agcaggaaaucauagcccug

SEQ ID NO: 3632606 - RNA, 17 nt, Salmonella enterica enterica serovar Typhi
agcaggcacuguggugu

SEQ ID NO: 3632607 - RNA, 10 nt, Salmonella enterica enterica serovar Typhi
agcaggcggg

SEQ ID NO: 3632608 - RNA, 16 nt, Salmonella enterica enterica serovar Typhi
agcagggucaggaacu

SEQ ID NO: 3632609 - RNA, 22 nt, Salmonella enterica enterica serovar Typhi
agcagggucaggaacugcggcc

SEQ ID NO: 3632610 - RNA, 20 nt, Salmonella enterica enterica serovar Typhi
agcagucccgccgggaucug

SEQ ID NO: 3632611 - RNA, 16 nt, Salmonella enterica enterica serovar Typhi
agcagugauuaugcuc

SEQ ID NO: 3632612 - RNA, 18 nt, Salmonella enterica enterica serovar Typhi
agcagugcuggcaacauu

SEQ ID NO: 3632613 - RNA, 14 nt, Salmonella enterica enterica serovar Typhi
agcagugggaaaau

SEQ ID NO: 3632614 - RNA, 15 nt, Salmonella enterica enterica serovar Typhi
agcaguuccagcauc

SEQ ID NO: 3632615 - RNA, 17 nt, Salmonella enterica enterica serovar Typhi
agcaguucgauaauccc

SEQ ID NO: 3632616 - RNA, 17 nt, Salmonella enterica enterica serovar Typhi
agcauaaaaaacaucau

SEQ ID NO: 3632617 - RNA, 17 nt, Salmonella enterica enterica serovar Typhi
agcauaauaaagcagcg

SEQ ID NO: 3632618 - RNA, 13 nt, Salmonella enterica enterica serovar Typhi
agcauaccgccca

SEQ ID NO: 3632619 - RNA, 16 nt, Salmonella enterica enterica serovar Typhi
agcauacgacaucgcc

SEQ ID NO: 3632620 - RNA, 14 nt, Salmonella enterica enterica serovar Typhi
agcauacugauguc

SEQ ID NO: 3632621 - RNA, 15 nt, Salmonella enterica enterica serovar Typhi
agcauacugcgucgg

SEQ ID NO: 3632622 - RNA, 18 nt, Salmonella enterica enterica serovar Typhi
agcauagcgccuucaggc

SEQ ID NO: 3632623 - RNA, 15 nt, Salmonella enterica enterica serovar Typhi
agcauaucgauagca

SEQ ID NO: 3632624 - RNA, 21 nt, Salmonella enterica enterica serovar Typhi
agcauauucaccagagcauca

SEQ ID NO: 3632625 - RNA, 19 nt, Salmonella enterica enterica serovar Typhi
agcaucaaacuuuuaaauu

SEQ ID NO: 3632626 - RNA, 16 nt, Salmonella enterica enterica serovar Typhi
agcaucaauagcagcu

SEQ ID NO: 3632627 - RNA, 15 nt, Salmonella enterica enterica serovar Typhi
agcaucaauaucugc

SEQ ID NO: 3632628 - RNA, 20 nt, Salmonella enterica enterica serovar Typhi
agcauccagacccagacaac

SEQ ID NO: 3632629 - RNA, 19 nt, Salmonella enterica enterica serovar Typhi
agcaucccgcaggcggcga

SEQ ID NO: 3632630 - RNA, 21 nt, Salmonella enterica enterica serovar Typhi
agcauccgcaagacacgcuuc

SEQ ID NO: 3632631 - RNA, 18 nt, Salmonella enterica enterica serovar Typhi
agcauccgggauauaaaa

SEQ ID NO: 3632632 - RNA, 14 nt, Salmonella enterica enterica serovar Typhi
agcauccuccggcg

SEQ ID NO: 3632633 - RNA, 20 nt, Salmonella enterica enterica serovar Typhi
agccagcucaccagccaaau

SEQ ID NO: 3632634 - RNA, 15 nt, Salmonella enterica enterica serovar Typhi
agccaggcaaagccc

SEQ ID NO: 3632635 - RNA, 13 nt, Salmonella enterica enterica serovar Typhi
agccaggccgcca

SEQ ID NO: 3632636 - RNA, 20 nt, Salmonella enterica enterica serovar Typhi
agccaggccgccagcaacgu

SEQ ID NO: 3632637 - RNA, 19 nt, Salmonella enterica enterica serovar Typhi
agccaggcuuuaaauucag

SEQ ID NO: 3632638 - RNA, 16 nt, Salmonella enterica enterica serovar Typhi
agccaguagcugguga

SEQ ID NO: 3632639 - RNA, 19 nt, Salmonella enterica enterica serovar Typhi
agccaguagcuggugacuu

SEQ ID NO: 3632640 - RNA, 18 nt, Salmonella enterica enterica serovar Typhi
agccagucgccaggcaag

SEQ ID NO: 3632641 - RNA, 20 nt, Salmonella enterica enterica serovar Typhi
agccagugggcgucaaaauc

SEQ ID NO: 3632642 - RNA, 18 nt, Salmonella enterica enterica serovar Typhi
agccaguucgccuucuuc

SEQ ID NO: 3632643 - RNA, 16 nt, Salmonella enterica enterica serovar Typhi
agccaguucucuucuu

SEQ ID NO: 3632644 - RNA, 19 nt, Salmonella enterica enterica serovar Typhi
agccauaaugcaaucaguu

SEQ ID NO: 3632645 - RNA, 20 nt, Salmonella enterica enterica serovar Typhi
agccauacauugaguaaaua

SEQ ID NO: 3632646 - RNA, 14 nt, Salmonella enterica enterica serovar Typhi
agccaucaauccau

SEQ ID NO: 3632647 - RNA, 15 nt, Salmonella enterica enterica serovar Typhi
agccaucauuaccaa

SEQ ID NO: 3632648 - RNA, 18 nt, Salmonella enterica enterica serovar Typhi
agccauccucacgcaacc

SEQ ID NO: 3632649 - RNA, 19 nt, Salmonella enterica enterica serovar Typhi
agccaugcauaaugcagcc

SEQ ID NO: 3632650 - RNA, 17 nt, Salmonella enterica enterica serovar Typhi
agccaugccagcaguuu

SEQ ID NO: 3632651 - RNA, 17 nt, Salmonella enterica enterica serovar Typhi
agccaugccauauggcc

SEQ ID NO: 3632652 - RNA, 14 nt, Salmonella enterica enterica serovar Typhi
agccauggcccaaa

SEQ ID NO: 3632653 - RNA, 14 nt, Salmonella enterica enterica serovar Typhi
agccauuaaagaag

SEQ ID NO: 3632654 - RNA, 16 nt, Salmonella enterica enterica serovar Typhi
agccauuaaugcaggc

SEQ ID NO: 3632655 - RNA, 20 nt, Salmonella enterica enterica serovar Typhi
agccauuccccacgccaucg

SEQ ID NO: 3632656 - RNA, 14 nt, Salmonella enterica enterica serovar Typhi
agccauucggcugc

SEQ ID NO: 3632657 - RNA, 13 nt, Salmonella enterica enterica serovar Typhi
agccauugccgcg

SEQ ID NO: 3632658 - RNA, 17 nt, Salmonella enterica enterica serovar Typhi
agccauuuuaaaaauau

SEQ ID NO: 3632659 - RNA, 19 nt, Salmonella enterica enterica serovar Typhi
agcccaauacgccagccua

SEQ ID NO: 3632660 - RNA, 16 nt, Salmonella enterica enterica serovar Typhi
agcccaauaucccuau

SEQ ID NO: 3632661 - RNA, 19 nt, Salmonella enterica enterica serovar Typhi
agcccaauaucccuauuag

SEQ ID NO: 3632662 - RNA, 18 nt, Salmonella enterica enterica serovar Typhi
agcccacgcccugcaaug

SEQ ID NO: 3632663 - RNA, 23 nt, Salmonella enterica enterica serovar Typhi
agcccacuggcaaguaugaaaag

SEQ ID NO: 3632664 - RNA, 14 nt, Salmonella enterica enterica serovar Typhi
agcccagcacggca

SEQ ID NO: 3632665 - RNA, 14 nt, Salmonella enterica enterica serovar Typhi
agcccagcgccgca

SEQ ID NO: 3632666 - RNA, 17 nt, Salmonella enterica enterica serovar Typhi
agcccagcucauaggau

SEQ ID NO: 3632667 - RNA, 18 nt, Salmonella enterica enterica serovar Typhi
agcccagguagaauccca

SEQ ID NO: 3632668 - RNA, 20 nt, Salmonella enterica enterica serovar Typhi
agcccaguaauauccccauc

SEQ ID NO: 3632669 - RNA, 15 nt, Salmonella enterica enterica serovar Typhi
agcccauaaagcacu

SEQ ID NO: 3632670 - RNA, 16 nt, Salmonella enterica enterica serovar Typhi
agcccaucaccgccag

SEQ ID NO: 3632671 - RNA, 14 nt, Salmonella enterica enterica serovar Typhi
agcccaucagcgcc

SEQ ID NO: 3632672 - RNA, 20 nt, Salmonella enterica enterica serovar Typhi
agcccaucagcgccagcccu

SEQ ID NO: 3632673 - RNA, 17 nt, Salmonella enterica enterica serovar Typhi
agcccaugauggugaac

SEQ ID NO: 3632674 - RNA, 21 nt, Salmonella enterica enterica serovar Typhi
agcccauggcaggcagcacaa

SEQ ID NO: 3632675 - RNA, 12 nt, Salmonella enterica enterica serovar Typhi
agccccacgccc

SEQ ID NO: 3632676 - RNA, 13 nt, Salmonella enterica enterica serovar Typhi
agccccagcacca

SEQ ID NO: 3632677 - RNA, 12 nt, Salmonella enterica enterica serovar Typhi
agccccagcgcc

SEQ ID NO: 3632678 - RNA, 13 nt, Salmonella enterica enterica serovar Typhi
agccccagcgcca

SEQ ID NO: 3632679 - RNA, 18 nt, Salmonella enterica enterica serovar Typhi
agccccagcgccagcgac

SEQ ID NO: 3632680 - RNA, 13 nt, Salmonella enterica enterica serovar Typhi
agccccccgcaca

SEQ ID NO: 3632681 - RNA, 23 nt, Salmonella enterica enterica serovar Typhi
agccccccuuugcauuacggcga

SEQ ID NO: 3632682 - RNA, 14 nt, Salmonella enterica enterica serovar Typhi
agccccgaugucgc

SEQ ID NO: 3632683 - RNA, 17 nt, Salmonella enterica enterica serovar Typhi
agccccggucaacgcgc

SEQ ID NO: 3632684 - RNA, 16 nt, Salmonella enterica enterica serovar Typhi
agccccucuuauugag

SEQ ID NO: 3632685 - RNA, 16 nt, Salmonella enterica enterica serovar Typhi
agccccugaaauaaca

SEQ ID NO: 3632686 - RNA, 15 nt, Salmonella enterica enterica serovar Typhi
agccccugacgcugc

SEQ ID NO: 3632687 - RNA, 14 nt, Salmonella enterica enterica serovar Typhi
agcccgccagcacc

SEQ ID NO: 3632688 - RNA, 21 nt, Salmonella enterica enterica serovar Typhi
agcccgccuccaccuuaucaa

SEQ ID NO: 3632689 - RNA, 20 nt, Salmonella enterica enterica serovar Typhi
agcccgcuucacgcgcggcu

SEQ ID NO: 3632690 - RNA, 21 nt, Salmonella enterica enterica serovar Typhi
agcccggaaauaaacgccagu

SEQ ID NO: 3632691 - RNA, 21 nt, Salmonella enterica enterica serovar Typhi
agcccggcauguccaucagau

SEQ ID NO: 3632692 - RNA, 17 nt, Salmonella enterica enterica serovar Typhi
agcccggccacagcgcc

SEQ ID NO: 3632693 - RNA, 18 nt, Salmonella enterica enterica serovar Typhi
agcccggccacagcgcca

SEQ ID NO: 3632694 - RNA, 22 nt, Salmonella enterica enterica serovar Typhi
agcccggccacagcgccagaca

SEQ ID NO: 3632695 - RNA, 18 nt, Salmonella enterica enterica serovar Typhi
agcccggcggaggccauu

SEQ ID NO: 3632696 - RNA, 17 nt, Salmonella enterica enterica serovar Typhi
agcccggcggcgcaucg

SEQ ID NO: 3632697 - RNA, 15 nt, Salmonella enterica enterica serovar Typhi
agcccggcuucccau

SEQ ID NO: 3632698 - RNA, 21 nt, Salmonella enterica enterica serovar Typhi
agcccguccagauaaugauca

SEQ ID NO: 3632699 - RNA, 14 nt, Salmonella enterica enterica serovar Typhi
agcccgucccuucc

SEQ ID NO: 3632700 - RNA, 16 nt, Salmonella enterica enterica serovar Typhi
agcccgucccuuccgc

SEQ ID NO: 3632701 - RNA, 13 nt, Salmonella enterica enterica serovar Typhi
agcccucuggcaa

SEQ ID NO: 3632702 - RNA, 15 nt, Salmonella enterica enterica serovar Typhi
agcccuguuauucag

SEQ ID NO: 3632703 - RNA, 14 nt, Salmonella enterica enterica serovar Typhi
agcccuuccaccag

SEQ ID NO: 3632704 - RNA, 22 nt, Salmonella enterica enterica serovar Typhi
agcccuugaucggguuuuccug

SEQ ID NO: 3632705 - RNA, 23 nt, Salmonella enterica enterica serovar Typhi
agcccuuugagaaaacugcgccc

SEQ ID NO: 3632706 - RNA, 13 nt, Salmonella enterica enterica serovar Typhi
agcccuuugcccu

SEQ ID NO: 3632707 - RNA, 14 nt, Salmonella enterica enterica serovar Typhi
agccgaccaccauc

SEQ ID NO: 3632708 - RNA, 21 nt, Salmonella enterica enterica serovar Typhi
agccgaccaucgcgccgcugg

SEQ ID NO: 3632709 - RNA, 14 nt, Salmonella enterica enterica serovar Typhi
agccgaccuggcgg

SEQ ID NO: 3632710 - RNA, 21 nt, Salmonella enterica enterica serovar Typhi
agccgacgcauuucuccugau

SEQ ID NO: 3632711 - RNA, 16 nt, Salmonella enterica enterica serovar Typhi
agccgacuaucuucuu

SEQ ID NO: 3632712 - RNA, 20 nt, Salmonella enterica enterica serovar Typhi
agccgagacuaucgauagcg

SEQ ID NO: 3632713 - RNA, 22 nt, Salmonella enterica enterica serovar Typhi
agccgaggcuuaauacggcaac

SEQ ID NO: 3632714 - RNA, 22 nt, Salmonella enterica enterica serovar Typhi
agccgauuuuucggcacgcugg

SEQ ID NO: 3632715 - RNA, 19 nt, Salmonella enterica enterica serovar Typhi
agccgcagaaccauuuccu

SEQ ID NO: 3632716 - RNA, 20 nt, Salmonella enterica enterica serovar Typhi
agccgccaggcaaucagcag

SEQ ID NO: 3632717 - RNA, 13 nt, Salmonella enterica enterica serovar Typhi
agccgccauuaau

SEQ ID NO: 3632718 - RNA, 14 nt, Salmonella enterica enterica serovar Typhi
agccgcccacaacc

SEQ ID NO: 3632719 - RNA, 19 nt, Salmonella enterica enterica serovar Typhi
agcgagcgccugaugccgc

SEQ ID NO: 3632720 - RNA, 17 nt, Salmonella enterica enterica serovar Typhi
agcgagcugguuucaau

SEQ ID NO: 3632721 - RNA, 11 nt, Salmonella enterica enterica serovar Typhi
agcgagucaga

SEQ ID NO: 3632722 - RNA, 21 nt, Salmonella enterica enterica serovar Typhi
agcgaguuacguugcggcgua

SEQ ID NO: 3632723 - RNA, 14 nt, Salmonella enterica enterica serovar Typhi
agcgauagacuguu

SEQ ID NO: 3632724 - RNA, 18 nt, Salmonella enterica enterica serovar Typhi
agcgauagucguugcgcc

SEQ ID NO: 3632725 - RNA, 16 nt, Salmonella enterica enterica serovar Typhi
agcgauauagcgcaua

SEQ ID NO: 3632726 - RNA, 15 nt, Salmonella enterica enterica serovar Typhi
agcgauauuucuccg

SEQ ID NO: 3632727 - RNA, 16 nt, Salmonella enterica enterica serovar Typhi
agcgaucacgccgucc

SEQ ID NO: 3632728 - RNA, 17 nt, Salmonella enterica enterica serovar Typhi
agcgaucauaagggagc

SEQ ID NO: 3632729 - RNA, 16 nt, Salmonella enterica enterica serovar Typhi
agcgaugacagcagga

SEQ ID NO: 3632730 - RNA, 23 nt, Salmonella enterica enterica serovar Typhi
agcgaugacgccugccagauagu

SEQ ID NO: 3632731 - RNA, 17 nt, Salmonella enterica enterica serovar Typhi
agcgaugagcgccagca

SEQ ID NO: 3632732 - RNA, 20 nt, Salmonella enterica enterica serovar Typhi
agcgaugagcgccagcaaca

SEQ ID NO: 3632733 - RNA, 23 nt, Salmonella enterica enterica serovar Typhi
agcgaugcgguucaacgcgcugc

SEQ ID NO: 3632734 - RNA, 18 nt, Salmonella enterica enterica serovar Typhi
agcgaugggagagaggac

SEQ ID NO: 3632735 - RNA, 17 nt, Salmonella enterica enterica serovar Typhi
agcgauuacgccagaca

SEQ ID NO: 3632736 - RNA, 14 nt, Salmonella enterica enterica serovar Typhi
agcgauuauuucau

SEQ ID NO: 3632737 - RNA, 14 nt, Salmonella enterica enterica serovar Typhi
agcgauuuauccac

SEQ ID NO: 3632738 - RNA, 17 nt, Salmonella enterica enterica serovar Typhi
agcgcaaaagcgcgccc

SEQ ID NO: 3632739 - RNA, 19 nt, Salmonella enterica enterica serovar Typhi
agcgcaaacggaucuucca

SEQ ID NO: 3632740 - RNA, 19 nt, Salmonella enterica enterica serovar Typhi
agcgcaaauauccuaccac

SEQ ID NO: 3632741 - RNA, 13 nt, Salmonella enterica enterica serovar Typhi
agcgcaaggccga

SEQ ID NO: 3632742 - RNA, 22 nt, Salmonella enterica enterica serovar Typhi
agcgcaccugccccgcucgaaa

SEQ ID NO: 3632743 - RNA, 22 nt, Salmonella enterica enterica serovar Typhi
agcgcacguuuagcuugcgaag

SEQ ID NO: 3632744 - RNA, 23 nt, Salmonella enterica enterica serovar Typhi
agcgcacuguuugcugacaaucu

SEQ ID NO: 3632745 - RNA, 20 nt, Salmonella enterica enterica serovar Typhi
agcgcagagugaccagcggu

SEQ ID NO: 3632746 - RNA, 13 nt, Salmonella enterica enterica serovar Typhi
agcgcagcaaaac

SEQ ID NO: 3632747 - RNA, 16 nt, Salmonella enterica enterica serovar Typhi
agcgcagcgagaaagc

SEQ ID NO: 3632748 - RNA, 21 nt, Salmonella enterica enterica serovar Typhi
agcgcagcgccaccgggcaac

SEQ ID NO: 3632749 - RNA, 15 nt, Salmonella enterica enterica serovar Typhi
agcgcagcgccauca

SEQ ID NO: 3632750 - RNA, 20 nt, Salmonella enterica enterica serovar Typhi
agcgcagcgccaucaggcac

SEQ ID NO: 3632751 - RNA, 22 nt, Salmonella enterica enterica serovar Typhi
agcgcagcgccauugagcauuc

SEQ ID NO: 3632752 - RNA, 18 nt, Salmonella enterica enterica serovar Typhi
agcgcagcuugguagcgc

SEQ ID NO: 3632753 - RNA, 13 nt, Salmonella enterica enterica serovar Typhi
agcgcauagcugc

SEQ ID NO: 3632754 - RNA, 16 nt, Salmonella enterica enterica serovar Typhi
agcgcauccaccagac

SEQ ID NO: 3632755 - RNA, 15 nt, Salmonella enterica enterica serovar Typhi
agcgcauccgguaaa

SEQ ID NO: 3632756 - RNA, 15 nt, Salmonella enterica enterica serovar Typhi
agcgcaugcccggua

SEQ ID NO: 3632757 - RNA, 18 nt, Salmonella enterica enterica serovar Typhi
agcgcauguucuucgucg

SEQ ID NO: 3632758 - RNA, 16 nt, Salmonella enterica enterica serovar Typhi
agcgcauugcgcccca

SEQ ID NO: 3632759 - RNA, 20 nt, Salmonella enterica enterica serovar Typhi
agcgcauugcgccccagcac

SEQ ID NO: 3632760 - RNA, 21 nt, Salmonella enterica enterica serovar Typhi
agcgcauugcgccccagcaca

SEQ ID NO: 3632761 - RNA, 16 nt, Salmonella enterica enterica serovar Typhi
agcgcauuugcggcgu

SEQ ID NO: 3632762 - RNA, 18 nt, Salmonella enterica enterica serovar Typhi
agcgcauuuuacugccgu

SEQ ID NO: 3632763 - RNA, 23 nt, Salmonella enterica enterica serovar Typhi
agcgccaaaaagaaaaaagugau

SEQ ID NO: 3632764 - RNA, 17 nt, Salmonella enterica enterica serovar Typhi
agcgccaauccacgggu

SEQ ID NO: 3632765 - RNA, 14 nt, Salmonella enterica enterica serovar Typhi
agcgccacccgaca

SEQ ID NO: 3632766 - RNA, 23 nt, Salmonella enterica enterica serovar Typhi
agcgccacgcgaugcaaccccug

SEQ ID NO: 3632767 - RNA, 17 nt, Salmonella enterica enterica serovar Typhi
agcgccacggagcauaa

SEQ ID NO: 3632768 - RNA, 22 nt, Salmonella enterica enterica serovar Typhi
agcgccagacagauaacaccag

SEQ ID NO: 3632769 - RNA, 15 nt, Salmonella enterica enterica serovar Typhi
agcgccagauaguca

SEQ ID NO: 3632770 - RNA, 16 nt, Salmonella enterica enterica serovar Typhi
agcgccagauagucac

SEQ ID NO: 3632771 - RNA, 13 nt, Salmonella enterica enterica serovar Typhi
agcgccagcagca

SEQ ID NO: 3632772 - RNA, 23 nt, Salmonella enterica enterica serovar Typhi
agcgccagcagcagcgcaaugcg

SEQ ID NO: 3632773 - RNA, 13 nt, Salmonella enterica enterica serovar Typhi
agcgccagcaugg

SEQ ID NO: 3632774 - RNA, 19 nt, Salmonella enterica enterica serovar Typhi
agcgccagcccugcgauca

SEQ ID NO: 3632775 - RNA, 16 nt, Salmonella enterica enterica serovar Typhi
agcgccagcgccaccu

SEQ ID NO: 3632776 - RNA, 18 nt, Salmonella enterica enterica serovar Typhi
agcgccagcgccaccugc

SEQ ID NO: 3632777 - RNA, 16 nt, Salmonella enterica enterica serovar Typhi
agcgccagcgguguuu

SEQ ID NO: 3632778 - RNA, 23 nt, Salmonella enterica enterica serovar Typhi
agcgccagcgguguuugccagac

SEQ ID NO: 3632779 - RNA, 13 nt, Salmonella enterica enterica serovar Typhi
agcgccagcucca

SEQ ID NO: 3632780 - RNA, 14 nt, Salmonella enterica enterica serovar Typhi
agcgccagcuccau

SEQ ID NO: 3632781 - RNA, 22 nt, Salmonella enterica enterica serovar Typhi
agcgccauaaaaaacaccuguc

SEQ ID NO: 3632782 - RNA, 18 nt, Salmonella enterica enterica serovar Typhi
agcgccauauaaauaggc

SEQ ID NO: 3632783 - RNA, 17 nt, Salmonella enterica enterica serovar Typhi
agcgccauauccgcaga

SEQ ID NO: 3632784 - RNA, 20 nt, Salmonella enterica enterica serovar Typhi
agcgccauaucggcacugcu

SEQ ID NO: 3632785 - RNA, 16 nt, Salmonella enterica enterica serovar Typhi
agcgccauauugcugu

SEQ ID NO: 3632786 - RNA, 19 nt, Salmonella enterica enterica serovar Typhi
agcgccaucaggcaugcca

SEQ ID NO: 3632787 - RNA, 14 nt, Salmonella enterica enterica serovar Typhi
agcgccaucgggca

SEQ ID NO: 3632788 - RNA, 17 nt, Salmonella enterica enterica serovar Typhi
agcgccaugaagauggu

SEQ ID NO: 3632789 - RNA, 23 nt, Salmonella enterica enterica serovar Typhi
agcgccauggagaaacaggccgc

SEQ ID NO: 3632790 - RNA, 17 nt, Salmonella enterica enterica serovar Typhi
agcgccauuaacgccau

SEQ ID NO: 3632791 - RNA, 13 nt, Salmonella enterica enterica serovar Typhi
agcgcccagcagc

SEQ ID NO: 3632792 - RNA, 22 nt, Salmonella enterica enterica serovar Typhi
agcgccccucuugcagcaagaa

SEQ ID NO: 3632793 - RNA, 16 nt, Salmonella enterica enterica serovar Typhi
agcgcccguccaugag

SEQ ID NO: 3632794 - RNA, 14 nt, Salmonella enterica enterica serovar Typhi
agcgccgcagggcg

SEQ ID NO: 3632795 - RNA, 14 nt, Salmonella enterica enterica serovar Typhi
agcgccgccaagau

SEQ ID NO: 3632796 - RNA, 20 nt, Salmonella enterica enterica serovar Typhi
agcgccgccagaaucaccuc

SEQ ID NO: 3632797 - RNA, 23 nt, Salmonella enterica enterica serovar Typhi
agcgccgccagaaucaccucuuu

SEQ ID NO: 3632798 - RNA, 16 nt, Salmonella enterica enterica serovar Typhi
agcgccgccagauaaa

SEQ ID NO: 3632799 - RNA, 18 nt, Salmonella enterica enterica serovar Typhi
agcgccgccagauaaagc

SEQ ID NO: 3632800 - RNA, 16 nt, Salmonella enterica enterica serovar Typhi
agcgccgcgccuacca

SEQ ID NO: 3632801 - RNA, 18 nt, Salmonella enterica enterica serovar Typhi
agcgccgcgcgaucaauc

SEQ ID NO: 3632802 - RNA, 19 nt, Salmonella enterica enterica serovar Typhi
agcgccgcgcgaucaauca

SEQ ID NO: 3632803 - RNA, 16 nt, Salmonella enterica enterica serovar Typhi
agcgccggcagcaguu

SEQ ID NO: 3632804 - RNA, 19 nt, Salmonella enterica enterica serovar Typhi
agcggcaggauccccaucc

SEQ ID NO: 3632805 - RNA, 14 nt, Salmonella enterica enterica serovar Typhi
agcggcagugauga

SEQ ID NO: 3632806 - RNA, 15 nt, Salmonella enterica enterica serovar Typhi
agcggccagauggca

SEQ ID NO: 3632807 - RNA, 13 nt, Salmonella enterica enterica serovar Typhi
agcggccagggca

SEQ ID NO: 3632808 - RNA, 20 nt, Salmonella enterica enterica serovar Typhi
agcggccagggcgucaauaa

SEQ ID NO: 3632809 - RNA, 19 nt, Salmonella enterica enterica serovar Typhi
agcggcgcgccgcucgaca

SEQ ID NO: 3632810 - RNA, 19 nt, Salmonella enterica enterica serovar Typhi
agcggcgcgcgguuaugcg

SEQ ID NO: 3632811 - RNA, 14 nt, Salmonella enterica enterica serovar Typhi
agcggcggaaugcu

SEQ ID NO: 3632812 - RNA, 18 nt, Salmonella enterica enterica serovar Typhi
agcggcggcuugccuuca

SEQ ID NO: 3632813 - RNA, 23 nt, Salmonella enterica enterica serovar Typhi
agcggcgggauuuuaagcaucca

SEQ ID NO: 3632814 - RNA, 17 nt, Salmonella enterica enterica serovar Typhi
agcggcguucaaaacgc

SEQ ID NO: 3632815 - RNA, 22 nt, Salmonella enterica enterica serovar Typhi
agcggcguugcccaguacggcg

SEQ ID NO: 3632816 - RNA, 22 nt, Salmonella enterica enterica serovar Typhi
agcggcguuuuuuccugcuggu

SEQ ID NO: 3632817 - RNA, 15 nt, Salmonella enterica enterica serovar Typhi
agcggcuaaucacca

SEQ ID NO: 3632818 - RNA, 19 nt, Salmonella enterica enterica serovar Typhi
agcggcucauccagcaaca

SEQ ID NO: 3632819 - RNA, 18 nt, Salmonella enterica enterica serovar Typhi
agcggcugacacucaucc

SEQ ID NO: 3632820 - RNA, 22 nt, Salmonella enterica enterica serovar Typhi
agcggcugacacucauccagac

SEQ ID NO: 3632821 - RNA, 20 nt, Salmonella enterica enterica serovar Typhi
agcgggcagcauugaccacc

SEQ ID NO: 3632822 - RNA, 19 nt, Salmonella enterica enterica serovar Typhi
agcgggcgcaguccagaug

SEQ ID NO: 3632823 - RNA, 13 nt, Salmonella enterica enterica serovar Typhi
agcgggggccggc

SEQ ID NO: 3632824 - RNA, 13 nt, Salmonella enterica enterica serovar Typhi
agcgggggcgccu

SEQ ID NO: 3632825 - RNA, 13 nt, Salmonella enterica enterica serovar Typhi
agcggguaaacag

SEQ ID NO: 3632826 - RNA, 18 nt, Salmonella enterica enterica serovar Typhi
agcgggucccagaagaaa

SEQ ID NO: 3632827 - RNA, 11 nt, Salmonella enterica enterica serovar Typhi
agcgguaaaau

SEQ ID NO: 3632828 - RNA, 23 nt, Salmonella enterica enterica serovar Typhi
agcgguugcauaaaauccuggua

SEQ ID NO: 3632829 - RNA, 22 nt, Salmonella enterica enterica serovar Typhi
agcgguuuuuuuguggccugcu

SEQ ID NO: 3632830 - RNA, 19 nt, Salmonella enterica enterica serovar Typhi
agcguaaauagcccggauc

SEQ ID NO: 3632831 - RNA, 22 nt, Salmonella enterica enterica serovar Typhi
agcguaaccgguugucgcgcca

SEQ ID NO: 3632832 - RNA, 15 nt, Salmonella enterica enterica serovar Typhi
agcguaauacaggcg

SEQ ID NO: 3632833 - RNA, 22 nt, Salmonella enterica enterica serovar Typhi
agcguaaugguggcaaccugac

SEQ ID NO: 3632834 - RNA, 19 nt, Salmonella enterica enterica serovar Typhi
agcguaauuucugguacca

SEQ ID NO: 3632835 - RNA, 18 nt, Salmonella enterica enterica serovar Typhi
agcguaccgaagaacaua

SEQ ID NO: 3632836 - RNA, 16 nt, Salmonella enterica enterica serovar Typhi
agcguaccggccacaa

SEQ ID NO: 3632837 - RNA, 20 nt, Salmonella enterica enterica serovar Typhi
agcguaccgucuggcgaggc

SEQ ID NO: 3632838 - RNA, 18 nt, Salmonella enterica enterica serovar Typhi
agcguagaccgcccagga

SEQ ID NO: 3632839 - RNA, 15 nt, Salmonella enterica enterica serovar Typhi
agcguagccugcaug

SEQ ID NO: 3632840 - RNA, 13 nt, Salmonella enterica enterica serovar Typhi
agcguagcgccau

SEQ ID NO: 3632841 - RNA, 17 nt, Salmonella enterica enterica serovar Typhi
agcguagcgccaucagg

SEQ ID NO: 3632842 - RNA, 13 nt, Salmonella enterica enterica serovar Typhi
agcguaggguaga

SEQ ID NO: 3632843 - RNA, 21 nt, Salmonella enterica enterica serovar Typhi
agcguaggguagaucacgcca

SEQ ID NO: 3632844 - RNA, 14 nt, Salmonella enterica enterica serovar Typhi
agcguaguccaggu

SEQ ID NO: 3632845 - RNA, 20 nt, Salmonella enterica enterica serovar Typhi
agcguauaauuaagcugcga

SEQ ID NO: 3632846 - RNA, 14 nt, Salmonella enterica enterica serovar Typhi
agcguauccagcac

SEQ ID NO: 3632847 - RNA, 15 nt, Salmonella enterica enterica serovar Typhi
agcguaucgccggcg

SEQ ID NO: 3632848 - RNA, 18 nt, Salmonella enterica enterica serovar Typhi
agcgucaauacaccucgg

SEQ ID NO: 3632849 - RNA, 12 nt, Salmonella enterica enterica serovar Typhi
agcgucagccca

SEQ ID NO: 3632850 - RNA, 23 nt, Salmonella enterica enterica serovar Typhi
agcgucagcccuucuuuaugcgc

SEQ ID NO: 3632851 - RNA, 21 nt, Salmonella enterica enterica serovar Typhi
agcgucaggcgaaguuccggg

SEQ ID NO: 3632852 - RNA, 17 nt, Salmonella enterica enterica serovar Typhi
agcgucagguagcccgg

SEQ ID NO: 3632853 - RNA, 22 nt, Salmonella enterica enterica serovar Typhi
agcgucagguagcccggcaggc

SEQ ID NO: 3632854 - RNA, 16 nt, Salmonella enterica enterica serovar Typhi
agcgucauuaaaaugc

SEQ ID NO: 3632855 - RNA, 15 nt, Salmonella enterica enterica serovar Typhi
agcguccaguccugu

SEQ ID NO: 3632856 - RNA, 23 nt, Salmonella enterica enterica serovar Typhi
agcguccaguccugucccugcca

SEQ ID NO: 3632857 - RNA, 14 nt, Salmonella enterica enterica serovar Typhi
agcguccccggcga

SEQ ID NO: 3632858 - RNA, 18 nt, Salmonella enterica enterica serovar Typhi
agcguccgccaucgccuc

SEQ ID NO: 3632859 - RNA, 19 nt, Salmonella enterica enterica serovar Typhi
agcguccggaaaauccuca

SEQ ID NO: 3632860 - RNA, 15 nt, Salmonella enterica enterica serovar Typhi
agcguccguucugau

SEQ ID NO: 3632861 - RNA, 19 nt, Salmonella enterica enterica serovar Typhi
agcguccguucugauacuc

SEQ ID NO: 3632862 - RNA, 17 nt, Salmonella enterica enterica serovar Typhi
agcgucgcgauccugcc

SEQ ID NO: 3632863 - RNA, 20 nt, Salmonella enterica enterica serovar Typhi
agcgucgcugauugccgcca

SEQ ID NO: 3632864 - RNA, 22 nt, Salmonella enterica enterica serovar Typhi
agcgucgggccgcgcugcgccu

SEQ ID NO: 3632865 - RNA, 17 nt, Salmonella enterica enterica serovar Typhi
agcgucggugaagaaaa

SEQ ID NO: 3632866 - RNA, 15 nt, Salmonella enterica enterica serovar Typhi
agcgucuauagauga

SEQ ID NO: 3632867 - RNA, 15 nt, Salmonella enterica enterica serovar Typhi
agcgucugcggcuga

SEQ ID NO: 3632868 - RNA, 20 nt, Salmonella enterica enterica serovar Typhi
agcgucuucuuaccgugucu

SEQ ID NO: 3632869 - RNA, 18 nt, Salmonella enterica enterica serovar Typhi
agcgugacaguuaccccg

SEQ ID NO: 3632870 - RNA, 15 nt, Salmonella enterica enterica serovar Typhi
agcgugacccagaca

SEQ ID NO: 3632871 - RNA, 12 nt, Salmonella enterica enterica serovar Typhi
agcgugauaauu

SEQ ID NO: 3632872 - RNA, 22 nt, Salmonella enterica enterica serovar Typhi
agcgugccgacguucaugccga

SEQ ID NO: 3632873 - RNA, 20 nt, Salmonella enterica enterica serovar Typhi
agcgugccgagcaacagaaa

SEQ ID NO: 3632874 - RNA, 18 nt, Salmonella enterica enterica serovar Typhi
agcgugccgguaaagggc

SEQ ID NO: 3632875 - RNA, 18 nt, Salmonella enterica enterica serovar Typhi
agcgugccuucaaauaua

SEQ ID NO: 3632876 - RNA, 23 nt, Salmonella enterica enterica serovar Typhi
agcgugcuguugcuaaauccaua

SEQ ID NO: 3632877 - RNA, 22 nt, Salmonella enterica enterica serovar Typhi
agcguggcgcaaccgauagcua

SEQ ID NO: 3632878 - RNA, 17 nt, Salmonella enterica enterica serovar Typhi
agcgugucgcagauacg

SEQ ID NO: 3632879 - RNA, 22 nt, Salmonella enterica enterica serovar Typhi
agcgugucgcagauacgcugua

SEQ ID NO: 3632880 - RNA, 18 nt, Salmonella enterica enterica serovar Typhi
agcguguucgcuacguuc

SEQ ID NO: 3632881 - RNA, 21 nt, Salmonella enterica enterica serovar Typhi
agcguuacgggaacagaauua

SEQ ID NO: 3632882 - RNA, 14 nt, Salmonella enterica enterica serovar Typhi
agcguuacugcaac

SEQ ID NO: 3632883 - RNA, 23 nt, Salmonella enterica enterica serovar Typhi
agcguuacugcaacugcgcggca

SEQ ID NO: 3632884 - RNA, 13 nt, Salmonella enterica enterica serovar Typhi
agcguuagcgcca

SEQ ID NO: 3632885 - RNA, 19 nt, Salmonella enterica enterica serovar Typhi
agcguuucuacgccauggc

SEQ ID NO: 3632886 - RNA, 21 nt, Salmonella enterica enterica serovar Typhi
agcguuuuauccguuuccgca

SEQ ID NO: 3632887 - RNA, 22 nt, Salmonella enterica enterica serovar Typhi
agcguuuugauguccagaugcu

SEQ ID NO: 3632888 - RNA, 18 nt, Salmonella enterica enterica serovar Typhi
agcuaaguuuguaaaaua

SEQ ID NO: 3632889 - RNA, 18 nt, Salmonella enterica enterica serovar Typhi
agcuuagaacucacgcuc

SEQ ID NO: 3632890 - RNA, 18 nt, Salmonella enterica enterica serovar Typhi
agcuuaggauucgccauu

SEQ ID NO: 3632891 - RNA, 14 nt, Salmonella enterica enterica serovar Typhi
agcuuauccugccc

SEQ ID NO: 3632892 - RNA, 23 nt, Salmonella enterica enterica serovar Typhi
agcuuaucgaacugugagccuaa

SEQ ID NO: 3632893 - RNA, 22 nt, Salmonella enterica enterica serovar Typhi
agcuuaucgccaaagauauagu

SEQ ID NO: 3632894 - RNA, 23 nt, Salmonella enterica enterica serovar Typhi
agcuuaucugaccaugccagcaa

SEQ ID NO: 3632895 - RNA, 16 nt, Salmonella enterica enterica serovar Typhi
agcuuauuccagucau

SEQ ID NO: 3632896 - RNA, 14 nt, Salmonella enterica enterica serovar Typhi
agcuucagcaaaua

SEQ ID NO: 3632897 - RNA, 14 nt, Salmonella enterica enterica serovar Typhi
agcuucaugcgccg

SEQ ID NO: 3632898 - RNA, 22 nt, Salmonella enterica enterica serovar Typhi
agcuuccagcaaaccuuccgcc

SEQ ID NO: 3632899 - RNA, 23 nt, Salmonella enterica enterica serovar Typhi
agcuuccagcaaaccuuccgcca

SEQ ID NO: 3632900 - RNA, 17 nt, Salmonella enterica enterica serovar Typhi
agcuucgcccaggcggg

SEQ ID NO: 3632901 - RNA, 18 nt, Salmonella enterica enterica serovar Typhi
agcuugaaagcagucccg

SEQ ID NO: 3632902 - RNA, 16 nt, Salmonella enterica enterica serovar Typhi
agcuugaaagcgcaaa

SEQ ID NO: 3632903 - RNA, 22 nt, Salmonella enterica enterica serovar Typhi
agcuugcauggccggucuuaug

SEQ ID NO: 3632904 - RNA, 15 nt, Salmonella enterica enterica serovar Typhi
agcuugccguagcgc

SEQ ID NO: 3632905 - RNA, 22 nt, Salmonella enterica enterica serovar Typhi
agcuuggccaguggggcugcug

SEQ ID NO: 3632906 - RNA, 20 nt, Salmonella enterica enterica serovar Typhi
agcuuggcggcuuccuguuu

SEQ ID NO: 3632907 - RNA, 21 nt, Salmonella enterica enterica serovar Typhi
agcuuguuguuuauccugcaa

SEQ ID NO: 3632908 - RNA, 22 nt, Salmonella enterica enterica serovar Typhi
agcuuuaaugauccgaugcgcu

SEQ ID NO: 3632909 - RNA, 16 nt, Salmonella enterica enterica serovar Typhi
agcuuugccacuggcu

SEQ ID NO: 3632910 - RNA, 22 nt, Salmonella enterica enterica serovar Typhi
agcuuuucaugacgcucuccuc

SEQ ID NO: 3632911 - RNA, 19 nt, Salmonella enterica enterica serovar Typhi
agcuuuuuacucagggcaa

SEQ ID NO: 3632912 - RNA, 15 nt, Salmonella enterica enterica serovar Typhi
agcuuuuuauuacuu

SEQ ID NO: 3632913 - RNA, 17 nt, Salmonella enterica enterica serovar Typhi
aggaaaacgcuuuccag

SEQ ID NO: 3632914 - RNA, 22 nt, Salmonella enterica enterica serovar Typhi
aggaaaagaccauccgguuuua

SEQ ID NO: 3632915 - RNA, 14 nt, Salmonella enterica enterica serovar Typhi
aggaaaagcuguag

SEQ ID NO: 3632916 - RNA, 22 nt, Salmonella enterica enterica serovar Typhi
aggaaauauuaauuaaggauga

SEQ ID NO: 3632917 - RNA, 12 nt, Salmonella enterica enterica serovar Typhi
aggaaauccagc

SEQ ID NO: 3632918 - RNA, 21 nt, Salmonella enterica enterica serovar Typhi
aggaaauccagcagaauaaca

SEQ ID NO: 3632919 - RNA, 17 nt, Salmonella enterica enterica serovar Typhi
aggaaaugccgggcaaa

SEQ ID NO: 3632920 - RNA, 12 nt, Salmonella enterica enterica serovar Typhi
aggaaauucaga

SEQ ID NO: 3632921 - RNA, 19 nt, Salmonella enterica enterica serovar Typhi
aggaaauucagauccgagg

SEQ ID NO: 3632922 - RNA, 13 nt, Salmonella enterica enterica serovar Typhi
aggaaauucugac

SEQ ID NO: 3632923 - RNA, 14 nt, Salmonella enterica enterica serovar Typhi
aggaaauucugacg

SEQ ID NO: 3632924 - RNA, 16 nt, Salmonella enterica enterica serovar Typhi
aggaaauucugacgca

SEQ ID NO: 3632925 - RNA, 14 nt, Salmonella enterica enterica serovar Typhi
aggaacagauacug

SEQ ID NO: 3632926 - RNA, 14 nt, Salmonella enterica enterica serovar Typhi
aggaacagugacaa

SEQ ID NO: 3632927 - RNA, 21 nt, Salmonella enterica enterica serovar Typhi
aggaaccgguagccaggcgcg

SEQ ID NO: 3632928 - RNA, 23 nt, Salmonella enterica enterica serovar Typhi
aggaacgcgcagaccguuuucaa

SEQ ID NO: 3632929 - RNA, 19 nt, Salmonella enterica enterica serovar Typhi
aggaacuaacuccggagcu

SEQ ID NO: 3632930 - RNA, 17 nt, Salmonella enterica enterica serovar Typhi
aggaacuguucagccag

SEQ ID NO: 3632931 - RNA, 20 nt, Salmonella enterica enterica serovar Typhi
aggaacuguucagccagcaa

SEQ ID NO: 3632932 - RNA, 22 nt, Salmonella enterica enterica serovar Typhi
aggaagacuauccagccaggga

SEQ ID NO: 3632933 - RNA, 14 nt, Salmonella enterica enterica serovar Typhi
aggaagacuucguu

SEQ ID NO: 3632934 - RNA, 19 nt, Salmonella enterica enterica serovar Typhi
aggaagcugcgcagcacuu

SEQ ID NO: 3632935 - RNA, 17 nt, Salmonella enterica enterica serovar Typhi
aggaaggaaacuuauuu

SEQ ID NO: 3632936 - RNA, 18 nt, Salmonella enterica enterica serovar Typhi
aggaaggcgguaagagag

SEQ ID NO: 3632937 - RNA, 13 nt, Salmonella enterica enterica serovar Typhi
aggaagucagcuu

SEQ ID NO: 3632938 - RNA, 22 nt, Salmonella enterica enterica serovar Typhi
aggaagucagcuuccugcacgc

SEQ ID NO: 3632939 - RNA, 14 nt, Salmonella enterica enterica serovar Typhi
aggaauaacaucgu

SEQ ID NO: 3632940 - RNA, 22 nt, Salmonella enterica enterica serovar Typhi
aggaauaacaucguaaaucaaa

SEQ ID NO: 3632941 - RNA, 23 nt, Salmonella enterica enterica serovar Typhi
aggaauaaccacugauggcuggc

SEQ ID NO: 3632942 - RNA, 21 nt, Salmonella enterica enterica serovar Typhi
aggaauaagggugagagggga

SEQ ID NO: 3632943 - RNA, 19 nt, Salmonella enterica enterica serovar Typhi
aggaaucauucuauugcau

SEQ ID NO: 3632944 - RNA, 14 nt, Salmonella enterica enterica serovar Typhi
aggaaugaaaacga

SEQ ID NO: 3632945 - RNA, 15 nt, Salmonella enterica enterica serovar Typhi
aggaauuuaucaaca

SEQ ID NO: 3632946 - RNA, 13 nt, Salmonella enterica enterica serovar Typhi
aggaauuuuccca

SEQ ID NO: 3632947 - RNA, 21 nt, Salmonella enterica enterica serovar Typhi
aggaauuuucccauaaaagag

SEQ ID NO: 3632948 - RNA, 22 nt, Salmonella enterica enterica serovar Typhi
aggaauuuucccauaaaagagc

SEQ ID NO: 3632949 - RNA, 18 nt, Salmonella enterica enterica serovar Typhi
aggacaaccccuacgcag

SEQ ID NO: 3632950 - RNA, 15 nt, Salmonella enterica enterica serovar Typhi
aggacaagcagugcu

SEQ ID NO: 3632951 - RNA, 20 nt, Salmonella enterica enterica serovar Typhi
aggacagacagacguugcgc

SEQ ID NO: 3632952 - RNA, 12 nt, Salmonella enterica enterica serovar Typhi
aggacaucaaag

SEQ ID NO: 3632953 - RNA, 14 nt, Salmonella enterica enterica serovar Typhi
aggaccaacaccag

SEQ ID NO: 3632954 - RNA, 14 nt, Salmonella enterica enterica serovar Typhi
aggacgccagugaa

SEQ ID NO: 3632955 - RNA, 21 nt, Salmonella enterica enterica serovar Typhi
aggacugacggaagagcucga

SEQ ID NO: 3632956 - RNA, 14 nt, Salmonella enterica enterica serovar Typhi
aggagaaaacgggu

SEQ ID NO: 3632957 - RNA, 14 nt, Salmonella enterica enterica serovar Typhi
aggagacgccgccc

SEQ ID NO: 3632958 - RNA, 21 nt, Salmonella enterica enterica serovar Typhi
aggagaucggcgcagguccau

SEQ ID NO: 3632959 - RNA, 15 nt, Salmonella enterica enterica serovar Typhi
aggagcauagauaac

SEQ ID NO: 3632960 - RNA, 22 nt, Salmonella enterica enterica serovar Typhi
aggagcauagauaacuauguga

SEQ ID NO: 3632961 - RNA, 16 nt, Salmonella enterica enterica serovar Typhi
aggagccaccggcagg

SEQ ID NO: 3632962 - RNA, 19 nt, Salmonella enterica enterica serovar Typhi
aggagcgccguggaaaaga

SEQ ID NO: 3632963 - RNA, 19 nt, Salmonella enterica enterica serovar Typhi
aggagcgcgacgacggcgc

SEQ ID NO: 3632964 - RNA, 13 nt, Salmonella enterica enterica serovar Typhi
aggagcuggagca

SEQ ID NO: 3632965 - RNA, 21 nt, Salmonella enterica enterica serovar Typhi
aggaguccaaaacgaacaggc

SEQ ID NO: 3632966 - RNA, 22 nt, Salmonella enterica enterica serovar Typhi
aggaguccaaaacgaacaggcc

SEQ ID NO: 3632967 - RNA, 11 nt, Salmonella enterica enterica serovar Typhi
aggagugaaca

SEQ ID NO: 3632968 - RNA, 16 nt, Salmonella enterica enterica serovar Typhi
aggauaaaauccugca

SEQ ID NO: 3632969 - RNA, 17 nt, Salmonella enterica enterica serovar Typhi
aggauaaaauccugcac

SEQ ID NO: 3632970 - RNA, 16 nt, Salmonella enterica enterica serovar Typhi
aggauaagaauaggug

SEQ ID NO: 3632971 - RNA, 16 nt, Salmonella enterica enterica serovar Typhi
aggauacagccgacua

SEQ ID NO: 3632972 - RNA, 21 nt, Salmonella enterica enterica serovar Typhi
aggauagcgaccagcgucagc

SEQ ID NO: 3632973 - RNA, 13 nt, Salmonella enterica enterica serovar Typhi
aggauauaaaaaa

SEQ ID NO: 3632974 - RNA, 20 nt, Salmonella enterica enterica serovar Typhi
aggccgguuguuuacacggc

SEQ ID NO: 3632975 - RNA, 20 nt, Salmonella enterica enterica serovar Typhi
aggccguuauugucaugcua

SEQ ID NO: 3632976 - RNA, 23 nt, Salmonella enterica enterica serovar Typhi
aggccguuauugucaugcuaaaa

SEQ ID NO: 3632977 - RNA, 16 nt, Salmonella enterica enterica serovar Typhi
aggccuaacacaugca

SEQ ID NO: 3632978 - RNA, 22 nt, Salmonella enterica enterica serovar Typhi
aggccuacaaucgugugaugca

SEQ ID NO: 3632979 - RNA, 17 nt, Salmonella enterica enterica serovar Typhi
aggccuacauccggcuc

SEQ ID NO: 3632980 - RNA, 12 nt, Salmonella enterica enterica serovar Typhi
aggccuacgcuc

SEQ ID NO: 3632981 - RNA, 21 nt, Salmonella enterica enterica serovar Typhi
aggccucgaccaguuuuuccg

SEQ ID NO: 3632982 - RNA, 18 nt, Salmonella enterica enterica serovar Typhi
aggccugauaagcacagg

SEQ ID NO: 3632983 - RNA, 20 nt, Salmonella enterica enterica serovar Typhi
aggccugauaagcacaggcc

SEQ ID NO: 3632984 - RNA, 20 nt, Salmonella enterica enterica serovar Typhi
aggccugauaagcgcagcgc

SEQ ID NO: 3632985 - RNA, 22 nt, Salmonella enterica enterica serovar Typhi
aggccugauaagcgcagcgcca

SEQ ID NO: 3632986 - RNA, 18 nt, Salmonella enterica enterica serovar Typhi
aggccugaugagcgcagc

SEQ ID NO: 3632987 - RNA, 22 nt, Salmonella enterica enterica serovar Typhi
aggccugccggguuuaaugcgc

SEQ ID NO: 3632988 - RNA, 20 nt, Salmonella enterica enterica serovar Typhi
aggccugguaagcguagcgc

SEQ ID NO: 3632989 - RNA, 18 nt, Salmonella enterica enterica serovar Typhi
aggccugguuaacaauau

SEQ ID NO: 3632990 - RNA, 17 nt, Salmonella enterica enterica serovar Typhi
aggccuuuucguacaug

SEQ ID NO: 3632991 - RNA, 18 nt, Salmonella enterica enterica serovar Typhi
aggccuuuugcagcagcg

SEQ ID NO: 3632992 - RNA, 20 nt, Salmonella enterica enterica serovar Typhi
aggcgaaaccggccgccauc

SEQ ID NO: 3632993 - RNA, 21 nt, Salmonella enterica enterica serovar Typhi
aggcgaacauaagagauggaa

SEQ ID NO: 3632994 - RNA, 18 nt, Salmonella enterica enterica serovar Typhi
aggcgaaccccaugccga

SEQ ID NO: 3632995 - RNA, 13 nt, Salmonella enterica enterica serovar Typhi
aggcgaauagcgc

SEQ ID NO: 3632996 - RNA, 13 nt, Salmonella enterica enterica serovar Typhi
aggcgaaucccca

SEQ ID NO: 3632997 - RNA, 15 nt, Salmonella enterica enterica serovar Typhi
aggcgacaaucucac

SEQ ID NO: 3632998 - RNA, 14 nt, Salmonella enterica enterica serovar Typhi
aggcgacccauaac

SEQ ID NO: 3632999 - RNA, 22 nt, Salmonella enterica enterica serovar Typhi
aggcgaccguuccguccgucag

SEQ ID NO: 3633000 - RNA, 23 nt, Salmonella enterica enterica serovar Typhi
aggcgaccguuccguccgucagg

SEQ ID NO: 3633001 - RNA, 16 nt, Salmonella enterica enterica serovar Typhi
aggcgacgccgccauc

SEQ ID NO: 3633002 - RNA, 17 nt, Salmonella enterica enterica serovar Typhi
aggcgacgcgauagcgc

SEQ ID NO: 3633003 - RNA, 22 nt, Salmonella enterica enterica serovar Typhi
aggcgacuaccguucacggcga

SEQ ID NO: 3633004 - RNA, 23 nt, Salmonella enterica enterica serovar Typhi
aggcgacuaccguucacggcgau

SEQ ID NO: 3633005 - RNA, 21 nt, Salmonella enterica enterica serovar Typhi
aggcgauccuguucaaacauc

SEQ ID NO: 3633006 - RNA, 13 nt, Salmonella enterica enterica serovar Typhi
aggcgcagccgcc

SEQ ID NO: 3633007 - RNA, 14 nt, Salmonella enterica enterica serovar Typhi
aggcgcaucagaaa

SEQ ID NO: 3633008 - RNA, 15 nt, Salmonella enterica enterica serovar Typhi
aggcgcaucagaaaa

SEQ ID NO: 3633009 - RNA, 18 nt, Salmonella enterica enterica serovar Typhi
aggcgccaguuggcguac

SEQ ID NO: 3633010 - RNA, 21 nt, Salmonella enterica enterica serovar Typhi
aggcgccgcucaucaccagca

SEQ ID NO: 3633011 - RNA, 22 nt, Salmonella enterica enterica serovar Typhi
aggcgccucgcgcggcgguuca

SEQ ID NO: 3633012 - RNA, 14 nt, Salmonella enterica enterica serovar Typhi
aggcgcgcagcugc

SEQ ID NO: 3633013 - RNA, 18 nt, Salmonella enterica enterica serovar Typhi
aggcgcgcagcugccaca

SEQ ID NO: 3633014 - RNA, 17 nt, Salmonella enterica enterica serovar Typhi
aggcgcggucuggccug

SEQ ID NO: 3633015 - RNA, 16 nt, Salmonella enterica enterica serovar Typhi
aggcgcguuuacuggc

SEQ ID NO: 3633016 - RNA, 21 nt, Salmonella enterica enterica serovar Typhi
aggcgcguuuacuggcgacga

SEQ ID NO: 3633017 - RNA, 21 nt, Salmonella enterica enterica serovar Typhi
aggcgcuaugcuuaccaucug

SEQ ID NO: 3633018 - RNA, 21 nt, Salmonella enterica enterica serovar Typhi
aggcgcugcguaguaccagua

SEQ ID NO: 3633019 - RNA, 14 nt, Salmonella enterica enterica serovar Typhi
aggcgcuugcgccg

SEQ ID NO: 3633020 - RNA, 16 nt, Salmonella enterica enterica serovar Typhi
aggcgcuugugauauc

SEQ ID NO: 3633021 - RNA, 21 nt, Salmonella enterica enterica serovar Typhi
aggcggaaaacauucgcccgu

SEQ ID NO: 3633022 - RNA, 20 nt, Salmonella enterica enterica serovar Typhi
aggcggauacagcggcgcgc

SEQ ID NO: 3633023 - RNA, 13 nt, Salmonella enterica enterica serovar Typhi
aggcggcaaagau

SEQ ID NO: 3633024 - RNA, 23 nt, Salmonella enterica enterica serovar Typhi
aggcggcaugauagggcgccugu

SEQ ID NO: 3633025 - RNA, 18 nt, Salmonella enterica enterica serovar Typhi
aggcggcggcgggaaguu

SEQ ID NO: 3633026 - RNA, 18 nt, Salmonella enterica enterica serovar Typhi
aggcgggcuuuuuuugcc

SEQ ID NO: 3633027 - RNA, 18 nt, Salmonella enterica enterica serovar Typhi
aggcgguuaacagacccg

SEQ ID NO: 3633028 - RNA, 23 nt, Salmonella enterica enterica serovar Typhi
aggcguagcuggucgccagcgcc

SEQ ID NO: 3633029 - RNA, 15 nt, Salmonella enterica enterica serovar Typhi
aggcgucaaaacagg

SEQ ID NO: 3633030 - RNA, 18 nt, Salmonella enterica enterica serovar Typhi
aggcgucauagccgcgcg

SEQ ID NO: 3633031 - RNA, 15 nt, Salmonella enterica enterica serovar Typhi
aggcgucccauguug

SEQ ID NO: 3633032 - RNA, 16 nt, Salmonella enterica enterica serovar Typhi
aggcgucgaacuccgc

SEQ ID NO: 3633033 - RNA, 19 nt, Salmonella enterica enterica serovar Typhi
aggcgucgaccgguccacc

SEQ ID NO: 3633034 - RNA, 18 nt, Salmonella enterica enterica serovar Typhi
aggcgugccccgcaacgc

SEQ ID NO: 3633035 - RNA, 23 nt, Salmonella enterica enterica serovar Typhi
aggcgugcguauugccccgucag

SEQ ID NO: 3633036 - RNA, 21 nt, Salmonella enterica enterica serovar Typhi
aggcgugguggauauccagca

SEQ ID NO: 3633037 - RNA, 22 nt, Salmonella enterica enterica serovar Typhi
aggcguuaaggcaucucuggcg

SEQ ID NO: 3633038 - RNA, 14 nt, Salmonella enterica enterica serovar Typhi
aggcguuacagacg

SEQ ID NO: 3633039 - RNA, 20 nt, Salmonella enterica enterica serovar Typhi
aggcguuagcggcgauucug

SEQ ID NO: 3633040 - RNA, 20 nt, Salmonella enterica enterica serovar Typhi
aggcguugugcugcggcaug

SEQ ID NO: 3633041 - RNA, 18 nt, Salmonella enterica enterica serovar Typhi
aggcguuuacgcugcuau

SEQ ID NO: 3633042 - RNA, 21 nt, Salmonella enterica enterica serovar Typhi
aggcguuuacgcugcuauccg

SEQ ID NO: 3633043 - RNA, 14 nt, Salmonella enterica enterica serovar Typhi
aggcuaaagugcgu

SEQ ID NO: 3633044 - RNA, 22 nt, Salmonella enterica enterica serovar Typhi
aggcuaacagcuggcuugccag

SEQ ID NO: 3633045 - RNA, 13 nt, Salmonella enterica enterica serovar Typhi
aggcuacccagac

SEQ ID NO: 3633046 - RNA, 16 nt, Salmonella enterica enterica serovar Typhi
aggcuacccagacaag

SEQ ID NO: 3633047 - RNA, 17 nt, Salmonella enterica enterica serovar Typhi
aggcuacccagacaagc

SEQ ID NO: 3633048 - RNA, 19 nt, Salmonella enterica enterica serovar Typhi
aggcuacccgcaauaccaa

SEQ ID NO: 3633049 - RNA, 18 nt, Salmonella enterica enterica serovar Typhi
aggcuaccgggcaaacau

SEQ ID NO: 3633050 - RNA, 15 nt, Salmonella enterica enterica serovar Typhi
aggcuaccguucaga

SEQ ID NO: 3633051 - RNA, 21 nt, Salmonella enterica enterica serovar Typhi
aggcuacgguacugcccaccu

SEQ ID NO: 3633052 - RNA, 13 nt, Salmonella enterica enterica serovar Typhi
aggcucagcgcca

SEQ ID NO: 3633053 - RNA, 15 nt, Salmonella enterica enterica serovar Typhi
aggcucaucagcgcc

SEQ ID NO: 3633054 - RNA, 21 nt, Salmonella enterica enterica serovar Typhi
aggcucaucagcgccauugcu

SEQ ID NO: 3633055 - RNA, 22 nt, Salmonella enterica enterica serovar Typhi
aggcucaucagcgccauugcua

SEQ ID NO: 3633056 - RNA, 22 nt, Salmonella enterica enterica serovar Typhi
aggcuccaaguauugauaccuu

SEQ ID NO: 3633057 - RNA, 21 nt, Salmonella enterica enterica serovar Typhi
aggcucccuuauacaggcgca

SEQ ID NO: 3633058 - RNA, 14 nt, Salmonella enterica enterica serovar Typhi
aggcucgcaaauaa

SEQ ID NO: 3633059 - RNA, 15 nt, Salmonella enterica enterica serovar Typhi
agguauugauuuuua

SEQ ID NO: 3633060 - RNA, 21 nt, Salmonella enterica enterica serovar Typhi
agguauugauuuuuaaaaugu

SEQ ID NO: 3633061 - RNA, 16 nt, Salmonella enterica enterica serovar Typhi
aggucacaucaucgcc

SEQ ID NO: 3633062 - RNA, 18 nt, Salmonella enterica enterica serovar Typhi
aggucaucaccuccagca

SEQ ID NO: 3633063 - RNA, 15 nt, Salmonella enterica enterica serovar Typhi
aggucaugguaaaac

SEQ ID NO: 3633064 - RNA, 16 nt, Salmonella enterica enterica serovar Typhi
aggucauuauucaggc

SEQ ID NO: 3633065 - RNA, 14 nt, Salmonella enterica enterica serovar Typhi
aggucauuccugcg

SEQ ID NO: 3633066 - RNA, 14 nt, Salmonella enterica enterica serovar Typhi
aggucauugcgcca

SEQ ID NO: 3633067 - RNA, 20 nt, Salmonella enterica enterica serovar Typhi
agguccagggaaaaauagcg

SEQ ID NO: 3633068 - RNA, 22 nt, Salmonella enterica enterica serovar Typhi
aggucgaaaacggccaauccug

SEQ ID NO: 3633069 - RNA, 14 nt, Salmonella enterica enterica serovar Typhi
aggucgacauuuaa

SEQ ID NO: 3633070 - RNA, 16 nt, Salmonella enterica enterica serovar Typhi
aggucgccaaauuuag

SEQ ID NO: 3633071 - RNA, 14 nt, Salmonella enterica enterica serovar Typhi
aggucggacguugc

SEQ ID NO: 3633072 - RNA, 21 nt, Salmonella enterica enterica serovar Typhi
aggucggccaaccgccacaau

SEQ ID NO: 3633073 - RNA, 13 nt, Salmonella enterica enterica serovar Typhi
aggucggcuccug

SEQ ID NO: 3633074 - RNA, 14 nt, Salmonella enterica enterica serovar Typhi
aggucggcugcccu

SEQ ID NO: 3633075 - RNA, 15 nt, Salmonella enterica enterica serovar Typhi
aggucgucaggccgc

SEQ ID NO: 3633076 - RNA, 22 nt, Salmonella enterica enterica serovar Typhi
aggucguuucccccgcaacaaa

SEQ ID NO: 3633077 - RNA, 15 nt, Salmonella enterica enterica serovar Typhi
aggucugcaccacgg

SEQ ID NO: 3633078 - RNA, 14 nt, Salmonella enterica enterica serovar Typhi
aggucuugauggcg

SEQ ID NO: 3633079 - RNA, 20 nt, Salmonella enterica enterica serovar Typhi
aggucuugccaacaaagguu

SEQ ID NO: 3633080 - RNA, 22 nt, Salmonella enterica enterica serovar Typhi
aggucuuuaucuaucaccgccu

SEQ ID NO: 3633081 - RNA, 17 nt, Salmonella enterica enterica serovar Typhi
aggugaaauaggggaga

SEQ ID NO: 3633082 - RNA, 19 nt, Salmonella enterica enterica serovar Typhi
aggugaacauuacaaugua

SEQ ID NO: 3633083 - RNA, 16 nt, Salmonella enterica enterica serovar Typhi
aggugacgaagaucgc

SEQ ID NO: 3633084 - RNA, 19 nt, Salmonella enterica enterica serovar Typhi
aggugacgccaugcaaaaa

SEQ ID NO: 3633085 - RNA, 17 nt, Salmonella enterica enterica serovar Typhi
aggugauaaucagcgcu

SEQ ID NO: 3633086 - RNA, 14 nt, Salmonella enterica enterica serovar Typhi
aggugaucuguuca

SEQ ID NO: 3633087 - RNA, 17 nt, Salmonella enterica enterica serovar Typhi
aggugauguccagacca

SEQ ID NO: 3633088 - RNA, 17 nt, Salmonella enterica enterica serovar Typhi
aggugccuggguuccag

SEQ ID NO: 3633089 - RNA, 22 nt, Salmonella enterica enterica serovar Typhi
aggugccuggguuccaggcgga

SEQ ID NO: 3633090 - RNA, 20 nt, Salmonella enterica enterica serovar Typhi
aggugcggugcgacaaagau

SEQ ID NO: 3633091 - RNA, 20 nt, Salmonella enterica enterica serovar Typhi
agguguaaaccguuuuuccg

SEQ ID NO: 3633092 - RNA, 17 nt, Salmonella enterica enterica serovar Typhi
agguguaucccuauucu

SEQ ID NO: 3633093 - RNA, 20 nt, Salmonella enterica enterica serovar Typhi
aggugucgaugagcucguua

SEQ ID NO: 3633094 - RNA, 16 nt, Salmonella enterica enterica serovar Typhi
agguguucagguaaau

SEQ ID NO: 3633095 - RNA, 17 nt, Salmonella enterica enterica serovar Typhi
agguguuuacgccgcca

SEQ ID NO: 3633096 - RNA, 15 nt, Salmonella enterica enterica serovar Typhi
agguuaaauagcagg

SEQ ID NO: 3633097 - RNA, 14 nt, Salmonella enterica enterica serovar Typhi
agguuaagccucac

SEQ ID NO: 3633098 - RNA, 16 nt, Salmonella enterica enterica serovar Typhi
agguuaauaacugcgc

SEQ ID NO: 3633099 - RNA, 16 nt, Salmonella enterica enterica serovar Typhi
agguuagguuaaauag

SEQ ID NO: 3633100 - RNA, 14 nt, Salmonella enterica enterica serovar Typhi
agguuaguaaugcc

SEQ ID NO: 3633101 - RNA, 15 nt, Salmonella enterica enterica serovar Typhi
agguuauauuccgcc

SEQ ID NO: 3633102 - RNA, 16 nt, Salmonella enterica enterica serovar Typhi
agguuauccgccggag

SEQ ID NO: 3633103 - RNA, 13 nt, Salmonella enterica enterica serovar Typhi
agguuaugcgcac

SEQ ID NO: 3633104 - RNA, 17 nt, Salmonella enterica enterica serovar Typhi
agguuauucagguggau

SEQ ID NO: 3633105 - RNA, 19 nt, Salmonella enterica enterica serovar Typhi
agguucagcgugcguucau

SEQ ID NO: 3633106 - RNA, 17 nt, Salmonella enterica enterica serovar Typhi
agguucccgccgccauu

SEQ ID NO: 3633107 - RNA, 19 nt, Salmonella enterica enterica serovar Typhi
agguugccugauggcgcug

SEQ ID NO: 3633108 - RNA, 16 nt, Salmonella enterica enterica serovar Typhi
agguugcguccgccgc

SEQ ID NO: 3633109 - RNA, 16 nt, Salmonella enterica enterica serovar Typhi
agguuguuuuauuacc

SEQ ID NO: 3633110 - RNA, 16 nt, Salmonella enterica enterica serovar Typhi
agguuucuucaucaaa

SEQ ID NO: 3633111 - RNA, 20 nt, Salmonella enterica enterica serovar Typhi
agguuugaccagauaaucaa

SEQ ID NO: 3633112 - RNA, 20 nt, Salmonella enterica enterica serovar Typhi
agguuugcgcggcggguaaa

SEQ ID NO: 3633113 - RNA, 11 nt, Salmonella enterica enterica serovar Typhi
agguuuugcug

SEQ ID NO: 3633114 - RNA, 16 nt, Salmonella enterica enterica serovar Typhi
aguaaaaaaaccguau

SEQ ID NO: 3633115 - RNA, 15 nt, Salmonella enterica enterica serovar Typhi
aguaaacagaaucaa

SEQ ID NO: 3633116 - RNA, 20 nt, Salmonella enterica enterica serovar Typhi
aguaaacuccucuuccgaca

SEQ ID NO: 3633117 - RNA, 17 nt, Salmonella enterica enterica serovar Typhi
aguaaagaaauuuugca

SEQ ID NO: 3633118 - RNA, 14 nt, Salmonella enterica enterica serovar Typhi
aguaaagauuuguu

SEQ ID NO: 3633119 - RNA, 15 nt, Salmonella enterica enterica serovar Typhi
aguaaaguuauucac

SEQ ID NO: 3633120 - RNA, 15 nt, Salmonella enterica enterica serovar Typhi
aguaaauagaaaaua

SEQ ID NO: 3633121 - RNA, 17 nt, Salmonella enterica enterica serovar Typhi
aguaaauuauuccuuga

SEQ ID NO: 3633122 - RNA, 16 nt, Salmonella enterica enterica serovar Typhi
aguaacaccgcggcgc

SEQ ID NO: 3633123 - RNA, 20 nt, Salmonella enterica enterica serovar Typhi
aguaaccccauacaguaguu

SEQ ID NO: 3633124 - RNA, 22 nt, Salmonella enterica enterica serovar Typhi
aguaacccgauacccugagccc

SEQ ID NO: 3633125 - RNA, 19 nt, Salmonella enterica enterica serovar Typhi
aguaaccuauuuuacaaaa

SEQ ID NO: 3633126 - RNA, 22 nt, Salmonella enterica enterica serovar Typhi
aguaacgcguccaacuggcuuu

SEQ ID NO: 3633127 - RNA, 19 nt, Salmonella enterica enterica serovar Typhi
aguaacugcccgucggacu

SEQ ID NO: 3633128 - RNA, 15 nt, Salmonella enterica enterica serovar Typhi
aguaauaaaauaaua

SEQ ID NO: 3633129 - RNA, 18 nt, Salmonella enterica enterica serovar Typhi
aguaauaaaauaauaggu

SEQ ID NO: 3633130 - RNA, 12 nt, Salmonella enterica enterica serovar Typhi
aguaauauuaaa

SEQ ID NO: 3633131 - RNA, 12 nt, Salmonella enterica enterica serovar Typhi
aguaauccauag

SEQ ID NO: 3633132 - RNA, 17 nt, Salmonella enterica enterica serovar Typhi
aguaauccguagccaac

SEQ ID NO: 3633133 - RNA, 17 nt, Salmonella enterica enterica serovar Typhi
aguaaugccuucugaaa

SEQ ID NO: 3633134 - RNA, 15 nt, Salmonella enterica enterica serovar Typhi
aguaauuccauuagc

SEQ ID NO: 3633135 - RNA, 20 nt, Salmonella enterica enterica serovar Typhi
aguaauuugaacauauccgc

SEQ ID NO: 3633136 - RNA, 17 nt, Salmonella enterica enterica serovar Typhi
aguaauuuuuccgccuc

SEQ ID NO: 3633137 - RNA, 14 nt, Salmonella enterica enterica serovar Typhi
aguaauuuuucucc

SEQ ID NO: 3633138 - RNA, 15 nt, Salmonella enterica enterica serovar Typhi
aguacaaacaaauaa

SEQ ID NO: 3633139 - RNA, 18 nt, Salmonella enterica enterica serovar Typhi
aguacagggcgauuuccg

SEQ ID NO: 3633140 - RNA, 18 nt, Salmonella enterica enterica serovar Typhi
aguacagguuaugcaagu

SEQ ID NO: 3633141 - RNA, 19 nt, Salmonella enterica enterica serovar Typhi
aguacauaguucuggcuuu

SEQ ID NO: 3633142 - RNA, 22 nt, Salmonella enterica enterica serovar Typhi
aguaccauaccggugcgcccca

SEQ ID NO: 3633143 - RNA, 13 nt, Salmonella enterica enterica serovar Typhi
aguacccucugca

SEQ ID NO: 3633144 - RNA, 15 nt, Salmonella enterica enterica serovar Typhi
aguaccgaacagcca

SEQ ID NO: 3633145 - RNA, 19 nt, Salmonella enterica enterica serovar Typhi
aguccagcauccaugccag

SEQ ID NO: 3633146 - RNA, 21 nt, Salmonella enterica enterica serovar Typhi
aguccauaccguuucaacugc

SEQ ID NO: 3633147 - RNA, 21 nt, Salmonella enterica enterica serovar Typhi
aguccauauccguacauaaca

SEQ ID NO: 3633148 - RNA, 17 nt, Salmonella enterica enterica serovar Typhi
aguccauuuccucaacc

SEQ ID NO: 3633149 - RNA, 12 nt, Salmonella enterica enterica serovar Typhi
agucccagcguu

SEQ ID NO: 3633150 - RNA, 17 nt, Salmonella enterica enterica serovar Typhi
agucccuccgcuuccac

SEQ ID NO: 3633151 - RNA, 18 nt, Salmonella enterica enterica serovar Typhi
agucccuggcgcgccagc

SEQ ID NO: 3633152 - RNA, 22 nt, Salmonella enterica enterica serovar Typhi
aguccgaagaagcgugucucuu

SEQ ID NO: 3633153 - RNA, 14 nt, Salmonella enterica enterica serovar Typhi
aguccgacuuuuuu

SEQ ID NO: 3633154 - RNA, 22 nt, Salmonella enterica enterica serovar Typhi
aguccgggcauaaccucuccuu

SEQ ID NO: 3633155 - RNA, 17 nt, Salmonella enterica enterica serovar Typhi
aguccgguauaaaacgu

SEQ ID NO: 3633156 - RNA, 20 nt, Salmonella enterica enterica serovar Typhi
aguccgucagaauaucuuuu

SEQ ID NO: 3633157 - RNA, 19 nt, Salmonella enterica enterica serovar Typhi
aguccgucguuaaucagcg

SEQ ID NO: 3633158 - RNA, 15 nt, Salmonella enterica enterica serovar Typhi
aguccuaacaccugc

SEQ ID NO: 3633159 - RNA, 14 nt, Salmonella enterica enterica serovar Typhi
aguccucagcgaau

SEQ ID NO: 3633160 - RNA, 21 nt, Salmonella enterica enterica serovar Typhi
aguccucagcgaauaucucua

SEQ ID NO: 3633161 - RNA, 15 nt, Salmonella enterica enterica serovar Typhi
aguccuccggcugaa

SEQ ID NO: 3633162 - RNA, 16 nt, Salmonella enterica enterica serovar Typhi
aguccucgcccacuuc

SEQ ID NO: 3633163 - RNA, 22 nt, Salmonella enterica enterica serovar Typhi
aguccugccauucgacaagcgg

SEQ ID NO: 3633164 - RNA, 22 nt, Salmonella enterica enterica serovar Typhi
aguccugccggacugauaccgc

SEQ ID NO: 3633165 - RNA, 21 nt, Salmonella enterica enterica serovar Typhi
aguccugcgcuuugacauugu

SEQ ID NO: 3633166 - RNA, 16 nt, Salmonella enterica enterica serovar Typhi
aguccugcgucgcuuc

SEQ ID NO: 3633167 - RNA, 13 nt, Salmonella enterica enterica serovar Typhi
aguccuguaucuu

SEQ ID NO: 3633168 - RNA, 15 nt, Salmonella enterica enterica serovar Typhi
aguccuguaucuucg

SEQ ID NO: 3633169 - RNA, 18 nt, Salmonella enterica enterica serovar Typhi
aguccuucaacccacuuu

SEQ ID NO: 3633170 - RNA, 14 nt, Salmonella enterica enterica serovar Typhi
aguccuuccgccgg

SEQ ID NO: 3633171 - RNA, 17 nt, Salmonella enterica enterica serovar Typhi
aguccuucuucccccug

SEQ ID NO: 3633172 - RNA, 16 nt, Salmonella enterica enterica serovar Typhi
agucgacucaucuuuu

SEQ ID NO: 3633173 - RNA, 18 nt, Salmonella enterica enterica serovar Typhi
agucgcaauauaaauauc

SEQ ID NO: 3633174 - RNA, 16 nt, Salmonella enterica enterica serovar Typhi
agucgcaucauggcga

SEQ ID NO: 3633175 - RNA, 22 nt, Salmonella enterica enterica serovar Typhi
agucgcauugugccugauggcg

SEQ ID NO: 3633176 - RNA, 13 nt, Salmonella enterica enterica serovar Typhi
agucgccaggauc

SEQ ID NO: 3633177 - RNA, 12 nt, Salmonella enterica enterica serovar Typhi
agucgccaggca

SEQ ID NO: 3633178 - RNA, 17 nt, Salmonella enterica enterica serovar Typhi
agucgccaggcaagguu

SEQ ID NO: 3633179 - RNA, 21 nt, Salmonella enterica enterica serovar Typhi
agucgccaugaguucaauaug

SEQ ID NO: 3633180 - RNA, 21 nt, Salmonella enterica enterica serovar Typhi
agucgcgccgugcccagcauc

SEQ ID NO: 3633181 - RNA, 20 nt, Salmonella enterica enterica serovar Typhi
agucgcgcgcgccagucauc

SEQ ID NO: 3633182 - RNA, 18 nt, Salmonella enterica enterica serovar Typhi
agucggaucaugaaaaau

SEQ ID NO: 3633183 - RNA, 19 nt, Salmonella enterica enterica serovar Typhi
agucggcgaacuucgcggu

SEQ ID NO: 3633184 - RNA, 16 nt, Salmonella enterica enterica serovar Typhi
agucgggaucgccaga

SEQ ID NO: 3633185 - RNA, 20 nt, Salmonella enterica enterica serovar Typhi
agucggggcguaaaaauuuu

SEQ ID NO: 3633186 - RNA, 16 nt, Salmonella enterica enterica serovar Typhi
agucguagaacaccac

SEQ ID NO: 3633187 - RNA, 13 nt, Salmonella enterica enterica serovar Typhi
agucgucauggcg

SEQ ID NO: 3633188 - RNA, 22 nt, Salmonella enterica enterica serovar Typhi
agucgugucauagucggcgcca

SEQ ID NO: 3633189 - RNA, 18 nt, Salmonella enterica enterica serovar Typhi
agucguuaucugacauau

SEQ ID NO: 3633190 - RNA, 23 nt, Salmonella enterica enterica serovar Typhi
agucucauugaucaguuugguau

SEQ ID NO: 3633191 - RNA, 20 nt, Salmonella enterica enterica serovar Typhi
agucucccuccugcuccaug

SEQ ID NO: 3633192 - RNA, 23 nt, Salmonella enterica enterica serovar Typhi
agucucccuccugcuccaugcug

SEQ ID NO: 3633193 - RNA, 19 nt, Salmonella enterica enterica serovar Typhi
agucuccugccaaugaaau

SEQ ID NO: 3633194 - RNA, 19 nt, Salmonella enterica enterica serovar Typhi
agucucgaaacgaaucuca

SEQ ID NO: 3633195 - RNA, 16 nt, Salmonella enterica enterica serovar Typhi
agucucuacuacauau

SEQ ID NO: 3633196 - RNA, 16 nt, Salmonella enterica enterica serovar Typhi
agucugaaaauaauug

SEQ ID NO: 3633197 - RNA, 17 nt, Salmonella enterica enterica serovar Typhi
agucugagcgcaaacau

SEQ ID NO: 3633198 - RNA, 18 nt, Salmonella enterica enterica serovar Typhi
agucuggauauaaaccgg

SEQ ID NO: 3633199 - RNA, 19 nt, Salmonella enterica enterica serovar Typhi
agucuggauauaaaccgga

SEQ ID NO: 3633200 - RNA, 18 nt, Salmonella enterica enterica serovar Typhi
agucuggguuagcuguau

SEQ ID NO: 3633201 - RNA, 18 nt, Salmonella enterica enterica serovar Typhi
agucuguucguagcccau

SEQ ID NO: 3633202 - RNA, 11 nt, Salmonella enterica enterica serovar Typhi
agucuuccugc

SEQ ID NO: 3633203 - RNA, 17 nt, Salmonella enterica enterica serovar Typhi
agucuuuuguuuuucuc

SEQ ID NO: 3633204 - RNA, 19 nt, Salmonella enterica enterica serovar Typhi
agucuuuuguuuuucucuu

SEQ ID NO: 3633205 - RNA, 15 nt, Salmonella enterica enterica serovar Typhi
agugaaagaccugcc

SEQ ID NO: 3633206 - RNA, 22 nt, Salmonella enterica enterica serovar Typhi
agugaaaguugguguuucucaa

SEQ ID NO: 3633207 - RNA, 18 nt, Salmonella enterica enterica serovar Typhi
agugaacgguugagcuuu

SEQ ID NO: 3633208 - RNA, 20 nt, Salmonella enterica enterica serovar Typhi
agugaagcgccggaugagga

SEQ ID NO: 3633209 - RNA, 19 nt, Salmonella enterica enterica serovar Typhi
agugaaggccaaguuuaga

SEQ ID NO: 3633210 - RNA, 17 nt, Salmonella enterica enterica serovar Typhi
agugaaucgacggcaau

SEQ ID NO: 3633211 - RNA, 23 nt, Salmonella enterica enterica serovar Typhi
agugaaucgacggcaauauuaaa

SEQ ID NO: 3633212 - RNA, 22 nt, Salmonella enterica enterica serovar Typhi
agugacaaacucacguucccca

SEQ ID NO: 3633213 - RNA, 13 nt, Salmonella enterica enterica serovar Typhi
agugaccagcauc

SEQ ID NO: 3633214 - RNA, 19 nt, Salmonella enterica enterica serovar Typhi
agugacccgccgccagcac

SEQ ID NO: 3633215 - RNA, 20 nt, Salmonella enterica enterica serovar Typhi
agugacccgccgccagcacc

SEQ ID NO: 3633216 - RNA, 18 nt, Salmonella enterica enterica serovar Typhi
agugacgaggccuguccc

SEQ ID NO: 3633217 - RNA, 17 nt, Salmonella enterica enterica serovar Typhi
agugacgccaguuccca

SEQ ID NO: 3633218 - RNA, 13 nt, Salmonella enterica enterica serovar Typhi
agugacgccgcca

SEQ ID NO: 3633219 - RNA, 20 nt, Salmonella enterica enterica serovar Typhi
agugacgguuuucacuggca

SEQ ID NO: 3633220 - RNA, 22 nt, Salmonella enterica enterica serovar Typhi
agugacguggcuucgccgagaa

SEQ ID NO: 3633221 - RNA, 19 nt, Salmonella enterica enterica serovar Typhi
agugacguuaucugucagc

SEQ ID NO: 3633222 - RNA, 23 nt, Salmonella enterica enterica serovar Typhi
agugacguuaucugucagccgca

SEQ ID NO: 3633223 - RNA, 16 nt, Salmonella enterica enterica serovar Typhi
agugacugacacccau

SEQ ID NO: 3633224 - RNA, 22 nt, Salmonella enterica enterica serovar Typhi
agugacuucugcucgguaaaaa

SEQ ID NO: 3633225 - RNA, 20 nt, Salmonella enterica enterica serovar Typhi
agugaggaccguacucagau

SEQ ID NO: 3633226 - RNA, 15 nt, Salmonella enterica enterica serovar Typhi
agugaguaacguuaa

SEQ ID NO: 3633227 - RNA, 20 nt, Salmonella enterica enterica serovar Typhi
agugaguaacguuaauacau

SEQ ID NO: 3633228 - RNA, 17 nt, Salmonella enterica enterica serovar Typhi
agugaguacgcaggagg

SEQ ID NO: 3633229 - RNA, 13 nt, Salmonella enterica enterica serovar Typhi
agugauaaagcac

SEQ ID NO: 3633230 - RNA, 16 nt, Salmonella enterica enterica serovar Typhi
aguugaacgguaaaca

SEQ ID NO: 3633231 - RNA, 21 nt, Salmonella enterica enterica serovar Typhi
aguugaauaacguguuaugcg

SEQ ID NO: 3633232 - RNA, 16 nt, Salmonella enterica enterica serovar Typhi
aguugaccacaucaaa

SEQ ID NO: 3633233 - RNA, 17 nt, Salmonella enterica enterica serovar Typhi
aguugagccauuccagc

SEQ ID NO: 3633234 - RNA, 23 nt, Salmonella enterica enterica serovar Typhi
aguugcaagucaccaucaguagc

SEQ ID NO: 3633235 - RNA, 20 nt, Salmonella enterica enterica serovar Typhi
aguugccaguacagcagcga

SEQ ID NO: 3633236 - RNA, 17 nt, Salmonella enterica enterica serovar Typhi
aguugcccauuuuccuc

SEQ ID NO: 3633237 - RNA, 18 nt, Salmonella enterica enterica serovar Typhi
aguugcccgacgccugca

SEQ ID NO: 3633238 - RNA, 20 nt, Salmonella enterica enterica serovar Typhi
aguugcccuuaucuggauga

SEQ ID NO: 3633239 - RNA, 15 nt, Salmonella enterica enterica serovar Typhi
aguugcgacugauaa

SEQ ID NO: 3633240 - RNA, 13 nt, Salmonella enterica enterica serovar Typhi
aguugcgcagggu

SEQ ID NO: 3633241 - RNA, 12 nt, Salmonella enterica enterica serovar Typhi
aguugcgucagc

SEQ ID NO: 3633242 - RNA, 12 nt, Salmonella enterica enterica serovar Typhi
aguugcugcauc

SEQ ID NO: 3633243 - RNA, 15 nt, Salmonella enterica enterica serovar Typhi
aguugcuuaccuugu

SEQ ID NO: 3633244 - RNA, 22 nt, Salmonella enterica enterica serovar Typhi
aguugcuuaccuuguucuucca

SEQ ID NO: 3633245 - RNA, 22 nt, Salmonella enterica enterica serovar Typhi
aguuggaaccaaacaccagauc

SEQ ID NO: 3633246 - RNA, 13 nt, Salmonella enterica enterica serovar Typhi
aguuggcuucagc

SEQ ID NO: 3633247 - RNA, 16 nt, Salmonella enterica enterica serovar Typhi
aguugguguuucucaa

SEQ ID NO: 3633248 - RNA, 13 nt, Salmonella enterica enterica serovar Typhi
aguugguucccag

SEQ ID NO: 3633249 - RNA, 17 nt, Salmonella enterica enterica serovar Typhi
aguuguucacgggaacg

SEQ ID NO: 3633250 - RNA, 18 nt, Salmonella enterica enterica serovar Typhi
aguuguuccgcgcugaug

SEQ ID NO: 3633251 - RNA, 19 nt, Salmonella enterica enterica serovar Typhi
aguuguuccgcgcugaugg

SEQ ID NO: 3633252 - RNA, 18 nt, Salmonella enterica enterica serovar Typhi
aguuguucuuucaccauu

SEQ ID NO: 3633253 - RNA, 13 nt, Salmonella enterica enterica serovar Typhi
aguuguuucaaca

SEQ ID NO: 3633254 - RNA, 18 nt, Salmonella enterica enterica serovar Typhi
aguuuaaacacucuccac

SEQ ID NO: 3633255 - RNA, 17 nt, Salmonella enterica enterica serovar Typhi
aguuuaaaucacagggg

SEQ ID NO: 3633256 - RNA, 14 nt, Salmonella enterica enterica serovar Typhi
aguuuaauucuuug

SEQ ID NO: 3633257 - RNA, 15 nt, Salmonella enterica enterica serovar Typhi
aguuuagccagcagc

SEQ ID NO: 3633258 - RNA, 16 nt, Salmonella enterica enterica serovar Typhi
aguuuagccagcagcg

SEQ ID NO: 3633259 - RNA, 20 nt, Salmonella enterica enterica serovar Typhi
aguuuagcgagcguucugca

SEQ ID NO: 3633260 - RNA, 15 nt, Salmonella enterica enterica serovar Typhi
aguuuauugagauaa

SEQ ID NO: 3633261 - RNA, 16 nt, Salmonella enterica enterica serovar Typhi
aguuuauugagauaau

SEQ ID NO: 3633262 - RNA, 14 nt, Salmonella enterica enterica serovar Typhi
aguuucaccuucug

SEQ ID NO: 3633263 - RNA, 14 nt, Salmonella enterica enterica serovar Typhi
aguuucaguaucau

SEQ ID NO: 3633264 - RNA, 15 nt, Salmonella enterica enterica serovar Typhi
aguuucagugguggc

SEQ ID NO: 3633265 - RNA, 15 nt, Salmonella enterica enterica serovar Typhi
aguuucaucagcaca

SEQ ID NO: 3633266 - RNA, 17 nt, Salmonella enterica enterica serovar Typhi
aguuucaucagcacaaa

SEQ ID NO: 3633267 - RNA, 16 nt, Salmonella enterica enterica serovar Typhi
aguuucaugccauacu

SEQ ID NO: 3633268 - RNA, 16 nt, Salmonella enterica enterica serovar Typhi
aguuucgacuuucauu

SEQ ID NO: 3633269 - RNA, 19 nt, Salmonella enterica enterica serovar Typhi
aguuucucccgccagaugc

SEQ ID NO: 3633270 - RNA, 19 nt, Salmonella enterica enterica serovar Typhi
aguuucugcucgaccguca

SEQ ID NO: 3633271 - RNA, 14 nt, Salmonella enterica enterica serovar Typhi
aguuucuuaccuac

SEQ ID NO: 3633272 - RNA, 22 nt, Salmonella enterica enterica serovar Typhi
aguuugaugcaaaugucagauc

SEQ ID NO: 3633273 - RNA, 23 nt, Salmonella enterica enterica serovar Typhi
aguuugccccauuguucuuucau

SEQ ID NO: 3633274 - RNA, 16 nt, Salmonella enterica enterica serovar Typhi
aguuugcgcgauuuau

SEQ ID NO: 3633275 - RNA, 20 nt, Salmonella enterica enterica serovar Typhi
aguuugcguacucagcagac

SEQ ID NO: 3633276 - RNA, 17 nt, Salmonella enterica enterica serovar Typhi
aguuugcuuaagcuuug

SEQ ID NO: 3633277 - RNA, 22 nt, Salmonella enterica enterica serovar Typhi
aguuugucaacgugugccagga

SEQ ID NO: 3633278 - RNA, 15 nt, Salmonella enterica enterica serovar Typhi
aguuugugccgccac

SEQ ID NO: 3633279 - RNA, 20 nt, Salmonella enterica enterica serovar Typhi
aguuuuaccguaaaaugcug

SEQ ID NO: 3633280 - RNA, 19 nt, Salmonella enterica enterica serovar Typhi
aguuuugcuucaugcacaa

SEQ ID NO: 3633281 - RNA, 20 nt, Salmonella enterica enterica serovar Typhi
aguuuugcuucaugcacaaa

SEQ ID NO: 3633282 - RNA, 12 nt, Salmonella enterica enterica serovar Typhi
aguuuuuaaaca

SEQ ID NO: 3633283 - RNA, 22 nt, Salmonella enterica enterica serovar Typhi
aguuuuuaaacaacauaucgcc

SEQ ID NO: 3633284 - RNA, 22 nt, Salmonella enterica enterica serovar Typhi
aguuuuucuacuaacuggcaau

SEQ ID NO: 3633285 - RNA, 18 nt, Salmonella enterica enterica serovar Typhi
aguuuuuugaccauucca

SEQ ID NO: 3633286 - RNA, 13 nt, Salmonella enterica enterica serovar Typhi
aguuuuuuuaaaa

SEQ ID NO: 3633287 - RNA, 21 nt, Salmonella enterica enterica serovar Typhi
auaaaaaagccguauuuuauu

SEQ ID NO: 3633288 - RNA, 17 nt, Salmonella enterica enterica serovar Typhi
auaaaaaagcugcgauc

SEQ ID NO: 3633289 - RNA, 13 nt, Salmonella enterica enterica serovar Typhi
auaaaaaaggcag

SEQ ID NO: 3633290 - RNA, 15 nt, Salmonella enterica enterica serovar Typhi
auaaaaaaggccgcu

SEQ ID NO: 3633291 - RNA, 13 nt, Salmonella enterica enterica serovar Typhi
auaaaaacgggua

SEQ ID NO: 3633292 - RNA, 22 nt, Salmonella enterica enterica serovar Typhi
auaaaaacugcuaaaagaagcu

SEQ ID NO: 3633293 - RNA, 22 nt, Salmonella enterica enterica serovar Typhi
auaaaaagccaucccgcugauc

SEQ ID NO: 3633294 - RNA, 14 nt, Salmonella enterica enterica serovar Typhi
auaaaaagccguga

SEQ ID NO: 3633295 - RNA, 21 nt, Salmonella enterica enterica serovar Typhi
auaaaaagugcgcacucagaa

SEQ ID NO: 3633296 - RNA, 12 nt, Salmonella enterica enterica serovar Typhi
auaaaaauaaau

SEQ ID NO: 3633297 - RNA, 14 nt, Salmonella enterica enterica serovar Typhi
auaaaaauagcugg

SEQ ID NO: 3633298 - RNA, 17 nt, Salmonella enterica enterica serovar Typhi
auaaaaauagcuggcug

SEQ ID NO: 3633299 - RNA, 18 nt, Salmonella enterica enterica serovar Typhi
auaaaaauagcuggcugu

SEQ ID NO: 3633300 - RNA, 14 nt, Salmonella enterica enterica serovar Typhi
auaaaaaucgggua

SEQ ID NO: 3633301 - RNA, 20 nt, Salmonella enterica enterica serovar Typhi
auaaaacauuccugacauuu

SEQ ID NO: 3633302 - RNA, 14 nt, Salmonella enterica enterica serovar Typhi
auaaaaccauucaa

SEQ ID NO: 3633303 - RNA, 16 nt, Salmonella enterica enterica serovar Typhi
auaaaacgcucucuuu

SEQ ID NO: 3633304 - RNA, 18 nt, Salmonella enterica enterica serovar Typhi
auaaaacugccgucaauu

SEQ ID NO: 3633305 - RNA, 18 nt, Salmonella enterica enterica serovar Typhi
auaaaagcccuuaucgcc

SEQ ID NO: 3633306 - RNA, 21 nt, Salmonella enterica enterica serovar Typhi
auaaaagccgccguguuuuuu

SEQ ID NO: 3633307 - RNA, 21 nt, Salmonella enterica enterica serovar Typhi
auaaaagggaucuacggaucc

SEQ ID NO: 3633308 - RNA, 13 nt, Salmonella enterica enterica serovar Typhi
auaaaauaaacac

SEQ ID NO: 3633309 - RNA, 12 nt, Salmonella enterica enterica serovar Typhi
auaaaauaacua

SEQ ID NO: 3633310 - RNA, 16 nt, Salmonella enterica enterica serovar Typhi
auaaaauccugcacgc

SEQ ID NO: 3633311 - RNA, 13 nt, Salmonella enterica enterica serovar Typhi
auaaaauggaugc

SEQ ID NO: 3633312 - RNA, 14 nt, Salmonella enterica enterica serovar Typhi
auaaaaugucuguu

SEQ ID NO: 3633313 - RNA, 14 nt, Salmonella enterica enterica serovar Typhi
auaaacacagcaaa

SEQ ID NO: 3633314 - RNA, 17 nt, Salmonella enterica enterica serovar Typhi
auaaacagcguuuucau

SEQ ID NO: 3633315 - RNA, 16 nt, Salmonella enterica enterica serovar Typhi
auaaacagguaaaaca

SEQ ID NO: 3633316 - RNA, 23 nt, Salmonella enterica enterica serovar Typhi
auaacgcgagaagaagaauuauu

SEQ ID NO: 3633317 - RNA, 22 nt, Salmonella enterica enterica serovar Typhi
auaacgcgauggccaaauaacc

SEQ ID NO: 3633318 - RNA, 20 nt, Salmonella enterica enterica serovar Typhi
auaacgcggcccgggagaac

SEQ ID NO: 3633319 - RNA, 18 nt, Salmonella enterica enterica serovar Typhi
auaacggcgcaaagacag

SEQ ID NO: 3633320 - RNA, 16 nt, Salmonella enterica enterica serovar Typhi
auaacgucagccggga

SEQ ID NO: 3633321 - RNA, 20 nt, Salmonella enterica enterica serovar Typhi
auaacgugccgaccagcggu

SEQ ID NO: 3633322 - RNA, 19 nt, Salmonella enterica enterica serovar Typhi
auaacguuacauuuuccau

SEQ ID NO: 3633323 - RNA, 20 nt, Salmonella enterica enterica serovar Typhi
auaacguuaccgcagcgaau

SEQ ID NO: 3633324 - RNA, 14 nt, Salmonella enterica enterica serovar Typhi
auaacguucuuuug

SEQ ID NO: 3633325 - RNA, 13 nt, Salmonella enterica enterica serovar Typhi
auaacguuuucag

SEQ ID NO: 3633326 - RNA, 15 nt, Salmonella enterica enterica serovar Typhi
auaacucaauagcgg

SEQ ID NO: 3633327 - RNA, 19 nt, Salmonella enterica enterica serovar Typhi
auaacucgaauuguuaaaa

SEQ ID NO: 3633328 - RNA, 12 nt, Salmonella enterica enterica serovar Typhi
auaacucuucau

SEQ ID NO: 3633329 - RNA, 15 nt, Salmonella enterica enterica serovar Typhi
auaacugcgccaucu

SEQ ID NO: 3633330 - RNA, 20 nt, Salmonella enterica enterica serovar Typhi
auaacuuccuuugccuuucu

SEQ ID NO: 3633331 - RNA, 20 nt, Salmonella enterica enterica serovar Typhi
auaacuuuccugccuucuga

SEQ ID NO: 3633332 - RNA, 22 nt, Salmonella enterica enterica serovar Typhi
auaacuuuuuaagcucccgcca

SEQ ID NO: 3633333 - RNA, 16 nt, Salmonella enterica enterica serovar Typhi
auaagaaaaaacuggu

SEQ ID NO: 3633334 - RNA, 24 nt, Salmonella enterica enterica serovar Typhi
auaagaaauaguucaucgugaaau

SEQ ID NO: 3633335 - RNA, 15 nt, Salmonella enterica enterica serovar Typhi
auaagaacuuuauca

SEQ ID NO: 3633336 - RNA, 17 nt, Salmonella enterica enterica serovar Typhi
auaagaaguaaacagaa

SEQ ID NO: 3633337 - RNA, 18 nt, Salmonella enterica enterica serovar Typhi
auaagaccaauacgaucg

SEQ ID NO: 3633338 - RNA, 19 nt, Salmonella enterica enterica serovar Typhi
auaagacgacgguuaaaaa

SEQ ID NO: 3633339 - RNA, 14 nt, Salmonella enterica enterica serovar Typhi
auaagacgcagggc

SEQ ID NO: 3633340 - RNA, 18 nt, Salmonella enterica enterica serovar Typhi
auaagagaaaauaccgcu

SEQ ID NO: 3633341 - RNA, 15 nt, Salmonella enterica enterica serovar Typhi
auaagagggcgccau

SEQ ID NO: 3633342 - RNA, 18 nt, Salmonella enterica enterica serovar Typhi
auaagauuuacaacagau

SEQ ID NO: 3633343 - RNA, 19 nt, Salmonella enterica enterica serovar Typhi
auaagcaacugggcuugca

SEQ ID NO: 3633344 - RNA, 17 nt, Salmonella enterica enterica serovar Typhi
auaagcacaccauuuca

SEQ ID NO: 3633345 - RNA, 11 nt, Salmonella enterica enterica serovar Typhi
auaagcagaac

SEQ ID NO: 3633346 - RNA, 18 nt, Salmonella enterica enterica serovar Typhi
auaagcauagcgccauca

SEQ ID NO: 3633347 - RNA, 17 nt, Salmonella enterica enterica serovar Typhi
auaagccacuucaacca

SEQ ID NO: 3633348 - RNA, 12 nt, Salmonella enterica enterica serovar Typhi
auaagccagccc

SEQ ID NO: 3633349 - RNA, 16 nt, Salmonella enterica enterica serovar Typhi
auaagccagguuuuca

SEQ ID NO: 3633350 - RNA, 18 nt, Salmonella enterica enterica serovar Typhi
auaagccgcguucugucg

SEQ ID NO: 3633351 - RNA, 22 nt, Salmonella enterica enterica serovar Typhi
auaagcgaauugccgucgccgg

SEQ ID NO: 3633352 - RNA, 18 nt, Salmonella enterica enterica serovar Typhi
auaagcgcagcgccauca

SEQ ID NO: 3633353 - RNA, 18 nt, Salmonella enterica enterica serovar Typhi
auaagcgcagcgccaucc

SEQ ID NO: 3633354 - RNA, 18 nt, Salmonella enterica enterica serovar Typhi
auaagcgcagcgucauca

SEQ ID NO: 3633355 - RNA, 15 nt, Salmonella enterica enterica serovar Typhi
auaagcgcucaggca

SEQ ID NO: 3633356 - RNA, 19 nt, Salmonella enterica enterica serovar Typhi
auaagcggcagcgccaucc

SEQ ID NO: 3633357 - RNA, 22 nt, Salmonella enterica enterica serovar Typhi
auaagcguagcgccaucaggcu

SEQ ID NO: 3633358 - RNA, 17 nt, Salmonella enterica enterica serovar Typhi
auaagcgugcgccaucc

SEQ ID NO: 3633359 - RNA, 21 nt, Salmonella enterica enterica serovar Typhi
auaagcuaguaaagaaauuuu

SEQ ID NO: 3633360 - RNA, 15 nt, Salmonella enterica enterica serovar Typhi
auaagcucaacgaua

SEQ ID NO: 3633361 - RNA, 19 nt, Salmonella enterica enterica serovar Typhi
auaagcuccgggacauccg

SEQ ID NO: 3633362 - RNA, 13 nt, Salmonella enterica enterica serovar Typhi
auaagcugaaugg

SEQ ID NO: 3633363 - RNA, 18 nt, Salmonella enterica enterica serovar Typhi
auaagcuuaggauaagaa

SEQ ID NO: 3633364 - RNA, 20 nt, Salmonella enterica enterica serovar Typhi
auaaggccacgccgccaucc

SEQ ID NO: 3633365 - RNA, 20 nt, Salmonella enterica enterica serovar Typhi
auaaggccugccguccugau

SEQ ID NO: 3633366 - RNA, 16 nt, Salmonella enterica enterica serovar Typhi
auaaggcgauaccuaa

SEQ ID NO: 3633367 - RNA, 20 nt, Salmonella enterica enterica serovar Typhi
auaaggcgcuugcgccauca

SEQ ID NO: 3633368 - RNA, 18 nt, Salmonella enterica enterica serovar Typhi
auaaggguaagcaauaug

SEQ ID NO: 3633369 - RNA, 20 nt, Salmonella enterica enterica serovar Typhi
auaagguaaagccgccaucc

SEQ ID NO: 3633370 - RNA, 20 nt, Salmonella enterica enterica serovar Typhi
auaaggucgcuauccagcag

SEQ ID NO: 3633371 - RNA, 16 nt, Salmonella enterica enterica serovar Typhi
auaagguucuggcauu

SEQ ID NO: 3633372 - RNA, 13 nt, Salmonella enterica enterica serovar Typhi
auaagucauauca

SEQ ID NO: 3633373 - RNA, 20 nt, Salmonella enterica enterica serovar Typhi
auaaguuagcuuuuuuaugc

SEQ ID NO: 3633374 - RNA, 22 nt, Salmonella enterica enterica serovar Typhi
auaaguuucucuucguuauuuu

SEQ ID NO: 3633375 - RNA, 14 nt, Salmonella enterica enterica serovar Typhi
auaauaaacgcgcc

SEQ ID NO: 3633376 - RNA, 23 nt, Salmonella enterica enterica serovar Typhi
auaauaaaugccgucgcuuucau

SEQ ID NO: 3633377 - RNA, 16 nt, Salmonella enterica enterica serovar Typhi
auaauaagaucaaagc

SEQ ID NO: 3633378 - RNA, 21 nt, Salmonella enterica enterica serovar Typhi
auaauacaccgccauauauuu

SEQ ID NO: 3633379 - RNA, 23 nt, Salmonella enterica enterica serovar Typhi
auaauacaccgccauauauuuac

SEQ ID NO: 3633380 - RNA, 20 nt, Salmonella enterica enterica serovar Typhi
auaauacacgguaaauucuu

SEQ ID NO: 3633381 - RNA, 11 nt, Salmonella enterica enterica serovar Typhi
auaauacuuaa

SEQ ID NO: 3633382 - RNA, 20 nt, Salmonella enterica enterica serovar Typhi
auaauacuuaauucauaacg

SEQ ID NO: 3633383 - RNA, 15 nt, Salmonella enterica enterica serovar Typhi
auaauagaacccaaa

SEQ ID NO: 3633384 - RNA, 21 nt, Salmonella enterica enterica serovar Typhi
auaauagacaacaucccagaa

SEQ ID NO: 3633385 - RNA, 16 nt, Salmonella enterica enterica serovar Typhi
auaauagcugaaaaga

SEQ ID NO: 3633386 - RNA, 21 nt, Salmonella enterica enterica serovar Typhi
auaauagcugaaaagauaaag

SEQ ID NO: 3633387 - RNA, 22 nt, Salmonella enterica enterica serovar Typhi
auaauaucgaauggggaaauaa

SEQ ID NO: 3633388 - RNA, 20 nt, Salmonella enterica enterica serovar Typhi
auaauaucguuaagccuuca

SEQ ID NO: 3633389 - RNA, 13 nt, Salmonella enterica enterica serovar Typhi
auaauaugcucaa

SEQ ID NO: 3633390 - RNA, 16 nt, Salmonella enterica enterica serovar Typhi
auaauaugcucaacuu

SEQ ID NO: 3633391 - RNA, 20 nt, Salmonella enterica enterica serovar Typhi
auaauauguuccacaaucaa

SEQ ID NO: 3633392 - RNA, 17 nt, Salmonella enterica enterica serovar Typhi
auaauauguuuauuugc

SEQ ID NO: 3633393 - RNA, 16 nt, Salmonella enterica enterica serovar Typhi
auaauauuaucauaau

SEQ ID NO: 3633394 - RNA, 21 nt, Salmonella enterica enterica serovar Typhi
auaauauuauccuuuaauuaa

SEQ ID NO: 3633395 - RNA, 14 nt, Salmonella enterica enterica serovar Typhi
auaaucaaacccuu

SEQ ID NO: 3633396 - RNA, 12 nt, Salmonella enterica enterica serovar Typhi
auaaucaaccau

SEQ ID NO: 3633397 - RNA, 14 nt, Salmonella enterica enterica serovar Typhi
auaaucaaccauac

SEQ ID NO: 3633398 - RNA, 20 nt, Salmonella enterica enterica serovar Typhi
auaaucaauggccuugccag

SEQ ID NO: 3633399 - RNA, 20 nt, Salmonella enterica enterica serovar Typhi
auaaucacauuaugcugggu

SEQ ID NO: 3633400 - RNA, 14 nt, Salmonella enterica enterica serovar Typhi
auaaucaccacgua

SEQ ID NO: 3633401 - RNA, 20 nt, Salmonella enterica enterica serovar Typhi
auaccgcuuuguaaaacauu

SEQ ID NO: 3633402 - RNA, 15 nt, Salmonella enterica enterica serovar Typhi
auaccggcaucacgc

SEQ ID NO: 3633403 - RNA, 13 nt, Salmonella enterica enterica serovar Typhi
auaccguaaauuu

SEQ ID NO: 3633404 - RNA, 19 nt, Salmonella enterica enterica serovar Typhi
auaccuacuuuauuuuucg

SEQ ID NO: 3633405 - RNA, 16 nt, Salmonella enterica enterica serovar Typhi
auaccuauaaaaauga

SEQ ID NO: 3633406 - RNA, 13 nt, Salmonella enterica enterica serovar Typhi
auaccucauuuca

SEQ ID NO: 3633407 - RNA, 15 nt, Salmonella enterica enterica serovar Typhi
auaccugucggcaaa

SEQ ID NO: 3633408 - RNA, 17 nt, Salmonella enterica enterica serovar Typhi
auaccuucccgcgauaa

SEQ ID NO: 3633409 - RNA, 21 nt, Salmonella enterica enterica serovar Typhi
auaccuucccgcgauaaaaac

SEQ ID NO: 3633410 - RNA, 22 nt, Salmonella enterica enterica serovar Typhi
auaccuucuucacuaaaaacag

SEQ ID NO: 3633411 - RNA, 21 nt, Salmonella enterica enterica serovar Typhi
auaccuuuaaccucuuuuuca

SEQ ID NO: 3633412 - RNA, 14 nt, Salmonella enterica enterica serovar Typhi
auacgaaauugaga

SEQ ID NO: 3633413 - RNA, 17 nt, Salmonella enterica enterica serovar Typhi
auacgcaccagcucuac

SEQ ID NO: 3633414 - RNA, 24 nt, Salmonella enterica enterica serovar Typhi
auacgcaggacuuucgcuucacga

SEQ ID NO: 3633415 - RNA, 15 nt, Salmonella enterica enterica serovar Typhi
auacgcauucucgcc

SEQ ID NO: 3633416 - RNA, 13 nt, Salmonella enterica enterica serovar Typhi
auacgccagcaga

SEQ ID NO: 3633417 - RNA, 23 nt, Salmonella enterica enterica serovar Typhi
auacgccagccgucaugauguuu

SEQ ID NO: 3633418 - RNA, 18 nt, Salmonella enterica enterica serovar Typhi
auacgccgccagcaauac

SEQ ID NO: 3633419 - RNA, 14 nt, Salmonella enterica enterica serovar Typhi
auacgccugccugg

SEQ ID NO: 3633420 - RNA, 13 nt, Salmonella enterica enterica serovar Typhi
auacgcgauaaaa

SEQ ID NO: 3633421 - RNA, 14 nt, Salmonella enterica enterica serovar Typhi
auacgcucaauaua

SEQ ID NO: 3633422 - RNA, 17 nt, Salmonella enterica enterica serovar Typhi
auacgcugcaccauuuu

SEQ ID NO: 3633423 - RNA, 13 nt, Salmonella enterica enterica serovar Typhi
auacgcuuucuga

SEQ ID NO: 3633424 - RNA, 16 nt, Salmonella enterica enterica serovar Typhi
auacggaugccgauuu

SEQ ID NO: 3633425 - RNA, 19 nt, Salmonella enterica enterica serovar Typhi
auacggcggcaaugccgcc

SEQ ID NO: 3633426 - RNA, 21 nt, Salmonella enterica enterica serovar Typhi
auacggcggcaaugccgccgu

SEQ ID NO: 3633427 - RNA, 23 nt, Salmonella enterica enterica serovar Typhi
auacggcgugauguagcuugaaa

SEQ ID NO: 3633428 - RNA, 13 nt, Salmonella enterica enterica serovar Typhi
auacggcugucag

SEQ ID NO: 3633429 - RNA, 14 nt, Salmonella enterica enterica serovar Typhi
auacggcuuccacu

SEQ ID NO: 3633430 - RNA, 16 nt, Salmonella enterica enterica serovar Typhi
auacggcuuccacugc

SEQ ID NO: 3633431 - RNA, 17 nt, Salmonella enterica enterica serovar Typhi
auacgguaaaucauuug

SEQ ID NO: 3633432 - RNA, 19 nt, Salmonella enterica enterica serovar Typhi
auacgucauaucauccagc

SEQ ID NO: 3633433 - RNA, 18 nt, Salmonella enterica enterica serovar Typhi
auacguccccauccgagc

SEQ ID NO: 3633434 - RNA, 22 nt, Salmonella enterica enterica serovar Typhi
auacgucgugacccacacauag

SEQ ID NO: 3633435 - RNA, 14 nt, Salmonella enterica enterica serovar Typhi
auacguggcucaag

SEQ ID NO: 3633436 - RNA, 17 nt, Salmonella enterica enterica serovar Typhi
auacuaaaacuuuaaca

SEQ ID NO: 3633437 - RNA, 16 nt, Salmonella enterica enterica serovar Typhi
auacuaccgcugcgau

SEQ ID NO: 3633438 - RNA, 16 nt, Salmonella enterica enterica serovar Typhi
auacucaauauccugc

SEQ ID NO: 3633439 - RNA, 18 nt, Salmonella enterica enterica serovar Typhi
auacucacgaauaagaau

SEQ ID NO: 3633440 - RNA, 19 nt, Salmonella enterica enterica serovar Typhi
auacucagcgacguaaucu

SEQ ID NO: 3633441 - RNA, 15 nt, Salmonella enterica enterica serovar Typhi
auacuccacaguuca

SEQ ID NO: 3633442 - RNA, 13 nt, Salmonella enterica enterica serovar Typhi
auacuccagcaga

SEQ ID NO: 3633443 - RNA, 14 nt, Salmonella enterica enterica serovar Typhi
auacuccagcagac

SEQ ID NO: 3633444 - RNA, 20 nt, Salmonella enterica enterica serovar Typhi
auacuccugcaacagaagag

SEQ ID NO: 3633445 - RNA, 15 nt, Salmonella enterica enterica serovar Typhi
auacuccugccugac

SEQ ID NO: 3633446 - RNA, 14 nt, Salmonella enterica enterica serovar Typhi
auacucugcuuuuu

SEQ ID NO: 3633447 - RNA, 12 nt, Salmonella enterica enterica serovar Typhi
auacucuucacg

SEQ ID NO: 3633448 - RNA, 22 nt, Salmonella enterica enterica serovar Typhi
auacucuuggagagcaucaucu

SEQ ID NO: 3633449 - RNA, 11 nt, Salmonella enterica enterica serovar Typhi
auacucuuucc

SEQ ID NO: 3633450 - RNA, 17 nt, Salmonella enterica enterica serovar Typhi
auacucuuucccggcaa

SEQ ID NO: 3633451 - RNA, 19 nt, Salmonella enterica enterica serovar Typhi
auacucuuugaacagccag

SEQ ID NO: 3633452 - RNA, 22 nt, Salmonella enterica enterica serovar Typhi
auacugaaauuucuuuuccaga

SEQ ID NO: 3633453 - RNA, 21 nt, Salmonella enterica enterica serovar Typhi
auacugaaccacggagagaca

SEQ ID NO: 3633454 - RNA, 12 nt, Salmonella enterica enterica serovar Typhi
auacugaccaac

SEQ ID NO: 3633455 - RNA, 17 nt, Salmonella enterica enterica serovar Typhi
auacugaccaacaacag

SEQ ID NO: 3633456 - RNA, 18 nt, Salmonella enterica enterica serovar Typhi
auacugaccaacaacaga

SEQ ID NO: 3633457 - RNA, 21 nt, Salmonella enterica enterica serovar Typhi
auacugaccaacaacagauau

SEQ ID NO: 3633458 - RNA, 22 nt, Salmonella enterica enterica serovar Typhi
auacugaccaacaacagauaua

SEQ ID NO: 3633459 - RNA, 13 nt, Salmonella enterica enterica serovar Typhi
auacugauaaaaa

SEQ ID NO: 3633460 - RNA, 11 nt, Salmonella enterica enterica serovar Typhi
auacugcaacg

SEQ ID NO: 3633461 - RNA, 22 nt, Salmonella enterica enterica serovar Typhi
auacuggccgguuuuaaaaaua

SEQ ID NO: 3633462 - RNA, 20 nt, Salmonella enterica enterica serovar Typhi
auacuggucgcgucaauauu

SEQ ID NO: 3633463 - RNA, 17 nt, Salmonella enterica enterica serovar Typhi
auacuguacgcccagcc

SEQ ID NO: 3633464 - RNA, 16 nt, Salmonella enterica enterica serovar Typhi
auacugugggauuuuu

SEQ ID NO: 3633465 - RNA, 16 nt, Salmonella enterica enterica serovar Typhi
auacuguuuuugcuuu

SEQ ID NO: 3633466 - RNA, 23 nt, Salmonella enterica enterica serovar Typhi
auacuuaauucauaacgaccuuu

SEQ ID NO: 3633467 - RNA, 13 nt, Salmonella enterica enterica serovar Typhi
auacuucaucagg

SEQ ID NO: 3633468 - RNA, 12 nt, Salmonella enterica enterica serovar Typhi
auacuuuuacuc

SEQ ID NO: 3633469 - RNA, 17 nt, Salmonella enterica enterica serovar Typhi
auagaaaauauaugaca

SEQ ID NO: 3633470 - RNA, 17 nt, Salmonella enterica enterica serovar Typhi
auagaaagucuuuuguu

SEQ ID NO: 3633471 - RNA, 14 nt, Salmonella enterica enterica serovar Typhi
auagaaauagccuu

SEQ ID NO: 3633472 - RNA, 16 nt, Salmonella enterica enterica serovar Typhi
auagaacgcucgcgca

SEQ ID NO: 3633473 - RNA, 22 nt, Salmonella enterica enterica serovar Typhi
auagaacgcucgcgcaugaccu

SEQ ID NO: 3633474 - RNA, 20 nt, Salmonella enterica enterica serovar Typhi
auagaagcucaugugcagca

SEQ ID NO: 3633475 - RNA, 20 nt, Salmonella enterica enterica serovar Typhi
auagaauaggaaauaauuaa

SEQ ID NO: 3633476 - RNA, 21 nt, Salmonella enterica enterica serovar Typhi
auagaauaggaaauaauuaau

SEQ ID NO: 3633477 - RNA, 16 nt, Salmonella enterica enterica serovar Typhi
auagacauacaggaau

SEQ ID NO: 3633478 - RNA, 13 nt, Salmonella enterica enterica serovar Typhi
auagaccacgcca

SEQ ID NO: 3633479 - RNA, 22 nt, Salmonella enterica enterica serovar Typhi
auagaccagcggcccgcgcuga

SEQ ID NO: 3633480 - RNA, 15 nt, Salmonella enterica enterica serovar Typhi
auagacgacaucuuu

SEQ ID NO: 3633481 - RNA, 22 nt, Salmonella enterica enterica serovar Typhi
auagacgacaucuuuuccugaa

SEQ ID NO: 3633482 - RNA, 18 nt, Salmonella enterica enterica serovar Typhi
auagacgcccugcaaagc

SEQ ID NO: 3633483 - RNA, 22 nt, Salmonella enterica enterica serovar Typhi
auagacgcccugcaaagcaaaa

SEQ ID NO: 3633484 - RNA, 18 nt, Salmonella enterica enterica serovar Typhi
auagacgccggucaugcc

SEQ ID NO: 3633485 - RNA, 15 nt, Salmonella enterica enterica serovar Typhi
auagacgcuacugug

SEQ ID NO: 3633486 - RNA, 23 nt, Salmonella enterica enterica serovar Typhi
auagacuccgucaaagaaaacuu

SEQ ID NO: 3633487 - RNA, 12 nt, Salmonella enterica enterica serovar Typhi
auaguccagcau

SEQ ID NO: 3633488 - RNA, 20 nt, Salmonella enterica enterica serovar Typhi
auagucgucuauuuccgcuu

SEQ ID NO: 3633489 - RNA, 17 nt, Salmonella enterica enterica serovar Typhi
auagucguugcgccgua

SEQ ID NO: 3633490 - RNA, 18 nt, Salmonella enterica enterica serovar Typhi
auagugacgccgccaucc

SEQ ID NO: 3633491 - RNA, 14 nt, Salmonella enterica enterica serovar Typhi
auagugauaccagu

SEQ ID NO: 3633492 - RNA, 20 nt, Salmonella enterica enterica serovar Typhi
auagugccggugacaugaaa

SEQ ID NO: 3633493 - RNA, 21 nt, Salmonella enterica enterica serovar Typhi
auagugcucauucguuuugcu

SEQ ID NO: 3633494 - RNA, 23 nt, Salmonella enterica enterica serovar Typhi
auaguggcgcgacgcgucaguga

SEQ ID NO: 3633495 - RNA, 20 nt, Salmonella enterica enterica serovar Typhi
auagugucgccauaaaucag

SEQ ID NO: 3633496 - RNA, 15 nt, Salmonella enterica enterica serovar Typhi
auaguuccacauaaa

SEQ ID NO: 3633497 - RNA, 16 nt, Salmonella enterica enterica serovar Typhi
auaguugagcagcgcg

SEQ ID NO: 3633498 - RNA, 15 nt, Salmonella enterica enterica serovar Typhi
auaguuugccagaga

SEQ ID NO: 3633499 - RNA, 16 nt, Salmonella enterica enterica serovar Typhi
auaguuuuuaauucca

SEQ ID NO: 3633500 - RNA, 18 nt, Salmonella enterica enterica serovar Typhi
auaguuuuuaauuccacc

SEQ ID NO: 3633501 - RNA, 15 nt, Salmonella enterica enterica serovar Typhi
auaguuuuuccccau

SEQ ID NO: 3633502 - RNA, 17 nt, Salmonella enterica enterica serovar Typhi
auauaaaaaacauauaa

SEQ ID NO: 3633503 - RNA, 12 nt, Salmonella enterica enterica serovar Typhi
auauaaaaauag

SEQ ID NO: 3633504 - RNA, 15 nt, Salmonella enterica enterica serovar Typhi
auauaacagaauaag

SEQ ID NO: 3633505 - RNA, 18 nt, Salmonella enterica enterica serovar Typhi
auauaaccacgaaaauua

SEQ ID NO: 3633506 - RNA, 17 nt, Salmonella enterica enterica serovar Typhi
auauaacgugccgacca

SEQ ID NO: 3633507 - RNA, 19 nt, Salmonella enterica enterica serovar Typhi
auauaagcgccgucauccg

SEQ ID NO: 3633508 - RNA, 19 nt, Salmonella enterica enterica serovar Typhi
auauaagcgguauucaggu

SEQ ID NO: 3633509 - RNA, 16 nt, Salmonella enterica enterica serovar Typhi
auauaaggugucuaua

SEQ ID NO: 3633510 - RNA, 14 nt, Salmonella enterica enterica serovar Typhi
auauaaucuaccau

SEQ ID NO: 3633511 - RNA, 16 nt, Salmonella enterica enterica serovar Typhi
auauaauuuauagcca

SEQ ID NO: 3633512 - RNA, 22 nt, Salmonella enterica enterica serovar Typhi
auauaauuuuauuauauuuaaa

SEQ ID NO: 3633513 - RNA, 23 nt, Salmonella enterica enterica serovar Typhi
auauaauuuuauuauauuuaaaa

SEQ ID NO: 3633514 - RNA, 23 nt, Salmonella enterica enterica serovar Typhi
auauacagccuuuugagcagcau

SEQ ID NO: 3633515 - RNA, 15 nt, Salmonella enterica enterica serovar Typhi
auauacccccugcaa

SEQ ID NO: 3633516 - RNA, 15 nt, Salmonella enterica enterica serovar Typhi
auauacgccacggcc

SEQ ID NO: 3633517 - RNA, 12 nt, Salmonella enterica enterica serovar Typhi
auauacugucuu

SEQ ID NO: 3633518 - RNA, 13 nt, Salmonella enterica enterica serovar Typhi
auauacuucauca

SEQ ID NO: 3633519 - RNA, 12 nt, Salmonella enterica enterica serovar Typhi
auauagacuccg

SEQ ID NO: 3633520 - RNA, 20 nt, Salmonella enterica enterica serovar Typhi
auauagcaacguccgcagcc

SEQ ID NO: 3633521 - RNA, 15 nt, Salmonella enterica enterica serovar Typhi
auauagccauuuaau

SEQ ID NO: 3633522 - RNA, 16 nt, Salmonella enterica enterica serovar Typhi
auauagccguggcugg

SEQ ID NO: 3633523 - RNA, 16 nt, Salmonella enterica enterica serovar Typhi
auauaguuuauugaag

SEQ ID NO: 3633524 - RNA, 21 nt, Salmonella enterica enterica serovar Typhi
auauauauuuucucaauuuua

SEQ ID NO: 3633525 - RNA, 16 nt, Salmonella enterica enterica serovar Typhi
auauauccuaacuuau

SEQ ID NO: 3633526 - RNA, 16 nt, Salmonella enterica enterica serovar Typhi
auauauucagcaaaug

SEQ ID NO: 3633527 - RNA, 18 nt, Salmonella enterica enterica serovar Typhi
auauauuucacuucauca

SEQ ID NO: 3633528 - RNA, 21 nt, Salmonella enterica enterica serovar Typhi
auauauuucacuucaucauca

SEQ ID NO: 3633529 - RNA, 12 nt, Salmonella enterica enterica serovar Typhi
auauauuuuccg

SEQ ID NO: 3633530 - RNA, 22 nt, Salmonella enterica enterica serovar Typhi
auaucaacccaguuuuuauccu

SEQ ID NO: 3633531 - RNA, 12 nt, Salmonella enterica enterica serovar Typhi
auaucaaugcgc

SEQ ID NO: 3633532 - RNA, 18 nt, Salmonella enterica enterica serovar Typhi
auaucaccaucuuuuugc

SEQ ID NO: 3633533 - RNA, 15 nt, Salmonella enterica enterica serovar Typhi
auaucacgcgcgcga

SEQ ID NO: 3633534 - RNA, 22 nt, Salmonella enterica enterica serovar Typhi
auaucagggcuuuuuucucgcg

SEQ ID NO: 3633535 - RNA, 13 nt, Salmonella enterica enterica serovar Typhi
auaucaucaucuc

SEQ ID NO: 3633536 - RNA, 13 nt, Salmonella enterica enterica serovar Typhi
auaucaucgucau

SEQ ID NO: 3633537 - RNA, 22 nt, Salmonella enterica enterica serovar Typhi
auaucaucgucauuaaugccua

SEQ ID NO: 3633538 - RNA, 22 nt, Salmonella enterica enterica serovar Typhi
auaucauucgcgucauacuuaa

SEQ ID NO: 3633539 - RNA, 13 nt, Salmonella enterica enterica serovar Typhi
auaucauuuuacc

SEQ ID NO: 3633540 - RNA, 21 nt, Salmonella enterica enterica serovar Typhi
auauccaccagcccaucuuuc

SEQ ID NO: 3633541 - RNA, 22 nt, Salmonella enterica enterica serovar Typhi
auauccagcucgcgcaggcgga

SEQ ID NO: 3633542 - RNA, 13 nt, Salmonella enterica enterica serovar Typhi
auauccaggagca

SEQ ID NO: 3633543 - RNA, 13 nt, Salmonella enterica enterica serovar Typhi
auauccaguugcg

SEQ ID NO: 3633544 - RNA, 20 nt, Salmonella enterica enterica serovar Typhi
auauccaguugcgccagcgu

SEQ ID NO: 3633545 - RNA, 23 nt, Salmonella enterica enterica serovar Typhi
auauccauugggggguuagugcu

SEQ ID NO: 3633546 - RNA, 14 nt, Salmonella enterica enterica serovar Typhi
auaucccgcaagaa

SEQ ID NO: 3633547 - RNA, 20 nt, Salmonella enterica enterica serovar Typhi
auaucccuauuagcacgccc

SEQ ID NO: 3633548 - RNA, 22 nt, Salmonella enterica enterica serovar Typhi
auauccgcugcggucaggaaug

SEQ ID NO: 3633549 - RNA, 14 nt, Salmonella enterica enterica serovar Typhi
auauccuaacuuau

SEQ ID NO: 3633550 - RNA, 13 nt, Salmonella enterica enterica serovar Typhi
auauccuccggca

SEQ ID NO: 3633551 - RNA, 22 nt, Salmonella enterica enterica serovar Typhi
auauccugcuuaauauccaguu

SEQ ID NO: 3633552 - RNA, 20 nt, Salmonella enterica enterica serovar Typhi
auauccuggcgagaauagaa

SEQ ID NO: 3633553 - RNA, 15 nt, Salmonella enterica enterica serovar Typhi
auauccuguaacuca

SEQ ID NO: 3633554 - RNA, 17 nt, Salmonella enterica enterica serovar Typhi
auauccuguaacucauc

SEQ ID NO: 3633555 - RNA, 22 nt, Salmonella enterica enterica serovar Typhi
auaucgacauaaguaaauaaca

SEQ ID NO: 3633556 - RNA, 14 nt, Salmonella enterica enterica serovar Typhi
auaucgacggucag

SEQ ID NO: 3633557 - RNA, 13 nt, Salmonella enterica enterica serovar Typhi
auaucgccauaca

SEQ ID NO: 3633558 - RNA, 13 nt, Salmonella enterica enterica serovar Typhi
auaucgccgccac

SEQ ID NO: 3633559 - RNA, 15 nt, Salmonella enterica enterica serovar Typhi
auaucgccugcggca

SEQ ID NO: 3633560 - RNA, 13 nt, Salmonella enterica enterica serovar Typhi
auaucgcgauaaa

SEQ ID NO: 3633561 - RNA, 17 nt, Salmonella enterica enterica serovar Typhi
auaucgcgauaaacuga

SEQ ID NO: 3633562 - RNA, 15 nt, Salmonella enterica enterica serovar Typhi
auaucgcgucaucaa

SEQ ID NO: 3633563 - RNA, 15 nt, Salmonella enterica enterica serovar Typhi
auaucgcuaaaccaa

SEQ ID NO: 3633564 - RNA, 14 nt, Salmonella enterica enterica serovar Typhi
auaucgcuaaccaa

SEQ ID NO: 3633565 - RNA, 20 nt, Salmonella enterica enterica serovar Typhi
auaucggcaauauugccgca

SEQ ID NO: 3633566 - RNA, 12 nt, Salmonella enterica enterica serovar Typhi
auaucggcugcu

SEQ ID NO: 3633567 - RNA, 20 nt, Salmonella enterica enterica serovar Typhi
auaucgguucaauacccuuu

SEQ ID NO: 3633568 - RNA, 18 nt, Salmonella enterica enterica serovar Typhi
auaucucuacccuauugu

SEQ ID NO: 3633569 - RNA, 11 nt, Salmonella enterica enterica serovar Typhi
auaucucuauu

SEQ ID NO: 3633570 - RNA, 16 nt, Salmonella enterica enterica serovar Typhi
auaucuggcgaggcuu

SEQ ID NO: 3633571 - RNA, 22 nt, Salmonella enterica enterica serovar Typhi
auaucuuccaggcuauccaaca

SEQ ID NO: 3633572 - RNA, 19 nt, Salmonella enterica enterica serovar Typhi
auaucuuucaguucgccgg

SEQ ID NO: 3633573 - RNA, 11 nt, Salmonella enterica enterica serovar Typhi
auauuuuaugg

SEQ ID NO: 3633574 - RNA, 12 nt, Salmonella enterica enterica serovar Typhi
auauuuucucaa

SEQ ID NO: 3633575 - RNA, 11 nt, Salmonella enterica enterica serovar Typhi
auauuuugcug

SEQ ID NO: 3633576 - RNA, 21 nt, Salmonella enterica enterica serovar Typhi
auauuuuguuuuaaauucaac

SEQ ID NO: 3633577 - RNA, 16 nt, Salmonella enterica enterica serovar Typhi
auauuuuucacacaua

SEQ ID NO: 3633578 - RNA, 17 nt, Salmonella enterica enterica serovar Typhi
auauuuuucagcuucug

SEQ ID NO: 3633579 - RNA, 12 nt, Salmonella enterica enterica serovar Typhi
auauuuuucccu

SEQ ID NO: 3633580 - RNA, 16 nt, Salmonella enterica enterica serovar Typhi
aucaaaaaaaaccaga

SEQ ID NO: 3633581 - RNA, 14 nt, Salmonella enterica enterica serovar Typhi
aucaaaacauuaga

SEQ ID NO: 3633582 - RNA, 20 nt, Salmonella enterica enterica serovar Typhi
aucaaaacuacgccaaugaa

SEQ ID NO: 3633583 - RNA, 15 nt, Salmonella enterica enterica serovar Typhi
aucaaaagugaucau

SEQ ID NO: 3633584 - RNA, 16 nt, Salmonella enterica enterica serovar Typhi
aucaaaaucaucgcca

SEQ ID NO: 3633585 - RNA, 19 nt, Salmonella enterica enterica serovar Typhi
aucaaacaaaccaaacuga

SEQ ID NO: 3633586 - RNA, 20 nt, Salmonella enterica enterica serovar Typhi
aucaaacaggacuucucccu

SEQ ID NO: 3633587 - RNA, 22 nt, Salmonella enterica enterica serovar Typhi
aucaaaccauucccgucccugc

SEQ ID NO: 3633588 - RNA, 20 nt, Salmonella enterica enterica serovar Typhi
aucaaacugaaaaucaaaua

SEQ ID NO: 3633589 - RNA, 19 nt, Salmonella enterica enterica serovar Typhi
aucaaacuuuuaaauugaa

SEQ ID NO: 3633590 - RNA, 21 nt, Salmonella enterica enterica serovar Typhi
aucaaacuuuuaaauugaaga

SEQ ID NO: 3633591 - RNA, 14 nt, Salmonella enterica enterica serovar Typhi
aucaaagaccuccg

SEQ ID NO: 3633592 - RNA, 15 nt, Salmonella enterica enterica serovar Typhi
aucaaagcgugauaa

SEQ ID NO: 3633593 - RNA, 20 nt, Salmonella enterica enterica serovar Typhi
aucaaaggcgucgccgaaua

SEQ ID NO: 3633594 - RNA, 20 nt, Salmonella enterica enterica serovar Typhi
aucaaauacgcuauuuaaaa

SEQ ID NO: 3633595 - RNA, 21 nt, Salmonella enterica enterica serovar Typhi
aucaaauacgcuauuuaaaaa

SEQ ID NO: 3633596 - RNA, 16 nt, Salmonella enterica enterica serovar Typhi
aucaaaugagaauaga

SEQ ID NO: 3633597 - RNA, 19 nt, Salmonella enterica enterica serovar Typhi
aucaacagcggagagacau

SEQ ID NO: 3633598 - RNA, 23 nt, Salmonella enterica enterica serovar Typhi
aucaacagcggagagacauuggu

SEQ ID NO: 3633599 - RNA, 20 nt, Salmonella enterica enterica serovar Typhi
aucaacagcgugagcugucg

SEQ ID NO: 3633600 - RNA, 15 nt, Salmonella enterica enterica serovar Typhi
aucaacauuauuaaa

SEQ ID NO: 3633601 - RNA, 19 nt, Salmonella enterica enterica serovar Typhi
aucaacauuauuaaaaugu

SEQ ID NO: 3633602 - RNA, 16 nt, Salmonella enterica enterica serovar Typhi
aucaacccguuuucau

SEQ ID NO: 3633603 - RNA, 16 nt, Salmonella enterica enterica serovar Typhi
aucaaccggguaaacg

SEQ ID NO: 3633604 - RNA, 15 nt, Salmonella enterica enterica serovar Typhi
aucaacgaaaucaga

SEQ ID NO: 3633605 - RNA, 23 nt, Salmonella enterica enterica serovar Typhi
aucaacgaccaugguucccgcca

SEQ ID NO: 3633606 - RNA, 18 nt, Salmonella enterica enterica serovar Typhi
aucaacgccgcgccauca

SEQ ID NO: 3633607 - RNA, 20 nt, Salmonella enterica enterica serovar Typhi
aucaacgccgcgccaucagg

SEQ ID NO: 3633608 - RNA, 17 nt, Salmonella enterica enterica serovar Typhi
aucaacgccuccaggcu

SEQ ID NO: 3633609 - RNA, 22 nt, Salmonella enterica enterica serovar Typhi
aucaacgguacggcauggcguc

SEQ ID NO: 3633610 - RNA, 20 nt, Salmonella enterica enterica serovar Typhi
aucaacgucgucgucuucaa

SEQ ID NO: 3633611 - RNA, 18 nt, Salmonella enterica enterica serovar Typhi
aucaacguuguccagcgg

SEQ ID NO: 3633612 - RNA, 14 nt, Salmonella enterica enterica serovar Typhi
aucaacucuccuuu

SEQ ID NO: 3633613 - RNA, 24 nt, Salmonella enterica enterica serovar Typhi
aucaacugggugugaucgccgcga

SEQ ID NO: 3633614 - RNA, 17 nt, Salmonella enterica enterica serovar Typhi
aucaagauugaguccau

SEQ ID NO: 3633615 - RNA, 21 nt, Salmonella enterica enterica serovar Typhi
aucaagcagugacguggcuuc

SEQ ID NO: 3633616 - RNA, 17 nt, Salmonella enterica enterica serovar Typhi
aucaagcccagcucagg

SEQ ID NO: 3633617 - RNA, 15 nt, Salmonella enterica enterica serovar Typhi
aucaagcccauguuc

SEQ ID NO: 3633618 - RNA, 19 nt, Salmonella enterica enterica serovar Typhi
aucaagccuaucaccgcga

SEQ ID NO: 3633619 - RNA, 21 nt, Salmonella enterica enterica serovar Typhi
aucaagcgguagcguuaucca

SEQ ID NO: 3633620 - RNA, 14 nt, Salmonella enterica enterica serovar Typhi
aucaaguacagcuu

SEQ ID NO: 3633621 - RNA, 22 nt, Salmonella enterica enterica serovar Typhi
aucaauaaaaucaccgcggcaa

SEQ ID NO: 3633622 - RNA, 17 nt, Salmonella enterica enterica serovar Typhi
aucaauaaccgccagca

SEQ ID NO: 3633623 - RNA, 19 nt, Salmonella enterica enterica serovar Typhi
aucaauaaccgccagcagu

SEQ ID NO: 3633624 - RNA, 20 nt, Salmonella enterica enterica serovar Typhi
aucaauaacgauaauuuuac

SEQ ID NO: 3633625 - RNA, 21 nt, Salmonella enterica enterica serovar Typhi
aucaauacagagauauuaaaa

SEQ ID NO: 3633626 - RNA, 21 nt, Salmonella enterica enterica serovar Typhi
aucaaucacuacggguuuuug

SEQ ID NO: 3633627 - RNA, 17 nt, Salmonella enterica enterica serovar Typhi
aucaaucgcuaucugac

SEQ ID NO: 3633628 - RNA, 15 nt, Salmonella enterica enterica serovar Typhi
aucaaucugcuuuuu

SEQ ID NO: 3633629 - RNA, 20 nt, Salmonella enterica enterica serovar Typhi
aucaaugcgcguaauuugcg

SEQ ID NO: 3633630 - RNA, 18 nt, Salmonella enterica enterica serovar Typhi
aucaauguaaaacgguau

SEQ ID NO: 3633631 - RNA, 19 nt, Salmonella enterica enterica serovar Typhi
aucaaugugcucaaccaug

SEQ ID NO: 3633632 - RNA, 22 nt, Salmonella enterica enterica serovar Typhi
aucaaugugucauaacgaccaa

SEQ ID NO: 3633633 - RNA, 18 nt, Salmonella enterica enterica serovar Typhi
aucaauuucauauuauua

SEQ ID NO: 3633634 - RNA, 19 nt, Salmonella enterica enterica serovar Typhi
aucaauuugccuuuauuca

SEQ ID NO: 3633635 - RNA, 21 nt, Salmonella enterica enterica serovar Typhi
aucaauuuugcgccuaccgcc

SEQ ID NO: 3633636 - RNA, 12 nt, Salmonella enterica enterica serovar Typhi
aucaauuuuucg

SEQ ID NO: 3633637 - RNA, 22 nt, Salmonella enterica enterica serovar Typhi
aucaauuuuucgcccggcucau

SEQ ID NO: 3633638 - RNA, 19 nt, Salmonella enterica enterica serovar Typhi
aucacaaaauggcugauaa

SEQ ID NO: 3633639 - RNA, 18 nt, Salmonella enterica enterica serovar Typhi
aucacaaauaacagacga

SEQ ID NO: 3633640 - RNA, 21 nt, Salmonella enterica enterica serovar Typhi
aucacaaucagccacggcaac

SEQ ID NO: 3633641 - RNA, 23 nt, Salmonella enterica enterica serovar Typhi
aucacaauuacgcaagagagcaa

SEQ ID NO: 3633642 - RNA, 13 nt, Salmonella enterica enterica serovar Typhi
aucacacauaucg

SEQ ID NO: 3633643 - RNA, 19 nt, Salmonella enterica enterica serovar Typhi
aucacacauaucgccagcc

SEQ ID NO: 3633644 - RNA, 22 nt, Salmonella enterica enterica serovar Typhi
aucacaccaacgcuggcccggc

SEQ ID NO: 3633645 - RNA, 12 nt, Salmonella enterica enterica serovar Typhi
aucacagacaga

SEQ ID NO: 3633646 - RNA, 21 nt, Salmonella enterica enterica serovar Typhi
aucacagggggaacauuuaag

SEQ ID NO: 3633647 - RNA, 17 nt, Salmonella enterica enterica serovar Typhi
aucacauuaugcugggu

SEQ ID NO: 3633648 - RNA, 16 nt, Salmonella enterica enterica serovar Typhi
aucaccaaguagacag

SEQ ID NO: 3633649 - RNA, 13 nt, Salmonella enterica enterica serovar Typhi
aucaccaccucaa

SEQ ID NO: 3633650 - RNA, 18 nt, Salmonella enterica enterica serovar Typhi
aucaccagaucggcaucu

SEQ ID NO: 3633651 - RNA, 20 nt, Salmonella enterica enterica serovar Typhi
aucaccagcccgaauccacu

SEQ ID NO: 3633652 - RNA, 22 nt, Salmonella enterica enterica serovar Typhi
aucaccagcgcaucucccugcc

SEQ ID NO: 3633653 - RNA, 18 nt, Salmonella enterica enterica serovar Typhi
aucaccauucccagcgcc

SEQ ID NO: 3633654 - RNA, 17 nt, Salmonella enterica enterica serovar Typhi
aucacccaacguucaug

SEQ ID NO: 3633655 - RNA, 15 nt, Salmonella enterica enterica serovar Typhi
aucacccugaauuuc

SEQ ID NO: 3633656 - RNA, 19 nt, Salmonella enterica enterica serovar Typhi
aucacccugaauuucaaua

SEQ ID NO: 3633657 - RNA, 18 nt, Salmonella enterica enterica serovar Typhi
aucaccgccagucccagc

SEQ ID NO: 3633658 - RNA, 17 nt, Salmonella enterica enterica serovar Typhi
aucagcgauugcgccag

SEQ ID NO: 3633659 - RNA, 14 nt, Salmonella enterica enterica serovar Typhi
aucagcgccaccac

SEQ ID NO: 3633660 - RNA, 14 nt, Salmonella enterica enterica serovar Typhi
aucagcgccagccc

SEQ ID NO: 3633661 - RNA, 15 nt, Salmonella enterica enterica serovar Typhi
aucagcgccagcccu

SEQ ID NO: 3633662 - RNA, 19 nt, Salmonella enterica enterica serovar Typhi
aucagcgccgucgccauca

SEQ ID NO: 3633663 - RNA, 19 nt, Salmonella enterica enterica serovar Typhi
aucagcgcggcgugaucaa

SEQ ID NO: 3633664 - RNA, 15 nt, Salmonella enterica enterica serovar Typhi
aucagcgcuaccagc

SEQ ID NO: 3633665 - RNA, 20 nt, Salmonella enterica enterica serovar Typhi
aucagcuuuucaugacgcga

SEQ ID NO: 3633666 - RNA, 21 nt, Salmonella enterica enterica serovar Typhi
aucaggaaaaagggaauaaua

SEQ ID NO: 3633667 - RNA, 15 nt, Salmonella enterica enterica serovar Typhi
aucaggaaaucuucc

SEQ ID NO: 3633668 - RNA, 18 nt, Salmonella enterica enterica serovar Typhi
aucaggaaaucuuccagu

SEQ ID NO: 3633669 - RNA, 22 nt, Salmonella enterica enterica serovar Typhi
aucaggaaauucucagaaacaa

SEQ ID NO: 3633670 - RNA, 13 nt, Salmonella enterica enterica serovar Typhi
aucaggacaucaa

SEQ ID NO: 3633671 - RNA, 21 nt, Salmonella enterica enterica serovar Typhi
aucaggaguaaauaacaaaag

SEQ ID NO: 3633672 - RNA, 14 nt, Salmonella enterica enterica serovar Typhi
aucaggaucaaaau

SEQ ID NO: 3633673 - RNA, 14 nt, Salmonella enterica enterica serovar Typhi
aucaggaucuucau

SEQ ID NO: 3633674 - RNA, 16 nt, Salmonella enterica enterica serovar Typhi
aucaggaugaauauga

SEQ ID NO: 3633675 - RNA, 15 nt, Salmonella enterica enterica serovar Typhi
aucaggauuauuaca

SEQ ID NO: 3633676 - RNA, 22 nt, Salmonella enterica enterica serovar Typhi
aucaggauucgacggccagcgc

SEQ ID NO: 3633677 - RNA, 21 nt, Salmonella enterica enterica serovar Typhi
aucaggcaaaaaucgucauca

SEQ ID NO: 3633678 - RNA, 19 nt, Salmonella enterica enterica serovar Typhi
aucaggcaauaaacaucag

SEQ ID NO: 3633679 - RNA, 17 nt, Salmonella enterica enterica serovar Typhi
aucaggcaaugucugcc

SEQ ID NO: 3633680 - RNA, 20 nt, Salmonella enterica enterica serovar Typhi
aucaggcacacguuaaaccc

SEQ ID NO: 3633681 - RNA, 15 nt, Salmonella enterica enterica serovar Typhi
aucaggcauaaaccu

SEQ ID NO: 3633682 - RNA, 16 nt, Salmonella enterica enterica serovar Typhi
aucaggcauaaaccua

SEQ ID NO: 3633683 - RNA, 17 nt, Salmonella enterica enterica serovar Typhi
aucaggcauccugcccu

SEQ ID NO: 3633684 - RNA, 18 nt, Salmonella enterica enterica serovar Typhi
aucaggcaugccaaacca

SEQ ID NO: 3633685 - RNA, 19 nt, Salmonella enterica enterica serovar Typhi
aucaggcauggcagcaggg

SEQ ID NO: 3633686 - RNA, 19 nt, Salmonella enterica enterica serovar Typhi
aucaggccaagcaacauuu

SEQ ID NO: 3633687 - RNA, 13 nt, Salmonella enterica enterica serovar Typhi
aucaggcccagua

SEQ ID NO: 3633688 - RNA, 16 nt, Salmonella enterica enterica serovar Typhi
aucaggccuacaaggc

SEQ ID NO: 3633689 - RNA, 17 nt, Salmonella enterica enterica serovar Typhi
aucaggccuacauccgg

SEQ ID NO: 3633690 - RNA, 15 nt, Salmonella enterica enterica serovar Typhi
aucaggccuaccagc

SEQ ID NO: 3633691 - RNA, 17 nt, Salmonella enterica enterica serovar Typhi
aucaggccuaccagccg

SEQ ID NO: 3633692 - RNA, 21 nt, Salmonella enterica enterica serovar Typhi
aucaggccugccugaucgcca

SEQ ID NO: 3633693 - RNA, 22 nt, Salmonella enterica enterica serovar Typhi
aucaggccugccugaucgccac

SEQ ID NO: 3633694 - RNA, 21 nt, Salmonella enterica enterica serovar Typhi
aucaggccugugguaugugcc

SEQ ID NO: 3633695 - RNA, 20 nt, Salmonella enterica enterica serovar Typhi
aucaggcgucagcauggugu

SEQ ID NO: 3633696 - RNA, 15 nt, Salmonella enterica enterica serovar Typhi
aucaggcguuacaga

SEQ ID NO: 3633697 - RNA, 19 nt, Salmonella enterica enterica serovar Typhi
aucaggcuuugcgccaucg

SEQ ID NO: 3633698 - RNA, 14 nt, Salmonella enterica enterica serovar Typhi
aucagggaaaaaug

SEQ ID NO: 3633699 - RNA, 21 nt, Salmonella enterica enterica serovar Typhi
aucaggggcgaacccaucagg

SEQ ID NO: 3633700 - RNA, 20 nt, Salmonella enterica enterica serovar Typhi
aucaguaacugacgaccggg

SEQ ID NO: 3633701 - RNA, 22 nt, Salmonella enterica enterica serovar Typhi
aucaguacgaccccgccgagaa

SEQ ID NO: 3633702 - RNA, 22 nt, Salmonella enterica enterica serovar Typhi
aucaguccccagcguaccacgc

SEQ ID NO: 3633703 - RNA, 19 nt, Salmonella enterica enterica serovar Typhi
aucaguccgggcauaaccu

SEQ ID NO: 3633704 - RNA, 14 nt, Salmonella enterica enterica serovar Typhi
aucagucgcagcgg

SEQ ID NO: 3633705 - RNA, 23 nt, Salmonella enterica enterica serovar Typhi
aucagucgcagcggcugcgccug

SEQ ID NO: 3633706 - RNA, 21 nt, Salmonella enterica enterica serovar Typhi
aucagugaccugaacauacuu

SEQ ID NO: 3633707 - RNA, 19 nt, Salmonella enterica enterica serovar Typhi
aucagugcaucuucacugu

SEQ ID NO: 3633708 - RNA, 19 nt, Salmonella enterica enterica serovar Typhi
aucaguggcggcaaaaaau

SEQ ID NO: 3633709 - RNA, 20 nt, Salmonella enterica enterica serovar Typhi
aucaguggcggcaaaaaaua

SEQ ID NO: 3633710 - RNA, 20 nt, Salmonella enterica enterica serovar Typhi
aucaguggggccuuuuuaau

SEQ ID NO: 3633711 - RNA, 19 nt, Salmonella enterica enterica serovar Typhi
aucaguuccaaucucuuuu

SEQ ID NO: 3633712 - RNA, 15 nt, Salmonella enterica enterica serovar Typhi
aucaguugcaggaag

SEQ ID NO: 3633713 - RNA, 20 nt, Salmonella enterica enterica serovar Typhi
aucaguuuaaccguuccaac

SEQ ID NO: 3633714 - RNA, 14 nt, Salmonella enterica enterica serovar Typhi
aucauaaaaggcau

SEQ ID NO: 3633715 - RNA, 21 nt, Salmonella enterica enterica serovar Typhi
aucauaaaaggcugagaaggu

SEQ ID NO: 3633716 - RNA, 20 nt, Salmonella enterica enterica serovar Typhi
aucauaaacgccugacgaua

SEQ ID NO: 3633717 - RNA, 18 nt, Salmonella enterica enterica serovar Typhi
aucauaaagcgcccggug

SEQ ID NO: 3633718 - RNA, 13 nt, Salmonella enterica enterica serovar Typhi
aucauaagggagc

SEQ ID NO: 3633719 - RNA, 22 nt, Salmonella enterica enterica serovar Typhi
aucauaagggagcugacugcaa

SEQ ID NO: 3633720 - RNA, 14 nt, Salmonella enterica enterica serovar Typhi
aucauacugaacuc

SEQ ID NO: 3633721 - RNA, 20 nt, Salmonella enterica enterica serovar Typhi
aucauacugaagauaaacag

SEQ ID NO: 3633722 - RNA, 22 nt, Salmonella enterica enterica serovar Typhi
aucauagcccugauuaaagaua

SEQ ID NO: 3633723 - RNA, 23 nt, Salmonella enterica enterica serovar Typhi
aucauagcccugauuaaagauaa

SEQ ID NO: 3633724 - RNA, 19 nt, Salmonella enterica enterica serovar Typhi
aucauaguuuuuccccauc

SEQ ID NO: 3633725 - RNA, 20 nt, Salmonella enterica enterica serovar Typhi
aucauaguuuuuccccauca

SEQ ID NO: 3633726 - RNA, 17 nt, Salmonella enterica enterica serovar Typhi
aucauaucaauauguuc

SEQ ID NO: 3633727 - RNA, 18 nt, Salmonella enterica enterica serovar Typhi
aucaucaaguaccgugaa

SEQ ID NO: 3633728 - RNA, 15 nt, Salmonella enterica enterica serovar Typhi
aucaucacgaucgag

SEQ ID NO: 3633729 - RNA, 15 nt, Salmonella enterica enterica serovar Typhi
aucaucagaccgaua

SEQ ID NO: 3633730 - RNA, 15 nt, Salmonella enterica enterica serovar Typhi
aucaucagggcgaaa

SEQ ID NO: 3633731 - RNA, 19 nt, Salmonella enterica enterica serovar Typhi
aucaucaucggcacagcca

SEQ ID NO: 3633732 - RNA, 21 nt, Salmonella enterica enterica serovar Typhi
aucaucaucucugucgaccau

SEQ ID NO: 3633733 - RNA, 21 nt, Salmonella enterica enterica serovar Typhi
aucaucauggcugauggcgaa

SEQ ID NO: 3633734 - RNA, 17 nt, Salmonella enterica enterica serovar Typhi
aucauccagucagcaau

SEQ ID NO: 3633735 - RNA, 20 nt, Salmonella enterica enterica serovar Typhi
aucauccagucagcaauuaa

SEQ ID NO: 3633736 - RNA, 19 nt, Salmonella enterica enterica serovar Typhi
aucauccccaccgcugaug

SEQ ID NO: 3633737 - RNA, 17 nt, Salmonella enterica enterica serovar Typhi
aucauccccggcaggcu

SEQ ID NO: 3633738 - RNA, 21 nt, Salmonella enterica enterica serovar Typhi
aucauccccguuuucgccgga

SEQ ID NO: 3633739 - RNA, 20 nt, Salmonella enterica enterica serovar Typhi
aucaucccgcccagcaacac

SEQ ID NO: 3633740 - RNA, 16 nt, Salmonella enterica enterica serovar Typhi
aucauccugauuuuac

SEQ ID NO: 3633741 - RNA, 16 nt, Salmonella enterica enterica serovar Typhi
aucaucgcgaucgcca

SEQ ID NO: 3633742 - RNA, 13 nt, Salmonella enterica enterica serovar Typhi
aucaucgcuauca

SEQ ID NO: 3633743 - RNA, 15 nt, Salmonella enterica enterica serovar Typhi
auccaguugaugaug

SEQ ID NO: 3633744 - RNA, 14 nt, Salmonella enterica enterica serovar Typhi
auccaguuuauauu

SEQ ID NO: 3633745 - RNA, 15 nt, Salmonella enterica enterica serovar Typhi
auccaguuuuuucca

SEQ ID NO: 3633746 - RNA, 17 nt, Salmonella enterica enterica serovar Typhi
auccauaagaugaaaga

SEQ ID NO: 3633747 - RNA, 18 nt, Salmonella enterica enterica serovar Typhi
auccauaauuuuccccag

SEQ ID NO: 3633748 - RNA, 23 nt, Salmonella enterica enterica serovar Typhi
auccauaccgcuuuguaaaacau

SEQ ID NO: 3633749 - RNA, 14 nt, Salmonella enterica enterica serovar Typhi
auccauauucuucg

SEQ ID NO: 3633750 - RNA, 19 nt, Salmonella enterica enterica serovar Typhi
auccaugccagcgcgggcg

SEQ ID NO: 3633751 - RNA, 16 nt, Salmonella enterica enterica serovar Typhi
auccauguacgcaggc

SEQ ID NO: 3633752 - RNA, 21 nt, Salmonella enterica enterica serovar Typhi
auccauguacgcaggcgacug

SEQ ID NO: 3633753 - RNA, 14 nt, Salmonella enterica enterica serovar Typhi
auccauguugccau

SEQ ID NO: 3633754 - RNA, 16 nt, Salmonella enterica enterica serovar Typhi
auccauguugccauga

SEQ ID NO: 3633755 - RNA, 14 nt, Salmonella enterica enterica serovar Typhi
auccauuaaaaucu

SEQ ID NO: 3633756 - RNA, 16 nt, Salmonella enterica enterica serovar Typhi
auccauuuuaaauaca

SEQ ID NO: 3633757 - RNA, 20 nt, Salmonella enterica enterica serovar Typhi
aucccaccaauugccacaua

SEQ ID NO: 3633758 - RNA, 17 nt, Salmonella enterica enterica serovar Typhi
aucccaccauaaagcga

SEQ ID NO: 3633759 - RNA, 18 nt, Salmonella enterica enterica serovar Typhi
aucccaccauaaagcgaa

SEQ ID NO: 3633760 - RNA, 15 nt, Salmonella enterica enterica serovar Typhi
aucccaccggaaaug

SEQ ID NO: 3633761 - RNA, 14 nt, Salmonella enterica enterica serovar Typhi
aucccacugcacgc

SEQ ID NO: 3633762 - RNA, 16 nt, Salmonella enterica enterica serovar Typhi
aucccacuuaggcagc

SEQ ID NO: 3633763 - RNA, 13 nt, Salmonella enterica enterica serovar Typhi
aucccagaaaaug

SEQ ID NO: 3633764 - RNA, 16 nt, Salmonella enterica enterica serovar Typhi
aucccagggcggcguc

SEQ ID NO: 3633765 - RNA, 21 nt, Salmonella enterica enterica serovar Typhi
aucccauccgggccacucucc

SEQ ID NO: 3633766 - RNA, 17 nt, Salmonella enterica enterica serovar Typhi
aucccaugcaccagucc

SEQ ID NO: 3633767 - RNA, 19 nt, Salmonella enterica enterica serovar Typhi
aucccaugcaccaguccca

SEQ ID NO: 3633768 - RNA, 22 nt, Salmonella enterica enterica serovar Typhi
aucccauuagggcuauuuuacu

SEQ ID NO: 3633769 - RNA, 18 nt, Salmonella enterica enterica serovar Typhi
auccccagcaucaugucc

SEQ ID NO: 3633770 - RNA, 12 nt, Salmonella enterica enterica serovar Typhi
auccccagcgcu

SEQ ID NO: 3633771 - RNA, 17 nt, Salmonella enterica enterica serovar Typhi
auccccagcgcuccacc

SEQ ID NO: 3633772 - RNA, 14 nt, Salmonella enterica enterica serovar Typhi
auccccccuuuuuu

SEQ ID NO: 3633773 - RNA, 15 nt, Salmonella enterica enterica serovar Typhi
aucccccugccacaa

SEQ ID NO: 3633774 - RNA, 13 nt, Salmonella enterica enterica serovar Typhi
aucccccuggccc

SEQ ID NO: 3633775 - RNA, 12 nt, Salmonella enterica enterica serovar Typhi
auccccgcuggc

SEQ ID NO: 3633776 - RNA, 13 nt, Salmonella enterica enterica serovar Typhi
auccccggcaacc

SEQ ID NO: 3633777 - RNA, 13 nt, Salmonella enterica enterica serovar Typhi
auccccugcuccu

SEQ ID NO: 3633778 - RNA, 16 nt, Salmonella enterica enterica serovar Typhi
auccccuucaggaaua

SEQ ID NO: 3633779 - RNA, 22 nt, Salmonella enterica enterica serovar Typhi
aucccgacccauacucuuuccc

SEQ ID NO: 3633780 - RNA, 13 nt, Salmonella enterica enterica serovar Typhi
aucccgcaucacc

SEQ ID NO: 3633781 - RNA, 15 nt, Salmonella enterica enterica serovar Typhi
aucccgccaaaccgg

SEQ ID NO: 3633782 - RNA, 19 nt, Salmonella enterica enterica serovar Typhi
aucccgccagcggcgccau

SEQ ID NO: 3633783 - RNA, 21 nt, Salmonella enterica enterica serovar Typhi
aucccgccaucguccagccau

SEQ ID NO: 3633784 - RNA, 18 nt, Salmonella enterica enterica serovar Typhi
aucccgccgcauccuuau

SEQ ID NO: 3633785 - RNA, 14 nt, Salmonella enterica enterica serovar Typhi
aucccgccgcuggc

SEQ ID NO: 3633786 - RNA, 23 nt, Salmonella enterica enterica serovar Typhi
aucccgccuugcggcgccaggac

SEQ ID NO: 3633787 - RNA, 19 nt, Salmonella enterica enterica serovar Typhi
aucccgggcgauaaaccag

SEQ ID NO: 3633788 - RNA, 22 nt, Salmonella enterica enterica serovar Typhi
aucccgggcgauaaaccagccc

SEQ ID NO: 3633789 - RNA, 12 nt, Salmonella enterica enterica serovar Typhi
aucccguagcgu

SEQ ID NO: 3633790 - RNA, 14 nt, Salmonella enterica enterica serovar Typhi
aucccgucccacca

SEQ ID NO: 3633791 - RNA, 21 nt, Salmonella enterica enterica serovar Typhi
aucccguuuucgucccagcgc

SEQ ID NO: 3633792 - RNA, 14 nt, Salmonella enterica enterica serovar Typhi
aucccuaauaaaau

SEQ ID NO: 3633793 - RNA, 17 nt, Salmonella enterica enterica serovar Typhi
aucccuaauaagguauu

SEQ ID NO: 3633794 - RNA, 18 nt, Salmonella enterica enterica serovar Typhi
aucccucaccucccccgc

SEQ ID NO: 3633795 - RNA, 14 nt, Salmonella enterica enterica serovar Typhi
aucccugcaaacua

SEQ ID NO: 3633796 - RNA, 18 nt, Salmonella enterica enterica serovar Typhi
aucccuguucaaaagccu

SEQ ID NO: 3633797 - RNA, 21 nt, Salmonella enterica enterica serovar Typhi
aucccuuucaaaaaagagaag

SEQ ID NO: 3633798 - RNA, 19 nt, Salmonella enterica enterica serovar Typhi
auccgaaaugaccaccgca

SEQ ID NO: 3633799 - RNA, 15 nt, Salmonella enterica enterica serovar Typhi
auccgacaacaugaa

SEQ ID NO: 3633800 - RNA, 16 nt, Salmonella enterica enterica serovar Typhi
auccgacagauagugg

SEQ ID NO: 3633801 - RNA, 12 nt, Salmonella enterica enterica serovar Typhi
auccgacaugau

SEQ ID NO: 3633802 - RNA, 18 nt, Salmonella enterica enterica serovar Typhi
auccgacgcucaaccggu

SEQ ID NO: 3633803 - RNA, 20 nt, Salmonella enterica enterica serovar Typhi
auccgcaaauuacugugccc

SEQ ID NO: 3633804 - RNA, 23 nt, Salmonella enterica enterica serovar Typhi
auccgcaacugaaaccaggcacu

SEQ ID NO: 3633805 - RNA, 13 nt, Salmonella enterica enterica serovar Typhi
auccgcacggcgg

SEQ ID NO: 3633806 - RNA, 15 nt, Salmonella enterica enterica serovar Typhi
auccgcagauccagc

SEQ ID NO: 3633807 - RNA, 17 nt, Salmonella enterica enterica serovar Typhi
auccgcagauccagcac

SEQ ID NO: 3633808 - RNA, 18 nt, Salmonella enterica enterica serovar Typhi
auccgcagauccagcacg

SEQ ID NO: 3633809 - RNA, 22 nt, Salmonella enterica enterica serovar Typhi
auccgcagauccagcacggccu

SEQ ID NO: 3633810 - RNA, 16 nt, Salmonella enterica enterica serovar Typhi
auccgccagccgccau

SEQ ID NO: 3633811 - RNA, 14 nt, Salmonella enterica enterica serovar Typhi
auccgccagcgccu

SEQ ID NO: 3633812 - RNA, 19 nt, Salmonella enterica enterica serovar Typhi
auccgccagugaauccacc

SEQ ID NO: 3633813 - RNA, 16 nt, Salmonella enterica enterica serovar Typhi
auccgccgagggcauu

SEQ ID NO: 3633814 - RNA, 12 nt, Salmonella enterica enterica serovar Typhi
auccgccgccca

SEQ ID NO: 3633815 - RNA, 19 nt, Salmonella enterica enterica serovar Typhi
auccgccgcccagcgggua

SEQ ID NO: 3633816 - RNA, 15 nt, Salmonella enterica enterica serovar Typhi
auccgcgaauaccuu

SEQ ID NO: 3633817 - RNA, 14 nt, Salmonella enterica enterica serovar Typhi
auccgcgccgccgc

SEQ ID NO: 3633818 - RNA, 20 nt, Salmonella enterica enterica serovar Typhi
auccgcgccgccgccgaagg

SEQ ID NO: 3633819 - RNA, 20 nt, Salmonella enterica enterica serovar Typhi
auccgcuucucuauacggcg

SEQ ID NO: 3633820 - RNA, 16 nt, Salmonella enterica enterica serovar Typhi
auccggauauucugca

SEQ ID NO: 3633821 - RNA, 19 nt, Salmonella enterica enterica serovar Typhi
auccggcaaaagaggcuaa

SEQ ID NO: 3633822 - RNA, 23 nt, Salmonella enterica enterica serovar Typhi
auccggcaacacguuugcccgau

SEQ ID NO: 3633823 - RNA, 16 nt, Salmonella enterica enterica serovar Typhi
auccggcaagcgcugg

SEQ ID NO: 3633824 - RNA, 14 nt, Salmonella enterica enterica serovar Typhi
auccggcagccaau

SEQ ID NO: 3633825 - RNA, 23 nt, Salmonella enterica enterica serovar Typhi
auccggcaguuauuuuacgggcg

SEQ ID NO: 3633826 - RNA, 15 nt, Salmonella enterica enterica serovar Typhi
auccggcauuaccgc

SEQ ID NO: 3633827 - RNA, 11 nt, Salmonella enterica enterica serovar Typhi
auccggcauuu

SEQ ID NO: 3633828 - RNA, 18 nt, Salmonella enterica enterica serovar Typhi
auccggcauuuuucucag

SEQ ID NO: 3633829 - RNA, 16 nt, Salmonella enterica enterica serovar Typhi
aucgcaggaugcgcug

SEQ ID NO: 3633830 - RNA, 23 nt, Salmonella enterica enterica serovar Typhi
aucgcauagacgcccugcaaagc

SEQ ID NO: 3633831 - RNA, 18 nt, Salmonella enterica enterica serovar Typhi
aucgcaugacuacgaauc

SEQ ID NO: 3633832 - RNA, 22 nt, Salmonella enterica enterica serovar Typhi
aucgcauugagcaggggcuccu

SEQ ID NO: 3633833 - RNA, 12 nt, Salmonella enterica enterica serovar Typhi
aucgccaaacca

SEQ ID NO: 3633834 - RNA, 13 nt, Salmonella enterica enterica serovar Typhi
aucgccaaaccag

SEQ ID NO: 3633835 - RNA, 16 nt, Salmonella enterica enterica serovar Typhi
aucgccacaugcggca

SEQ ID NO: 3633836 - RNA, 19 nt, Salmonella enterica enterica serovar Typhi
aucgccaccguaacuacaa

SEQ ID NO: 3633837 - RNA, 12 nt, Salmonella enterica enterica serovar Typhi
aucgccagcuuc

SEQ ID NO: 3633838 - RNA, 18 nt, Salmonella enterica enterica serovar Typhi
aucgccaucauagcccau

SEQ ID NO: 3633839 - RNA, 14 nt, Salmonella enterica enterica serovar Typhi
aucgccauccugca

SEQ ID NO: 3633840 - RNA, 19 nt, Salmonella enterica enterica serovar Typhi
aucgccauccugcaccgua

SEQ ID NO: 3633841 - RNA, 21 nt, Salmonella enterica enterica serovar Typhi
aucgccaucgauagcagcgcu

SEQ ID NO: 3633842 - RNA, 13 nt, Salmonella enterica enterica serovar Typhi
aucgccauuacgc

SEQ ID NO: 3633843 - RNA, 18 nt, Salmonella enterica enterica serovar Typhi
aucgccauuacgccgacg

SEQ ID NO: 3633844 - RNA, 14 nt, Salmonella enterica enterica serovar Typhi
aucgcccaucacau

SEQ ID NO: 3633845 - RNA, 15 nt, Salmonella enterica enterica serovar Typhi
aucgcccaucacaug

SEQ ID NO: 3633846 - RNA, 15 nt, Salmonella enterica enterica serovar Typhi
aucgccccauuggcg

SEQ ID NO: 3633847 - RNA, 17 nt, Salmonella enterica enterica serovar Typhi
aucgcccggccuccggu

SEQ ID NO: 3633848 - RNA, 19 nt, Salmonella enterica enterica serovar Typhi
aucgccgaaagcgaucaca

SEQ ID NO: 3633849 - RNA, 16 nt, Salmonella enterica enterica serovar Typhi
aucgccgaagcggcag

SEQ ID NO: 3633850 - RNA, 21 nt, Salmonella enterica enterica serovar Typhi
aucgccgcccaguggcaaaau

SEQ ID NO: 3633851 - RNA, 23 nt, Salmonella enterica enterica serovar Typhi
aucgccgcccgcaugguaaacgc

SEQ ID NO: 3633852 - RNA, 19 nt, Salmonella enterica enterica serovar Typhi
aucgccgcgacagucgcag

SEQ ID NO: 3633853 - RNA, 22 nt, Salmonella enterica enterica serovar Typhi
aucgccgcgccggacuccagca

SEQ ID NO: 3633854 - RNA, 22 nt, Salmonella enterica enterica serovar Typhi
aucgccggagccgccuggccug

SEQ ID NO: 3633855 - RNA, 23 nt, Salmonella enterica enterica serovar Typhi
aucgccguauuucacuuuugccg

SEQ ID NO: 3633856 - RNA, 13 nt, Salmonella enterica enterica serovar Typhi
aucgccucaacca

SEQ ID NO: 3633857 - RNA, 18 nt, Salmonella enterica enterica serovar Typhi
aucgccuccagacuggcg

SEQ ID NO: 3633858 - RNA, 22 nt, Salmonella enterica enterica serovar Typhi
aucgccuccagacuggcgaccg

SEQ ID NO: 3633859 - RNA, 22 nt, Salmonella enterica enterica serovar Typhi
aucgccucccugccuaaagaaa

SEQ ID NO: 3633860 - RNA, 23 nt, Salmonella enterica enterica serovar Typhi
aucgccucccugccuaaagaaaa

SEQ ID NO: 3633861 - RNA, 16 nt, Salmonella enterica enterica serovar Typhi
aucgccugaucgcgca

SEQ ID NO: 3633862 - RNA, 15 nt, Salmonella enterica enterica serovar Typhi
aucgccugauggcgc

SEQ ID NO: 3633863 - RNA, 16 nt, Salmonella enterica enterica serovar Typhi
aucgccugccagcgcu

SEQ ID NO: 3633864 - RNA, 15 nt, Salmonella enterica enterica serovar Typhi
aucgccugcgcgccu

SEQ ID NO: 3633865 - RNA, 17 nt, Salmonella enterica enterica serovar Typhi
aucgccugguaaggcaa

SEQ ID NO: 3633866 - RNA, 13 nt, Salmonella enterica enterica serovar Typhi
aucgcgagaaaau

SEQ ID NO: 3633867 - RNA, 19 nt, Salmonella enterica enterica serovar Typhi
aucgcgagcacuuuuuccu

SEQ ID NO: 3633868 - RNA, 19 nt, Salmonella enterica enterica serovar Typhi
aucgcgauacugccgccca

SEQ ID NO: 3633869 - RNA, 21 nt, Salmonella enterica enterica serovar Typhi
aucgcgauaucaacccaguuu

SEQ ID NO: 3633870 - RNA, 20 nt, Salmonella enterica enterica serovar Typhi
aucgcgauuccggacaacgc

SEQ ID NO: 3633871 - RNA, 20 nt, Salmonella enterica enterica serovar Typhi
aucgcgcacaugcugugcgc

SEQ ID NO: 3633872 - RNA, 12 nt, Salmonella enterica enterica serovar Typhi
aucgcgccaucg

SEQ ID NO: 3633873 - RNA, 19 nt, Salmonella enterica enterica serovar Typhi
aucgcgccggucgccagca

SEQ ID NO: 3633874 - RNA, 16 nt, Salmonella enterica enterica serovar Typhi
aucgcgcgcaaaugca

SEQ ID NO: 3633875 - RNA, 12 nt, Salmonella enterica enterica serovar Typhi
aucgcgcggcga

SEQ ID NO: 3633876 - RNA, 15 nt, Salmonella enterica enterica serovar Typhi
aucgcgcugauauuu

SEQ ID NO: 3633877 - RNA, 22 nt, Salmonella enterica enterica serovar Typhi
aucgcggcccucuaagcgcuca

SEQ ID NO: 3633878 - RNA, 13 nt, Salmonella enterica enterica serovar Typhi
aucgcggcgcuga

SEQ ID NO: 3633879 - RNA, 23 nt, Salmonella enterica enterica serovar Typhi
aucgcgggcaaucaaaugcgcau

SEQ ID NO: 3633880 - RNA, 15 nt, Salmonella enterica enterica serovar Typhi
aucgcggggcaacag

SEQ ID NO: 3633881 - RNA, 19 nt, Salmonella enterica enterica serovar Typhi
aucgcggucagcggcgcgc

SEQ ID NO: 3633882 - RNA, 18 nt, Salmonella enterica enterica serovar Typhi
aucgcgguuuuccggguc

SEQ ID NO: 3633883 - RNA, 16 nt, Salmonella enterica enterica serovar Typhi
aucgcguacaggaugu

SEQ ID NO: 3633884 - RNA, 21 nt, Salmonella enterica enterica serovar Typhi
aucgcguuacggccaaauuua

SEQ ID NO: 3633885 - RNA, 20 nt, Salmonella enterica enterica serovar Typhi
aucgcguuguaaucgccuga

SEQ ID NO: 3633886 - RNA, 18 nt, Salmonella enterica enterica serovar Typhi
aucgcguuuuccagcauc

SEQ ID NO: 3633887 - RNA, 20 nt, Salmonella enterica enterica serovar Typhi
aucgcguuuuccagcauccu

SEQ ID NO: 3633888 - RNA, 21 nt, Salmonella enterica enterica serovar Typhi
aucgcuaaccaaaccagaugc

SEQ ID NO: 3633889 - RNA, 15 nt, Salmonella enterica enterica serovar Typhi
aucgcuaauuuuuaa

SEQ ID NO: 3633890 - RNA, 18 nt, Salmonella enterica enterica serovar Typhi
aucgcuccauucugucga

SEQ ID NO: 3633891 - RNA, 13 nt, Salmonella enterica enterica serovar Typhi
aucgcuccggaac

SEQ ID NO: 3633892 - RNA, 18 nt, Salmonella enterica enterica serovar Typhi
aucgcucuauauccugcc

SEQ ID NO: 3633893 - RNA, 17 nt, Salmonella enterica enterica serovar Typhi
aucgcugaccaacguca

SEQ ID NO: 3633894 - RNA, 22 nt, Salmonella enterica enterica serovar Typhi
aucgcugaccaacgucagcauc

SEQ ID NO: 3633895 - RNA, 19 nt, Salmonella enterica enterica serovar Typhi
aucgcuggacgucgucacc

SEQ ID NO: 3633896 - RNA, 16 nt, Salmonella enterica enterica serovar Typhi
aucgcugucggucaga

SEQ ID NO: 3633897 - RNA, 18 nt, Salmonella enterica enterica serovar Typhi
aucgcuucuauuaccgca

SEQ ID NO: 3633898 - RNA, 23 nt, Salmonella enterica enterica serovar Typhi
aucgcuuuaacgcugcaaaguua

SEQ ID NO: 3633899 - RNA, 17 nt, Salmonella enterica enterica serovar Typhi
aucgcuuucggcaaagc

SEQ ID NO: 3633900 - RNA, 22 nt, Salmonella enterica enterica serovar Typhi
aucgcuuugcagaaaauccuuc

SEQ ID NO: 3633901 - RNA, 23 nt, Salmonella enterica enterica serovar Typhi
aucggaaacuauccuggccugau

SEQ ID NO: 3633902 - RNA, 21 nt, Salmonella enterica enterica serovar Typhi
aucggagauuucauccucuug

SEQ ID NO: 3633903 - RNA, 20 nt, Salmonella enterica enterica serovar Typhi
aucggauuauuuucacgcca

SEQ ID NO: 3633904 - RNA, 17 nt, Salmonella enterica enterica serovar Typhi
aucggauuuacagggga

SEQ ID NO: 3633905 - RNA, 11 nt, Salmonella enterica enterica serovar Typhi
aucggcaaaca

SEQ ID NO: 3633906 - RNA, 20 nt, Salmonella enterica enterica serovar Typhi
aucggcaaacauagccucaa

SEQ ID NO: 3633907 - RNA, 16 nt, Salmonella enterica enterica serovar Typhi
aucggcacacagccag

SEQ ID NO: 3633908 - RNA, 16 nt, Salmonella enterica enterica serovar Typhi
aucggcaccuggagcg

SEQ ID NO: 3633909 - RNA, 16 nt, Salmonella enterica enterica serovar Typhi
aucggcauacagcgau

SEQ ID NO: 3633910 - RNA, 17 nt, Salmonella enterica enterica serovar Typhi
aucggcaugauggcgaa

SEQ ID NO: 3633911 - RNA, 23 nt, Salmonella enterica enterica serovar Typhi
aucggcaugauggcgaacagccc

SEQ ID NO: 3633912 - RNA, 13 nt, Salmonella enterica enterica serovar Typhi
aucggccagcagg

SEQ ID NO: 3633913 - RNA, 14 nt, Salmonella enterica enterica serovar Typhi
aucggccagcgcca

SEQ ID NO: 3633914 - RNA, 22 nt, Salmonella enterica enterica serovar Typhi
aucuccugcgauagcugcugac

SEQ ID NO: 3633915 - RNA, 17 nt, Salmonella enterica enterica serovar Typhi
aucuccuguaaugaggc

SEQ ID NO: 3633916 - RNA, 18 nt, Salmonella enterica enterica serovar Typhi
aucuccuguaaugaggca

SEQ ID NO: 3633917 - RNA, 12 nt, Salmonella enterica enterica serovar Typhi
aucucgccuggc

SEQ ID NO: 3633918 - RNA, 19 nt, Salmonella enterica enterica serovar Typhi
aucucgcgguugacgcugc

SEQ ID NO: 3633919 - RNA, 19 nt, Salmonella enterica enterica serovar Typhi
aucucgcuaaccaucagcg

SEQ ID NO: 3633920 - RNA, 21 nt, Salmonella enterica enterica serovar Typhi
aucucgucaaacucuuccggg

SEQ ID NO: 3633921 - RNA, 22 nt, Salmonella enterica enterica serovar Typhi
aucucguuuuacgccuucggcg

SEQ ID NO: 3633922 - RNA, 14 nt, Salmonella enterica enterica serovar Typhi
aucucuacgccggc

SEQ ID NO: 3633923 - RNA, 14 nt, Salmonella enterica enterica serovar Typhi
aucucuccccccuc

SEQ ID NO: 3633924 - RNA, 19 nt, Salmonella enterica enterica serovar Typhi
aucucucuggcgcauucca

SEQ ID NO: 3633925 - RNA, 15 nt, Salmonella enterica enterica serovar Typhi
aucucuggcggcgua

SEQ ID NO: 3633926 - RNA, 16 nt, Salmonella enterica enterica serovar Typhi
aucucugucgaccauc

SEQ ID NO: 3633927 - RNA, 19 nt, Salmonella enterica enterica serovar Typhi
aucucugucgaccaucgca

SEQ ID NO: 3633928 - RNA, 19 nt, Salmonella enterica enterica serovar Typhi
aucucuugcauaauaucca

SEQ ID NO: 3633929 - RNA, 15 nt, Salmonella enterica enterica serovar Typhi
aucucuuucagaaua

SEQ ID NO: 3633930 - RNA, 17 nt, Salmonella enterica enterica serovar Typhi
aucucuuuuaauuuucu

SEQ ID NO: 3633931 - RNA, 15 nt, Salmonella enterica enterica serovar Typhi
aucucuuuugcggcg

SEQ ID NO: 3633932 - RNA, 13 nt, Salmonella enterica enterica serovar Typhi
aucucuuuuucuc

SEQ ID NO: 3633933 - RNA, 13 nt, Salmonella enterica enterica serovar Typhi
aucugaaaugcuc

SEQ ID NO: 3633934 - RNA, 19 nt, Salmonella enterica enterica serovar Typhi
aucugacagccaaacugcu

SEQ ID NO: 3633935 - RNA, 21 nt, Salmonella enterica enterica serovar Typhi
aucugacagccaaacugcugu

SEQ ID NO: 3633936 - RNA, 22 nt, Salmonella enterica enterica serovar Typhi
aucugacagccaaacugcugua

SEQ ID NO: 3633937 - RNA, 14 nt, Salmonella enterica enterica serovar Typhi
aucugacauauaca

SEQ ID NO: 3633938 - RNA, 16 nt, Salmonella enterica enterica serovar Typhi
aucugacgcggcgccg

SEQ ID NO: 3633939 - RNA, 19 nt, Salmonella enterica enterica serovar Typhi
aucugagcugguuucuccg

SEQ ID NO: 3633940 - RNA, 16 nt, Salmonella enterica enterica serovar Typhi
aucugaguaucgcuuu

SEQ ID NO: 3633941 - RNA, 16 nt, Salmonella enterica enterica serovar Typhi
aucugauauaucuuca

SEQ ID NO: 3633942 - RNA, 22 nt, Salmonella enterica enterica serovar Typhi
aucugaugauggaacagacgcc

SEQ ID NO: 3633943 - RNA, 14 nt, Salmonella enterica enterica serovar Typhi
aucugaugccugaa

SEQ ID NO: 3633944 - RNA, 17 nt, Salmonella enterica enterica serovar Typhi
aucugcacguaccugcu

SEQ ID NO: 3633945 - RNA, 20 nt, Salmonella enterica enterica serovar Typhi
aucugcacguaccugcucca

SEQ ID NO: 3633946 - RNA, 15 nt, Salmonella enterica enterica serovar Typhi
aucugcauaggcuuu

SEQ ID NO: 3633947 - RNA, 20 nt, Salmonella enterica enterica serovar Typhi
aucugcauguaguaagccau

SEQ ID NO: 3633948 - RNA, 20 nt, Salmonella enterica enterica serovar Typhi
aucugccagccgauuuuucg

SEQ ID NO: 3633949 - RNA, 13 nt, Salmonella enterica enterica serovar Typhi
aucugccauuucu

SEQ ID NO: 3633950 - RNA, 16 nt, Salmonella enterica enterica serovar Typhi
aucugccauuucugcu

SEQ ID NO: 3633951 - RNA, 14 nt, Salmonella enterica enterica serovar Typhi
aucugcccuuucuu

SEQ ID NO: 3633952 - RNA, 20 nt, Salmonella enterica enterica serovar Typhi
aucugccgcgcccgccaucg

SEQ ID NO: 3633953 - RNA, 12 nt, Salmonella enterica enterica serovar Typhi
aucugccgucau

SEQ ID NO: 3633954 - RNA, 19 nt, Salmonella enterica enterica serovar Typhi
aucugcgcaacauucugcu

SEQ ID NO: 3633955 - RNA, 19 nt, Salmonella enterica enterica serovar Typhi
aucugcgccggcugcgcug

SEQ ID NO: 3633956 - RNA, 22 nt, Salmonella enterica enterica serovar Typhi
aucugcgccggcugcgcugcca

SEQ ID NO: 3633957 - RNA, 20 nt, Salmonella enterica enterica serovar Typhi
aucugcgugaugcaucagaa

SEQ ID NO: 3633958 - RNA, 15 nt, Salmonella enterica enterica serovar Typhi
aucugcguugcgcgc

SEQ ID NO: 3633959 - RNA, 16 nt, Salmonella enterica enterica serovar Typhi
aucugcuccgccagca

SEQ ID NO: 3633960 - RNA, 13 nt, Salmonella enterica enterica serovar Typhi
aucugcuccggcg

SEQ ID NO: 3633961 - RNA, 20 nt, Salmonella enterica enterica serovar Typhi
aucugcugacacccucugcg

SEQ ID NO: 3633962 - RNA, 14 nt, Salmonella enterica enterica serovar Typhi
aucuggacgccaau

SEQ ID NO: 3633963 - RNA, 17 nt, Salmonella enterica enterica serovar Typhi
aucuggccaauuuuuca

SEQ ID NO: 3633964 - RNA, 23 nt, Salmonella enterica enterica serovar Typhi
aucuggcgagagcauugccugau

SEQ ID NO: 3633965 - RNA, 17 nt, Salmonella enterica enterica serovar Typhi
aucuggucaaguauuuc

SEQ ID NO: 3633966 - RNA, 20 nt, Salmonella enterica enterica serovar Typhi
aucuggugacgaugauaaca

SEQ ID NO: 3633967 - RNA, 17 nt, Salmonella enterica enterica serovar Typhi
aucuggugauaaagcag

SEQ ID NO: 3633968 - RNA, 17 nt, Salmonella enterica enterica serovar Typhi
aucugguggaaaagaaa

SEQ ID NO: 3633969 - RNA, 18 nt, Salmonella enterica enterica serovar Typhi
aucugguuauccaccagc

SEQ ID NO: 3633970 - RNA, 21 nt, Salmonella enterica enterica serovar Typhi
aucuguaauugacgcgucagg

SEQ ID NO: 3633971 - RNA, 13 nt, Salmonella enterica enterica serovar Typhi
aucuguauaaaau

SEQ ID NO: 3633972 - RNA, 12 nt, Salmonella enterica enterica serovar Typhi
aucugucaugcg

SEQ ID NO: 3633973 - RNA, 15 nt, Salmonella enterica enterica serovar Typhi
aucugucccagccuu

SEQ ID NO: 3633974 - RNA, 21 nt, Salmonella enterica enterica serovar Typhi
aucugucccagccuuccuggu

SEQ ID NO: 3633975 - RNA, 13 nt, Salmonella enterica enterica serovar Typhi
aucuguggcgacg

SEQ ID NO: 3633976 - RNA, 22 nt, Salmonella enterica enterica serovar Typhi
aucugugugggcacucgaagau

SEQ ID NO: 3633977 - RNA, 14 nt, Salmonella enterica enterica serovar Typhi
aucuguuccagcga

SEQ ID NO: 3633978 - RNA, 14 nt, Salmonella enterica enterica serovar Typhi
aucuguuucaugga

SEQ ID NO: 3633979 - RNA, 15 nt, Salmonella enterica enterica serovar Typhi
aucuguuugagaaaa

SEQ ID NO: 3633980 - RNA, 15 nt, Salmonella enterica enterica serovar Typhi
aucuuauuagcgauu

SEQ ID NO: 3633981 - RNA, 23 nt, Salmonella enterica enterica serovar Typhi
aucuuauuuuccguuagccaaug

SEQ ID NO: 3633982 - RNA, 21 nt, Salmonella enterica enterica serovar Typhi
aucuucaaagccacacugcau

SEQ ID NO: 3633983 - RNA, 21 nt, Salmonella enterica enterica serovar Typhi
aucuucaagguuaugcgcaca

SEQ ID NO: 3633984 - RNA, 21 nt, Salmonella enterica enterica serovar Typhi
aucuucaaucgugaccaccgc

SEQ ID NO: 3633985 - RNA, 19 nt, Salmonella enterica enterica serovar Typhi
aucuucaccgaugcccagc

SEQ ID NO: 3633986 - RNA, 22 nt, Salmonella enterica enterica serovar Typhi
aucuucaccgaugcccagcuug

SEQ ID NO: 3633987 - RNA, 17 nt, Salmonella enterica enterica serovar Typhi
aucuucacgcagcguga

SEQ ID NO: 3633988 - RNA, 15 nt, Salmonella enterica enterica serovar Typhi
aucuucacuguuauc

SEQ ID NO: 3633989 - RNA, 18 nt, Salmonella enterica enterica serovar Typhi
aucuucacuucacaaaca

SEQ ID NO: 3633990 - RNA, 15 nt, Salmonella enterica enterica serovar Typhi
aucuucagcccguuc

SEQ ID NO: 3633991 - RNA, 20 nt, Salmonella enterica enterica serovar Typhi
aucuucauguucuaacagau

SEQ ID NO: 3633992 - RNA, 17 nt, Salmonella enterica enterica serovar Typhi
aucuucauuucauugcg

SEQ ID NO: 3633993 - RNA, 23 nt, Salmonella enterica enterica serovar Typhi
aucuuccacccgcgcgcuuucca

SEQ ID NO: 3633994 - RNA, 13 nt, Salmonella enterica enterica serovar Typhi
aucuuccagcauc

SEQ ID NO: 3633995 - RNA, 22 nt, Salmonella enterica enterica serovar Typhi
aucuuccagcgucgggccgcgc

SEQ ID NO: 3633996 - RNA, 20 nt, Salmonella enterica enterica serovar Typhi
aucuuccgggucaguuuuuu

SEQ ID NO: 3633997 - RNA, 18 nt, Salmonella enterica enterica serovar Typhi
aucuucgauaaacucaau

SEQ ID NO: 3633998 - RNA, 19 nt, Salmonella enterica enterica serovar Typhi
aucuucggcgggaucucca

SEQ ID NO: 3633999 - RNA, 18 nt, Salmonella enterica enterica serovar Typhi
augagaaaaggaagaaua

SEQ ID NO: 3634000 - RNA, 12 nt, Salmonella enterica enterica serovar Typhi
augagaagaaaa

SEQ ID NO: 3634001 - RNA, 14 nt, Salmonella enterica enterica serovar Typhi
augagauaauaaau

SEQ ID NO: 3634002 - RNA, 12 nt, Salmonella enterica enterica serovar Typhi
augagcaggcca

SEQ ID NO: 3634003 - RNA, 15 nt, Salmonella enterica enterica serovar Typhi
augagcaggccaggg

SEQ ID NO: 3634004 - RNA, 22 nt, Salmonella enterica enterica serovar Typhi
augagcgcgaaaucaaagaccu

SEQ ID NO: 3634005 - RNA, 15 nt, Salmonella enterica enterica serovar Typhi
augagcguuagcgcc

SEQ ID NO: 3634006 - RNA, 17 nt, Salmonella enterica enterica serovar Typhi
augagcucaaauaugau

SEQ ID NO: 3634007 - RNA, 20 nt, Salmonella enterica enterica serovar Typhi
augaggacggcccgcugucu

SEQ ID NO: 3634008 - RNA, 13 nt, Salmonella enterica enterica serovar Typhi
augaggagcugga

SEQ ID NO: 3634009 - RNA, 18 nt, Salmonella enterica enterica serovar Typhi
augaggcaaaucccugau

SEQ ID NO: 3634010 - RNA, 12 nt, Salmonella enterica enterica serovar Typhi
augaguaaaauu

SEQ ID NO: 3634011 - RNA, 23 nt, Salmonella enterica enterica serovar Typhi
augaguauauagcgcuccuuuaa

SEQ ID NO: 3634012 - RNA, 20 nt, Salmonella enterica enterica serovar Typhi
augauaaccgccgccaaacu

SEQ ID NO: 3634013 - RNA, 16 nt, Salmonella enterica enterica serovar Typhi
augauaagugauaccg

SEQ ID NO: 3634014 - RNA, 16 nt, Salmonella enterica enterica serovar Typhi
augauaauaugcucaa

SEQ ID NO: 3634015 - RNA, 13 nt, Salmonella enterica enterica serovar Typhi
augauaaugccgc

SEQ ID NO: 3634016 - RNA, 20 nt, Salmonella enterica enterica serovar Typhi
augauacguggcucaaggau

SEQ ID NO: 3634017 - RNA, 19 nt, Salmonella enterica enterica serovar Typhi
augauagcgccauauaaau

SEQ ID NO: 3634018 - RNA, 16 nt, Salmonella enterica enterica serovar Typhi
augauauccagcacgc

SEQ ID NO: 3634019 - RNA, 18 nt, Salmonella enterica enterica serovar Typhi
augauauccagcacgccu

SEQ ID NO: 3634020 - RNA, 22 nt, Salmonella enterica enterica serovar Typhi
augauaucgccaauggcgucgu

SEQ ID NO: 3634021 - RNA, 23 nt, Salmonella enterica enterica serovar Typhi
augauaucgcgguuacgcccuau

SEQ ID NO: 3634022 - RNA, 20 nt, Salmonella enterica enterica serovar Typhi
augauaucggccggaugcca

SEQ ID NO: 3634023 - RNA, 22 nt, Salmonella enterica enterica serovar Typhi
augauaucggccggaugccagu

SEQ ID NO: 3634024 - RNA, 16 nt, Salmonella enterica enterica serovar Typhi
augaucagacgcacaa

SEQ ID NO: 3634025 - RNA, 23 nt, Salmonella enterica enterica serovar Typhi
augaucagcgacgguccuggcca

SEQ ID NO: 3634026 - RNA, 15 nt, Salmonella enterica enterica serovar Typhi
augaucauacugccg

SEQ ID NO: 3634027 - RNA, 19 nt, Salmonella enterica enterica serovar Typhi
augaucgauagcgacggcg

SEQ ID NO: 3634028 - RNA, 15 nt, Salmonella enterica enterica serovar Typhi
augaucgccucuucg

SEQ ID NO: 3634029 - RNA, 16 nt, Salmonella enterica enterica serovar Typhi
augaucguaugcagcc

SEQ ID NO: 3634030 - RNA, 20 nt, Salmonella enterica enterica serovar Typhi
augaucguaugcagccaggc

SEQ ID NO: 3634031 - RNA, 19 nt, Salmonella enterica enterica serovar Typhi
augaucuuaccucuccuga

SEQ ID NO: 3634032 - RNA, 14 nt, Salmonella enterica enterica serovar Typhi
augaucuucauaaa

SEQ ID NO: 3634033 - RNA, 15 nt, Salmonella enterica enterica serovar Typhi
augaucuuuccuuuu

SEQ ID NO: 3634034 - RNA, 13 nt, Salmonella enterica enterica serovar Typhi
augaugaaaaaga

SEQ ID NO: 3634035 - RNA, 15 nt, Salmonella enterica enterica serovar Typhi
augaugaaaaagaau

SEQ ID NO: 3634036 - RNA, 14 nt, Salmonella enterica enterica serovar Typhi
augaugaauauuuu

SEQ ID NO: 3634037 - RNA, 17 nt, Salmonella enterica enterica serovar Typhi
augaugaccgaagcagg

SEQ ID NO: 3634038 - RNA, 21 nt, Salmonella enterica enterica serovar Typhi
augaugaccuggugcaucaua

SEQ ID NO: 3634039 - RNA, 13 nt, Salmonella enterica enterica serovar Typhi
augaugagcgcca

SEQ ID NO: 3634040 - RNA, 19 nt, Salmonella enterica enterica serovar Typhi
augaugcauuugauuuguu

SEQ ID NO: 3634041 - RNA, 18 nt, Salmonella enterica enterica serovar Typhi
augaugccacgagaaauc

SEQ ID NO: 3634042 - RNA, 23 nt, Salmonella enterica enterica serovar Typhi
augaugccuugcgaauggagaag

SEQ ID NO: 3634043 - RNA, 13 nt, Salmonella enterica enterica serovar Typhi
augaugcguuacu

SEQ ID NO: 3634044 - RNA, 17 nt, Salmonella enterica enterica serovar Typhi
augaugcucgcucauca

SEQ ID NO: 3634045 - RNA, 19 nt, Salmonella enterica enterica serovar Typhi
augauggcgaacagcccca

SEQ ID NO: 3634046 - RNA, 13 nt, Salmonella enterica enterica serovar Typhi
augauggcuccug

SEQ ID NO: 3634047 - RNA, 19 nt, Salmonella enterica enterica serovar Typhi
augaugggcgcacagcgcc

SEQ ID NO: 3634048 - RNA, 20 nt, Salmonella enterica enterica serovar Typhi
augaugggcgcacagcgcca

SEQ ID NO: 3634049 - RNA, 17 nt, Salmonella enterica enterica serovar Typhi
augauguacaggugaaa

SEQ ID NO: 3634050 - RNA, 19 nt, Salmonella enterica enterica serovar Typhi
augauguucauccauauau

SEQ ID NO: 3634051 - RNA, 14 nt, Salmonella enterica enterica serovar Typhi
augauuaaagccac

SEQ ID NO: 3634052 - RNA, 19 nt, Salmonella enterica enterica serovar Typhi
augauuagauagauauuuu

SEQ ID NO: 3634053 - RNA, 15 nt, Salmonella enterica enterica serovar Typhi
augauuaucaucuau

SEQ ID NO: 3634054 - RNA, 19 nt, Salmonella enterica enterica serovar Typhi
augauuauuguuaaaaaga

SEQ ID NO: 3634055 - RNA, 14 nt, Salmonella enterica enterica serovar Typhi
augauuucaggcau

SEQ ID NO: 3634056 - RNA, 14 nt, Salmonella enterica enterica serovar Typhi
augauuuuaacauc

SEQ ID NO: 3634057 - RNA, 16 nt, Salmonella enterica enterica serovar Typhi
augauuuuaacaucac

SEQ ID NO: 3634058 - RNA, 14 nt, Salmonella enterica enterica serovar Typhi
augauuuucuuauu

SEQ ID NO: 3634059 - RNA, 22 nt, Salmonella enterica enterica serovar Typhi
augauuuucuuauuacaagaaa

SEQ ID NO: 3634060 - RNA, 23 nt, Salmonella enterica enterica serovar Typhi
augauuuucuuauuacaagaaag

SEQ ID NO: 3634061 - RNA, 20 nt, Salmonella enterica enterica serovar Typhi
augcaaaaaagcccauccgu

SEQ ID NO: 3634062 - RNA, 14 nt, Salmonella enterica enterica serovar Typhi
augcaaaagaaaaa

SEQ ID NO: 3634063 - RNA, 21 nt, Salmonella enterica enterica serovar Typhi
augcaaagaagggcaggggaa

SEQ ID NO: 3634064 - RNA, 12 nt, Salmonella enterica enterica serovar Typhi
augcaaauguca

SEQ ID NO: 3634065 - RNA, 14 nt, Salmonella enterica enterica serovar Typhi
augcaacuggcaag

SEQ ID NO: 3634066 - RNA, 17 nt, Salmonella enterica enterica serovar Typhi
augcaagcagcauaaug

SEQ ID NO: 3634067 - RNA, 19 nt, Salmonella enterica enterica serovar Typhi
augcaaucaguuccaaucu

SEQ ID NO: 3634068 - RNA, 17 nt, Salmonella enterica enterica serovar Typhi
augcaaucucuuccgcc

SEQ ID NO: 3634069 - RNA, 14 nt, Salmonella enterica enterica serovar Typhi
augcaauuccgcuu

SEQ ID NO: 3634070 - RNA, 18 nt, Salmonella enterica enterica serovar Typhi
augcaauuccgcuuucuu

SEQ ID NO: 3634071 - RNA, 15 nt, Salmonella enterica enterica serovar Typhi
augcacaacacgcuu

SEQ ID NO: 3634072 - RNA, 19 nt, Salmonella enterica enterica serovar Typhi
augcacaggcggcgguuca

SEQ ID NO: 3634073 - RNA, 20 nt, Salmonella enterica enterica serovar Typhi
augcacauuagcaauugcca

SEQ ID NO: 3634074 - RNA, 12 nt, Salmonella enterica enterica serovar Typhi
augcaccgccuu

SEQ ID NO: 3634075 - RNA, 16 nt, Salmonella enterica enterica serovar Typhi
augcaccgccuugccc

SEQ ID NO: 3634076 - RNA, 18 nt, Salmonella enterica enterica serovar Typhi
augcacguuaaagccgac

SEQ ID NO: 3634077 - RNA, 13 nt, Salmonella enterica enterica serovar Typhi
augcacugcugau

SEQ ID NO: 3634078 - RNA, 14 nt, Salmonella enterica enterica serovar Typhi
augcacugcugaua

SEQ ID NO: 3634079 - RNA, 21 nt, Salmonella enterica enterica serovar Typhi
augcagcaggucgaccaccug

SEQ ID NO: 3634080 - RNA, 21 nt, Salmonella enterica enterica serovar Typhi
augcagcaucaugucacccac

SEQ ID NO: 3634081 - RNA, 20 nt, Salmonella enterica enterica serovar Typhi
augcagcgucugcccuccug

SEQ ID NO: 3634082 - RNA, 16 nt, Salmonella enterica enterica serovar Typhi
augcaggcauaaaaaa

SEQ ID NO: 3634083 - RNA, 14 nt, Salmonella enterica enterica serovar Typhi
augcaggccaagca

SEQ ID NO: 3634084 - RNA, 23 nt, Salmonella enterica enterica serovar Typhi
augcagggauccuguaacaacug

SEQ ID NO: 3634085 - RNA, 17 nt, Salmonella enterica enterica serovar Typhi
augcgccagcggccagc

SEQ ID NO: 3634086 - RNA, 15 nt, Salmonella enterica enterica serovar Typhi
augcgccaggugacg

SEQ ID NO: 3634087 - RNA, 19 nt, Salmonella enterica enterica serovar Typhi
augcgccaucccaugcacc

SEQ ID NO: 3634088 - RNA, 12 nt, Salmonella enterica enterica serovar Typhi
augcgcccagcc

SEQ ID NO: 3634089 - RNA, 18 nt, Salmonella enterica enterica serovar Typhi
augcgccccggcggcgua

SEQ ID NO: 3634090 - RNA, 18 nt, Salmonella enterica enterica serovar Typhi
augcgccccugcaggcga

SEQ ID NO: 3634091 - RNA, 18 nt, Salmonella enterica enterica serovar Typhi
augcgccgcccaccgcca

SEQ ID NO: 3634092 - RNA, 22 nt, Salmonella enterica enterica serovar Typhi
augcgccgccuuggcgaccuga

SEQ ID NO: 3634093 - RNA, 21 nt, Salmonella enterica enterica serovar Typhi
augcgccgucaggcuugccgc

SEQ ID NO: 3634094 - RNA, 21 nt, Salmonella enterica enterica serovar Typhi
augcgccugguugacccgcau

SEQ ID NO: 3634095 - RNA, 14 nt, Salmonella enterica enterica serovar Typhi
augcgccugucucc

SEQ ID NO: 3634096 - RNA, 16 nt, Salmonella enterica enterica serovar Typhi
augcgccugucuuaaa

SEQ ID NO: 3634097 - RNA, 19 nt, Salmonella enterica enterica serovar Typhi
augcgcggaauagcggcua

SEQ ID NO: 3634098 - RNA, 16 nt, Salmonella enterica enterica serovar Typhi
augcgcguaauuugcg

SEQ ID NO: 3634099 - RNA, 16 nt, Salmonella enterica enterica serovar Typhi
augcgcguagcccaca

SEQ ID NO: 3634100 - RNA, 18 nt, Salmonella enterica enterica serovar Typhi
augcgcguagcccacagg

SEQ ID NO: 3634101 - RNA, 18 nt, Salmonella enterica enterica serovar Typhi
augcgcgucaggccaggg

SEQ ID NO: 3634102 - RNA, 20 nt, Salmonella enterica enterica serovar Typhi
augcgcgucccggcagugca

SEQ ID NO: 3634103 - RNA, 22 nt, Salmonella enterica enterica serovar Typhi
augcgcgugcgguuuuccugau

SEQ ID NO: 3634104 - RNA, 20 nt, Salmonella enterica enterica serovar Typhi
augcgcguuuagcgccagca

SEQ ID NO: 3634105 - RNA, 22 nt, Salmonella enterica enterica serovar Typhi
augcgcguuuagcgccagcagc

SEQ ID NO: 3634106 - RNA, 15 nt, Salmonella enterica enterica serovar Typhi
augcgcugaauagcg

SEQ ID NO: 3634107 - RNA, 16 nt, Salmonella enterica enterica serovar Typhi
augcgcuuccagcaug

SEQ ID NO: 3634108 - RNA, 21 nt, Salmonella enterica enterica serovar Typhi
augcggcugacgauacucagc

SEQ ID NO: 3634109 - RNA, 16 nt, Salmonella enterica enterica serovar Typhi
augcggcuuugcgccg

SEQ ID NO: 3634110 - RNA, 12 nt, Salmonella enterica enterica serovar Typhi
augcgggcucgu

SEQ ID NO: 3634111 - RNA, 16 nt, Salmonella enterica enterica serovar Typhi
augcgggggagaugau

SEQ ID NO: 3634112 - RNA, 18 nt, Salmonella enterica enterica serovar Typhi
augcgggggcaguaaauu

SEQ ID NO: 3634113 - RNA, 15 nt, Salmonella enterica enterica serovar Typhi
augcgguuaaaccag

SEQ ID NO: 3634114 - RNA, 20 nt, Salmonella enterica enterica serovar Typhi
augcguaauccggccuggcg

SEQ ID NO: 3634115 - RNA, 22 nt, Salmonella enterica enterica serovar Typhi
augcguaccugcgcgcaggucu

SEQ ID NO: 3634116 - RNA, 22 nt, Salmonella enterica enterica serovar Typhi
augcguauuuccaccuucucuu

SEQ ID NO: 3634117 - RNA, 22 nt, Salmonella enterica enterica serovar Typhi
augcgucagcgcggcuuccagu

SEQ ID NO: 3634118 - RNA, 13 nt, Salmonella enterica enterica serovar Typhi
augcguccgccag

SEQ ID NO: 3634119 - RNA, 20 nt, Salmonella enterica enterica serovar Typhi
augcgucgcauccuuaugca

SEQ ID NO: 3634120 - RNA, 12 nt, Salmonella enterica enterica serovar Typhi
augcguucaaaa

SEQ ID NO: 3634121 - RNA, 17 nt, Salmonella enterica enterica serovar Typhi
augcguugucgcugauu

SEQ ID NO: 3634122 - RNA, 13 nt, Salmonella enterica enterica serovar Typhi
augcuaaaacaga

SEQ ID NO: 3634123 - RNA, 20 nt, Salmonella enterica enterica serovar Typhi
augcuacccgucgcgcccac

SEQ ID NO: 3634124 - RNA, 16 nt, Salmonella enterica enterica serovar Typhi
augcuauaugcaggca

SEQ ID NO: 3634125 - RNA, 14 nt, Salmonella enterica enterica serovar Typhi
augcuaucgcggau

SEQ ID NO: 3634126 - RNA, 22 nt, Salmonella enterica enterica serovar Typhi
augcuauucagcaguucauucg

SEQ ID NO: 3634127 - RNA, 22 nt, Salmonella enterica enterica serovar Typhi
augcucaaccaguaccgggccu

SEQ ID NO: 3634128 - RNA, 19 nt, Salmonella enterica enterica serovar Typhi
augcucaccgcgaauauac

SEQ ID NO: 3634129 - RNA, 15 nt, Salmonella enterica enterica serovar Typhi
augcucaggcaacac

SEQ ID NO: 3634130 - RNA, 23 nt, Salmonella enterica enterica serovar Typhi
augcucagggcauccgccgccgc

SEQ ID NO: 3634131 - RNA, 19 nt, Salmonella enterica enterica serovar Typhi
augcucauccaacugcgcc

SEQ ID NO: 3634132 - RNA, 15 nt, Salmonella enterica enterica serovar Typhi
augcucauuauuugg

SEQ ID NO: 3634133 - RNA, 21 nt, Salmonella enterica enterica serovar Typhi
augcuccaguuguuccagcag

SEQ ID NO: 3634134 - RNA, 13 nt, Salmonella enterica enterica serovar Typhi
augcucuccagca

SEQ ID NO: 3634135 - RNA, 14 nt, Salmonella enterica enterica serovar Typhi
augcugaacagccg

SEQ ID NO: 3634136 - RNA, 18 nt, Salmonella enterica enterica serovar Typhi
augcugacggauucuucc

SEQ ID NO: 3634137 - RNA, 21 nt, Salmonella enterica enterica serovar Typhi
augcugacggauucuuccucu

SEQ ID NO: 3634138 - RNA, 15 nt, Salmonella enterica enterica serovar Typhi
augcugcaccgcauc

SEQ ID NO: 3634139 - RNA, 21 nt, Salmonella enterica enterica serovar Typhi
augcugcaccgcaucaaacuu

SEQ ID NO: 3634140 - RNA, 13 nt, Salmonella enterica enterica serovar Typhi
augcugcagggcc

SEQ ID NO: 3634141 - RNA, 23 nt, Salmonella enterica enterica serovar Typhi
augcugccagcgaaccgcggcau

SEQ ID NO: 3634142 - RNA, 19 nt, Salmonella enterica enterica serovar Typhi
augcugccuacugcccuac

SEQ ID NO: 3634143 - RNA, 23 nt, Salmonella enterica enterica serovar Typhi
augcugcgguuauaauaauaauu

SEQ ID NO: 3634144 - RNA, 21 nt, Salmonella enterica enterica serovar Typhi
augcugcguacaaucgcguuu

SEQ ID NO: 3634145 - RNA, 20 nt, Salmonella enterica enterica serovar Typhi
augcugggcgugucccugga

SEQ ID NO: 3634146 - RNA, 21 nt, Salmonella enterica enterica serovar Typhi
augcuggugaagacgcugcaa

SEQ ID NO: 3634147 - RNA, 22 nt, Salmonella enterica enterica serovar Typhi
augcugguuuuagcuuauccca

SEQ ID NO: 3634148 - RNA, 19 nt, Salmonella enterica enterica serovar Typhi
augcugugugaccagcagu

SEQ ID NO: 3634149 - RNA, 21 nt, Salmonella enterica enterica serovar Typhi
augcuuaaaaucccgccgcug

SEQ ID NO: 3634150 - RNA, 14 nt, Salmonella enterica enterica serovar Typhi
augcuucuucgcca

SEQ ID NO: 3634151 - RNA, 19 nt, Salmonella enterica enterica serovar Typhi
augcuuucaauaaaucaau

SEQ ID NO: 3634152 - RNA, 15 nt, Salmonella enterica enterica serovar Typhi
augcuuucagcaugu

SEQ ID NO: 3634153 - RNA, 20 nt, Salmonella enterica enterica serovar Typhi
augcuuuccagccaugccag

SEQ ID NO: 3634154 - RNA, 22 nt, Salmonella enterica enterica serovar Typhi
augcuuuccagccaugccagca

SEQ ID NO: 3634155 - RNA, 23 nt, Salmonella enterica enterica serovar Typhi
augcuuuuuauaaagugauuaua

SEQ ID NO: 3634156 - RNA, 17 nt, Salmonella enterica enterica serovar Typhi
augcuuuuugugccgaa

SEQ ID NO: 3634157 - RNA, 14 nt, Salmonella enterica enterica serovar Typhi
auggaaaugcacgu

SEQ ID NO: 3634158 - RNA, 21 nt, Salmonella enterica enterica serovar Typhi
auggaacucugcgacgccagg

SEQ ID NO: 3634159 - RNA, 20 nt, Salmonella enterica enterica serovar Typhi
auggaacugccuggcucauu

SEQ ID NO: 3634160 - RNA, 12 nt, Salmonella enterica enterica serovar Typhi
auggaaguacug

SEQ ID NO: 3634161 - RNA, 19 nt, Salmonella enterica enterica serovar Typhi
auggaaucggcuaguaaua

SEQ ID NO: 3634162 - RNA, 16 nt, Salmonella enterica enterica serovar Typhi
auggacagauuuccac

SEQ ID NO: 3634163 - RNA, 15 nt, Salmonella enterica enterica serovar Typhi
auggagcaucagcgc

SEQ ID NO: 3634164 - RNA, 16 nt, Salmonella enterica enterica serovar Typhi
auggauaacgaaaagg

SEQ ID NO: 3634165 - RNA, 12 nt, Salmonella enterica enterica serovar Typhi
auggaucaucgg

SEQ ID NO: 3634166 - RNA, 22 nt, Salmonella enterica enterica serovar Typhi
auggaugcccaccugaaaaagg

SEQ ID NO: 3634167 - RNA, 23 nt, Salmonella enterica enterica serovar Typhi
auggaugcccaccugaaaaaggg

SEQ ID NO: 3634168 - RNA, 22 nt, Salmonella enterica enterica serovar Typhi
auggauucaugguacucaacau

SEQ ID NO: 3634169 - RNA, 12 nt, Salmonella enterica enterica serovar Typhi
auggcaaagucg

SEQ ID NO: 3634170 - RNA, 20 nt, Salmonella enterica enterica serovar Typhi
augguacucaacaucauuaa

SEQ ID NO: 3634171 - RNA, 19 nt, Salmonella enterica enterica serovar Typhi
augguaggccugauaagcg

SEQ ID NO: 3634172 - RNA, 22 nt, Salmonella enterica enterica serovar Typhi
augguauaaaucccggugggga

SEQ ID NO: 3634173 - RNA, 12 nt, Salmonella enterica enterica serovar Typhi
augguauuuauu

SEQ ID NO: 3634174 - RNA, 16 nt, Salmonella enterica enterica serovar Typhi
augguauuucagaccg

SEQ ID NO: 3634175 - RNA, 20 nt, Salmonella enterica enterica serovar Typhi
auggucgaaaauaucggccu

SEQ ID NO: 3634176 - RNA, 21 nt, Salmonella enterica enterica serovar Typhi
auggucgcauggcuaaaagaa

SEQ ID NO: 3634177 - RNA, 22 nt, Salmonella enterica enterica serovar Typhi
auggucgccuccguaugaccgc

SEQ ID NO: 3634178 - RNA, 18 nt, Salmonella enterica enterica serovar Typhi
auggucgcgccaaaagag

SEQ ID NO: 3634179 - RNA, 19 nt, Salmonella enterica enterica serovar Typhi
auggucguauuuuggcgcu

SEQ ID NO: 3634180 - RNA, 20 nt, Salmonella enterica enterica serovar Typhi
auggucucguugccauuggu

SEQ ID NO: 3634181 - RNA, 16 nt, Salmonella enterica enterica serovar Typhi
auggucugaaagaguu

SEQ ID NO: 3634182 - RNA, 21 nt, Salmonella enterica enterica serovar Typhi
auggucuguaccaccagaauc

SEQ ID NO: 3634183 - RNA, 13 nt, Salmonella enterica enterica serovar Typhi
auggucuuaaaug

SEQ ID NO: 3634184 - RNA, 23 nt, Salmonella enterica enterica serovar Typhi
auggugauagcgcgccagcacca

SEQ ID NO: 3634185 - RNA, 18 nt, Salmonella enterica enterica serovar Typhi
auggugcggcgcacugcc

SEQ ID NO: 3634186 - RNA, 13 nt, Salmonella enterica enterica serovar Typhi
auggugcucagcc

SEQ ID NO: 3634187 - RNA, 19 nt, Salmonella enterica enterica serovar Typhi
augguggagggguauuuau

SEQ ID NO: 3634188 - RNA, 14 nt, Salmonella enterica enterica serovar Typhi
augguuaaauucau

SEQ ID NO: 3634189 - RNA, 18 nt, Salmonella enterica enterica serovar Typhi
augguugaacaggcugug

SEQ ID NO: 3634190 - RNA, 23 nt, Salmonella enterica enterica serovar Typhi
augguugacuuacaaaaaauaca

SEQ ID NO: 3634191 - RNA, 19 nt, Salmonella enterica enterica serovar Typhi
auguaaaacgguaugaaac

SEQ ID NO: 3634192 - RNA, 18 nt, Salmonella enterica enterica serovar Typhi
auguaaacuccauuaaau

SEQ ID NO: 3634193 - RNA, 11 nt, Salmonella enterica enterica serovar Typhi
auguaaaugac

SEQ ID NO: 3634194 - RNA, 18 nt, Salmonella enterica enterica serovar Typhi
auguaauuugcaaaccau

SEQ ID NO: 3634195 - RNA, 16 nt, Salmonella enterica enterica serovar Typhi
auguacaacuucauga

SEQ ID NO: 3634196 - RNA, 20 nt, Salmonella enterica enterica serovar Typhi
auguacacgaaauagcgcag

SEQ ID NO: 3634197 - RNA, 13 nt, Salmonella enterica enterica serovar Typhi
auguacaggugaa

SEQ ID NO: 3634198 - RNA, 23 nt, Salmonella enterica enterica serovar Typhi
auguacaggugaaauaggggaga

SEQ ID NO: 3634199 - RNA, 18 nt, Salmonella enterica enterica serovar Typhi
auguaccauugucaaaaa

SEQ ID NO: 3634200 - RNA, 15 nt, Salmonella enterica enterica serovar Typhi
auguaccgucaucgc

SEQ ID NO: 3634201 - RNA, 17 nt, Salmonella enterica enterica serovar Typhi
auguaccugcguuaaac

SEQ ID NO: 3634202 - RNA, 17 nt, Salmonella enterica enterica serovar Typhi
auguacgccuaaaaaug

SEQ ID NO: 3634203 - RNA, 15 nt, Salmonella enterica enterica serovar Typhi
auguagcaaauuuca

SEQ ID NO: 3634204 - RNA, 14 nt, Salmonella enterica enterica serovar Typhi
auguaguaaauagg

SEQ ID NO: 3634205 - RNA, 21 nt, Salmonella enterica enterica serovar Typhi
auguaguaaauaggagaugca

SEQ ID NO: 3634206 - RNA, 20 nt, Salmonella enterica enterica serovar Typhi
auguaucgcgcggauuccgc

SEQ ID NO: 3634207 - RNA, 16 nt, Salmonella enterica enterica serovar Typhi
augucaacuuaaacgu

SEQ ID NO: 3634208 - RNA, 17 nt, Salmonella enterica enterica serovar Typhi
augucaggaucagauau

SEQ ID NO: 3634209 - RNA, 16 nt, Salmonella enterica enterica serovar Typhi
augucaguaauauauu

SEQ ID NO: 3634210 - RNA, 22 nt, Salmonella enterica enterica serovar Typhi
augucagugacgguaucgugac

SEQ ID NO: 3634211 - RNA, 14 nt, Salmonella enterica enterica serovar Typhi
augucauaauugcc

SEQ ID NO: 3634212 - RNA, 16 nt, Salmonella enterica enterica serovar Typhi
augucauauuugugag

SEQ ID NO: 3634213 - RNA, 20 nt, Salmonella enterica enterica serovar Typhi
augucaucaggcgguguugu

SEQ ID NO: 3634214 - RNA, 20 nt, Salmonella enterica enterica serovar Typhi
augucauccgguucacccac

SEQ ID NO: 3634215 - RNA, 14 nt, Salmonella enterica enterica serovar Typhi
augucaucggcuuu

SEQ ID NO: 3634216 - RNA, 17 nt, Salmonella enterica enterica serovar Typhi
augucaugacuuaacgu

SEQ ID NO: 3634217 - RNA, 20 nt, Salmonella enterica enterica serovar Typhi
auguccaccgauuucaucgc

SEQ ID NO: 3634218 - RNA, 14 nt, Salmonella enterica enterica serovar Typhi
auguccagaccaau

SEQ ID NO: 3634219 - RNA, 17 nt, Salmonella enterica enterica serovar Typhi
auguccaucucuuuacc

SEQ ID NO: 3634220 - RNA, 17 nt, Salmonella enterica enterica serovar Typhi
augucccaucguaacgc

SEQ ID NO: 3634221 - RNA, 17 nt, Salmonella enterica enterica serovar Typhi
auguccgauagcauuau

SEQ ID NO: 3634222 - RNA, 20 nt, Salmonella enterica enterica serovar Typhi
augucgacauaauuuccggc

SEQ ID NO: 3634223 - RNA, 19 nt, Salmonella enterica enterica serovar Typhi
augucgauaauacagccug

SEQ ID NO: 3634224 - RNA, 17 nt, Salmonella enterica enterica serovar Typhi
augucggcgaaaauccu

SEQ ID NO: 3634225 - RNA, 12 nt, Salmonella enterica enterica serovar Typhi
augucuggcgcu

SEQ ID NO: 3634226 - RNA, 18 nt, Salmonella enterica enterica serovar Typhi
augucuggugcagcaagc

SEQ ID NO: 3634227 - RNA, 15 nt, Salmonella enterica enterica serovar Typhi
augucuuccuuuucu

SEQ ID NO: 3634228 - RNA, 20 nt, Salmonella enterica enterica serovar Typhi
augugaauaugaucugcaca

SEQ ID NO: 3634229 - RNA, 20 nt, Salmonella enterica enterica serovar Typhi
augugaauaugaucugcgca

SEQ ID NO: 3634230 - RNA, 16 nt, Salmonella enterica enterica serovar Typhi
augugaauccaggcca

SEQ ID NO: 3634231 - RNA, 13 nt, Salmonella enterica enterica serovar Typhi
augugacaaucac

SEQ ID NO: 3634232 - RNA, 20 nt, Salmonella enterica enterica serovar Typhi
augugagcgcauccggccag

SEQ ID NO: 3634233 - RNA, 16 nt, Salmonella enterica enterica serovar Typhi
augugaucuauauauu

SEQ ID NO: 3634234 - RNA, 23 nt, Salmonella enterica enterica serovar Typhi
augugauuuuugacccgcagcaa

SEQ ID NO: 3634235 - RNA, 18 nt, Salmonella enterica enterica serovar Typhi
augugcagcauccagcuc

SEQ ID NO: 3634236 - RNA, 19 nt, Salmonella enterica enterica serovar Typhi
augugcuauuuucucuugc

SEQ ID NO: 3634237 - RNA, 22 nt, Salmonella enterica enterica serovar Typhi
auguggacgccauaaaccagaa

SEQ ID NO: 3634238 - RNA, 17 nt, Salmonella enterica enterica serovar Typhi
auguggcggcccguggu

SEQ ID NO: 3634239 - RNA, 19 nt, Salmonella enterica enterica serovar Typhi
augugguugugguaaucaa

SEQ ID NO: 3634240 - RNA, 17 nt, Salmonella enterica enterica serovar Typhi
auguguuucagcagccc

SEQ ID NO: 3634241 - RNA, 21 nt, Salmonella enterica enterica serovar Typhi
auguuaaaguuuuucauaucc

SEQ ID NO: 3634242 - RNA, 18 nt, Salmonella enterica enterica serovar Typhi
auguuaauaccagcgcca

SEQ ID NO: 3634243 - RNA, 17 nt, Salmonella enterica enterica serovar Typhi
auguuaauuucaucgcc

SEQ ID NO: 3634244 - RNA, 15 nt, Salmonella enterica enterica serovar Typhi
auguuagcaaaaaug

SEQ ID NO: 3634245 - RNA, 17 nt, Salmonella enterica enterica serovar Typhi
auguuaggguagaaaaa

SEQ ID NO: 3634246 - RNA, 13 nt, Salmonella enterica enterica serovar Typhi
auguuauaaacuu

SEQ ID NO: 3634247 - RNA, 22 nt, Salmonella enterica enterica serovar Typhi
auguucaacgucagcuggaaug

SEQ ID NO: 3634248 - RNA, 13 nt, Salmonella enterica enterica serovar Typhi
auguuccacaauc

SEQ ID NO: 3634249 - RNA, 14 nt, Salmonella enterica enterica serovar Typhi
auguuccgcagggg

SEQ ID NO: 3634250 - RNA, 18 nt, Salmonella enterica enterica serovar Typhi
auguuccgcaggggauuc

SEQ ID NO: 3634251 - RNA, 19 nt, Salmonella enterica enterica serovar Typhi
auguuccgcuaccugcgag

SEQ ID NO: 3634252 - RNA, 23 nt, Salmonella enterica enterica serovar Typhi
auguuccuggacguggguuucaa

SEQ ID NO: 3634253 - RNA, 14 nt, Salmonella enterica enterica serovar Typhi
auguucgaacaugc

SEQ ID NO: 3634254 - RNA, 21 nt, Salmonella enterica enterica serovar Typhi
auguugaucguaaaaugaaaa

SEQ ID NO: 3634255 - RNA, 14 nt, Salmonella enterica enterica serovar Typhi
auuacaaaaaucau

SEQ ID NO: 3634256 - RNA, 20 nt, Salmonella enterica enterica serovar Typhi
auuacaaaauaagucauauc

SEQ ID NO: 3634257 - RNA, 16 nt, Salmonella enterica enterica serovar Typhi
auuacaaacaggcuuu

SEQ ID NO: 3634258 - RNA, 21 nt, Salmonella enterica enterica serovar Typhi
auuacaaacaggcuuuauaca

SEQ ID NO: 3634259 - RNA, 21 nt, Salmonella enterica enterica serovar Typhi
auuacaaagggcaauauauua

SEQ ID NO: 3634260 - RNA, 14 nt, Salmonella enterica enterica serovar Typhi
auuacaacaugucc

SEQ ID NO: 3634261 - RNA, 13 nt, Salmonella enterica enterica serovar Typhi
auuacaagaaagu

SEQ ID NO: 3634262 - RNA, 16 nt, Salmonella enterica enterica serovar Typhi
auuacaaguaauaaaa

SEQ ID NO: 3634263 - RNA, 17 nt, Salmonella enterica enterica serovar Typhi
auuacagauauccaccg

SEQ ID NO: 3634264 - RNA, 18 nt, Salmonella enterica enterica serovar Typhi
auuacagccgcgaugcua

SEQ ID NO: 3634265 - RNA, 19 nt, Salmonella enterica enterica serovar Typhi
auuacagcguguucaugcg

SEQ ID NO: 3634266 - RNA, 20 nt, Salmonella enterica enterica serovar Typhi
auuacagguguuaaucauuu

SEQ ID NO: 3634267 - RNA, 18 nt, Salmonella enterica enterica serovar Typhi
auuacaucaauaaacauu

SEQ ID NO: 3634268 - RNA, 16 nt, Salmonella enterica enterica serovar Typhi
auuaccaguacggaaa

SEQ ID NO: 3634269 - RNA, 17 nt, Salmonella enterica enterica serovar Typhi
auuacccaauaaugaac

SEQ ID NO: 3634270 - RNA, 18 nt, Salmonella enterica enterica serovar Typhi
auuaccccgugguggggu

SEQ ID NO: 3634271 - RNA, 12 nt, Salmonella enterica enterica serovar Typhi
auuaccgcaucg

SEQ ID NO: 3634272 - RNA, 22 nt, Salmonella enterica enterica serovar Typhi
auuaccgggauuuccauauuaa

SEQ ID NO: 3634273 - RNA, 16 nt, Salmonella enterica enterica serovar Typhi
auuaccugguauuauu

SEQ ID NO: 3634274 - RNA, 18 nt, Salmonella enterica enterica serovar Typhi
auuacgaaaaggucuuuc

SEQ ID NO: 3634275 - RNA, 16 nt, Salmonella enterica enterica serovar Typhi
auuacgcuauaaaguu

SEQ ID NO: 3634276 - RNA, 19 nt, Salmonella enterica enterica serovar Typhi
auuacgcuauaaaguuccc

SEQ ID NO: 3634277 - RNA, 21 nt, Salmonella enterica enterica serovar Typhi
auuacgcuauaaaguucccau

SEQ ID NO: 3634278 - RNA, 19 nt, Salmonella enterica enterica serovar Typhi
auuacggcgaaugcgguaa

SEQ ID NO: 3634279 - RNA, 22 nt, Salmonella enterica enterica serovar Typhi
auuacguuggggauaaccagaa

SEQ ID NO: 3634280 - RNA, 21 nt, Salmonella enterica enterica serovar Typhi
auuacuaucuucaaagccaca

SEQ ID NO: 3634281 - RNA, 14 nt, Salmonella enterica enterica serovar Typhi
auuacucuuuaugc

SEQ ID NO: 3634282 - RNA, 13 nt, Salmonella enterica enterica serovar Typhi
auuacugauaaag

SEQ ID NO: 3634283 - RNA, 23 nt, Salmonella enterica enterica serovar Typhi
auuacugcguaaaccauuucucc

SEQ ID NO: 3634284 - RNA, 20 nt, Salmonella enterica enterica serovar Typhi
auuacugcgugcuggcggcc

SEQ ID NO: 3634285 - RNA, 13 nt, Salmonella enterica enterica serovar Typhi
auuacuggaucau

SEQ ID NO: 3634286 - RNA, 15 nt, Salmonella enterica enterica serovar Typhi
auuacuuaugauaua

SEQ ID NO: 3634287 - RNA, 15 nt, Salmonella enterica enterica serovar Typhi
auuacuucaggcugc

SEQ ID NO: 3634288 - RNA, 15 nt, Salmonella enterica enterica serovar Typhi
auuacuuuccagcaa

SEQ ID NO: 3634289 - RNA, 20 nt, Salmonella enterica enterica serovar Typhi
auuagaaacccauauuccug

SEQ ID NO: 3634290 - RNA, 15 nt, Salmonella enterica enterica serovar Typhi
auuagacuucuucca

SEQ ID NO: 3634291 - RNA, 18 nt, Salmonella enterica enterica serovar Typhi
auuagaggcguaaguaaa

SEQ ID NO: 3634292 - RNA, 16 nt, Salmonella enterica enterica serovar Typhi
auuagaggucagaaua

SEQ ID NO: 3634293 - RNA, 20 nt, Salmonella enterica enterica serovar Typhi
auuagaggucagaauaacuc

SEQ ID NO: 3634294 - RNA, 17 nt, Salmonella enterica enterica serovar Typhi
auuagcaccguuucuga

SEQ ID NO: 3634295 - RNA, 15 nt, Salmonella enterica enterica serovar Typhi
auuagccgccauccg

SEQ ID NO: 3634296 - RNA, 22 nt, Salmonella enterica enterica serovar Typhi
auuagccgccauccggcaucuc

SEQ ID NO: 3634297 - RNA, 22 nt, Salmonella enterica enterica serovar Typhi
auuagcgacgcauacucuugga

SEQ ID NO: 3634298 - RNA, 13 nt, Salmonella enterica enterica serovar Typhi
auuagcuggcugc

SEQ ID NO: 3634299 - RNA, 19 nt, Salmonella enterica enterica serovar Typhi
auuaggcguaaaauugccg

SEQ ID NO: 3634300 - RNA, 23 nt, Salmonella enterica enterica serovar Typhi
auuaguccgucggggauggcgga

SEQ ID NO: 3634301 - RNA, 16 nt, Salmonella enterica enterica serovar Typhi
auuaguccugccgcua

SEQ ID NO: 3634302 - RNA, 15 nt, Salmonella enterica enterica serovar Typhi
auuauaaagcauaaa

SEQ ID NO: 3634303 - RNA, 16 nt, Salmonella enterica enterica serovar Typhi
auuauacauucgcuca

SEQ ID NO: 3634304 - RNA, 22 nt, Salmonella enterica enterica serovar Typhi
auuauacuugcugcuauguaaa

SEQ ID NO: 3634305 - RNA, 18 nt, Salmonella enterica enterica serovar Typhi
auuauauagacuccguca

SEQ ID NO: 3634306 - RNA, 16 nt, Salmonella enterica enterica serovar Typhi
auuauauagucuuaau

SEQ ID NO: 3634307 - RNA, 13 nt, Salmonella enterica enterica serovar Typhi
auuauauuuaaaa

SEQ ID NO: 3634308 - RNA, 15 nt, Salmonella enterica enterica serovar Typhi
auuauauuuaaaauu

SEQ ID NO: 3634309 - RNA, 17 nt, Salmonella enterica enterica serovar Typhi
auuauauuuaaaauucc

SEQ ID NO: 3634310 - RNA, 14 nt, Salmonella enterica enterica serovar Typhi
auuauauuuuaugg

SEQ ID NO: 3634311 - RNA, 16 nt, Salmonella enterica enterica serovar Typhi
auuaucaauagcuuca

SEQ ID NO: 3634312 - RNA, 12 nt, Salmonella enterica enterica serovar Typhi
auuaucaccauu

SEQ ID NO: 3634313 - RNA, 13 nt, Salmonella enterica enterica serovar Typhi
auuaucaggauga

SEQ ID NO: 3634314 - RNA, 18 nt, Salmonella enterica enterica serovar Typhi
auuaucaggaugaauaug

SEQ ID NO: 3634315 - RNA, 22 nt, Salmonella enterica enterica serovar Typhi
auuauccacaaacuccagacga

SEQ ID NO: 3634316 - RNA, 23 nt, Salmonella enterica enterica serovar Typhi
auuauccagccgaaguucauaaa

SEQ ID NO: 3634317 - RNA, 18 nt, Salmonella enterica enterica serovar Typhi
auuauccgccgcaaauuc

SEQ ID NO: 3634318 - RNA, 23 nt, Salmonella enterica enterica serovar Typhi
auuauccuuuaauuaauccauuu

SEQ ID NO: 3634319 - RNA, 18 nt, Salmonella enterica enterica serovar Typhi
auuaucgauuugguaaau

SEQ ID NO: 3634320 - RNA, 22 nt, Salmonella enterica enterica serovar Typhi
auuaucgauuugguaaauaacu

SEQ ID NO: 3634321 - RNA, 13 nt, Salmonella enterica enterica serovar Typhi
auuaucgccauca

SEQ ID NO: 3634322 - RNA, 14 nt, Salmonella enterica enterica serovar Typhi
auuaucgcuccgga

SEQ ID NO: 3634323 - RNA, 16 nt, Salmonella enterica enterica serovar Typhi
auuaucguccggcauc

SEQ ID NO: 3634324 - RNA, 17 nt, Salmonella enterica enterica serovar Typhi
auuaucguuuacguuau

SEQ ID NO: 3634325 - RNA, 18 nt, Salmonella enterica enterica serovar Typhi
auuaucugauucaauuaa

SEQ ID NO: 3634326 - RNA, 23 nt, Salmonella enterica enterica serovar Typhi
auuaucugccagccgauuuuucg

SEQ ID NO: 3634327 - RNA, 16 nt, Salmonella enterica enterica serovar Typhi
auuaucuuuauugaaa

SEQ ID NO: 3634328 - RNA, 17 nt, Salmonella enterica enterica serovar Typhi
auuaugaucgguuuuuu

SEQ ID NO: 3634329 - RNA, 13 nt, Salmonella enterica enterica serovar Typhi
auuaugccgacca

SEQ ID NO: 3634330 - RNA, 19 nt, Salmonella enterica enterica serovar Typhi
auuaugccgcacuccccag

SEQ ID NO: 3634331 - RNA, 20 nt, Salmonella enterica enterica serovar Typhi
auuaugccgcacuccccaga

SEQ ID NO: 3634332 - RNA, 16 nt, Salmonella enterica enterica serovar Typhi
auuauuaaaucaauac

SEQ ID NO: 3634333 - RNA, 12 nt, Salmonella enterica enterica serovar Typhi
auuauuccccuc

SEQ ID NO: 3634334 - RNA, 21 nt, Salmonella enterica enterica serovar Typhi
auuauuccuugaucaggaaau

SEQ ID NO: 3634335 - RNA, 13 nt, Salmonella enterica enterica serovar Typhi
auuauucugcuga

SEQ ID NO: 3634336 - RNA, 14 nt, Salmonella enterica enterica serovar Typhi
auuauugcacauaa

SEQ ID NO: 3634337 - RNA, 22 nt, Salmonella enterica enterica serovar Typhi
auuauugcguugcuuuauaaaa

SEQ ID NO: 3634338 - RNA, 15 nt, Salmonella enterica enterica serovar Typhi
auuauuggugaaaaa

SEQ ID NO: 3634339 - RNA, 20 nt, Salmonella enterica enterica serovar Typhi
auuauuggugaaaaaucauu

SEQ ID NO: 3634340 - RNA, 19 nt, Salmonella enterica enterica serovar Typhi
auuauuuuagugaaaaaau

SEQ ID NO: 3634341 - RNA, 21 nt, Salmonella enterica enterica serovar Typhi
auuccgcgcuaucgguaucau

SEQ ID NO: 3634342 - RNA, 23 nt, Salmonella enterica enterica serovar Typhi
auuccgcguguuuguaaaaauag

SEQ ID NO: 3634343 - RNA, 16 nt, Salmonella enterica enterica serovar Typhi
auuccgcuuccagaau

SEQ ID NO: 3634344 - RNA, 16 nt, Salmonella enterica enterica serovar Typhi
auuccgcuucuuccau

SEQ ID NO: 3634345 - RNA, 23 nt, Salmonella enterica enterica serovar Typhi
auuccggcacucugcgccagguu

SEQ ID NO: 3634346 - RNA, 13 nt, Salmonella enterica enterica serovar Typhi
auuccggcgcugg

SEQ ID NO: 3634347 - RNA, 14 nt, Salmonella enterica enterica serovar Typhi
auuccggcgcuggc

SEQ ID NO: 3634348 - RNA, 21 nt, Salmonella enterica enterica serovar Typhi
auuccgucaggaacggauaac

SEQ ID NO: 3634349 - RNA, 17 nt, Salmonella enterica enterica serovar Typhi
auuccgugucugaauga

SEQ ID NO: 3634350 - RNA, 16 nt, Salmonella enterica enterica serovar Typhi
auuccucagaauccgu

SEQ ID NO: 3634351 - RNA, 19 nt, Salmonella enterica enterica serovar Typhi
auuccugacauuuauauua

SEQ ID NO: 3634352 - RNA, 20 nt, Salmonella enterica enterica serovar Typhi
auuccugccgccgcaccacu

SEQ ID NO: 3634353 - RNA, 14 nt, Salmonella enterica enterica serovar Typhi
auuccuggauuaaa

SEQ ID NO: 3634354 - RNA, 17 nt, Salmonella enterica enterica serovar Typhi
auuccuggcguaugcuu

SEQ ID NO: 3634355 - RNA, 15 nt, Salmonella enterica enterica serovar Typhi
auuccuuuaaauauc

SEQ ID NO: 3634356 - RNA, 22 nt, Salmonella enterica enterica serovar Typhi
auucgacugcggucguauuuac

SEQ ID NO: 3634357 - RNA, 20 nt, Salmonella enterica enterica serovar Typhi
auucgagauuuuucugcgcc

SEQ ID NO: 3634358 - RNA, 18 nt, Salmonella enterica enterica serovar Typhi
auucgaugguguuaccgc

SEQ ID NO: 3634359 - RNA, 16 nt, Salmonella enterica enterica serovar Typhi
auucgccaccaggcuc

SEQ ID NO: 3634360 - RNA, 23 nt, Salmonella enterica enterica serovar Typhi
auucgccaccgcgcgcuuaaucg

SEQ ID NO: 3634361 - RNA, 16 nt, Salmonella enterica enterica serovar Typhi
auucgccagcgugcuu

SEQ ID NO: 3634362 - RNA, 15 nt, Salmonella enterica enterica serovar Typhi
auucgccccagcaua

SEQ ID NO: 3634363 - RNA, 13 nt, Salmonella enterica enterica serovar Typhi
auucgcccggcag

SEQ ID NO: 3634364 - RNA, 18 nt, Salmonella enterica enterica serovar Typhi
auucgcgaugcucaacca

SEQ ID NO: 3634365 - RNA, 11 nt, Salmonella enterica enterica serovar Typhi
auucgcggcaa

SEQ ID NO: 3634366 - RNA, 14 nt, Salmonella enterica enterica serovar Typhi
auucgcuaauaaau

SEQ ID NO: 3634367 - RNA, 14 nt, Salmonella enterica enterica serovar Typhi
auucgcuaauaauu

SEQ ID NO: 3634368 - RNA, 19 nt, Salmonella enterica enterica serovar Typhi
auucgcuaauccccccuuu

SEQ ID NO: 3634369 - RNA, 20 nt, Salmonella enterica enterica serovar Typhi
auucgcugaauguugcucgc

SEQ ID NO: 3634370 - RNA, 12 nt, Salmonella enterica enterica serovar Typhi
auucgcuugccc

SEQ ID NO: 3634371 - RNA, 20 nt, Salmonella enterica enterica serovar Typhi
auucggaaugaugugcuauu

SEQ ID NO: 3634372 - RNA, 14 nt, Salmonella enterica enterica serovar Typhi
auucggcccugcgc

SEQ ID NO: 3634373 - RNA, 19 nt, Salmonella enterica enterica serovar Typhi
auucggccuucgguuuuau

SEQ ID NO: 3634374 - RNA, 16 nt, Salmonella enterica enterica serovar Typhi
auucggcgaaagaagc

SEQ ID NO: 3634375 - RNA, 22 nt, Salmonella enterica enterica serovar Typhi
auucggcgcuucgcagcgauau

SEQ ID NO: 3634376 - RNA, 22 nt, Salmonella enterica enterica serovar Typhi
auucgggacaaacccccagcca

SEQ ID NO: 3634377 - RNA, 17 nt, Salmonella enterica enterica serovar Typhi
auucgguaguuccagaa

SEQ ID NO: 3634378 - RNA, 16 nt, Salmonella enterica enterica serovar Typhi
auucguuaccagcauc

SEQ ID NO: 3634379 - RNA, 19 nt, Salmonella enterica enterica serovar Typhi
auucuaacauaaugaaucc

SEQ ID NO: 3634380 - RNA, 17 nt, Salmonella enterica enterica serovar Typhi
auucuacaaguucagua

SEQ ID NO: 3634381 - RNA, 19 nt, Salmonella enterica enterica serovar Typhi
auucuacaguuugucauca

SEQ ID NO: 3634382 - RNA, 12 nt, Salmonella enterica enterica serovar Typhi
auucuaugccag

SEQ ID NO: 3634383 - RNA, 20 nt, Salmonella enterica enterica serovar Typhi
auucucagccagguauuuag

SEQ ID NO: 3634384 - RNA, 21 nt, Salmonella enterica enterica serovar Typhi
auucucccuacugcuuagcuc

SEQ ID NO: 3634385 - RNA, 14 nt, Salmonella enterica enterica serovar Typhi
auucucgcacuuua

SEQ ID NO: 3634386 - RNA, 17 nt, Salmonella enterica enterica serovar Typhi
auucucugucgccgccc

SEQ ID NO: 3634387 - RNA, 22 nt, Salmonella enterica enterica serovar Typhi
auucugaaaaggggauaacaac

SEQ ID NO: 3634388 - RNA, 18 nt, Salmonella enterica enterica serovar Typhi
auucugacgcagcuucug

SEQ ID NO: 3634389 - RNA, 15 nt, Salmonella enterica enterica serovar Typhi
auucugccaguucac

SEQ ID NO: 3634390 - RNA, 15 nt, Salmonella enterica enterica serovar Typhi
auucugcgccagcca

SEQ ID NO: 3634391 - RNA, 16 nt, Salmonella enterica enterica serovar Typhi
auucugcgccagccag

SEQ ID NO: 3634392 - RNA, 13 nt, Salmonella enterica enterica serovar Typhi
auucugcgguaau

SEQ ID NO: 3634393 - RNA, 13 nt, Salmonella enterica enterica serovar Typhi
auucugcugaugc

SEQ ID NO: 3634394 - RNA, 15 nt, Salmonella enterica enterica serovar Typhi
auucugcuuccagaa

SEQ ID NO: 3634395 - RNA, 21 nt, Salmonella enterica enterica serovar Typhi
auucugcuucgucuucggcga

SEQ ID NO: 3634396 - RNA, 21 nt, Salmonella enterica enterica serovar Typhi
auucuggaaucaauuucccuu

SEQ ID NO: 3634397 - RNA, 18 nt, Salmonella enterica enterica serovar Typhi
auucugguaguaagucag

SEQ ID NO: 3634398 - RNA, 22 nt, Salmonella enterica enterica serovar Typhi
auucuguaucgcuuauuuucgu

SEQ ID NO: 3634399 - RNA, 22 nt, Salmonella enterica enterica serovar Typhi
auucugugaugaugcguuuguu

SEQ ID NO: 3634400 - RNA, 18 nt, Salmonella enterica enterica serovar Typhi
auucuguuagcgcccucu

SEQ ID NO: 3634401 - RNA, 18 nt, Salmonella enterica enterica serovar Typhi
auucuuaguccucagcga

SEQ ID NO: 3634402 - RNA, 22 nt, Salmonella enterica enterica serovar Typhi
auucuucgccgaagugugccag

SEQ ID NO: 3634403 - RNA, 19 nt, Salmonella enterica enterica serovar Typhi
auucuucuaccagaacgac

SEQ ID NO: 3634404 - RNA, 17 nt, Salmonella enterica enterica serovar Typhi
auucuugcccuauaaua

SEQ ID NO: 3634405 - RNA, 15 nt, Salmonella enterica enterica serovar Typhi
auucuugccgcaucu

SEQ ID NO: 3634406 - RNA, 19 nt, Salmonella enterica enterica serovar Typhi
auucuuuaauuugugccag

SEQ ID NO: 3634407 - RNA, 20 nt, Salmonella enterica enterica serovar Typhi
auucuuuacuaauaccugga

SEQ ID NO: 3634408 - RNA, 19 nt, Salmonella enterica enterica serovar Typhi
auucuuucgcguaaacacu

SEQ ID NO: 3634409 - RNA, 17 nt, Salmonella enterica enterica serovar Typhi
auucuuuucacgcauug

SEQ ID NO: 3634410 - RNA, 20 nt, Salmonella enterica enterica serovar Typhi
auugaaaagcagccagaccc

SEQ ID NO: 3634411 - RNA, 21 nt, Salmonella enterica enterica serovar Typhi
auugaacauuuuuucagccug

SEQ ID NO: 3634412 - RNA, 12 nt, Salmonella enterica enterica serovar Typhi
auugaacgugau

SEQ ID NO: 3634413 - RNA, 14 nt, Salmonella enterica enterica serovar Typhi
auugaagugguggc

SEQ ID NO: 3634414 - RNA, 22 nt, Salmonella enterica enterica serovar Typhi
auugaauaugguggucggcaau

SEQ ID NO: 3634415 - RNA, 19 nt, Salmonella enterica enterica serovar Typhi
auugaauucaccgcaugac

SEQ ID NO: 3634416 - RNA, 16 nt, Salmonella enterica enterica serovar Typhi
auugaccgcuuuuucc

SEQ ID NO: 3634417 - RNA, 17 nt, Salmonella enterica enterica serovar Typhi
auugaccgcuuuuucca

SEQ ID NO: 3634418 - RNA, 14 nt, Salmonella enterica enterica serovar Typhi
auugaccggaaaaa

SEQ ID NO: 3634419 - RNA, 18 nt, Salmonella enterica enterica serovar Typhi
auugacgggaaaucuccc

SEQ ID NO: 3634420 - RNA, 16 nt, Salmonella enterica enterica serovar Typhi
auugacgguaaaguaa

SEQ ID NO: 3634421 - RNA, 17 nt, Salmonella enterica enterica serovar Typhi
auugacuggauuuuuga

SEQ ID NO: 3634422 - RNA, 15 nt, Salmonella enterica enterica serovar Typhi
auugacuuucagagc

SEQ ID NO: 3634423 - RNA, 21 nt, Salmonella enterica enterica serovar Typhi
auugagacaugccgccagacc

SEQ ID NO: 3634424 - RNA, 22 nt, Salmonella enterica enterica serovar Typhi
auugagacaugccgccagacca

SEQ ID NO: 3634425 - RNA, 20 nt, Salmonella enterica enterica serovar Typhi
auugagcgcaaaacgcugcu

SEQ ID NO: 3634426 - RNA, 18 nt, Salmonella enterica enterica serovar Typhi
auugagcuggauaagcug

SEQ ID NO: 3634427 - RNA, 20 nt, Salmonella enterica enterica serovar Typhi
auugaggcggguaauuugcg

SEQ ID NO: 3634428 - RNA, 20 nt, Salmonella enterica enterica serovar Typhi
auugagguauaggaaaauga

SEQ ID NO: 3634429 - RNA, 16 nt, Salmonella enterica enterica serovar Typhi
auugauaauaaccguc

SEQ ID NO: 3634430 - RNA, 22 nt, Salmonella enterica enterica serovar Typhi
auugauaccuaaacgcgucaga

SEQ ID NO: 3634431 - RNA, 20 nt, Salmonella enterica enterica serovar Typhi
auugauauagaguccagcca

SEQ ID NO: 3634432 - RNA, 12 nt, Salmonella enterica enterica serovar Typhi
auugauccacgg

SEQ ID NO: 3634433 - RNA, 15 nt, Salmonella enterica enterica serovar Typhi
auugauggccagccc

SEQ ID NO: 3634434 - RNA, 20 nt, Salmonella enterica enterica serovar Typhi
auugauuaaucgucaucccg

SEQ ID NO: 3634435 - RNA, 13 nt, Salmonella enterica enterica serovar Typhi
auugauucccggu

SEQ ID NO: 3634436 - RNA, 12 nt, Salmonella enterica enterica serovar Typhi
auugauucugug

SEQ ID NO: 3634437 - RNA, 20 nt, Salmonella enterica enterica serovar Typhi
auugauuuccgcgcaaucgc

SEQ ID NO: 3634438 - RNA, 17 nt, Salmonella enterica enterica serovar Typhi
auugcaacgaucccuaa

SEQ ID NO: 3634439 - RNA, 13 nt, Salmonella enterica enterica serovar Typhi
auugcaagaauau

SEQ ID NO: 3634440 - RNA, 15 nt, Salmonella enterica enterica serovar Typhi
auugcaccauuuaca

SEQ ID NO: 3634441 - RNA, 20 nt, Salmonella enterica enterica serovar Typhi
auugcagauaauuuugcaua

SEQ ID NO: 3634442 - RNA, 21 nt, Salmonella enterica enterica serovar Typhi
auugcagcauuacacuauguu

SEQ ID NO: 3634443 - RNA, 17 nt, Salmonella enterica enterica serovar Typhi
auugcagcgaccuggga

SEQ ID NO: 3634444 - RNA, 13 nt, Salmonella enterica enterica serovar Typhi
auugcauaucgcu

SEQ ID NO: 3634445 - RNA, 15 nt, Salmonella enterica enterica serovar Typhi
auugccacaauauca

SEQ ID NO: 3634446 - RNA, 16 nt, Salmonella enterica enterica serovar Typhi
auugccacagccucag

SEQ ID NO: 3634447 - RNA, 16 nt, Salmonella enterica enterica serovar Typhi
auugccacgaacgaua

SEQ ID NO: 3634448 - RNA, 13 nt, Salmonella enterica enterica serovar Typhi
auugccacuuaau

SEQ ID NO: 3634449 - RNA, 21 nt, Salmonella enterica enterica serovar Typhi
auugccaggcguuacgcgcca

SEQ ID NO: 3634450 - RNA, 17 nt, Salmonella enterica enterica serovar Typhi
auugccauaaaaacaau

SEQ ID NO: 3634451 - RNA, 19 nt, Salmonella enterica enterica serovar Typhi
auugccauacacgcggcga

SEQ ID NO: 3634452 - RNA, 23 nt, Salmonella enterica enterica serovar Typhi
auugccaugcgacuaaccugauc

SEQ ID NO: 3634453 - RNA, 19 nt, Salmonella enterica enterica serovar Typhi
auugccauguuaauaccag

SEQ ID NO: 3634454 - RNA, 17 nt, Salmonella enterica enterica serovar Typhi
auugccgaccauuaccc

SEQ ID NO: 3634455 - RNA, 19 nt, Salmonella enterica enterica serovar Typhi
auugccgaccauuacccac

SEQ ID NO: 3634456 - RNA, 19 nt, Salmonella enterica enterica serovar Typhi
auugccgaccgccagcaga

SEQ ID NO: 3634457 - RNA, 22 nt, Salmonella enterica enterica serovar Typhi
auugccgaccgccagcagagcg

SEQ ID NO: 3634458 - RNA, 15 nt, Salmonella enterica enterica serovar Typhi
auugccgcacauguu

SEQ ID NO: 3634459 - RNA, 21 nt, Salmonella enterica enterica serovar Typhi
auugccgccaucuuuacccug

SEQ ID NO: 3634460 - RNA, 20 nt, Salmonella enterica enterica serovar Typhi
auugccgcuuaaauuaccgc

SEQ ID NO: 3634461 - RNA, 24 nt, Salmonella enterica enterica serovar Typhi
auugccggauggggcauuagccgc

SEQ ID NO: 3634462 - RNA, 23 nt, Salmonella enterica enterica serovar Typhi
auugccggcaucauucugcaggc

SEQ ID NO: 3634463 - RNA, 13 nt, Salmonella enterica enterica serovar Typhi
auugccggccuga

SEQ ID NO: 3634464 - RNA, 21 nt, Salmonella enterica enterica serovar Typhi
auugccggcgaccaugccagc

SEQ ID NO: 3634465 - RNA, 16 nt, Salmonella enterica enterica serovar Typhi
auugccuaaauaacuc

SEQ ID NO: 3634466 - RNA, 16 nt, Salmonella enterica enterica serovar Typhi
auugcgaauaaaacug

SEQ ID NO: 3634467 - RNA, 18 nt, Salmonella enterica enterica serovar Typhi
auugcgaauaaaacugcc

SEQ ID NO: 3634468 - RNA, 22 nt, Salmonella enterica enterica serovar Typhi
auugcgacaacuagaauuuuca

SEQ ID NO: 3634469 - RNA, 20 nt, Salmonella enterica enterica serovar Typhi
auugcgacaagcucauuucc

SEQ ID NO: 3634470 - RNA, 20 nt, Salmonella enterica enterica serovar Typhi
auugcgacaggcugccgaca

SEQ ID NO: 3634471 - RNA, 15 nt, Salmonella enterica enterica serovar Typhi
auugcgagaaaaaac

SEQ ID NO: 3634472 - RNA, 16 nt, Salmonella enterica enterica serovar Typhi
auugcgauaugcuguu

SEQ ID NO: 3634473 - RNA, 14 nt, Salmonella enterica enterica serovar Typhi
auugcgccagcuuu

SEQ ID NO: 3634474 - RNA, 15 nt, Salmonella enterica enterica serovar Typhi
auugcgccccagcac

SEQ ID NO: 3634475 - RNA, 21 nt, Salmonella enterica enterica serovar Typhi
auugcgccugggauaagcaga

SEQ ID NO: 3634476 - RNA, 18 nt, Salmonella enterica enterica serovar Typhi
auugcgcuaaaauccacg

SEQ ID NO: 3634477 - RNA, 19 nt, Salmonella enterica enterica serovar Typhi
auugcgcuaaaauccacgu

SEQ ID NO: 3634478 - RNA, 15 nt, Salmonella enterica enterica serovar Typhi
auugcgguucugcau

SEQ ID NO: 3634479 - RNA, 22 nt, Salmonella enterica enterica serovar Typhi
auugcguaucguaagccaccgc

SEQ ID NO: 3634480 - RNA, 13 nt, Salmonella enterica enterica serovar Typhi
auugcucacccau

SEQ ID NO: 3634481 - RNA, 20 nt, Salmonella enterica enterica serovar Typhi
auugcucuuccggcauaaaa

SEQ ID NO: 3634482 - RNA, 16 nt, Salmonella enterica enterica serovar Typhi
auugcugaagauaaaa

SEQ ID NO: 3634483 - RNA, 22 nt, Salmonella enterica enterica serovar Typhi
auugcugacaaaauaaagugaa

SEQ ID NO: 3634484 - RNA, 14 nt, Salmonella enterica enterica serovar Typhi
auugcugagcugac

SEQ ID NO: 3634485 - RNA, 23 nt, Salmonella enterica enterica serovar Typhi
auugcuguaggcacuuuccagac

SEQ ID NO: 3634486 - RNA, 15 nt, Salmonella enterica enterica serovar Typhi
auugcuguuaauuuc

SEQ ID NO: 3634487 - RNA, 22 nt, Salmonella enterica enterica serovar Typhi
auugcuucguggcaaucagcaa

SEQ ID NO: 3634488 - RNA, 18 nt, Salmonella enterica enterica serovar Typhi
auugcuuuuggcaacggc

SEQ ID NO: 3634489 - RNA, 14 nt, Salmonella enterica enterica serovar Typhi
auugcuuuuuucca

SEQ ID NO: 3634490 - RNA, 17 nt, Salmonella enterica enterica serovar Typhi
auuggcaagaaucacgc

SEQ ID NO: 3634491 - RNA, 13 nt, Salmonella enterica enterica serovar Typhi
auuggcaccacca

SEQ ID NO: 3634492 - RNA, 14 nt, Salmonella enterica enterica serovar Typhi
auuggcaucauaaa

SEQ ID NO: 3634493 - RNA, 11 nt, Salmonella enterica enterica serovar Typhi
auuggcaucug

SEQ ID NO: 3634494 - RNA, 13 nt, Salmonella enterica enterica serovar Typhi
auuggccccuggc

SEQ ID NO: 3634495 - RNA, 15 nt, Salmonella enterica enterica serovar Typhi
auuggccccuggccg

SEQ ID NO: 3634496 - RNA, 16 nt, Salmonella enterica enterica serovar Typhi
auuggcgcagccuguu

SEQ ID NO: 3634497 - RNA, 20 nt, Salmonella enterica enterica serovar Typhi
auuggcgcgucaucaauauc

SEQ ID NO: 3634498 - RNA, 21 nt, Salmonella enterica enterica serovar Typhi
auuggcggacgaaucuggaua

SEQ ID NO: 3634499 - RNA, 16 nt, Salmonella enterica enterica serovar Typhi
auuggcggcaaagaaa

SEQ ID NO: 3634500 - RNA, 20 nt, Salmonella enterica enterica serovar Typhi
auuggcucggcgucaucccg

SEQ ID NO: 3634501 - RNA, 15 nt, Salmonella enterica enterica serovar Typhi
auugggcguaagaaa

SEQ ID NO: 3634502 - RNA, 20 nt, Salmonella enterica enterica serovar Typhi
auugggcguaagaaaaguuu

SEQ ID NO: 3634503 - RNA, 15 nt, Salmonella enterica enterica serovar Typhi
auuggggaaccuggc

SEQ ID NO: 3634504 - RNA, 12 nt, Salmonella enterica enterica serovar Typhi
auuguaaaaccg

SEQ ID NO: 3634505 - RNA, 15 nt, Salmonella enterica enterica serovar Typhi
auuguaaaaccgacu

SEQ ID NO: 3634506 - RNA, 14 nt, Salmonella enterica enterica serovar Typhi
auugucaaaaauag

SEQ ID NO: 3634507 - RNA, 21 nt, Salmonella enterica enterica serovar Typhi
auugucaccuguaaccccagc

SEQ ID NO: 3634508 - RNA, 21 nt, Salmonella enterica enterica serovar Typhi
auugucagcucuuuguuuagc

SEQ ID NO: 3634509 - RNA, 21 nt, Salmonella enterica enterica serovar Typhi
auuguccgcauucuugccgca

SEQ ID NO: 3634510 - RNA, 23 nt, Salmonella enterica enterica serovar Typhi
auuguccuuuaucugcccuuucu

SEQ ID NO: 3634511 - RNA, 17 nt, Salmonella enterica enterica serovar Typhi
auugucuuaaauaugaa

SEQ ID NO: 3634512 - RNA, 15 nt, Salmonella enterica enterica serovar Typhi
auugucuuauuauua

SEQ ID NO: 3634513 - RNA, 15 nt, Salmonella enterica enterica serovar Typhi
auugugaaccauggc

SEQ ID NO: 3634514 - RNA, 18 nt, Salmonella enterica enterica serovar Typhi
auugugagaaaagcagag

SEQ ID NO: 3634515 - RNA, 18 nt, Salmonella enterica enterica serovar Typhi
auugugcacagguaaacg

SEQ ID NO: 3634516 - RNA, 21 nt, Salmonella enterica enterica serovar Typhi
auuguggaucagacgccgcgc

SEQ ID NO: 3634517 - RNA, 17 nt, Salmonella enterica enterica serovar Typhi
auuguguuuaccucaua

SEQ ID NO: 3634518 - RNA, 14 nt, Salmonella enterica enterica serovar Typhi
auuguuccagguuu

SEQ ID NO: 3634519 - RNA, 18 nt, Salmonella enterica enterica serovar Typhi
auuguugggguuaucgcu

SEQ ID NO: 3634520 - RNA, 19 nt, Salmonella enterica enterica serovar Typhi
auuguuggugaguggccug

SEQ ID NO: 3634521 - RNA, 20 nt, Salmonella enterica enterica serovar Typhi
auuguuuaacguuucaugga

SEQ ID NO: 3634522 - RNA, 19 nt, Salmonella enterica enterica serovar Typhi
auuguuucggauaauucug

SEQ ID NO: 3634523 - RNA, 17 nt, Salmonella enterica enterica serovar Typhi
auuguuuguagaaagug

SEQ ID NO: 3634524 - RNA, 13 nt, Salmonella enterica enterica serovar Typhi
auuguuuuacuuu

SEQ ID NO: 3634525 - RNA, 15 nt, Salmonella enterica enterica serovar Typhi
auuuaaauacuuuuu

SEQ ID NO: 3634526 - RNA, 19 nt, Salmonella enterica enterica serovar Typhi
auuuaaauagcaauuauau

SEQ ID NO: 3634527 - RNA, 17 nt, Salmonella enterica enterica serovar Typhi
auuuaaauaucgguuca

SEQ ID NO: 3634528 - RNA, 22 nt, Salmonella enterica enterica serovar Typhi
auuuaacagagagggaaaaaaa

SEQ ID NO: 3634529 - RNA, 21 nt, Salmonella enterica enterica serovar Typhi
auuuaagccagacgcgcagca

SEQ ID NO: 3634530 - RNA, 19 nt, Salmonella enterica enterica serovar Typhi
auuuaagccagauguaauc

SEQ ID NO: 3634531 - RNA, 13 nt, Salmonella enterica enterica serovar Typhi
auuuaauauauga

SEQ ID NO: 3634532 - RNA, 13 nt, Salmonella enterica enterica serovar Typhi
auuuaauauuuau

SEQ ID NO: 3634533 - RNA, 17 nt, Salmonella enterica enterica serovar Typhi
auuuaauggucuuaaau

SEQ ID NO: 3634534 - RNA, 15 nt, Salmonella enterica enterica serovar Typhi
auuuaccacgguaac

SEQ ID NO: 3634535 - RNA, 17 nt, Salmonella enterica enterica serovar Typhi
auuuaccagugcuaaaa

SEQ ID NO: 3634536 - RNA, 21 nt, Salmonella enterica enterica serovar Typhi
auuuacgccaacgagaauaag

SEQ ID NO: 3634537 - RNA, 20 nt, Salmonella enterica enterica serovar Typhi
auuuacgguuggccagcaug

SEQ ID NO: 3634538 - RNA, 16 nt, Salmonella enterica enterica serovar Typhi
auuuacuccaaaaaua

SEQ ID NO: 3634539 - RNA, 16 nt, Salmonella enterica enterica serovar Typhi
auuuacugaauaaaua

SEQ ID NO: 3634540 - RNA, 11 nt, Salmonella enterica enterica serovar Typhi
auuuacugccg

SEQ ID NO: 3634541 - RNA, 15 nt, Salmonella enterica enterica serovar Typhi
auuuacugugaucca

SEQ ID NO: 3634542 - RNA, 17 nt, Salmonella enterica enterica serovar Typhi
auuuagagugauccacc

SEQ ID NO: 3634543 - RNA, 22 nt, Salmonella enterica enterica serovar Typhi
auuuagcuauuccaaaauaaua

SEQ ID NO: 3634544 - RNA, 14 nt, Salmonella enterica enterica serovar Typhi
auuuaggauuuguc

SEQ ID NO: 3634545 - RNA, 14 nt, Salmonella enterica enterica serovar Typhi
auuuauauuagggc

SEQ ID NO: 3634546 - RNA, 16 nt, Salmonella enterica enterica serovar Typhi
auuuauauugugccuc

SEQ ID NO: 3634547 - RNA, 14 nt, Salmonella enterica enterica serovar Typhi
auuuaucaauaacc

SEQ ID NO: 3634548 - RNA, 17 nt, Salmonella enterica enterica serovar Typhi
auuuaucaaucugcuuu

SEQ ID NO: 3634549 - RNA, 16 nt, Salmonella enterica enterica serovar Typhi
auuuaucaauuuuuaa

SEQ ID NO: 3634550 - RNA, 14 nt, Salmonella enterica enterica serovar Typhi
auuuauccacgccg

SEQ ID NO: 3634551 - RNA, 14 nt, Salmonella enterica enterica serovar Typhi
auuuauccagcagg

SEQ ID NO: 3634552 - RNA, 23 nt, Salmonella enterica enterica serovar Typhi
auuuaucccguggugggguuccc

SEQ ID NO: 3634553 - RNA, 14 nt, Salmonella enterica enterica serovar Typhi
auuuauccuccgaa

SEQ ID NO: 3634554 - RNA, 18 nt, Salmonella enterica enterica serovar Typhi
auuuaucgaucuccaucu

SEQ ID NO: 3634555 - RNA, 14 nt, Salmonella enterica enterica serovar Typhi
auuuaucugcguga

SEQ ID NO: 3634556 - RNA, 22 nt, Salmonella enterica enterica serovar Typhi
auuuaucuuccggcaucacauc

SEQ ID NO: 3634557 - RNA, 15 nt, Salmonella enterica enterica serovar Typhi
auuuaucuucucuau

SEQ ID NO: 3634558 - RNA, 19 nt, Salmonella enterica enterica serovar Typhi
auuuaugauuuuaacauca

SEQ ID NO: 3634559 - RNA, 20 nt, Salmonella enterica enterica serovar Typhi
auuuaugauuuuaacaucac

SEQ ID NO: 3634560 - RNA, 13 nt, Salmonella enterica enterica serovar Typhi
auuuaugccgcca

SEQ ID NO: 3634561 - RNA, 14 nt, Salmonella enterica enterica serovar Typhi
auuuaugccgccau

SEQ ID NO: 3634562 - RNA, 16 nt, Salmonella enterica enterica serovar Typhi
auuuaugccgccaucc

SEQ ID NO: 3634563 - RNA, 21 nt, Salmonella enterica enterica serovar Typhi
auuuauggcgucaccauuacu

SEQ ID NO: 3634564 - RNA, 16 nt, Salmonella enterica enterica serovar Typhi
auuuauuagugagugc

SEQ ID NO: 3634565 - RNA, 17 nt, Salmonella enterica enterica serovar Typhi
auuuauugccugaaacg

SEQ ID NO: 3634566 - RNA, 21 nt, Salmonella enterica enterica serovar Typhi
auuuauuugcauuguacuuuu

SEQ ID NO: 3634567 - RNA, 23 nt, Salmonella enterica enterica serovar Typhi
auuuauuuucugaacgcugcugu

SEQ ID NO: 3634568 - RNA, 18 nt, Salmonella enterica enterica serovar Typhi
auuuauuuugaauuuuua

SEQ ID NO: 3634569 - RNA, 19 nt, Salmonella enterica enterica serovar Typhi
auuuauuuugaauuuuuau

SEQ ID NO: 3634570 - RNA, 14 nt, Salmonella enterica enterica serovar Typhi
auuucaaaacccgc

SEQ ID NO: 3634571 - RNA, 14 nt, Salmonella enterica enterica serovar Typhi
auuucaaucaucau

SEQ ID NO: 3634572 - RNA, 13 nt, Salmonella enterica enterica serovar Typhi
auuucaaucgcgc

SEQ ID NO: 3634573 - RNA, 14 nt, Salmonella enterica enterica serovar Typhi
auuucaaucgcgcc

SEQ ID NO: 3634574 - RNA, 19 nt, Salmonella enterica enterica serovar Typhi
auuucaaugcauacugccg

SEQ ID NO: 3634575 - RNA, 21 nt, Salmonella enterica enterica serovar Typhi
auuucaccgggccaaugccgc

SEQ ID NO: 3634576 - RNA, 14 nt, Salmonella enterica enterica serovar Typhi
auuucacgcagcac

SEQ ID NO: 3634577 - RNA, 15 nt, Salmonella enterica enterica serovar Typhi
auuucagaccgugcu

SEQ ID NO: 3634578 - RNA, 18 nt, Salmonella enterica enterica serovar Typhi
auuucagaccgugcuuuu

SEQ ID NO: 3634579 - RNA, 20 nt, Salmonella enterica enterica serovar Typhi
auuucagcgcagaauuuauu

SEQ ID NO: 3634580 - RNA, 20 nt, Salmonella enterica enterica serovar Typhi
auuucaggcaaaaaaaaacc

SEQ ID NO: 3634581 - RNA, 17 nt, Salmonella enterica enterica serovar Typhi
auuucaggcaaaggaau

SEQ ID NO: 3634582 - RNA, 17 nt, Salmonella enterica enterica serovar Typhi
auuucagggaaaagaag

SEQ ID NO: 3634583 - RNA, 17 nt, Salmonella enterica enterica serovar Typhi
auuucagggcuuauuca

SEQ ID NO: 3634584 - RNA, 17 nt, Salmonella enterica enterica serovar Typhi
auuucaguacagccaaa

SEQ ID NO: 3634585 - RNA, 21 nt, Salmonella enterica enterica serovar Typhi
auuucagugaaucgacggcaa

SEQ ID NO: 3634586 - RNA, 14 nt, Salmonella enterica enterica serovar Typhi
auuucauaauaagc

SEQ ID NO: 3634587 - RNA, 16 nt, Salmonella enterica enterica serovar Typhi
auuucaucgccgccgc

SEQ ID NO: 3634588 - RNA, 15 nt, Salmonella enterica enterica serovar Typhi
auuucaucuaucugc

SEQ ID NO: 3634589 - RNA, 23 nt, Salmonella enterica enterica serovar Typhi
auuucaugcggugcaugaauauc

SEQ ID NO: 3634590 - RNA, 16 nt, Salmonella enterica enterica serovar Typhi
auuuccaccuucucuu

SEQ ID NO: 3634591 - RNA, 12 nt, Salmonella enterica enterica serovar Typhi
auuuccgcagcc

SEQ ID NO: 3634592 - RNA, 18 nt, Salmonella enterica enterica serovar Typhi
auuuccgcagccagaauc

SEQ ID NO: 3634593 - RNA, 14 nt, Salmonella enterica enterica serovar Typhi
auuuccgccgccag

SEQ ID NO: 3634594 - RNA, 13 nt, Salmonella enterica enterica serovar Typhi
auuuccggcgcau

SEQ ID NO: 3634595 - RNA, 20 nt, Salmonella enterica enterica serovar Typhi
auuuccuguguuacgccaau

SEQ ID NO: 3634596 - RNA, 19 nt, Salmonella enterica enterica serovar Typhi
auuucgacgauaaaaaaag

SEQ ID NO: 3634597 - RNA, 21 nt, Salmonella enterica enterica serovar Typhi
auuucgacgauaaaaaaagua

SEQ ID NO: 3634598 - RNA, 20 nt, Salmonella enterica enterica serovar Typhi
auuucgacgucaacgguaaa

SEQ ID NO: 3634599 - RNA, 12 nt, Salmonella enterica enterica serovar Typhi
auuucgaucugu

SEQ ID NO: 3634600 - RNA, 22 nt, Salmonella enterica enterica serovar Typhi
auuucgaucuguuuaaguacgc

SEQ ID NO: 3634601 - RNA, 18 nt, Salmonella enterica enterica serovar Typhi
auuucgcaacgccgccga

SEQ ID NO: 3634602 - RNA, 22 nt, Salmonella enterica enterica serovar Typhi
auuucgccuuugcgacgguuuu

SEQ ID NO: 3634603 - RNA, 13 nt, Salmonella enterica enterica serovar Typhi
auuucggcaauga

SEQ ID NO: 3634604 - RNA, 14 nt, Salmonella enterica enterica serovar Typhi
auuucgucaucgcu

SEQ ID NO: 3634605 - RNA, 20 nt, Salmonella enterica enterica serovar Typhi
auuucuccugcgccagccgg

SEQ ID NO: 3634606 - RNA, 21 nt, Salmonella enterica enterica serovar Typhi
auuucucgcucgcccaucacu

SEQ ID NO: 3634607 - RNA, 23 nt, Salmonella enterica enterica serovar Typhi
auuucugcugccagcgccgccgc

SEQ ID NO: 3634608 - RNA, 14 nt, Salmonella enterica enterica serovar Typhi
auuucuggccccug

SEQ ID NO: 3634609 - RNA, 23 nt, Salmonella enterica enterica serovar Typhi
auuucuuagcacccaccaucacu

SEQ ID NO: 3634610 - RNA, 14 nt, Salmonella enterica enterica serovar Typhi
auuucuuccagcac

SEQ ID NO: 3634611 - RNA, 13 nt, Salmonella enterica enterica serovar Typhi
auuucuuccauua

SEQ ID NO: 3634612 - RNA, 16 nt, Salmonella enterica enterica serovar Typhi
auuucuugaucaaucu

SEQ ID NO: 3634613 - RNA, 16 nt, Salmonella enterica enterica serovar Typhi
auuucuugcaauagcg

SEQ ID NO: 3634614 - RNA, 17 nt, Salmonella enterica enterica serovar Typhi
auuucuugcaauagcgc

SEQ ID NO: 3634615 - RNA, 23 nt, Salmonella enterica enterica serovar Typhi
auuucuuuaaugcccgguauuuu

SEQ ID NO: 3634616 - RNA, 15 nt, Salmonella enterica enterica serovar Typhi
auuucuuugucgcca

SEQ ID NO: 3634617 - RNA, 23 nt, Salmonella enterica enterica serovar Typhi
auuugaaggacugauacagccaa

SEQ ID NO: 3634618 - RNA, 20 nt, Salmonella enterica enterica serovar Typhi
auuugaauaauucuguacca

SEQ ID NO: 3634619 - RNA, 23 nt, Salmonella enterica enterica serovar Typhi
auuugacgagucggaucaugaaa

SEQ ID NO: 3634620 - RNA, 14 nt, Salmonella enterica enterica serovar Typhi
auuugacguuaucc

SEQ ID NO: 3634621 - RNA, 18 nt, Salmonella enterica enterica serovar Typhi
auuugcccuuccagcagc

SEQ ID NO: 3634622 - RNA, 22 nt, Salmonella enterica enterica serovar Typhi
auuugcgacaucagccagccgc

SEQ ID NO: 3634623 - RNA, 16 nt, Salmonella enterica enterica serovar Typhi
auuugcgcuuuuaauu

SEQ ID NO: 3634624 - RNA, 16 nt, Salmonella enterica enterica serovar Typhi
auuugcgugucaucaa

SEQ ID NO: 3634625 - RNA, 15 nt, Salmonella enterica enterica serovar Typhi
auuugcucaguucag

SEQ ID NO: 3634626 - RNA, 15 nt, Salmonella enterica enterica serovar Typhi
auuugcugcauuucu

SEQ ID NO: 3634627 - RNA, 16 nt, Salmonella enterica enterica serovar Typhi
auuugcugcugcucgc

SEQ ID NO: 3634628 - RNA, 20 nt, Salmonella enterica enterica serovar Typhi
auuugcuguuuuuuguugau

SEQ ID NO: 3634629 - RNA, 21 nt, Salmonella enterica enterica serovar Typhi
auuugcuguuuuuuguugauu

SEQ ID NO: 3634630 - RNA, 16 nt, Salmonella enterica enterica serovar Typhi
auuuggcuuaaauaau

SEQ ID NO: 3634631 - RNA, 16 nt, Salmonella enterica enterica serovar Typhi
auuugguaaauaacuu

SEQ ID NO: 3634632 - RNA, 13 nt, Salmonella enterica enterica serovar Typhi
auuuggucggcgu

SEQ ID NO: 3634633 - RNA, 19 nt, Salmonella enterica enterica serovar Typhi
auuuguacaaaaaauguga

SEQ ID NO: 3634634 - RNA, 16 nt, Salmonella enterica enterica serovar Typhi
auuuguacuucagagc

SEQ ID NO: 3634635 - RNA, 17 nt, Salmonella enterica enterica serovar Typhi
auuuguagcugcgccug

SEQ ID NO: 3634636 - RNA, 19 nt, Salmonella enterica enterica serovar Typhi
auuugucgucaugcgccag

SEQ ID NO: 3634637 - RNA, 20 nt, Salmonella enterica enterica serovar Typhi
auuugucucuuacguugcau

SEQ ID NO: 3634638 - RNA, 16 nt, Salmonella enterica enterica serovar Typhi
auuugugagauaaaaa

SEQ ID NO: 3634639 - RNA, 17 nt, Salmonella enterica enterica serovar Typhi
auuugugagcuauacgg

SEQ ID NO: 3634640 - RNA, 16 nt, Salmonella enterica enterica serovar Typhi
auuuguuaguccgccu

SEQ ID NO: 3634641 - RNA, 13 nt, Salmonella enterica enterica serovar Typhi
auuuguuaucuac

SEQ ID NO: 3634642 - RNA, 15 nt, Salmonella enterica enterica serovar Typhi
auuuguuaucuacag

SEQ ID NO: 3634643 - RNA, 15 nt, Salmonella enterica enterica serovar Typhi
auuuguugguuuaaa

SEQ ID NO: 3634644 - RNA, 14 nt, Salmonella enterica enterica serovar Typhi
auuuuaaaaauauc

SEQ ID NO: 3634645 - RNA, 20 nt, Salmonella enterica enterica serovar Typhi
auuuuaaauugguuauauua

SEQ ID NO: 3634646 - RNA, 21 nt, Salmonella enterica enterica serovar Typhi
auuuuacccgcgcaucccaca

SEQ ID NO: 3634647 - RNA, 22 nt, Salmonella enterica enterica serovar Typhi
auuuuacugcguaaucuuuuca

SEQ ID NO: 3634648 - RNA, 14 nt, Salmonella enterica enterica serovar Typhi
auuuuacuuucauu

SEQ ID NO: 3634649 - RNA, 14 nt, Salmonella enterica enterica serovar Typhi
auuuuagaucccca

SEQ ID NO: 3634650 - RNA, 22 nt, Salmonella enterica enterica serovar Typhi
auuuuaucgacgcuauuuuuca

SEQ ID NO: 3634651 - RNA, 18 nt, Salmonella enterica enterica serovar Typhi
auuuuauuauauuuaaaa

SEQ ID NO: 3634652 - RNA, 12 nt, Salmonella enterica enterica serovar Typhi
auuuuauuuuua

SEQ ID NO: 3634653 - RNA, 13 nt, Salmonella enterica enterica serovar Typhi
auuuuauuuuuca

SEQ ID NO: 3634654 - RNA, 14 nt, Salmonella enterica enterica serovar Typhi
auuuucaaaaacaa

SEQ ID NO: 3634655 - RNA, 15 nt, Salmonella enterica enterica serovar Typhi
auuuucaaaaacaag

SEQ ID NO: 3634656 - RNA, 17 nt, Salmonella enterica enterica serovar Typhi
auuuucaaaaacaaggg

SEQ ID NO: 3634657 - RNA, 14 nt, Salmonella enterica enterica serovar Typhi
auuuucaccuggau

SEQ ID NO: 3634658 - RNA, 17 nt, Salmonella enterica enterica serovar Typhi
auuuucacuuauaaaua

SEQ ID NO: 3634659 - RNA, 21 nt, Salmonella enterica enterica serovar Typhi
auuuucagccauuuuuuauug

SEQ ID NO: 3634660 - RNA, 14 nt, Salmonella enterica enterica serovar Typhi
auuuucaucauauc

SEQ ID NO: 3634661 - RNA, 22 nt, Salmonella enterica enterica serovar Typhi
auuuuccaugccuuuauuucaa

SEQ ID NO: 3634662 - RNA, 16 nt, Salmonella enterica enterica serovar Typhi
auuuuccggcgacgcu

SEQ ID NO: 3634663 - RNA, 16 nt, Salmonella enterica enterica serovar Typhi
auuuuccugaaaaaau

SEQ ID NO: 3634664 - RNA, 17 nt, Salmonella enterica enterica serovar Typhi
auuuucgauaaucgcgc

SEQ ID NO: 3634665 - RNA, 20 nt, Salmonella enterica enterica serovar Typhi
auuuucgcaaacugaucgag

SEQ ID NO: 3634666 - RNA, 18 nt, Salmonella enterica enterica serovar Typhi
auuuucggcacaucaaua

SEQ ID NO: 3634667 - RNA, 16 nt, Salmonella enterica enterica serovar Typhi
auuuucggcaucagca

SEQ ID NO: 3634668 - RNA, 17 nt, Salmonella enterica enterica serovar Typhi
auuuucggcaucagcag

SEQ ID NO: 3634669 - RNA, 21 nt, Salmonella enterica enterica serovar Typhi
auuuucgucguuucuacaaua

SEQ ID NO: 3634670 - RNA, 19 nt, Salmonella enterica enterica serovar Typhi
auuuucuccggaagcauaa

SEQ ID NO: 3634671 - RNA, 18 nt, Salmonella enterica enterica serovar Typhi
auuuucuuauuacaagaa

SEQ ID NO: 3634672 - RNA, 20 nt, Salmonella enterica enterica serovar Typhi
auuuucuuucaucaaacgga

SEQ ID NO: 3634673 - RNA, 14 nt, Salmonella enterica enterica serovar Typhi
auuuugaauuuuua

SEQ ID NO: 3634674 - RNA, 16 nt, Salmonella enterica enterica serovar Typhi
auuuugauaaaaacac

SEQ ID NO: 3634675 - RNA, 15 nt, Salmonella enterica enterica serovar Typhi
auuuugauaaaucag

SEQ ID NO: 3634676 - RNA, 23 nt, Salmonella enterica enterica serovar Typhi
auuuugauaagagaaaauaccgc

SEQ ID NO: 3634677 - RNA, 16 nt, Salmonella enterica enterica serovar Typhi
auuuugauacucauca

SEQ ID NO: 3634678 - RNA, 13 nt, Salmonella enterica enterica serovar Typhi
auuuugccuucaa

SEQ ID NO: 3634679 - RNA, 17 nt, Salmonella enterica enterica serovar Typhi
auuuugcgguuuuaauu

SEQ ID NO: 3634680 - RNA, 22 nt, Salmonella enterica enterica serovar Typhi
auuuugcucauauuguguuuuu

SEQ ID NO: 3634681 - RNA, 13 nt, Salmonella enterica enterica serovar Typhi
auuuugcuuuuuc

SEQ ID NO: 3634682 - RNA, 16 nt, Salmonella enterica enterica serovar Typhi
auuuuggggaaaauac

SEQ ID NO: 3634683 - RNA, 17 nt, Salmonella enterica enterica serovar Typhi
auuuuggggaaaauacc

SEQ ID NO: 3634684 - RNA, 21 nt, Salmonella enterica enterica serovar Typhi
auuuuguaguuguuuuaugug

SEQ ID NO: 3634685 - RNA, 19 nt, Salmonella enterica enterica serovar Typhi
auuuugucauguccagggc

SEQ ID NO: 3634686 - RNA, 13 nt, Salmonella enterica enterica serovar Typhi
auuuuuaaauaac

SEQ ID NO: 3634687 - RNA, 21 nt, Salmonella enterica enterica serovar Typhi
auuuuuaagguauugauuuuu

SEQ ID NO: 3634688 - RNA, 14 nt, Salmonella enterica enterica serovar Typhi
auuuuuaauugcug

SEQ ID NO: 3634689 - RNA, 15 nt, Salmonella enterica enterica serovar Typhi
auuuuuacaaauuua

SEQ ID NO: 3634690 - RNA, 22 nt, Salmonella enterica enterica serovar Typhi
auuuuuagcgugccgacguuca

SEQ ID NO: 3634691 - RNA, 15 nt, Salmonella enterica enterica serovar Typhi
auuuuuaguaacuua

SEQ ID NO: 3634692 - RNA, 17 nt, Salmonella enterica enterica serovar Typhi
auuuuuaugucauuuau

SEQ ID NO: 3634693 - RNA, 17 nt, Salmonella enterica enterica serovar Typhi
auuuuuauucccgccgc

SEQ ID NO: 3634694 - RNA, 14 nt, Salmonella enterica enterica serovar Typhi
auuuuucagauaac

SEQ ID NO: 3634695 - RNA, 12 nt, Salmonella enterica enterica serovar Typhi
auuuuucagggu

SEQ ID NO: 3634696 - RNA, 18 nt, Salmonella enterica enterica serovar Typhi
auuuuucauggcauagcc

SEQ ID NO: 3634697 - RNA, 22 nt, Salmonella enterica enterica serovar Typhi
auuuuucauugcaagccgaccu

SEQ ID NO: 3634698 - RNA, 17 nt, Salmonella enterica enterica serovar Typhi
auuuuuccagcucagaa

SEQ ID NO: 3634699 - RNA, 16 nt, Salmonella enterica enterica serovar Typhi
auuuuucccaucaauc

SEQ ID NO: 3634700 - RNA, 15 nt, Salmonella enterica enterica serovar Typhi
auuuuucccuggccg

SEQ ID NO: 3634701 - RNA, 18 nt, Salmonella enterica enterica serovar Typhi
auuuuucgccagguacau

SEQ ID NO: 3634702 - RNA, 19 nt, Salmonella enterica enterica serovar Typhi
auuuuucgcgucaaaacuu

SEQ ID NO: 3634703 - RNA, 16 nt, Salmonella enterica enterica serovar Typhi
auuuuucgguuuucca

SEQ ID NO: 3634704 - RNA, 23 nt, Salmonella enterica enterica serovar Typhi
auuuuucucagccagauccagug

SEQ ID NO: 3634705 - RNA, 20 nt, Salmonella enterica enterica serovar Typhi
auuuuucuggcuucuuaaaa

SEQ ID NO: 3634706 - RNA, 14 nt, Salmonella enterica enterica serovar Typhi
auuuuucugguaaa

SEQ ID NO: 3634707 - RNA, 17 nt, Salmonella enterica enterica serovar Typhi
auuuuugaucugcuuga

SEQ ID NO: 3634708 - RNA, 18 nt, Salmonella enterica enterica serovar Typhi
auuuuugcccagccuucu

SEQ ID NO: 3634709 - RNA, 15 nt, Salmonella enterica enterica serovar Typhi
auuuuuuaucuucca

SEQ ID NO: 3634710 - RNA, 12 nt, Salmonella enterica enterica serovar Typhi
auuuuuucugcu

SEQ ID NO: 3634711 - RNA, 21 nt, Salmonella enterica enterica serovar Typhi
auuuuuugacaacaaaaagau

SEQ ID NO: 3634712 - RNA, 16 nt, Salmonella enterica enterica serovar Typhi
auuuuuugcuggcggc

SEQ ID NO: 3634713 - RNA, 16 nt, Salmonella enterica enterica serovar Typhi
auuuuuugcugggaua

SEQ ID NO: 3634714 - RNA, 15 nt, Salmonella enterica enterica serovar Typhi
auuuuuugucuguau

SEQ ID NO: 3634715 - RNA, 15 nt, Salmonella enterica enterica serovar Typhi
auuuuuuucagccuu

SEQ ID NO: 3634716 - RNA, 23 nt, Salmonella enterica enterica serovar Typhi
auuuuuuucucgauaucuucccc

SEQ ID NO: 3634717 - RNA, 13 nt, Salmonella enterica enterica serovar Typhi
caaaaaaaaaccg

SEQ ID NO: 3634718 - RNA, 22 nt, Salmonella enterica enterica serovar Typhi
caaaaaaaaucccgccagcggc

SEQ ID NO: 3634719 - RNA, 22 nt, Salmonella enterica enterica serovar Typhi
caaaaaaacuaauccucuucuc

SEQ ID NO: 3634720 - RNA, 16 nt, Salmonella enterica enterica serovar Typhi
caaaaaagcaguauau

SEQ ID NO: 3634721 - RNA, 22 nt, Salmonella enterica enterica serovar Typhi
caaaaaauauagccauuuaaug

SEQ ID NO: 3634722 - RNA, 16 nt, Salmonella enterica enterica serovar Typhi
caaaaaaugugagcca

SEQ ID NO: 3634723 - RNA, 21 nt, Salmonella enterica enterica serovar Typhi
caaaaaccccgacauucccag

SEQ ID NO: 3634724 - RNA, 12 nt, Salmonella enterica enterica serovar Typhi
caaaaacgccag

SEQ ID NO: 3634725 - RNA, 15 nt, Salmonella enterica enterica serovar Typhi
caaaaacgcccccag

SEQ ID NO: 3634726 - RNA, 20 nt, Salmonella enterica enterica serovar Typhi
caaaaagaacucacucagug

SEQ ID NO: 3634727 - RNA, 15 nt, Salmonella enterica enterica serovar Typhi
caaaaagauauuaua

SEQ ID NO: 3634728 - RNA, 20 nt, Salmonella enterica enterica serovar Typhi
caaaaagauauuauaaaaua

SEQ ID NO: 3634729 - RNA, 11 nt, Salmonella enterica enterica serovar Typhi
caaaaagccuu

SEQ ID NO: 3634730 - RNA, 21 nt, Salmonella enterica enterica serovar Typhi
caaaaagcgcgccgaaaauau

SEQ ID NO: 3634731 - RNA, 18 nt, Salmonella enterica enterica serovar Typhi
caaaaaguaguuccagca

SEQ ID NO: 3634732 - RNA, 14 nt, Salmonella enterica enterica serovar Typhi
caaaaauaaaaacc

SEQ ID NO: 3634733 - RNA, 12 nt, Salmonella enterica enterica serovar Typhi
caaaaauaccac

SEQ ID NO: 3634734 - RNA, 15 nt, Salmonella enterica enterica serovar Typhi
caaaaauagcauuaa

SEQ ID NO: 3634735 - RNA, 20 nt, Salmonella enterica enterica serovar Typhi
caaaaauauggucgaaaaua

SEQ ID NO: 3634736 - RNA, 21 nt, Salmonella enterica enterica serovar Typhi
caaaaauauggucgaaaauau

SEQ ID NO: 3634737 - RNA, 16 nt, Salmonella enterica enterica serovar Typhi
caaaaaucagcccgga

SEQ ID NO: 3634738 - RNA, 14 nt, Salmonella enterica enterica serovar Typhi
caaaaauccuucuu

SEQ ID NO: 3634739 - RNA, 20 nt, Salmonella enterica enterica serovar Typhi
caaaaaucgucaucagauag

SEQ ID NO: 3634740 - RNA, 21 nt, Salmonella enterica enterica serovar Typhi
caaaaauuucgaccucuucgu

SEQ ID NO: 3634741 - RNA, 15 nt, Salmonella enterica enterica serovar Typhi
caaaacaacaaagua

SEQ ID NO: 3634742 - RNA, 16 nt, Salmonella enterica enterica serovar Typhi
caaaacaacaaaguau

SEQ ID NO: 3634743 - RNA, 17 nt, Salmonella enterica enterica serovar Typhi
caaaacccagaaucagu

SEQ ID NO: 3634744 - RNA, 17 nt, Salmonella enterica enterica serovar Typhi
caaaacgcauccagcgc

SEQ ID NO: 3634745 - RNA, 21 nt, Salmonella enterica enterica serovar Typhi
caaaacgccgguacuggagac

SEQ ID NO: 3634746 - RNA, 17 nt, Salmonella enterica enterica serovar Typhi
caaaacgcugcuauuuu

SEQ ID NO: 3634747 - RNA, 15 nt, Salmonella enterica enterica serovar Typhi
caaaacggucgguaa

SEQ ID NO: 3634748 - RNA, 18 nt, Salmonella enterica enterica serovar Typhi
caaaacguagagugcuuc

SEQ ID NO: 3634749 - RNA, 17 nt, Salmonella enterica enterica serovar Typhi
caaaacgucgugagugg

SEQ ID NO: 3634750 - RNA, 17 nt, Salmonella enterica enterica serovar Typhi
caaaacuacgccaauga

SEQ ID NO: 3634751 - RNA, 23 nt, Salmonella enterica enterica serovar Typhi
caaaacucucaccgaccugccuu

SEQ ID NO: 3634752 - RNA, 21 nt, Salmonella enterica enterica serovar Typhi
caaaacugaguuguaggcuca

SEQ ID NO: 3634753 - RNA, 14 nt, Salmonella enterica enterica serovar Typhi
caaaagaaaaaacu

SEQ ID NO: 3634754 - RNA, 18 nt, Salmonella enterica enterica serovar Typhi
caaaagaaagcaauagcu

SEQ ID NO: 3634755 - RNA, 23 nt, Salmonella enterica enterica serovar Typhi
caaaagaggaaguugcucccgca

SEQ ID NO: 3634756 - RNA, 14 nt, Salmonella enterica enterica serovar Typhi
caaaagauugauuu

SEQ ID NO: 3634757 - RNA, 22 nt, Salmonella enterica enterica serovar Typhi
caaaagauuuaucaauuuuuaa

SEQ ID NO: 3634758 - RNA, 21 nt, Salmonella enterica enterica serovar Typhi
caaaagccggucguaaugagc

SEQ ID NO: 3634759 - RNA, 22 nt, Salmonella enterica enterica serovar Typhi
caaaagccggucguaaugagca

SEQ ID NO: 3634760 - RNA, 17 nt, Salmonella enterica enterica serovar Typhi
caaaagccuguuuacca

SEQ ID NO: 3634761 - RNA, 23 nt, Salmonella enterica enterica serovar Typhi
caaaagcugugacgacguaacgg

SEQ ID NO: 3634762 - RNA, 17 nt, Salmonella enterica enterica serovar Typhi
caaaaggauacagcgcc

SEQ ID NO: 3634763 - RNA, 22 nt, Salmonella enterica enterica serovar Typhi
caaaaggccuuuuuuuuaugcg

SEQ ID NO: 3634764 - RNA, 20 nt, Salmonella enterica enterica serovar Typhi
caaaaggcgccgcuuccccc

SEQ ID NO: 3634765 - RNA, 23 nt, Salmonella enterica enterica serovar Typhi
caaaaggcuccacuucgguuugu

SEQ ID NO: 3634766 - RNA, 16 nt, Salmonella enterica enterica serovar Typhi
caaaagugaucauggu

SEQ ID NO: 3634767 - RNA, 18 nt, Salmonella enterica enterica serovar Typhi
caaaauaaauauccuccg

SEQ ID NO: 3634768 - RNA, 18 nt, Salmonella enterica enterica serovar Typhi
caaaauaacguuuaaacu

SEQ ID NO: 3634769 - RNA, 17 nt, Salmonella enterica enterica serovar Typhi
caaaauaagucauauca

SEQ ID NO: 3634770 - RNA, 16 nt, Salmonella enterica enterica serovar Typhi
caaaauaauacguuua

SEQ ID NO: 3634771 - RNA, 14 nt, Salmonella enterica enterica serovar Typhi
caaaauacuggccg

SEQ ID NO: 3634772 - RNA, 14 nt, Salmonella enterica enterica serovar Typhi
caaaauagucaguu

SEQ ID NO: 3634773 - RNA, 15 nt, Salmonella enterica enterica serovar Typhi
caaaauauauaauuu

SEQ ID NO: 3634774 - RNA, 21 nt, Salmonella enterica enterica serovar Typhi
caaaaucacgcacacgucuga

SEQ ID NO: 3634775 - RNA, 13 nt, Salmonella enterica enterica serovar Typhi
caaaaucauucgg

SEQ ID NO: 3634776 - RNA, 16 nt, Salmonella enterica enterica serovar Typhi
caaaaucccggcuggg

SEQ ID NO: 3634777 - RNA, 19 nt, Salmonella enterica enterica serovar Typhi
caaaaucccggcuggguuc

SEQ ID NO: 3634778 - RNA, 20 nt, Salmonella enterica enterica serovar Typhi
caaaaucccggcuggguuca

SEQ ID NO: 3634779 - RNA, 16 nt, Salmonella enterica enterica serovar Typhi
caaaauccgccaccgc

SEQ ID NO: 3634780 - RNA, 23 nt, Salmonella enterica enterica serovar Typhi
caaaauccgccaccgcgcgcaga

SEQ ID NO: 3634781 - RNA, 20 nt, Salmonella enterica enterica serovar Typhi
caaaauccuuguugauaaaa

SEQ ID NO: 3634782 - RNA, 24 nt, Salmonella enterica enterica serovar Typhi
caaaauccuuguugauaaaacgaa

SEQ ID NO: 3634783 - RNA, 18 nt, Salmonella enterica enterica serovar Typhi
caaaaucgcaaacgccag

SEQ ID NO: 3634784 - RNA, 21 nt, Salmonella enterica enterica serovar Typhi
caaaaucgcccaggccugaug

SEQ ID NO: 3634785 - RNA, 18 nt, Salmonella enterica enterica serovar Typhi
caaaaucggcuucuccca

SEQ ID NO: 3634786 - RNA, 23 nt, Salmonella enterica enterica serovar Typhi
caaaaucguuaaccagcggcgac

SEQ ID NO: 3634787 - RNA, 19 nt, Salmonella enterica enterica serovar Typhi
caaaaucuuuccagcucca

SEQ ID NO: 3634788 - RNA, 15 nt, Salmonella enterica enterica serovar Typhi
caaaaucuuuuucgc

SEQ ID NO: 3634789 - RNA, 16 nt, Salmonella enterica enterica serovar Typhi
caaaaucuuuuucgcu

SEQ ID NO: 3634790 - RNA, 15 nt, Salmonella enterica enterica serovar Typhi
caaaaugaggacaca

SEQ ID NO: 3634791 - RNA, 18 nt, Salmonella enterica enterica serovar Typhi
caaaaugcaccggcguua

SEQ ID NO: 3634792 - RNA, 18 nt, Salmonella enterica enterica serovar Typhi
caaaaugcccuucgaccg

SEQ ID NO: 3634793 - RNA, 16 nt, Salmonella enterica enterica serovar Typhi
caaaauggaaaauaau

SEQ ID NO: 3634794 - RNA, 16 nt, Salmonella enterica enterica serovar Typhi
caaaaugucaguaucg

SEQ ID NO: 3634795 - RNA, 21 nt, Salmonella enterica enterica serovar Typhi
caaaauguucauguacgccgc

SEQ ID NO: 3634796 - RNA, 14 nt, Salmonella enterica enterica serovar Typhi
caaaauucacacca

SEQ ID NO: 3634797 - RNA, 21 nt, Salmonella enterica enterica serovar Typhi
caaaauuugugguggucaucc

SEQ ID NO: 3634798 - RNA, 14 nt, Salmonella enterica enterica serovar Typhi
caaaauuuucaaua

SEQ ID NO: 3634799 - RNA, 13 nt, Salmonella enterica enterica serovar Typhi
caaacaaauaaau

SEQ ID NO: 3634800 - RNA, 16 nt, Salmonella enterica enterica serovar Typhi
caaacaaauaaaucca

SEQ ID NO: 3634801 - RNA, 18 nt, Salmonella enterica enterica serovar Typhi
caaacaauuuacgcagcc

SEQ ID NO: 3634802 - RNA, 19 nt, Salmonella enterica enterica serovar Typhi
caaacacaaauuucgagca

SEQ ID NO: 3634803 - RNA, 17 nt, Salmonella enterica enterica serovar Typhi
caaacacaaucacaacg

SEQ ID NO: 3634804 - RNA, 18 nt, Salmonella enterica enterica serovar Typhi
caaacacaaucacgccca

SEQ ID NO: 3634805 - RNA, 13 nt, Salmonella enterica enterica serovar Typhi
caaacacagccau

SEQ ID NO: 3634806 - RNA, 12 nt, Salmonella enterica enterica serovar Typhi
caaacaccacca

SEQ ID NO: 3634807 - RNA, 13 nt, Salmonella enterica enterica serovar Typhi
caaacaccagauc

SEQ ID NO: 3634808 - RNA, 14 nt, Salmonella enterica enterica serovar Typhi
caaacaccagauca

SEQ ID NO: 3634809 - RNA, 18 nt, Salmonella enterica enterica serovar Typhi
caaacaccucagccaccc

SEQ ID NO: 3634810 - RNA, 15 nt, Salmonella enterica enterica serovar Typhi
caaacaccugaacca

SEQ ID NO: 3634811 - RNA, 19 nt, Salmonella enterica enterica serovar Typhi
caaacaccugaaccagcgc

SEQ ID NO: 3634812 - RNA, 21 nt, Salmonella enterica enterica serovar Typhi
caaacacuaccgggcagcauc

SEQ ID NO: 3634813 - RNA, 22 nt, Salmonella enterica enterica serovar Typhi
caaacacuaccgggcagcaucu

SEQ ID NO: 3634814 - RNA, 21 nt, Salmonella enterica enterica serovar Typhi
caaacaggcggcuguugguuu

SEQ ID NO: 3634815 - RNA, 14 nt, Salmonella enterica enterica serovar Typhi
caaacaguacgccc

SEQ ID NO: 3634816 - RNA, 15 nt, Salmonella enterica enterica serovar Typhi
caaacagugaaaaaa

SEQ ID NO: 3634817 - RNA, 16 nt, Salmonella enterica enterica serovar Typhi
caaacagugggaagca

SEQ ID NO: 3634818 - RNA, 23 nt, Salmonella enterica enterica serovar Typhi
caaacagugggaagcacauccau

SEQ ID NO: 3634819 - RNA, 22 nt, Salmonella enterica enterica serovar Typhi
caaacaguucauuucaggcaaa

SEQ ID NO: 3634820 - RNA, 16 nt, Salmonella enterica enterica serovar Typhi
caaacauagccucaag

SEQ ID NO: 3634821 - RNA, 14 nt, Salmonella enterica enterica serovar Typhi
caaacaucgcgcuc

SEQ ID NO: 3634822 - RNA, 14 nt, Salmonella enterica enterica serovar Typhi
caaaccaaacugau

SEQ ID NO: 3634823 - RNA, 12 nt, Salmonella enterica enterica serovar Typhi
caaaccaccacc

SEQ ID NO: 3634824 - RNA, 13 nt, Salmonella enterica enterica serovar Typhi
caaaccaccacca

SEQ ID NO: 3634825 - RNA, 19 nt, Salmonella enterica enterica serovar Typhi
caaaccacgcugaggcgcc

SEQ ID NO: 3634826 - RNA, 12 nt, Salmonella enterica enterica serovar Typhi
caaaccacugcu

SEQ ID NO: 3634827 - RNA, 14 nt, Salmonella enterica enterica serovar Typhi
caaaccacugcugu

SEQ ID NO: 3634828 - RNA, 23 nt, Salmonella enterica enterica serovar Typhi
caaaccagacgcguaaccccugc

SEQ ID NO: 3634829 - RNA, 17 nt, Salmonella enterica enterica serovar Typhi
caaaccaugauaauaau

SEQ ID NO: 3634830 - RNA, 12 nt, Salmonella enterica enterica serovar Typhi
caaaccauguac

SEQ ID NO: 3634831 - RNA, 21 nt, Salmonella enterica enterica serovar Typhi
caaaccccagauuacugcccu

SEQ ID NO: 3634832 - RNA, 15 nt, Salmonella enterica enterica serovar Typhi
caaaccccggacaca

SEQ ID NO: 3634833 - RNA, 14 nt, Salmonella enterica enterica serovar Typhi
caaacccuuccgca

SEQ ID NO: 3634834 - RNA, 14 nt, Salmonella enterica enterica serovar Typhi
caaacccuuuggca

SEQ ID NO: 3634835 - RNA, 16 nt, Salmonella enterica enterica serovar Typhi
caaaccgacccaaaaa

SEQ ID NO: 3634836 - RNA, 22 nt, Salmonella enterica enterica serovar Typhi
caaaccgauaaucaccagcccg

SEQ ID NO: 3634837 - RNA, 17 nt, Salmonella enterica enterica serovar Typhi
caaaccggcgaauagcg

SEQ ID NO: 3634838 - RNA, 21 nt, Salmonella enterica enterica serovar Typhi
caaaccugagcauauaaauaa

SEQ ID NO: 3634839 - RNA, 21 nt, Salmonella enterica enterica serovar Typhi
caaaccugccacaggccaaca

SEQ ID NO: 3634840 - RNA, 15 nt, Salmonella enterica enterica serovar Typhi
caaacgauaaaagcu

SEQ ID NO: 3634841 - RNA, 17 nt, Salmonella enterica enterica serovar Typhi
caaacgccgauggcgcc

SEQ ID NO: 3634842 - RNA, 14 nt, Salmonella enterica enterica serovar Typhi
caaacgcgacaacg

SEQ ID NO: 3634843 - RNA, 20 nt, Salmonella enterica enterica serovar Typhi
caaacgcgauacacuccggc

SEQ ID NO: 3634844 - RNA, 16 nt, Salmonella enterica enterica serovar Typhi
caaacgcuggugcugu

SEQ ID NO: 3634845 - RNA, 16 nt, Salmonella enterica enterica serovar Typhi
caaacggaauagcgcc

SEQ ID NO: 3634846 - RNA, 18 nt, Salmonella enterica enterica serovar Typhi
caaacggaauagcgccuu

SEQ ID NO: 3634847 - RNA, 16 nt, Salmonella enterica enterica serovar Typhi
caaacggaucuuccac

SEQ ID NO: 3634848 - RNA, 19 nt, Salmonella enterica enterica serovar Typhi
caaacggcagcucuuucaa

SEQ ID NO: 3634849 - RNA, 17 nt, Salmonella enterica enterica serovar Typhi
caaacgucguaaaaccu

SEQ ID NO: 3634850 - RNA, 23 nt, Salmonella enterica enterica serovar Typhi
caaacuaauggcgcagcgguugc

SEQ ID NO: 3634851 - RNA, 16 nt, Salmonella enterica enterica serovar Typhi
caaacuauuuuuagcc

SEQ ID NO: 3634852 - RNA, 22 nt, Salmonella enterica enterica serovar Typhi
caaacucacguuccccagcacc

SEQ ID NO: 3634853 - RNA, 21 nt, Salmonella enterica enterica serovar Typhi
caaacuccagcucgcaugcau

SEQ ID NO: 3634854 - RNA, 21 nt, Salmonella enterica enterica serovar Typhi
caaacuccucacugcguaaaa

SEQ ID NO: 3634855 - RNA, 17 nt, Salmonella enterica enterica serovar Typhi
caaacucugaaaaaauu

SEQ ID NO: 3634856 - RNA, 21 nt, Salmonella enterica enterica serovar Typhi
caaacugaaaacgggugaucu

SEQ ID NO: 3634857 - RNA, 19 nt, Salmonella enterica enterica serovar Typhi
caaacugaaaaucaaauaa

SEQ ID NO: 3634858 - RNA, 16 nt, Salmonella enterica enterica serovar Typhi
caaacugcgcgccgcc

SEQ ID NO: 3634859 - RNA, 22 nt, Salmonella enterica enterica serovar Typhi
caaacugcgcuagccgccgugu

SEQ ID NO: 3634860 - RNA, 11 nt, Salmonella enterica enterica serovar Typhi
caaacugcugg

SEQ ID NO: 3634861 - RNA, 16 nt, Salmonella enterica enterica serovar Typhi
caaacuggccacagca

SEQ ID NO: 3634862 - RNA, 20 nt, Salmonella enterica enterica serovar Typhi
caaacuuaucucuuuuucuc

SEQ ID NO: 3634863 - RNA, 13 nt, Salmonella enterica enterica serovar Typhi
caaacuuuuaaau

SEQ ID NO: 3634864 - RNA, 12 nt, Salmonella enterica enterica serovar Typhi
caaagaaaacca

SEQ ID NO: 3634865 - RNA, 16 nt, Salmonella enterica enterica serovar Typhi
caaagacaggugacca

SEQ ID NO: 3634866 - RNA, 13 nt, Salmonella enterica enterica serovar Typhi
caaagaccaauaa

SEQ ID NO: 3634867 - RNA, 14 nt, Salmonella enterica enterica serovar Typhi
caaagacgaauaag

SEQ ID NO: 3634868 - RNA, 23 nt, Salmonella enterica enterica serovar Typhi
caaagacgguuucagugauaaag

SEQ ID NO: 3634869 - RNA, 19 nt, Salmonella enterica enterica serovar Typhi
caaagagguugcugauuaa

SEQ ID NO: 3634870 - RNA, 23 nt, Salmonella enterica enterica serovar Typhi
caaagauauaguuuauugaagug

SEQ ID NO: 3634871 - RNA, 19 nt, Salmonella enterica enterica serovar Typhi
caaagauuagccccagcgc

SEQ ID NO: 3634872 - RNA, 16 nt, Salmonella enterica enterica serovar Typhi
caaagcaaaaaucacc

SEQ ID NO: 3634873 - RNA, 14 nt, Salmonella enterica enterica serovar Typhi
caaagcaaucgcca

SEQ ID NO: 3634874 - RNA, 19 nt, Salmonella enterica enterica serovar Typhi
caaagcaccauucuucaac

SEQ ID NO: 3634875 - RNA, 16 nt, Salmonella enterica enterica serovar Typhi
caaagcacugcugcug

SEQ ID NO: 3634876 - RNA, 18 nt, Salmonella enterica enterica serovar Typhi
caaagcacugcugcugaa

SEQ ID NO: 3634877 - RNA, 19 nt, Salmonella enterica enterica serovar Typhi
caaagccaggccgccagca

SEQ ID NO: 3634878 - RNA, 21 nt, Salmonella enterica enterica serovar Typhi
caaagccaggccgccagcaac

SEQ ID NO: 3634879 - RNA, 15 nt, Salmonella enterica enterica serovar Typhi
caaagccccagucau

SEQ ID NO: 3634880 - RNA, 19 nt, Salmonella enterica enterica serovar Typhi
caaagccgccauccggccu

SEQ ID NO: 3634881 - RNA, 20 nt, Salmonella enterica enterica serovar Typhi
caaagccgccauccggccug

SEQ ID NO: 3634882 - RNA, 13 nt, Salmonella enterica enterica serovar Typhi
caaagccugcugg

SEQ ID NO: 3634883 - RNA, 17 nt, Salmonella enterica enterica serovar Typhi
caaagccugcuggaaag

SEQ ID NO: 3634884 - RNA, 16 nt, Salmonella enterica enterica serovar Typhi
caaagcgagguaaaaa

SEQ ID NO: 3634885 - RNA, 19 nt, Salmonella enterica enterica serovar Typhi
caaagcgagguaaaaagcg

SEQ ID NO: 3634886 - RNA, 16 nt, Salmonella enterica enterica serovar Typhi
caaagcguaccgucug

SEQ ID NO: 3634887 - RNA, 21 nt, Salmonella enterica enterica serovar Typhi
caaagcguugcaaccccagac

SEQ ID NO: 3634888 - RNA, 15 nt, Salmonella enterica enterica serovar Typhi
caaagcucaacgcag

SEQ ID NO: 3634889 - RNA, 20 nt, Salmonella enterica enterica serovar Typhi
caaagcucaacgcaggcugg

SEQ ID NO: 3634890 - RNA, 21 nt, Salmonella enterica enterica serovar Typhi
caaagcuugcgcagaguaucg

SEQ ID NO: 3634891 - RNA, 15 nt, Salmonella enterica enterica serovar Typhi
caaaggccagcagca

SEQ ID NO: 3634892 - RNA, 18 nt, Salmonella enterica enterica serovar Typhi
caaaggccuuauccggcc

SEQ ID NO: 3634893 - RNA, 16 nt, Salmonella enterica enterica serovar Typhi
caaaggcguaaaaagg

SEQ ID NO: 3634894 - RNA, 10 nt, Salmonella enterica enterica serovar Typhi
caaagggagc

SEQ ID NO: 3634895 - RNA, 23 nt, Salmonella enterica enterica serovar Typhi
caaagggcccguggaaaaacuca

SEQ ID NO: 3634896 - RNA, 20 nt, Salmonella enterica enterica serovar Typhi
caaagguaauaucacacccg

SEQ ID NO: 3634897 - RNA, 15 nt, Salmonella enterica enterica serovar Typhi
caaagguguuauuuc

SEQ ID NO: 3634898 - RNA, 22 nt, Salmonella enterica enterica serovar Typhi
caaagucagcgcgcgcuuucac

SEQ ID NO: 3634899 - RNA, 21 nt, Salmonella enterica enterica serovar Typhi
caaagucuggccaccgauaaa

SEQ ID NO: 3634900 - RNA, 16 nt, Salmonella enterica enterica serovar Typhi
caaagucuucaugguc

SEQ ID NO: 3634901 - RNA, 22 nt, Salmonella enterica enterica serovar Typhi
caaagucuuuuguauugcgcgu

SEQ ID NO: 3634902 - RNA, 14 nt, Salmonella enterica enterica serovar Typhi
caaaguuaaucagc

SEQ ID NO: 3634903 - RNA, 18 nt, Salmonella enterica enterica serovar Typhi
caaaguuaucccugcuga

SEQ ID NO: 3634904 - RNA, 16 nt, Salmonella enterica enterica serovar Typhi
caaaguugcaucaaga

SEQ ID NO: 3634905 - RNA, 18 nt, Salmonella enterica enterica serovar Typhi
caaaguugguucccagca

SEQ ID NO: 3634906 - RNA, 22 nt, Salmonella enterica enterica serovar Typhi
caaauaaagcggucuuucaaca

SEQ ID NO: 3634907 - RNA, 21 nt, Salmonella enterica enterica serovar Typhi
caaauaaauccaugagaagaa

SEQ ID NO: 3634908 - RNA, 18 nt, Salmonella enterica enterica serovar Typhi
caaauaaggacuuuaucu

SEQ ID NO: 3634909 - RNA, 22 nt, Salmonella enterica enterica serovar Typhi
caaauaagguggcuaacccgcu

SEQ ID NO: 3634910 - RNA, 14 nt, Salmonella enterica enterica serovar Typhi
caaauacauggugc

SEQ ID NO: 3634911 - RNA, 13 nt, Salmonella enterica enterica serovar Typhi
caaauaccacauc

SEQ ID NO: 3634912 - RNA, 21 nt, Salmonella enterica enterica serovar Typhi
caaauacgcgauaaaaaccca

SEQ ID NO: 3634913 - RNA, 20 nt, Salmonella enterica enterica serovar Typhi
caaauacugcuuuuccggca

SEQ ID NO: 3634914 - RNA, 16 nt, Salmonella enterica enterica serovar Typhi
caaauacuggaaaaaa

SEQ ID NO: 3634915 - RNA, 14 nt, Salmonella enterica enterica serovar Typhi
caaauagagaaaau

SEQ ID NO: 3634916 - RNA, 15 nt, Salmonella enterica enterica serovar Typhi
caaauagagaaaaua

SEQ ID NO: 3634917 - RNA, 17 nt, Salmonella enterica enterica serovar Typhi
caaauagagaaaauaac

SEQ ID NO: 3634918 - RNA, 20 nt, Salmonella enterica enterica serovar Typhi
caaauagagaaaauaacaau

SEQ ID NO: 3634919 - RNA, 14 nt, Salmonella enterica enterica serovar Typhi
caaauagcgcugau

SEQ ID NO: 3634920 - RNA, 16 nt, Salmonella enterica enterica serovar Typhi
caaauagcggcacaga

SEQ ID NO: 3634921 - RNA, 16 nt, Salmonella enterica enterica serovar Typhi
caaauaguccagcauc

SEQ ID NO: 3634922 - RNA, 22 nt, Salmonella enterica enterica serovar Typhi
caaauauccuaccacgccgcua

SEQ ID NO: 3634923 - RNA, 17 nt, Salmonella enterica enterica serovar Typhi
caaauaugauaugugua

SEQ ID NO: 3634924 - RNA, 14 nt, Salmonella enterica enterica serovar Typhi
caaauauuucuuug

SEQ ID NO: 3634925 - RNA, 14 nt, Salmonella enterica enterica serovar Typhi
caaaucaacauuau

SEQ ID NO: 3634926 - RNA, 16 nt, Salmonella enterica enterica serovar Typhi
caaaucaccacauggc

SEQ ID NO: 3634927 - RNA, 19 nt, Salmonella enterica enterica serovar Typhi
caaauccagcucaguuucc

SEQ ID NO: 3634928 - RNA, 17 nt, Salmonella enterica enterica serovar Typhi
caaaucccgguaaaggu

SEQ ID NO: 3634929 - RNA, 13 nt, Salmonella enterica enterica serovar Typhi
caaauccuccaua

SEQ ID NO: 3634930 - RNA, 17 nt, Salmonella enterica enterica serovar Typhi
caaauccuccauaaaua

SEQ ID NO: 3634931 - RNA, 15 nt, Salmonella enterica enterica serovar Typhi
caaaucgccaucagc

SEQ ID NO: 3634932 - RNA, 18 nt, Salmonella enterica enterica serovar Typhi
caaaucgcccaucacaug

SEQ ID NO: 3634933 - RNA, 20 nt, Salmonella enterica enterica serovar Typhi
caaaucgcccaucacaugua

SEQ ID NO: 3634934 - RNA, 16 nt, Salmonella enterica enterica serovar Typhi
caaaucgcgguaaaaa

SEQ ID NO: 3634935 - RNA, 20 nt, Salmonella enterica enterica serovar Typhi
caaaucggcgccggcgcguu

SEQ ID NO: 3634936 - RNA, 18 nt, Salmonella enterica enterica serovar Typhi
caaaucgggaaaaugaug

SEQ ID NO: 3634937 - RNA, 16 nt, Salmonella enterica enterica serovar Typhi
caaaucgguaaauguc

SEQ ID NO: 3634938 - RNA, 23 nt, Salmonella enterica enterica serovar Typhi
caaaucgugugcgguauagauca

SEQ ID NO: 3634939 - RNA, 16 nt, Salmonella enterica enterica serovar Typhi
caaaucuguuaucugg

SEQ ID NO: 3634940 - RNA, 21 nt, Salmonella enterica enterica serovar Typhi
caaaucuguuaucuggaugua

SEQ ID NO: 3634941 - RNA, 19 nt, Salmonella enterica enterica serovar Typhi
caaaucuucauuucauugc

SEQ ID NO: 3634942 - RNA, 22 nt, Salmonella enterica enterica serovar Typhi
caaaugaaccugaugugcuuuu

SEQ ID NO: 3634943 - RNA, 15 nt, Salmonella enterica enterica serovar Typhi
caaaugaccucaaga

SEQ ID NO: 3634944 - RNA, 15 nt, Salmonella enterica enterica serovar Typhi
caaaugagaauagac

SEQ ID NO: 3634945 - RNA, 16 nt, Salmonella enterica enterica serovar Typhi
caaaugagaauagacu

SEQ ID NO: 3634946 - RNA, 18 nt, Salmonella enterica enterica serovar Typhi
caaaugauaauaugcuca

SEQ ID NO: 3634947 - RNA, 21 nt, Salmonella enterica enterica serovar Typhi
caaaugcagcggaauucccac

SEQ ID NO: 3634948 - RNA, 14 nt, Salmonella enterica enterica serovar Typhi
caaaugccauccca

SEQ ID NO: 3634949 - RNA, 15 nt, Salmonella enterica enterica serovar Typhi
caaaugggaucuuca

SEQ ID NO: 3634950 - RNA, 13 nt, Salmonella enterica enterica serovar Typhi
caaaugucagauc

SEQ ID NO: 3634951 - RNA, 17 nt, Salmonella enterica enterica serovar Typhi
caaauuaucuguugaua

SEQ ID NO: 3634952 - RNA, 24 nt, Salmonella enterica enterica serovar Typhi
caaauuaucuguugauaaaacacu

SEQ ID NO: 3634953 - RNA, 17 nt, Salmonella enterica enterica serovar Typhi
caaauucagaccccugu

SEQ ID NO: 3634954 - RNA, 13 nt, Salmonella enterica enterica serovar Typhi
caaauuccggcac

SEQ ID NO: 3634955 - RNA, 18 nt, Salmonella enterica enterica serovar Typhi
caacaaagccugcuggaa

SEQ ID NO: 3634956 - RNA, 14 nt, Salmonella enterica enterica serovar Typhi
caacaaagguuugu

SEQ ID NO: 3634957 - RNA, 17 nt, Salmonella enterica enterica serovar Typhi
caacaaaguauaaagcu

SEQ ID NO: 3634958 - RNA, 15 nt, Salmonella enterica enterica serovar Typhi
caacaaauuccggca

SEQ ID NO: 3634959 - RNA, 14 nt, Salmonella enterica enterica serovar Typhi
caacaacagauaua

SEQ ID NO: 3634960 - RNA, 23 nt, Salmonella enterica enterica serovar Typhi
caacaacuucaaaauagguguug

SEQ ID NO: 3634961 - RNA, 20 nt, Salmonella enterica enterica serovar Typhi
caacaaguccuucuuccccc

SEQ ID NO: 3634962 - RNA, 21 nt, Salmonella enterica enterica serovar Typhi
caacaaguccuucuucccccu

SEQ ID NO: 3634963 - RNA, 23 nt, Salmonella enterica enterica serovar Typhi
caacaaucccuuaaagccgcccu

SEQ ID NO: 3634964 - RNA, 15 nt, Salmonella enterica enterica serovar Typhi
caacaaugccacgcc

SEQ ID NO: 3634965 - RNA, 18 nt, Salmonella enterica enterica serovar Typhi
caacaaugccacgccccu

SEQ ID NO: 3634966 - RNA, 16 nt, Salmonella enterica enterica serovar Typhi
caacacacguaacaac

SEQ ID NO: 3634967 - RNA, 23 nt, Salmonella enterica enterica serovar Typhi
caacacauaagcaacuugaagua

SEQ ID NO: 3634968 - RNA, 14 nt, Salmonella enterica enterica serovar Typhi
caacacauaagcca

SEQ ID NO: 3634969 - RNA, 15 nt, Salmonella enterica enterica serovar Typhi
caacacccacaccau

SEQ ID NO: 3634970 - RNA, 16 nt, Salmonella enterica enterica serovar Typhi
caacacgacaaaagca

SEQ ID NO: 3634971 - RNA, 15 nt, Salmonella enterica enterica serovar Typhi
caacacgauccccau

SEQ ID NO: 3634972 - RNA, 17 nt, Salmonella enterica enterica serovar Typhi
caacacgccgaacaaca

SEQ ID NO: 3634973 - RNA, 18 nt, Salmonella enterica enterica serovar Typhi
caacacgcgcaccaguuc

SEQ ID NO: 3634974 - RNA, 20 nt, Salmonella enterica enterica serovar Typhi
caacacuuagaacgcggaag

SEQ ID NO: 3634975 - RNA, 15 nt, Salmonella enterica enterica serovar Typhi
caacacuuugcgcug

SEQ ID NO: 3634976 - RNA, 21 nt, Salmonella enterica enterica serovar Typhi
caacacuuugcgcugcgcauu

SEQ ID NO: 3634977 - RNA, 16 nt, Salmonella enterica enterica serovar Typhi
caacagaaucgcgaua

SEQ ID NO: 3634978 - RNA, 21 nt, Salmonella enterica enterica serovar Typhi
caacagaccgacgaugaccgg

SEQ ID NO: 3634979 - RNA, 21 nt, Salmonella enterica enterica serovar Typhi
caacagcaaaacgcgcuauca

SEQ ID NO: 3634980 - RNA, 12 nt, Salmonella enterica enterica serovar Typhi
caacagcaaugu

SEQ ID NO: 3634981 - RNA, 12 nt, Salmonella enterica enterica serovar Typhi
caacagcaccag

SEQ ID NO: 3634982 - RNA, 14 nt, Salmonella enterica enterica serovar Typhi
caacagccgccugu

SEQ ID NO: 3634983 - RNA, 22 nt, Salmonella enterica enterica serovar Typhi
caacagcgacgccagauuaucg

SEQ ID NO: 3634984 - RNA, 15 nt, Salmonella enterica enterica serovar Typhi
caacagcggagagac

SEQ ID NO: 3634985 - RNA, 16 nt, Salmonella enterica enterica serovar Typhi
caacagcucgccaugc

SEQ ID NO: 3634986 - RNA, 16 nt, Salmonella enterica enterica serovar Typhi
caacagcuugcgccca

SEQ ID NO: 3634987 - RNA, 24 nt, Salmonella enterica enterica serovar Typhi
caacagggcggccuccuggcuuac

SEQ ID NO: 3634988 - RNA, 17 nt, Salmonella enterica enterica serovar Typhi
caacagguaccccgcca

SEQ ID NO: 3634989 - RNA, 20 nt, Salmonella enterica enterica serovar Typhi
caacaguaccugauaaaauu

SEQ ID NO: 3634990 - RNA, 15 nt, Salmonella enterica enterica serovar Typhi
caacaguaccuucaa

SEQ ID NO: 3634991 - RNA, 16 nt, Salmonella enterica enterica serovar Typhi
caacagugggcuauga

SEQ ID NO: 3634992 - RNA, 21 nt, Salmonella enterica enterica serovar Typhi
caacagugggcuaugaagaga

SEQ ID NO: 3634993 - RNA, 20 nt, Salmonella enterica enterica serovar Typhi
caacauagcuaaauaaaaau

SEQ ID NO: 3634994 - RNA, 23 nt, Salmonella enterica enterica serovar Typhi
caacauagcuaaauaaaaauaau

SEQ ID NO: 3634995 - RNA, 16 nt, Salmonella enterica enterica serovar Typhi
caacauauuugcccug

SEQ ID NO: 3634996 - RNA, 17 nt, Salmonella enterica enterica serovar Typhi
caacauauuuuucacac

SEQ ID NO: 3634997 - RNA, 19 nt, Salmonella enterica enterica serovar Typhi
caacaucagcgcuaccagc

SEQ ID NO: 3634998 - RNA, 21 nt, Salmonella enterica enterica serovar Typhi
caacaucagcgcuaccagcgc

SEQ ID NO: 3634999 - RNA, 16 nt, Salmonella enterica enterica serovar Typhi
caacaucaguucagaa

SEQ ID NO: 3635000 - RNA, 19 nt, Salmonella enterica enterica serovar Typhi
caacaucauuauuccccuc

SEQ ID NO: 3635001 - RNA, 16 nt, Salmonella enterica enterica serovar Typhi
caacauccugggucug

SEQ ID NO: 3635002 - RNA, 21 nt, Salmonella enterica enterica serovar Typhi
caacaucuuaccggugcgauu

SEQ ID NO: 3635003 - RNA, 23 nt, Salmonella enterica enterica serovar Typhi
caacaugcugaccgaaccgcugu

SEQ ID NO: 3635004 - RNA, 20 nt, Salmonella enterica enterica serovar Typhi
caacauuaucaaaagugauc

SEQ ID NO: 3635005 - RNA, 21 nt, Salmonella enterica enterica serovar Typhi
caacauuaucaaaagugauca

SEQ ID NO: 3635006 - RNA, 18 nt, Salmonella enterica enterica serovar Typhi
caacauuauuaaaauguc

SEQ ID NO: 3635007 - RNA, 23 nt, Salmonella enterica enterica serovar Typhi
caacauugccggcaucauucugc

SEQ ID NO: 3635008 - RNA, 21 nt, Salmonella enterica enterica serovar Typhi
caacauuggaaaacuccagca

SEQ ID NO: 3635009 - RNA, 15 nt, Salmonella enterica enterica serovar Typhi
caaccaaaguccaac

SEQ ID NO: 3635010 - RNA, 15 nt, Salmonella enterica enterica serovar Typhi
caaccaacccaaaaa

SEQ ID NO: 3635011 - RNA, 14 nt, Salmonella enterica enterica serovar Typhi
caaccaaugcaacg

SEQ ID NO: 3635012 - RNA, 18 nt, Salmonella enterica enterica serovar Typhi
caaccaaugcaacgccuu

SEQ ID NO: 3635013 - RNA, 13 nt, Salmonella enterica enterica serovar Typhi
caaccaccaaaaa

SEQ ID NO: 3635014 - RNA, 18 nt, Salmonella enterica enterica serovar Typhi
caaccacggauaagccag

SEQ ID NO: 3635015 - RNA, 20 nt, Salmonella enterica enterica serovar Typhi
caaccacggauaagccagcc

SEQ ID NO: 3635016 - RNA, 16 nt, Salmonella enterica enterica serovar Typhi
caaccagaauaauggg

SEQ ID NO: 3635017 - RNA, 12 nt, Salmonella enterica enterica serovar Typhi
caaccagcaaug

SEQ ID NO: 3635018 - RNA, 18 nt, Salmonella enterica enterica serovar Typhi
caaccagcaaugagacaa

SEQ ID NO: 3635019 - RNA, 18 nt, Salmonella enterica enterica serovar Typhi
caaccagccgaucagcgc

SEQ ID NO: 3635020 - RNA, 17 nt, Salmonella enterica enterica serovar Typhi
caaccagcgaaaugacg

SEQ ID NO: 3635021 - RNA, 22 nt, Salmonella enterica enterica serovar Typhi
caaccagcgaaaugacggccac

SEQ ID NO: 3635022 - RNA, 14 nt, Salmonella enterica enterica serovar Typhi
caaccaggauucaa

SEQ ID NO: 3635023 - RNA, 12 nt, Salmonella enterica enterica serovar Typhi
caaccaggcaaa

SEQ ID NO: 3635024 - RNA, 13 nt, Salmonella enterica enterica serovar Typhi
caaccaggcaaac

SEQ ID NO: 3635025 - RNA, 17 nt, Salmonella enterica enterica serovar Typhi
caaccaggcaaaccagc

SEQ ID NO: 3635026 - RNA, 22 nt, Salmonella enterica enterica serovar Typhi
caaccaguggcggggcagaacc

SEQ ID NO: 3635027 - RNA, 18 nt, Salmonella enterica enterica serovar Typhi
caaccaucacugaaccca

SEQ ID NO: 3635028 - RNA, 20 nt, Salmonella enterica enterica serovar Typhi
caaccaugauaaccagcccc

SEQ ID NO: 3635029 - RNA, 22 nt, Salmonella enterica enterica serovar Typhi
caaccaugauaaccagccccgg

SEQ ID NO: 3635030 - RNA, 14 nt, Salmonella enterica enterica serovar Typhi
caacccaaaggcca

SEQ ID NO: 3635031 - RNA, 15 nt, Salmonella enterica enterica serovar Typhi
caacccacauuggcc

SEQ ID NO: 3635032 - RNA, 17 nt, Salmonella enterica enterica serovar Typhi
caaccccagacggcggc

SEQ ID NO: 3635033 - RNA, 15 nt, Salmonella enterica enterica serovar Typhi
caaccccguggugac

SEQ ID NO: 3635034 - RNA, 12 nt, Salmonella enterica enterica serovar Typhi
caaccccugacg

SEQ ID NO: 3635035 - RNA, 21 nt, Salmonella enterica enterica serovar Typhi
caaccccugacgggcgauggc

SEQ ID NO: 3635036 - RNA, 18 nt, Salmonella enterica enterica serovar Typhi
caacccuggcgcuuuaaa

SEQ ID NO: 3635037 - RNA, 16 nt, Salmonella enterica enterica serovar Typhi
caacccuuuggccacc

SEQ ID NO: 3635038 - RNA, 13 nt, Salmonella enterica enterica serovar Typhi
caaccgacgcauu

SEQ ID NO: 3635039 - RNA, 15 nt, Salmonella enterica enterica serovar Typhi
caaccgcaccggauc

SEQ ID NO: 3635040 - RNA, 14 nt, Salmonella enterica enterica serovar Typhi
caaccgccaauaau

SEQ ID NO: 3635041 - RNA, 14 nt, Salmonella enterica enterica serovar Typhi
caaccgccugcacu

SEQ ID NO: 3635042 - RNA, 16 nt, Salmonella enterica enterica serovar Typhi
caaccgccugcguuug

SEQ ID NO: 3635043 - RNA, 14 nt, Salmonella enterica enterica serovar Typhi
caaccggaugccga

SEQ ID NO: 3635044 - RNA, 12 nt, Salmonella enterica enterica serovar Typhi
caaccggcuggc

SEQ ID NO: 3635045 - RNA, 14 nt, Salmonella enterica enterica serovar Typhi
caaccgggaucuuu

SEQ ID NO: 3635046 - RNA, 17 nt, Salmonella enterica enterica serovar Typhi
caaccggguaaacgcca

SEQ ID NO: 3635047 - RNA, 15 nt, Salmonella enterica enterica serovar Typhi
caaccgucaucucuu

SEQ ID NO: 3635048 - RNA, 17 nt, Salmonella enterica enterica serovar Typhi
caaccucacuguugaua

SEQ ID NO: 3635049 - RNA, 22 nt, Salmonella enterica enterica serovar Typhi
caaccuccgcggggaucgguuu

SEQ ID NO: 3635050 - RNA, 12 nt, Salmonella enterica enterica serovar Typhi
caaccucgcuuc

SEQ ID NO: 3635051 - RNA, 18 nt, Salmonella enterica enterica serovar Typhi
caaccucggcuugcuuca

SEQ ID NO: 3635052 - RNA, 15 nt, Salmonella enterica enterica serovar Typhi
caaccucuuuuuccg

SEQ ID NO: 3635053 - RNA, 17 nt, Salmonella enterica enterica serovar Typhi
caaccugaaagaagcgc

SEQ ID NO: 3635054 - RNA, 20 nt, Salmonella enterica enterica serovar Typhi
caaccugaggaaaaagcgca

SEQ ID NO: 3635055 - RNA, 11 nt, Salmonella enterica enterica serovar Typhi
caaccugauau

SEQ ID NO: 3635056 - RNA, 14 nt, Salmonella enterica enterica serovar Typhi
caaccugcccuuuc

SEQ ID NO: 3635057 - RNA, 21 nt, Salmonella enterica enterica serovar Typhi
caaccugccguuuuccagccg

SEQ ID NO: 3635058 - RNA, 15 nt, Salmonella enterica enterica serovar Typhi
caaccugcgaaaagc

SEQ ID NO: 3635059 - RNA, 12 nt, Salmonella enterica enterica serovar Typhi
caaccugcgcug

SEQ ID NO: 3635060 - RNA, 17 nt, Salmonella enterica enterica serovar Typhi
caaccugcgcugacggc

SEQ ID NO: 3635061 - RNA, 23 nt, Salmonella enterica enterica serovar Typhi
caaccuguaggccggauaagcau

SEQ ID NO: 3635062 - RNA, 15 nt, Salmonella enterica enterica serovar Typhi
caaccuuugggcaga

SEQ ID NO: 3635063 - RNA, 20 nt, Salmonella enterica enterica serovar Typhi
caaccuuugggcagauaucg

SEQ ID NO: 3635064 - RNA, 16 nt, Salmonella enterica enterica serovar Typhi
caacgaaaaucauccg

SEQ ID NO: 3635065 - RNA, 11 nt, Salmonella enterica enterica serovar Typhi
caacgaccaga

SEQ ID NO: 3635066 - RNA, 17 nt, Salmonella enterica enterica serovar Typhi
caacgaccagugaacgu

SEQ ID NO: 3635067 - RNA, 21 nt, Salmonella enterica enterica serovar Typhi
caacgacgucuuucuucgcug

SEQ ID NO: 3635068 - RNA, 16 nt, Salmonella enterica enterica serovar Typhi
caacgagaauaagacc

SEQ ID NO: 3635069 - RNA, 16 nt, Salmonella enterica enterica serovar Typhi
caacgcaggcuggaga

SEQ ID NO: 3635070 - RNA, 17 nt, Salmonella enterica enterica serovar Typhi
caacgcaggcuggagag

SEQ ID NO: 3635071 - RNA, 14 nt, Salmonella enterica enterica serovar Typhi
caacgccaacauag

SEQ ID NO: 3635072 - RNA, 12 nt, Salmonella enterica enterica serovar Typhi
caacgccaagcg

SEQ ID NO: 3635073 - RNA, 15 nt, Salmonella enterica enterica serovar Typhi
caacgccaagcgcgg

SEQ ID NO: 3635074 - RNA, 14 nt, Salmonella enterica enterica serovar Typhi
caacgccagcagcg

SEQ ID NO: 3635075 - RNA, 18 nt, Salmonella enterica enterica serovar Typhi
caacgccgcuuuaccgcc

SEQ ID NO: 3635076 - RNA, 20 nt, Salmonella enterica enterica serovar Typhi
caacgccgcuuuaccgccuu

SEQ ID NO: 3635077 - RNA, 13 nt, Salmonella enterica enterica serovar Typhi
caacgccggcaac

SEQ ID NO: 3635078 - RNA, 19 nt, Salmonella enterica enterica serovar Typhi
caacgccggcaacacccgc

SEQ ID NO: 3635079 - RNA, 14 nt, Salmonella enterica enterica serovar Typhi
caacgccuccaggc

SEQ ID NO: 3635080 - RNA, 13 nt, Salmonella enterica enterica serovar Typhi
caacgccuccugc

SEQ ID NO: 3635081 - RNA, 15 nt, Salmonella enterica enterica serovar Typhi
caacgccuccugccg

SEQ ID NO: 3635082 - RNA, 16 nt, Salmonella enterica enterica serovar Typhi
caacgccuucugcuug

SEQ ID NO: 3635083 - RNA, 14 nt, Salmonella enterica enterica serovar Typhi
caacgcgcaucaac

SEQ ID NO: 3635084 - RNA, 17 nt, Salmonella enterica enterica serovar Typhi
caacgcgggccauacac

SEQ ID NO: 3635085 - RNA, 17 nt, Salmonella enterica enterica serovar Typhi
caacgcgugauccacag

SEQ ID NO: 3635086 - RNA, 16 nt, Salmonella enterica enterica serovar Typhi
caacgcguugccgccg

SEQ ID NO: 3635087 - RNA, 21 nt, Salmonella enterica enterica serovar Typhi
caacgcugaauaucgucagua

SEQ ID NO: 3635088 - RNA, 15 nt, Salmonella enterica enterica serovar Typhi
caacgcuucacaacc

SEQ ID NO: 3635089 - RNA, 19 nt, Salmonella enterica enterica serovar Typhi
caacgcuuuagugccgcca

SEQ ID NO: 3635090 - RNA, 20 nt, Salmonella enterica enterica serovar Typhi
caacgcuuuagugccgccau

SEQ ID NO: 3635091 - RNA, 19 nt, Salmonella enterica enterica serovar Typhi
caacggaagcugaccaggg

SEQ ID NO: 3635092 - RNA, 15 nt, Salmonella enterica enterica serovar Typhi
caacggcaagccggu

SEQ ID NO: 3635093 - RNA, 15 nt, Salmonella enterica enterica serovar Typhi
caacggcacacaggc

SEQ ID NO: 3635094 - RNA, 15 nt, Salmonella enterica enterica serovar Typhi
caacggcuugugagc

SEQ ID NO: 3635095 - RNA, 17 nt, Salmonella enterica enterica serovar Typhi
caacgggacggcggcca

SEQ ID NO: 3635096 - RNA, 16 nt, Salmonella enterica enterica serovar Typhi
caacgggcaaugccac

SEQ ID NO: 3635097 - RNA, 20 nt, Salmonella enterica enterica serovar Typhi
caacguaaauuacuuaugau

SEQ ID NO: 3635098 - RNA, 22 nt, Salmonella enterica enterica serovar Typhi
caacguaaucaucaugcugcac

SEQ ID NO: 3635099 - RNA, 18 nt, Salmonella enterica enterica serovar Typhi
caacguaaucccgccagc

SEQ ID NO: 3635100 - RNA, 19 nt, Salmonella enterica enterica serovar Typhi
caacguauaaaauggcaaa

SEQ ID NO: 3635101 - RNA, 14 nt, Salmonella enterica enterica serovar Typhi
caacgucagcaucu

SEQ ID NO: 3635102 - RNA, 17 nt, Salmonella enterica enterica serovar Typhi
caacgucaucaugaaaa

SEQ ID NO: 3635103 - RNA, 18 nt, Salmonella enterica enterica serovar Typhi
caacguccaguucguucu

SEQ ID NO: 3635104 - RNA, 17 nt, Salmonella enterica enterica serovar Typhi
caacguccugcggcuuu

SEQ ID NO: 3635105 - RNA, 14 nt, Salmonella enterica enterica serovar Typhi
caacgucgccaucc

SEQ ID NO: 3635106 - RNA, 13 nt, Salmonella enterica enterica serovar Typhi
caacgugcagaug

SEQ ID NO: 3635107 - RNA, 16 nt, Salmonella enterica enterica serovar Typhi
caacgugccagaaaca

SEQ ID NO: 3635108 - RNA, 16 nt, Salmonella enterica enterica serovar Typhi
caacguuaacugcugc

SEQ ID NO: 3635109 - RNA, 20 nt, Salmonella enterica enterica serovar Typhi
caacguugaaaacggcguuu

SEQ ID NO: 3635110 - RNA, 20 nt, Salmonella enterica enterica serovar Typhi
caacguuucuuucaucagau

SEQ ID NO: 3635111 - RNA, 22 nt, Salmonella enterica enterica serovar Typhi
caacguuucuuucaucagauca

SEQ ID NO: 3635112 - RNA, 19 nt, Salmonella enterica enterica serovar Typhi
caacguuuucagcagugca

SEQ ID NO: 3635113 - RNA, 14 nt, Salmonella enterica enterica serovar Typhi
caacuacacucuua

SEQ ID NO: 3635114 - RNA, 14 nt, Salmonella enterica enterica serovar Typhi
caacuccacaaaua

SEQ ID NO: 3635115 - RNA, 13 nt, Salmonella enterica enterica serovar Typhi
caacuccgccggc

SEQ ID NO: 3635116 - RNA, 23 nt, Salmonella enterica enterica serovar Typhi
caacuccgccggcgcggaaggga

SEQ ID NO: 3635117 - RNA, 19 nt, Salmonella enterica enterica serovar Typhi
caacucugugcguucgcga

SEQ ID NO: 3635118 - RNA, 13 nt, Salmonella enterica enterica serovar Typhi
caacugaaaccag

SEQ ID NO: 3635119 - RNA, 16 nt, Salmonella enterica enterica serovar Typhi
caacugaaaccaggca

SEQ ID NO: 3635120 - RNA, 19 nt, Salmonella enterica enterica serovar Typhi
caacugauuaaucugccga

SEQ ID NO: 3635121 - RNA, 17 nt, Salmonella enterica enterica serovar Typhi
caacugauucaaaaggu

SEQ ID NO: 3635122 - RNA, 11 nt, Salmonella enterica enterica serovar Typhi
caacuggaagc

SEQ ID NO: 3635123 - RNA, 15 nt, Salmonella enterica enterica serovar Typhi
caacuggcgccggag

SEQ ID NO: 3635124 - RNA, 11 nt, Salmonella enterica enterica serovar Typhi
caacuggcuca

SEQ ID NO: 3635125 - RNA, 17 nt, Salmonella enterica enterica serovar Typhi
caacuguaccugaucca

SEQ ID NO: 3635126 - RNA, 15 nt, Salmonella enterica enterica serovar Typhi
caacuguauuuugaa

SEQ ID NO: 3635127 - RNA, 22 nt, Salmonella enterica enterica serovar Typhi
caacuguucuucgguuucgaca

SEQ ID NO: 3635128 - RNA, 10 nt, Salmonella enterica enterica serovar Typhi
caacuucaug

SEQ ID NO: 3635129 - RNA, 16 nt, Salmonella enterica enterica serovar Typhi
caacuucaugaguaaa

SEQ ID NO: 3635130 - RNA, 22 nt, Salmonella enterica enterica serovar Typhi
caacuuccagagcaucuaccgc

SEQ ID NO: 3635131 - RNA, 16 nt, Salmonella enterica enterica serovar Typhi
caacuucguucaguuc

SEQ ID NO: 3635132 - RNA, 12 nt, Salmonella enterica enterica serovar Typhi
caacuucugcug

SEQ ID NO: 3635133 - RNA, 16 nt, Salmonella enterica enterica serovar Typhi
caacuuuuucuuaagc

SEQ ID NO: 3635134 - RNA, 23 nt, Salmonella enterica enterica serovar Typhi
caagaaaugcaggcguuuuauug

SEQ ID NO: 3635135 - RNA, 18 nt, Salmonella enterica enterica serovar Typhi
caagaagcguugaccgua

SEQ ID NO: 3635136 - RNA, 16 nt, Salmonella enterica enterica serovar Typhi
caagaauaugagauug

SEQ ID NO: 3635137 - RNA, 20 nt, Salmonella enterica enterica serovar Typhi
caagaaugaccagccgaagu

SEQ ID NO: 3635138 - RNA, 16 nt, Salmonella enterica enterica serovar Typhi
caagaauuaaauaacg

SEQ ID NO: 3635139 - RNA, 19 nt, Salmonella enterica enterica serovar Typhi
caagaauuacaucaauaaa

SEQ ID NO: 3635140 - RNA, 18 nt, Salmonella enterica enterica serovar Typhi
caagaauuauuucaggaa

SEQ ID NO: 3635141 - RNA, 16 nt, Salmonella enterica enterica serovar Typhi
caagaauuuaucgcaa

SEQ ID NO: 3635142 - RNA, 20 nt, Salmonella enterica enterica serovar Typhi
caagacacagcgucgcgcga

SEQ ID NO: 3635143 - RNA, 17 nt, Salmonella enterica enterica serovar Typhi
caagacccgaaccugcg

SEQ ID NO: 3635144 - RNA, 21 nt, Salmonella enterica enterica serovar Typhi
caagaccgauagagacugccg

SEQ ID NO: 3635145 - RNA, 18 nt, Salmonella enterica enterica serovar Typhi
caagaccgccuaacagcg

SEQ ID NO: 3635146 - RNA, 16 nt, Salmonella enterica enterica serovar Typhi
caagaccgggcugcac

SEQ ID NO: 3635147 - RNA, 23 nt, Salmonella enterica enterica serovar Typhi
caagaccgggcugcacgccaucg

SEQ ID NO: 3635148 - RNA, 16 nt, Salmonella enterica enterica serovar Typhi
caagacgaaaaaugaa

SEQ ID NO: 3635149 - RNA, 17 nt, Salmonella enterica enterica serovar Typhi
caagacgaaaaaugaau

SEQ ID NO: 3635150 - RNA, 21 nt, Salmonella enterica enterica serovar Typhi
caagacgguuauuuuucagau

SEQ ID NO: 3635151 - RNA, 14 nt, Salmonella enterica enterica serovar Typhi
caagagaaauaaca

SEQ ID NO: 3635152 - RNA, 21 nt, Salmonella enterica enterica serovar Typhi
caagagagcaacauaccgcag

SEQ ID NO: 3635153 - RNA, 17 nt, Salmonella enterica enterica serovar Typhi
caagagaugcagacaau

SEQ ID NO: 3635154 - RNA, 15 nt, Salmonella enterica enterica serovar Typhi
caagagcagcaaccc

SEQ ID NO: 3635155 - RNA, 15 nt, Salmonella enterica enterica serovar Typhi
caagagccgccgcca

SEQ ID NO: 3635156 - RNA, 24 nt, Salmonella enterica enterica serovar Typhi
caagagguaaugcccgauggcgcu

SEQ ID NO: 3635157 - RNA, 19 nt, Salmonella enterica enterica serovar Typhi
caagauaagaaguaaacag

SEQ ID NO: 3635158 - RNA, 23 nt, Salmonella enterica enterica serovar Typhi
caagaucauccggguuaaaccag

SEQ ID NO: 3635159 - RNA, 14 nt, Salmonella enterica enterica serovar Typhi
caagaucccucacc

SEQ ID NO: 3635160 - RNA, 14 nt, Salmonella enterica enterica serovar Typhi
caagauccguccau

SEQ ID NO: 3635161 - RNA, 16 nt, Salmonella enterica enterica serovar Typhi
caagauccguccaugu

SEQ ID NO: 3635162 - RNA, 18 nt, Salmonella enterica enterica serovar Typhi
caagaucgcgcagcaggc

SEQ ID NO: 3635163 - RNA, 21 nt, Salmonella enterica enterica serovar Typhi
caagauuaagaccguauaaua

SEQ ID NO: 3635164 - RNA, 16 nt, Salmonella enterica enterica serovar Typhi
caagauuucaaaaccc

SEQ ID NO: 3635165 - RNA, 17 nt, Salmonella enterica enterica serovar Typhi
caagauuucaaaacccg

SEQ ID NO: 3635166 - RNA, 19 nt, Salmonella enterica enterica serovar Typhi
caagcaacuguagaaugcu

SEQ ID NO: 3635167 - RNA, 18 nt, Salmonella enterica enterica serovar Typhi
caagcaccuuauccggcc

SEQ ID NO: 3635168 - RNA, 20 nt, Salmonella enterica enterica serovar Typhi
caagcaccuuauccggccua

SEQ ID NO: 3635169 - RNA, 13 nt, Salmonella enterica enterica serovar Typhi
caagcagaaauac

SEQ ID NO: 3635170 - RNA, 20 nt, Salmonella enterica enterica serovar Typhi
caagcaggcgaucggcguga

SEQ ID NO: 3635171 - RNA, 20 nt, Salmonella enterica enterica serovar Typhi
caagcaguaucguguuauuu

SEQ ID NO: 3635172 - RNA, 18 nt, Salmonella enterica enterica serovar Typhi
caagcaguucugaagcua

SEQ ID NO: 3635173 - RNA, 15 nt, Salmonella enterica enterica serovar Typhi
caagccauugcgcgc

SEQ ID NO: 3635174 - RNA, 11 nt, Salmonella enterica enterica serovar Typhi
caagcccagcu

SEQ ID NO: 3635175 - RNA, 14 nt, Salmonella enterica enterica serovar Typhi
caagcccagcucag

SEQ ID NO: 3635176 - RNA, 19 nt, Salmonella enterica enterica serovar Typhi
caagcccgguaaaauagcc

SEQ ID NO: 3635177 - RNA, 17 nt, Salmonella enterica enterica serovar Typhi
caagccgaccuuauucc

SEQ ID NO: 3635178 - RNA, 14 nt, Salmonella enterica enterica serovar Typhi
caagccgaucagcg

SEQ ID NO: 3635179 - RNA, 14 nt, Salmonella enterica enterica serovar Typhi
caagccgccaacgc

SEQ ID NO: 3635180 - RNA, 15 nt, Salmonella enterica enterica serovar Typhi
caagccgccaacgcc

SEQ ID NO: 3635181 - RNA, 17 nt, Salmonella enterica enterica serovar Typhi
caagccgccaacgccag

SEQ ID NO: 3635182 - RNA, 20 nt, Salmonella enterica enterica serovar Typhi
caagccgguaaucgcgcgca

SEQ ID NO: 3635183 - RNA, 17 nt, Salmonella enterica enterica serovar Typhi
caagcgcggacagcaga

SEQ ID NO: 3635184 - RNA, 18 nt, Salmonella enterica enterica serovar Typhi
caagcgcggacagcagaa

SEQ ID NO: 3635185 - RNA, 14 nt, Salmonella enterica enterica serovar Typhi
caagcgcggcagca

SEQ ID NO: 3635186 - RNA, 17 nt, Salmonella enterica enterica serovar Typhi
caagcgcggcagcagcu

SEQ ID NO: 3635187 - RNA, 16 nt, Salmonella enterica enterica serovar Typhi
caagcgcuaagcaaca

SEQ ID NO: 3635188 - RNA, 15 nt, Salmonella enterica enterica serovar Typhi
caagcgcuucguuga

SEQ ID NO: 3635189 - RNA, 18 nt, Salmonella enterica enterica serovar Typhi
caagcggcaucucgccaa

SEQ ID NO: 3635190 - RNA, 22 nt, Salmonella enterica enterica serovar Typhi
caagcuaauccccagcgcucca

SEQ ID NO: 3635191 - RNA, 20 nt, Salmonella enterica enterica serovar Typhi
caagcucauguaaaggcgug

SEQ ID NO: 3635192 - RNA, 13 nt, Salmonella enterica enterica serovar Typhi
caagcucauuucc

SEQ ID NO: 3635193 - RNA, 18 nt, Salmonella enterica enterica serovar Typhi
caagcugacggauacgcu

SEQ ID NO: 3635194 - RNA, 15 nt, Salmonella enterica enterica serovar Typhi
caagcugauuuuucg

SEQ ID NO: 3635195 - RNA, 18 nt, Salmonella enterica enterica serovar Typhi
caagcugcaucccgguca

SEQ ID NO: 3635196 - RNA, 20 nt, Salmonella enterica enterica serovar Typhi
caagcugguaaaugcgccua

SEQ ID NO: 3635197 - RNA, 12 nt, Salmonella enterica enterica serovar Typhi
caaggaaagaaa

SEQ ID NO: 3635198 - RNA, 18 nt, Salmonella enterica enterica serovar Typhi
caaggcaucgucggcgau

SEQ ID NO: 3635199 - RNA, 15 nt, Salmonella enterica enterica serovar Typhi
caaggcauucaggcc

SEQ ID NO: 3635200 - RNA, 15 nt, Salmonella enterica enterica serovar Typhi
caaggcgacucaaaa

SEQ ID NO: 3635201 - RNA, 19 nt, Salmonella enterica enterica serovar Typhi
caaggcgcaaaaccauacu

SEQ ID NO: 3635202 - RNA, 12 nt, Salmonella enterica enterica serovar Typhi
caaggcgcgcca

SEQ ID NO: 3635203 - RNA, 19 nt, Salmonella enterica enterica serovar Typhi
caaggcuauuagccaaagc

SEQ ID NO: 3635204 - RNA, 16 nt, Salmonella enterica enterica serovar Typhi
caaggcucaauacgca

SEQ ID NO: 3635205 - RNA, 17 nt, Salmonella enterica enterica serovar Typhi
caagggagugagucccc

SEQ ID NO: 3635206 - RNA, 13 nt, Salmonella enterica enterica serovar Typhi
caaggucggcucc

SEQ ID NO: 3635207 - RNA, 14 nt, Salmonella enterica enterica serovar Typhi
caaggucggcuccu

SEQ ID NO: 3635208 - RNA, 19 nt, Salmonella enterica enterica serovar Typhi
caagguggaaaaaagauaa

SEQ ID NO: 3635209 - RNA, 16 nt, Salmonella enterica enterica serovar Typhi
caagguugaucaggaa

SEQ ID NO: 3635210 - RNA, 18 nt, Salmonella enterica enterica serovar Typhi
caaguaaaaugcccugcu

SEQ ID NO: 3635211 - RNA, 13 nt, Salmonella enterica enterica serovar Typhi
caaguaauaaaau

SEQ ID NO: 3635212 - RNA, 21 nt, Salmonella enterica enterica serovar Typhi
caaguacagcuuaaucaccag

SEQ ID NO: 3635213 - RNA, 23 nt, Salmonella enterica enterica serovar Typhi
caaguaguuguuauagcgcgccc

SEQ ID NO: 3635214 - RNA, 18 nt, Salmonella enterica enterica serovar Typhi
caagucgcgggcgcuaaa

SEQ ID NO: 3635215 - RNA, 16 nt, Salmonella enterica enterica serovar Typhi
caaguugcgccacugc

SEQ ID NO: 3635216 - RNA, 14 nt, Salmonella enterica enterica serovar Typhi
caaguuuagaaaaa

SEQ ID NO: 3635217 - RNA, 14 nt, Salmonella enterica enterica serovar Typhi
caaguuuagaaaau

SEQ ID NO: 3635218 - RNA, 16 nt, Salmonella enterica enterica serovar Typhi
caauaaacauuuuuuu

SEQ ID NO: 3635219 - RNA, 20 nt, Salmonella enterica enterica serovar Typhi
caauaaacuaaguaaggagg

SEQ ID NO: 3635220 - RNA, 20 nt, Salmonella enterica enterica serovar Typhi
caauaaacucccgcauauau

SEQ ID NO: 3635221 - RNA, 15 nt, Salmonella enterica enterica serovar Typhi
caauaaaguuuauuu

SEQ ID NO: 3635222 - RNA, 12 nt, Salmonella enterica enterica serovar Typhi
caauaaauaaua

SEQ ID NO: 3635223 - RNA, 23 nt, Salmonella enterica enterica serovar Typhi
caauaaauaauaucguuaagccu

SEQ ID NO: 3635224 - RNA, 19 nt, Salmonella enterica enterica serovar Typhi
caauaaaucaacauacuga

SEQ ID NO: 3635225 - RNA, 15 nt, Salmonella enterica enterica serovar Typhi
caauaacaccacaac

SEQ ID NO: 3635226 - RNA, 18 nt, Salmonella enterica enterica serovar Typhi
caauaacaccacaacaca

SEQ ID NO: 3635227 - RNA, 14 nt, Salmonella enterica enterica serovar Typhi
caauaacagccagc

SEQ ID NO: 3635228 - RNA, 15 nt, Salmonella enterica enterica serovar Typhi
caauaacagccagcg

SEQ ID NO: 3635229 - RNA, 17 nt, Salmonella enterica enterica serovar Typhi
caauaacagccagcggg

SEQ ID NO: 3635230 - RNA, 16 nt, Salmonella enterica enterica serovar Typhi
caauaaccaccuguuc

SEQ ID NO: 3635231 - RNA, 14 nt, Salmonella enterica enterica serovar Typhi
caauaaccgccagc

SEQ ID NO: 3635232 - RNA, 20 nt, Salmonella enterica enterica serovar Typhi
caauaacgaccccaauagcg

SEQ ID NO: 3635233 - RNA, 21 nt, Salmonella enterica enterica serovar Typhi
caauaacgaccccaauagcga

SEQ ID NO: 3635234 - RNA, 23 nt, Salmonella enterica enterica serovar Typhi
caauaacgccggauauguuugac

SEQ ID NO: 3635235 - RNA, 13 nt, Salmonella enterica enterica serovar Typhi
caauaagaacuuu

SEQ ID NO: 3635236 - RNA, 13 nt, Salmonella enterica enterica serovar Typhi
caauaagccagac

SEQ ID NO: 3635237 - RNA, 20 nt, Salmonella enterica enterica serovar Typhi
caauaagcuugcuuuccaua

SEQ ID NO: 3635238 - RNA, 19 nt, Salmonella enterica enterica serovar Typhi
caauaagggcauguuucau

SEQ ID NO: 3635239 - RNA, 19 nt, Salmonella enterica enterica serovar Typhi
caauaagggucgcgcugua

SEQ ID NO: 3635240 - RNA, 23 nt, Salmonella enterica enterica serovar Typhi
caauaagggucgcgcuguauaau

SEQ ID NO: 3635241 - RNA, 23 nt, Salmonella enterica enterica serovar Typhi
caauaaguaaaaacgaaaaaccc

SEQ ID NO: 3635242 - RNA, 18 nt, Salmonella enterica enterica serovar Typhi
caauaaucccuucuuuua

SEQ ID NO: 3635243 - RNA, 21 nt, Salmonella enterica enterica serovar Typhi
caauaauccgcuaacgauguc

SEQ ID NO: 3635244 - RNA, 16 nt, Salmonella enterica enterica serovar Typhi
caauaaucgaaauaaa

SEQ ID NO: 3635245 - RNA, 18 nt, Salmonella enterica enterica serovar Typhi
caauaaucgaaauaaagu

SEQ ID NO: 3635246 - RNA, 18 nt, Salmonella enterica enterica serovar Typhi
caauaaucgcgagaaaau

SEQ ID NO: 3635247 - RNA, 23 nt, Salmonella enterica enterica serovar Typhi
caauacaggcgaccgggcagaca

SEQ ID NO: 3635248 - RNA, 14 nt, Salmonella enterica enterica serovar Typhi
caauaccaauuacc

SEQ ID NO: 3635249 - RNA, 15 nt, Salmonella enterica enterica serovar Typhi
caauaccaauuaccg

SEQ ID NO: 3635250 - RNA, 14 nt, Salmonella enterica enterica serovar Typhi
caauaccacgcccg

SEQ ID NO: 3635251 - RNA, 22 nt, Salmonella enterica enterica serovar Typhi
caauaccacgcccgccgccagc

SEQ ID NO: 3635252 - RNA, 14 nt, Salmonella enterica enterica serovar Typhi
caauaccagggcga

SEQ ID NO: 3635253 - RNA, 15 nt, Salmonella enterica enterica serovar Typhi
caauacccagcgcca

SEQ ID NO: 3635254 - RNA, 16 nt, Salmonella enterica enterica serovar Typhi
caauaccuucugcgcc

SEQ ID NO: 3635255 - RNA, 17 nt, Salmonella enterica enterica serovar Typhi
caauacgaaaaccgagc

SEQ ID NO: 3635256 - RNA, 19 nt, Salmonella enterica enterica serovar Typhi
caauacgagugacauuauu

SEQ ID NO: 3635257 - RNA, 19 nt, Salmonella enterica enterica serovar Typhi
caauacgcugaacuucggg

SEQ ID NO: 3635258 - RNA, 20 nt, Salmonella enterica enterica serovar Typhi
caauacuuaaaccugcgccg

SEQ ID NO: 3635259 - RNA, 22 nt, Salmonella enterica enterica serovar Typhi
caauagaccugaaaucagccug

SEQ ID NO: 3635260 - RNA, 17 nt, Salmonella enterica enterica serovar Typhi
caauagagcaguuaaua

SEQ ID NO: 3635261 - RNA, 21 nt, Salmonella enterica enterica serovar Typhi
caauagagcaguuaauaauga

SEQ ID NO: 3635262 - RNA, 23 nt, Salmonella enterica enterica serovar Typhi
caauagaguaaugacaaaaauua

SEQ ID NO: 3635263 - RNA, 16 nt, Salmonella enterica enterica serovar Typhi
caauagcaaucuguaa

SEQ ID NO: 3635264 - RNA, 17 nt, Salmonella enterica enterica serovar Typhi
caauagcaaucuguaac

SEQ ID NO: 3635265 - RNA, 23 nt, Salmonella enterica enterica serovar Typhi
caauagcgcgucguugccuuugc

SEQ ID NO: 3635266 - RNA, 14 nt, Salmonella enterica enterica serovar Typhi
caauagcgcuaaac

SEQ ID NO: 3635267 - RNA, 19 nt, Salmonella enterica enterica serovar Typhi
caauagcuucaaugaucca

SEQ ID NO: 3635268 - RNA, 19 nt, Salmonella enterica enterica serovar Typhi
caauaguauccauaauuuu

SEQ ID NO: 3635269 - RNA, 22 nt, Salmonella enterica enterica serovar Typhi
caauaguauccauaauuuuccc

SEQ ID NO: 3635270 - RNA, 16 nt, Salmonella enterica enterica serovar Typhi
caauaguggacacaca

SEQ ID NO: 3635271 - RNA, 14 nt, Salmonella enterica enterica serovar Typhi
caauauaccgucag

SEQ ID NO: 3635272 - RNA, 20 nt, Salmonella enterica enterica serovar Typhi
caauauaccgucaguaccag

SEQ ID NO: 3635273 - RNA, 12 nt, Salmonella enterica enterica serovar Typhi
caauauacuuau

SEQ ID NO: 3635274 - RNA, 16 nt, Salmonella enterica enterica serovar Typhi
caauauagaguccuga

SEQ ID NO: 3635275 - RNA, 14 nt, Salmonella enterica enterica serovar Typhi
caauauaugagcaa

SEQ ID NO: 3635276 - RNA, 20 nt, Salmonella enterica enterica serovar Typhi
caauaucagccauuaaccag

SEQ ID NO: 3635277 - RNA, 15 nt, Salmonella enterica enterica serovar Typhi
caauauccccagccc

SEQ ID NO: 3635278 - RNA, 12 nt, Salmonella enterica enterica serovar Typhi
caauauccuccg

SEQ ID NO: 3635279 - RNA, 18 nt, Salmonella enterica enterica serovar Typhi
caauauccucgcauccuc

SEQ ID NO: 3635280 - RNA, 19 nt, Salmonella enterica enterica serovar Typhi
caauauccucgcauccucc

SEQ ID NO: 3635281 - RNA, 21 nt, Salmonella enterica enterica serovar Typhi
caauaucgauagcauuuuuac

SEQ ID NO: 3635282 - RNA, 19 nt, Salmonella enterica enterica serovar Typhi
caauaugcagaucgacggu

SEQ ID NO: 3635283 - RNA, 18 nt, Salmonella enterica enterica serovar Typhi
caauaugcgucagcgcgg

SEQ ID NO: 3635284 - RNA, 15 nt, Salmonella enterica enterica serovar Typhi
caauaugcuguuuau

SEQ ID NO: 3635285 - RNA, 16 nt, Salmonella enterica enterica serovar Typhi
caauaugcuguuuaug

SEQ ID NO: 3635286 - RNA, 15 nt, Salmonella enterica enterica serovar Typhi
caauauggcaccgaa

SEQ ID NO: 3635287 - RNA, 17 nt, Salmonella enterica enterica serovar Typhi
caauaugucuuaaacag

SEQ ID NO: 3635288 - RNA, 22 nt, Salmonella enterica enterica serovar Typhi
caauaugucuuaaacagcgauc

SEQ ID NO: 3635289 - RNA, 17 nt, Salmonella enterica enterica serovar Typhi
caauaugugcaucggca

SEQ ID NO: 3635290 - RNA, 23 nt, Salmonella enterica enterica serovar Typhi
caauauguuuaaagaagaaagac

SEQ ID NO: 3635291 - RNA, 14 nt, Salmonella enterica enterica serovar Typhi
caauauuaaauaaa

SEQ ID NO: 3635292 - RNA, 15 nt, Salmonella enterica enterica serovar Typhi
caauauuaaauaaau

SEQ ID NO: 3635293 - RNA, 13 nt, Salmonella enterica enterica serovar Typhi
caauauuaaauga

SEQ ID NO: 3635294 - RNA, 14 nt, Salmonella enterica enterica serovar Typhi
caauauuaaaugac

SEQ ID NO: 3635295 - RNA, 23 nt, Salmonella enterica enterica serovar Typhi
caauauugaacauuuuuucagcc

SEQ ID NO: 3635296 - RNA, 19 nt, Salmonella enterica enterica serovar Typhi
caauauugcugugcuauga

SEQ ID NO: 3635297 - RNA, 15 nt, Salmonella enterica enterica serovar Typhi
caauauuuauuuaau

SEQ ID NO: 3635298 - RNA, 15 nt, Salmonella enterica enterica serovar Typhi
caaucaaaacauuag

SEQ ID NO: 3635299 - RNA, 16 nt, Salmonella enterica enterica serovar Typhi
caaucaacuccauaau

SEQ ID NO: 3635300 - RNA, 14 nt, Salmonella enterica enterica serovar Typhi
caaucacaaaaugg

SEQ ID NO: 3635301 - RNA, 15 nt, Salmonella enterica enterica serovar Typhi
caaucacaaaauggc

SEQ ID NO: 3635302 - RNA, 15 nt, Salmonella enterica enterica serovar Typhi
caaucaccaucccau

SEQ ID NO: 3635303 - RNA, 12 nt, Salmonella enterica enterica serovar Typhi
caaucaccguug

SEQ ID NO: 3635304 - RNA, 19 nt, Salmonella enterica enterica serovar Typhi
caaucaccugcaucacgcc

SEQ ID NO: 3635305 - RNA, 16 nt, Salmonella enterica enterica serovar Typhi
caaucacgcccagcgc

SEQ ID NO: 3635306 - RNA, 22 nt, Salmonella enterica enterica serovar Typhi
caaucacgccgauaaugcguuu

SEQ ID NO: 3635307 - RNA, 15 nt, Salmonella enterica enterica serovar Typhi
caaucacguuauagc

SEQ ID NO: 3635308 - RNA, 19 nt, Salmonella enterica enterica serovar Typhi
caaucacugaugccacacc

SEQ ID NO: 3635309 - RNA, 19 nt, Salmonella enterica enterica serovar Typhi
caaucacuuuugcgaccca

SEQ ID NO: 3635310 - RNA, 14 nt, Salmonella enterica enterica serovar Typhi
caaucagaagaaau

SEQ ID NO: 3635311 - RNA, 20 nt, Salmonella enterica enterica serovar Typhi
caaucagacgccgggccugc

SEQ ID NO: 3635312 - RNA, 12 nt, Salmonella enterica enterica serovar Typhi
caaucagauucg

SEQ ID NO: 3635313 - RNA, 13 nt, Salmonella enterica enterica serovar Typhi
caaucagcaccau

SEQ ID NO: 3635314 - RNA, 15 nt, Salmonella enterica enterica serovar Typhi
caaucagcccaugcc

SEQ ID NO: 3635315 - RNA, 19 nt, Salmonella enterica enterica serovar Typhi
caaucagccccagcaccag

SEQ ID NO: 3635316 - RNA, 22 nt, Salmonella enterica enterica serovar Typhi
caaucaggaaagagccgcgcag

SEQ ID NO: 3635317 - RNA, 22 nt, Salmonella enterica enterica serovar Typhi
caaucaggcgcaaacgcgugcu

SEQ ID NO: 3635318 - RNA, 17 nt, Salmonella enterica enterica serovar Typhi
caaucagguauuuccug

SEQ ID NO: 3635319 - RNA, 20 nt, Salmonella enterica enterica serovar Typhi
caaucaguaugaugaccugg

SEQ ID NO: 3635320 - RNA, 21 nt, Salmonella enterica enterica serovar Typhi
caaucauaaacgccugacgau

SEQ ID NO: 3635321 - RNA, 14 nt, Salmonella enterica enterica serovar Typhi
caaucaucagaaga

SEQ ID NO: 3635322 - RNA, 13 nt, Salmonella enterica enterica serovar Typhi
caaucauccugau

SEQ ID NO: 3635323 - RNA, 17 nt, Salmonella enterica enterica serovar Typhi
caauccaacgaaacuca

SEQ ID NO: 3635324 - RNA, 18 nt, Salmonella enterica enterica serovar Typhi
caauccaacgaaacucag

SEQ ID NO: 3635325 - RNA, 21 nt, Salmonella enterica enterica serovar Typhi
caauccaacgaaacucagcgg

SEQ ID NO: 3635326 - RNA, 17 nt, Salmonella enterica enterica serovar Typhi
caauccauuuuaaauac

SEQ ID NO: 3635327 - RNA, 18 nt, Salmonella enterica enterica serovar Typhi
caauccauuuuaaauaca

SEQ ID NO: 3635328 - RNA, 23 nt, Salmonella enterica enterica serovar Typhi
caaucccggagagagcaacuggc

SEQ ID NO: 3635329 - RNA, 15 nt, Salmonella enterica enterica serovar Typhi
caaucccuuaaagcc

SEQ ID NO: 3635330 - RNA, 18 nt, Salmonella enterica enterica serovar Typhi
caauccgcgccgcaucuu

SEQ ID NO: 3635331 - RNA, 15 nt, Salmonella enterica enterica serovar Typhi
caauccgcggcaaac

SEQ ID NO: 3635332 - RNA, 13 nt, Salmonella enterica enterica serovar Typhi
caauccuggcuuc

SEQ ID NO: 3635333 - RNA, 20 nt, Salmonella enterica enterica serovar Typhi
caauccuucuaccuucaccc

SEQ ID NO: 3635334 - RNA, 14 nt, Salmonella enterica enterica serovar Typhi
caaucgagaagcca

SEQ ID NO: 3635335 - RNA, 16 nt, Salmonella enterica enterica serovar Typhi
caaucgagaucagacu

SEQ ID NO: 3635336 - RNA, 17 nt, Salmonella enterica enterica serovar Typhi
caaucgcaaauugcugu

SEQ ID NO: 3635337 - RNA, 16 nt, Salmonella enterica enterica serovar Typhi
caaucgccugcaacgc

SEQ ID NO: 3635338 - RNA, 15 nt, Salmonella enterica enterica serovar Typhi
caaucgccugcugua

SEQ ID NO: 3635339 - RNA, 13 nt, Salmonella enterica enterica serovar Typhi
caaucgcgguaug

SEQ ID NO: 3635340 - RNA, 16 nt, Salmonella enterica enterica serovar Typhi
caaucgcguucgcggg

SEQ ID NO: 3635341 - RNA, 14 nt, Salmonella enterica enterica serovar Typhi
caaucgcguuuucc

SEQ ID NO: 3635342 - RNA, 18 nt, Salmonella enterica enterica serovar Typhi
caaucgcguuuuccagca

SEQ ID NO: 3635343 - RNA, 20 nt, Salmonella enterica enterica serovar Typhi
caaucgcuaucugacagcca

SEQ ID NO: 3635344 - RNA, 20 nt, Salmonella enterica enterica serovar Typhi
caaucgcuuccagcgccggu

SEQ ID NO: 3635345 - RNA, 23 nt, Salmonella enterica enterica serovar Typhi
caaucggcgauaaaccaacagcc

SEQ ID NO: 3635346 - RNA, 21 nt, Salmonella enterica enterica serovar Typhi
caaucggcgucuggagcgugc

SEQ ID NO: 3635347 - RNA, 18 nt, Salmonella enterica enterica serovar Typhi
caaucgucguuccgccag

SEQ ID NO: 3635348 - RNA, 12 nt, Salmonella enterica enterica serovar Typhi
caaucgucuuca

SEQ ID NO: 3635349 - RNA, 22 nt, Salmonella enterica enterica serovar Typhi
caaucguuaauucauggccauc

SEQ ID NO: 3635350 - RNA, 12 nt, Salmonella enterica enterica serovar Typhi
caaucuacuuuu

SEQ ID NO: 3635351 - RNA, 15 nt, Salmonella enterica enterica serovar Typhi
caaucucacugccca

SEQ ID NO: 3635352 - RNA, 14 nt, Salmonella enterica enterica serovar Typhi
caaucuccuccggc

SEQ ID NO: 3635353 - RNA, 22 nt, Salmonella enterica enterica serovar Typhi
caaucuccuccggcuucagcaa

SEQ ID NO: 3635354 - RNA, 16 nt, Salmonella enterica enterica serovar Typhi
caaucucgccaaugcc

SEQ ID NO: 3635355 - RNA, 15 nt, Salmonella enterica enterica serovar Typhi
caaucucuuccgccc

SEQ ID NO: 3635356 - RNA, 23 nt, Salmonella enterica enterica serovar Typhi
caaucucuuccgcccagauauca

SEQ ID NO: 3635357 - RNA, 12 nt, Salmonella enterica enterica serovar Typhi
caaucucuuuau

SEQ ID NO: 3635358 - RNA, 14 nt, Salmonella enterica enterica serovar Typhi
caaucuggugacga

SEQ ID NO: 3635359 - RNA, 17 nt, Salmonella enterica enterica serovar Typhi
caaucuguuuguuagaa

SEQ ID NO: 3635360 - RNA, 14 nt, Salmonella enterica enterica serovar Typhi
caaugaaauaauug

SEQ ID NO: 3635361 - RNA, 19 nt, Salmonella enterica enterica serovar Typhi
caaugaacagcacguuacc

SEQ ID NO: 3635362 - RNA, 13 nt, Salmonella enterica enterica serovar Typhi
caaugaacaguuu

SEQ ID NO: 3635363 - RNA, 15 nt, Salmonella enterica enterica serovar Typhi
caaugaaccagccca

SEQ ID NO: 3635364 - RNA, 17 nt, Salmonella enterica enterica serovar Typhi
caaugaaccagcccaua

SEQ ID NO: 3635365 - RNA, 17 nt, Salmonella enterica enterica serovar Typhi
caaugaccacaaauucu

SEQ ID NO: 3635366 - RNA, 22 nt, Salmonella enterica enterica serovar Typhi
caaugaccauaauuuccggcgc

SEQ ID NO: 3635367 - RNA, 20 nt, Salmonella enterica enterica serovar Typhi
caaugagauccacugagcgc

SEQ ID NO: 3635368 - RNA, 13 nt, Salmonella enterica enterica serovar Typhi
caaugagcaggcc

SEQ ID NO: 3635369 - RNA, 13 nt, Salmonella enterica enterica serovar Typhi
caaugaucagacg

SEQ ID NO: 3635370 - RNA, 14 nt, Salmonella enterica enterica serovar Typhi
caaugaucagcgac

SEQ ID NO: 3635371 - RNA, 17 nt, Salmonella enterica enterica serovar Typhi
caaugaugccuugcgaa

SEQ ID NO: 3635372 - RNA, 18 nt, Salmonella enterica enterica serovar Typhi
caaugauucaagcgggug

SEQ ID NO: 3635373 - RNA, 15 nt, Salmonella enterica enterica serovar Typhi
caaugauuuuuagcc

SEQ ID NO: 3635374 - RNA, 14 nt, Salmonella enterica enterica serovar Typhi
caaugcaacgccuu

SEQ ID NO: 3635375 - RNA, 18 nt, Salmonella enterica enterica serovar Typhi
caaugccaaaaaaacuaa

SEQ ID NO: 3635376 - RNA, 14 nt, Salmonella enterica enterica serovar Typhi
caaugccaccacac

SEQ ID NO: 3635377 - RNA, 19 nt, Salmonella enterica enterica serovar Typhi
caaugccaccagcgccaua

SEQ ID NO: 3635378 - RNA, 22 nt, Salmonella enterica enterica serovar Typhi
caaugccauauuuaccuuuucc

SEQ ID NO: 3635379 - RNA, 22 nt, Salmonella enterica enterica serovar Typhi
caaugcccgguuuuuuaaugag

SEQ ID NO: 3635380 - RNA, 16 nt, Salmonella enterica enterica serovar Typhi
caaugccgcagcgcgg

SEQ ID NO: 3635381 - RNA, 20 nt, Salmonella enterica enterica serovar Typhi
caaugccgcgggaaauacca

SEQ ID NO: 3635382 - RNA, 21 nt, Salmonella enterica enterica serovar Typhi
caaugccgcgggaaauaccaa

SEQ ID NO: 3635383 - RNA, 18 nt, Salmonella enterica enterica serovar Typhi
caaugccuaacccuuuuc

SEQ ID NO: 3635384 - RNA, 19 nt, Salmonella enterica enterica serovar Typhi
caaugccuaacccuuuucc

SEQ ID NO: 3635385 - RNA, 15 nt, Salmonella enterica enterica serovar Typhi
caaugcgaauaacau

SEQ ID NO: 3635386 - RNA, 14 nt, Salmonella enterica enterica serovar Typhi
caaugcgcuuuuuu

SEQ ID NO: 3635387 - RNA, 14 nt, Salmonella enterica enterica serovar Typhi
caaugcggaaacca

SEQ ID NO: 3635388 - RNA, 14 nt, Salmonella enterica enterica serovar Typhi
caaugcuggcaggc

SEQ ID NO: 3635389 - RNA, 20 nt, Salmonella enterica enterica serovar Typhi
caaugcuggcaggcgcgacc

SEQ ID NO: 3635390 - RNA, 23 nt, Salmonella enterica enterica serovar Typhi
caauggauuuauggcacaucagg

SEQ ID NO: 3635391 - RNA, 18 nt, Salmonella enterica enterica serovar Typhi
caauggccagaugaaacu

SEQ ID NO: 3635392 - RNA, 16 nt, Salmonella enterica enterica serovar Typhi
caauggccgcagcgcc

SEQ ID NO: 3635393 - RNA, 13 nt, Salmonella enterica enterica serovar Typhi
caauggcgacgau

SEQ ID NO: 3635394 - RNA, 19 nt, Salmonella enterica enterica serovar Typhi
caauggcgacgaucagcgc

SEQ ID NO: 3635395 - RNA, 20 nt, Salmonella enterica enterica serovar Typhi
caauggcgacgaucagcgcc

SEQ ID NO: 3635396 - RNA, 22 nt, Salmonella enterica enterica serovar Typhi
caauggcgcucggaugugcauu

SEQ ID NO: 3635397 - RNA, 19 nt, Salmonella enterica enterica serovar Typhi
caauggcuagggaaacgcu

SEQ ID NO: 3635398 - RNA, 17 nt, Salmonella enterica enterica serovar Typhi
caaugguugccuggugu

SEQ ID NO: 3635399 - RNA, 14 nt, Salmonella enterica enterica serovar Typhi
caauguaaaacggu

SEQ ID NO: 3635400 - RNA, 22 nt, Salmonella enterica enterica serovar Typhi
caauguaacaccuguaacguca

SEQ ID NO: 3635401 - RNA, 21 nt, Salmonella enterica enterica serovar Typhi
caauguauuguucaugcaauu

SEQ ID NO: 3635402 - RNA, 17 nt, Salmonella enterica enterica serovar Typhi
caaugucgcaaucggcu

SEQ ID NO: 3635403 - RNA, 18 nt, Salmonella enterica enterica serovar Typhi
caaugucggccugauuuc

SEQ ID NO: 3635404 - RNA, 22 nt, Salmonella enterica enterica serovar Typhi
caauguuaaauucagcauuagg

SEQ ID NO: 3635405 - RNA, 23 nt, Salmonella enterica enterica serovar Typhi
caauguugaaucccacgccgcug

SEQ ID NO: 3635406 - RNA, 17 nt, Salmonella enterica enterica serovar Typhi
caauguugagcaucgcu

SEQ ID NO: 3635407 - RNA, 14 nt, Salmonella enterica enterica serovar Typhi
caauuaacaaauaa

SEQ ID NO: 3635408 - RNA, 12 nt, Salmonella enterica enterica serovar Typhi
caauuaacauuu

SEQ ID NO: 3635409 - RNA, 17 nt, Salmonella enterica enterica serovar Typhi
caauuagcgacgcauac

SEQ ID NO: 3635410 - RNA, 21 nt, Salmonella enterica enterica serovar Typhi
caauuauauugcguaaaaacc

SEQ ID NO: 3635411 - RNA, 22 nt, Salmonella enterica enterica serovar Typhi
caauuauauugcguaaaaaccc

SEQ ID NO: 3635412 - RNA, 14 nt, Salmonella enterica enterica serovar Typhi
caauucaaucacuu

SEQ ID NO: 3635413 - RNA, 23 nt, Salmonella enterica enterica serovar Typhi
caauuccaccaccucggcacgga

SEQ ID NO: 3635414 - RNA, 18 nt, Salmonella enterica enterica serovar Typhi
caauucuggaaucaauuu

SEQ ID NO: 3635415 - RNA, 20 nt, Salmonella enterica enterica serovar Typhi
caauucuggcgcacauugcu

SEQ ID NO: 3635416 - RNA, 14 nt, Salmonella enterica enterica serovar Typhi
caauugcaggcagc

SEQ ID NO: 3635417 - RNA, 16 nt, Salmonella enterica enterica serovar Typhi
caauuuaccuauuucg

SEQ ID NO: 3635418 - RNA, 12 nt, Salmonella enterica enterica serovar Typhi
caauuuaucugc

SEQ ID NO: 3635419 - RNA, 15 nt, Salmonella enterica enterica serovar Typhi
caauuuaucugcgug

SEQ ID NO: 3635420 - RNA, 16 nt, Salmonella enterica enterica serovar Typhi
caauuucauauuauua

SEQ ID NO: 3635421 - RNA, 20 nt, Salmonella enterica enterica serovar Typhi
caauuuccccugcgaacagc

SEQ ID NO: 3635422 - RNA, 23 nt, Salmonella enterica enterica serovar Typhi
caauuuccccugcgaacagcgcu

SEQ ID NO: 3635423 - RNA, 17 nt, Salmonella enterica enterica serovar Typhi
caauuucccuucaauca

SEQ ID NO: 3635424 - RNA, 14 nt, Salmonella enterica enterica serovar Typhi
caauuuccgccgcc

SEQ ID NO: 3635425 - RNA, 20 nt, Salmonella enterica enterica serovar Typhi
caauuuccgcugaaauagcc

SEQ ID NO: 3635426 - RNA, 21 nt, Salmonella enterica enterica serovar Typhi
caauuucucgcucgcccauca

SEQ ID NO: 3635427 - RNA, 21 nt, Salmonella enterica enterica serovar Typhi
caauuugguuagggaucaucu

SEQ ID NO: 3635428 - RNA, 15 nt, Salmonella enterica enterica serovar Typhi
caauuuucaguuuua

SEQ ID NO: 3635429 - RNA, 22 nt, Salmonella enterica enterica serovar Typhi
caauuuucuuaauaugcugccu

SEQ ID NO: 3635430 - RNA, 20 nt, Salmonella enterica enterica serovar Typhi
caauuuuuacaaauuuaaac

SEQ ID NO: 3635431 - RNA, 20 nt, Salmonella enterica enterica serovar Typhi
cacaaaaaaaccgcucaacu

SEQ ID NO: 3635432 - RNA, 20 nt, Salmonella enterica enterica serovar Typhi
cacaaaaacacccgcagccg

SEQ ID NO: 3635433 - RNA, 13 nt, Salmonella enterica enterica serovar Typhi
cacaaaacaggau

SEQ ID NO: 3635434 - RNA, 22 nt, Salmonella enterica enterica serovar Typhi
cacaaaacuauuuuccccuucu

SEQ ID NO: 3635435 - RNA, 16 nt, Salmonella enterica enterica serovar Typhi
cacaaaauggcugaua

SEQ ID NO: 3635436 - RNA, 23 nt, Salmonella enterica enterica serovar Typhi
cacaaaauuuugcauaaauaaug

SEQ ID NO: 3635437 - RNA, 15 nt, Salmonella enterica enterica serovar Typhi
cacaaacaauuuacg

SEQ ID NO: 3635438 - RNA, 21 nt, Salmonella enterica enterica serovar Typhi
cacaaacaauuuacgcagccc

SEQ ID NO: 3635439 - RNA, 23 nt, Salmonella enterica enterica serovar Typhi
cacaaacaauuuacgcagcccca

SEQ ID NO: 3635440 - RNA, 14 nt, Salmonella enterica enterica serovar Typhi
cacaaacaauuucc

SEQ ID NO: 3635441 - RNA, 22 nt, Salmonella enterica enterica serovar Typhi
cacaaacgccgucacaaagccc

SEQ ID NO: 3635442 - RNA, 18 nt, Salmonella enterica enterica serovar Typhi
cacaaacggcaucgauau

SEQ ID NO: 3635443 - RNA, 16 nt, Salmonella enterica enterica serovar Typhi
cacaaacuccagacga

SEQ ID NO: 3635444 - RNA, 14 nt, Salmonella enterica enterica serovar Typhi
cacaaauuucgagc

SEQ ID NO: 3635445 - RNA, 20 nt, Salmonella enterica enterica serovar Typhi
cacaaauuuugauaaaaaca

SEQ ID NO: 3635446 - RNA, 12 nt, Salmonella enterica enterica serovar Typhi
cacaacccaaag

SEQ ID NO: 3635447 - RNA, 13 nt, Salmonella enterica enterica serovar Typhi
cacaaccuccacg

SEQ ID NO: 3635448 - RNA, 17 nt, Salmonella enterica enterica serovar Typhi
cacaaccuccacgccca

SEQ ID NO: 3635449 - RNA, 19 nt, Salmonella enterica enterica serovar Typhi
cacaaccuccacgcccagc

SEQ ID NO: 3635450 - RNA, 15 nt, Salmonella enterica enterica serovar Typhi
cacaaccugaaagaa

SEQ ID NO: 3635451 - RNA, 16 nt, Salmonella enterica enterica serovar Typhi
cacaacgaguccccuc

SEQ ID NO: 3635452 - RNA, 22 nt, Salmonella enterica enterica serovar Typhi
cacaacgcgaguauucgcgccc

SEQ ID NO: 3635453 - RNA, 12 nt, Salmonella enterica enterica serovar Typhi
cacaacguaaua

SEQ ID NO: 3635454 - RNA, 16 nt, Salmonella enterica enterica serovar Typhi
cacaacguaaucauca

SEQ ID NO: 3635455 - RNA, 21 nt, Salmonella enterica enterica serovar Typhi
cacaacgucaguggaaaacag

SEQ ID NO: 3635456 - RNA, 21 nt, Salmonella enterica enterica serovar Typhi
cacaacgugaugaucguguug

SEQ ID NO: 3635457 - RNA, 22 nt, Salmonella enterica enterica serovar Typhi
cacaacgugccagaaacaagaa

SEQ ID NO: 3635458 - RNA, 13 nt, Salmonella enterica enterica serovar Typhi
cacaacuguucuu

SEQ ID NO: 3635459 - RNA, 16 nt, Salmonella enterica enterica serovar Typhi
cacaagagcagcaacc

SEQ ID NO: 3635460 - RNA, 20 nt, Salmonella enterica enterica serovar Typhi
cacaagccccacgcccgcca

SEQ ID NO: 3635461 - RNA, 13 nt, Salmonella enterica enterica serovar Typhi
cacaaguuuaucc

SEQ ID NO: 3635462 - RNA, 13 nt, Salmonella enterica enterica serovar Typhi
cacaauagcgcua

SEQ ID NO: 3635463 - RNA, 14 nt, Salmonella enterica enterica serovar Typhi
cacaauauccgccc

SEQ ID NO: 3635464 - RNA, 13 nt, Salmonella enterica enterica serovar Typhi
cacaaucaaggca

SEQ ID NO: 3635465 - RNA, 13 nt, Salmonella enterica enterica serovar Typhi
cacaaucacagcg

SEQ ID NO: 3635466 - RNA, 16 nt, Salmonella enterica enterica serovar Typhi
cacaaucccgccagac

SEQ ID NO: 3635467 - RNA, 21 nt, Salmonella enterica enterica serovar Typhi
cacaaucccgccagacccgca

SEQ ID NO: 3635468 - RNA, 22 nt, Salmonella enterica enterica serovar Typhi
cacaaugacagaaaugcaggga

SEQ ID NO: 3635469 - RNA, 13 nt, Salmonella enterica enterica serovar Typhi
cacaaugacaugu

SEQ ID NO: 3635470 - RNA, 17 nt, Salmonella enterica enterica serovar Typhi
cacaaugguggucgcca

SEQ ID NO: 3635471 - RNA, 20 nt, Salmonella enterica enterica serovar Typhi
cacaauugccagcagguauc

SEQ ID NO: 3635472 - RNA, 23 nt, Salmonella enterica enterica serovar Typhi
cacaauuuucuuaauaugcugcc

SEQ ID NO: 3635473 - RNA, 13 nt, Salmonella enterica enterica serovar Typhi
cacacacuguuua

SEQ ID NO: 3635474 - RNA, 23 nt, Salmonella enterica enterica serovar Typhi
cacacacuguuuaaugcuuucaa

SEQ ID NO: 3635475 - RNA, 18 nt, Salmonella enterica enterica serovar Typhi
cacacaggaguucaucau

SEQ ID NO: 3635476 - RNA, 15 nt, Salmonella enterica enterica serovar Typhi
cacaccaacgcuggc

SEQ ID NO: 3635477 - RNA, 19 nt, Salmonella enterica enterica serovar Typhi
cacaccaaugucauauuug

SEQ ID NO: 3635478 - RNA, 18 nt, Salmonella enterica enterica serovar Typhi
cacaccacaugcgagcag

SEQ ID NO: 3635479 - RNA, 18 nt, Salmonella enterica enterica serovar Typhi
cacaccacgugcggacgu

SEQ ID NO: 3635480 - RNA, 17 nt, Salmonella enterica enterica serovar Typhi
cacaccaucccggcgua

SEQ ID NO: 3635481 - RNA, 16 nt, Salmonella enterica enterica serovar Typhi
cacaccauuucacaaa

SEQ ID NO: 3635482 - RNA, 20 nt, Salmonella enterica enterica serovar Typhi
cacaccauuucacaaauuaa

SEQ ID NO: 3635483 - RNA, 13 nt, Salmonella enterica enterica serovar Typhi
cacacccauagca

SEQ ID NO: 3635484 - RNA, 14 nt, Salmonella enterica enterica serovar Typhi
cacacccauagcag

SEQ ID NO: 3635485 - RNA, 15 nt, Salmonella enterica enterica serovar Typhi
cacaccgccgccagc

SEQ ID NO: 3635486 - RNA, 19 nt, Salmonella enterica enterica serovar Typhi
cacaccgucaacaucaucc

SEQ ID NO: 3635487 - RNA, 21 nt, Salmonella enterica enterica serovar Typhi
cacaccguuacgaccccauua

SEQ ID NO: 3635488 - RNA, 18 nt, Salmonella enterica enterica serovar Typhi
cacacgccaaaaucgccc

SEQ ID NO: 3635489 - RNA, 20 nt, Salmonella enterica enterica serovar Typhi
cacacgccuggccaggcuuu

SEQ ID NO: 3635490 - RNA, 14 nt, Salmonella enterica enterica serovar Typhi
cacacggcauucac

SEQ ID NO: 3635491 - RNA, 19 nt, Salmonella enterica enterica serovar Typhi
cacacgucugagcaggcgg

SEQ ID NO: 3635492 - RNA, 20 nt, Salmonella enterica enterica serovar Typhi
cacacuaguaaucaggcgag

SEQ ID NO: 3635493 - RNA, 22 nt, Salmonella enterica enterica serovar Typhi
cacacucauuuugccguugcug

SEQ ID NO: 3635494 - RNA, 14 nt, Salmonella enterica enterica serovar Typhi
cacacucucuccag

SEQ ID NO: 3635495 - RNA, 14 nt, Salmonella enterica enterica serovar Typhi
cacacugcaucgaa

SEQ ID NO: 3635496 - RNA, 14 nt, Salmonella enterica enterica serovar Typhi
cacacugcgccgcc

SEQ ID NO: 3635497 - RNA, 15 nt, Salmonella enterica enterica serovar Typhi
cacacugcgccgcca

SEQ ID NO: 3635498 - RNA, 22 nt, Salmonella enterica enterica serovar Typhi
cacacuguuuaaugcuuucaau

SEQ ID NO: 3635499 - RNA, 13 nt, Salmonella enterica enterica serovar Typhi
cacacuuaccgac

SEQ ID NO: 3635500 - RNA, 14 nt, Salmonella enterica enterica serovar Typhi
cacacuuucaucag

SEQ ID NO: 3635501 - RNA, 15 nt, Salmonella enterica enterica serovar Typhi
cacacuuucaucagc

SEQ ID NO: 3635502 - RNA, 24 nt, Salmonella enterica enterica serovar Typhi
cacacuuucgcccggcgccagcuc

SEQ ID NO: 3635503 - RNA, 20 nt, Salmonella enterica enterica serovar Typhi
cacagaaggcuaacagcugg

SEQ ID NO: 3635504 - RNA, 15 nt, Salmonella enterica enterica serovar Typhi
cacagaaucgcugug

SEQ ID NO: 3635505 - RNA, 23 nt, Salmonella enterica enterica serovar Typhi
cacagaauuacauaugcgcggcg

SEQ ID NO: 3635506 - RNA, 16 nt, Salmonella enterica enterica serovar Typhi
cacagacccaguacaa

SEQ ID NO: 3635507 - RNA, 19 nt, Salmonella enterica enterica serovar Typhi
cacagaucgaaugaaaaug

SEQ ID NO: 3635508 - RNA, 22 nt, Salmonella enterica enterica serovar Typhi
cacagauuaugcaguucuucgc

SEQ ID NO: 3635509 - RNA, 15 nt, Salmonella enterica enterica serovar Typhi
cacagcaaacauccc

SEQ ID NO: 3635510 - RNA, 17 nt, Salmonella enterica enterica serovar Typhi
cacagcaaacauccccg

SEQ ID NO: 3635511 - RNA, 17 nt, Salmonella enterica enterica serovar Typhi
cacagcaaaugaaagga

SEQ ID NO: 3635512 - RNA, 16 nt, Salmonella enterica enterica serovar Typhi
cacagcacaauaccuu

SEQ ID NO: 3635513 - RNA, 15 nt, Salmonella enterica enterica serovar Typhi
cacagcacauagaag

SEQ ID NO: 3635514 - RNA, 22 nt, Salmonella enterica enterica serovar Typhi
cacagcacauagaagcucaugu

SEQ ID NO: 3635515 - RNA, 19 nt, Salmonella enterica enterica serovar Typhi
cacagcacgauaugcauaa

SEQ ID NO: 3635516 - RNA, 14 nt, Salmonella enterica enterica serovar Typhi
cacagcagaaagca

SEQ ID NO: 3635517 - RNA, 21 nt, Salmonella enterica enterica serovar Typhi
cacagcagaaagcaacagcaa

SEQ ID NO: 3635518 - RNA, 22 nt, Salmonella enterica enterica serovar Typhi
cacagcaugaauaaccucccgc

SEQ ID NO: 3635519 - RNA, 17 nt, Salmonella enterica enterica serovar Typhi
cacagccaaaauaugcu

SEQ ID NO: 3635520 - RNA, 19 nt, Salmonella enterica enterica serovar Typhi
cacagccaguaagaacgag

SEQ ID NO: 3635521 - RNA, 18 nt, Salmonella enterica enterica serovar Typhi
cacagccaguggcgaaac

SEQ ID NO: 3635522 - RNA, 14 nt, Salmonella enterica enterica serovar Typhi
cacagccccagcac

SEQ ID NO: 3635523 - RNA, 17 nt, Salmonella enterica enterica serovar Typhi
cacagccccagcaccaa

SEQ ID NO: 3635524 - RNA, 14 nt, Salmonella enterica enterica serovar Typhi
cacagccguguccg

SEQ ID NO: 3635525 - RNA, 19 nt, Salmonella enterica enterica serovar Typhi
cacagccuuauaagaacca

SEQ ID NO: 3635526 - RNA, 18 nt, Salmonella enterica enterica serovar Typhi
cacagcgcuaucaggcac

SEQ ID NO: 3635527 - RNA, 19 nt, Salmonella enterica enterica serovar Typhi
cacagcgcuuuaguacgcg

SEQ ID NO: 3635528 - RNA, 21 nt, Salmonella enterica enterica serovar Typhi
cacagcggacacccgcagcca

SEQ ID NO: 3635529 - RNA, 22 nt, Salmonella enterica enterica serovar Typhi
cacagcguacaauggcaggcau

SEQ ID NO: 3635530 - RNA, 21 nt, Salmonella enterica enterica serovar Typhi
cacagcuugccguagcgcgcu

SEQ ID NO: 3635531 - RNA, 22 nt, Salmonella enterica enterica serovar Typhi
cacagcuugccguagcgcgcuu

SEQ ID NO: 3635532 - RNA, 13 nt, Salmonella enterica enterica serovar Typhi
cacaggccaacau

SEQ ID NO: 3635533 - RNA, 18 nt, Salmonella enterica enterica serovar Typhi
cacaggcggaaaacauuc

SEQ ID NO: 3635534 - RNA, 19 nt, Salmonella enterica enterica serovar Typhi
cacaggcggcgguucaacc

SEQ ID NO: 3635535 - RNA, 13 nt, Salmonella enterica enterica serovar Typhi
cacaggcuuauac

SEQ ID NO: 3635536 - RNA, 17 nt, Salmonella enterica enterica serovar Typhi
cacagggggaacauuua

SEQ ID NO: 3635537 - RNA, 18 nt, Salmonella enterica enterica serovar Typhi
cacagguaaacgcauagg

SEQ ID NO: 3635538 - RNA, 21 nt, Salmonella enterica enterica serovar Typhi
cacagguacaggccgccgccu

SEQ ID NO: 3635539 - RNA, 13 nt, Salmonella enterica enterica serovar Typhi
cacagguuaucgc

SEQ ID NO: 3635540 - RNA, 20 nt, Salmonella enterica enterica serovar Typhi
cacaguaaaaaaacgccugu

SEQ ID NO: 3635541 - RNA, 20 nt, Salmonella enterica enterica serovar Typhi
cacaguacgcccggcgggua

SEQ ID NO: 3635542 - RNA, 15 nt, Salmonella enterica enterica serovar Typhi
cacaguuaacgccaa

SEQ ID NO: 3635543 - RNA, 15 nt, Salmonella enterica enterica serovar Typhi
cacauaacaaaacca

SEQ ID NO: 3635544 - RNA, 20 nt, Salmonella enterica enterica serovar Typhi
cacauaacugagacucagca

SEQ ID NO: 3635545 - RNA, 18 nt, Salmonella enterica enterica serovar Typhi
cacauaagcaacuugaag

SEQ ID NO: 3635546 - RNA, 15 nt, Salmonella enterica enterica serovar Typhi
cacauaccgucacca

SEQ ID NO: 3635547 - RNA, 21 nt, Salmonella enterica enterica serovar Typhi
cacauauaacaaacgccgcuc

SEQ ID NO: 3635548 - RNA, 15 nt, Salmonella enterica enterica serovar Typhi
cacauauauuucugu

SEQ ID NO: 3635549 - RNA, 17 nt, Salmonella enterica enterica serovar Typhi
cacauaucgccagccau

SEQ ID NO: 3635550 - RNA, 19 nt, Salmonella enterica enterica serovar Typhi
cacauauucaauaauauua

SEQ ID NO: 3635551 - RNA, 14 nt, Salmonella enterica enterica serovar Typhi
cacauauugcgcuu

SEQ ID NO: 3635552 - RNA, 15 nt, Salmonella enterica enterica serovar Typhi
cacaucacaaucucc

SEQ ID NO: 3635553 - RNA, 16 nt, Salmonella enterica enterica serovar Typhi
cacaucaggaaugcca

SEQ ID NO: 3635554 - RNA, 20 nt, Salmonella enterica enterica serovar Typhi
cacaucaugaugaucuucag

SEQ ID NO: 3635555 - RNA, 20 nt, Salmonella enterica enterica serovar Typhi
cacauccagacagccgacgg

SEQ ID NO: 3635556 - RNA, 13 nt, Salmonella enterica enterica serovar Typhi
cacauccagcgcc

SEQ ID NO: 3635557 - RNA, 23 nt, Salmonella enterica enterica serovar Typhi
cacauccagcgccagcgccaccu

SEQ ID NO: 3635558 - RNA, 13 nt, Salmonella enterica enterica serovar Typhi
cacauccauguac

SEQ ID NO: 3635559 - RNA, 14 nt, Salmonella enterica enterica serovar Typhi
cacauccugcggga

SEQ ID NO: 3635560 - RNA, 20 nt, Salmonella enterica enterica serovar Typhi
cacaucgacaugcagaucgc

SEQ ID NO: 3635561 - RNA, 17 nt, Salmonella enterica enterica serovar Typhi
cacaucgcccugauggc

SEQ ID NO: 3635562 - RNA, 15 nt, Salmonella enterica enterica serovar Typhi
cacaucgccguucca

SEQ ID NO: 3635563 - RNA, 16 nt, Salmonella enterica enterica serovar Typhi
cacaucguuacccauu

SEQ ID NO: 3635564 - RNA, 23 nt, Salmonella enterica enterica serovar Typhi
cacaucguuacccauuaccuggc

SEQ ID NO: 3635565 - RNA, 18 nt, Salmonella enterica enterica serovar Typhi
cacaucguuaucuaugcu

SEQ ID NO: 3635566 - RNA, 15 nt, Salmonella enterica enterica serovar Typhi
cacaucuacucauau

SEQ ID NO: 3635567 - RNA, 15 nt, Salmonella enterica enterica serovar Typhi
cacaugaccugaaua

SEQ ID NO: 3635568 - RNA, 20 nt, Salmonella enterica enterica serovar Typhi
cacaugcaaaaaagcccauc

SEQ ID NO: 3635569 - RNA, 12 nt, Salmonella enterica enterica serovar Typhi
cacaugggcagg

SEQ ID NO: 3635570 - RNA, 14 nt, Salmonella enterica enterica serovar Typhi
cacauguuggcauu

SEQ ID NO: 3635571 - RNA, 12 nt, Salmonella enterica enterica serovar Typhi
cacauuccauuu

SEQ ID NO: 3635572 - RNA, 22 nt, Salmonella enterica enterica serovar Typhi
cacauucugcccgcguuuccac

SEQ ID NO: 3635573 - RNA, 14 nt, Salmonella enterica enterica serovar Typhi
cacauugcgcgccg

SEQ ID NO: 3635574 - RNA, 16 nt, Salmonella enterica enterica serovar Typhi
cacauugcgguucauu

SEQ ID NO: 3635575 - RNA, 12 nt, Salmonella enterica enterica serovar Typhi
cacauuggcaaa

SEQ ID NO: 3635576 - RNA, 14 nt, Salmonella enterica enterica serovar Typhi
cacauuggccccug

SEQ ID NO: 3635577 - RNA, 20 nt, Salmonella enterica enterica serovar Typhi
cacauuggcugcgcuucuga

SEQ ID NO: 3635578 - RNA, 16 nt, Salmonella enterica enterica serovar Typhi
cacauuguaugcaaga

SEQ ID NO: 3635579 - RNA, 15 nt, Salmonella enterica enterica serovar Typhi
cacauuucaaacguu

SEQ ID NO: 3635580 - RNA, 17 nt, Salmonella enterica enterica serovar Typhi
cacauuucagcgcagaa

SEQ ID NO: 3635581 - RNA, 19 nt, Salmonella enterica enterica serovar Typhi
cacauuucuuuugaucguc

SEQ ID NO: 3635582 - RNA, 13 nt, Salmonella enterica enterica serovar Typhi
cacauuuuuauca

SEQ ID NO: 3635583 - RNA, 13 nt, Salmonella enterica enterica serovar Typhi
caccaaaaagcca

SEQ ID NO: 3635584 - RNA, 17 nt, Salmonella enterica enterica serovar Typhi
caccaaaaauucuuuua

SEQ ID NO: 3635585 - RNA, 23 nt, Salmonella enterica enterica serovar Typhi
caccaacgauaaauuuucagaca

SEQ ID NO: 3635586 - RNA, 21 nt, Salmonella enterica enterica serovar Typhi
caccaacggcgacgcccgcca

SEQ ID NO: 3635587 - RNA, 13 nt, Salmonella enterica enterica serovar Typhi
caccaacugcuga

SEQ ID NO: 3635588 - RNA, 16 nt, Salmonella enterica enterica serovar Typhi
caccaacugcugaccg

SEQ ID NO: 3635589 - RNA, 17 nt, Salmonella enterica enterica serovar Typhi
caccaauacgugagcga

SEQ ID NO: 3635590 - RNA, 22 nt, Salmonella enterica enterica serovar Typhi
caccaaugucauauuugugagc

SEQ ID NO: 3635591 - RNA, 22 nt, Salmonella enterica enterica serovar Typhi
caccacaaacgccgucacaaag

SEQ ID NO: 3635592 - RNA, 22 nt, Salmonella enterica enterica serovar Typhi
caccacaaagcgguaaaucgca

SEQ ID NO: 3635593 - RNA, 14 nt, Salmonella enterica enterica serovar Typhi
caccaccaggaacg

SEQ ID NO: 3635594 - RNA, 18 nt, Salmonella enterica enterica serovar Typhi
caccaccaguacauggcu

SEQ ID NO: 3635595 - RNA, 24 nt, Salmonella enterica enterica serovar Typhi
caccaccaugggucucauccaucc

SEQ ID NO: 3635596 - RNA, 22 nt, Salmonella enterica enterica serovar Typhi
caccacccguucgaaugagaac

SEQ ID NO: 3635597 - RNA, 16 nt, Salmonella enterica enterica serovar Typhi
caccaccgccacuucc

SEQ ID NO: 3635598 - RNA, 12 nt, Salmonella enterica enterica serovar Typhi
caccaccgccgc

SEQ ID NO: 3635599 - RNA, 21 nt, Salmonella enterica enterica serovar Typhi
caccacgaucuugucacaaua

SEQ ID NO: 3635600 - RNA, 15 nt, Salmonella enterica enterica serovar Typhi
caccacgcaaaccgc

SEQ ID NO: 3635601 - RNA, 13 nt, Salmonella enterica enterica serovar Typhi
caccacgcacagu

SEQ ID NO: 3635602 - RNA, 14 nt, Salmonella enterica enterica serovar Typhi
caccacgcagcccg

SEQ ID NO: 3635603 - RNA, 22 nt, Salmonella enterica enterica serovar Typhi
caccacgcccggaucaaacaua

SEQ ID NO: 3635604 - RNA, 15 nt, Salmonella enterica enterica serovar Typhi
caccacgccgagaaa

SEQ ID NO: 3635605 - RNA, 11 nt, Salmonella enterica enterica serovar Typhi
caccacgcggg

SEQ ID NO: 3635606 - RNA, 18 nt, Salmonella enterica enterica serovar Typhi
caccacgguguaccccgc

SEQ ID NO: 3635607 - RNA, 22 nt, Salmonella enterica enterica serovar Typhi
caccacgguguaccccgccuga

SEQ ID NO: 3635608 - RNA, 19 nt, Salmonella enterica enterica serovar Typhi
caccacguaaugcgccccg

SEQ ID NO: 3635609 - RNA, 14 nt, Salmonella enterica enterica serovar Typhi
caccacgucauccg

SEQ ID NO: 3635610 - RNA, 16 nt, Salmonella enterica enterica serovar Typhi
caccacgucauccucc

SEQ ID NO: 3635611 - RNA, 23 nt, Salmonella enterica enterica serovar Typhi
caccacugaaaaauaauuacuau

SEQ ID NO: 3635612 - RNA, 19 nt, Salmonella enterica enterica serovar Typhi
caccacuggcagcgccuga

SEQ ID NO: 3635613 - RNA, 20 nt, Salmonella enterica enterica serovar Typhi
caccacuuuguuuuuguccg

SEQ ID NO: 3635614 - RNA, 19 nt, Salmonella enterica enterica serovar Typhi
caccagaaucgccagcauc

SEQ ID NO: 3635615 - RNA, 16 nt, Salmonella enterica enterica serovar Typhi
caccagacccgggacu

SEQ ID NO: 3635616 - RNA, 21 nt, Salmonella enterica enterica serovar Typhi
caccagacccgggacuucagg

SEQ ID NO: 3635617 - RNA, 21 nt, Salmonella enterica enterica serovar Typhi
caccagaccgacaagcccccc

SEQ ID NO: 3635618 - RNA, 21 nt, Salmonella enterica enterica serovar Typhi
caccagacgcuggcacuggca

SEQ ID NO: 3635619 - RNA, 23 nt, Salmonella enterica enterica serovar Typhi
caccagcaacguaaucccgccag

SEQ ID NO: 3635620 - RNA, 13 nt, Salmonella enterica enterica serovar Typhi
caccagcacagcc

SEQ ID NO: 3635621 - RNA, 14 nt, Salmonella enterica enterica serovar Typhi
caccagcacagccc

SEQ ID NO: 3635622 - RNA, 17 nt, Salmonella enterica enterica serovar Typhi
caccagcacgaugcaua

SEQ ID NO: 3635623 - RNA, 17 nt, Salmonella enterica enterica serovar Typhi
caccagccaggccgcca

SEQ ID NO: 3635624 - RNA, 21 nt, Salmonella enterica enterica serovar Typhi
caccagcccaucuuucgccag

SEQ ID NO: 3635625 - RNA, 24 nt, Salmonella enterica enterica serovar Typhi
caccagccccaaaauucacgcuuc

SEQ ID NO: 3635626 - RNA, 20 nt, Salmonella enterica enterica serovar Typhi
caccagccguucaccagcca

SEQ ID NO: 3635627 - RNA, 18 nt, Salmonella enterica enterica serovar Typhi
caccagcgauaucaacgu

SEQ ID NO: 3635628 - RNA, 16 nt, Salmonella enterica enterica serovar Typhi
caccagcgaugcgcgc

SEQ ID NO: 3635629 - RNA, 24 nt, Salmonella enterica enterica serovar Typhi
caccagcgauuacgccagacagca

SEQ ID NO: 3635630 - RNA, 20 nt, Salmonella enterica enterica serovar Typhi
caccagcgcauugacgauau

SEQ ID NO: 3635631 - RNA, 14 nt, Salmonella enterica enterica serovar Typhi
caccagcgccaggc

SEQ ID NO: 3635632 - RNA, 11 nt, Salmonella enterica enterica serovar Typhi
caccagcgccg

SEQ ID NO: 3635633 - RNA, 16 nt, Salmonella enterica enterica serovar Typhi
caccagcgccugcgcu

SEQ ID NO: 3635634 - RNA, 17 nt, Salmonella enterica enterica serovar Typhi
caccagcgccugcgcug

SEQ ID NO: 3635635 - RNA, 18 nt, Salmonella enterica enterica serovar Typhi
caccagcgccugcgcugc

SEQ ID NO: 3635636 - RNA, 17 nt, Salmonella enterica enterica serovar Typhi
caccagcgcgccgccgc

SEQ ID NO: 3635637 - RNA, 19 nt, Salmonella enterica enterica serovar Typhi
caccagcguggcuauccau

SEQ ID NO: 3635638 - RNA, 13 nt, Salmonella enterica enterica serovar Typhi
caccaggaacgcc

SEQ ID NO: 3635639 - RNA, 20 nt, Salmonella enterica enterica serovar Typhi
caccaggaagacuauccagc

SEQ ID NO: 3635640 - RNA, 18 nt, Salmonella enterica enterica serovar Typhi
caccaggaguuaaaccug

SEQ ID NO: 3635641 - RNA, 23 nt, Salmonella enterica enterica serovar Typhi
caccaggauacguucauccuccu

SEQ ID NO: 3635642 - RNA, 15 nt, Salmonella enterica enterica serovar Typhi
caccaguucacuccu

SEQ ID NO: 3635643 - RNA, 21 nt, Salmonella enterica enterica serovar Typhi
caccaguucacuccuaagaga

SEQ ID NO: 3635644 - RNA, 16 nt, Salmonella enterica enterica serovar Typhi
caccaguucauauuug

SEQ ID NO: 3635645 - RNA, 15 nt, Salmonella enterica enterica serovar Typhi
caccauaaaaccauu

SEQ ID NO: 3635646 - RNA, 16 nt, Salmonella enterica enterica serovar Typhi
caccauaaaucauuac

SEQ ID NO: 3635647 - RNA, 20 nt, Salmonella enterica enterica serovar Typhi
caccauaauuaccggcacac

SEQ ID NO: 3635648 - RNA, 17 nt, Salmonella enterica enterica serovar Typhi
caccauaccgacgacca

SEQ ID NO: 3635649 - RNA, 18 nt, Salmonella enterica enterica serovar Typhi
caccauaccuauaaaaau

SEQ ID NO: 3635650 - RNA, 22 nt, Salmonella enterica enterica serovar Typhi
caccauauagacauacaggaau

SEQ ID NO: 3635651 - RNA, 17 nt, Salmonella enterica enterica serovar Typhi
caccauauucgccaccg

SEQ ID NO: 3635652 - RNA, 23 nt, Salmonella enterica enterica serovar Typhi
caccaucacuaccauuuccggcg

SEQ ID NO: 3635653 - RNA, 13 nt, Salmonella enterica enterica serovar Typhi
caccaucacuucc

SEQ ID NO: 3635654 - RNA, 13 nt, Salmonella enterica enterica serovar Typhi
caccaucccgcuc

SEQ ID NO: 3635655 - RNA, 14 nt, Salmonella enterica enterica serovar Typhi
caccaucccggcgu

SEQ ID NO: 3635656 - RNA, 14 nt, Salmonella enterica enterica serovar Typhi
caccauccgcgcau

SEQ ID NO: 3635657 - RNA, 14 nt, Salmonella enterica enterica serovar Typhi
caccauccggcgcu

SEQ ID NO: 3635658 - RNA, 17 nt, Salmonella enterica enterica serovar Typhi
caccauccggcgcugcg

SEQ ID NO: 3635659 - RNA, 20 nt, Salmonella enterica enterica serovar Typhi
caccaucgucgccagaccca

SEQ ID NO: 3635660 - RNA, 21 nt, Salmonella enterica enterica serovar Typhi
caccaucgucgccagacccag

SEQ ID NO: 3635661 - RNA, 16 nt, Salmonella enterica enterica serovar Typhi
caccaucguugccagc

SEQ ID NO: 3635662 - RNA, 19 nt, Salmonella enterica enterica serovar Typhi
caccaucguugccagcggc

SEQ ID NO: 3635663 - RNA, 21 nt, Salmonella enterica enterica serovar Typhi
caccaucguugccagcggcca

SEQ ID NO: 3635664 - RNA, 13 nt, Salmonella enterica enterica serovar Typhi
caccaucuuuuuu

SEQ ID NO: 3635665 - RNA, 16 nt, Salmonella enterica enterica serovar Typhi
caccaugcaaaaugcu

SEQ ID NO: 3635666 - RNA, 18 nt, Salmonella enterica enterica serovar Typhi
caccauguugaccagguc

SEQ ID NO: 3635667 - RNA, 21 nt, Salmonella enterica enterica serovar Typhi
caccauuaugaccaauaauaa

SEQ ID NO: 3635668 - RNA, 13 nt, Salmonella enterica enterica serovar Typhi
caccauucccagc

SEQ ID NO: 3635669 - RNA, 14 nt, Salmonella enterica enterica serovar Typhi
caccauucuucaac

SEQ ID NO: 3635670 - RNA, 19 nt, Salmonella enterica enterica serovar Typhi
caccauuucacaaauuaaa

SEQ ID NO: 3635671 - RNA, 20 nt, Salmonella enterica enterica serovar Typhi
cacccaauauagaguccuga

SEQ ID NO: 3635672 - RNA, 14 nt, Salmonella enterica enterica serovar Typhi
cacccacaggagcc

SEQ ID NO: 3635673 - RNA, 13 nt, Salmonella enterica enterica serovar Typhi
cacccacgccgga

SEQ ID NO: 3635674 - RNA, 21 nt, Salmonella enterica enterica serovar Typhi
cacccagaauacggccuucuu

SEQ ID NO: 3635675 - RNA, 16 nt, Salmonella enterica enterica serovar Typhi
cacccagugccaccag

SEQ ID NO: 3635676 - RNA, 20 nt, Salmonella enterica enterica serovar Typhi
cacccaguuuuuuucugcca

SEQ ID NO: 3635677 - RNA, 14 nt, Salmonella enterica enterica serovar Typhi
cacccaugccgcga

SEQ ID NO: 3635678 - RNA, 14 nt, Salmonella enterica enterica serovar Typhi
caccccaaaucucc

SEQ ID NO: 3635679 - RNA, 14 nt, Salmonella enterica enterica serovar Typhi
caccccaacaaaua

SEQ ID NO: 3635680 - RNA, 21 nt, Salmonella enterica enterica serovar Typhi
caccccaacaaauagcacaca

SEQ ID NO: 3635681 - RNA, 15 nt, Salmonella enterica enterica serovar Typhi
caccccuugcgcguu

SEQ ID NO: 3635682 - RNA, 20 nt, Salmonella enterica enterica serovar Typhi
cacccgaacaacaauacgcg

SEQ ID NO: 3635683 - RNA, 20 nt, Salmonella enterica enterica serovar Typhi
cacccgauacacgccgacgc

SEQ ID NO: 3635684 - RNA, 15 nt, Salmonella enterica enterica serovar Typhi
cacccgcagccagaa

SEQ ID NO: 3635685 - RNA, 22 nt, Salmonella enterica enterica serovar Typhi
cacccgcagccgcaaucagcgu

SEQ ID NO: 3635686 - RNA, 15 nt, Salmonella enterica enterica serovar Typhi
cacccgcgccagcag

SEQ ID NO: 3635687 - RNA, 14 nt, Salmonella enterica enterica serovar Typhi
cacccggagagaaa

SEQ ID NO: 3635688 - RNA, 15 nt, Salmonella enterica enterica serovar Typhi
cacccggagagaaac

SEQ ID NO: 3635689 - RNA, 23 nt, Salmonella enterica enterica serovar Typhi
cacccgggaaaaaugacgccggg

SEQ ID NO: 3635690 - RNA, 24 nt, Salmonella enterica enterica serovar Typhi
cacccgggccggaagagcgcagag

SEQ ID NO: 3635691 - RNA, 15 nt, Salmonella enterica enterica serovar Typhi
cacccuauccgccag

SEQ ID NO: 3635692 - RNA, 19 nt, Salmonella enterica enterica serovar Typhi
cacccucgucuuugccucg

SEQ ID NO: 3635693 - RNA, 10 nt, Salmonella enterica enterica serovar Typhi
cacccugccc

SEQ ID NO: 3635694 - RNA, 17 nt, Salmonella enterica enterica serovar Typhi
cacccuugcggcuugca

SEQ ID NO: 3635695 - RNA, 16 nt, Salmonella enterica enterica serovar Typhi
caccgaaacagcacgc

SEQ ID NO: 3635696 - RNA, 15 nt, Salmonella enterica enterica serovar Typhi
caccgacacgcauau

SEQ ID NO: 3635697 - RNA, 14 nt, Salmonella enterica enterica serovar Typhi
caccgacagcaccg

SEQ ID NO: 3635698 - RNA, 15 nt, Salmonella enterica enterica serovar Typhi
caccgacagcaccgc

SEQ ID NO: 3635699 - RNA, 15 nt, Salmonella enterica enterica serovar Typhi
caccgaccugccuug

SEQ ID NO: 3635700 - RNA, 12 nt, Salmonella enterica enterica serovar Typhi
caccgacuccuc

SEQ ID NO: 3635701 - RNA, 11 nt, Salmonella enterica enterica serovar Typhi
caccgauaaac

SEQ ID NO: 3635702 - RNA, 14 nt, Salmonella enterica enterica serovar Typhi
caccgauccgaaga

SEQ ID NO: 3635703 - RNA, 22 nt, Salmonella enterica enterica serovar Typhi
caccgcaaauucgucgccgcca

SEQ ID NO: 3635704 - RNA, 13 nt, Salmonella enterica enterica serovar Typhi
caccgcaucggca

SEQ ID NO: 3635705 - RNA, 17 nt, Salmonella enterica enterica serovar Typhi
caccgcaucggcaucaa

SEQ ID NO: 3635706 - RNA, 12 nt, Salmonella enterica enterica serovar Typhi
caccgcauggcu

SEQ ID NO: 3635707 - RNA, 15 nt, Salmonella enterica enterica serovar Typhi
caccgccaaacgcgg

SEQ ID NO: 3635708 - RNA, 18 nt, Salmonella enterica enterica serovar Typhi
caccgccaaccgcccguc

SEQ ID NO: 3635709 - RNA, 18 nt, Salmonella enterica enterica serovar Typhi
caccgccaccugcccuuu

SEQ ID NO: 3635710 - RNA, 18 nt, Salmonella enterica enterica serovar Typhi
caccgccacuuccgcuac

SEQ ID NO: 3635711 - RNA, 18 nt, Salmonella enterica enterica serovar Typhi
caccgccagacgccccaa

SEQ ID NO: 3635712 - RNA, 13 nt, Salmonella enterica enterica serovar Typhi
caccgccagagca

SEQ ID NO: 3635713 - RNA, 15 nt, Salmonella enterica enterica serovar Typhi
caccgccagagcacg

SEQ ID NO: 3635714 - RNA, 13 nt, Salmonella enterica enterica serovar Typhi
caccgccagccau

SEQ ID NO: 3635715 - RNA, 16 nt, Salmonella enterica enterica serovar Typhi
caccgccagcgccgcg

SEQ ID NO: 3635716 - RNA, 16 nt, Salmonella enterica enterica serovar Typhi
caccgccagcgucugu

SEQ ID NO: 3635717 - RNA, 22 nt, Salmonella enterica enterica serovar Typhi
caccgccauauuaugcuggccu

SEQ ID NO: 3635718 - RNA, 15 nt, Salmonella enterica enterica serovar Typhi
caccgcccagagaau

SEQ ID NO: 3635719 - RNA, 16 nt, Salmonella enterica enterica serovar Typhi
caccgcccuggcggga

SEQ ID NO: 3635720 - RNA, 18 nt, Salmonella enterica enterica serovar Typhi
caccgccgccaccaaaaa

SEQ ID NO: 3635721 - RNA, 17 nt, Salmonella enterica enterica serovar Typhi
caccgccgcgauagacc

SEQ ID NO: 3635722 - RNA, 12 nt, Salmonella enterica enterica serovar Typhi
caccgccgggcu

SEQ ID NO: 3635723 - RNA, 18 nt, Salmonella enterica enterica serovar Typhi
caccgccuaggccagugc

SEQ ID NO: 3635724 - RNA, 17 nt, Salmonella enterica enterica serovar Typhi
caccgcgaauauacgca

SEQ ID NO: 3635725 - RNA, 22 nt, Salmonella enterica enterica serovar Typhi
caccgcgaauauacgcaccuga

SEQ ID NO: 3635726 - RNA, 19 nt, Salmonella enterica enterica serovar Typhi
caccgcgaauuucaccacc

SEQ ID NO: 3635727 - RNA, 20 nt, Salmonella enterica enterica serovar Typhi
caccgcgaugaccaucaaau

SEQ ID NO: 3635728 - RNA, 22 nt, Salmonella enterica enterica serovar Typhi
caccgcgaugcugcucuccacg

SEQ ID NO: 3635729 - RNA, 16 nt, Salmonella enterica enterica serovar Typhi
caccgcgcgcgcggca

SEQ ID NO: 3635730 - RNA, 20 nt, Salmonella enterica enterica serovar Typhi
caccgcggagaucgcucccg

SEQ ID NO: 3635731 - RNA, 18 nt, Salmonella enterica enterica serovar Typhi
caccgcggcaaccagccc

SEQ ID NO: 3635732 - RNA, 17 nt, Salmonella enterica enterica serovar Typhi
caccgcggcgcucgcca

SEQ ID NO: 3635733 - RNA, 21 nt, Salmonella enterica enterica serovar Typhi
caccgcggcgcucgccagccc

SEQ ID NO: 3635734 - RNA, 22 nt, Salmonella enterica enterica serovar Typhi
caccgcgucguuacgcucguca

SEQ ID NO: 3635735 - RNA, 20 nt, Salmonella enterica enterica serovar Typhi
caccgcuaaaaaacaggcgc

SEQ ID NO: 3635736 - RNA, 20 nt, Salmonella enterica enterica serovar Typhi
caccgcuacaauccaggacg

SEQ ID NO: 3635737 - RNA, 18 nt, Salmonella enterica enterica serovar Typhi
caccgcucaauaucauag

SEQ ID NO: 3635738 - RNA, 21 nt, Salmonella enterica enterica serovar Typhi
caccgcuucacauacccgcuu

SEQ ID NO: 3635739 - RNA, 14 nt, Salmonella enterica enterica serovar Typhi
caccgcuugccggc

SEQ ID NO: 3635740 - RNA, 19 nt, Salmonella enterica enterica serovar Typhi
caccgcuugccggcgcagc

SEQ ID NO: 3635741 - RNA, 12 nt, Salmonella enterica enterica serovar Typhi
caccggaauuug

SEQ ID NO: 3635742 - RNA, 13 nt, Salmonella enterica enterica serovar Typhi
caccggacauccc

SEQ ID NO: 3635743 - RNA, 14 nt, Salmonella enterica enterica serovar Typhi
caccggaccgccga

SEQ ID NO: 3635744 - RNA, 16 nt, Salmonella enterica enterica serovar Typhi
caccggaccgccgagu

SEQ ID NO: 3635745 - RNA, 15 nt, Salmonella enterica enterica serovar Typhi
caccggaguuaccau

SEQ ID NO: 3635746 - RNA, 14 nt, Salmonella enterica enterica serovar Typhi
caccggcacaucca

SEQ ID NO: 3635747 - RNA, 20 nt, Salmonella enterica enterica serovar Typhi
caccggccauugccgcgccg

SEQ ID NO: 3635748 - RNA, 20 nt, Salmonella enterica enterica serovar Typhi
caccggcccccggccauagc

SEQ ID NO: 3635749 - RNA, 21 nt, Salmonella enterica enterica serovar Typhi
caccggcccgguugucccggu

SEQ ID NO: 3635750 - RNA, 12 nt, Salmonella enterica enterica serovar Typhi
caccggcggcca

SEQ ID NO: 3635751 - RNA, 14 nt, Salmonella enterica enterica serovar Typhi
caccggcggcgcca

SEQ ID NO: 3635752 - RNA, 18 nt, Salmonella enterica enterica serovar Typhi
caccggcuguauacacuu

SEQ ID NO: 3635753 - RNA, 15 nt, Salmonella enterica enterica serovar Typhi
caccgggccaaugcc

SEQ ID NO: 3635754 - RNA, 14 nt, Salmonella enterica enterica serovar Typhi
caccgggccaccga

SEQ ID NO: 3635755 - RNA, 20 nt, Salmonella enterica enterica serovar Typhi
caccggguccagucgcgccg

SEQ ID NO: 3635756 - RNA, 21 nt, Salmonella enterica enterica serovar Typhi
caccgguugcgcaaccuccgc

SEQ ID NO: 3635757 - RNA, 21 nt, Salmonella enterica enterica serovar Typhi
caccgguuuuuccgcuucacc

SEQ ID NO: 3635758 - RNA, 22 nt, Salmonella enterica enterica serovar Typhi
caccguaucgacauaguacccu

SEQ ID NO: 3635759 - RNA, 18 nt, Salmonella enterica enterica serovar Typhi
caccgucaacaucauccc

SEQ ID NO: 3635760 - RNA, 13 nt, Salmonella enterica enterica serovar Typhi
caccgucaauaac

SEQ ID NO: 3635761 - RNA, 21 nt, Salmonella enterica enterica serovar Typhi
caccgucacugaaccugccuu

SEQ ID NO: 3635762 - RNA, 19 nt, Salmonella enterica enterica serovar Typhi
caccgucgcggcaucguag

SEQ ID NO: 3635763 - RNA, 19 nt, Salmonella enterica enterica serovar Typhi
caccguggugaccgccaga

SEQ ID NO: 3635764 - RNA, 23 nt, Salmonella enterica enterica serovar Typhi
caccguuacaaauagcggcacag

SEQ ID NO: 3635765 - RNA, 16 nt, Salmonella enterica enterica serovar Typhi
caccguuauccggcaa

SEQ ID NO: 3635766 - RNA, 16 nt, Salmonella enterica enterica serovar Typhi
caccguucuggcugcc

SEQ ID NO: 3635767 - RNA, 18 nt, Salmonella enterica enterica serovar Typhi
caccguugugcuccagcg

SEQ ID NO: 3635768 - RNA, 19 nt, Salmonella enterica enterica serovar Typhi
caccguugugcuccagcgu

SEQ ID NO: 3635769 - RNA, 19 nt, Salmonella enterica enterica serovar Typhi
caccguuuaaaaacaucau

SEQ ID NO: 3635770 - RNA, 19 nt, Salmonella enterica enterica serovar Typhi
caccguuuaaucgcccugc

SEQ ID NO: 3635771 - RNA, 20 nt, Salmonella enterica enterica serovar Typhi
caccguuuaaucgcccugcg

SEQ ID NO: 3635772 - RNA, 18 nt, Salmonella enterica enterica serovar Typhi
caccguuugcagccagau

SEQ ID NO: 3635773 - RNA, 14 nt, Salmonella enterica enterica serovar Typhi
caccguuuuccagg

SEQ ID NO: 3635774 - RNA, 16 nt, Salmonella enterica enterica serovar Typhi
caccuaacccaccaua

SEQ ID NO: 3635775 - RNA, 20 nt, Salmonella enterica enterica serovar Typhi
caccucagaauucugcgcgu

SEQ ID NO: 3635776 - RNA, 16 nt, Salmonella enterica enterica serovar Typhi
caccucagccacccac

SEQ ID NO: 3635777 - RNA, 20 nt, Salmonella enterica enterica serovar Typhi
caccucagguaaauccgcca

SEQ ID NO: 3635778 - RNA, 16 nt, Salmonella enterica enterica serovar Typhi
caccucaucaacgcca

SEQ ID NO: 3635779 - RNA, 16 nt, Salmonella enterica enterica serovar Typhi
caccuccagcgccugu

SEQ ID NO: 3635780 - RNA, 17 nt, Salmonella enterica enterica serovar Typhi
caccucguucaaacaga

SEQ ID NO: 3635781 - RNA, 19 nt, Salmonella enterica enterica serovar Typhi
caccucuuccgccaggucg

SEQ ID NO: 3635782 - RNA, 16 nt, Salmonella enterica enterica serovar Typhi
caccucuuuaugcggc

SEQ ID NO: 3635783 - RNA, 14 nt, Salmonella enterica enterica serovar Typhi
caccugaucgccaa

SEQ ID NO: 3635784 - RNA, 21 nt, Salmonella enterica enterica serovar Typhi
caccugaucgugccaugacca

SEQ ID NO: 3635785 - RNA, 12 nt, Salmonella enterica enterica serovar Typhi
caccugaugccc

SEQ ID NO: 3635786 - RNA, 18 nt, Salmonella enterica enterica serovar Typhi
caccugaugguuauuuuc

SEQ ID NO: 3635787 - RNA, 22 nt, Salmonella enterica enterica serovar Typhi
caccugauugauacgcgcccga

SEQ ID NO: 3635788 - RNA, 16 nt, Salmonella enterica enterica serovar Typhi
caccugcaacuccugg

SEQ ID NO: 3635789 - RNA, 17 nt, Salmonella enterica enterica serovar Typhi
caccugccauucacgcu

SEQ ID NO: 3635790 - RNA, 23 nt, Salmonella enterica enterica serovar Typhi
caccugcccuuucagagcgucuu

SEQ ID NO: 3635791 - RNA, 20 nt, Salmonella enterica enterica serovar Typhi
caccugcuguugcggaauac

SEQ ID NO: 3635792 - RNA, 16 nt, Salmonella enterica enterica serovar Typhi
caccuggaugcugccu

SEQ ID NO: 3635793 - RNA, 18 nt, Salmonella enterica enterica serovar Typhi
caccuggaugcugccugc

SEQ ID NO: 3635794 - RNA, 20 nt, Salmonella enterica enterica serovar Typhi
caccugguuauuagaugcga

SEQ ID NO: 3635795 - RNA, 23 nt, Salmonella enterica enterica serovar Typhi
caccuguaaccccagcaucugca

SEQ ID NO: 3635796 - RNA, 17 nt, Salmonella enterica enterica serovar Typhi
caccuuaaacuugccgu

SEQ ID NO: 3635797 - RNA, 15 nt, Salmonella enterica enterica serovar Typhi
caccuuacccggcgu

SEQ ID NO: 3635798 - RNA, 22 nt, Salmonella enterica enterica serovar Typhi
caccuuacgaauuuuaucuucc

SEQ ID NO: 3635799 - RNA, 18 nt, Salmonella enterica enterica serovar Typhi
caccuuacgcacaugauc

SEQ ID NO: 3635800 - RNA, 13 nt, Salmonella enterica enterica serovar Typhi
caccuuauccugg

SEQ ID NO: 3635801 - RNA, 22 nt, Salmonella enterica enterica serovar Typhi
caccuucggucccaucgcgcca

SEQ ID NO: 3635802 - RNA, 13 nt, Salmonella enterica enterica serovar Typhi
caccuuucugcca

SEQ ID NO: 3635803 - RNA, 14 nt, Salmonella enterica enterica serovar Typhi
cacgaaaaauaaaa

SEQ ID NO: 3635804 - RNA, 21 nt, Salmonella enterica enterica serovar Typhi
cacgaaaaguguguaccagca

SEQ ID NO: 3635805 - RNA, 14 nt, Salmonella enterica enterica serovar Typhi
cacgaagcggguuu

SEQ ID NO: 3635806 - RNA, 22 nt, Salmonella enterica enterica serovar Typhi
cacgaaucuggucguaagaauu

SEQ ID NO: 3635807 - RNA, 13 nt, Salmonella enterica enterica serovar Typhi
cacgacacaaaag

SEQ ID NO: 3635808 - RNA, 13 nt, Salmonella enterica enterica serovar Typhi
cacgacauccgga

SEQ ID NO: 3635809 - RNA, 14 nt, Salmonella enterica enterica serovar Typhi
cacgaccagcgaca

SEQ ID NO: 3635810 - RNA, 18 nt, Salmonella enterica enterica serovar Typhi
cacgacuaucgucacccu

SEQ ID NO: 3635811 - RNA, 22 nt, Salmonella enterica enterica serovar Typhi
cacgacuaucgucacccuauuu

SEQ ID NO: 3635812 - RNA, 16 nt, Salmonella enterica enterica serovar Typhi
cacgaggccacgcagc

SEQ ID NO: 3635813 - RNA, 20 nt, Salmonella enterica enterica serovar Typhi
cacgauaaaccucacgcaau

SEQ ID NO: 3635814 - RNA, 18 nt, Salmonella enterica enterica serovar Typhi
cacgauaaauugccugau

SEQ ID NO: 3635815 - RNA, 21 nt, Salmonella enterica enterica serovar Typhi
cacgauacgccccugcuggcg

SEQ ID NO: 3635816 - RNA, 20 nt, Salmonella enterica enterica serovar Typhi
cacgauacuguugcaguuua

SEQ ID NO: 3635817 - RNA, 16 nt, Salmonella enterica enterica serovar Typhi
cacgauagacagcacc

SEQ ID NO: 3635818 - RNA, 17 nt, Salmonella enterica enterica serovar Typhi
cacgauagacagcacca

SEQ ID NO: 3635819 - RNA, 21 nt, Salmonella enterica enterica serovar Typhi
cacgauaugcauaaucgccga

SEQ ID NO: 3635820 - RNA, 16 nt, Salmonella enterica enterica serovar Typhi
cacgaucgagccgucg

SEQ ID NO: 3635821 - RNA, 16 nt, Salmonella enterica enterica serovar Typhi
cacgaucgaugcccug

SEQ ID NO: 3635822 - RNA, 12 nt, Salmonella enterica enterica serovar Typhi
cacgaucgccua

SEQ ID NO: 3635823 - RNA, 14 nt, Salmonella enterica enterica serovar Typhi
cacgaucgccuaau

SEQ ID NO: 3635824 - RNA, 20 nt, Salmonella enterica enterica serovar Typhi
cacgaucuugucacaauaac

SEQ ID NO: 3635825 - RNA, 22 nt, Salmonella enterica enterica serovar Typhi
cacgauggcgauuuucaccggc

SEQ ID NO: 3635826 - RNA, 19 nt, Salmonella enterica enterica serovar Typhi
cacgauguucaacgucagc

SEQ ID NO: 3635827 - RNA, 13 nt, Salmonella enterica enterica serovar Typhi
cacgcaaaccgcu

SEQ ID NO: 3635828 - RNA, 16 nt, Salmonella enterica enterica serovar Typhi
cacgcaaugcguccgu

SEQ ID NO: 3635829 - RNA, 23 nt, Salmonella enterica enterica serovar Typhi
cacgcacacgucugagcaggcgg

SEQ ID NO: 3635830 - RNA, 13 nt, Salmonella enterica enterica serovar Typhi
cacgcacgccggc

SEQ ID NO: 3635831 - RNA, 15 nt, Salmonella enterica enterica serovar Typhi
cacgcagacccaggc

SEQ ID NO: 3635832 - RNA, 12 nt, Salmonella enterica enterica serovar Typhi
cacgcagacgcc

SEQ ID NO: 3635833 - RNA, 19 nt, Salmonella enterica enterica serovar Typhi
cacgcagauaucuuccagc

SEQ ID NO: 3635834 - RNA, 19 nt, Salmonella enterica enterica serovar Typhi
cacgcagggggucgcgggu

SEQ ID NO: 3635835 - RNA, 14 nt, Salmonella enterica enterica serovar Typhi
cacgcaguccaaca

SEQ ID NO: 3635836 - RNA, 16 nt, Salmonella enterica enterica serovar Typhi
cacgcaguccaacaag

SEQ ID NO: 3635837 - RNA, 17 nt, Salmonella enterica enterica serovar Typhi
cacgcagugcgaugcga

SEQ ID NO: 3635838 - RNA, 21 nt, Salmonella enterica enterica serovar Typhi
cacgcauaaaaaaggcucgca

SEQ ID NO: 3635839 - RNA, 21 nt, Salmonella enterica enterica serovar Typhi
cacgcaucgggucgcgcgccg

SEQ ID NO: 3635840 - RNA, 22 nt, Salmonella enterica enterica serovar Typhi
cacgcauggcguugcugcaaau

SEQ ID NO: 3635841 - RNA, 18 nt, Salmonella enterica enterica serovar Typhi
cacgcauugccacagccu

SEQ ID NO: 3635842 - RNA, 17 nt, Salmonella enterica enterica serovar Typhi
cacgccaaaaagugaau

SEQ ID NO: 3635843 - RNA, 15 nt, Salmonella enterica enterica serovar Typhi
cacgccaaaaucgcc

SEQ ID NO: 3635844 - RNA, 13 nt, Salmonella enterica enterica serovar Typhi
cacgccaccaucc

SEQ ID NO: 3635845 - RNA, 14 nt, Salmonella enterica enterica serovar Typhi
cacgccaccgggcc

SEQ ID NO: 3635846 - RNA, 18 nt, Salmonella enterica enterica serovar Typhi
cacgccagauaaaucagc

SEQ ID NO: 3635847 - RNA, 19 nt, Salmonella enterica enterica serovar Typhi
cacgccagauaaaucagcc

SEQ ID NO: 3635848 - RNA, 19 nt, Salmonella enterica enterica serovar Typhi
cacgccagggagggccaac

SEQ ID NO: 3635849 - RNA, 20 nt, Salmonella enterica enterica serovar Typhi
cacgccagggagggccaacc

SEQ ID NO: 3635850 - RNA, 16 nt, Salmonella enterica enterica serovar Typhi
cacgccaucagggacg

SEQ ID NO: 3635851 - RNA, 16 nt, Salmonella enterica enterica serovar Typhi
cacgccaucauuggcu

SEQ ID NO: 3635852 - RNA, 16 nt, Salmonella enterica enterica serovar Typhi
cacgccaucgccugau

SEQ ID NO: 3635853 - RNA, 13 nt, Salmonella enterica enterica serovar Typhi
cacgccaucgcgg

SEQ ID NO: 3635854 - RNA, 14 nt, Salmonella enterica enterica serovar Typhi
cacgccaucggcua

SEQ ID NO: 3635855 - RNA, 17 nt, Salmonella enterica enterica serovar Typhi
cacgccauugccaggac

SEQ ID NO: 3635856 - RNA, 17 nt, Salmonella enterica enterica serovar Typhi
cacgcccauauccagcu

SEQ ID NO: 3635857 - RNA, 22 nt, Salmonella enterica enterica serovar Typhi
cacgccccccgguagccacacc

SEQ ID NO: 3635858 - RNA, 21 nt, Salmonella enterica enterica serovar Typhi
cacgcccugccauucccagcc

SEQ ID NO: 3635859 - RNA, 17 nt, Salmonella enterica enterica serovar Typhi
cacgccgacgaccggca

SEQ ID NO: 3635860 - RNA, 19 nt, Salmonella enterica enterica serovar Typhi
cacgccgacgcauccgcca

SEQ ID NO: 3635861 - RNA, 22 nt, Salmonella enterica enterica serovar Typhi
cacgccgacucacgcagcgcuc

SEQ ID NO: 3635862 - RNA, 18 nt, Salmonella enterica enterica serovar Typhi
cacgccgccauccggcaa

SEQ ID NO: 3635863 - RNA, 19 nt, Salmonella enterica enterica serovar Typhi
cacgccgccauccggcaac

SEQ ID NO: 3635864 - RNA, 23 nt, Salmonella enterica enterica serovar Typhi
cacgccgcccgccugagcgcgca

SEQ ID NO: 3635865 - RNA, 24 nt, Salmonella enterica enterica serovar Typhi
cacgccgcuaucgaccagcaccug

SEQ ID NO: 3635866 - RNA, 14 nt, Salmonella enterica enterica serovar Typhi
cacgccguccagca

SEQ ID NO: 3635867 - RNA, 20 nt, Salmonella enterica enterica serovar Typhi
cacgccguccagcaccaccu

SEQ ID NO: 3635868 - RNA, 15 nt, Salmonella enterica enterica serovar Typhi
cacgccgucgaugau

SEQ ID NO: 3635869 - RNA, 21 nt, Salmonella enterica enterica serovar Typhi
cacgccgugcacuucugcggu

SEQ ID NO: 3635870 - RNA, 15 nt, Salmonella enterica enterica serovar Typhi
cacgccguuugccau

SEQ ID NO: 3635871 - RNA, 13 nt, Salmonella enterica enterica serovar Typhi
cacgccuccauac

SEQ ID NO: 3635872 - RNA, 17 nt, Salmonella enterica enterica serovar Typhi
cacgccugcauaaagga

SEQ ID NO: 3635873 - RNA, 17 nt, Salmonella enterica enterica serovar Typhi
cacgccuuccuccagca

SEQ ID NO: 3635874 - RNA, 13 nt, Salmonella enterica enterica serovar Typhi
cacgcgacgccag

SEQ ID NO: 3635875 - RNA, 14 nt, Salmonella enterica enterica serovar Typhi
cacgcgccagccgu

SEQ ID NO: 3635876 - RNA, 21 nt, Salmonella enterica enterica serovar Typhi
cacgcgcgccugccgccagca

SEQ ID NO: 3635877 - RNA, 15 nt, Salmonella enterica enterica serovar Typhi
cacgcgcgcgcguca

SEQ ID NO: 3635878 - RNA, 20 nt, Salmonella enterica enterica serovar Typhi
cacgcgcgcugcgccuggaa

SEQ ID NO: 3635879 - RNA, 13 nt, Salmonella enterica enterica serovar Typhi
cacgcgcggcgcc

SEQ ID NO: 3635880 - RNA, 14 nt, Salmonella enterica enterica serovar Typhi
cacgcgcggcgcca

SEQ ID NO: 3635881 - RNA, 19 nt, Salmonella enterica enterica serovar Typhi
cacgcgcggcuacugccag

SEQ ID NO: 3635882 - RNA, 14 nt, Salmonella enterica enterica serovar Typhi
cacgcggcaucagg

SEQ ID NO: 3635883 - RNA, 16 nt, Salmonella enterica enterica serovar Typhi
cacgcggcaucaggca

SEQ ID NO: 3635884 - RNA, 17 nt, Salmonella enterica enterica serovar Typhi
cacgcguaaacuuccgc

SEQ ID NO: 3635885 - RNA, 18 nt, Salmonella enterica enterica serovar Typhi
cacgcuaaaaaaggcaga

SEQ ID NO: 3635886 - RNA, 13 nt, Salmonella enterica enterica serovar Typhi
cacgcuaaagcgc

SEQ ID NO: 3635887 - RNA, 20 nt, Salmonella enterica enterica serovar Typhi
cacgcuaugguacggcgugu

SEQ ID NO: 3635888 - RNA, 12 nt, Salmonella enterica enterica serovar Typhi
cacgcucauagc

SEQ ID NO: 3635889 - RNA, 18 nt, Salmonella enterica enterica serovar Typhi
cacgcucgaguucuucac

SEQ ID NO: 3635890 - RNA, 14 nt, Salmonella enterica enterica serovar Typhi
cacgcucgcggaag

SEQ ID NO: 3635891 - RNA, 19 nt, Salmonella enterica enterica serovar Typhi
cacgcugaccacgccgccg

SEQ ID NO: 3635892 - RNA, 17 nt, Salmonella enterica enterica serovar Typhi
cacgcugaccuuuuuca

SEQ ID NO: 3635893 - RNA, 13 nt, Salmonella enterica enterica serovar Typhi
cacgcuguuuauu

SEQ ID NO: 3635894 - RNA, 19 nt, Salmonella enterica enterica serovar Typhi
cacggaacaacggcacaca

SEQ ID NO: 3635895 - RNA, 15 nt, Salmonella enterica enterica serovar Typhi
cacggacagcgcgca

SEQ ID NO: 3635896 - RNA, 20 nt, Salmonella enterica enterica serovar Typhi
cacggagagacaguucagau

SEQ ID NO: 3635897 - RNA, 17 nt, Salmonella enterica enterica serovar Typhi
cacggaugaucuucaua

SEQ ID NO: 3635898 - RNA, 15 nt, Salmonella enterica enterica serovar Typhi
cacggauggccucug

SEQ ID NO: 3635899 - RNA, 14 nt, Salmonella enterica enterica serovar Typhi
cacggcaacgccgu

SEQ ID NO: 3635900 - RNA, 16 nt, Salmonella enterica enterica serovar Typhi
cacggcaguacacgca

SEQ ID NO: 3635901 - RNA, 17 nt, Salmonella enterica enterica serovar Typhi
cacggcauaagccucau

SEQ ID NO: 3635902 - RNA, 13 nt, Salmonella enterica enterica serovar Typhi
cacggcauucacg

SEQ ID NO: 3635903 - RNA, 14 nt, Salmonella enterica enterica serovar Typhi
cacggcauucacgu

SEQ ID NO: 3635904 - RNA, 23 nt, Salmonella enterica enterica serovar Typhi
cacggcauucacgucgcgcgccg

SEQ ID NO: 3635905 - RNA, 13 nt, Salmonella enterica enterica serovar Typhi
cacggcauucagu

SEQ ID NO: 3635906 - RNA, 13 nt, Salmonella enterica enterica serovar Typhi
cacggccaccaua

SEQ ID NO: 3635907 - RNA, 13 nt, Salmonella enterica enterica serovar Typhi
cacggcgauaaau

SEQ ID NO: 3635908 - RNA, 22 nt, Salmonella enterica enterica serovar Typhi
cacggcgcucaggaucgccgga

SEQ ID NO: 3635909 - RNA, 19 nt, Salmonella enterica enterica serovar Typhi
cacggcguacuccacuguc

SEQ ID NO: 3635910 - RNA, 21 nt, Salmonella enterica enterica serovar Typhi
cacggcucgccuuugcgcccg

SEQ ID NO: 3635911 - RNA, 18 nt, Salmonella enterica enterica serovar Typhi
cacggggcggacgaugaa

SEQ ID NO: 3635912 - RNA, 14 nt, Salmonella enterica enterica serovar Typhi
cacggggcggcaau

SEQ ID NO: 3635913 - RNA, 14 nt, Salmonella enterica enterica serovar Typhi
cacgguaaaccucu

SEQ ID NO: 3635914 - RNA, 17 nt, Salmonella enterica enterica serovar Typhi
cacggucaaucaucaga

SEQ ID NO: 3635915 - RNA, 17 nt, Salmonella enterica enterica serovar Typhi
cacgguguaccccgccu

SEQ ID NO: 3635916 - RNA, 18 nt, Salmonella enterica enterica serovar Typhi
cacggugugaucaccgcc

SEQ ID NO: 3635917 - RNA, 23 nt, Salmonella enterica enterica serovar Typhi
cacgguuaucuggcgcaaccggc

SEQ ID NO: 3635918 - RNA, 14 nt, Salmonella enterica enterica serovar Typhi
cacgguucacauuc

SEQ ID NO: 3635919 - RNA, 23 nt, Salmonella enterica enterica serovar Typhi
cacgguucacggccaaagcgcga

SEQ ID NO: 3635920 - RNA, 15 nt, Salmonella enterica enterica serovar Typhi
cacgguuggcccagc

SEQ ID NO: 3635921 - RNA, 17 nt, Salmonella enterica enterica serovar Typhi
cacgguuucugcgcgcu

SEQ ID NO: 3635922 - RNA, 17 nt, Salmonella enterica enterica serovar Typhi
cacguaacucggcagcg

SEQ ID NO: 3635923 - RNA, 15 nt, Salmonella enterica enterica serovar Typhi
cacguaguaaugcau

SEQ ID NO: 3635924 - RNA, 18 nt, Salmonella enterica enterica serovar Typhi
cacguauaaacgccgccg

SEQ ID NO: 3635925 - RNA, 20 nt, Salmonella enterica enterica serovar Typhi
cacguauucggcuuacccaa

SEQ ID NO: 3635926 - RNA, 19 nt, Salmonella enterica enterica serovar Typhi
cacgucagcgaccauugcg

SEQ ID NO: 3635927 - RNA, 17 nt, Salmonella enterica enterica serovar Typhi
cacgucauccggcaagc

SEQ ID NO: 3635928 - RNA, 21 nt, Salmonella enterica enterica serovar Typhi
cacgucauccggcaagcgcug

SEQ ID NO: 3635929 - RNA, 14 nt, Salmonella enterica enterica serovar Typhi
cacgucauccuccu

SEQ ID NO: 3635930 - RNA, 17 nt, Salmonella enterica enterica serovar Typhi
cacgucgucccaggcca

SEQ ID NO: 3635931 - RNA, 17 nt, Salmonella enterica enterica serovar Typhi
cacgucugaugcguggc

SEQ ID NO: 3635932 - RNA, 17 nt, Salmonella enterica enterica serovar Typhi
cacgugguacacaauca

SEQ ID NO: 3635933 - RNA, 18 nt, Salmonella enterica enterica serovar Typhi
cacguuacccgccagucg

SEQ ID NO: 3635934 - RNA, 22 nt, Salmonella enterica enterica serovar Typhi
cacguuaccgcgcaguucaaua

SEQ ID NO: 3635935 - RNA, 16 nt, Salmonella enterica enterica serovar Typhi
cacguuaccggcgguu

SEQ ID NO: 3635936 - RNA, 18 nt, Salmonella enterica enterica serovar Typhi
cacguuaucugaccuaca

SEQ ID NO: 3635937 - RNA, 23 nt, Salmonella enterica enterica serovar Typhi
cacguuccauuucagcgagugcg

SEQ ID NO: 3635938 - RNA, 16 nt, Salmonella enterica enterica serovar Typhi
cacguuuugcagcgcc

SEQ ID NO: 3635939 - RNA, 15 nt, Salmonella enterica enterica serovar Typhi
cacuaaaaacaggcu

SEQ ID NO: 3635940 - RNA, 20 nt, Salmonella enterica enterica serovar Typhi
cacuaacgauguaaaaccug

SEQ ID NO: 3635941 - RNA, 15 nt, Salmonella enterica enterica serovar Typhi
cacuaacugaccaua

SEQ ID NO: 3635942 - RNA, 18 nt, Salmonella enterica enterica serovar Typhi
cacuaagaccagcaucag

SEQ ID NO: 3635943 - RNA, 18 nt, Salmonella enterica enterica serovar Typhi
cacuaauccccauuuuuu

SEQ ID NO: 3635944 - RNA, 20 nt, Salmonella enterica enterica serovar Typhi
cacuacacagggucgucaaa

SEQ ID NO: 3635945 - RNA, 15 nt, Salmonella enterica enterica serovar Typhi
cacuaccgggcagca

SEQ ID NO: 3635946 - RNA, 22 nt, Salmonella enterica enterica serovar Typhi
cacuaccugauuggcuccccgc

SEQ ID NO: 3635947 - RNA, 18 nt, Salmonella enterica enterica serovar Typhi
cacuacuacaccacccgu

SEQ ID NO: 3635948 - RNA, 21 nt, Salmonella enterica enterica serovar Typhi
cacuauaaaaauaccggcauc

SEQ ID NO: 3635949 - RNA, 18 nt, Salmonella enterica enterica serovar Typhi
cacuauauguccuuuacu

SEQ ID NO: 3635950 - RNA, 19 nt, Salmonella enterica enterica serovar Typhi
cacucaaucauugucauua

SEQ ID NO: 3635951 - RNA, 22 nt, Salmonella enterica enterica serovar Typhi
cacucagaaaauuauuuuaaau

SEQ ID NO: 3635952 - RNA, 16 nt, Salmonella enterica enterica serovar Typhi
cacucaggcagauggu

SEQ ID NO: 3635953 - RNA, 12 nt, Salmonella enterica enterica serovar Typhi
cacucauccagc

SEQ ID NO: 3635954 - RNA, 14 nt, Salmonella enterica enterica serovar Typhi
cacuccaauauacu

SEQ ID NO: 3635955 - RNA, 12 nt, Salmonella enterica enterica serovar Typhi
cacuccagaccu

SEQ ID NO: 3635956 - RNA, 14 nt, Salmonella enterica enterica serovar Typhi
cacuccaucgccug

SEQ ID NO: 3635957 - RNA, 23 nt, Salmonella enterica enterica serovar Typhi
cacucccgauucaacguuucgcu

SEQ ID NO: 3635958 - RNA, 16 nt, Salmonella enterica enterica serovar Typhi
cacuccggcugcacca

SEQ ID NO: 3635959 - RNA, 14 nt, Salmonella enterica enterica serovar Typhi
cacucgcucauuug

SEQ ID NO: 3635960 - RNA, 21 nt, Salmonella enterica enterica serovar Typhi
cacucgcuuccuuuauugguu

SEQ ID NO: 3635961 - RNA, 19 nt, Salmonella enterica enterica serovar Typhi
cacucguaacgcauaucca

SEQ ID NO: 3635962 - RNA, 16 nt, Salmonella enterica enterica serovar Typhi
cacucuauucaugcau

SEQ ID NO: 3635963 - RNA, 16 nt, Salmonella enterica enterica serovar Typhi
cacucuucaaccggca

SEQ ID NO: 3635964 - RNA, 20 nt, Salmonella enterica enterica serovar Typhi
cacucuucgggaauggggaa

SEQ ID NO: 3635965 - RNA, 22 nt, Salmonella enterica enterica serovar Typhi
cacugaaaaauaauuacuaucu

SEQ ID NO: 3635966 - RNA, 23 nt, Salmonella enterica enterica serovar Typhi
cacugacauuuaaggcgcggccu

SEQ ID NO: 3635967 - RNA, 15 nt, Salmonella enterica enterica serovar Typhi
cacugacuauccaca

SEQ ID NO: 3635968 - RNA, 17 nt, Salmonella enterica enterica serovar Typhi
cacugagcgcgccauga

SEQ ID NO: 3635969 - RNA, 20 nt, Salmonella enterica enterica serovar Typhi
cacugauaguccaucaccuc

SEQ ID NO: 3635970 - RNA, 21 nt, Salmonella enterica enterica serovar Typhi
cacugauggaguuucaucagc

SEQ ID NO: 3635971 - RNA, 21 nt, Salmonella enterica enterica serovar Typhi
cacugauggcuggcgucgcca

SEQ ID NO: 3635972 - RNA, 18 nt, Salmonella enterica enterica serovar Typhi
cacugcaauuucugcugg

SEQ ID NO: 3635973 - RNA, 19 nt, Salmonella enterica enterica serovar Typhi
cacugcaauuucugcugga

SEQ ID NO: 3635974 - RNA, 21 nt, Salmonella enterica enterica serovar Typhi
cacugcaggcgggaagcuuca

SEQ ID NO: 3635975 - RNA, 21 nt, Salmonella enterica enterica serovar Typhi
cacugcauaaauaucugcauu

SEQ ID NO: 3635976 - RNA, 15 nt, Salmonella enterica enterica serovar Typhi
cacugcccgccgcca

SEQ ID NO: 3635977 - RNA, 18 nt, Salmonella enterica enterica serovar Typhi
cacugcccucaaguuaug

SEQ ID NO: 3635978 - RNA, 21 nt, Salmonella enterica enterica serovar Typhi
cacugcccucaaguuauguua

SEQ ID NO: 3635979 - RNA, 15 nt, Salmonella enterica enterica serovar Typhi
cacugccgccacgcc

SEQ ID NO: 3635980 - RNA, 22 nt, Salmonella enterica enterica serovar Typhi
cacugcgaacgcaucaaagcca

SEQ ID NO: 3635981 - RNA, 22 nt, Salmonella enterica enterica serovar Typhi
cacugcgagggauuuccuggca

SEQ ID NO: 3635982 - RNA, 19 nt, Salmonella enterica enterica serovar Typhi
cacugcgcuuauccggccu

SEQ ID NO: 3635983 - RNA, 18 nt, Salmonella enterica enterica serovar Typhi
cacugcguaaaaucgcag

SEQ ID NO: 3635984 - RNA, 13 nt, Salmonella enterica enterica serovar Typhi
cacugcugaaagc

SEQ ID NO: 3635985 - RNA, 23 nt, Salmonella enterica enterica serovar Typhi
cacugcugcugaaagaagacgaa

SEQ ID NO: 3635986 - RNA, 15 nt, Salmonella enterica enterica serovar Typhi
cacugcuguagcguc

SEQ ID NO: 3635987 - RNA, 22 nt, Salmonella enterica enterica serovar Typhi
cacugcuguagcgucucaucaa

SEQ ID NO: 3635988 - RNA, 16 nt, Salmonella enterica enterica serovar Typhi
cacugcuguguccagg

SEQ ID NO: 3635989 - RNA, 23 nt, Salmonella enterica enterica serovar Typhi
cacugcuguguccaggucaucac

SEQ ID NO: 3635990 - RNA, 16 nt, Salmonella enterica enterica serovar Typhi
cacuggaaacagccaa

SEQ ID NO: 3635991 - RNA, 17 nt, Salmonella enterica enterica serovar Typhi
cacuggaaacagccaau

SEQ ID NO: 3635992 - RNA, 21 nt, Salmonella enterica enterica serovar Typhi
cacuggaauaguuacggacau

SEQ ID NO: 3635993 - RNA, 20 nt, Salmonella enterica enterica serovar Typhi
cacuggaauucguuaccucg

SEQ ID NO: 3635994 - RNA, 21 nt, Salmonella enterica enterica serovar Typhi
cacuggagcgcauuuuacugc

SEQ ID NO: 3635995 - RNA, 21 nt, Salmonella enterica enterica serovar Typhi
cacuggcauuuugcggcgugg

SEQ ID NO: 3635996 - RNA, 16 nt, Salmonella enterica enterica serovar Typhi
cacuggcccccuguuc

SEQ ID NO: 3635997 - RNA, 19 nt, Salmonella enterica enterica serovar Typhi
cacuggccucccaguuccc

SEQ ID NO: 3635998 - RNA, 22 nt, Salmonella enterica enterica serovar Typhi
cacuggcguagucucccuccug

SEQ ID NO: 3635999 - RNA, 22 nt, Salmonella enterica enterica serovar Typhi
cacugucaaaaauaacaggcac

SEQ ID NO: 3636000 - RNA, 20 nt, Salmonella enterica enterica serovar Typhi
cacugucaugguuauuuugu

SEQ ID NO: 3636001 - RNA, 16 nt, Salmonella enterica enterica serovar Typhi
cacuguggugugccug

SEQ ID NO: 3636002 - RNA, 15 nt, Salmonella enterica enterica serovar Typhi
cacuguucagaaauc

SEQ ID NO: 3636003 - RNA, 14 nt, Salmonella enterica enterica serovar Typhi
cacuguugccgaca

SEQ ID NO: 3636004 - RNA, 21 nt, Salmonella enterica enterica serovar Typhi
cacuguuuaaugcuuucaaua

SEQ ID NO: 3636005 - RNA, 22 nt, Salmonella enterica enterica serovar Typhi
cacuguuugcugacaaucugcu

SEQ ID NO: 3636006 - RNA, 21 nt, Salmonella enterica enterica serovar Typhi
cacuguuuuuagccuguuauu

SEQ ID NO: 3636007 - RNA, 16 nt, Salmonella enterica enterica serovar Typhi
cacuuacuuucuugcc

SEQ ID NO: 3636008 - RNA, 17 nt, Salmonella enterica enterica serovar Typhi
cacuuagcacaaagaau

SEQ ID NO: 3636009 - RNA, 15 nt, Salmonella enterica enterica serovar Typhi
cacuuaucccugccc

SEQ ID NO: 3636010 - RNA, 16 nt, Salmonella enterica enterica serovar Typhi
cacuuaucccugcccc

SEQ ID NO: 3636011 - RNA, 19 nt, Salmonella enterica enterica serovar Typhi
cacuucaauguuagcauua

SEQ ID NO: 3636012 - RNA, 16 nt, Salmonella enterica enterica serovar Typhi
cacuucacaaacaauu

SEQ ID NO: 3636013 - RNA, 14 nt, Salmonella enterica enterica serovar Typhi
cacuucaucaucau

SEQ ID NO: 3636014 - RNA, 16 nt, Salmonella enterica enterica serovar Typhi
cacuucauccggauaa

SEQ ID NO: 3636015 - RNA, 15 nt, Salmonella enterica enterica serovar Typhi
cacuucauccggcgu

SEQ ID NO: 3636016 - RNA, 21 nt, Salmonella enterica enterica serovar Typhi
cacuucauccggcguugcgcc

SEQ ID NO: 3636017 - RNA, 21 nt, Salmonella enterica enterica serovar Typhi
cacuucaugccgaacagguua

SEQ ID NO: 3636018 - RNA, 15 nt, Salmonella enterica enterica serovar Typhi
cacuuccccugccag

SEQ ID NO: 3636019 - RNA, 17 nt, Salmonella enterica enterica serovar Typhi
cacuuccgccaccacgc

SEQ ID NO: 3636020 - RNA, 15 nt, Salmonella enterica enterica serovar Typhi
cacuuccggugucca

SEQ ID NO: 3636021 - RNA, 15 nt, Salmonella enterica enterica serovar Typhi
cacuucgaaacgauc

SEQ ID NO: 3636022 - RNA, 14 nt, Salmonella enterica enterica serovar Typhi
cacuucgauaaacg

SEQ ID NO: 3636023 - RNA, 22 nt, Salmonella enterica enterica serovar Typhi
cacuucgcgccauugaucauug

SEQ ID NO: 3636024 - RNA, 19 nt, Salmonella enterica enterica serovar Typhi
cacuucucgcgcaucagga

SEQ ID NO: 3636025 - RNA, 13 nt, Salmonella enterica enterica serovar Typhi
cacuucugacaga

SEQ ID NO: 3636026 - RNA, 22 nt, Salmonella enterica enterica serovar Typhi
cacuucugaguucggcaugggg

SEQ ID NO: 3636027 - RNA, 13 nt, Salmonella enterica enterica serovar Typhi
cacuucugcggua

SEQ ID NO: 3636028 - RNA, 23 nt, Salmonella enterica enterica serovar Typhi
cacuucuucgcgaucgugauaaa

SEQ ID NO: 3636029 - RNA, 22 nt, Salmonella enterica enterica serovar Typhi
cacuugagaaauuauuuuaaau

SEQ ID NO: 3636030 - RNA, 11 nt, Salmonella enterica enterica serovar Typhi
cacuuguucuu

SEQ ID NO: 3636031 - RNA, 22 nt, Salmonella enterica enterica serovar Typhi
cacuuuacugaauaacagcacc

SEQ ID NO: 3636032 - RNA, 19 nt, Salmonella enterica enterica serovar Typhi
cacuuuccagaccaagauc

SEQ ID NO: 3636033 - RNA, 18 nt, Salmonella enterica enterica serovar Typhi
cacuuuccgaaucaggcg

SEQ ID NO: 3636034 - RNA, 17 nt, Salmonella enterica enterica serovar Typhi
cacuuucgcccggcgcc

SEQ ID NO: 3636035 - RNA, 12 nt, Salmonella enterica enterica serovar Typhi
cacuuucucggc

SEQ ID NO: 3636036 - RNA, 17 nt, Salmonella enterica enterica serovar Typhi
cacuuuuaccggcgucc

SEQ ID NO: 3636037 - RNA, 20 nt, Salmonella enterica enterica serovar Typhi
cacuuuucccgccagcugcg

SEQ ID NO: 3636038 - RNA, 14 nt, Salmonella enterica enterica serovar Typhi
cacuuuuccggcac

SEQ ID NO: 3636039 - RNA, 21 nt, Salmonella enterica enterica serovar Typhi
cacuuuucuuuccugcaaauu

SEQ ID NO: 3636040 - RNA, 19 nt, Salmonella enterica enterica serovar Typhi
cacuuuuggcgacaggaac

SEQ ID NO: 3636041 - RNA, 19 nt, Salmonella enterica enterica serovar Typhi
cagaaaaaagccaagcaca

SEQ ID NO: 3636042 - RNA, 22 nt, Salmonella enterica enterica serovar Typhi
cagaaaaaagccaagcacaaaa

SEQ ID NO: 3636043 - RNA, 19 nt, Salmonella enterica enterica serovar Typhi
cagaaaaaaugcaccgccu

SEQ ID NO: 3636044 - RNA, 18 nt, Salmonella enterica enterica serovar Typhi
cagaaaaaccaaaaaaua

SEQ ID NO: 3636045 - RNA, 11 nt, Salmonella enterica enterica serovar Typhi
cagaaaaaccu

SEQ ID NO: 3636046 - RNA, 19 nt, Salmonella enterica enterica serovar Typhi
cagaaaaagggaaaagcca

SEQ ID NO: 3636047 - RNA, 15 nt, Salmonella enterica enterica serovar Typhi
cagaaaaccggcaaa

SEQ ID NO: 3636048 - RNA, 19 nt, Salmonella enterica enterica serovar Typhi
cagaaaauccuucagcguu

SEQ ID NO: 3636049 - RNA, 22 nt, Salmonella enterica enterica serovar Typhi
cagaaacaacgcgggccauaca

SEQ ID NO: 3636050 - RNA, 17 nt, Salmonella enterica enterica serovar Typhi
cagaaagcaacagcaag

SEQ ID NO: 3636051 - RNA, 13 nt, Salmonella enterica enterica serovar Typhi
cagaaaggaugcc

SEQ ID NO: 3636052 - RNA, 14 nt, Salmonella enterica enterica serovar Typhi
cagaaaggaugccc

SEQ ID NO: 3636053 - RNA, 14 nt, Salmonella enterica enterica serovar Typhi
cagaaauaaaauac

SEQ ID NO: 3636054 - RNA, 15 nt, Salmonella enterica enterica serovar Typhi
cagaaauaaaauacu

SEQ ID NO: 3636055 - RNA, 17 nt, Salmonella enterica enterica serovar Typhi
cagaaauauucaguacu

SEQ ID NO: 3636056 - RNA, 16 nt, Salmonella enterica enterica serovar Typhi
cagaaaucgccgggcu

SEQ ID NO: 3636057 - RNA, 15 nt, Salmonella enterica enterica serovar Typhi
cagaaaucggcagca

SEQ ID NO: 3636058 - RNA, 18 nt, Salmonella enterica enterica serovar Typhi
cagaaaucggcagcaccc

SEQ ID NO: 3636059 - RNA, 10 nt, Salmonella enterica enterica serovar Typhi
cagaaaugac

SEQ ID NO: 3636060 - RNA, 21 nt, Salmonella enterica enterica serovar Typhi
cagaaauugaauuauaauaaa

SEQ ID NO: 3636061 - RNA, 18 nt, Salmonella enterica enterica serovar Typhi
cagaacaaacuuauccca

SEQ ID NO: 3636062 - RNA, 14 nt, Salmonella enterica enterica serovar Typhi
cagaacaacgggaa

SEQ ID NO: 3636063 - RNA, 14 nt, Salmonella enterica enterica serovar Typhi
cagaaccacuugaa

SEQ ID NO: 3636064 - RNA, 15 nt, Salmonella enterica enterica serovar Typhi
cagaaccacuugaac

SEQ ID NO: 3636065 - RNA, 13 nt, Salmonella enterica enterica serovar Typhi
cagaaccauuucc

SEQ ID NO: 3636066 - RNA, 19 nt, Salmonella enterica enterica serovar Typhi
cagaaccuguucaugccag

SEQ ID NO: 3636067 - RNA, 13 nt, Salmonella enterica enterica serovar Typhi
cagaacgagagga

SEQ ID NO: 3636068 - RNA, 17 nt, Salmonella enterica enterica serovar Typhi
cagaacgcuuuugcgca

SEQ ID NO: 3636069 - RNA, 15 nt, Salmonella enterica enterica serovar Typhi
cagaacgggaaagcg

SEQ ID NO: 3636070 - RNA, 16 nt, Salmonella enterica enterica serovar Typhi
cagaacguagcccauu

SEQ ID NO: 3636071 - RNA, 14 nt, Salmonella enterica enterica serovar Typhi
cagaacucaucuuc

SEQ ID NO: 3636072 - RNA, 15 nt, Salmonella enterica enterica serovar Typhi
cagaagaaucugccu

SEQ ID NO: 3636073 - RNA, 16 nt, Salmonella enterica enterica serovar Typhi
cagaagaaucugccuu

SEQ ID NO: 3636074 - RNA, 12 nt, Salmonella enterica enterica serovar Typhi
cagaagagaaug

SEQ ID NO: 3636075 - RNA, 16 nt, Salmonella enterica enterica serovar Typhi
cagaagcaaauucagg

SEQ ID NO: 3636076 - RNA, 14 nt, Salmonella enterica enterica serovar Typhi
cagaagcuaaggga

SEQ ID NO: 3636077 - RNA, 11 nt, Salmonella enterica enterica serovar Typhi
cagaagcuucg

SEQ ID NO: 3636078 - RNA, 15 nt, Salmonella enterica enterica serovar Typhi
cagaaggcaugggga

SEQ ID NO: 3636079 - RNA, 19 nt, Salmonella enterica enterica serovar Typhi
cagaaggccagugguaaaa

SEQ ID NO: 3636080 - RNA, 19 nt, Salmonella enterica enterica serovar Typhi
cagaaggcgaacauaagag

SEQ ID NO: 3636081 - RNA, 15 nt, Salmonella enterica enterica serovar Typhi
cagaaggcuaacagc

SEQ ID NO: 3636082 - RNA, 23 nt, Salmonella enterica enterica serovar Typhi
cagaaggugaguuucgcaucagg

SEQ ID NO: 3636083 - RNA, 18 nt, Salmonella enterica enterica serovar Typhi
cagaagguuauucgccuu

SEQ ID NO: 3636084 - RNA, 20 nt, Salmonella enterica enterica serovar Typhi
cagaauaaacggcagggcag

SEQ ID NO: 3636085 - RNA, 13 nt, Salmonella enterica enterica serovar Typhi
cagaauaauguug

SEQ ID NO: 3636086 - RNA, 16 nt, Salmonella enterica enterica serovar Typhi
cagaauacacuucuca

SEQ ID NO: 3636087 - RNA, 13 nt, Salmonella enterica enterica serovar Typhi
cagaauaccagaa

SEQ ID NO: 3636088 - RNA, 12 nt, Salmonella enterica enterica serovar Typhi
cagaauacggcc

SEQ ID NO: 3636089 - RNA, 18 nt, Salmonella enterica enterica serovar Typhi
cagaauauccgguacacc

SEQ ID NO: 3636090 - RNA, 15 nt, Salmonella enterica enterica serovar Typhi
cagaauaucuuuuac

SEQ ID NO: 3636091 - RNA, 17 nt, Salmonella enterica enterica serovar Typhi
cagaauauuuuucucag

SEQ ID NO: 3636092 - RNA, 13 nt, Salmonella enterica enterica serovar Typhi
cagaaucacccca

SEQ ID NO: 3636093 - RNA, 19 nt, Salmonella enterica enterica serovar Typhi
cagaaucagcgugccggua

SEQ ID NO: 3636094 - RNA, 13 nt, Salmonella enterica enterica serovar Typhi
cagaaucaggcca

SEQ ID NO: 3636095 - RNA, 22 nt, Salmonella enterica enterica serovar Typhi
cagaaucaguaacacaaucagg

SEQ ID NO: 3636096 - RNA, 14 nt, Salmonella enterica enterica serovar Typhi
cagaaucagugacc

SEQ ID NO: 3636097 - RNA, 15 nt, Salmonella enterica enterica serovar Typhi
cagaaucgccagcau

SEQ ID NO: 3636098 - RNA, 23 nt, Salmonella enterica enterica serovar Typhi
cagaaugauaaugccgcugauaa

SEQ ID NO: 3636099 - RNA, 24 nt, Salmonella enterica enterica serovar Typhi
cagaaugauaaugccgcugauaau

SEQ ID NO: 3636100 - RNA, 15 nt, Salmonella enterica enterica serovar Typhi
cagaaugcccagcaa

SEQ ID NO: 3636101 - RNA, 16 nt, Salmonella enterica enterica serovar Typhi
cagaaugcccugcugu

SEQ ID NO: 3636102 - RNA, 20 nt, Salmonella enterica enterica serovar Typhi
cagaaugcccugcuguucca

SEQ ID NO: 3636103 - RNA, 17 nt, Salmonella enterica enterica serovar Typhi
cagaauggcgauuaacg

SEQ ID NO: 3636104 - RNA, 21 nt, Salmonella enterica enterica serovar Typhi
cagaauucguacguuuuucca

SEQ ID NO: 3636105 - RNA, 16 nt, Salmonella enterica enterica serovar Typhi
cagaauugcgccaccu

SEQ ID NO: 3636106 - RNA, 15 nt, Salmonella enterica enterica serovar Typhi
cagaauuuauuucug

SEQ ID NO: 3636107 - RNA, 16 nt, Salmonella enterica enterica serovar Typhi
cagaauuuauuucugc

SEQ ID NO: 3636108 - RNA, 21 nt, Salmonella enterica enterica serovar Typhi
cagaauuucgcccuguauaca

SEQ ID NO: 3636109 - RNA, 18 nt, Salmonella enterica enterica serovar Typhi
cagacaaagggcacaccg

SEQ ID NO: 3636110 - RNA, 16 nt, Salmonella enterica enterica serovar Typhi
cagacaacgccgccug

SEQ ID NO: 3636111 - RNA, 16 nt, Salmonella enterica enterica serovar Typhi
cagacaagcacauaac

SEQ ID NO: 3636112 - RNA, 20 nt, Salmonella enterica enterica serovar Typhi
cagacaagcacauaacugag

SEQ ID NO: 3636113 - RNA, 18 nt, Salmonella enterica enterica serovar Typhi
cagacaauaaacgguccg

SEQ ID NO: 3636114 - RNA, 20 nt, Salmonella enterica enterica serovar Typhi
cagacaauaccagggcgauu

SEQ ID NO: 3636115 - RNA, 14 nt, Salmonella enterica enterica serovar Typhi
cagacaauccgcgg

SEQ ID NO: 3636116 - RNA, 20 nt, Salmonella enterica enterica serovar Typhi
cagacaauuagcgacgcaua

SEQ ID NO: 3636117 - RNA, 21 nt, Salmonella enterica enterica serovar Typhi
cagacacggugugccgccauc

SEQ ID NO: 3636118 - RNA, 18 nt, Salmonella enterica enterica serovar Typhi
cagacacugccaccgcuc

SEQ ID NO: 3636119 - RNA, 18 nt, Salmonella enterica enterica serovar Typhi
cagacagacguugcgcca

SEQ ID NO: 3636120 - RNA, 17 nt, Salmonella enterica enterica serovar Typhi
cagacagccauauuuau

SEQ ID NO: 3636121 - RNA, 19 nt, Salmonella enterica enterica serovar Typhi
cagacagccauauuuaugc

SEQ ID NO: 3636122 - RNA, 23 nt, Salmonella enterica enterica serovar Typhi
cagacagccauauuuaugcagcg

SEQ ID NO: 3636123 - RNA, 12 nt, Salmonella enterica enterica serovar Typhi
cagacagccgac

SEQ ID NO: 3636124 - RNA, 20 nt, Salmonella enterica enterica serovar Typhi
cagacagccgacggcaaaaa

SEQ ID NO: 3636125 - RNA, 14 nt, Salmonella enterica enterica serovar Typhi
cagacaggacgcca

SEQ ID NO: 3636126 - RNA, 15 nt, Salmonella enterica enterica serovar Typhi
cagacaggacgccag

SEQ ID NO: 3636127 - RNA, 23 nt, Salmonella enterica enterica serovar Typhi
cagacaggccugguuaacaauau

SEQ ID NO: 3636128 - RNA, 22 nt, Salmonella enterica enterica serovar Typhi
cagacaguggccaucuuccagc

SEQ ID NO: 3636129 - RNA, 14 nt, Salmonella enterica enterica serovar Typhi
cagacaucaucgaa

SEQ ID NO: 3636130 - RNA, 18 nt, Salmonella enterica enterica serovar Typhi
cagacaugaccgcacagc

SEQ ID NO: 3636131 - RNA, 20 nt, Salmonella enterica enterica serovar Typhi
cagacaugaccgcacagcag

SEQ ID NO: 3636132 - RNA, 15 nt, Salmonella enterica enterica serovar Typhi
cagacaugcacaugg

SEQ ID NO: 3636133 - RNA, 15 nt, Salmonella enterica enterica serovar Typhi
cagacaugcgccgga

SEQ ID NO: 3636134 - RNA, 22 nt, Salmonella enterica enterica serovar Typhi
cagaccaauagagagcgacagc

SEQ ID NO: 3636135 - RNA, 16 nt, Salmonella enterica enterica serovar Typhi
cagaccaccagcgaca

SEQ ID NO: 3636136 - RNA, 16 nt, Salmonella enterica enterica serovar Typhi
cagaccagucggacag

SEQ ID NO: 3636137 - RNA, 23 nt, Salmonella enterica enterica serovar Typhi
cagaccaguugccccugcgucac

SEQ ID NO: 3636138 - RNA, 17 nt, Salmonella enterica enterica serovar Typhi
cagaccauucaaccagc

SEQ ID NO: 3636139 - RNA, 18 nt, Salmonella enterica enterica serovar Typhi
cagaccauucaaccagcc

SEQ ID NO: 3636140 - RNA, 16 nt, Salmonella enterica enterica serovar Typhi
cagacccacagccggu

SEQ ID NO: 3636141 - RNA, 23 nt, Salmonella enterica enterica serovar Typhi
cagacccaguacaaacaaauaaa

SEQ ID NO: 3636142 - RNA, 22 nt, Salmonella enterica enterica serovar Typhi
cagaccccaguaauccggcaac

SEQ ID NO: 3636143 - RNA, 18 nt, Salmonella enterica enterica serovar Typhi
cagacccgauagcgccgc

SEQ ID NO: 3636144 - RNA, 15 nt, Salmonella enterica enterica serovar Typhi
cagacccgcaaacca

SEQ ID NO: 3636145 - RNA, 21 nt, Salmonella enterica enterica serovar Typhi
cagacccgcauacaggaagcc

SEQ ID NO: 3636146 - RNA, 15 nt, Salmonella enterica enterica serovar Typhi
cagaccgacaaaacu

SEQ ID NO: 3636147 - RNA, 17 nt, Salmonella enterica enterica serovar Typhi
cagaccgacaagccccc

SEQ ID NO: 3636148 - RNA, 18 nt, Salmonella enterica enterica serovar Typhi
cagaccgacgccaaccgc

SEQ ID NO: 3636149 - RNA, 14 nt, Salmonella enterica enterica serovar Typhi
cagaccgaucucau

SEQ ID NO: 3636150 - RNA, 17 nt, Salmonella enterica enterica serovar Typhi
cagaccgaucucaugca

SEQ ID NO: 3636151 - RNA, 20 nt, Salmonella enterica enterica serovar Typhi
cagaccgaucucaugcaacu

SEQ ID NO: 3636152 - RNA, 22 nt, Salmonella enterica enterica serovar Typhi
cagaccgaucucaugcaacugg

SEQ ID NO: 3636153 - RNA, 23 nt, Salmonella enterica enterica serovar Typhi
cagaccgccaagcgcggacagca

SEQ ID NO: 3636154 - RNA, 13 nt, Salmonella enterica enterica serovar Typhi
cagaccgccaugc

SEQ ID NO: 3636155 - RNA, 21 nt, Salmonella enterica enterica serovar Typhi
cagaccgcugcggaacaccag

SEQ ID NO: 3636156 - RNA, 14 nt, Salmonella enterica enterica serovar Typhi
cagaccggauugcc

SEQ ID NO: 3636157 - RNA, 15 nt, Salmonella enterica enterica serovar Typhi
cagaccggcaaucaa

SEQ ID NO: 3636158 - RNA, 15 nt, Salmonella enterica enterica serovar Typhi
cagaccggcagccug

SEQ ID NO: 3636159 - RNA, 17 nt, Salmonella enterica enterica serovar Typhi
cagaccggcaucucauc

SEQ ID NO: 3636160 - RNA, 21 nt, Salmonella enterica enterica serovar Typhi
cagaccggcaucucaucuugc

SEQ ID NO: 3636161 - RNA, 21 nt, Salmonella enterica enterica serovar Typhi
cagaccgggcgaaguuugccg

SEQ ID NO: 3636162 - RNA, 21 nt, Salmonella enterica enterica serovar Typhi
cagaccucguucggcgcaccu

SEQ ID NO: 3636163 - RNA, 13 nt, Salmonella enterica enterica serovar Typhi
cagaccucugcaa

SEQ ID NO: 3636164 - RNA, 14 nt, Salmonella enterica enterica serovar Typhi
cagaccucugcaaa

SEQ ID NO: 3636165 - RNA, 18 nt, Salmonella enterica enterica serovar Typhi
cagaccucugcaaacacc

SEQ ID NO: 3636166 - RNA, 23 nt, Salmonella enterica enterica serovar Typhi
cagaccugaauauucggcuccag

SEQ ID NO: 3636167 - RNA, 15 nt, Salmonella enterica enterica serovar Typhi
cagaccuguaaaaaa

SEQ ID NO: 3636168 - RNA, 16 nt, Salmonella enterica enterica serovar Typhi
cagaccuguaaaaaaa

SEQ ID NO: 3636169 - RNA, 19 nt, Salmonella enterica enterica serovar Typhi
cagaccuuaucgcagucag

SEQ ID NO: 3636170 - RNA, 21 nt, Salmonella enterica enterica serovar Typhi
cagaccuucaacccagcagca

SEQ ID NO: 3636171 - RNA, 18 nt, Salmonella enterica enterica serovar Typhi
cagaccuuuauaagguua

SEQ ID NO: 3636172 - RNA, 20 nt, Salmonella enterica enterica serovar Typhi
cagacgaaaaaaaagacgcu

SEQ ID NO: 3636173 - RNA, 19 nt, Salmonella enterica enterica serovar Typhi
cagacgaccguaauagcaa

SEQ ID NO: 3636174 - RNA, 16 nt, Salmonella enterica enterica serovar Typhi
cagacgcgcagcaccg

SEQ ID NO: 3636175 - RNA, 21 nt, Salmonella enterica enterica serovar Typhi
cagacgcguauggcgguuggg

SEQ ID NO: 3636176 - RNA, 13 nt, Salmonella enterica enterica serovar Typhi
cagacgcuccgca

SEQ ID NO: 3636177 - RNA, 22 nt, Salmonella enterica enterica serovar Typhi
cagacgcuucauugguuaauuc

SEQ ID NO: 3636178 - RNA, 18 nt, Salmonella enterica enterica serovar Typhi
cagacggcaagcaaccgu

SEQ ID NO: 3636179 - RNA, 23 nt, Salmonella enterica enterica serovar Typhi
cagacggcgcuaauguacgccua

SEQ ID NO: 3636180 - RNA, 13 nt, Salmonella enterica enterica serovar Typhi
cagacggcugggc

SEQ ID NO: 3636181 - RNA, 13 nt, Salmonella enterica enterica serovar Typhi
cagacguagcgcc

SEQ ID NO: 3636182 - RNA, 18 nt, Salmonella enterica enterica serovar Typhi
cagacgugcaauaucgcg

SEQ ID NO: 3636183 - RNA, 15 nt, Salmonella enterica enterica serovar Typhi
cagacguuuaagcau

SEQ ID NO: 3636184 - RNA, 21 nt, Salmonella enterica enterica serovar Typhi
cagacuaaccguucaucuauc

SEQ ID NO: 3636185 - RNA, 22 nt, Salmonella enterica enterica serovar Typhi
cagacuauccguccucuuuccc

SEQ ID NO: 3636186 - RNA, 14 nt, Salmonella enterica enterica serovar Typhi
cagacucagccagg

SEQ ID NO: 3636187 - RNA, 15 nt, Salmonella enterica enterica serovar Typhi
cagacucagccaggu

SEQ ID NO: 3636188 - RNA, 19 nt, Salmonella enterica enterica serovar Typhi
cagacucgcuucacgcgga

SEQ ID NO: 3636189 - RNA, 14 nt, Salmonella enterica enterica serovar Typhi
cagacucugcgcgu

SEQ ID NO: 3636190 - RNA, 19 nt, Salmonella enterica enterica serovar Typhi
cagacugaauaaaggguuu

SEQ ID NO: 3636191 - RNA, 15 nt, Salmonella enterica enterica serovar Typhi
cagacugcgccacgu

SEQ ID NO: 3636192 - RNA, 19 nt, Salmonella enterica enterica serovar Typhi
cagacuguaaaucugccgu

SEQ ID NO: 3636193 - RNA, 18 nt, Salmonella enterica enterica serovar Typhi
cagacuucaacgccgcac

SEQ ID NO: 3636194 - RNA, 16 nt, Salmonella enterica enterica serovar Typhi
cagacuucauuuucca

SEQ ID NO: 3636195 - RNA, 12 nt, Salmonella enterica enterica serovar Typhi
cagacuuuccag

SEQ ID NO: 3636196 - RNA, 18 nt, Salmonella enterica enterica serovar Typhi
cagacuuuggauaaagcc

SEQ ID NO: 3636197 - RNA, 15 nt, Salmonella enterica enterica serovar Typhi
cagagauaauuuucc

SEQ ID NO: 3636198 - RNA, 22 nt, Salmonella enterica enterica serovar Typhi
cagagauucgccguucuguucu

SEQ ID NO: 3636199 - RNA, 21 nt, Salmonella enterica enterica serovar Typhi
cagagcagucguugcgccugu

SEQ ID NO: 3636200 - RNA, 18 nt, Salmonella enterica enterica serovar Typhi
cagagcaucaauggugaa

SEQ ID NO: 3636201 - RNA, 18 nt, Salmonella enterica enterica serovar Typhi
cagagcgacaaugaacca

SEQ ID NO: 3636202 - RNA, 21 nt, Salmonella enterica enterica serovar Typhi
cagagcgacauggcccauuuc

SEQ ID NO: 3636203 - RNA, 20 nt, Salmonella enterica enterica serovar Typhi
cagagcgccggcaaagccau

SEQ ID NO: 3636204 - RNA, 17 nt, Salmonella enterica enterica serovar Typhi
cagagcgcgcuggcaag

SEQ ID NO: 3636205 - RNA, 20 nt, Salmonella enterica enterica serovar Typhi
cagagcgcgcuggcaagcgc

SEQ ID NO: 3636206 - RNA, 22 nt, Salmonella enterica enterica serovar Typhi
cagagcgcgcuggcaagcgcca

SEQ ID NO: 3636207 - RNA, 15 nt, Salmonella enterica enterica serovar Typhi
cagagcggauaaaua

SEQ ID NO: 3636208 - RNA, 17 nt, Salmonella enterica enterica serovar Typhi
cagagcggggaaacucu

SEQ ID NO: 3636209 - RNA, 22 nt, Salmonella enterica enterica serovar Typhi
cagagcggggaaacucuuuucc

SEQ ID NO: 3636210 - RNA, 17 nt, Salmonella enterica enterica serovar Typhi
cagagcguccacgccau

SEQ ID NO: 3636211 - RNA, 20 nt, Salmonella enterica enterica serovar Typhi
cagagcucgucaaaaaucac

SEQ ID NO: 3636212 - RNA, 15 nt, Salmonella enterica enterica serovar Typhi
cagaggaaugaaaac

SEQ ID NO: 3636213 - RNA, 16 nt, Salmonella enterica enterica serovar Typhi
cagaggccugaaugca

SEQ ID NO: 3636214 - RNA, 18 nt, Salmonella enterica enterica serovar Typhi
cagagguaagauguucua

SEQ ID NO: 3636215 - RNA, 19 nt, Salmonella enterica enterica serovar Typhi
cagaggucucagguucgaa

SEQ ID NO: 3636216 - RNA, 17 nt, Salmonella enterica enterica serovar Typhi
cagaggugaaccauuga

SEQ ID NO: 3636217 - RNA, 21 nt, Salmonella enterica enterica serovar Typhi
cagaguaacccgauacccuga

SEQ ID NO: 3636218 - RNA, 14 nt, Salmonella enterica enterica serovar Typhi
cagaguacgucgcc

SEQ ID NO: 3636219 - RNA, 16 nt, Salmonella enterica enterica serovar Typhi
cagaguaugcugcuaa

SEQ ID NO: 3636220 - RNA, 13 nt, Salmonella enterica enterica serovar Typhi
cagaguccagcgg

SEQ ID NO: 3636221 - RNA, 18 nt, Salmonella enterica enterica serovar Typhi
cagagucgaaagaaacgc

SEQ ID NO: 3636222 - RNA, 16 nt, Salmonella enterica enterica serovar Typhi
cagagugcucaauaag

SEQ ID NO: 3636223 - RNA, 17 nt, Salmonella enterica enterica serovar Typhi
cagauaaagcagcgaca

SEQ ID NO: 3636224 - RNA, 20 nt, Salmonella enterica enterica serovar Typhi
cagauaaaucagcccgauac

SEQ ID NO: 3636225 - RNA, 15 nt, Salmonella enterica enterica serovar Typhi
cagauaacaccagcg

SEQ ID NO: 3636226 - RNA, 18 nt, Salmonella enterica enterica serovar Typhi
cagauaacaccagcgauc

SEQ ID NO: 3636227 - RNA, 18 nt, Salmonella enterica enterica serovar Typhi
cagauaacaggcaguuuc

SEQ ID NO: 3636228 - RNA, 23 nt, Salmonella enterica enterica serovar Typhi
cagauaaccgucggcgccggcgu

SEQ ID NO: 3636229 - RNA, 22 nt, Salmonella enterica enterica serovar Typhi
cagauaacgaaccaucauuaau

SEQ ID NO: 3636230 - RNA, 21 nt, Salmonella enterica enterica serovar Typhi
cagauaacugagcuugagcca

SEQ ID NO: 3636231 - RNA, 13 nt, Salmonella enterica enterica serovar Typhi
cagauaacuuccu

SEQ ID NO: 3636232 - RNA, 20 nt, Salmonella enterica enterica serovar Typhi
cagauaagcgacucuguauu

SEQ ID NO: 3636233 - RNA, 14 nt, Salmonella enterica enterica serovar Typhi
cagauaagcgucug

SEQ ID NO: 3636234 - RNA, 23 nt, Salmonella enterica enterica serovar Typhi
cagauaaguuugcagaucggccu

SEQ ID NO: 3636235 - RNA, 18 nt, Salmonella enterica enterica serovar Typhi
cagauaauagcugcggcu

SEQ ID NO: 3636236 - RNA, 14 nt, Salmonella enterica enterica serovar Typhi
cagauaauccagcg

SEQ ID NO: 3636237 - RNA, 17 nt, Salmonella enterica enterica serovar Typhi
cagauaauuaauaaugg

SEQ ID NO: 3636238 - RNA, 16 nt, Salmonella enterica enterica serovar Typhi
cagauacggcgcgucg

SEQ ID NO: 3636239 - RNA, 17 nt, Salmonella enterica enterica serovar Typhi
cagauacggcgcgucgg

SEQ ID NO: 3636240 - RNA, 17 nt, Salmonella enterica enterica serovar Typhi
cagauacggcuccagca

SEQ ID NO: 3636241 - RNA, 13 nt, Salmonella enterica enterica serovar Typhi
cagauagcgcugc

SEQ ID NO: 3636242 - RNA, 17 nt, Salmonella enterica enterica serovar Typhi
cagauagcgcugcgcca

SEQ ID NO: 3636243 - RNA, 19 nt, Salmonella enterica enterica serovar Typhi
cagauagcgcugcgccaga

SEQ ID NO: 3636244 - RNA, 15 nt, Salmonella enterica enterica serovar Typhi
cagauagcguaaccg

SEQ ID NO: 3636245 - RNA, 17 nt, Salmonella enterica enterica serovar Typhi
cagauagcguaaccggu

SEQ ID NO: 3636246 - RNA, 15 nt, Salmonella enterica enterica serovar Typhi
cagauagcuuccaug

SEQ ID NO: 3636247 - RNA, 24 nt, Salmonella enterica enterica serovar Typhi
cagauaggcggcaaauaaagccag

SEQ ID NO: 3636248 - RNA, 12 nt, Salmonella enterica enterica serovar Typhi
cagauagucauc

SEQ ID NO: 3636249 - RNA, 19 nt, Salmonella enterica enterica serovar Typhi
cagauaguggcugaggccg

SEQ ID NO: 3636250 - RNA, 21 nt, Salmonella enterica enterica serovar Typhi
cagauaguuagcuaucgcgcc

SEQ ID NO: 3636251 - RNA, 13 nt, Salmonella enterica enterica serovar Typhi
cagauaucgcgua

SEQ ID NO: 3636252 - RNA, 15 nt, Salmonella enterica enterica serovar Typhi
cagauaugcgggcuc

SEQ ID NO: 3636253 - RNA, 16 nt, Salmonella enterica enterica serovar Typhi
cagauauuccagcgac

SEQ ID NO: 3636254 - RNA, 21 nt, Salmonella enterica enterica serovar Typhi
cagauauugcggaucagcaaa

SEQ ID NO: 3636255 - RNA, 23 nt, Salmonella enterica enterica serovar Typhi
cagauauuuucggcauacucuuu

SEQ ID NO: 3636256 - RNA, 18 nt, Salmonella enterica enterica serovar Typhi
cagaucagcacgcgccgu

SEQ ID NO: 3636257 - RNA, 16 nt, Salmonella enterica enterica serovar Typhi
cagaucaggucugaga

SEQ ID NO: 3636258 - RNA, 17 nt, Salmonella enterica enterica serovar Typhi
cagaucaggucugagau

SEQ ID NO: 3636259 - RNA, 14 nt, Salmonella enterica enterica serovar Typhi
cagauccaaauggc

SEQ ID NO: 3636260 - RNA, 16 nt, Salmonella enterica enterica serovar Typhi
cagauccaucgccugc

SEQ ID NO: 3636261 - RNA, 14 nt, Salmonella enterica enterica serovar Typhi
cagauccuuuuucu

SEQ ID NO: 3636262 - RNA, 20 nt, Salmonella enterica enterica serovar Typhi
cagaucgccaaagucauugc

SEQ ID NO: 3636263 - RNA, 19 nt, Salmonella enterica enterica serovar Typhi
cagaucggcagacaguuuc

SEQ ID NO: 3636264 - RNA, 15 nt, Salmonella enterica enterica serovar Typhi
cagaucggcaucuuu

SEQ ID NO: 3636265 - RNA, 23 nt, Salmonella enterica enterica serovar Typhi
cagaucguagccauguuccucac

SEQ ID NO: 3636266 - RNA, 18 nt, Salmonella enterica enterica serovar Typhi
cagaucguaugcgccugu

SEQ ID NO: 3636267 - RNA, 20 nt, Salmonella enterica enterica serovar Typhi
cagaucguaugcgccuguua

SEQ ID NO: 3636268 - RNA, 14 nt, Salmonella enterica enterica serovar Typhi
cagaucuaucugaa

SEQ ID NO: 3636269 - RNA, 16 nt, Salmonella enterica enterica serovar Typhi
cagaucugucgccaug

SEQ ID NO: 3636270 - RNA, 14 nt, Salmonella enterica enterica serovar Typhi
cagaucuucaaucg

SEQ ID NO: 3636271 - RNA, 18 nt, Salmonella enterica enterica serovar Typhi
cagaucuugugaguaaua

SEQ ID NO: 3636272 - RNA, 17 nt, Salmonella enterica enterica serovar Typhi
cagaucuuuauccugca

SEQ ID NO: 3636273 - RNA, 17 nt, Salmonella enterica enterica serovar Typhi
cagaugaagcgcaucgg

SEQ ID NO: 3636274 - RNA, 19 nt, Salmonella enterica enterica serovar Typhi
cagaugcagguucccgccc

SEQ ID NO: 3636275 - RNA, 21 nt, Salmonella enterica enterica serovar Typhi
cagaugcagguucccgcccug

SEQ ID NO: 3636276 - RNA, 21 nt, Salmonella enterica enterica serovar Typhi
cagaugcgccagauucaugau

SEQ ID NO: 3636277 - RNA, 15 nt, Salmonella enterica enterica serovar Typhi
cagaugcgcuucaag

SEQ ID NO: 3636278 - RNA, 16 nt, Salmonella enterica enterica serovar Typhi
cagaugcguuuucugc

SEQ ID NO: 3636279 - RNA, 21 nt, Salmonella enterica enterica serovar Typhi
cagaugcugucuuagugaaag

SEQ ID NO: 3636280 - RNA, 17 nt, Salmonella enterica enterica serovar Typhi
cagaugcuuaaacugcg

SEQ ID NO: 3636281 - RNA, 20 nt, Salmonella enterica enterica serovar Typhi
cagaugcuuaaugcucugcu

SEQ ID NO: 3636282 - RNA, 23 nt, Salmonella enterica enterica serovar Typhi
cagaugcuuaaugcucugcugug

SEQ ID NO: 3636283 - RNA, 18 nt, Salmonella enterica enterica serovar Typhi
cagauggauaaccugccg

SEQ ID NO: 3636284 - RNA, 22 nt, Salmonella enterica enterica serovar Typhi
cagauggcgauucauaugcgcc

SEQ ID NO: 3636285 - RNA, 18 nt, Salmonella enterica enterica serovar Typhi
cagaugggccauuuacgc

SEQ ID NO: 3636286 - RNA, 22 nt, Salmonella enterica enterica serovar Typhi
cagaugguauaaaucacgcuga

SEQ ID NO: 3636287 - RNA, 19 nt, Salmonella enterica enterica serovar Typhi
cagauggugauagcgcgcc

SEQ ID NO: 3636288 - RNA, 20 nt, Salmonella enterica enterica serovar Typhi
cagauggugauagcgcgcca

SEQ ID NO: 3636289 - RNA, 18 nt, Salmonella enterica enterica serovar Typhi
cagauguccaccgauuuc

SEQ ID NO: 3636290 - RNA, 19 nt, Salmonella enterica enterica serovar Typhi
cagauguggcggcccgugg

SEQ ID NO: 3636291 - RNA, 15 nt, Salmonella enterica enterica serovar Typhi
cagauguuauaaacu

SEQ ID NO: 3636292 - RNA, 17 nt, Salmonella enterica enterica serovar Typhi
cagauguuauaaacuuc

SEQ ID NO: 3636293 - RNA, 14 nt, Salmonella enterica enterica serovar Typhi
cagauguugauaca

SEQ ID NO: 3636294 - RNA, 15 nt, Salmonella enterica enterica serovar Typhi
cagauguugauacag

SEQ ID NO: 3636295 - RNA, 17 nt, Salmonella enterica enterica serovar Typhi
cagauguuuacgcugcu

SEQ ID NO: 3636296 - RNA, 18 nt, Salmonella enterica enterica serovar Typhi
cagauuacgcauggucaa

SEQ ID NO: 3636297 - RNA, 14 nt, Salmonella enterica enterica serovar Typhi
cagauuacuaugag

SEQ ID NO: 3636298 - RNA, 21 nt, Salmonella enterica enterica serovar Typhi
cagauuaucggccagcgccag

SEQ ID NO: 3636299 - RNA, 17 nt, Salmonella enterica enterica serovar Typhi
cagauuaugcaguucuu

SEQ ID NO: 3636300 - RNA, 18 nt, Salmonella enterica enterica serovar Typhi
cagauucuuaguccucag

SEQ ID NO: 3636301 - RNA, 13 nt, Salmonella enterica enterica serovar Typhi
cagauucuucugc

SEQ ID NO: 3636302 - RNA, 22 nt, Salmonella enterica enterica serovar Typhi
cagauuggugaugcgcaacguu

SEQ ID NO: 3636303 - RNA, 18 nt, Salmonella enterica enterica serovar Typhi
cagauuucgcagcagcau

SEQ ID NO: 3636304 - RNA, 14 nt, Salmonella enterica enterica serovar Typhi
cagauuugaacguc

SEQ ID NO: 3636305 - RNA, 15 nt, Salmonella enterica enterica serovar Typhi
cagauuuuuaauguc

SEQ ID NO: 3636306 - RNA, 19 nt, Salmonella enterica enterica serovar Typhi
cagcaaaacgcgcuaucaa

SEQ ID NO: 3636307 - RNA, 21 nt, Salmonella enterica enterica serovar Typhi
cagcaaaacggcuaccgucau

SEQ ID NO: 3636308 - RNA, 15 nt, Salmonella enterica enterica serovar Typhi
cagcaaaauggcaau

SEQ ID NO: 3636309 - RNA, 23 nt, Salmonella enterica enterica serovar Typhi
cagcaaaauuuugcgcagaccgc

SEQ ID NO: 3636310 - RNA, 13 nt, Salmonella enterica enterica serovar Typhi
cagcaaaccgaua

SEQ ID NO: 3636311 - RNA, 21 nt, Salmonella enterica enterica serovar Typhi
cagcaaacggcuggauaaccg

SEQ ID NO: 3636312 - RNA, 15 nt, Salmonella enterica enterica serovar Typhi
cagcaaauacagaug

SEQ ID NO: 3636313 - RNA, 20 nt, Salmonella enterica enterica serovar Typhi
cagcaaauagccguuaccgc

SEQ ID NO: 3636314 - RNA, 15 nt, Salmonella enterica enterica serovar Typhi
cagcaaaucgcccau

SEQ ID NO: 3636315 - RNA, 20 nt, Salmonella enterica enterica serovar Typhi
cagcaaaucgggaaaaugau

SEQ ID NO: 3636316 - RNA, 17 nt, Salmonella enterica enterica serovar Typhi
cagcaaaucugacacua

SEQ ID NO: 3636317 - RNA, 19 nt, Salmonella enterica enterica serovar Typhi
cagcaacacuuugcgcugc

SEQ ID NO: 3636318 - RNA, 22 nt, Salmonella enterica enterica serovar Typhi
cagcaacacuuugcgcugcgca

SEQ ID NO: 3636319 - RNA, 16 nt, Salmonella enterica enterica serovar Typhi
cagcaacagaaguuca

SEQ ID NO: 3636320 - RNA, 23 nt, Salmonella enterica enterica serovar Typhi
cagcaacagugggcuaugaagag

SEQ ID NO: 3636321 - RNA, 16 nt, Salmonella enterica enterica serovar Typhi
cagcaacaguugcugg

SEQ ID NO: 3636322 - RNA, 17 nt, Salmonella enterica enterica serovar Typhi
cagcaacgagcuuuuuu

SEQ ID NO: 3636323 - RNA, 18 nt, Salmonella enterica enterica serovar Typhi
cagcaacgagcuuuuuuc

SEQ ID NO: 3636324 - RNA, 13 nt, Salmonella enterica enterica serovar Typhi
cagcaacgcccag

SEQ ID NO: 3636325 - RNA, 22 nt, Salmonella enterica enterica serovar Typhi
cagcaacgcgcuaaaugcauag

SEQ ID NO: 3636326 - RNA, 22 nt, Salmonella enterica enterica serovar Typhi
cagcaacgugaacugcgccugc

SEQ ID NO: 3636327 - RNA, 14 nt, Salmonella enterica enterica serovar Typhi
cagcaacugacgcg

SEQ ID NO: 3636328 - RNA, 22 nt, Salmonella enterica enterica serovar Typhi
cagcaacugcugcgcgugcugu

SEQ ID NO: 3636329 - RNA, 22 nt, Salmonella enterica enterica serovar Typhi
cagcaagaaguuccgcuuuucu

SEQ ID NO: 3636330 - RNA, 18 nt, Salmonella enterica enterica serovar Typhi
cagcaagucgcgggcgcu

SEQ ID NO: 3636331 - RNA, 17 nt, Salmonella enterica enterica serovar Typhi
cagcaaguugcgccacu

SEQ ID NO: 3636332 - RNA, 14 nt, Salmonella enterica enterica serovar Typhi
cagcaauaaaagga

SEQ ID NO: 3636333 - RNA, 15 nt, Salmonella enterica enterica serovar Typhi
cagcaauaaaaggaa

SEQ ID NO: 3636334 - RNA, 23 nt, Salmonella enterica enterica serovar Typhi
cagcaauaacauuugccgggcca

SEQ ID NO: 3636335 - RNA, 13 nt, Salmonella enterica enterica serovar Typhi
cagcaauacgccc

SEQ ID NO: 3636336 - RNA, 17 nt, Salmonella enterica enterica serovar Typhi
cagcaauaucagccauu

SEQ ID NO: 3636337 - RNA, 18 nt, Salmonella enterica enterica serovar Typhi
cagcaauaucagccauua

SEQ ID NO: 3636338 - RNA, 12 nt, Salmonella enterica enterica serovar Typhi
cagcaaucaggu

SEQ ID NO: 3636339 - RNA, 15 nt, Salmonella enterica enterica serovar Typhi
cagcaaugagcaggc

SEQ ID NO: 3636340 - RNA, 20 nt, Salmonella enterica enterica serovar Typhi
cagcaaugauaacggcgcca

SEQ ID NO: 3636341 - RNA, 18 nt, Salmonella enterica enterica serovar Typhi
cagcaaugauuuuuagcc

SEQ ID NO: 3636342 - RNA, 17 nt, Salmonella enterica enterica serovar Typhi
cagcaaugccgccgcca

SEQ ID NO: 3636343 - RNA, 20 nt, Salmonella enterica enterica serovar Typhi
cagcaaugccgccgccaggu

SEQ ID NO: 3636344 - RNA, 23 nt, Salmonella enterica enterica serovar Typhi
cagcaauuccgccaucucauucg

SEQ ID NO: 3636345 - RNA, 21 nt, Salmonella enterica enterica serovar Typhi
cagcaauuggccaucuucguu

SEQ ID NO: 3636346 - RNA, 23 nt, Salmonella enterica enterica serovar Typhi
cagcaauuucucgcccgccagau

SEQ ID NO: 3636347 - RNA, 14 nt, Salmonella enterica enterica serovar Typhi
cagcacaaaauccc

SEQ ID NO: 3636348 - RNA, 21 nt, Salmonella enterica enterica serovar Typhi
cagcacaauuccggcccaggc

SEQ ID NO: 3636349 - RNA, 17 nt, Salmonella enterica enterica serovar Typhi
cagcacaugauguuuua

SEQ ID NO: 3636350 - RNA, 14 nt, Salmonella enterica enterica serovar Typhi
cagcacaugcaauu

SEQ ID NO: 3636351 - RNA, 22 nt, Salmonella enterica enterica serovar Typhi
cagcacauuacaggcaucuucc

SEQ ID NO: 3636352 - RNA, 16 nt, Salmonella enterica enterica serovar Typhi
cagcacauucagcagc

SEQ ID NO: 3636353 - RNA, 20 nt, Salmonella enterica enterica serovar Typhi
cagcacauucgauaaccgcc

SEQ ID NO: 3636354 - RNA, 16 nt, Salmonella enterica enterica serovar Typhi
cagcaccaacgccgcu

SEQ ID NO: 3636355 - RNA, 16 nt, Salmonella enterica enterica serovar Typhi
cagcaccacgcccgga

SEQ ID NO: 3636356 - RNA, 12 nt, Salmonella enterica enterica serovar Typhi
cagcaccaggau

SEQ ID NO: 3636357 - RNA, 15 nt, Salmonella enterica enterica serovar Typhi
cagcaccaucaugca

SEQ ID NO: 3636358 - RNA, 17 nt, Salmonella enterica enterica serovar Typhi
cagcaccaucaugcaag

SEQ ID NO: 3636359 - RNA, 20 nt, Salmonella enterica enterica serovar Typhi
cagcacccagcgaauuauga

SEQ ID NO: 3636360 - RNA, 15 nt, Salmonella enterica enterica serovar Typhi
cagcaccgccgcgau

SEQ ID NO: 3636361 - RNA, 16 nt, Salmonella enterica enterica serovar Typhi
cagcaccugaauaaug

SEQ ID NO: 3636362 - RNA, 15 nt, Salmonella enterica enterica serovar Typhi
cagcacgagcgccag

SEQ ID NO: 3636363 - RNA, 16 nt, Salmonella enterica enterica serovar Typhi
cagcacgaugcauaug

SEQ ID NO: 3636364 - RNA, 19 nt, Salmonella enterica enterica serovar Typhi
cagcacgcuuacccagcau

SEQ ID NO: 3636365 - RNA, 14 nt, Salmonella enterica enterica serovar Typhi
cagcacgggccugu

SEQ ID NO: 3636366 - RNA, 19 nt, Salmonella enterica enterica serovar Typhi
cagcacguagcuuauaaau

SEQ ID NO: 3636367 - RNA, 14 nt, Salmonella enterica enterica serovar Typhi
cagcacuaacagca

SEQ ID NO: 3636368 - RNA, 18 nt, Salmonella enterica enterica serovar Typhi
cagcacuaacagcagcag

SEQ ID NO: 3636369 - RNA, 23 nt, Salmonella enterica enterica serovar Typhi
cagcacuaacagcagcagcaaac

SEQ ID NO: 3636370 - RNA, 17 nt, Salmonella enterica enterica serovar Typhi
cagcacuucagaacggc

SEQ ID NO: 3636371 - RNA, 15 nt, Salmonella enterica enterica serovar Typhi
cagcacuucccgcuc

SEQ ID NO: 3636372 - RNA, 19 nt, Salmonella enterica enterica serovar Typhi
cagcacuuccggaucgcua

SEQ ID NO: 3636373 - RNA, 17 nt, Salmonella enterica enterica serovar Typhi
cagcacuucgcugauac

SEQ ID NO: 3636374 - RNA, 22 nt, Salmonella enterica enterica serovar Typhi
cagcagaaauucggcagcgucu

SEQ ID NO: 3636375 - RNA, 19 nt, Salmonella enterica enterica serovar Typhi
cagcagaacaaccagugcg

SEQ ID NO: 3636376 - RNA, 17 nt, Salmonella enterica enterica serovar Typhi
cagcagaaucaggcaca

SEQ ID NO: 3636377 - RNA, 14 nt, Salmonella enterica enterica serovar Typhi
cagcagacagguga

SEQ ID NO: 3636378 - RNA, 14 nt, Salmonella enterica enterica serovar Typhi
cagcagaccggcaa

SEQ ID NO: 3636379 - RNA, 23 nt, Salmonella enterica enterica serovar Typhi
cagcagaccggcaaaaauuugcg

SEQ ID NO: 3636380 - RNA, 20 nt, Salmonella enterica enterica serovar Typhi
cagcagacugccuacgcggc

SEQ ID NO: 3636381 - RNA, 15 nt, Salmonella enterica enterica serovar Typhi
cagcagacugguaac

SEQ ID NO: 3636382 - RNA, 24 nt, Salmonella enterica enterica serovar Typhi
cagcagauaauuuuucagacguca

SEQ ID NO: 3636383 - RNA, 14 nt, Salmonella enterica enterica serovar Typhi
cagcagauguggcg

SEQ ID NO: 3636384 - RNA, 18 nt, Salmonella enterica enterica serovar Typhi
cagcagauguggcggccc

SEQ ID NO: 3636385 - RNA, 16 nt, Salmonella enterica enterica serovar Typhi
cagcagcagaaucagg

SEQ ID NO: 3636386 - RNA, 18 nt, Salmonella enterica enterica serovar Typhi
cagcagcagagccggaac

SEQ ID NO: 3636387 - RNA, 14 nt, Salmonella enterica enterica serovar Typhi
cagcagcagccggu

SEQ ID NO: 3636388 - RNA, 13 nt, Salmonella enterica enterica serovar Typhi
cagcagcagcucg

SEQ ID NO: 3636389 - RNA, 23 nt, Salmonella enterica enterica serovar Typhi
cagcagcaggcuggagagcaacg

SEQ ID NO: 3636390 - RNA, 12 nt, Salmonella enterica enterica serovar Typhi
cagcagccagaa

SEQ ID NO: 3636391 - RNA, 14 nt, Salmonella enterica enterica serovar Typhi
cagcagccagccgu

SEQ ID NO: 3636392 - RNA, 20 nt, Salmonella enterica enterica serovar Typhi
cagcagccgggccagacgcu

SEQ ID NO: 3636393 - RNA, 13 nt, Salmonella enterica enterica serovar Typhi
cagcagcgacgca

SEQ ID NO: 3636394 - RNA, 18 nt, Salmonella enterica enterica serovar Typhi
cagcagcgacgcauugag

SEQ ID NO: 3636395 - RNA, 15 nt, Salmonella enterica enterica serovar Typhi
cagcagcgagauggc

SEQ ID NO: 3636396 - RNA, 14 nt, Salmonella enterica enterica serovar Typhi
cagcagcgcauagg

SEQ ID NO: 3636397 - RNA, 20 nt, Salmonella enterica enterica serovar Typhi
cagcagcgcccagccaaagc

SEQ ID NO: 3636398 - RNA, 17 nt, Salmonella enterica enterica serovar Typhi
cagcagcggaaucgcuu

SEQ ID NO: 3636399 - RNA, 14 nt, Salmonella enterica enterica serovar Typhi
cagcagcuucagca

SEQ ID NO: 3636400 - RNA, 22 nt, Salmonella enterica enterica serovar Typhi
cagcagcuucagcaucaucucc

SEQ ID NO: 3636401 - RNA, 17 nt, Salmonella enterica enterica serovar Typhi
cagcagcuucaugcauc

SEQ ID NO: 3636402 - RNA, 22 nt, Salmonella enterica enterica serovar Typhi
cagcaggacaaccccuacgcag

SEQ ID NO: 3636403 - RNA, 16 nt, Salmonella enterica enterica serovar Typhi
cagcaggacgcgcacu

SEQ ID NO: 3636404 - RNA, 23 nt, Salmonella enterica enterica serovar Typhi
cagcaggauagcgaccagcguca

SEQ ID NO: 3636405 - RNA, 15 nt, Salmonella enterica enterica serovar Typhi
cagcaggcagacgcg

SEQ ID NO: 3636406 - RNA, 20 nt, Salmonella enterica enterica serovar Typhi
cagcaggcuuugcugcugcg

SEQ ID NO: 3636407 - RNA, 21 nt, Salmonella enterica enterica serovar Typhi
cagcagggauauacaaauauc

SEQ ID NO: 3636408 - RNA, 20 nt, Salmonella enterica enterica serovar Typhi
cagcaggucgaccaccugcu

SEQ ID NO: 3636409 - RNA, 20 nt, Salmonella enterica enterica serovar Typhi
cagcaggucgcacuccucug

SEQ ID NO: 3636410 - RNA, 20 nt, Salmonella enterica enterica serovar Typhi
cagcagguugagucugcucg

SEQ ID NO: 3636411 - RNA, 16 nt, Salmonella enterica enterica serovar Typhi
cagcagucucuacuac

SEQ ID NO: 3636412 - RNA, 16 nt, Salmonella enterica enterica serovar Typhi
cagcagugggaaaauu

SEQ ID NO: 3636413 - RNA, 17 nt, Salmonella enterica enterica serovar Typhi
cagcaguuccccgccgc

SEQ ID NO: 3636414 - RNA, 16 nt, Salmonella enterica enterica serovar Typhi
cagcaguuccggcgua

SEQ ID NO: 3636415 - RNA, 14 nt, Salmonella enterica enterica serovar Typhi
cagcaguucuacgc

SEQ ID NO: 3636416 - RNA, 16 nt, Salmonella enterica enterica serovar Typhi
cagcaguugccauagc

SEQ ID NO: 3636417 - RNA, 18 nt, Salmonella enterica enterica serovar Typhi
cagcaguuggcggaggug

SEQ ID NO: 3636418 - RNA, 13 nt, Salmonella enterica enterica serovar Typhi
cagcauaaacauc

SEQ ID NO: 3636419 - RNA, 18 nt, Salmonella enterica enterica serovar Typhi
cagcauaauauucauaac

SEQ ID NO: 3636420 - RNA, 12 nt, Salmonella enterica enterica serovar Typhi
cagcauaccgcc

SEQ ID NO: 3636421 - RNA, 17 nt, Salmonella enterica enterica serovar Typhi
cagcauacgacaucgcc

SEQ ID NO: 3636422 - RNA, 18 nt, Salmonella enterica enterica serovar Typhi
cagcauacgacaucgcca

SEQ ID NO: 3636423 - RNA, 13 nt, Salmonella enterica enterica serovar Typhi
cagcauacgucug

SEQ ID NO: 3636424 - RNA, 17 nt, Salmonella enterica enterica serovar Typhi
cagcauacgucugcgcu

SEQ ID NO: 3636425 - RNA, 14 nt, Salmonella enterica enterica serovar Typhi
cagcauagucgcuc

SEQ ID NO: 3636426 - RNA, 18 nt, Salmonella enterica enterica serovar Typhi
cagcauauuuuccggcgu

SEQ ID NO: 3636427 - RNA, 20 nt, Salmonella enterica enterica serovar Typhi
cagcaucaauagcagcuuca

SEQ ID NO: 3636428 - RNA, 18 nt, Salmonella enterica enterica serovar Typhi
cagcaucaucucccaggc

SEQ ID NO: 3636429 - RNA, 20 nt, Salmonella enterica enterica serovar Typhi
cagcaucaucucccaggccg

SEQ ID NO: 3636430 - RNA, 15 nt, Salmonella enterica enterica serovar Typhi
cagcaucaugucccc

SEQ ID NO: 3636431 - RNA, 13 nt, Salmonella enterica enterica serovar Typhi
cagcauccaugcc

SEQ ID NO: 3636432 - RNA, 15 nt, Salmonella enterica enterica serovar Typhi
cagcauccaugccag

SEQ ID NO: 3636433 - RNA, 13 nt, Salmonella enterica enterica serovar Typhi
cagcaucccgcug

SEQ ID NO: 3636434 - RNA, 19 nt, Salmonella enterica enterica serovar Typhi
cagcaucccgcuggcgcca

SEQ ID NO: 3636435 - RNA, 13 nt, Salmonella enterica enterica serovar Typhi
cagcaucccggca

SEQ ID NO: 3636436 - RNA, 14 nt, Salmonella enterica enterica serovar Typhi
cagcaucccggcaa

SEQ ID NO: 3636437 - RNA, 15 nt, Salmonella enterica enterica serovar Typhi
cagcaucccggcaaa

SEQ ID NO: 3636438 - RNA, 23 nt, Salmonella enterica enterica serovar Typhi
cagcaucccguuaugguuaucaa

SEQ ID NO: 3636439 - RNA, 19 nt, Salmonella enterica enterica serovar Typhi
cagcaucgccaucaacucc

SEQ ID NO: 3636440 - RNA, 23 nt, Salmonella enterica enterica serovar Typhi
cagcaucgcccgggcaauuucuc

SEQ ID NO: 3636441 - RNA, 18 nt, Salmonella enterica enterica serovar Typhi
cagcaucgggaaucaucg

SEQ ID NO: 3636442 - RNA, 16 nt, Salmonella enterica enterica serovar Typhi
cagcaucguaccgugc

SEQ ID NO: 3636443 - RNA, 17 nt, Salmonella enterica enterica serovar Typhi
cagcaucuccuggcgca

SEQ ID NO: 3636444 - RNA, 22 nt, Salmonella enterica enterica serovar Typhi
cagcaucugcauaauggcgacg

SEQ ID NO: 3636445 - RNA, 14 nt, Salmonella enterica enterica serovar Typhi
cagcaucugcggcu

SEQ ID NO: 3636446 - RNA, 17 nt, Salmonella enterica enterica serovar Typhi
cagcaucuuaugcgcaa

SEQ ID NO: 3636447 - RNA, 20 nt, Salmonella enterica enterica serovar Typhi
cagcaugaauaaccucccgc

SEQ ID NO: 3636448 - RNA, 16 nt, Salmonella enterica enterica serovar Typhi
cagcaugagccagccc

SEQ ID NO: 3636449 - RNA, 14 nt, Salmonella enterica enterica serovar Typhi
cagcaugcccgcca

SEQ ID NO: 3636450 - RNA, 15 nt, Salmonella enterica enterica serovar Typhi
cagcauggcgccugc

SEQ ID NO: 3636451 - RNA, 23 nt, Salmonella enterica enterica serovar Typhi
cagcauguuucuccugccagcga

SEQ ID NO: 3636452 - RNA, 14 nt, Salmonella enterica enterica serovar Typhi
cagcauuacccccg

SEQ ID NO: 3636453 - RNA, 15 nt, Salmonella enterica enterica serovar Typhi
cagcauuagcgccac

SEQ ID NO: 3636454 - RNA, 19 nt, Salmonella enterica enterica serovar Typhi
cagcauugggauggauaaa

SEQ ID NO: 3636455 - RNA, 19 nt, Salmonella enterica enterica serovar Typhi
cagcauugggucaugcgga

SEQ ID NO: 3636456 - RNA, 21 nt, Salmonella enterica enterica serovar Typhi
cagcauuggugagagaguugc

SEQ ID NO: 3636457 - RNA, 23 nt, Salmonella enterica enterica serovar Typhi
cagcauuucaaucgcgcccgcca

SEQ ID NO: 3636458 - RNA, 13 nt, Salmonella enterica enterica serovar Typhi
cagcauuuccagc

SEQ ID NO: 3636459 - RNA, 14 nt, Salmonella enterica enterica serovar Typhi
cagcauuucgucga

SEQ ID NO: 3636460 - RNA, 17 nt, Salmonella enterica enterica serovar Typhi
cagcauuugcuguuuua

SEQ ID NO: 3636461 - RNA, 19 nt, Salmonella enterica enterica serovar Typhi
cagccaaacuccucacugc

SEQ ID NO: 3636462 - RNA, 15 nt, Salmonella enterica enterica serovar Typhi
cagccaaacugcugu

SEQ ID NO: 3636463 - RNA, 22 nt, Salmonella enterica enterica serovar Typhi
cagccaaagucuggccaccgau

SEQ ID NO: 3636464 - RNA, 18 nt, Salmonella enterica enterica serovar Typhi
cagccaaauagcgccaga

SEQ ID NO: 3636465 - RNA, 21 nt, Salmonella enterica enterica serovar Typhi
cagccaaauaggcgaggaaaa

SEQ ID NO: 3636466 - RNA, 17 nt, Salmonella enterica enterica serovar Typhi
cagccaacaacaggccg

SEQ ID NO: 3636467 - RNA, 19 nt, Salmonella enterica enterica serovar Typhi
cagccaacaacaggccgcc

SEQ ID NO: 3636468 - RNA, 18 nt, Salmonella enterica enterica serovar Typhi
cagccaaucauaaacgcc

SEQ ID NO: 3636469 - RNA, 22 nt, Salmonella enterica enterica serovar Typhi
cagccaaucauaaacgccugac

SEQ ID NO: 3636470 - RNA, 19 nt, Salmonella enterica enterica serovar Typhi
cagccaauuuaggcguggu

SEQ ID NO: 3636471 - RNA, 20 nt, Salmonella enterica enterica serovar Typhi
cagccacacacuguuuaaug

SEQ ID NO: 3636472 - RNA, 15 nt, Salmonella enterica enterica serovar Typhi
cagccacacugcugu

SEQ ID NO: 3636473 - RNA, 17 nt, Salmonella enterica enterica serovar Typhi
cagccacggcaacgccg

SEQ ID NO: 3636474 - RNA, 16 nt, Salmonella enterica enterica serovar Typhi
cagccacguugcgcgc

SEQ ID NO: 3636475 - RNA, 14 nt, Salmonella enterica enterica serovar Typhi
cagccacucccgau

SEQ ID NO: 3636476 - RNA, 23 nt, Salmonella enterica enterica serovar Typhi
cagccacugacuuuccugguaau

SEQ ID NO: 3636477 - RNA, 16 nt, Salmonella enterica enterica serovar Typhi
cagccacugcgccauu

SEQ ID NO: 3636478 - RNA, 15 nt, Salmonella enterica enterica serovar Typhi
cagccacuucuucca

SEQ ID NO: 3636479 - RNA, 20 nt, Salmonella enterica enterica serovar Typhi
cagccacuucuuccagcggc

SEQ ID NO: 3636480 - RNA, 13 nt, Salmonella enterica enterica serovar Typhi
cagccagaaaaag

SEQ ID NO: 3636481 - RNA, 16 nt, Salmonella enterica enterica serovar Typhi
cagccagaacucaucu

SEQ ID NO: 3636482 - RNA, 15 nt, Salmonella enterica enterica serovar Typhi
cagccagacgccagc

SEQ ID NO: 3636483 - RNA, 16 nt, Salmonella enterica enterica serovar Typhi
cagccagacggcgccc

SEQ ID NO: 3636484 - RNA, 17 nt, Salmonella enterica enterica serovar Typhi
cagccagacggcgccca

SEQ ID NO: 3636485 - RNA, 11 nt, Salmonella enterica enterica serovar Typhi
cagccagcagc

SEQ ID NO: 3636486 - RNA, 15 nt, Salmonella enterica enterica serovar Typhi
cagccagcauuucca

SEQ ID NO: 3636487 - RNA, 19 nt, Salmonella enterica enterica serovar Typhi
cagccagccguugugcugg

SEQ ID NO: 3636488 - RNA, 20 nt, Salmonella enterica enterica serovar Typhi
cagccagcgccaccaaagcc

SEQ ID NO: 3636489 - RNA, 11 nt, Salmonella enterica enterica serovar Typhi
cagccagcggg

SEQ ID NO: 3636490 - RNA, 20 nt, Salmonella enterica enterica serovar Typhi
cagccagcguuucuggaagu

SEQ ID NO: 3636491 - RNA, 17 nt, Salmonella enterica enterica serovar Typhi
cagccagcucaccagcc

SEQ ID NO: 3636492 - RNA, 17 nt, Salmonella enterica enterica serovar Typhi
cagccaggcaaaacagu

SEQ ID NO: 3636493 - RNA, 11 nt, Salmonella enterica enterica serovar Typhi
cagccaggcca

SEQ ID NO: 3636494 - RNA, 18 nt, Salmonella enterica enterica serovar Typhi
cagccaggccgccagcgu

SEQ ID NO: 3636495 - RNA, 23 nt, Salmonella enterica enterica serovar Typhi
cagccaggcgaucgcacagagau

SEQ ID NO: 3636496 - RNA, 21 nt, Salmonella enterica enterica serovar Typhi
cagccagguauuuagccacgc

SEQ ID NO: 3636497 - RNA, 11 nt, Salmonella enterica enterica serovar Typhi
cagccaggugg

SEQ ID NO: 3636498 - RNA, 13 nt, Salmonella enterica enterica serovar Typhi
cagccagguggca

SEQ ID NO: 3636499 - RNA, 18 nt, Salmonella enterica enterica serovar Typhi
cagccagguugccagaaa

SEQ ID NO: 3636500 - RNA, 12 nt, Salmonella enterica enterica serovar Typhi
cagccaguccuc

SEQ ID NO: 3636501 - RNA, 19 nt, Salmonella enterica enterica serovar Typhi
cagccaguccuccggcuga

SEQ ID NO: 3636502 - RNA, 21 nt, Salmonella enterica enterica serovar Typhi
cagccaguuggcuucagcaaa

SEQ ID NO: 3636503 - RNA, 15 nt, Salmonella enterica enterica serovar Typhi
cagccauaaauauug

SEQ ID NO: 3636504 - RNA, 22 nt, Salmonella enterica enterica serovar Typhi
cagccauaaucaguacugcgcc

SEQ ID NO: 3636505 - RNA, 22 nt, Salmonella enterica enterica serovar Typhi
cagccauaauggauuagguugc

SEQ ID NO: 3636506 - RNA, 15 nt, Salmonella enterica enterica serovar Typhi
cagccauagcccacu

SEQ ID NO: 3636507 - RNA, 16 nt, Salmonella enterica enterica serovar Typhi
cagccauagcgcgccg

SEQ ID NO: 3636508 - RNA, 22 nt, Salmonella enterica enterica serovar Typhi
cagccauagcgcgccgcuccag

SEQ ID NO: 3636509 - RNA, 16 nt, Salmonella enterica enterica serovar Typhi
cagccauauuuaugca

SEQ ID NO: 3636510 - RNA, 15 nt, Salmonella enterica enterica serovar Typhi
cagccauccccauau

SEQ ID NO: 3636511 - RNA, 18 nt, Salmonella enterica enterica serovar Typhi
cagccaucuucugcguca

SEQ ID NO: 3636512 - RNA, 22 nt, Salmonella enterica enterica serovar Typhi
cagccaugccauauggccgucg

SEQ ID NO: 3636513 - RNA, 22 nt, Salmonella enterica enterica serovar Typhi
cagccauggcccaaaagguagc

SEQ ID NO: 3636514 - RNA, 13 nt, Salmonella enterica enterica serovar Typhi
cagccauggcccu

SEQ ID NO: 3636515 - RNA, 14 nt, Salmonella enterica enterica serovar Typhi
cagccauggcccuu

SEQ ID NO: 3636516 - RNA, 20 nt, Salmonella enterica enterica serovar Typhi
cagccauguagaauagcgcc

SEQ ID NO: 3636517 - RNA, 14 nt, Salmonella enterica enterica serovar Typhi
cagccauucaccac

SEQ ID NO: 3636518 - RNA, 18 nt, Salmonella enterica enterica serovar Typhi
cagccauucggcugccuu

SEQ ID NO: 3636519 - RNA, 20 nt, Salmonella enterica enterica serovar Typhi
cagcccauaccacaacagaa

SEQ ID NO: 3636520 - RNA, 20 nt, Salmonella enterica enterica serovar Typhi
cagcccaucggucgcgcgca

SEQ ID NO: 3636521 - RNA, 22 nt, Salmonella enterica enterica serovar Typhi
cagcccaucggucgcgcgcagg

SEQ ID NO: 3636522 - RNA, 16 nt, Salmonella enterica enterica serovar Typhi
cagccccacauuggaa

SEQ ID NO: 3636523 - RNA, 13 nt, Salmonella enterica enterica serovar Typhi
cagccccagcgcc

SEQ ID NO: 3636524 - RNA, 14 nt, Salmonella enterica enterica serovar Typhi
cagccccagcgcca

SEQ ID NO: 3636525 - RNA, 17 nt, Salmonella enterica enterica serovar Typhi
cagccccagcgccagcc

SEQ ID NO: 3636526 - RNA, 18 nt, Salmonella enterica enterica serovar Typhi
cagccccagcgccagccg

SEQ ID NO: 3636527 - RNA, 13 nt, Salmonella enterica enterica serovar Typhi
cagccccaggcca

SEQ ID NO: 3636528 - RNA, 15 nt, Salmonella enterica enterica serovar Typhi
cagcccccugccagu

SEQ ID NO: 3636529 - RNA, 16 nt, Salmonella enterica enterica serovar Typhi
cagccccuucgcuguc

SEQ ID NO: 3636530 - RNA, 17 nt, Salmonella enterica enterica serovar Typhi
cagcccgauacccgccc

SEQ ID NO: 3636531 - RNA, 19 nt, Salmonella enterica enterica serovar Typhi
cagcccgaucaucuccugu

SEQ ID NO: 3636532 - RNA, 20 nt, Salmonella enterica enterica serovar Typhi
cagcccgaucaucuccugua

SEQ ID NO: 3636533 - RNA, 13 nt, Salmonella enterica enterica serovar Typhi
cagcccgccagca

SEQ ID NO: 3636534 - RNA, 14 nt, Salmonella enterica enterica serovar Typhi
cagcccgccagcac

SEQ ID NO: 3636535 - RNA, 12 nt, Salmonella enterica enterica serovar Typhi
cagcccggcgug

SEQ ID NO: 3636536 - RNA, 14 nt, Salmonella enterica enterica serovar Typhi
cagcccgucggcgu

SEQ ID NO: 3636537 - RNA, 21 nt, Salmonella enterica enterica serovar Typhi
cagcccguucugugcgccgcu

SEQ ID NO: 3636538 - RNA, 23 nt, Salmonella enterica enterica serovar Typhi
cagcccuaaauggagcgagcugg

SEQ ID NO: 3636539 - RNA, 22 nt, Salmonella enterica enterica serovar Typhi
cagcccucaacauugccggcau

SEQ ID NO: 3636540 - RNA, 15 nt, Salmonella enterica enterica serovar Typhi
cagcccugugccgcu

SEQ ID NO: 3636541 - RNA, 13 nt, Salmonella enterica enterica serovar Typhi
cagccgacgcauu

SEQ ID NO: 3636542 - RNA, 18 nt, Salmonella enterica enterica serovar Typhi
cagccgacuaucuucuuc

SEQ ID NO: 3636543 - RNA, 20 nt, Salmonella enterica enterica serovar Typhi
cagccgacuauuccgcaaac

SEQ ID NO: 3636544 - RNA, 23 nt, Salmonella enterica enterica serovar Typhi
cagccgagcgguaagagccagac

SEQ ID NO: 3636545 - RNA, 24 nt, Salmonella enterica enterica serovar Typhi
cagccgaucaacgggguuagcguu

SEQ ID NO: 3636546 - RNA, 14 nt, Salmonella enterica enterica serovar Typhi
cagccgaucaggcc

SEQ ID NO: 3636547 - RNA, 12 nt, Salmonella enterica enterica serovar Typhi
cagccgcaucuu

SEQ ID NO: 3636548 - RNA, 23 nt, Salmonella enterica enterica serovar Typhi
cagccgcauuuuucauggugaac

SEQ ID NO: 3636549 - RNA, 17 nt, Salmonella enterica enterica serovar Typhi
cagccgccaccacaaag

SEQ ID NO: 3636550 - RNA, 12 nt, Salmonella enterica enterica serovar Typhi
cagccgccaggc

SEQ ID NO: 3636551 - RNA, 22 nt, Salmonella enterica enterica serovar Typhi
cagccgccaguuugguuaauuc

SEQ ID NO: 3636552 - RNA, 13 nt, Salmonella enterica enterica serovar Typhi
cagccgccauggc

SEQ ID NO: 3636553 - RNA, 11 nt, Salmonella enterica enterica serovar Typhi
cagccgccauu

SEQ ID NO: 3636554 - RNA, 19 nt, Salmonella enterica enterica serovar Typhi
cagccgccauuaauaccau

SEQ ID NO: 3636555 - RNA, 21 nt, Salmonella enterica enterica serovar Typhi
cagccgcccgcgauaaaaauc

SEQ ID NO: 3636556 - RNA, 17 nt, Salmonella enterica enterica serovar Typhi
cagccgcgccaucuccu

SEQ ID NO: 3636557 - RNA, 14 nt, Salmonella enterica enterica serovar Typhi
cagccgcucugcug

SEQ ID NO: 3636558 - RNA, 16 nt, Salmonella enterica enterica serovar Typhi
cagccgcucugcuguu

SEQ ID NO: 3636559 - RNA, 20 nt, Salmonella enterica enterica serovar Typhi
cagccgcucugcuguuccuu

SEQ ID NO: 3636560 - RNA, 22 nt, Salmonella enterica enterica serovar Typhi
cagccgcuuuccgccgccgcca

SEQ ID NO: 3636561 - RNA, 21 nt, Salmonella enterica enterica serovar Typhi
cagccggaaaagcgcuggcug

SEQ ID NO: 3636562 - RNA, 23 nt, Salmonella enterica enterica serovar Typhi
cagccggaaaagcgcuggcuggc

SEQ ID NO: 3636563 - RNA, 18 nt, Salmonella enterica enterica serovar Typhi
cagccggauagacaugac

SEQ ID NO: 3636564 - RNA, 16 nt, Salmonella enterica enterica serovar Typhi
cagccggauuuuaaau

SEQ ID NO: 3636565 - RNA, 15 nt, Salmonella enterica enterica serovar Typhi
cagccgggcaggaaa

SEQ ID NO: 3636566 - RNA, 18 nt, Salmonella enterica enterica serovar Typhi
cagccgggccgcaaccgc

SEQ ID NO: 3636567 - RNA, 16 nt, Salmonella enterica enterica serovar Typhi
cagccgguauccagcg

SEQ ID NO: 3636568 - RNA, 17 nt, Salmonella enterica enterica serovar Typhi
cagccgguuagccacaa

SEQ ID NO: 3636569 - RNA, 15 nt, Salmonella enterica enterica serovar Typhi
cagccguaccacccg

SEQ ID NO: 3636570 - RNA, 21 nt, Salmonella enterica enterica serovar Typhi
cagccguaccacccgggaaaa

SEQ ID NO: 3636571 - RNA, 14 nt, Salmonella enterica enterica serovar Typhi
cagccgugagcaga

SEQ ID NO: 3636572 - RNA, 14 nt, Salmonella enterica enterica serovar Typhi
cagccguugugcug

SEQ ID NO: 3636573 - RNA, 16 nt, Salmonella enterica enterica serovar Typhi
cagccguuucuugucu

SEQ ID NO: 3636574 - RNA, 16 nt, Salmonella enterica enterica serovar Typhi
cagccuaccugccgcc

SEQ ID NO: 3636575 - RNA, 23 nt, Salmonella enterica enterica serovar Typhi
cagccuaccugccgccauaacgc

SEQ ID NO: 3636576 - RNA, 13 nt, Salmonella enterica enterica serovar Typhi
cagccuaucgcca

SEQ ID NO: 3636577 - RNA, 16 nt, Salmonella enterica enterica serovar Typhi
cagccucgcgcauccg

SEQ ID NO: 3636578 - RNA, 23 nt, Salmonella enterica enterica serovar Typhi
cagccucgcgcauccgggccgcu

SEQ ID NO: 3636579 - RNA, 18 nt, Salmonella enterica enterica serovar Typhi
cagccucgcguugagggu

SEQ ID NO: 3636580 - RNA, 15 nt, Salmonella enterica enterica serovar Typhi
cagccugccgcaucu

SEQ ID NO: 3636581 - RNA, 13 nt, Salmonella enterica enterica serovar Typhi
cagccugcugguc

SEQ ID NO: 3636582 - RNA, 21 nt, Salmonella enterica enterica serovar Typhi
cagccugcuggucugaaucug

SEQ ID NO: 3636583 - RNA, 19 nt, Salmonella enterica enterica serovar Typhi
cagccuggagagcagcgcc

SEQ ID NO: 3636584 - RNA, 22 nt, Salmonella enterica enterica serovar Typhi
cagccuggagagcagcgccagc

SEQ ID NO: 3636585 - RNA, 21 nt, Salmonella enterica enterica serovar Typhi
cagccugugaucggagaaaua

SEQ ID NO: 3636586 - RNA, 17 nt, Salmonella enterica enterica serovar Typhi
cagccuuauaagaacca

SEQ ID NO: 3636587 - RNA, 11 nt, Salmonella enterica enterica serovar Typhi
cagccuuauag

SEQ ID NO: 3636588 - RNA, 19 nt, Salmonella enterica enterica serovar Typhi
cagccuuccuggucugcca

SEQ ID NO: 3636589 - RNA, 18 nt, Salmonella enterica enterica serovar Typhi
cagccuugauaccgccgc

SEQ ID NO: 3636590 - RNA, 21 nt, Salmonella enterica enterica serovar Typhi
cagcgaaagaugcguaccgcu

SEQ ID NO: 3636591 - RNA, 16 nt, Salmonella enterica enterica serovar Typhi
cagcgaaagcugccuu

SEQ ID NO: 3636592 - RNA, 17 nt, Salmonella enterica enterica serovar Typhi
cagcgaaagcugccuuu

SEQ ID NO: 3636593 - RNA, 17 nt, Salmonella enterica enterica serovar Typhi
cagcgaaaugcgaaucc

SEQ ID NO: 3636594 - RNA, 14 nt, Salmonella enterica enterica serovar Typhi
cagcgaauaaugaa

SEQ ID NO: 3636595 - RNA, 14 nt, Salmonella enterica enterica serovar Typhi
cagcgaauagcggc

SEQ ID NO: 3636596 - RNA, 23 nt, Salmonella enterica enterica serovar Typhi
cagcgaauccgugcguaaaauau

SEQ ID NO: 3636597 - RNA, 21 nt, Salmonella enterica enterica serovar Typhi
cagcgaauuccggccaucaga

SEQ ID NO: 3636598 - RNA, 21 nt, Salmonella enterica enterica serovar Typhi
cagcgacaaggcaccguuucu

SEQ ID NO: 3636599 - RNA, 19 nt, Salmonella enterica enterica serovar Typhi
cagcgacacuccgcgcaug

SEQ ID NO: 3636600 - RNA, 21 nt, Salmonella enterica enterica serovar Typhi
cagcgacaguaguaucaucca

SEQ ID NO: 3636601 - RNA, 17 nt, Salmonella enterica enterica serovar Typhi
cagcgacauccucuuca

SEQ ID NO: 3636602 - RNA, 19 nt, Salmonella enterica enterica serovar Typhi
cagcgaccacgacgccgga

SEQ ID NO: 3636603 - RNA, 17 nt, Salmonella enterica enterica serovar Typhi
cagcgaccacgccaccg

SEQ ID NO: 3636604 - RNA, 13 nt, Salmonella enterica enterica serovar Typhi
cagcgaccuccgc

SEQ ID NO: 3636605 - RNA, 23 nt, Salmonella enterica enterica serovar Typhi
cagcgacgaugaaauaaacgacc

SEQ ID NO: 3636606 - RNA, 13 nt, Salmonella enterica enterica serovar Typhi
cagcgacgccaga

SEQ ID NO: 3636607 - RNA, 23 nt, Salmonella enterica enterica serovar Typhi
cagcgacgccagauuaucggcca

SEQ ID NO: 3636608 - RNA, 14 nt, Salmonella enterica enterica serovar Typhi
cagcgacucauuca

SEQ ID NO: 3636609 - RNA, 18 nt, Salmonella enterica enterica serovar Typhi
cagcgagcaggaauagcu

SEQ ID NO: 3636610 - RNA, 21 nt, Salmonella enterica enterica serovar Typhi
cagcgaguuacguugcggcgu

SEQ ID NO: 3636611 - RNA, 14 nt, Salmonella enterica enterica serovar Typhi
cagcgauauuucuc

SEQ ID NO: 3636612 - RNA, 16 nt, Salmonella enterica enterica serovar Typhi
cagcgauauuucuccg

SEQ ID NO: 3636613 - RNA, 15 nt, Salmonella enterica enterica serovar Typhi
cagcgaucacgccgu

SEQ ID NO: 3636614 - RNA, 22 nt, Salmonella enterica enterica serovar Typhi
cagcgauccgccgucggcaaua

SEQ ID NO: 3636615 - RNA, 13 nt, Salmonella enterica enterica serovar Typhi
cagcgauccugcg

SEQ ID NO: 3636616 - RNA, 19 nt, Salmonella enterica enterica serovar Typhi
cagcgaucugucgccgcgu

SEQ ID NO: 3636617 - RNA, 18 nt, Salmonella enterica enterica serovar Typhi
cagcgaugagcgccagca

SEQ ID NO: 3636618 - RNA, 19 nt, Salmonella enterica enterica serovar Typhi
cagcgaugagcgccagcaa

SEQ ID NO: 3636619 - RNA, 14 nt, Salmonella enterica enterica serovar Typhi
cagcgaugcgcgcg

SEQ ID NO: 3636620 - RNA, 13 nt, Salmonella enterica enterica serovar Typhi
cagcgauuauuuc

SEQ ID NO: 3636621 - RNA, 20 nt, Salmonella enterica enterica serovar Typhi
cagcgauuccgucaggaacg

SEQ ID NO: 3636622 - RNA, 14 nt, Salmonella enterica enterica serovar Typhi
cagcgauugcgcca

SEQ ID NO: 3636623 - RNA, 17 nt, Salmonella enterica enterica serovar Typhi
cagcgauugcgccagac

SEQ ID NO: 3636624 - RNA, 21 nt, Salmonella enterica enterica serovar Typhi
cagcgauuuuuacgccauuca

SEQ ID NO: 3636625 - RNA, 22 nt, Salmonella enterica enterica serovar Typhi
cagcgcaaacaacccggcugcc

SEQ ID NO: 3636626 - RNA, 15 nt, Salmonella enterica enterica serovar Typhi
cagcgcaacgcgcau

SEQ ID NO: 3636627 - RNA, 17 nt, Salmonella enterica enterica serovar Typhi
cagcgcaccuucaacag

SEQ ID NO: 3636628 - RNA, 17 nt, Salmonella enterica enterica serovar Typhi
cagcgcagaauuuauuu

SEQ ID NO: 3636629 - RNA, 21 nt, Salmonella enterica enterica serovar Typhi
cagcgcagucaaaacgacaua

SEQ ID NO: 3636630 - RNA, 15 nt, Salmonella enterica enterica serovar Typhi
cagcgcaguuuccau

SEQ ID NO: 3636631 - RNA, 19 nt, Salmonella enterica enterica serovar Typhi
cagcgcauagcugcccugu

SEQ ID NO: 3636632 - RNA, 19 nt, Salmonella enterica enterica serovar Typhi
cagcgcauccaccagaccc

SEQ ID NO: 3636633 - RNA, 21 nt, Salmonella enterica enterica serovar Typhi
cagcgcaucucccugccagug

SEQ ID NO: 3636634 - RNA, 23 nt, Salmonella enterica enterica serovar Typhi
cagcgcauugccuuucgcgcgau

SEQ ID NO: 3636635 - RNA, 17 nt, Salmonella enterica enterica serovar Typhi
cagcgcauuuuucuuca

SEQ ID NO: 3636636 - RNA, 21 nt, Salmonella enterica enterica serovar Typhi
cagcgccaacgccacugccau

SEQ ID NO: 3636637 - RNA, 19 nt, Salmonella enterica enterica serovar Typhi
cagcgccaccaaagccagg

SEQ ID NO: 3636638 - RNA, 21 nt, Salmonella enterica enterica serovar Typhi
cagcgccaccacaaacgccgu

SEQ ID NO: 3636639 - RNA, 18 nt, Salmonella enterica enterica serovar Typhi
cagcgccacccauuuucc

SEQ ID NO: 3636640 - RNA, 11 nt, Salmonella enterica enterica serovar Typhi
cagcgccaccg

SEQ ID NO: 3636641 - RNA, 12 nt, Salmonella enterica enterica serovar Typhi
cagcgccaccgg

SEQ ID NO: 3636642 - RNA, 20 nt, Salmonella enterica enterica serovar Typhi
cagcgccagaaagguauuaa

SEQ ID NO: 3636643 - RNA, 23 nt, Salmonella enterica enterica serovar Typhi
cagcgccagaauagacgccaugu

SEQ ID NO: 3636644 - RNA, 13 nt, Salmonella enterica enterica serovar Typhi
cagcgccagcccu

SEQ ID NO: 3636645 - RNA, 16 nt, Salmonella enterica enterica serovar Typhi
cagcgccagcccugcg

SEQ ID NO: 3636646 - RNA, 14 nt, Salmonella enterica enterica serovar Typhi
cagcgccagcgcca

SEQ ID NO: 3636647 - RNA, 13 nt, Salmonella enterica enterica serovar Typhi
cagcgccagcggc

SEQ ID NO: 3636648 - RNA, 16 nt, Salmonella enterica enterica serovar Typhi
cagcgccagcggcugc

SEQ ID NO: 3636649 - RNA, 19 nt, Salmonella enterica enterica serovar Typhi
cagcgccagcgugcgcagc

SEQ ID NO: 3636650 - RNA, 15 nt, Salmonella enterica enterica serovar Typhi
cagcgccagcuccau

SEQ ID NO: 3636651 - RNA, 21 nt, Salmonella enterica enterica serovar Typhi
cagcgccagcugcgucauguc

SEQ ID NO: 3636652 - RNA, 14 nt, Salmonella enterica enterica serovar Typhi
cagcgccaggccau

SEQ ID NO: 3636653 - RNA, 15 nt, Salmonella enterica enterica serovar Typhi
cagcgccauaaucca

SEQ ID NO: 3636654 - RNA, 15 nt, Salmonella enterica enterica serovar Typhi
cagcgccaucaggaa

SEQ ID NO: 3636655 - RNA, 15 nt, Salmonella enterica enterica serovar Typhi
cagcgccaucaggca

SEQ ID NO: 3636656 - RNA, 17 nt, Salmonella enterica enterica serovar Typhi
cagcgccaucaggcccc

SEQ ID NO: 3636657 - RNA, 14 nt, Salmonella enterica enterica serovar Typhi
cagcgccauccggc

SEQ ID NO: 3636658 - RNA, 17 nt, Salmonella enterica enterica serovar Typhi
cagcgccauccggcaaa

SEQ ID NO: 3636659 - RNA, 21 nt, Salmonella enterica enterica serovar Typhi
cagcgccauuaacgccaugac

SEQ ID NO: 3636660 - RNA, 20 nt, Salmonella enterica enterica serovar Typhi
cagcgccauugcuaggaaca

SEQ ID NO: 3636661 - RNA, 15 nt, Salmonella enterica enterica serovar Typhi
cagcgcccccagcaa

SEQ ID NO: 3636662 - RNA, 14 nt, Salmonella enterica enterica serovar Typhi
cagcgccccgccgc

SEQ ID NO: 3636663 - RNA, 18 nt, Salmonella enterica enterica serovar Typhi
cagcgccgcgaaugugcc

SEQ ID NO: 3636664 - RNA, 14 nt, Salmonella enterica enterica serovar Typhi
cagcgccgcgccga

SEQ ID NO: 3636665 - RNA, 23 nt, Salmonella enterica enterica serovar Typhi
cagcgccgcgccgauagcgucuc

SEQ ID NO: 3636666 - RNA, 17 nt, Salmonella enterica enterica serovar Typhi
cagcgccggauaaucca

SEQ ID NO: 3636667 - RNA, 13 nt, Salmonella enterica enterica serovar Typhi
cagcgccggcagc

SEQ ID NO: 3636668 - RNA, 14 nt, Salmonella enterica enterica serovar Typhi
cagcgccggcagca

SEQ ID NO: 3636669 - RNA, 19 nt, Salmonella enterica enterica serovar Typhi
cagcgccgucauaccgccc

SEQ ID NO: 3636670 - RNA, 22 nt, Salmonella enterica enterica serovar Typhi
cagcgccuccgcguagcccagc

SEQ ID NO: 3636671 - RNA, 14 nt, Salmonella enterica enterica serovar Typhi
cagcgccugaaugu

SEQ ID NO: 3636672 - RNA, 14 nt, Salmonella enterica enterica serovar Typhi
cagcgccugacggc

SEQ ID NO: 3636673 - RNA, 21 nt, Salmonella enterica enterica serovar Typhi
cagcgccuguaggaucaacca

SEQ ID NO: 3636674 - RNA, 15 nt, Salmonella enterica enterica serovar Typhi
cagcgccuguugauu

SEQ ID NO: 3636675 - RNA, 14 nt, Salmonella enterica enterica serovar Typhi
cagcgcgaacaggc

SEQ ID NO: 3636676 - RNA, 17 nt, Salmonella enterica enterica serovar Typhi
cagcgcgaccagcguga

SEQ ID NO: 3636677 - RNA, 16 nt, Salmonella enterica enterica serovar Typhi
cagcgcgaccaggaaa

SEQ ID NO: 3636678 - RNA, 14 nt, Salmonella enterica enterica serovar Typhi
cagcgcgaccugca

SEQ ID NO: 3636679 - RNA, 22 nt, Salmonella enterica enterica serovar Typhi
cagcgcgaccugcaucccuuuc

SEQ ID NO: 3636680 - RNA, 14 nt, Salmonella enterica enterica serovar Typhi
cagcgcgauacgcg

SEQ ID NO: 3636681 - RNA, 19 nt, Salmonella enterica enterica serovar Typhi
cagcgcgcgacccagcgca

SEQ ID NO: 3636682 - RNA, 17 nt, Salmonella enterica enterica serovar Typhi
cagcgcgcgcgacggca

SEQ ID NO: 3636683 - RNA, 17 nt, Salmonella enterica enterica serovar Typhi
cagcgcgcgcgcaaagc

SEQ ID NO: 3636684 - RNA, 19 nt, Salmonella enterica enterica serovar Typhi
cagcgcgcgcuuucaccgc

SEQ ID NO: 3636685 - RNA, 13 nt, Salmonella enterica enterica serovar Typhi
cagcgcgcguaac

SEQ ID NO: 3636686 - RNA, 15 nt, Salmonella enterica enterica serovar Typhi
cagcgcgcuccagac

SEQ ID NO: 3636687 - RNA, 15 nt, Salmonella enterica enterica serovar Typhi
cagcgcggcacacag

SEQ ID NO: 3636688 - RNA, 16 nt, Salmonella enterica enterica serovar Typhi
cagcgcggcagccgga

SEQ ID NO: 3636689 - RNA, 24 nt, Salmonella enterica enterica serovar Typhi
cagcgcggccugcgugcgccguga

SEQ ID NO: 3636690 - RNA, 19 nt, Salmonella enterica enterica serovar Typhi
cagcgcggcguacacuuca

SEQ ID NO: 3636691 - RNA, 13 nt, Salmonella enterica enterica serovar Typhi
cagcgcggcguga

SEQ ID NO: 3636692 - RNA, 20 nt, Salmonella enterica enterica serovar Typhi
cagcgcgggcgaggccucgu

SEQ ID NO: 3636693 - RNA, 17 nt, Salmonella enterica enterica serovar Typhi
cagcgcgguuucuacac

SEQ ID NO: 3636694 - RNA, 18 nt, Salmonella enterica enterica serovar Typhi
cagcgcguccagcccgcu

SEQ ID NO: 3636695 - RNA, 16 nt, Salmonella enterica enterica serovar Typhi
cagcgcgucgaccaua

SEQ ID NO: 3636696 - RNA, 15 nt, Salmonella enterica enterica serovar Typhi
cagcgcgugaaccgu

SEQ ID NO: 3636697 - RNA, 19 nt, Salmonella enterica enterica serovar Typhi
cagcgcuaacggcgguacc

SEQ ID NO: 3636698 - RNA, 20 nt, Salmonella enterica enterica serovar Typhi
cagcgcuaccagcgcggcgc

SEQ ID NO: 3636699 - RNA, 22 nt, Salmonella enterica enterica serovar Typhi
cagcgcuaccagcgcggcgcca

SEQ ID NO: 3636700 - RNA, 15 nt, Salmonella enterica enterica serovar Typhi
cagcgcuacccgcug

SEQ ID NO: 3636701 - RNA, 14 nt, Salmonella enterica enterica serovar Typhi
cagcgcuaucaggc

SEQ ID NO: 3636702 - RNA, 18 nt, Salmonella enterica enterica serovar Typhi
cagcgcuaucaggcacug

SEQ ID NO: 3636703 - RNA, 15 nt, Salmonella enterica enterica serovar Typhi
cagcgcuccaccaac

SEQ ID NO: 3636704 - RNA, 23 nt, Salmonella enterica enterica serovar Typhi
cagcgcuccaccaaccaggcaaa

SEQ ID NO: 3636705 - RNA, 17 nt, Salmonella enterica enterica serovar Typhi
cagcgcugaaucgcaau

SEQ ID NO: 3636706 - RNA, 22 nt, Salmonella enterica enterica serovar Typhi
cagcgcugagucauccuucccc

SEQ ID NO: 3636707 - RNA, 20 nt, Salmonella enterica enterica serovar Typhi
cagcgcugcauuugcugccg

SEQ ID NO: 3636708 - RNA, 23 nt, Salmonella enterica enterica serovar Typhi
cagcgcugcuguaacagacgcag

SEQ ID NO: 3636709 - RNA, 15 nt, Salmonella enterica enterica serovar Typhi
cagcgcuuucaccgc

SEQ ID NO: 3636710 - RNA, 11 nt, Salmonella enterica enterica serovar Typhi
cagcgcuuugc

SEQ ID NO: 3636711 - RNA, 15 nt, Salmonella enterica enterica serovar Typhi
cagcgcuuugccgcu

SEQ ID NO: 3636712 - RNA, 18 nt, Salmonella enterica enterica serovar Typhi
cagcgcuuugccgcugcu

SEQ ID NO: 3636713 - RNA, 22 nt, Salmonella enterica enterica serovar Typhi
cagcgcuuugccgcugcugccu

SEQ ID NO: 3636714 - RNA, 20 nt, Salmonella enterica enterica serovar Typhi
cagcggaaaauauucagcac

SEQ ID NO: 3636715 - RNA, 23 nt, Salmonella enterica enterica serovar Typhi
cagcggaaagugaaggccagacu

SEQ ID NO: 3636716 - RNA, 20 nt, Salmonella enterica enterica serovar Typhi
cagcggaauccccgccgcca

SEQ ID NO: 3636717 - RNA, 15 nt, Salmonella enterica enterica serovar Typhi
cagcggaauucccac

SEQ ID NO: 3636718 - RNA, 22 nt, Salmonella enterica enterica serovar Typhi
cagcggacacccgcagccagaa

SEQ ID NO: 3636719 - RNA, 15 nt, Salmonella enterica enterica serovar Typhi
cagcggaucgauaac

SEQ ID NO: 3636720 - RNA, 17 nt, Salmonella enterica enterica serovar Typhi
cagcggcaacucgugca

SEQ ID NO: 3636721 - RNA, 16 nt, Salmonella enterica enterica serovar Typhi
cagcggcagcucugcc

SEQ ID NO: 3636722 - RNA, 18 nt, Salmonella enterica enterica serovar Typhi
cagcggcagcucugccug

SEQ ID NO: 3636723 - RNA, 19 nt, Salmonella enterica enterica serovar Typhi
cagcggcagcuucagccag

SEQ ID NO: 3636724 - RNA, 21 nt, Salmonella enterica enterica serovar Typhi
cagcggcaggauccccauccc

SEQ ID NO: 3636725 - RNA, 15 nt, Salmonella enterica enterica serovar Typhi
cagcggcaguaaauu

SEQ ID NO: 3636726 - RNA, 13 nt, Salmonella enterica enterica serovar Typhi
cagcggccaugac

SEQ ID NO: 3636727 - RNA, 17 nt, Salmonella enterica enterica serovar Typhi
cagcggccauugaaguc

SEQ ID NO: 3636728 - RNA, 22 nt, Salmonella enterica enterica serovar Typhi
cagcggcccgcgcugaauagcg

SEQ ID NO: 3636729 - RNA, 21 nt, Salmonella enterica enterica serovar Typhi
cagcggcgauuuauagagcag

SEQ ID NO: 3636730 - RNA, 13 nt, Salmonella enterica enterica serovar Typhi
cagcggcgcaggg

SEQ ID NO: 3636731 - RNA, 18 nt, Salmonella enterica enterica serovar Typhi
cagcggcgccaucaccau

SEQ ID NO: 3636732 - RNA, 19 nt, Salmonella enterica enterica serovar Typhi
cagcggcgccaucaccauc

SEQ ID NO: 3636733 - RNA, 13 nt, Salmonella enterica enterica serovar Typhi
cagcggcgcgcca

SEQ ID NO: 3636734 - RNA, 15 nt, Salmonella enterica enterica serovar Typhi
cagcggcgcgccgcu

SEQ ID NO: 3636735 - RNA, 22 nt, Salmonella enterica enterica serovar Typhi
cagcggcggcuugccuucaucc

SEQ ID NO: 3636736 - RNA, 18 nt, Salmonella enterica enterica serovar Typhi
cagcggcgguuauccgcc

SEQ ID NO: 3636737 - RNA, 19 nt, Salmonella enterica enterica serovar Typhi
cagcggcgguuauccgcca

SEQ ID NO: 3636738 - RNA, 21 nt, Salmonella enterica enterica serovar Typhi
cagcggcguaucuuccagcgu

SEQ ID NO: 3636739 - RNA, 13 nt, Salmonella enterica enterica serovar Typhi
cagcggcugcgcc

SEQ ID NO: 3636740 - RNA, 21 nt, Salmonella enterica enterica serovar Typhi
cagcgggcuaugcugaagcag

SEQ ID NO: 3636741 - RNA, 21 nt, Salmonella enterica enterica serovar Typhi
cagcgggugaucgcuugccac

SEQ ID NO: 3636742 - RNA, 15 nt, Salmonella enterica enterica serovar Typhi
cagcgguaugcaccu

SEQ ID NO: 3636743 - RNA, 14 nt, Salmonella enterica enterica serovar Typhi
cagcggucaucaau

SEQ ID NO: 3636744 - RNA, 22 nt, Salmonella enterica enterica serovar Typhi
cagcgguccaauaaacgccagg

SEQ ID NO: 3636745 - RNA, 20 nt, Salmonella enterica enterica serovar Typhi
cagcgguuacuuuugaacau

SEQ ID NO: 3636746 - RNA, 23 nt, Salmonella enterica enterica serovar Typhi
cagcgguuacuuuugaacauaaa

SEQ ID NO: 3636747 - RNA, 16 nt, Salmonella enterica enterica serovar Typhi
cagcgguuagcggcau

SEQ ID NO: 3636748 - RNA, 22 nt, Salmonella enterica enterica serovar Typhi
cagcgguugcauaaaauccugg

SEQ ID NO: 3636749 - RNA, 15 nt, Salmonella enterica enterica serovar Typhi
cagcgguuugccggu

SEQ ID NO: 3636750 - RNA, 21 nt, Salmonella enterica enterica serovar Typhi
cagcguacaauggcaggcaua

SEQ ID NO: 3636751 - RNA, 15 nt, Salmonella enterica enterica serovar Typhi
cagcguacaucuucc

SEQ ID NO: 3636752 - RNA, 16 nt, Salmonella enterica enterica serovar Typhi
cagcguauacgccgga

SEQ ID NO: 3636753 - RNA, 18 nt, Salmonella enterica enterica serovar Typhi
cagcgucagcagaguguc

SEQ ID NO: 3636754 - RNA, 15 nt, Salmonella enterica enterica serovar Typhi
cagcgucaucagauc

SEQ ID NO: 3636755 - RNA, 13 nt, Salmonella enterica enterica serovar Typhi
cagcgucccggcg

SEQ ID NO: 3636756 - RNA, 14 nt, Salmonella enterica enterica serovar Typhi
cagcguccggagca

SEQ ID NO: 3636757 - RNA, 16 nt, Salmonella enterica enterica serovar Typhi
cagcgucgcaugggua

SEQ ID NO: 3636758 - RNA, 14 nt, Salmonella enterica enterica serovar Typhi
cagcgucgcuuugg

SEQ ID NO: 3636759 - RNA, 15 nt, Salmonella enterica enterica serovar Typhi
cagcgucggugaaga

SEQ ID NO: 3636760 - RNA, 17 nt, Salmonella enterica enterica serovar Typhi
cagcgucuauagaugau

SEQ ID NO: 3636761 - RNA, 18 nt, Salmonella enterica enterica serovar Typhi
cagcgucuauagaugaua

SEQ ID NO: 3636762 - RNA, 19 nt, Salmonella enterica enterica serovar Typhi
cagcgucucagcaggcggc

SEQ ID NO: 3636763 - RNA, 22 nt, Salmonella enterica enterica serovar Typhi
cagcgugaaacgcccuucccag

SEQ ID NO: 3636764 - RNA, 18 nt, Salmonella enterica enterica serovar Typhi
cagcgugccuucaaauau

SEQ ID NO: 3636765 - RNA, 16 nt, Salmonella enterica enterica serovar Typhi
cagcguggaugaacuc

SEQ ID NO: 3636766 - RNA, 22 nt, Salmonella enterica enterica serovar Typhi
cagcguggugacgguugagagg

SEQ ID NO: 3636767 - RNA, 16 nt, Salmonella enterica enterica serovar Typhi
cagcguguaaucgccg

SEQ ID NO: 3636768 - RNA, 18 nt, Salmonella enterica enterica serovar Typhi
cagcguguaaucgccgua

SEQ ID NO: 3636769 - RNA, 17 nt, Salmonella enterica enterica serovar Typhi
cagcguuaaaauaccgc

SEQ ID NO: 3636770 - RNA, 21 nt, Salmonella enterica enterica serovar Typhi
cagcguuacugcaacugcgcg

SEQ ID NO: 3636771 - RNA, 14 nt, Salmonella enterica enterica serovar Typhi
cagcguugaccagc

SEQ ID NO: 3636772 - RNA, 23 nt, Salmonella enterica enterica serovar Typhi
cagcguuuccggaaugagaugca

SEQ ID NO: 3636773 - RNA, 15 nt, Salmonella enterica enterica serovar Typhi
cagcguuuugcgcuc

SEQ ID NO: 3636774 - RNA, 19 nt, Salmonella enterica enterica serovar Typhi
cagcuaaaaacagcgcaau

SEQ ID NO: 3636775 - RNA, 19 nt, Salmonella enterica enterica serovar Typhi
cagcuaaaaccguagauuu

SEQ ID NO: 3636776 - RNA, 13 nt, Salmonella enterica enterica serovar Typhi
cagcuacuggcca

SEQ ID NO: 3636777 - RNA, 18 nt, Salmonella enterica enterica serovar Typhi
cagcuaucgcagcucggu

SEQ ID NO: 3636778 - RNA, 19 nt, Salmonella enterica enterica serovar Typhi
cagcuauuuuucaccauaa

SEQ ID NO: 3636779 - RNA, 14 nt, Salmonella enterica enterica serovar Typhi
cagcucaaccgcgc

SEQ ID NO: 3636780 - RNA, 19 nt, Salmonella enterica enterica serovar Typhi
cagcucaaccgcgcggcgu

SEQ ID NO: 3636781 - RNA, 14 nt, Salmonella enterica enterica serovar Typhi
cagcucaacuauua

SEQ ID NO: 3636782 - RNA, 14 nt, Salmonella enterica enterica serovar Typhi
cagcucaccagcca

SEQ ID NO: 3636783 - RNA, 18 nt, Salmonella enterica enterica serovar Typhi
cagcucaccgagacugcc

SEQ ID NO: 3636784 - RNA, 14 nt, Salmonella enterica enterica serovar Typhi
cagcucacgcgcca

SEQ ID NO: 3636785 - RNA, 17 nt, Salmonella enterica enterica serovar Typhi
cagcucacgcgccagca

SEQ ID NO: 3636786 - RNA, 19 nt, Salmonella enterica enterica serovar Typhi
cagcucagcuuuaaugcuu

SEQ ID NO: 3636787 - RNA, 21 nt, Salmonella enterica enterica serovar Typhi
cagcucaggguuuucuaccgc

SEQ ID NO: 3636788 - RNA, 16 nt, Salmonella enterica enterica serovar Typhi
cagcucauacccuucc

SEQ ID NO: 3636789 - RNA, 17 nt, Salmonella enterica enterica serovar Typhi
cagcucauacccuucca

SEQ ID NO: 3636790 - RNA, 22 nt, Salmonella enterica enterica serovar Typhi
cagcucaugcaagacaucuaac

SEQ ID NO: 3636791 - RNA, 20 nt, Salmonella enterica enterica serovar Typhi
cagcuccagccgcugccuuc

SEQ ID NO: 3636792 - RNA, 23 nt, Salmonella enterica enterica serovar Typhi
cagcuccagcucaggguccccau

SEQ ID NO: 3636793 - RNA, 22 nt, Salmonella enterica enterica serovar Typhi
cagcuccaugucuugcuaucaa

SEQ ID NO: 3636794 - RNA, 18 nt, Salmonella enterica enterica serovar Typhi
cagcuccuuuuaauaaag

SEQ ID NO: 3636795 - RNA, 17 nt, Salmonella enterica enterica serovar Typhi
cagcucgcgcaguucca

SEQ ID NO: 3636796 - RNA, 16 nt, Salmonella enterica enterica serovar Typhi
cagcucguacuccgcg

SEQ ID NO: 3636797 - RNA, 18 nt, Salmonella enterica enterica serovar Typhi
cagcucguacuccgcgcg

SEQ ID NO: 3636798 - RNA, 21 nt, Salmonella enterica enterica serovar Typhi
cagcucguacuccgcgcgcgu

SEQ ID NO: 3636799 - RNA, 14 nt, Salmonella enterica enterica serovar Typhi
cagcucuucaggcg

SEQ ID NO: 3636800 - RNA, 18 nt, Salmonella enterica enterica serovar Typhi
cagcucuuuaggcaggaa

SEQ ID NO: 3636801 - RNA, 13 nt, Salmonella enterica enterica serovar Typhi
cagcucuuuucug

SEQ ID NO: 3636802 - RNA, 17 nt, Salmonella enterica enterica serovar Typhi
cagcugacaaugugccg

SEQ ID NO: 3636803 - RNA, 16 nt, Salmonella enterica enterica serovar Typhi
cagcugacgacgccag

SEQ ID NO: 3636804 - RNA, 21 nt, Salmonella enterica enterica serovar Typhi
cagcugacgcagcaguucccc

SEQ ID NO: 3636805 - RNA, 21 nt, Salmonella enterica enterica serovar Typhi
cagcugagcuaaucacccacu

SEQ ID NO: 3636806 - RNA, 18 nt, Salmonella enterica enterica serovar Typhi
cagcuggcgauauccgug

SEQ ID NO: 3636807 - RNA, 17 nt, Salmonella enterica enterica serovar Typhi
cagcugggccugcuccg

SEQ ID NO: 3636808 - RNA, 16 nt, Salmonella enterica enterica serovar Typhi
cagcugggucgcgcuu

SEQ ID NO: 3636809 - RNA, 19 nt, Salmonella enterica enterica serovar Typhi
cagcuguuuaagcgccucc

SEQ ID NO: 3636810 - RNA, 21 nt, Salmonella enterica enterica serovar Typhi
cagcuguuuaagcgccuccac

SEQ ID NO: 3636811 - RNA, 18 nt, Salmonella enterica enterica serovar Typhi
cagcuuaaucaccagcgc

SEQ ID NO: 3636812 - RNA, 14 nt, Salmonella enterica enterica serovar Typhi
cagcuuaucgggau

SEQ ID NO: 3636813 - RNA, 17 nt, Salmonella enterica enterica serovar Typhi
cagcuuaucugaccaug

SEQ ID NO: 3636814 - RNA, 23 nt, Salmonella enterica enterica serovar Typhi
cagcuucaggcucaucagcgcca

SEQ ID NO: 3636815 - RNA, 21 nt, Salmonella enterica enterica serovar Typhi
cagcuuccugcacgccugcuu

SEQ ID NO: 3636816 - RNA, 17 nt, Salmonella enterica enterica serovar Typhi
cagcuucgguccggcgc

SEQ ID NO: 3636817 - RNA, 14 nt, Salmonella enterica enterica serovar Typhi
cagcuucugauacu

SEQ ID NO: 3636818 - RNA, 16 nt, Salmonella enterica enterica serovar Typhi
cagcuucugucagccu

SEQ ID NO: 3636819 - RNA, 18 nt, Salmonella enterica enterica serovar Typhi
cagcuugaucaucagggc

SEQ ID NO: 3636820 - RNA, 21 nt, Salmonella enterica enterica serovar Typhi
cagcuugccgucacaggcggc

SEQ ID NO: 3636821 - RNA, 15 nt, Salmonella enterica enterica serovar Typhi
cagcuugcuggccgc

SEQ ID NO: 3636822 - RNA, 19 nt, Salmonella enterica enterica serovar Typhi
cagcuuguuauccaucagc

SEQ ID NO: 3636823 - RNA, 15 nt, Salmonella enterica enterica serovar Typhi
cagcuuuugcgcguu

SEQ ID NO: 3636824 - RNA, 13 nt, Salmonella enterica enterica serovar Typhi
caggaaaaacaug

SEQ ID NO: 3636825 - RNA, 17 nt, Salmonella enterica enterica serovar Typhi
caggaaaaacugucccu

SEQ ID NO: 3636826 - RNA, 14 nt, Salmonella enterica enterica serovar Typhi
caggaaaagaccau

SEQ ID NO: 3636827 - RNA, 21 nt, Salmonella enterica enterica serovar Typhi
caggaaaccgguaaaggcgac

SEQ ID NO: 3636828 - RNA, 14 nt, Salmonella enterica enterica serovar Typhi
caggaaaucuucca

SEQ ID NO: 3636829 - RNA, 17 nt, Salmonella enterica enterica serovar Typhi
caggaaaucuuccaguu

SEQ ID NO: 3636830 - RNA, 15 nt, Salmonella enterica enterica serovar Typhi
caggaaccgccgaug

SEQ ID NO: 3636831 - RNA, 12 nt, Salmonella enterica enterica serovar Typhi
caggaacgccau

SEQ ID NO: 3636832 - RNA, 19 nt, Salmonella enterica enterica serovar Typhi
caggaacugcggccagaca

SEQ ID NO: 3636833 - RNA, 16 nt, Salmonella enterica enterica serovar Typhi
caggaagccgguguac

SEQ ID NO: 3636834 - RNA, 20 nt, Salmonella enterica enterica serovar Typhi
caggaaggcgugcagcgugc

SEQ ID NO: 3636835 - RNA, 13 nt, Salmonella enterica enterica serovar Typhi
caggaagggcagc

SEQ ID NO: 3636836 - RNA, 20 nt, Salmonella enterica enterica serovar Typhi
caggaauaacaucguaaauc

SEQ ID NO: 3636837 - RNA, 21 nt, Salmonella enterica enterica serovar Typhi
caggaauaacaucguaaauca

SEQ ID NO: 3636838 - RNA, 23 nt, Salmonella enterica enterica serovar Typhi
caggaauaaccacugauggcugg

SEQ ID NO: 3636839 - RNA, 14 nt, Salmonella enterica enterica serovar Typhi
caggaaugcggcca

SEQ ID NO: 3636840 - RNA, 19 nt, Salmonella enterica enterica serovar Typhi
caggaauuccaguccuuuc

SEQ ID NO: 3636841 - RNA, 19 nt, Salmonella enterica enterica serovar Typhi
caggacagaugucccgccu

SEQ ID NO: 3636842 - RNA, 12 nt, Salmonella enterica enterica serovar Typhi
caggacagcgac

SEQ ID NO: 3636843 - RNA, 23 nt, Salmonella enterica enterica serovar Typhi
caggacauaaaacaguacgccga

SEQ ID NO: 3636844 - RNA, 19 nt, Salmonella enterica enterica serovar Typhi
caggacauggucaccauga

SEQ ID NO: 3636845 - RNA, 20 nt, Salmonella enterica enterica serovar Typhi
caggacauggucaccaugac

SEQ ID NO: 3636846 - RNA, 19 nt, Salmonella enterica enterica serovar Typhi
caggaccaaaacaguacug

SEQ ID NO: 3636847 - RNA, 18 nt, Salmonella enterica enterica serovar Typhi
caggacgagagacugaua

SEQ ID NO: 3636848 - RNA, 19 nt, Salmonella enterica enterica serovar Typhi
caggacgcacccuguucau

SEQ ID NO: 3636849 - RNA, 20 nt, Salmonella enterica enterica serovar Typhi
caggacgcacccuguucauc

SEQ ID NO: 3636850 - RNA, 12 nt, Salmonella enterica enterica serovar Typhi
caggacgccagc

SEQ ID NO: 3636851 - RNA, 12 nt, Salmonella enterica enterica serovar Typhi
caggacgccagu

SEQ ID NO: 3636852 - RNA, 16 nt, Salmonella enterica enterica serovar Typhi
caggacugacugcugu

SEQ ID NO: 3636853 - RNA, 18 nt, Salmonella enterica enterica serovar Typhi
caggagcaaaccgaccca

SEQ ID NO: 3636854 - RNA, 12 nt, Salmonella enterica enterica serovar Typhi
caggagcauggu

SEQ ID NO: 3636855 - RNA, 19 nt, Salmonella enterica enterica serovar Typhi
caggagcauuggaaauuca

SEQ ID NO: 3636856 - RNA, 21 nt, Salmonella enterica enterica serovar Typhi
caggagcauuggaaauucagg

SEQ ID NO: 3636857 - RNA, 21 nt, Salmonella enterica enterica serovar Typhi
caggagccaguuuucgacaua

SEQ ID NO: 3636858 - RNA, 18 nt, Salmonella enterica enterica serovar Typhi
caggaguaaauaacaaaa

SEQ ID NO: 3636859 - RNA, 16 nt, Salmonella enterica enterica serovar Typhi
caggauaaaauccugc

SEQ ID NO: 3636860 - RNA, 17 nt, Salmonella enterica enterica serovar Typhi
caggauaaaauccugca

SEQ ID NO: 3636861 - RNA, 18 nt, Salmonella enterica enterica serovar Typhi
caggauaaaauccugcac

SEQ ID NO: 3636862 - RNA, 12 nt, Salmonella enterica enterica serovar Typhi
caggauaaagac

SEQ ID NO: 3636863 - RNA, 17 nt, Salmonella enterica enterica serovar Typhi
caggauaaagaccggca

SEQ ID NO: 3636864 - RNA, 15 nt, Salmonella enterica enterica serovar Typhi
caggauaauaaugau

SEQ ID NO: 3636865 - RNA, 20 nt, Salmonella enterica enterica serovar Typhi
caggauaauaucgcuggcca

SEQ ID NO: 3636866 - RNA, 18 nt, Salmonella enterica enterica serovar Typhi
caggauauacuucaucag

SEQ ID NO: 3636867 - RNA, 22 nt, Salmonella enterica enterica serovar Typhi
caggauauuuugcucauauugu

SEQ ID NO: 3636868 - RNA, 19 nt, Salmonella enterica enterica serovar Typhi
caggaucaaaaucgcgccc

SEQ ID NO: 3636869 - RNA, 21 nt, Salmonella enterica enterica serovar Typhi
caggaucaaaaucgcgcccca

SEQ ID NO: 3636870 - RNA, 22 nt, Salmonella enterica enterica serovar Typhi
caggaucagauauuccagcgac

SEQ ID NO: 3636871 - RNA, 22 nt, Salmonella enterica enterica serovar Typhi
caggaucgccgccgcgagcagc

SEQ ID NO: 3636872 - RNA, 15 nt, Salmonella enterica enterica serovar Typhi
caggaucggaagcga

SEQ ID NO: 3636873 - RNA, 13 nt, Salmonella enterica enterica serovar Typhi
caggaucgguaaa

SEQ ID NO: 3636874 - RNA, 22 nt, Salmonella enterica enterica serovar Typhi
caggaucgguaaacgccccuuc

SEQ ID NO: 3636875 - RNA, 23 nt, Salmonella enterica enterica serovar Typhi
caggaucgguaaacgccccuucg

SEQ ID NO: 3636876 - RNA, 13 nt, Salmonella enterica enterica serovar Typhi
caggaucuuuuuc

SEQ ID NO: 3636877 - RNA, 16 nt, Salmonella enterica enterica serovar Typhi
caggaugauguucauc

SEQ ID NO: 3636878 - RNA, 15 nt, Salmonella enterica enterica serovar Typhi
caggaugccaaccac

SEQ ID NO: 3636879 - RNA, 17 nt, Salmonella enterica enterica serovar Typhi
caggaugccguugacca

SEQ ID NO: 3636880 - RNA, 11 nt, Salmonella enterica enterica serovar Typhi
caggaugcuga

SEQ ID NO: 3636881 - RNA, 16 nt, Salmonella enterica enterica serovar Typhi
caggauggccagcacc

SEQ ID NO: 3636882 - RNA, 20 nt, Salmonella enterica enterica serovar Typhi
caggauggccagcaccagca

SEQ ID NO: 3636883 - RNA, 19 nt, Salmonella enterica enterica serovar Typhi
caggaugugaggcagauau

SEQ ID NO: 3636884 - RNA, 22 nt, Salmonella enterica enterica serovar Typhi
caggauugcugugaaguaauuc

SEQ ID NO: 3636885 - RNA, 18 nt, Salmonella enterica enterica serovar Typhi
caggauuuacugagcgcc

SEQ ID NO: 3636886 - RNA, 16 nt, Salmonella enterica enterica serovar Typhi
caggcaaaaaucggcc

SEQ ID NO: 3636887 - RNA, 22 nt, Salmonella enterica enterica serovar Typhi
caggcaaaaaucggccucuuca

SEQ ID NO: 3636888 - RNA, 18 nt, Salmonella enterica enterica serovar Typhi
caggcaaaaggccuuuuu

SEQ ID NO: 3636889 - RNA, 16 nt, Salmonella enterica enterica serovar Typhi
caggcaaaggaaugcu

SEQ ID NO: 3636890 - RNA, 17 nt, Salmonella enterica enterica serovar Typhi
caggcaaaucuggugau

SEQ ID NO: 3636891 - RNA, 22 nt, Salmonella enterica enterica serovar Typhi
caggcaagacacagcgucgcgc

SEQ ID NO: 3636892 - RNA, 22 nt, Salmonella enterica enterica serovar Typhi
caggcaauaaaaaaggcagagc

SEQ ID NO: 3636893 - RNA, 12 nt, Salmonella enterica enterica serovar Typhi
caggcaaucagc

SEQ ID NO: 3636894 - RNA, 19 nt, Salmonella enterica enterica serovar Typhi
caggcaaucagcagccggg

SEQ ID NO: 3636895 - RNA, 19 nt, Salmonella enterica enterica serovar Typhi
caggcacagaagcgccugu

SEQ ID NO: 3636896 - RNA, 13 nt, Salmonella enterica enterica serovar Typhi
caggcacgccugu

SEQ ID NO: 3636897 - RNA, 15 nt, Salmonella enterica enterica serovar Typhi
caggcacgugcauaa

SEQ ID NO: 3636898 - RNA, 16 nt, Salmonella enterica enterica serovar Typhi
caggcacguuaaacac

SEQ ID NO: 3636899 - RNA, 17 nt, Salmonella enterica enterica serovar Typhi
caggcacuguggugugc

SEQ ID NO: 3636900 - RNA, 20 nt, Salmonella enterica enterica serovar Typhi
caggcacuguggugugccug

SEQ ID NO: 3636901 - RNA, 13 nt, Salmonella enterica enterica serovar Typhi
caggcagccacaa

SEQ ID NO: 3636902 - RNA, 15 nt, Salmonella enterica enterica serovar Typhi
caggcagccacaaug

SEQ ID NO: 3636903 - RNA, 20 nt, Salmonella enterica enterica serovar Typhi
caggcagccggauuuuaaau

SEQ ID NO: 3636904 - RNA, 21 nt, Salmonella enterica enterica serovar Typhi
caggcaggcccgcgcuuuaau

SEQ ID NO: 3636905 - RNA, 22 nt, Salmonella enterica enterica serovar Typhi
caggcaguagccggaaaacaua

SEQ ID NO: 3636906 - RNA, 17 nt, Salmonella enterica enterica serovar Typhi
caggcaguuugcgaaaa

SEQ ID NO: 3636907 - RNA, 18 nt, Salmonella enterica enterica serovar Typhi
caggcauaaaaaagagga

SEQ ID NO: 3636908 - RNA, 21 nt, Salmonella enterica enterica serovar Typhi
caggcauaauggaacugccug

SEQ ID NO: 3636909 - RNA, 15 nt, Salmonella enterica enterica serovar Typhi
caggcauacagaugc

SEQ ID NO: 3636910 - RNA, 18 nt, Salmonella enterica enterica serovar Typhi
caggcauccagacccaca

SEQ ID NO: 3636911 - RNA, 19 nt, Salmonella enterica enterica serovar Typhi
caggcauccgugaccugcu

SEQ ID NO: 3636912 - RNA, 16 nt, Salmonella enterica enterica serovar Typhi
caggcaucgacgccag

SEQ ID NO: 3636913 - RNA, 18 nt, Salmonella enterica enterica serovar Typhi
caggcaucgacgccagcg

SEQ ID NO: 3636914 - RNA, 13 nt, Salmonella enterica enterica serovar Typhi
caggcaucuucca

SEQ ID NO: 3636915 - RNA, 15 nt, Salmonella enterica enterica serovar Typhi
caggcaucuuccagc

SEQ ID NO: 3636916 - RNA, 15 nt, Salmonella enterica enterica serovar Typhi
caggcauggcagcag

SEQ ID NO: 3636917 - RNA, 17 nt, Salmonella enterica enterica serovar Typhi
caggcauggcagcaggg

SEQ ID NO: 3636918 - RNA, 15 nt, Salmonella enterica enterica serovar Typhi
caggcauuaaaaaaa

SEQ ID NO: 3636919 - RNA, 20 nt, Salmonella enterica enterica serovar Typhi
caggcauugauaaagcgcuc

SEQ ID NO: 3636920 - RNA, 15 nt, Salmonella enterica enterica serovar Typhi
caggcauugucaccu

SEQ ID NO: 3636921 - RNA, 15 nt, Salmonella enterica enterica serovar Typhi
caggcauuuuauuac

SEQ ID NO: 3636922 - RNA, 17 nt, Salmonella enterica enterica serovar Typhi
caggcauuuuauuaccu

SEQ ID NO: 3636923 - RNA, 21 nt, Salmonella enterica enterica serovar Typhi
caggccaaacccugcgccgca

SEQ ID NO: 3636924 - RNA, 22 nt, Salmonella enterica enterica serovar Typhi
caggccaaacccugcgccgcaa

SEQ ID NO: 3636925 - RNA, 20 nt, Salmonella enterica enterica serovar Typhi
caggccaacguaguuauugu

SEQ ID NO: 3636926 - RNA, 16 nt, Salmonella enterica enterica serovar Typhi
caggccaagcagcgcc

SEQ ID NO: 3636927 - RNA, 18 nt, Salmonella enterica enterica serovar Typhi
caggccaauuccgccaua

SEQ ID NO: 3636928 - RNA, 19 nt, Salmonella enterica enterica serovar Typhi
caggccagaauucagcaug

SEQ ID NO: 3636929 - RNA, 23 nt, Salmonella enterica enterica serovar Typhi
caggccagauauugccgaccauu

SEQ ID NO: 3636930 - RNA, 14 nt, Salmonella enterica enterica serovar Typhi
caggccaugcgccg

SEQ ID NO: 3636931 - RNA, 16 nt, Salmonella enterica enterica serovar Typhi
caggccaugcgccgcg

SEQ ID NO: 3636932 - RNA, 21 nt, Salmonella enterica enterica serovar Typhi
caggccaugcgccgcgucagc

SEQ ID NO: 3636933 - RNA, 22 nt, Salmonella enterica enterica serovar Typhi
caggccaugcgccgcgucagca

SEQ ID NO: 3636934 - RNA, 12 nt, Salmonella enterica enterica serovar Typhi
caggcccagccg

SEQ ID NO: 3636935 - RNA, 15 nt, Salmonella enterica enterica serovar Typhi
caggcccagccgcuc

SEQ ID NO: 3636936 - RNA, 13 nt, Salmonella enterica enterica serovar Typhi
caggccgccaccg

SEQ ID NO: 3636937 - RNA, 17 nt, Salmonella enterica enterica serovar Typhi
caggccgccaccgccuc

SEQ ID NO: 3636938 - RNA, 19 nt, Salmonella enterica enterica serovar Typhi
caggccgccgcaaaagccg

SEQ ID NO: 3636939 - RNA, 13 nt, Salmonella enterica enterica serovar Typhi
caggccgccgccu

SEQ ID NO: 3636940 - RNA, 14 nt, Salmonella enterica enterica serovar Typhi
caggccgcgcugau

SEQ ID NO: 3636941 - RNA, 18 nt, Salmonella enterica enterica serovar Typhi
caggccggacaggcgacg

SEQ ID NO: 3636942 - RNA, 15 nt, Salmonella enterica enterica serovar Typhi
caggccggauaagag

SEQ ID NO: 3636943 - RNA, 18 nt, Salmonella enterica enterica serovar Typhi
caggccggauaagccgga

SEQ ID NO: 3636944 - RNA, 18 nt, Salmonella enterica enterica serovar Typhi
caggccggauaaggcagc

SEQ ID NO: 3636945 - RNA, 17 nt, Salmonella enterica enterica serovar Typhi
caggccggauggcggcu

SEQ ID NO: 3636946 - RNA, 22 nt, Salmonella enterica enterica serovar Typhi
caggccggauggcggcuuugaa

SEQ ID NO: 3636947 - RNA, 18 nt, Salmonella enterica enterica serovar Typhi
caggccgucggcgccagc

SEQ ID NO: 3636948 - RNA, 16 nt, Salmonella enterica enterica serovar Typhi
caggccuaacacaugc

SEQ ID NO: 3636949 - RNA, 20 nt, Salmonella enterica enterica serovar Typhi
caggccuacacguucgcuua

SEQ ID NO: 3636950 - RNA, 18 nt, Salmonella enterica enterica serovar Typhi
caggccuacacucugcgc

SEQ ID NO: 3636951 - RNA, 20 nt, Salmonella enterica enterica serovar Typhi
caggccuacacucugcgcgc

SEQ ID NO: 3636952 - RNA, 16 nt, Salmonella enterica enterica serovar Typhi
caggccuacauccggc

SEQ ID NO: 3636953 - RNA, 16 nt, Salmonella enterica enterica serovar Typhi
caggccuaccagccga

SEQ ID NO: 3636954 - RNA, 16 nt, Salmonella enterica enterica serovar Typhi
caggccuccugacgaa

SEQ ID NO: 3636955 - RNA, 16 nt, Salmonella enterica enterica serovar Typhi
caggccucuaucuucu

SEQ ID NO: 3636956 - RNA, 20 nt, Salmonella enterica enterica serovar Typhi
caggccugauaagcacaggc

SEQ ID NO: 3636957 - RNA, 19 nt, Salmonella enterica enterica serovar Typhi
caggccugauaagcgcagc

SEQ ID NO: 3636958 - RNA, 21 nt, Salmonella enterica enterica serovar Typhi
caggccugcauuugcuggcgu

SEQ ID NO: 3636959 - RNA, 22 nt, Salmonella enterica enterica serovar Typhi
caggccugcauuugcuggcgug

SEQ ID NO: 3636960 - RNA, 16 nt, Salmonella enterica enterica serovar Typhi
caggccugguuaacaa

SEQ ID NO: 3636961 - RNA, 17 nt, Salmonella enterica enterica serovar Typhi
caggccugguuaacaau

SEQ ID NO: 3636962 - RNA, 16 nt, Salmonella enterica enterica serovar Typhi
caggccuguaaaccgc

SEQ ID NO: 3636963 - RNA, 16 nt, Salmonella enterica enterica serovar Typhi
caggcgaauagcgcgc

SEQ ID NO: 3636964 - RNA, 18 nt, Salmonella enterica enterica serovar Typhi
caggcgaauagcgcgcua

SEQ ID NO: 3636965 - RNA, 13 nt, Salmonella enterica enterica serovar Typhi
caggcgacaugac

SEQ ID NO: 3636966 - RNA, 18 nt, Salmonella enterica enterica serovar Typhi
caggcgacaugacaucca

SEQ ID NO: 3636967 - RNA, 17 nt, Salmonella enterica enterica serovar Typhi
caggcgaccagaugcag

SEQ ID NO: 3636968 - RNA, 16 nt, Salmonella enterica enterica serovar Typhi
caggcgaccgggcaga

SEQ ID NO: 3636969 - RNA, 20 nt, Salmonella enterica enterica serovar Typhi
caggcgacgaaccgcguaac

SEQ ID NO: 3636970 - RNA, 17 nt, Salmonella enterica enterica serovar Typhi
caggcgacgccgccauc

SEQ ID NO: 3636971 - RNA, 23 nt, Salmonella enterica enterica serovar Typhi
caggcgacucauuacgccgcguu

SEQ ID NO: 3636972 - RNA, 15 nt, Salmonella enterica enterica serovar Typhi
caggcgagacgcgcc

SEQ ID NO: 3636973 - RNA, 19 nt, Salmonella enterica enterica serovar Typhi
caggcgauagccguccaug

SEQ ID NO: 3636974 - RNA, 20 nt, Salmonella enterica enterica serovar Typhi
caggcgauagccguccaugu

SEQ ID NO: 3636975 - RNA, 18 nt, Salmonella enterica enterica serovar Typhi
caggcgauccuguucaaa

SEQ ID NO: 3636976 - RNA, 19 nt, Salmonella enterica enterica serovar Typhi
caggcgauucggacucaua

SEQ ID NO: 3636977 - RNA, 15 nt, Salmonella enterica enterica serovar Typhi
caggcgauugccggu

SEQ ID NO: 3636978 - RNA, 21 nt, Salmonella enterica enterica serovar Typhi
caggcgauugccgguccguuc

SEQ ID NO: 3636979 - RNA, 24 nt, Salmonella enterica enterica serovar Typhi
caggcgcagagugagcaggcuaug

SEQ ID NO: 3636980 - RNA, 14 nt, Salmonella enterica enterica serovar Typhi
caggcgcaggcauu

SEQ ID NO: 3636981 - RNA, 16 nt, Salmonella enterica enterica serovar Typhi
caggcgcaucagaaaa

SEQ ID NO: 3636982 - RNA, 20 nt, Salmonella enterica enterica serovar Typhi
caggcgcgaauaaugcgucc

SEQ ID NO: 3636983 - RNA, 22 nt, Salmonella enterica enterica serovar Typhi
caggcgcgaaucgacaauccgc

SEQ ID NO: 3636984 - RNA, 19 nt, Salmonella enterica enterica serovar Typhi
caggcgcgaccucaucaaa

SEQ ID NO: 3636985 - RNA, 22 nt, Salmonella enterica enterica serovar Typhi
caggcgcuaucuucaauacgaa

SEQ ID NO: 3636986 - RNA, 19 nt, Salmonella enterica enterica serovar Typhi
caggcgcuauucccaggca

SEQ ID NO: 3636987 - RNA, 19 nt, Salmonella enterica enterica serovar Typhi
caggcgcuuaucgccguaa

SEQ ID NO: 3636988 - RNA, 19 nt, Salmonella enterica enterica serovar Typhi
caggcggaugaaacagucc

SEQ ID NO: 3636989 - RNA, 22 nt, Salmonella enterica enterica serovar Typhi
caggcggcaaaaaaugcauuga

SEQ ID NO: 3636990 - RNA, 14 nt, Salmonella enterica enterica serovar Typhi
caggcggcaugggu

SEQ ID NO: 3636991 - RNA, 16 nt, Salmonella enterica enterica serovar Typhi
caggcggcauggguaa

SEQ ID NO: 3636992 - RNA, 17 nt, Salmonella enterica enterica serovar Typhi
caggcggcauggguaaa

SEQ ID NO: 3636993 - RNA, 14 nt, Salmonella enterica enterica serovar Typhi
caggcggcguuaua

SEQ ID NO: 3636994 - RNA, 19 nt, Salmonella enterica enterica serovar Typhi
caggcgggaagcuucagca

SEQ ID NO: 3636995 - RNA, 21 nt, Salmonella enterica enterica serovar Typhi
caggcggggagggucagcagg

SEQ ID NO: 3636996 - RNA, 14 nt, Salmonella enterica enterica serovar Typhi
caggcgggugcgca

SEQ ID NO: 3636997 - RNA, 19 nt, Salmonella enterica enterica serovar Typhi
caggcgggugcgcagcccc

SEQ ID NO: 3636998 - RNA, 22 nt, Salmonella enterica enterica serovar Typhi
caggcgggugcgcagccccagc

SEQ ID NO: 3636999 - RNA, 16 nt, Salmonella enterica enterica serovar Typhi
caggcggguggugagc

SEQ ID NO: 3637000 - RNA, 17 nt, Salmonella enterica enterica serovar Typhi
caggcguagagaggcau

SEQ ID NO: 3637001 - RNA, 17 nt, Salmonella enterica enterica serovar Typhi
caggcgucaaaacaggu

SEQ ID NO: 3637002 - RNA, 20 nt, Salmonella enterica enterica serovar Typhi
caggcgucagcauggugugu

SEQ ID NO: 3637003 - RNA, 18 nt, Salmonella enterica enterica serovar Typhi
caggcgucauagccgcgc

SEQ ID NO: 3637004 - RNA, 22 nt, Salmonella enterica enterica serovar Typhi
caggcgucauagccgcgcguca

SEQ ID NO: 3637005 - RNA, 19 nt, Salmonella enterica enterica serovar Typhi
caggcgugguggauaucca

SEQ ID NO: 3637006 - RNA, 16 nt, Salmonella enterica enterica serovar Typhi
caggcguuagccgcca

SEQ ID NO: 3637007 - RNA, 14 nt, Salmonella enterica enterica serovar Typhi
caggcucagcgcca

SEQ ID NO: 3637008 - RNA, 17 nt, Salmonella enterica enterica serovar Typhi
caggcucaucagcgcca

SEQ ID NO: 3637009 - RNA, 18 nt, Salmonella enterica enterica serovar Typhi
caggcucaucagcgccau

SEQ ID NO: 3637010 - RNA, 17 nt, Salmonella enterica enterica serovar Typhi
caggcuccaaguauuga

SEQ ID NO: 3637011 - RNA, 17 nt, Salmonella enterica enterica serovar Typhi
caggcucucgguggugg

SEQ ID NO: 3637012 - RNA, 23 nt, Salmonella enterica enterica serovar Typhi
caggcugagcguagaccgcccag

SEQ ID NO: 3637013 - RNA, 15 nt, Salmonella enterica enterica serovar Typhi
caggcugccaaccag

SEQ ID NO: 3637014 - RNA, 12 nt, Salmonella enterica enterica serovar Typhi
caggcuggaaau

SEQ ID NO: 3637015 - RNA, 15 nt, Salmonella enterica enterica serovar Typhi
caggcuggagagcaa

SEQ ID NO: 3637016 - RNA, 21 nt, Salmonella enterica enterica serovar Typhi
caggcuggagagcaacgccau

SEQ ID NO: 3637017 - RNA, 14 nt, Salmonella enterica enterica serovar Typhi
caggcugucgcggc

SEQ ID NO: 3637018 - RNA, 16 nt, Salmonella enterica enterica serovar Typhi
caggcugucgcggcgg

SEQ ID NO: 3637019 - RNA, 15 nt, Salmonella enterica enterica serovar Typhi
caggcuguugcgcau

SEQ ID NO: 3637020 - RNA, 21 nt, Salmonella enterica enterica serovar Typhi
caggcuucaucggauagauga

SEQ ID NO: 3637021 - RNA, 22 nt, Salmonella enterica enterica serovar Typhi
caggcuucaucggauagaugaa

SEQ ID NO: 3637022 - RNA, 14 nt, Salmonella enterica enterica serovar Typhi
caggcuuccacgca

SEQ ID NO: 3637023 - RNA, 15 nt, Salmonella enterica enterica serovar Typhi
caggcuuccagauac

SEQ ID NO: 3637024 - RNA, 14 nt, Salmonella enterica enterica serovar Typhi
caggcuugcccauu

SEQ ID NO: 3637025 - RNA, 19 nt, Salmonella enterica enterica serovar Typhi
caggcuugcccauucgccg

SEQ ID NO: 3637026 - RNA, 19 nt, Salmonella enterica enterica serovar Typhi
caggcuuuaaauucagcac

SEQ ID NO: 3637027 - RNA, 16 nt, Salmonella enterica enterica serovar Typhi
caggcuuuccacguuc

SEQ ID NO: 3637028 - RNA, 21 nt, Salmonella enterica enterica serovar Typhi
caggcuuuccacguucccggu

SEQ ID NO: 3637029 - RNA, 15 nt, Salmonella enterica enterica serovar Typhi
caggcuuuucaggcu

SEQ ID NO: 3637030 - RNA, 20 nt, Salmonella enterica enterica serovar Typhi
cagggaaaagaaguggacuu

SEQ ID NO: 3637031 - RNA, 23 nt, Salmonella enterica enterica serovar Typhi
cagggaaaagaaguggacuucca

SEQ ID NO: 3637032 - RNA, 16 nt, Salmonella enterica enterica serovar Typhi
cagggaaaccauguug

SEQ ID NO: 3637033 - RNA, 14 nt, Salmonella enterica enterica serovar Typhi
cagggaaagccagu

SEQ ID NO: 3637034 - RNA, 22 nt, Salmonella enterica enterica serovar Typhi
cagggaaauggcgaacagcccg

SEQ ID NO: 3637035 - RNA, 19 nt, Salmonella enterica enterica serovar Typhi
cagggaauacccgcccggu

SEQ ID NO: 3637036 - RNA, 19 nt, Salmonella enterica enterica serovar Typhi
cagggacgcauccugcacu

SEQ ID NO: 3637037 - RNA, 13 nt, Salmonella enterica enterica serovar Typhi
cagggagggccaa

SEQ ID NO: 3637038 - RNA, 17 nt, Salmonella enterica enterica serovar Typhi
cagggauauacaaauau

SEQ ID NO: 3637039 - RNA, 16 nt, Salmonella enterica enterica serovar Typhi
cagggauauuccauac

SEQ ID NO: 3637040 - RNA, 19 nt, Salmonella enterica enterica serovar Typhi
cagggcaacggccagcgca

SEQ ID NO: 3637041 - RNA, 18 nt, Salmonella enterica enterica serovar Typhi
cagggcagcgagcaccga

SEQ ID NO: 3637042 - RNA, 21 nt, Salmonella enterica enterica serovar Typhi
cagggcaugauuacagauauc

SEQ ID NO: 3637043 - RNA, 14 nt, Salmonella enterica enterica serovar Typhi
cagggcgauaucca

SEQ ID NO: 3637044 - RNA, 15 nt, Salmonella enterica enterica serovar Typhi
cagggcgaugccuca

SEQ ID NO: 3637045 - RNA, 22 nt, Salmonella enterica enterica serovar Typhi
cagggcggcaaaaucuuuuucg

SEQ ID NO: 3637046 - RNA, 21 nt, Salmonella enterica enterica serovar Typhi
cagggcgggauccccugcucc

SEQ ID NO: 3637047 - RNA, 19 nt, Salmonella enterica enterica serovar Typhi
cagggcugaaucggcaccu

SEQ ID NO: 3637048 - RNA, 13 nt, Salmonella enterica enterica serovar Typhi
cagggcugcuggc

SEQ ID NO: 3637049 - RNA, 19 nt, Salmonella enterica enterica serovar Typhi
cagggcugcuggccuucca

SEQ ID NO: 3637050 - RNA, 20 nt, Salmonella enterica enterica serovar Typhi
cagggcuuuuuucucgcgcu

SEQ ID NO: 3637051 - RNA, 20 nt, Salmonella enterica enterica serovar Typhi
caggggaugauuuucaggca

SEQ ID NO: 3637052 - RNA, 19 nt, Salmonella enterica enterica serovar Typhi
caggggcucuaaaaaggaa

SEQ ID NO: 3637053 - RNA, 18 nt, Salmonella enterica enterica serovar Typhi
cagggggaguccauuucc

SEQ ID NO: 3637054 - RNA, 23 nt, Salmonella enterica enterica serovar Typhi
caggggggaaaugagaaaaggaa

SEQ ID NO: 3637055 - RNA, 16 nt, Salmonella enterica enterica serovar Typhi
cagggguuccggcaau

SEQ ID NO: 3637056 - RNA, 17 nt, Salmonella enterica enterica serovar Typhi
caggguaaucaccauua

SEQ ID NO: 3637057 - RNA, 21 nt, Salmonella enterica enterica serovar Typhi
caggguaucauuaugggcagc

SEQ ID NO: 3637058 - RNA, 22 nt, Salmonella enterica enterica serovar Typhi
caggguaucauuaugggcagca

SEQ ID NO: 3637059 - RNA, 23 nt, Salmonella enterica enterica serovar Typhi
caggguaucauuaugggcagcac

SEQ ID NO: 3637060 - RNA, 16 nt, Salmonella enterica enterica serovar Typhi
caggguaucuaacccg

SEQ ID NO: 3637061 - RNA, 22 nt, Salmonella enterica enterica serovar Typhi
caggguaugucgguagcgccag

SEQ ID NO: 3637062 - RNA, 14 nt, Salmonella enterica enterica serovar Typhi
cagggucaggaacu

SEQ ID NO: 3637063 - RNA, 21 nt, Salmonella enterica enterica serovar Typhi
cagggucaggaacugcggcca

SEQ ID NO: 3637064 - RNA, 16 nt, Salmonella enterica enterica serovar Typhi
caggguccccauaucc

SEQ ID NO: 3637065 - RNA, 17 nt, Salmonella enterica enterica serovar Typhi
caggguccccauauccc

SEQ ID NO: 3637066 - RNA, 21 nt, Salmonella enterica enterica serovar Typhi
cagggucgcggcauuaaaugc

SEQ ID NO: 3637067 - RNA, 17 nt, Salmonella enterica enterica serovar Typhi
cagggucuuauuucucc

SEQ ID NO: 3637068 - RNA, 23 nt, Salmonella enterica enterica serovar Typhi
cagggucuuauuucuccugcgcc

SEQ ID NO: 3637069 - RNA, 16 nt, Salmonella enterica enterica serovar Typhi
cagggugaugguguca

SEQ ID NO: 3637070 - RNA, 12 nt, Salmonella enterica enterica serovar Typhi
caggguggcgcu

SEQ ID NO: 3637071 - RNA, 17 nt, Salmonella enterica enterica serovar Typhi
caggguucacugccagu

SEQ ID NO: 3637072 - RNA, 22 nt, Salmonella enterica enterica serovar Typhi
caggguuccguucccaaugcuu

SEQ ID NO: 3637073 - RNA, 14 nt, Salmonella enterica enterica serovar Typhi
caggguugcguucg

SEQ ID NO: 3637074 - RNA, 13 nt, Salmonella enterica enterica serovar Typhi
caggguugucuca

SEQ ID NO: 3637075 - RNA, 18 nt, Salmonella enterica enterica serovar Typhi
caggguuuaaucacgcca

SEQ ID NO: 3637076 - RNA, 18 nt, Salmonella enterica enterica serovar Typhi
caggguuugccagcacca

SEQ ID NO: 3637077 - RNA, 21 nt, Salmonella enterica enterica serovar Typhi
caggguuugccagcaccagca

SEQ ID NO: 3637078 - RNA, 23 nt, Salmonella enterica enterica serovar Typhi
caggguuugcgcagacugcgcca

SEQ ID NO: 3637079 - RNA, 16 nt, Salmonella enterica enterica serovar Typhi
caggguuuuacgcugg

SEQ ID NO: 3637080 - RNA, 17 nt, Salmonella enterica enterica serovar Typhi
caggguuuucuaccgca

SEQ ID NO: 3637081 - RNA, 13 nt, Salmonella enterica enterica serovar Typhi
cagguaaaccggu

SEQ ID NO: 3637082 - RNA, 18 nt, Salmonella enterica enterica serovar Typhi
cagguaaaccggucaggu

SEQ ID NO: 3637083 - RNA, 20 nt, Salmonella enterica enterica serovar Typhi
cagguaaaccggucagguag

SEQ ID NO: 3637084 - RNA, 17 nt, Salmonella enterica enterica serovar Typhi
cagguaauacgcgucug

SEQ ID NO: 3637085 - RNA, 23 nt, Salmonella enterica enterica serovar Typhi
cagguaaucaucaccguuuucca

SEQ ID NO: 3637086 - RNA, 15 nt, Salmonella enterica enterica serovar Typhi
cagguaaugacuuuu

SEQ ID NO: 3637087 - RNA, 16 nt, Salmonella enterica enterica serovar Typhi
cagguacagguaauga

SEQ ID NO: 3637088 - RNA, 21 nt, Salmonella enterica enterica serovar Typhi
cagguaccccagccauauuuc

SEQ ID NO: 3637089 - RNA, 22 nt, Salmonella enterica enterica serovar Typhi
cagguacgcguuucacaaccuc

SEQ ID NO: 3637090 - RNA, 14 nt, Salmonella enterica enterica serovar Typhi
cagguagcagaccg

SEQ ID NO: 3637091 - RNA, 18 nt, Salmonella enterica enterica serovar Typhi
cagguagcagaccgguac

SEQ ID NO: 3637092 - RNA, 12 nt, Salmonella enterica enterica serovar Typhi
cagguagcgucg

SEQ ID NO: 3637093 - RNA, 21 nt, Salmonella enterica enterica serovar Typhi
cagguaguuaccguauucugc

SEQ ID NO: 3637094 - RNA, 17 nt, Salmonella enterica enterica serovar Typhi
cagguaguugucggcgg

SEQ ID NO: 3637095 - RNA, 19 nt, Salmonella enterica enterica serovar Typhi
cagguaucccgccagcggc

SEQ ID NO: 3637096 - RNA, 23 nt, Salmonella enterica enterica serovar Typhi
cagguaucccgccagcggcgcca

SEQ ID NO: 3637097 - RNA, 19 nt, Salmonella enterica enterica serovar Typhi
cagguaugcuucagcguug

SEQ ID NO: 3637098 - RNA, 16 nt, Salmonella enterica enterica serovar Typhi
cagguauuaaauacag

SEQ ID NO: 3637099 - RNA, 23 nt, Salmonella enterica enterica serovar Typhi
cagguauuaaauacagagucgcu

SEQ ID NO: 3637100 - RNA, 16 nt, Salmonella enterica enterica serovar Typhi
cagguauucaccaaaa

SEQ ID NO: 3637101 - RNA, 20 nt, Salmonella enterica enterica serovar Typhi
cagguauucuaacugaucag

SEQ ID NO: 3637102 - RNA, 21 nt, Salmonella enterica enterica serovar Typhi
caggucaaaauuaaucgccag

SEQ ID NO: 3637103 - RNA, 23 nt, Salmonella enterica enterica serovar Typhi
caggucaucaccuccagcacgcg

SEQ ID NO: 3637104 - RNA, 20 nt, Salmonella enterica enterica serovar Typhi
caggucgccagaagccgucg

SEQ ID NO: 3637105 - RNA, 15 nt, Salmonella enterica enterica serovar Typhi
caggucgccagcggg

SEQ ID NO: 3637106 - RNA, 13 nt, Salmonella enterica enterica serovar Typhi
caggucgcucuuu

SEQ ID NO: 3637107 - RNA, 16 nt, Salmonella enterica enterica serovar Typhi
caggucggccaaccgc

SEQ ID NO: 3637108 - RNA, 14 nt, Salmonella enterica enterica serovar Typhi
caggucugcaccac

SEQ ID NO: 3637109 - RNA, 13 nt, Salmonella enterica enterica serovar Typhi
caggucugcgcgu

SEQ ID NO: 3637110 - RNA, 14 nt, Salmonella enterica enterica serovar Typhi
caggugaacauuac

SEQ ID NO: 3637111 - RNA, 13 nt, Salmonella enterica enterica serovar Typhi
caggugaccaggc

SEQ ID NO: 3637112 - RNA, 17 nt, Salmonella enterica enterica serovar Typhi
caggugaucuguucaaa

SEQ ID NO: 3637113 - RNA, 18 nt, Salmonella enterica enterica serovar Typhi
caggugccgacucgcgca

SEQ ID NO: 3637114 - RNA, 15 nt, Salmonella enterica enterica serovar Typhi
caggugcggcugggc

SEQ ID NO: 3637115 - RNA, 13 nt, Salmonella enterica enterica serovar Typhi
caggugcugccac

SEQ ID NO: 3637116 - RNA, 18 nt, Salmonella enterica enterica serovar Typhi
cagguggaucggaaauca

SEQ ID NO: 3637117 - RNA, 22 nt, Salmonella enterica enterica serovar Typhi
cagguggauuuuugcugguugu

SEQ ID NO: 3637118 - RNA, 20 nt, Salmonella enterica enterica serovar Typhi
caggugguacaucaaaucag

SEQ ID NO: 3637119 - RNA, 18 nt, Salmonella enterica enterica serovar Typhi
caggugucguuaaugcuc

SEQ ID NO: 3637120 - RNA, 18 nt, Salmonella enterica enterica serovar Typhi
cagguguuaaucauuuuc

SEQ ID NO: 3637121 - RNA, 23 nt, Salmonella enterica enterica serovar Typhi
cagguguuauucgcccaaaugca

SEQ ID NO: 3637122 - RNA, 17 nt, Salmonella enterica enterica serovar Typhi
cagguuaaagccucuuu

SEQ ID NO: 3637123 - RNA, 15 nt, Salmonella enterica enterica serovar Typhi
cagguuacucuucca

SEQ ID NO: 3637124 - RNA, 20 nt, Salmonella enterica enterica serovar Typhi
cagguuacucuuccaccauc

SEQ ID NO: 3637125 - RNA, 15 nt, Salmonella enterica enterica serovar Typhi
cagguuagcagccac

SEQ ID NO: 3637126 - RNA, 15 nt, Salmonella enterica enterica serovar Typhi
cagguuauacuguga

SEQ ID NO: 3637127 - RNA, 14 nt, Salmonella enterica enterica serovar Typhi
cagguuaucgccgc

SEQ ID NO: 3637128 - RNA, 12 nt, Salmonella enterica enterica serovar Typhi
cagguucagcaa

SEQ ID NO: 3637129 - RNA, 16 nt, Salmonella enterica enterica serovar Typhi
cagguuccccaaugau

SEQ ID NO: 3637130 - RNA, 22 nt, Salmonella enterica enterica serovar Typhi
cagguucccgcccugcccgcca

SEQ ID NO: 3637131 - RNA, 15 nt, Salmonella enterica enterica serovar Typhi
cagguucgaaucccg

SEQ ID NO: 3637132 - RNA, 18 nt, Salmonella enterica enterica serovar Typhi
cagguugccagaaacaac

SEQ ID NO: 3637133 - RNA, 19 nt, Salmonella enterica enterica serovar Typhi
cagguugcguaacgccaca

SEQ ID NO: 3637134 - RNA, 16 nt, Salmonella enterica enterica serovar Typhi
cagguugcguccgccg

SEQ ID NO: 3637135 - RNA, 18 nt, Salmonella enterica enterica serovar Typhi
cagguugcguccgccgcu

SEQ ID NO: 3637136 - RNA, 19 nt, Salmonella enterica enterica serovar Typhi
cagguugcguccgccgcua

SEQ ID NO: 3637137 - RNA, 17 nt, Salmonella enterica enterica serovar Typhi
cagguuuacccugauuu

SEQ ID NO: 3637138 - RNA, 21 nt, Salmonella enterica enterica serovar Typhi
cagguuuacccugauuuucaa

SEQ ID NO: 3637139 - RNA, 13 nt, Salmonella enterica enterica serovar Typhi
cagguuucaucgc

SEQ ID NO: 3637140 - RNA, 20 nt, Salmonella enterica enterica serovar Typhi
cagguuucuggcaacagcca

SEQ ID NO: 3637141 - RNA, 15 nt, Salmonella enterica enterica serovar Typhi
cagguuuuuaagcug

SEQ ID NO: 3637142 - RNA, 17 nt, Salmonella enterica enterica serovar Typhi
cagguuuuuaagcugcc

SEQ ID NO: 3637143 - RNA, 22 nt, Salmonella enterica enterica serovar Typhi
cagguuuuuugugaguucauaa

SEQ ID NO: 3637144 - RNA, 21 nt, Salmonella enterica enterica serovar Typhi
cagguuuuuuuauaacauaaa

SEQ ID NO: 3637145 - RNA, 22 nt, Salmonella enterica enterica serovar Typhi
caguaaagauuuguuucaucgc

SEQ ID NO: 3637146 - RNA, 20 nt, Salmonella enterica enterica serovar Typhi
caguaaaucccgcaucaccc

SEQ ID NO: 3637147 - RNA, 16 nt, Salmonella enterica enterica serovar Typhi
caguaaauuaaacagc

SEQ ID NO: 3637148 - RNA, 17 nt, Salmonella enterica enterica serovar Typhi
caguaaauuaaacagcu

SEQ ID NO: 3637149 - RNA, 20 nt, Salmonella enterica enterica serovar Typhi
caguaaauuaaacagcugua

SEQ ID NO: 3637150 - RNA, 19 nt, Salmonella enterica enterica serovar Typhi
caguaacaucgaaugucga

SEQ ID NO: 3637151 - RNA, 15 nt, Salmonella enterica enterica serovar Typhi
caguaaccgccacag

SEQ ID NO: 3637152 - RNA, 16 nt, Salmonella enterica enterica serovar Typhi
caguaaccgccacagc

SEQ ID NO: 3637153 - RNA, 21 nt, Salmonella enterica enterica serovar Typhi
caguaaccuauuuuacaaaau

SEQ ID NO: 3637154 - RNA, 15 nt, Salmonella enterica enterica serovar Typhi
caguaacgcacuuuu

SEQ ID NO: 3637155 - RNA, 18 nt, Salmonella enterica enterica serovar Typhi
caguaacucaucgccagc

SEQ ID NO: 3637156 - RNA, 13 nt, Salmonella enterica enterica serovar Typhi
caguaagaucacc

SEQ ID NO: 3637157 - RNA, 22 nt, Salmonella enterica enterica serovar Typhi
caguaagcguaccauuccauuc

SEQ ID NO: 3637158 - RNA, 24 nt, Salmonella enterica enterica serovar Typhi
caguaagggcagccgagacuaucg

SEQ ID NO: 3637159 - RNA, 16 nt, Salmonella enterica enterica serovar Typhi
caguaauaauauaaag

SEQ ID NO: 3637160 - RNA, 21 nt, Salmonella enterica enterica serovar Typhi
caguaauauaaccaauuuaaa

SEQ ID NO: 3637161 - RNA, 22 nt, Salmonella enterica enterica serovar Typhi
caguaauauaaccaauuuaaaa

SEQ ID NO: 3637162 - RNA, 20 nt, Salmonella enterica enterica serovar Typhi
caguaauauccccaucccag

SEQ ID NO: 3637163 - RNA, 23 nt, Salmonella enterica enterica serovar Typhi
caguaauaucgccucccugccua

SEQ ID NO: 3637164 - RNA, 17 nt, Salmonella enterica enterica serovar Typhi
caguaauaugaauugau

SEQ ID NO: 3637165 - RNA, 22 nt, Salmonella enterica enterica serovar Typhi
caguaaucccggucgcgccagc

SEQ ID NO: 3637166 - RNA, 16 nt, Salmonella enterica enterica serovar Typhi
caguaaucgcacggcu

SEQ ID NO: 3637167 - RNA, 23 nt, Salmonella enterica enterica serovar Typhi
caguaauggacagguaaaccggu

SEQ ID NO: 3637168 - RNA, 14 nt, Salmonella enterica enterica serovar Typhi
caguaauuuuucuc

SEQ ID NO: 3637169 - RNA, 22 nt, Salmonella enterica enterica serovar Typhi
caguaauuuuucucccagcaga

SEQ ID NO: 3637170 - RNA, 23 nt, Salmonella enterica enterica serovar Typhi
caguaauuuuucucccagcagac

SEQ ID NO: 3637171 - RNA, 16 nt, Salmonella enterica enterica serovar Typhi
caguacaaacaaauaa

SEQ ID NO: 3637172 - RNA, 17 nt, Salmonella enterica enterica serovar Typhi
caguacaaacaaauaaa

SEQ ID NO: 3637173 - RNA, 21 nt, Salmonella enterica enterica serovar Typhi
caguacaaacaaauaaaucca

SEQ ID NO: 3637174 - RNA, 17 nt, Salmonella enterica enterica serovar Typhi
caguacagacuggaugg

SEQ ID NO: 3637175 - RNA, 14 nt, Salmonella enterica enterica serovar Typhi
caguacagcagcga

SEQ ID NO: 3637176 - RNA, 19 nt, Salmonella enterica enterica serovar Typhi
caguacagccaaaaauaac

SEQ ID NO: 3637177 - RNA, 12 nt, Salmonella enterica enterica serovar Typhi
caguacaggcau

SEQ ID NO: 3637178 - RNA, 13 nt, Salmonella enterica enterica serovar Typhi
caguaccagcgag

SEQ ID NO: 3637179 - RNA, 14 nt, Salmonella enterica enterica serovar Typhi
caguaccagcgaga

SEQ ID NO: 3637180 - RNA, 17 nt, Salmonella enterica enterica serovar Typhi
caguacccgcacgcuuu

SEQ ID NO: 3637181 - RNA, 17 nt, Salmonella enterica enterica serovar Typhi
caguaccgccuucagcg

SEQ ID NO: 3637182 - RNA, 22 nt, Salmonella enterica enterica serovar Typhi
caguaccgccuucagcgcgccc

SEQ ID NO: 3637183 - RNA, 22 nt, Salmonella enterica enterica serovar Typhi
caguaccgggccuccuuuccug

SEQ ID NO: 3637184 - RNA, 22 nt, Salmonella enterica enterica serovar Typhi
caguaccugacuuuuccauacu

SEQ ID NO: 3637185 - RNA, 15 nt, Salmonella enterica enterica serovar Typhi
caguaccuucaacgc

SEQ ID NO: 3637186 - RNA, 19 nt, Salmonella enterica enterica serovar Typhi
caguacgaucaugagucgc

SEQ ID NO: 3637187 - RNA, 21 nt, Salmonella enterica enterica serovar Typhi
caguacgcguucuacgguauc

SEQ ID NO: 3637188 - RNA, 23 nt, Salmonella enterica enterica serovar Typhi
caguacggaaaugaucagacgca

SEQ ID NO: 3637189 - RNA, 13 nt, Salmonella enterica enterica serovar Typhi
caguacggucagg

SEQ ID NO: 3637190 - RNA, 20 nt, Salmonella enterica enterica serovar Typhi
caguagaucgacauaagagu

SEQ ID NO: 3637191 - RNA, 12 nt, Salmonella enterica enterica serovar Typhi
caguagauggcg

SEQ ID NO: 3637192 - RNA, 17 nt, Salmonella enterica enterica serovar Typhi
caguagauggcgcuaaa

SEQ ID NO: 3637193 - RNA, 18 nt, Salmonella enterica enterica serovar Typhi
caguagcagacagccgau

SEQ ID NO: 3637194 - RNA, 12 nt, Salmonella enterica enterica serovar Typhi
caguagccaugc

SEQ ID NO: 3637195 - RNA, 20 nt, Salmonella enterica enterica serovar Typhi
caguagccgccgcaggacag

SEQ ID NO: 3637196 - RNA, 16 nt, Salmonella enterica enterica serovar Typhi
caguagcgcgacgcca

SEQ ID NO: 3637197 - RNA, 22 nt, Salmonella enterica enterica serovar Typhi
caguagcgcgacgccaaaccug

SEQ ID NO: 3637198 - RNA, 14 nt, Salmonella enterica enterica serovar Typhi
caguaggacaaaaa

SEQ ID NO: 3637199 - RNA, 18 nt, Salmonella enterica enterica serovar Typhi
caguaggcaugcacucca

SEQ ID NO: 3637200 - RNA, 21 nt, Salmonella enterica enterica serovar Typhi
caguaggcgaacuucauccac

SEQ ID NO: 3637201 - RNA, 13 nt, Salmonella enterica enterica serovar Typhi
caguaguaaaccg

SEQ ID NO: 3637202 - RNA, 14 nt, Salmonella enterica enterica serovar Typhi
caguagucgcgcca

SEQ ID NO: 3637203 - RNA, 15 nt, Salmonella enterica enterica serovar Typhi
caguauaaauaccuu

SEQ ID NO: 3637204 - RNA, 17 nt, Salmonella enterica enterica serovar Typhi
caguaucguguuauuuu

SEQ ID NO: 3637205 - RNA, 23 nt, Salmonella enterica enterica serovar Typhi
cagucaaaacgacauaaccggca

SEQ ID NO: 3637206 - RNA, 23 nt, Salmonella enterica enterica serovar Typhi
cagucaacgaggugaauaaaucc

SEQ ID NO: 3637207 - RNA, 16 nt, Salmonella enterica enterica serovar Typhi
cagucagaggaauucu

SEQ ID NO: 3637208 - RNA, 17 nt, Salmonella enterica enterica serovar Typhi
cagucagcaauuaacaa

SEQ ID NO: 3637209 - RNA, 18 nt, Salmonella enterica enterica serovar Typhi
cagucagcaauuaacaaa

SEQ ID NO: 3637210 - RNA, 11 nt, Salmonella enterica enterica serovar Typhi
cagucagcucc

SEQ ID NO: 3637211 - RNA, 12 nt, Salmonella enterica enterica serovar Typhi
cagucaguuuau

SEQ ID NO: 3637212 - RNA, 13 nt, Salmonella enterica enterica serovar Typhi
cagucaucgcgcc

SEQ ID NO: 3637213 - RNA, 17 nt, Salmonella enterica enterica serovar Typhi
cagucaucgcgccaaac

SEQ ID NO: 3637214 - RNA, 17 nt, Salmonella enterica enterica serovar Typhi
cagucaugaaaucgauu

SEQ ID NO: 3637215 - RNA, 15 nt, Salmonella enterica enterica serovar Typhi
cagucauggcuuuua

SEQ ID NO: 3637216 - RNA, 21 nt, Salmonella enterica enterica serovar Typhi
cagucauuaauucccgcagcc

SEQ ID NO: 3637217 - RNA, 17 nt, Salmonella enterica enterica serovar Typhi
cagucauucucuuucug

SEQ ID NO: 3637218 - RNA, 17 nt, Salmonella enterica enterica serovar Typhi
cagucauuugcagguua

SEQ ID NO: 3637219 - RNA, 19 nt, Salmonella enterica enterica serovar Typhi
caguccaccuguaaccgcu

SEQ ID NO: 3637220 - RNA, 12 nt, Salmonella enterica enterica serovar Typhi
caguccagaugc

SEQ ID NO: 3637221 - RNA, 21 nt, Salmonella enterica enterica serovar Typhi
caguccccagcguaccacgcc

SEQ ID NO: 3637222 - RNA, 23 nt, Salmonella enterica enterica serovar Typhi
caguccccagcguaccacgccgc

SEQ ID NO: 3637223 - RNA, 17 nt, Salmonella enterica enterica serovar Typhi
caguccgggcauaaccu

SEQ ID NO: 3637224 - RNA, 23 nt, Salmonella enterica enterica serovar Typhi
caguccgggccgugacacauuug

SEQ ID NO: 3637225 - RNA, 18 nt, Salmonella enterica enterica serovar Typhi
caguccuccggcugaagc

SEQ ID NO: 3637226 - RNA, 22 nt, Salmonella enterica enterica serovar Typhi
caguccuccggcugaagcccca

SEQ ID NO: 3637227 - RNA, 18 nt, Salmonella enterica enterica serovar Typhi
caguccugucccugccag

SEQ ID NO: 3637228 - RNA, 14 nt, Salmonella enterica enterica serovar Typhi
caguccuuccgccg

SEQ ID NO: 3637229 - RNA, 23 nt, Salmonella enterica enterica serovar Typhi
cagucgauguggccuuccucguc

SEQ ID NO: 3637230 - RNA, 16 nt, Salmonella enterica enterica serovar Typhi
cagucgcagagcccag

SEQ ID NO: 3637231 - RNA, 12 nt, Salmonella enterica enterica serovar Typhi
cagucgcgccgu

SEQ ID NO: 3637232 - RNA, 20 nt, Salmonella enterica enterica serovar Typhi
cagucgcuauggugcggggu

SEQ ID NO: 3637233 - RNA, 14 nt, Salmonella enterica enterica serovar Typhi
cagucgcuccacca

SEQ ID NO: 3637234 - RNA, 23 nt, Salmonella enterica enterica serovar Typhi
cagucgcucuaucgccuggagcu

SEQ ID NO: 3637235 - RNA, 14 nt, Salmonella enterica enterica serovar Typhi
cagucggcgaacuu

SEQ ID NO: 3637236 - RNA, 19 nt, Salmonella enterica enterica serovar Typhi
cagucgggaucgccagauc

SEQ ID NO: 3637237 - RNA, 23 nt, Salmonella enterica enterica serovar Typhi
cagucguuaucugacauauacaa

SEQ ID NO: 3637238 - RNA, 18 nt, Salmonella enterica enterica serovar Typhi
cagucucaaaggccugca

SEQ ID NO: 3637239 - RNA, 19 nt, Salmonella enterica enterica serovar Typhi
cagucugcagaccuguucu

SEQ ID NO: 3637240 - RNA, 13 nt, Salmonella enterica enterica serovar Typhi
cagucugcccggc

SEQ ID NO: 3637241 - RNA, 21 nt, Salmonella enterica enterica serovar Typhi
cagucuggcggcagccgacag

SEQ ID NO: 3637242 - RNA, 17 nt, Salmonella enterica enterica serovar Typhi
cagugaaaaaccgaucu

SEQ ID NO: 3637243 - RNA, 18 nt, Salmonella enterica enterica serovar Typhi
cagugaaaccggcgcgcc

SEQ ID NO: 3637244 - RNA, 19 nt, Salmonella enterica enterica serovar Typhi
cagugaaaccggcgcgccu

SEQ ID NO: 3637245 - RNA, 13 nt, Salmonella enterica enterica serovar Typhi
cagugaaauaaau

SEQ ID NO: 3637246 - RNA, 21 nt, Salmonella enterica enterica serovar Typhi
cagugaaauuugucgauaaaa

SEQ ID NO: 3637247 - RNA, 18 nt, Salmonella enterica enterica serovar Typhi
cagugaauuaugaccaau

SEQ ID NO: 3637248 - RNA, 21 nt, Salmonella enterica enterica serovar Typhi
cagugacaaacucacguuccc

SEQ ID NO: 3637249 - RNA, 17 nt, Salmonella enterica enterica serovar Typhi
cagugacagaggaauga

SEQ ID NO: 3637250 - RNA, 15 nt, Salmonella enterica enterica serovar Typhi
cagugacauuuaucu

SEQ ID NO: 3637251 - RNA, 21 nt, Salmonella enterica enterica serovar Typhi
cagugacccgccgccagcacc

SEQ ID NO: 3637252 - RNA, 13 nt, Salmonella enterica enterica serovar Typhi
cagugacgccagu

SEQ ID NO: 3637253 - RNA, 16 nt, Salmonella enterica enterica serovar Typhi
cagugacgccaguucc

SEQ ID NO: 3637254 - RNA, 17 nt, Salmonella enterica enterica serovar Typhi
cagugagcccuccucca

SEQ ID NO: 3637255 - RNA, 22 nt, Salmonella enterica enterica serovar Typhi
cagugauccaucgguucucugc

SEQ ID NO: 3637256 - RNA, 16 nt, Salmonella enterica enterica serovar Typhi
cagugauggauuucac

SEQ ID NO: 3637257 - RNA, 24 nt, Salmonella enterica enterica serovar Typhi
cagugauuacaaaaugugcaauca

SEQ ID NO: 3637258 - RNA, 17 nt, Salmonella enterica enterica serovar Typhi
cagugauuaugcucccg

SEQ ID NO: 3637259 - RNA, 22 nt, Salmonella enterica enterica serovar Typhi
cagugauuuacuccaaaaauaa

SEQ ID NO: 3637260 - RNA, 23 nt, Salmonella enterica enterica serovar Typhi
cagugccugauagcgcugugcua

SEQ ID NO: 3637261 - RNA, 17 nt, Salmonella enterica enterica serovar Typhi
cagugccugguggcgac

SEQ ID NO: 3637262 - RNA, 12 nt, Salmonella enterica enterica serovar Typhi
cagugcgauacc

SEQ ID NO: 3637263 - RNA, 16 nt, Salmonella enterica enterica serovar Typhi
cagugcgauaccggcc

SEQ ID NO: 3637264 - RNA, 12 nt, Salmonella enterica enterica serovar Typhi
cagugcgcgacc

SEQ ID NO: 3637265 - RNA, 16 nt, Salmonella enterica enterica serovar Typhi
caguggacgcgucgcu

SEQ ID NO: 3637266 - RNA, 23 nt, Salmonella enterica enterica serovar Typhi
caguggcuuaccguaugcaaaag

SEQ ID NO: 3637267 - RNA, 20 nt, Salmonella enterica enterica serovar Typhi
cagugggcgucaaaaucccg

SEQ ID NO: 3637268 - RNA, 22 nt, Salmonella enterica enterica serovar Typhi
cagugggcgucaaaaucccggc

SEQ ID NO: 3637269 - RNA, 16 nt, Salmonella enterica enterica serovar Typhi
caguguaaacgccaga

SEQ ID NO: 3637270 - RNA, 24 nt, Salmonella enterica enterica serovar Typhi
caguguacauagcuuugccacugg

SEQ ID NO: 3637271 - RNA, 19 nt, Salmonella enterica enterica serovar Typhi
caguguucccugcgcugga

SEQ ID NO: 3637272 - RNA, 17 nt, Salmonella enterica enterica serovar Typhi
caguguugauugaaacu

SEQ ID NO: 3637273 - RNA, 23 nt, Salmonella enterica enterica serovar Typhi
caguguugauugaaacucgccau

SEQ ID NO: 3637274 - RNA, 17 nt, Salmonella enterica enterica serovar Typhi
caguguuucccaacaau

SEQ ID NO: 3637275 - RNA, 22 nt, Salmonella enterica enterica serovar Typhi
caguguuucccaacaaugccac

SEQ ID NO: 3637276 - RNA, 19 nt, Salmonella enterica enterica serovar Typhi
caguuaacagaaugcugaa

SEQ ID NO: 3637277 - RNA, 21 nt, Salmonella enterica enterica serovar Typhi
caguuaacgcguaaucuucca

SEQ ID NO: 3637278 - RNA, 14 nt, Salmonella enterica enterica serovar Typhi
caguuaauaaugaa

SEQ ID NO: 3637279 - RNA, 20 nt, Salmonella enterica enterica serovar Typhi
caguuaaugccgacccaccu

SEQ ID NO: 3637280 - RNA, 22 nt, Salmonella enterica enterica serovar Typhi
caguuauuaaucaagcccagcu

SEQ ID NO: 3637281 - RNA, 24 nt, Salmonella enterica enterica serovar Typhi
caguuauuaaucaagcccagcuca

SEQ ID NO: 3637282 - RNA, 18 nt, Salmonella enterica enterica serovar Typhi
caguuauuuuacgggcgu

SEQ ID NO: 3637283 - RNA, 14 nt, Salmonella enterica enterica serovar Typhi
caguuauuuuuuuu

SEQ ID NO: 3637284 - RNA, 19 nt, Salmonella enterica enterica serovar Typhi
caguucaaacggcccggcg

SEQ ID NO: 3637285 - RNA, 13 nt, Salmonella enterica enterica serovar Typhi
caguucaaucagg

SEQ ID NO: 3637286 - RNA, 16 nt, Salmonella enterica enterica serovar Typhi
caguucaccggcggcc

SEQ ID NO: 3637287 - RNA, 19 nt, Salmonella enterica enterica serovar Typhi
caguucacuccuaagagaa

SEQ ID NO: 3637288 - RNA, 20 nt, Salmonella enterica enterica serovar Typhi
caguucacuccuaagagaaa

SEQ ID NO: 3637289 - RNA, 21 nt, Salmonella enterica enterica serovar Typhi
caguucacuccuaagagaaaa

SEQ ID NO: 3637290 - RNA, 14 nt, Salmonella enterica enterica serovar Typhi
caguucagaaacgg

SEQ ID NO: 3637291 - RNA, 22 nt, Salmonella enterica enterica serovar Typhi
caguucagacaccacgccggaa

SEQ ID NO: 3637292 - RNA, 14 nt, Salmonella enterica enterica serovar Typhi
caguucagccgcca

SEQ ID NO: 3637293 - RNA, 19 nt, Salmonella enterica enterica serovar Typhi
caguucauccacgucauaa

SEQ ID NO: 3637294 - RNA, 13 nt, Salmonella enterica enterica serovar Typhi
caguucauuccgc

SEQ ID NO: 3637295 - RNA, 19 nt, Salmonella enterica enterica serovar Typhi
caguucauuucaggcaaag

SEQ ID NO: 3637296 - RNA, 17 nt, Salmonella enterica enterica serovar Typhi
caguuccaaucucuuuu

SEQ ID NO: 3637297 - RNA, 15 nt, Salmonella enterica enterica serovar Typhi
caguuccccgccgcg

SEQ ID NO: 3637298 - RNA, 20 nt, Salmonella enterica enterica serovar Typhi
caguuccgccagacucagcc

SEQ ID NO: 3637299 - RNA, 12 nt, Salmonella enterica enterica serovar Typhi
caguuccugugc

SEQ ID NO: 3637300 - RNA, 22 nt, Salmonella enterica enterica serovar Typhi
caguucgauaaucccggcgcgc

SEQ ID NO: 3637301 - RNA, 21 nt, Salmonella enterica enterica serovar Typhi
caguucgccuucuucaucuuc

SEQ ID NO: 3637302 - RNA, 22 nt, Salmonella enterica enterica serovar Typhi
caguucgccuucuucaucuuca

SEQ ID NO: 3637303 - RNA, 16 nt, Salmonella enterica enterica serovar Typhi
caguucguucugcguc

SEQ ID NO: 3637304 - RNA, 13 nt, Salmonella enterica enterica serovar Typhi
caguugcagcacc

SEQ ID NO: 3637305 - RNA, 20 nt, Salmonella enterica enterica serovar Typhi
caguugcgacuguucaucaa

SEQ ID NO: 3637306 - RNA, 23 nt, Salmonella enterica enterica serovar Typhi
caguugcgcgguuaacagccgcu

SEQ ID NO: 3637307 - RNA, 16 nt, Salmonella enterica enterica serovar Typhi
caguugcggcaucaga

SEQ ID NO: 3637308 - RNA, 17 nt, Salmonella enterica enterica serovar Typhi
caguuggucgcguuuac

SEQ ID NO: 3637309 - RNA, 23 nt, Salmonella enterica enterica serovar Typhi
caguuuacgagugcguucuucca

SEQ ID NO: 3637310 - RNA, 17 nt, Salmonella enterica enterica serovar Typhi
caguuuagggaucaucu

SEQ ID NO: 3637311 - RNA, 14 nt, Salmonella enterica enterica serovar Typhi
caguuucaucaucg

SEQ ID NO: 3637312 - RNA, 15 nt, Salmonella enterica enterica serovar Typhi
caguuucgccagcgc

SEQ ID NO: 3637313 - RNA, 20 nt, Salmonella enterica enterica serovar Typhi
caguuucucaaacacuucua

SEQ ID NO: 3637314 - RNA, 18 nt, Salmonella enterica enterica serovar Typhi
caguuuguaaccaacaaa

SEQ ID NO: 3637315 - RNA, 13 nt, Salmonella enterica enterica serovar Typhi
caguuugucauca

SEQ ID NO: 3637316 - RNA, 17 nt, Salmonella enterica enterica serovar Typhi
caguuuucacuggcauu

SEQ ID NO: 3637317 - RNA, 15 nt, Salmonella enterica enterica serovar Typhi
caguuuuuauaacua

SEQ ID NO: 3637318 - RNA, 12 nt, Salmonella enterica enterica serovar Typhi
caguuuuuccuu

SEQ ID NO: 3637319 - RNA, 22 nt, Salmonella enterica enterica serovar Typhi
caguuuuucgccaagaucgcca

SEQ ID NO: 3637320 - RNA, 15 nt, Salmonella enterica enterica serovar Typhi
caguuuuugaacaua

SEQ ID NO: 3637321 - RNA, 22 nt, Salmonella enterica enterica serovar Typhi
caguuuuuucaguagccgccgc

SEQ ID NO: 3637322 - RNA, 12 nt, Salmonella enterica enterica serovar Typhi
cauaaaaaaacg

SEQ ID NO: 3637323 - RNA, 18 nt, Salmonella enterica enterica serovar Typhi
cauaaaaaacaucaugcc

SEQ ID NO: 3637324 - RNA, 12 nt, Salmonella enterica enterica serovar Typhi
cauaaaaaagag

SEQ ID NO: 3637325 - RNA, 13 nt, Salmonella enterica enterica serovar Typhi
cauaaaaacguga

SEQ ID NO: 3637326 - RNA, 14 nt, Salmonella enterica enterica serovar Typhi
cauaaaaagccauc

SEQ ID NO: 3637327 - RNA, 20 nt, Salmonella enterica enterica serovar Typhi
cauaaaauccugguaacggc

SEQ ID NO: 3637328 - RNA, 22 nt, Salmonella enterica enterica serovar Typhi
cauaaagauauugucgcccugc

SEQ ID NO: 3637329 - RNA, 15 nt, Salmonella enterica enterica serovar Typhi
cauaaagccucucuu

SEQ ID NO: 3637330 - RNA, 17 nt, Salmonella enterica enterica serovar Typhi
cauaaaguagccaaugc

SEQ ID NO: 3637331 - RNA, 22 nt, Salmonella enterica enterica serovar Typhi
cauaaauauuggcggcaaagaa

SEQ ID NO: 3637332 - RNA, 12 nt, Salmonella enterica enterica serovar Typhi
cauaaaucagau

SEQ ID NO: 3637333 - RNA, 15 nt, Salmonella enterica enterica serovar Typhi
cauaaaugcugauga

SEQ ID NO: 3637334 - RNA, 15 nt, Salmonella enterica enterica serovar Typhi
cauaaauugcagcga

SEQ ID NO: 3637335 - RNA, 14 nt, Salmonella enterica enterica serovar Typhi
cauaaauuggcuca

SEQ ID NO: 3637336 - RNA, 23 nt, Salmonella enterica enterica serovar Typhi
cauaaauuggcucagaauuuaaa

SEQ ID NO: 3637337 - RNA, 15 nt, Salmonella enterica enterica serovar Typhi
cauaacaaaaccagc

SEQ ID NO: 3637338 - RNA, 21 nt, Salmonella enterica enterica serovar Typhi
cauaacaacuauuuuuccggc

SEQ ID NO: 3637339 - RNA, 15 nt, Salmonella enterica enterica serovar Typhi
cauaacaccaauacg

SEQ ID NO: 3637340 - RNA, 15 nt, Salmonella enterica enterica serovar Typhi
cauaaccaaacgcgc

SEQ ID NO: 3637341 - RNA, 18 nt, Salmonella enterica enterica serovar Typhi
cauaaccgcagcgcggcc

SEQ ID NO: 3637342 - RNA, 16 nt, Salmonella enterica enterica serovar Typhi
cauaaccgcagucucc

SEQ ID NO: 3637343 - RNA, 14 nt, Salmonella enterica enterica serovar Typhi
cauaaccucuccuu

SEQ ID NO: 3637344 - RNA, 16 nt, Salmonella enterica enterica serovar Typhi
cauaacgaaugccauu

SEQ ID NO: 3637345 - RNA, 17 nt, Salmonella enterica enterica serovar Typhi
cauaacgaccaaacaag

SEQ ID NO: 3637346 - RNA, 18 nt, Salmonella enterica enterica serovar Typhi
cauaacgcacaacgucag

SEQ ID NO: 3637347 - RNA, 20 nt, Salmonella enterica enterica serovar Typhi
cauaacgcuuuguacagaca

SEQ ID NO: 3637348 - RNA, 18 nt, Salmonella enterica enterica serovar Typhi
cauaacggccuuuuuccg

SEQ ID NO: 3637349 - RNA, 15 nt, Salmonella enterica enterica serovar Typhi
cauaacggcugucca

SEQ ID NO: 3637350 - RNA, 23 nt, Salmonella enterica enterica serovar Typhi
cauaacgggguauaacucagcgg

SEQ ID NO: 3637351 - RNA, 18 nt, Salmonella enterica enterica serovar Typhi
cauaacgugccaucuuug

SEQ ID NO: 3637352 - RNA, 19 nt, Salmonella enterica enterica serovar Typhi
cauaacguuguggaaugcc

SEQ ID NO: 3637353 - RNA, 20 nt, Salmonella enterica enterica serovar Typhi
cauaacugagacucagcagc

SEQ ID NO: 3637354 - RNA, 22 nt, Salmonella enterica enterica serovar Typhi
cauaagcaaacagugggaagca

SEQ ID NO: 3637355 - RNA, 23 nt, Salmonella enterica enterica serovar Typhi
cauaagcaaauccucgucaaggu

SEQ ID NO: 3637356 - RNA, 14 nt, Salmonella enterica enterica serovar Typhi
cauaagcaauaggu

SEQ ID NO: 3637357 - RNA, 14 nt, Salmonella enterica enterica serovar Typhi
cauaagcgcggcgg

SEQ ID NO: 3637358 - RNA, 21 nt, Salmonella enterica enterica serovar Typhi
cauaagcuuaggauaagaaua

SEQ ID NO: 3637359 - RNA, 15 nt, Salmonella enterica enterica serovar Typhi
cauaaguaaauaaca

SEQ ID NO: 3637360 - RNA, 12 nt, Salmonella enterica enterica serovar Typhi
cauaagucaucc

SEQ ID NO: 3637361 - RNA, 17 nt, Salmonella enterica enterica serovar Typhi
cauaauaaacugcaucc

SEQ ID NO: 3637362 - RNA, 19 nt, Salmonella enterica enterica serovar Typhi
cauaauaagcgcucaggca

SEQ ID NO: 3637363 - RNA, 14 nt, Salmonella enterica enterica serovar Typhi
cauaauauccugca

SEQ ID NO: 3637364 - RNA, 23 nt, Salmonella enterica enterica serovar Typhi
cauaauaucucccguuuguauaa

SEQ ID NO: 3637365 - RNA, 17 nt, Salmonella enterica enterica serovar Typhi
cauaauccagaauacgc

SEQ ID NO: 3637366 - RNA, 15 nt, Salmonella enterica enterica serovar Typhi
cauaaucgacagugg

SEQ ID NO: 3637367 - RNA, 19 nt, Salmonella enterica enterica serovar Typhi
cauaaucgacaguggcuuu

SEQ ID NO: 3637368 - RNA, 17 nt, Salmonella enterica enterica serovar Typhi
cauaaucgcuuuuuccu

SEQ ID NO: 3637369 - RNA, 21 nt, Salmonella enterica enterica serovar Typhi
cauaaucggccaggauggccc

SEQ ID NO: 3637370 - RNA, 19 nt, Salmonella enterica enterica serovar Typhi
cauaaugaauuuaucccgu

SEQ ID NO: 3637371 - RNA, 19 nt, Salmonella enterica enterica serovar Typhi
cauaaugacgauaaauaag

SEQ ID NO: 3637372 - RNA, 19 nt, Salmonella enterica enterica serovar Typhi
cauaaugacguccaggccg

SEQ ID NO: 3637373 - RNA, 22 nt, Salmonella enterica enterica serovar Typhi
cauaaugauggggucacagguu

SEQ ID NO: 3637374 - RNA, 17 nt, Salmonella enterica enterica serovar Typhi
cauaaugcacaauacgc

SEQ ID NO: 3637375 - RNA, 14 nt, Salmonella enterica enterica serovar Typhi
cauaauggaacugc

SEQ ID NO: 3637376 - RNA, 22 nt, Salmonella enterica enterica serovar Typhi
cauaauggaacugccuggcuca

SEQ ID NO: 3637377 - RNA, 15 nt, Salmonella enterica enterica serovar Typhi
cauaauuuuccccag

SEQ ID NO: 3637378 - RNA, 16 nt, Salmonella enterica enterica serovar Typhi
cauacaaagagaaaau

SEQ ID NO: 3637379 - RNA, 16 nt, Salmonella enterica enterica serovar Typhi
cauacaccuuugcccg

SEQ ID NO: 3637380 - RNA, 24 nt, Salmonella enterica enterica serovar Typhi
cauacacgccgggcacgcugacca

SEQ ID NO: 3637381 - RNA, 19 nt, Salmonella enterica enterica serovar Typhi
cauacacguaauacaugag

SEQ ID NO: 3637382 - RNA, 14 nt, Salmonella enterica enterica serovar Typhi
cauacacucaacca

SEQ ID NO: 3637383 - RNA, 19 nt, Salmonella enterica enterica serovar Typhi
cauacacugcauaaauauc

SEQ ID NO: 3637384 - RNA, 14 nt, Salmonella enterica enterica serovar Typhi
cauacagcacuucc

SEQ ID NO: 3637385 - RNA, 13 nt, Salmonella enterica enterica serovar Typhi
cauacagcccgcg

SEQ ID NO: 3637386 - RNA, 18 nt, Salmonella enterica enterica serovar Typhi
cauacagcgauaaccgcc

SEQ ID NO: 3637387 - RNA, 19 nt, Salmonella enterica enterica serovar Typhi
cauacauccaucacuccuu

SEQ ID NO: 3637388 - RNA, 18 nt, Salmonella enterica enterica serovar Typhi
cauaccacgcagcggcau

SEQ ID NO: 3637389 - RNA, 12 nt, Salmonella enterica enterica serovar Typhi
cauaccagcgaa

SEQ ID NO: 3637390 - RNA, 19 nt, Salmonella enterica enterica serovar Typhi
cauaccagcgaaaugcgaa

SEQ ID NO: 3637391 - RNA, 17 nt, Salmonella enterica enterica serovar Typhi
cauacccaguagcagac

SEQ ID NO: 3637392 - RNA, 19 nt, Salmonella enterica enterica serovar Typhi
cauacccgcgcucuccggc

SEQ ID NO: 3637393 - RNA, 12 nt, Salmonella enterica enterica serovar Typhi
cauacccgcuua

SEQ ID NO: 3637394 - RNA, 13 nt, Salmonella enterica enterica serovar Typhi
cauacccuuccag

SEQ ID NO: 3637395 - RNA, 15 nt, Salmonella enterica enterica serovar Typhi
cauaccgaacagaaa

SEQ ID NO: 3637396 - RNA, 12 nt, Salmonella enterica enterica serovar Typhi
cauaccgcagau

SEQ ID NO: 3637397 - RNA, 15 nt, Salmonella enterica enterica serovar Typhi
cauaccgccaaucaa

SEQ ID NO: 3637398 - RNA, 17 nt, Salmonella enterica enterica serovar Typhi
cauaccgcuuaacagcg

SEQ ID NO: 3637399 - RNA, 18 nt, Salmonella enterica enterica serovar Typhi
cauaccggacuccaggca

SEQ ID NO: 3637400 - RNA, 20 nt, Salmonella enterica enterica serovar Typhi
cauaccggugcgccccagca

SEQ ID NO: 3637401 - RNA, 16 nt, Salmonella enterica enterica serovar Typhi
cauaccgguugcgcgc

SEQ ID NO: 3637402 - RNA, 19 nt, Salmonella enterica enterica serovar Typhi
cauaccgucgugaaucauc

SEQ ID NO: 3637403 - RNA, 15 nt, Salmonella enterica enterica serovar Typhi
cauaccguuucaacu

SEQ ID NO: 3637404 - RNA, 16 nt, Salmonella enterica enterica serovar Typhi
cauaccugacgcacag

SEQ ID NO: 3637405 - RNA, 19 nt, Salmonella enterica enterica serovar Typhi
cauaccugcggccaugauc

SEQ ID NO: 3637406 - RNA, 21 nt, Salmonella enterica enterica serovar Typhi
cauaccugguuacucacgcga

SEQ ID NO: 3637407 - RNA, 22 nt, Salmonella enterica enterica serovar Typhi
cauacgaucgcgcacaugcugu

SEQ ID NO: 3637408 - RNA, 12 nt, Salmonella enterica enterica serovar Typhi
cauacgccgcca

SEQ ID NO: 3637409 - RNA, 19 nt, Salmonella enterica enterica serovar Typhi
cauacgccgcggucgagca

SEQ ID NO: 3637410 - RNA, 15 nt, Salmonella enterica enterica serovar Typhi
cauacgcgcgccaca

SEQ ID NO: 3637411 - RNA, 16 nt, Salmonella enterica enterica serovar Typhi
cauacgcuuuacgcuu

SEQ ID NO: 3637412 - RNA, 18 nt, Salmonella enterica enterica serovar Typhi
cauacggaugaaauacuc

SEQ ID NO: 3637413 - RNA, 17 nt, Salmonella enterica enterica serovar Typhi
cauacguuuaaagcgcu

SEQ ID NO: 3637414 - RNA, 19 nt, Salmonella enterica enterica serovar Typhi
cauacguuuuuauuaucug

SEQ ID NO: 3637415 - RNA, 12 nt, Salmonella enterica enterica serovar Typhi
cauacucacauu

SEQ ID NO: 3637416 - RNA, 23 nt, Salmonella enterica enterica serovar Typhi
cauacucacauucauaaaagauc

SEQ ID NO: 3637417 - RNA, 23 nt, Salmonella enterica enterica serovar Typhi
cauacugaagauaaacagcagcg

SEQ ID NO: 3637418 - RNA, 19 nt, Salmonella enterica enterica serovar Typhi
cauacugaccaacaacaga

SEQ ID NO: 3637419 - RNA, 19 nt, Salmonella enterica enterica serovar Typhi
cauacugauuucggaauga

SEQ ID NO: 3637420 - RNA, 16 nt, Salmonella enterica enterica serovar Typhi
cauacugccaaccauu

SEQ ID NO: 3637421 - RNA, 20 nt, Salmonella enterica enterica serovar Typhi
cauacugcuuuuucggcuca

SEQ ID NO: 3637422 - RNA, 14 nt, Salmonella enterica enterica serovar Typhi
cauacuguuuauca

SEQ ID NO: 3637423 - RNA, 15 nt, Salmonella enterica enterica serovar Typhi
cauacuuacugcugu

SEQ ID NO: 3637424 - RNA, 15 nt, Salmonella enterica enterica serovar Typhi
cauacuuccucaccg

SEQ ID NO: 3637425 - RNA, 14 nt, Salmonella enterica enterica serovar Typhi
cauagaaaaagaac

SEQ ID NO: 3637426 - RNA, 23 nt, Salmonella enterica enterica serovar Typhi
cauagaaaaagaacugcaaauac

SEQ ID NO: 3637427 - RNA, 17 nt, Salmonella enterica enterica serovar Typhi
cauagaaaucagcaggu

SEQ ID NO: 3637428 - RNA, 13 nt, Salmonella enterica enterica serovar Typhi
cauagaauuucag

SEQ ID NO: 3637429 - RNA, 20 nt, Salmonella enterica enterica serovar Typhi
cauagacgcccugcaaagca

SEQ ID NO: 3637430 - RNA, 21 nt, Salmonella enterica enterica serovar Typhi
cauagacgcccugcaaagcaa

SEQ ID NO: 3637431 - RNA, 17 nt, Salmonella enterica enterica serovar Typhi
cauagacuuuggcgcag

SEQ ID NO: 3637432 - RNA, 13 nt, Salmonella enterica enterica serovar Typhi
cauagauaacuau

SEQ ID NO: 3637433 - RNA, 15 nt, Salmonella enterica enterica serovar Typhi
cauagauaccuucuu

SEQ ID NO: 3637434 - RNA, 17 nt, Salmonella enterica enterica serovar Typhi
cauagauaccuucuuca

SEQ ID NO: 3637435 - RNA, 17 nt, Salmonella enterica enterica serovar Typhi
cauagauauaacccagu

SEQ ID NO: 3637436 - RNA, 19 nt, Salmonella enterica enterica serovar Typhi
cauagcagaguacuggaau

SEQ ID NO: 3637437 - RNA, 14 nt, Salmonella enterica enterica serovar Typhi
cauagcaucguuac

SEQ ID NO: 3637438 - RNA, 22 nt, Salmonella enterica enterica serovar Typhi
cauagccguggcuggcgucccg

SEQ ID NO: 3637439 - RNA, 15 nt, Salmonella enterica enterica serovar Typhi
cauagcgccccagua

SEQ ID NO: 3637440 - RNA, 14 nt, Salmonella enterica enterica serovar Typhi
cauagcgccuucag

SEQ ID NO: 3637441 - RNA, 20 nt, Salmonella enterica enterica serovar Typhi
cauagcggacuaaauuccug

SEQ ID NO: 3637442 - RNA, 19 nt, Salmonella enterica enterica serovar Typhi
cauagcggccagauggcaa

SEQ ID NO: 3637443 - RNA, 18 nt, Salmonella enterica enterica serovar Typhi
cauagcgggagauugaaa

SEQ ID NO: 3637444 - RNA, 16 nt, Salmonella enterica enterica serovar Typhi
cauagcguugauaugc

SEQ ID NO: 3637445 - RNA, 22 nt, Salmonella enterica enterica serovar Typhi
cauagcguugauaugcucgaca

SEQ ID NO: 3637446 - RNA, 21 nt, Salmonella enterica enterica serovar Typhi
cauagcguuuaaaaagcugca

SEQ ID NO: 3637447 - RNA, 18 nt, Salmonella enterica enterica serovar Typhi
cauagcuaaauaaaaaua

SEQ ID NO: 3637448 - RNA, 18 nt, Salmonella enterica enterica serovar Typhi
cauagcuuugccacuggc

SEQ ID NO: 3637449 - RNA, 12 nt, Salmonella enterica enterica serovar Typhi
cauaggacugau

SEQ ID NO: 3637450 - RNA, 18 nt, Salmonella enterica enterica serovar Typhi
cauaggcaauauccuccg

SEQ ID NO: 3637451 - RNA, 19 nt, Salmonella enterica enterica serovar Typhi
cauaggccagcgucaccuc

SEQ ID NO: 3637452 - RNA, 17 nt, Salmonella enterica enterica serovar Typhi
cauaggccggcgaagau

SEQ ID NO: 3637453 - RNA, 22 nt, Salmonella enterica enterica serovar Typhi
cauaggcgacaggcgugauagc

SEQ ID NO: 3637454 - RNA, 21 nt, Salmonella enterica enterica serovar Typhi
cauaggcguugauggcguaau

SEQ ID NO: 3637455 - RNA, 19 nt, Salmonella enterica enterica serovar Typhi
cauaggcuuugcugagcgc

SEQ ID NO: 3637456 - RNA, 20 nt, Salmonella enterica enterica serovar Typhi
cauaguacccucugcaccag

SEQ ID NO: 3637457 - RNA, 20 nt, Salmonella enterica enterica serovar Typhi
cauaguccugccgacaggca

SEQ ID NO: 3637458 - RNA, 15 nt, Salmonella enterica enterica serovar Typhi
cauaguuugcauaac

SEQ ID NO: 3637459 - RNA, 15 nt, Salmonella enterica enterica serovar Typhi
cauaguuuuccagcc

SEQ ID NO: 3637460 - RNA, 16 nt, Salmonella enterica enterica serovar Typhi
cauaguuuuuccccau

SEQ ID NO: 3637461 - RNA, 18 nt, Salmonella enterica enterica serovar Typhi
cauauaaauuucauccau

SEQ ID NO: 3637462 - RNA, 23 nt, Salmonella enterica enterica serovar Typhi
cauauaaccacgaaaauuauuuu

SEQ ID NO: 3637463 - RNA, 19 nt, Salmonella enterica enterica serovar Typhi
cauauaccgcaccugggua

SEQ ID NO: 3637464 - RNA, 14 nt, Salmonella enterica enterica serovar Typhi
cauauacucacuga

SEQ ID NO: 3637465 - RNA, 18 nt, Salmonella enterica enterica serovar Typhi
cauauacucuucgccauu

SEQ ID NO: 3637466 - RNA, 19 nt, Salmonella enterica enterica serovar Typhi
cauauagcagcagucucua

SEQ ID NO: 3637467 - RNA, 14 nt, Salmonella enterica enterica serovar Typhi
cauauagccgcgca

SEQ ID NO: 3637468 - RNA, 12 nt, Salmonella enterica enterica serovar Typhi
cauauauuuacu

SEQ ID NO: 3637469 - RNA, 18 nt, Salmonella enterica enterica serovar Typhi
cauaucaaucaacgguuc

SEQ ID NO: 3637470 - RNA, 22 nt, Salmonella enterica enterica serovar Typhi
cauaucaaugaacuacggcccu

SEQ ID NO: 3637471 - RNA, 23 nt, Salmonella enterica enterica serovar Typhi
cauaucaccgcugacugaacuca

SEQ ID NO: 3637472 - RNA, 22 nt, Salmonella enterica enterica serovar Typhi
cauaucaguggggccuuuuuaa

SEQ ID NO: 3637473 - RNA, 15 nt, Salmonella enterica enterica serovar Typhi
cauauccaagccccu

SEQ ID NO: 3637474 - RNA, 16 nt, Salmonella enterica enterica serovar Typhi
cauauccaagccccuc

SEQ ID NO: 3637475 - RNA, 17 nt, Salmonella enterica enterica serovar Typhi
cauauccgacagauagu

SEQ ID NO: 3637476 - RNA, 12 nt, Salmonella enterica enterica serovar Typhi
cauaucgaauga

SEQ ID NO: 3637477 - RNA, 14 nt, Salmonella enterica enterica serovar Typhi
cauaucgcaauuga

SEQ ID NO: 3637478 - RNA, 20 nt, Salmonella enterica enterica serovar Typhi
cauaucgcagaccauccaug

SEQ ID NO: 3637479 - RNA, 16 nt, Salmonella enterica enterica serovar Typhi
cauaucgccgccacau

SEQ ID NO: 3637480 - RNA, 19 nt, Salmonella enterica enterica serovar Typhi
cauaucgcggguaaacuca

SEQ ID NO: 3637481 - RNA, 15 nt, Salmonella enterica enterica serovar Typhi
cauaucgcuaaacca

SEQ ID NO: 3637482 - RNA, 16 nt, Salmonella enterica enterica serovar Typhi
cauaucgcuaaaccaa

SEQ ID NO: 3637483 - RNA, 19 nt, Salmonella enterica enterica serovar Typhi
cauaucguacugcuuuaau

SEQ ID NO: 3637484 - RNA, 14 nt, Salmonella enterica enterica serovar Typhi
cauaucuauauuuu

SEQ ID NO: 3637485 - RNA, 22 nt, Salmonella enterica enterica serovar Typhi
cauaucuauauuuuuauaucug

SEQ ID NO: 3637486 - RNA, 16 nt, Salmonella enterica enterica serovar Typhi
cauaucuggacgggcc

SEQ ID NO: 3637487 - RNA, 14 nt, Salmonella enterica enterica serovar Typhi
cauaugcgcggcga

SEQ ID NO: 3637488 - RNA, 16 nt, Salmonella enterica enterica serovar Typhi
cauauggcauucgcag

SEQ ID NO: 3637489 - RNA, 12 nt, Salmonella enterica enterica serovar Typhi
cauaugggaaga

SEQ ID NO: 3637490 - RNA, 17 nt, Salmonella enterica enterica serovar Typhi
cauaugggaagacauuc

SEQ ID NO: 3637491 - RNA, 14 nt, Salmonella enterica enterica serovar Typhi
cauaugugccgaug

SEQ ID NO: 3637492 - RNA, 15 nt, Salmonella enterica enterica serovar Typhi
cauauuacauagaaa

SEQ ID NO: 3637493 - RNA, 14 nt, Salmonella enterica enterica serovar Typhi
cauauuauuauaua

SEQ ID NO: 3637494 - RNA, 21 nt, Salmonella enterica enterica serovar Typhi
cauauucaccagagcaucaau

SEQ ID NO: 3637495 - RNA, 15 nt, Salmonella enterica enterica serovar Typhi
cauauucacgcagcu

SEQ ID NO: 3637496 - RNA, 22 nt, Salmonella enterica enterica serovar Typhi
cauauucaguuuuacgccauag

SEQ ID NO: 3637497 - RNA, 22 nt, Salmonella enterica enterica serovar Typhi
cauauuccagccacacgacggu

SEQ ID NO: 3637498 - RNA, 14 nt, Salmonella enterica enterica serovar Typhi
cauauugcgccgca

SEQ ID NO: 3637499 - RNA, 16 nt, Salmonella enterica enterica serovar Typhi
cauauuguguuuuuua

SEQ ID NO: 3637500 - RNA, 19 nt, Salmonella enterica enterica serovar Typhi
cauauuugcgugucaucaa

SEQ ID NO: 3637501 - RNA, 20 nt, Salmonella enterica enterica serovar Typhi
cauauuugcgugucaucaaa

SEQ ID NO: 3637502 - RNA, 19 nt, Salmonella enterica enterica serovar Typhi
cauauuuucaacggcauca

SEQ ID NO: 3637503 - RNA, 13 nt, Salmonella enterica enterica serovar Typhi
cauauuuuuaugc

SEQ ID NO: 3637504 - RNA, 18 nt, Salmonella enterica enterica serovar Typhi
cauauuuuucacacauaa

SEQ ID NO: 3637505 - RNA, 18 nt, Salmonella enterica enterica serovar Typhi
cauauuuuuccagcgccu

SEQ ID NO: 3637506 - RNA, 14 nt, Salmonella enterica enterica serovar Typhi
caucaaaaaaaaua

SEQ ID NO: 3637507 - RNA, 13 nt, Salmonella enterica enterica serovar Typhi
caucaaaaucauc

SEQ ID NO: 3637508 - RNA, 21 nt, Salmonella enterica enterica serovar Typhi
caucaaaaucaucgccacgau

SEQ ID NO: 3637509 - RNA, 22 nt, Salmonella enterica enterica serovar Typhi
caucaaacgcagcaaacgccau

SEQ ID NO: 3637510 - RNA, 14 nt, Salmonella enterica enterica serovar Typhi
caucaaacuuuuaa

SEQ ID NO: 3637511 - RNA, 16 nt, Salmonella enterica enterica serovar Typhi
caucaaacuuuuaaau

SEQ ID NO: 3637512 - RNA, 15 nt, Salmonella enterica enterica serovar Typhi
caucaaagaaaacca

SEQ ID NO: 3637513 - RNA, 19 nt, Salmonella enterica enterica serovar Typhi
caucaaagaaauacccuuc

SEQ ID NO: 3637514 - RNA, 13 nt, Salmonella enterica enterica serovar Typhi
caucaaagccacc

SEQ ID NO: 3637515 - RNA, 18 nt, Salmonella enterica enterica serovar Typhi
caucaacagcggagagac

SEQ ID NO: 3637516 - RNA, 23 nt, Salmonella enterica enterica serovar Typhi
caucaacguaaauagagaaauca

SEQ ID NO: 3637517 - RNA, 21 nt, Salmonella enterica enterica serovar Typhi
caucaagcccacacaucacaa

SEQ ID NO: 3637518 - RNA, 22 nt, Salmonella enterica enterica serovar Typhi
caucaagcugcuggcgagcagg

SEQ ID NO: 3637519 - RNA, 14 nt, Salmonella enterica enterica serovar Typhi
caucaaguaccgug

SEQ ID NO: 3637520 - RNA, 19 nt, Salmonella enterica enterica serovar Typhi
caucaaguaccgugaagaa

SEQ ID NO: 3637521 - RNA, 17 nt, Salmonella enterica enterica serovar Typhi
caucaauaaaaucaccg

SEQ ID NO: 3637522 - RNA, 18 nt, Salmonella enterica enterica serovar Typhi
caucaauacccggccccu

SEQ ID NO: 3637523 - RNA, 11 nt, Salmonella enterica enterica serovar Typhi
caucaauagca

SEQ ID NO: 3637524 - RNA, 23 nt, Salmonella enterica enterica serovar Typhi
caucaaucacuacggguuuuugu

SEQ ID NO: 3637525 - RNA, 13 nt, Salmonella enterica enterica serovar Typhi
caucaaugcccag

SEQ ID NO: 3637526 - RNA, 15 nt, Salmonella enterica enterica serovar Typhi
caucaaugcccagcg

SEQ ID NO: 3637527 - RNA, 20 nt, Salmonella enterica enterica serovar Typhi
caucaauucuuuaauuugug

SEQ ID NO: 3637528 - RNA, 21 nt, Salmonella enterica enterica serovar Typhi
caucaauuuugcgccuaccgc

SEQ ID NO: 3637529 - RNA, 17 nt, Salmonella enterica enterica serovar Typhi
caucacaaaccagacgc

SEQ ID NO: 3637530 - RNA, 22 nt, Salmonella enterica enterica serovar Typhi
caucacaaucuccagaccgcug

SEQ ID NO: 3637531 - RNA, 18 nt, Salmonella enterica enterica serovar Typhi
caucacaaugaccucuuu

SEQ ID NO: 3637532 - RNA, 15 nt, Salmonella enterica enterica serovar Typhi
caucacagccacacu

SEQ ID NO: 3637533 - RNA, 16 nt, Salmonella enterica enterica serovar Typhi
caucacagccacacug

SEQ ID NO: 3637534 - RNA, 17 nt, Salmonella enterica enterica serovar Typhi
caucacaucaaagcccc

SEQ ID NO: 3637535 - RNA, 20 nt, Salmonella enterica enterica serovar Typhi
caucacaucguaaaucagcg

SEQ ID NO: 3637536 - RNA, 19 nt, Salmonella enterica enterica serovar Typhi
caucacauguagcgcggca

SEQ ID NO: 3637537 - RNA, 22 nt, Salmonella enterica enterica serovar Typhi
caucaccaguugcgaagccacu

SEQ ID NO: 3637538 - RNA, 15 nt, Salmonella enterica enterica serovar Typhi
caucacccggcgaga

SEQ ID NO: 3637539 - RNA, 17 nt, Salmonella enterica enterica serovar Typhi
caucaccgacggggcgu

SEQ ID NO: 3637540 - RNA, 21 nt, Salmonella enterica enterica serovar Typhi
caucaccgucuucaggucauu

SEQ ID NO: 3637541 - RNA, 12 nt, Salmonella enterica enterica serovar Typhi
caucaccguuac

SEQ ID NO: 3637542 - RNA, 21 nt, Salmonella enterica enterica serovar Typhi
caucaccuccagcacgcgcug

SEQ ID NO: 3637543 - RNA, 21 nt, Salmonella enterica enterica serovar Typhi
caucacgaucuggcaaaccau

SEQ ID NO: 3637544 - RNA, 22 nt, Salmonella enterica enterica serovar Typhi
caucacgcaaaugcagcggaau

SEQ ID NO: 3637545 - RNA, 17 nt, Salmonella enterica enterica serovar Typhi
caucacgcaacggugag

SEQ ID NO: 3637546 - RNA, 20 nt, Salmonella enterica enterica serovar Typhi
caucacgcgaagcggcguca

SEQ ID NO: 3637547 - RNA, 20 nt, Salmonella enterica enterica serovar Typhi
caucacggagcgguaguuca

SEQ ID NO: 3637548 - RNA, 19 nt, Salmonella enterica enterica serovar Typhi
caucacggcagcaccgcug

SEQ ID NO: 3637549 - RNA, 18 nt, Salmonella enterica enterica serovar Typhi
caucacgggaucgcagaa

SEQ ID NO: 3637550 - RNA, 14 nt, Salmonella enterica enterica serovar Typhi
caucacguccuccc

SEQ ID NO: 3637551 - RNA, 16 nt, Salmonella enterica enterica serovar Typhi
caucacguucaggcag

SEQ ID NO: 3637552 - RNA, 19 nt, Salmonella enterica enterica serovar Typhi
caucacguucgcgcauacc

SEQ ID NO: 3637553 - RNA, 21 nt, Salmonella enterica enterica serovar Typhi
caucacuaccgccgcggauac

SEQ ID NO: 3637554 - RNA, 15 nt, Salmonella enterica enterica serovar Typhi
caucacuuuuggcga

SEQ ID NO: 3637555 - RNA, 21 nt, Salmonella enterica enterica serovar Typhi
caucacuuuuggcgacaggaa

SEQ ID NO: 3637556 - RNA, 21 nt, Salmonella enterica enterica serovar Typhi
caucagaaaaaagccaagcac

SEQ ID NO: 3637557 - RNA, 15 nt, Salmonella enterica enterica serovar Typhi
caucagaaaaaccuc

SEQ ID NO: 3637558 - RNA, 20 nt, Salmonella enterica enterica serovar Typhi
caucagaaaaaccuccggcu

SEQ ID NO: 3637559 - RNA, 20 nt, Salmonella enterica enterica serovar Typhi
caucagaaaauagugaaugg

SEQ ID NO: 3637560 - RNA, 17 nt, Salmonella enterica enterica serovar Typhi
caucagaaugcugguca

SEQ ID NO: 3637561 - RNA, 22 nt, Salmonella enterica enterica serovar Typhi
caucagacaguacggaugaugu

SEQ ID NO: 3637562 - RNA, 17 nt, Salmonella enterica enterica serovar Typhi
caucagaccgauaaaua

SEQ ID NO: 3637563 - RNA, 18 nt, Salmonella enterica enterica serovar Typhi
caucagaccgauaaauac

SEQ ID NO: 3637564 - RNA, 17 nt, Salmonella enterica enterica serovar Typhi
caucagaccgccaagcg

SEQ ID NO: 3637565 - RNA, 22 nt, Salmonella enterica enterica serovar Typhi
caucagacuacuuuuacccuuc

SEQ ID NO: 3637566 - RNA, 21 nt, Salmonella enterica enterica serovar Typhi
caucagacucucaaugcccau

SEQ ID NO: 3637567 - RNA, 18 nt, Salmonella enterica enterica serovar Typhi
caucagacuguuacgcug

SEQ ID NO: 3637568 - RNA, 15 nt, Salmonella enterica enterica serovar Typhi
caucagcaaaugaac

SEQ ID NO: 3637569 - RNA, 23 nt, Salmonella enterica enterica serovar Typhi
caucagcaauuucucgcccgcca

SEQ ID NO: 3637570 - RNA, 16 nt, Salmonella enterica enterica serovar Typhi
caucagccagcagcuc

SEQ ID NO: 3637571 - RNA, 17 nt, Salmonella enterica enterica serovar Typhi
caucagccagccgccaa

SEQ ID NO: 3637572 - RNA, 23 nt, Salmonella enterica enterica serovar Typhi
caucagccagccgccaaaaauau

SEQ ID NO: 3637573 - RNA, 17 nt, Salmonella enterica enterica serovar Typhi
caucagcccuaucgcug

SEQ ID NO: 3637574 - RNA, 19 nt, Salmonella enterica enterica serovar Typhi
caucagccguuacuucccc

SEQ ID NO: 3637575 - RNA, 20 nt, Salmonella enterica enterica serovar Typhi
caucagccguuacuuccccc

SEQ ID NO: 3637576 - RNA, 16 nt, Salmonella enterica enterica serovar Typhi
caucagcgccagcccu

SEQ ID NO: 3637577 - RNA, 18 nt, Salmonella enterica enterica serovar Typhi
caucagcgccagcccugc

SEQ ID NO: 3637578 - RNA, 10 nt, Salmonella enterica enterica serovar Typhi
caucagcgcu

SEQ ID NO: 3637579 - RNA, 21 nt, Salmonella enterica enterica serovar Typhi
caucagcgcuaccagcgcggc

SEQ ID NO: 3637580 - RNA, 20 nt, Salmonella enterica enterica serovar Typhi
caucagcgggcuaugcugaa

SEQ ID NO: 3637581 - RNA, 13 nt, Salmonella enterica enterica serovar Typhi
caucaggaaugcc

SEQ ID NO: 3637582 - RNA, 17 nt, Salmonella enterica enterica serovar Typhi
caucaggaucuucaucc

SEQ ID NO: 3637583 - RNA, 13 nt, Salmonella enterica enterica serovar Typhi
caucaggcaucug

SEQ ID NO: 3637584 - RNA, 18 nt, Salmonella enterica enterica serovar Typhi
caucaggcaucugaaaug

SEQ ID NO: 3637585 - RNA, 19 nt, Salmonella enterica enterica serovar Typhi
caucaggcaucugaaaugc

SEQ ID NO: 3637586 - RNA, 15 nt, Salmonella enterica enterica serovar Typhi
caucaggccugcaaa

SEQ ID NO: 3637587 - RNA, 13 nt, Salmonella enterica enterica serovar Typhi
caucaggcgugcc

SEQ ID NO: 3637588 - RNA, 21 nt, Salmonella enterica enterica serovar Typhi
caucaggcugacgaagaacuu

SEQ ID NO: 3637589 - RNA, 18 nt, Salmonella enterica enterica serovar Typhi
caucagguggaagaaacg

SEQ ID NO: 3637590 - RNA, 18 nt, Salmonella enterica enterica serovar Typhi
caucaguaacacccgcgc

SEQ ID NO: 3637591 - RNA, 13 nt, Salmonella enterica enterica serovar Typhi
caucaguaacuga

SEQ ID NO: 3637592 - RNA, 15 nt, Salmonella enterica enterica serovar Typhi
caucaguccuguuga

SEQ ID NO: 3637593 - RNA, 13 nt, Salmonella enterica enterica serovar Typhi
caucauaaaaggc

SEQ ID NO: 3637594 - RNA, 16 nt, Salmonella enterica enterica serovar Typhi
caucauaaauggcuga

SEQ ID NO: 3637595 - RNA, 14 nt, Salmonella enterica enterica serovar Typhi
caucauaauccuua

SEQ ID NO: 3637596 - RNA, 19 nt, Salmonella enterica enterica serovar Typhi
caucaucaggacucaauca

SEQ ID NO: 3637597 - RNA, 22 nt, Salmonella enterica enterica serovar Typhi
caucaucaggguuauccuccag

SEQ ID NO: 3637598 - RNA, 14 nt, Salmonella enterica enterica serovar Typhi
caucaucccgcgcc

SEQ ID NO: 3637599 - RNA, 17 nt, Salmonella enterica enterica serovar Typhi
caucaucgccgauuucu

SEQ ID NO: 3637600 - RNA, 22 nt, Salmonella enterica enterica serovar Typhi
caucaucgcuggugugcagcca

SEQ ID NO: 3637601 - RNA, 17 nt, Salmonella enterica enterica serovar Typhi
caucaucggcacagcca

SEQ ID NO: 3637602 - RNA, 13 nt, Salmonella enterica enterica serovar Typhi
caucaucuugucc

SEQ ID NO: 3637603 - RNA, 20 nt, Salmonella enterica enterica serovar Typhi
caucaucuuguccucaucau

SEQ ID NO: 3637604 - RNA, 20 nt, Salmonella enterica enterica serovar Typhi
caucaugaaaaacaguaccg

SEQ ID NO: 3637605 - RNA, 13 nt, Salmonella enterica enterica serovar Typhi
caucaugauauaa

SEQ ID NO: 3637606 - RNA, 14 nt, Salmonella enterica enterica serovar Typhi
caucaugauauaau

SEQ ID NO: 3637607 - RNA, 22 nt, Salmonella enterica enterica serovar Typhi
caucaugaugaucuucagcccg

SEQ ID NO: 3637608 - RNA, 21 nt, Salmonella enterica enterica serovar Typhi
caucaugcaagagucccagaa

SEQ ID NO: 3637609 - RNA, 22 nt, Salmonella enterica enterica serovar Typhi
caucaugcaagagucccagaac

SEQ ID NO: 3637610 - RNA, 17 nt, Salmonella enterica enterica serovar Typhi
caucaugcccacaggca

SEQ ID NO: 3637611 - RNA, 20 nt, Salmonella enterica enterica serovar Typhi
caucaugcgcagaaacugau

SEQ ID NO: 3637612 - RNA, 19 nt, Salmonella enterica enterica serovar Typhi
caucaugcuaaaagcgacu

SEQ ID NO: 3637613 - RNA, 16 nt, Salmonella enterica enterica serovar Typhi
caucaugcuugcuuug

SEQ ID NO: 3637614 - RNA, 20 nt, Salmonella enterica enterica serovar Typhi
caucauguugaaauauuuga

SEQ ID NO: 3637615 - RNA, 16 nt, Salmonella enterica enterica serovar Typhi
caucauuauuccccuc

SEQ ID NO: 3637616 - RNA, 19 nt, Salmonella enterica enterica serovar Typhi
caucauucaacgcaucaaa

SEQ ID NO: 3637617 - RNA, 22 nt, Salmonella enterica enterica serovar Typhi
caucauucgguuaggaauagca

SEQ ID NO: 3637618 - RNA, 17 nt, Salmonella enterica enterica serovar Typhi
caucauugauacuguac

SEQ ID NO: 3637619 - RNA, 13 nt, Salmonella enterica enterica serovar Typhi
caucauugcgcca

SEQ ID NO: 3637620 - RNA, 13 nt, Salmonella enterica enterica serovar Typhi
cauccaacugcgc

SEQ ID NO: 3637621 - RNA, 23 nt, Salmonella enterica enterica serovar Typhi
cauccacauucguaacaugcugg

SEQ ID NO: 3637622 - RNA, 14 nt, Salmonella enterica enterica serovar Typhi
cauccaccagaccc

SEQ ID NO: 3637623 - RNA, 17 nt, Salmonella enterica enterica serovar Typhi
cauccaccaggcaugca

SEQ ID NO: 3637624 - RNA, 13 nt, Salmonella enterica enterica serovar Typhi
cauccacccuggc

SEQ ID NO: 3637625 - RNA, 18 nt, Salmonella enterica enterica serovar Typhi
cauccaccuuauccuggc

SEQ ID NO: 3637626 - RNA, 14 nt, Salmonella enterica enterica serovar Typhi
cauccacggccccg

SEQ ID NO: 3637627 - RNA, 17 nt, Salmonella enterica enterica serovar Typhi
cauccagacaugcacau

SEQ ID NO: 3637628 - RNA, 19 nt, Salmonella enterica enterica serovar Typhi
cauccagacaugcacaugg

SEQ ID NO: 3637629 - RNA, 11 nt, Salmonella enterica enterica serovar Typhi
cauccagacca

SEQ ID NO: 3637630 - RNA, 21 nt, Salmonella enterica enterica serovar Typhi
cauccagcaauaacaccggcg

SEQ ID NO: 3637631 - RNA, 22 nt, Salmonella enterica enterica serovar Typhi
cauccagcacagguacaggccg

SEQ ID NO: 3637632 - RNA, 18 nt, Salmonella enterica enterica serovar Typhi
cauccagcagcagcaccg

SEQ ID NO: 3637633 - RNA, 14 nt, Salmonella enterica enterica serovar Typhi
cauccagcgaaccu

SEQ ID NO: 3637634 - RNA, 17 nt, Salmonella enterica enterica serovar Typhi
cauccagcgaaccuucc

SEQ ID NO: 3637635 - RNA, 14 nt, Salmonella enterica enterica serovar Typhi
cauccagcgccugc

SEQ ID NO: 3637636 - RNA, 18 nt, Salmonella enterica enterica serovar Typhi
cauccagcgucacaggcu

SEQ ID NO: 3637637 - RNA, 21 nt, Salmonella enterica enterica serovar Typhi
cauccaggaaguaaauuauuc

SEQ ID NO: 3637638 - RNA, 16 nt, Salmonella enterica enterica serovar Typhi
cauccagucagcaauu

SEQ ID NO: 3637639 - RNA, 23 nt, Salmonella enterica enterica serovar Typhi
cauccaguuuauauucuucgccc

SEQ ID NO: 3637640 - RNA, 15 nt, Salmonella enterica enterica serovar Typhi
cauccaucacuccuu

SEQ ID NO: 3637641 - RNA, 14 nt, Salmonella enterica enterica serovar Typhi
cauccaucagcgcg

SEQ ID NO: 3637642 - RNA, 13 nt, Salmonella enterica enterica serovar Typhi
cauccaugccagc

SEQ ID NO: 3637643 - RNA, 16 nt, Salmonella enterica enterica serovar Typhi
cauccaugccagcgcg

SEQ ID NO: 3637644 - RNA, 17 nt, Salmonella enterica enterica serovar Typhi
cauccauguacuccuga

SEQ ID NO: 3637645 - RNA, 15 nt, Salmonella enterica enterica serovar Typhi
cauccauuaaaaucu

SEQ ID NO: 3637646 - RNA, 20 nt, Salmonella enterica enterica serovar Typhi
cauccauugcgccacggaug

SEQ ID NO: 3637647 - RNA, 17 nt, Salmonella enterica enterica serovar Typhi
caucccacuccaucgcc

SEQ ID NO: 3637648 - RNA, 16 nt, Salmonella enterica enterica serovar Typhi
caucccaugcaccagu

SEQ ID NO: 3637649 - RNA, 14 nt, Salmonella enterica enterica serovar Typhi
cauccccggcgccc

SEQ ID NO: 3637650 - RNA, 21 nt, Salmonella enterica enterica serovar Typhi
caucccgauaauggcgccgau

SEQ ID NO: 3637651 - RNA, 15 nt, Salmonella enterica enterica serovar Typhi
caucccgcccagcaa

SEQ ID NO: 3637652 - RNA, 12 nt, Salmonella enterica enterica serovar Typhi
caucccggcaac

SEQ ID NO: 3637653 - RNA, 14 nt, Salmonella enterica enterica serovar Typhi
caucccggcaacgu

SEQ ID NO: 3637654 - RNA, 14 nt, Salmonella enterica enterica serovar Typhi
caucccguagcguc

SEQ ID NO: 3637655 - RNA, 15 nt, Salmonella enterica enterica serovar Typhi
cauccgaccacggcc

SEQ ID NO: 3637656 - RNA, 22 nt, Salmonella enterica enterica serovar Typhi
cauccgaccacggccacagcca

SEQ ID NO: 3637657 - RNA, 21 nt, Salmonella enterica enterica serovar Typhi
cauccgauuucauggucaucg

SEQ ID NO: 3637658 - RNA, 23 nt, Salmonella enterica enterica serovar Typhi
cauccgauuucauggucaucgca

SEQ ID NO: 3637659 - RNA, 18 nt, Salmonella enterica enterica serovar Typhi
cauccgccaaaacaucuu

SEQ ID NO: 3637660 - RNA, 15 nt, Salmonella enterica enterica serovar Typhi
cauccgccagcgccu

SEQ ID NO: 3637661 - RNA, 17 nt, Salmonella enterica enterica serovar Typhi
cauccgccagcgccucu

SEQ ID NO: 3637662 - RNA, 19 nt, Salmonella enterica enterica serovar Typhi
cauccgccagcgccucuuc

SEQ ID NO: 3637663 - RNA, 18 nt, Salmonella enterica enterica serovar Typhi
cauccgcccggcaucaag

SEQ ID NO: 3637664 - RNA, 23 nt, Salmonella enterica enterica serovar Typhi
cauccgcgcaauaugcggcgcca

SEQ ID NO: 3637665 - RNA, 21 nt, Salmonella enterica enterica serovar Typhi
cauccgcuucggacuccugac

SEQ ID NO: 3637666 - RNA, 13 nt, Salmonella enterica enterica serovar Typhi
cauccggacgcca

SEQ ID NO: 3637667 - RNA, 15 nt, Salmonella enterica enterica serovar Typhi
cauccggacgccagu

SEQ ID NO: 3637668 - RNA, 19 nt, Salmonella enterica enterica serovar Typhi
cauccggaugguuaagcag

SEQ ID NO: 3637669 - RNA, 16 nt, Salmonella enterica enterica serovar Typhi
cauccggcaaacucag

SEQ ID NO: 3637670 - RNA, 15 nt, Salmonella enterica enterica serovar Typhi
cauccggcaauaaug

SEQ ID NO: 3637671 - RNA, 16 nt, Salmonella enterica enterica serovar Typhi
cauccggcaaucagac

SEQ ID NO: 3637672 - RNA, 14 nt, Salmonella enterica enterica serovar Typhi
cauccggcaaugau

SEQ ID NO: 3637673 - RNA, 13 nt, Salmonella enterica enterica serovar Typhi
cauccggcacagu

SEQ ID NO: 3637674 - RNA, 15 nt, Salmonella enterica enterica serovar Typhi
cauccggcauuuuuu

SEQ ID NO: 3637675 - RNA, 16 nt, Salmonella enterica enterica serovar Typhi
cauccggcgcugauga

SEQ ID NO: 3637676 - RNA, 19 nt, Salmonella enterica enterica serovar Typhi
cauccggcgcugcgcggcg

SEQ ID NO: 3637677 - RNA, 23 nt, Salmonella enterica enterica serovar Typhi
cauccggcgcugcgcggcgugca

SEQ ID NO: 3637678 - RNA, 17 nt, Salmonella enterica enterica serovar Typhi
cauccgggccgcuagcu

SEQ ID NO: 3637679 - RNA, 15 nt, Salmonella enterica enterica serovar Typhi
cauccgguuuuaaau

SEQ ID NO: 3637680 - RNA, 20 nt, Salmonella enterica enterica serovar Typhi
cauccgucaaaaugaucaga

SEQ ID NO: 3637681 - RNA, 15 nt, Salmonella enterica enterica serovar Typhi
cauccgugaccugcu

SEQ ID NO: 3637682 - RNA, 18 nt, Salmonella enterica enterica serovar Typhi
cauccucaauguuaacua

SEQ ID NO: 3637683 - RNA, 14 nt, Salmonella enterica enterica serovar Typhi
cauccucacgcaac

SEQ ID NO: 3637684 - RNA, 20 nt, Salmonella enterica enterica serovar Typhi
cauccuccggcgacugaaug

SEQ ID NO: 3637685 - RNA, 21 nt, Salmonella enterica enterica serovar Typhi
cauccuccggcgacugaaugc

SEQ ID NO: 3637686 - RNA, 14 nt, Salmonella enterica enterica serovar Typhi
cauccucgccauaa

SEQ ID NO: 3637687 - RNA, 21 nt, Salmonella enterica enterica serovar Typhi
cauccucuuggguuauuucga

SEQ ID NO: 3637688 - RNA, 18 nt, Salmonella enterica enterica serovar Typhi
cauccugaguauaaaacu

SEQ ID NO: 3637689 - RNA, 18 nt, Salmonella enterica enterica serovar Typhi
cauccugauuuuacugac

SEQ ID NO: 3637690 - RNA, 19 nt, Salmonella enterica enterica serovar Typhi
cauccugcaacucaaaaua

SEQ ID NO: 3637691 - RNA, 15 nt, Salmonella enterica enterica serovar Typhi
cauccugcgcacagc

SEQ ID NO: 3637692 - RNA, 21 nt, Salmonella enterica enterica serovar Typhi
cauccugcgccauugcgggag

SEQ ID NO: 3637693 - RNA, 14 nt, Salmonella enterica enterica serovar Typhi
cauccugcggcagu

SEQ ID NO: 3637694 - RNA, 17 nt, Salmonella enterica enterica serovar Typhi
cauccugcgggaugcgu

SEQ ID NO: 3637695 - RNA, 13 nt, Salmonella enterica enterica serovar Typhi
cauccugcggguu

SEQ ID NO: 3637696 - RNA, 20 nt, Salmonella enterica enterica serovar Typhi
cauccugcggguucaucgcc

SEQ ID NO: 3637697 - RNA, 20 nt, Salmonella enterica enterica serovar Typhi
cauccuguaccaccacgccc

SEQ ID NO: 3637698 - RNA, 15 nt, Salmonella enterica enterica serovar Typhi
cauccuguucaagca

SEQ ID NO: 3637699 - RNA, 23 nt, Salmonella enterica enterica serovar Typhi
cauccuguuuuuucagcgcgccg

SEQ ID NO: 3637700 - RNA, 12 nt, Salmonella enterica enterica serovar Typhi
caucgaacgccg

SEQ ID NO: 3637701 - RNA, 21 nt, Salmonella enterica enterica serovar Typhi
caucgaagagcauaugcgcug

SEQ ID NO: 3637702 - RNA, 19 nt, Salmonella enterica enterica serovar Typhi
caucgacaaaggcaagauc

SEQ ID NO: 3637703 - RNA, 21 nt, Salmonella enterica enterica serovar Typhi
caucgacaagcuaauccccag

SEQ ID NO: 3637704 - RNA, 21 nt, Salmonella enterica enterica serovar Typhi
caucgacccccaccucaauca

SEQ ID NO: 3637705 - RNA, 17 nt, Salmonella enterica enterica serovar Typhi
caucgacuucaagguuc

SEQ ID NO: 3637706 - RNA, 18 nt, Salmonella enterica enterica serovar Typhi
caucgauacccugcugau

SEQ ID NO: 3637707 - RNA, 17 nt, Salmonella enterica enterica serovar Typhi
caucgauuuccugauga

SEQ ID NO: 3637708 - RNA, 14 nt, Salmonella enterica enterica serovar Typhi
caucgauuuuucau

SEQ ID NO: 3637709 - RNA, 19 nt, Salmonella enterica enterica serovar Typhi
caucgcaaauucaucgccg

SEQ ID NO: 3637710 - RNA, 16 nt, Salmonella enterica enterica serovar Typhi
caucgcaaugccacca

SEQ ID NO: 3637711 - RNA, 20 nt, Salmonella enterica enterica serovar Typhi
caucgcauauugcguaucgu

SEQ ID NO: 3637712 - RNA, 20 nt, Salmonella enterica enterica serovar Typhi
caucgcauuaacguccauac

SEQ ID NO: 3637713 - RNA, 18 nt, Salmonella enterica enterica serovar Typhi
caucgccaccgcauggaa

SEQ ID NO: 3637714 - RNA, 16 nt, Salmonella enterica enterica serovar Typhi
caucgccacgauagac

SEQ ID NO: 3637715 - RNA, 13 nt, Salmonella enterica enterica serovar Typhi
caucgccagcuuc

SEQ ID NO: 3637716 - RNA, 16 nt, Salmonella enterica enterica serovar Typhi
caucgccagcuucgcu

SEQ ID NO: 3637717 - RNA, 12 nt, Salmonella enterica enterica serovar Typhi
caucgcccaggu

SEQ ID NO: 3637718 - RNA, 15 nt, Salmonella enterica enterica serovar Typhi
caucgcccgcuccca

SEQ ID NO: 3637719 - RNA, 21 nt, Salmonella enterica enterica serovar Typhi
caucgcccugauggcgcgcca

SEQ ID NO: 3637720 - RNA, 17 nt, Salmonella enterica enterica serovar Typhi
caucgccgauuccugcu

SEQ ID NO: 3637721 - RNA, 19 nt, Salmonella enterica enterica serovar Typhi
caucgccgcaaugaccaca

SEQ ID NO: 3637722 - RNA, 14 nt, Salmonella enterica enterica serovar Typhi
caucgccgccgagu

SEQ ID NO: 3637723 - RNA, 14 nt, Salmonella enterica enterica serovar Typhi
caucgccgccucgc

SEQ ID NO: 3637724 - RNA, 14 nt, Salmonella enterica enterica serovar Typhi
caucgccgcgccgu

SEQ ID NO: 3637725 - RNA, 19 nt, Salmonella enterica enterica serovar Typhi
caucgccugaucgcgcaga

SEQ ID NO: 3637726 - RNA, 20 nt, Salmonella enterica enterica serovar Typhi
caucgcgaauuucaaucgcc

SEQ ID NO: 3637727 - RNA, 14 nt, Salmonella enterica enterica serovar Typhi
caucgcgaucgcca

SEQ ID NO: 3637728 - RNA, 22 nt, Salmonella enterica enterica serovar Typhi
caucgcgcaaagccuuuccgca

SEQ ID NO: 3637729 - RNA, 13 nt, Salmonella enterica enterica serovar Typhi
caucgcgcagcag

SEQ ID NO: 3637730 - RNA, 16 nt, Salmonella enterica enterica serovar Typhi
caucgcgccgcuggcg

SEQ ID NO: 3637731 - RNA, 15 nt, Salmonella enterica enterica serovar Typhi
caucgcgccuccccu

SEQ ID NO: 3637732 - RNA, 22 nt, Salmonella enterica enterica serovar Typhi
caucgcgcugauauuuuuacug

SEQ ID NO: 3637733 - RNA, 14 nt, Salmonella enterica enterica serovar Typhi
caucgcgcuuaacu

SEQ ID NO: 3637734 - RNA, 21 nt, Salmonella enterica enterica serovar Typhi
caucgcggccagcaugguuaa

SEQ ID NO: 3637735 - RNA, 18 nt, Salmonella enterica enterica serovar Typhi
caucgcgucgccaucagg

SEQ ID NO: 3637736 - RNA, 18 nt, Salmonella enterica enterica serovar Typhi
caucgcuaaccggcggcg

SEQ ID NO: 3637737 - RNA, 15 nt, Salmonella enterica enterica serovar Typhi
caucgcuaucaugcu

SEQ ID NO: 3637738 - RNA, 13 nt, Salmonella enterica enterica serovar Typhi
caucgcucccggc

SEQ ID NO: 3637739 - RNA, 12 nt, Salmonella enterica enterica serovar Typhi
caucgcuccggc

SEQ ID NO: 3637740 - RNA, 23 nt, Salmonella enterica enterica serovar Typhi
caucgcugaauuuggcggcgcgc

SEQ ID NO: 3637741 - RNA, 14 nt, Salmonella enterica enterica serovar Typhi
caucgcuggcgcgc

SEQ ID NO: 3637742 - RNA, 20 nt, Salmonella enterica enterica serovar Typhi
caucgcuggcgcgcgcgccu

SEQ ID NO: 3637743 - RNA, 20 nt, Salmonella enterica enterica serovar Typhi
caucgcuggucgcuaccaca

SEQ ID NO: 3637744 - RNA, 21 nt, Salmonella enterica enterica serovar Typhi
caucgcuggugugcagccagu

SEQ ID NO: 3637745 - RNA, 16 nt, Salmonella enterica enterica serovar Typhi
caucgcuuagcggcuc

SEQ ID NO: 3637746 - RNA, 18 nt, Salmonella enterica enterica serovar Typhi
caucgcuucuacagccac

SEQ ID NO: 3637747 - RNA, 20 nt, Salmonella enterica enterica serovar Typhi
caucgcuucuauuaccgcag

SEQ ID NO: 3637748 - RNA, 13 nt, Salmonella enterica enterica serovar Typhi
caucgcuugccca

SEQ ID NO: 3637749 - RNA, 21 nt, Salmonella enterica enterica serovar Typhi
caucgcuuuuaggcugaaagc

SEQ ID NO: 3637750 - RNA, 15 nt, Salmonella enterica enterica serovar Typhi
caucggauagaugaa

SEQ ID NO: 3637751 - RNA, 14 nt, Salmonella enterica enterica serovar Typhi
caucggauuauuuu

SEQ ID NO: 3637752 - RNA, 19 nt, Salmonella enterica enterica serovar Typhi
caucggcaaacgccgccug

SEQ ID NO: 3637753 - RNA, 15 nt, Salmonella enterica enterica serovar Typhi
caucggcacagccag

SEQ ID NO: 3637754 - RNA, 15 nt, Salmonella enterica enterica serovar Typhi
caucggcagcgccag

SEQ ID NO: 3637755 - RNA, 19 nt, Salmonella enterica enterica serovar Typhi
caucggcagcgccagugac

SEQ ID NO: 3637756 - RNA, 19 nt, Salmonella enterica enterica serovar Typhi
caucggccagcaggcgcac

SEQ ID NO: 3637757 - RNA, 16 nt, Salmonella enterica enterica serovar Typhi
caucggcggcaaugcc

SEQ ID NO: 3637758 - RNA, 19 nt, Salmonella enterica enterica serovar Typhi
caucgggaacggcauacug

SEQ ID NO: 3637759 - RNA, 18 nt, Salmonella enterica enterica serovar Typhi
caucgggucgcgcgccgc

SEQ ID NO: 3637760 - RNA, 15 nt, Salmonella enterica enterica serovar Typhi
caucgguaagcgcaa

SEQ ID NO: 3637761 - RNA, 14 nt, Salmonella enterica enterica serovar Typhi
caucgguucucugc

SEQ ID NO: 3637762 - RNA, 17 nt, Salmonella enterica enterica serovar Typhi
caucguaccaauaccca

SEQ ID NO: 3637763 - RNA, 23 nt, Salmonella enterica enterica serovar Typhi
caucguaccaauacccagcgcca

SEQ ID NO: 3637764 - RNA, 20 nt, Salmonella enterica enterica serovar Typhi
caucguagucaggcaacagg

SEQ ID NO: 3637765 - RNA, 18 nt, Salmonella enterica enterica serovar Typhi
caucguagucguagaaca

SEQ ID NO: 3637766 - RNA, 21 nt, Salmonella enterica enterica serovar Typhi
caucgucgccagacccagcgc

SEQ ID NO: 3637767 - RNA, 22 nt, Salmonella enterica enterica serovar Typhi
caucgucuuuuaccgcgucgcu

SEQ ID NO: 3637768 - RNA, 16 nt, Salmonella enterica enterica serovar Typhi
caucgugagcgcguca

SEQ ID NO: 3637769 - RNA, 13 nt, Salmonella enterica enterica serovar Typhi
caucgugauaaac

SEQ ID NO: 3637770 - RNA, 14 nt, Salmonella enterica enterica serovar Typhi
caucgugauaaacg

SEQ ID NO: 3637771 - RNA, 23 nt, Salmonella enterica enterica serovar Typhi
caucgugauagacggcugaaugu

SEQ ID NO: 3637772 - RNA, 19 nt, Salmonella enterica enterica serovar Typhi
caucgugguuaauacauca

SEQ ID NO: 3637773 - RNA, 15 nt, Salmonella enterica enterica serovar Typhi
caucguguagcguga

SEQ ID NO: 3637774 - RNA, 22 nt, Salmonella enterica enterica serovar Typhi
caucguguauaccaaaaauaau

SEQ ID NO: 3637775 - RNA, 17 nt, Salmonella enterica enterica serovar Typhi
caucguuugcaguuccg

SEQ ID NO: 3637776 - RNA, 16 nt, Salmonella enterica enterica serovar Typhi
caucuaccgcauacug

SEQ ID NO: 3637777 - RNA, 23 nt, Salmonella enterica enterica serovar Typhi
caucuauaauaccuccugucuau

SEQ ID NO: 3637778 - RNA, 13 nt, Salmonella enterica enterica serovar Typhi
caucuaucgccag

SEQ ID NO: 3637779 - RNA, 15 nt, Salmonella enterica enterica serovar Typhi
caucucaucggcuuu

SEQ ID NO: 3637780 - RNA, 19 nt, Salmonella enterica enterica serovar Typhi
caucucccaggccgccacc

SEQ ID NO: 3637781 - RNA, 21 nt, Salmonella enterica enterica serovar Typhi
caucuccgauaaauaagaagg

SEQ ID NO: 3637782 - RNA, 17 nt, Salmonella enterica enterica serovar Typhi
caucuccucgcacuggc

SEQ ID NO: 3637783 - RNA, 14 nt, Salmonella enterica enterica serovar Typhi
caucuccucgcgcg

SEQ ID NO: 3637784 - RNA, 15 nt, Salmonella enterica enterica serovar Typhi
caucuccuguaauga

SEQ ID NO: 3637785 - RNA, 23 nt, Salmonella enterica enterica serovar Typhi
caucucgauaccgguaaucaaac

SEQ ID NO: 3637786 - RNA, 22 nt, Salmonella enterica enterica serovar Typhi
caucucgucaaacucuuccggg

SEQ ID NO: 3637787 - RNA, 16 nt, Salmonella enterica enterica serovar Typhi
caucucuucaaacaau

SEQ ID NO: 3637788 - RNA, 15 nt, Salmonella enterica enterica serovar Typhi
caucucuuucagaau

SEQ ID NO: 3637789 - RNA, 21 nt, Salmonella enterica enterica serovar Typhi
caucucuuugcccgucgccga

SEQ ID NO: 3637790 - RNA, 19 nt, Salmonella enterica enterica serovar Typhi
caucucuuuuaauuuucug

SEQ ID NO: 3637791 - RNA, 19 nt, Salmonella enterica enterica serovar Typhi
caucugaaaugcucaauca

SEQ ID NO: 3637792 - RNA, 14 nt, Salmonella enterica enterica serovar Typhi
caucugaccgugag

SEQ ID NO: 3637793 - RNA, 23 nt, Salmonella enterica enterica serovar Typhi
caucugaccgugaguaucgaucg

SEQ ID NO: 3637794 - RNA, 19 nt, Salmonella enterica enterica serovar Typhi
caucugauaauuacgaugc

SEQ ID NO: 3637795 - RNA, 18 nt, Salmonella enterica enterica serovar Typhi
caucugcaauucggcggc

SEQ ID NO: 3637796 - RNA, 16 nt, Salmonella enterica enterica serovar Typhi
caucugccauuucugc

SEQ ID NO: 3637797 - RNA, 22 nt, Salmonella enterica enterica serovar Typhi
caucugcggcaugaauugccgu

SEQ ID NO: 3637798 - RNA, 17 nt, Salmonella enterica enterica serovar Typhi
caucugcggcuuucauc

SEQ ID NO: 3637799 - RNA, 14 nt, Salmonella enterica enterica serovar Typhi
caucugcguugcgc

SEQ ID NO: 3637800 - RNA, 23 nt, Salmonella enterica enterica serovar Typhi
caucugcuccggcguacgggcaa

SEQ ID NO: 3637801 - RNA, 17 nt, Salmonella enterica enterica serovar Typhi
caucugggcugagaaaa

SEQ ID NO: 3637802 - RNA, 15 nt, Salmonella enterica enterica serovar Typhi
caucugggggaagau

SEQ ID NO: 3637803 - RNA, 22 nt, Salmonella enterica enterica serovar Typhi
caucugguuguuucuuaacccc

SEQ ID NO: 3637804 - RNA, 18 nt, Salmonella enterica enterica serovar Typhi
caucugugccagcccaau

SEQ ID NO: 3637805 - RNA, 15 nt, Salmonella enterica enterica serovar Typhi
caucuguucaacuuu

SEQ ID NO: 3637806 - RNA, 18 nt, Salmonella enterica enterica serovar Typhi
caucuguucaacuuuucg

SEQ ID NO: 3637807 - RNA, 23 nt, Salmonella enterica enterica serovar Typhi
caucuuaccggugcgauucagcg

SEQ ID NO: 3637808 - RNA, 12 nt, Salmonella enterica enterica serovar Typhi
caucuuauauuu

SEQ ID NO: 3637809 - RNA, 22 nt, Salmonella enterica enterica serovar Typhi
caucuuauauuuugguguaaca

SEQ ID NO: 3637810 - RNA, 21 nt, Salmonella enterica enterica serovar Typhi
caucuucaccgaugcccagcu

SEQ ID NO: 3637811 - RNA, 16 nt, Salmonella enterica enterica serovar Typhi
caucuucaccuuucca

SEQ ID NO: 3637812 - RNA, 17 nt, Salmonella enterica enterica serovar Typhi
caucuucaccuuuccag

SEQ ID NO: 3637813 - RNA, 21 nt, Salmonella enterica enterica serovar Typhi
caucuucacuucacaaacaau

SEQ ID NO: 3637814 - RNA, 14 nt, Salmonella enterica enterica serovar Typhi
caucuuccagcauc

SEQ ID NO: 3637815 - RNA, 16 nt, Salmonella enterica enterica serovar Typhi
caucuuccagcaucag

SEQ ID NO: 3637816 - RNA, 12 nt, Salmonella enterica enterica serovar Typhi
caucuuccagua

SEQ ID NO: 3637817 - RNA, 23 nt, Salmonella enterica enterica serovar Typhi
caucuuccucacagccuugccag

SEQ ID NO: 3637818 - RNA, 22 nt, Salmonella enterica enterica serovar Typhi
caucuucgagggugggcgcaca

SEQ ID NO: 3637819 - RNA, 14 nt, Salmonella enterica enterica serovar Typhi
caucuucgcccggc

SEQ ID NO: 3637820 - RNA, 15 nt, Salmonella enterica enterica serovar Typhi
caucuucgccuggau

SEQ ID NO: 3637821 - RNA, 15 nt, Salmonella enterica enterica serovar Typhi
caucuucuaccugga

SEQ ID NO: 3637822 - RNA, 21 nt, Salmonella enterica enterica serovar Typhi
caucuucuuugacccacgcca

SEQ ID NO: 3637823 - RNA, 14 nt, Salmonella enterica enterica serovar Typhi
caucuucuuuuucc

SEQ ID NO: 3637824 - RNA, 18 nt, Salmonella enterica enterica serovar Typhi
caucuugaaugauuuugu

SEQ ID NO: 3637825 - RNA, 12 nt, Salmonella enterica enterica serovar Typhi
caucuugcguua

SEQ ID NO: 3637826 - RNA, 13 nt, Salmonella enterica enterica serovar Typhi
caucuugcguuau

SEQ ID NO: 3637827 - RNA, 21 nt, Salmonella enterica enterica serovar Typhi
caucuuuaccaaugugcaaag

SEQ ID NO: 3637828 - RNA, 13 nt, Salmonella enterica enterica serovar Typhi
caucuuuguucug

SEQ ID NO: 3637829 - RNA, 15 nt, Salmonella enterica enterica serovar Typhi
caucuuuuacaggcc

SEQ ID NO: 3637830 - RNA, 14 nt, Salmonella enterica enterica serovar Typhi
caucuuuugccgcg

SEQ ID NO: 3637831 - RNA, 17 nt, Salmonella enterica enterica serovar Typhi
caucuuuuugcucaagc

SEQ ID NO: 3637832 - RNA, 13 nt, Salmonella enterica enterica serovar Typhi
caugaaaaaaacg

SEQ ID NO: 3637833 - RNA, 16 nt, Salmonella enterica enterica serovar Typhi
caugaaaaauauaaaa

SEQ ID NO: 3637834 - RNA, 19 nt, Salmonella enterica enterica serovar Typhi
caugaaaaauauaaaaagc

SEQ ID NO: 3637835 - RNA, 20 nt, Salmonella enterica enterica serovar Typhi
caugaaccuggcgugcgauu

SEQ ID NO: 3637836 - RNA, 16 nt, Salmonella enterica enterica serovar Typhi
caugaacguuaucggc

SEQ ID NO: 3637837 - RNA, 18 nt, Salmonella enterica enterica serovar Typhi
caugaaucaucacaauua

SEQ ID NO: 3637838 - RNA, 21 nt, Salmonella enterica enterica serovar Typhi
caugaaugccccagcgcugcu

SEQ ID NO: 3637839 - RNA, 20 nt, Salmonella enterica enterica serovar Typhi
caugaauuacagcucauaaa

SEQ ID NO: 3637840 - RNA, 17 nt, Salmonella enterica enterica serovar Typhi
caugacaauaacggccu

SEQ ID NO: 3637841 - RNA, 15 nt, Salmonella enterica enterica serovar Typhi
caugacaucagaagu

SEQ ID NO: 3637842 - RNA, 13 nt, Salmonella enterica enterica serovar Typhi
caugacauccaug

SEQ ID NO: 3637843 - RNA, 14 nt, Salmonella enterica enterica serovar Typhi
caugaccaccagcg

SEQ ID NO: 3637844 - RNA, 14 nt, Salmonella enterica enterica serovar Typhi
caugaccauucaca

SEQ ID NO: 3637845 - RNA, 15 nt, Salmonella enterica enterica serovar Typhi
caugacccagagcga

SEQ ID NO: 3637846 - RNA, 16 nt, Salmonella enterica enterica serovar Typhi
caugaccggaugugcc

SEQ ID NO: 3637847 - RNA, 21 nt, Salmonella enterica enterica serovar Typhi
caugacgccaagcugcagaau

SEQ ID NO: 3637848 - RNA, 18 nt, Salmonella enterica enterica serovar Typhi
caugacgccgaaauaaau

SEQ ID NO: 3637849 - RNA, 14 nt, Salmonella enterica enterica serovar Typhi
caugacggcugacg

SEQ ID NO: 3637850 - RNA, 14 nt, Salmonella enterica enterica serovar Typhi
caugacucuuguuu

SEQ ID NO: 3637851 - RNA, 20 nt, Salmonella enterica enterica serovar Typhi
caugacuuuuuucaaccuca

SEQ ID NO: 3637852 - RNA, 13 nt, Salmonella enterica enterica serovar Typhi
caugagaagaaaa

SEQ ID NO: 3637853 - RNA, 16 nt, Salmonella enterica enterica serovar Typhi
caugagccagcccuca

SEQ ID NO: 3637854 - RNA, 18 nt, Salmonella enterica enterica serovar Typhi
caugagucgcgcgcgcca

SEQ ID NO: 3637855 - RNA, 17 nt, Salmonella enterica enterica serovar Typhi
caugauacccagcgucc

SEQ ID NO: 3637856 - RNA, 17 nt, Salmonella enterica enterica serovar Typhi
caugauacguggcucaa

SEQ ID NO: 3637857 - RNA, 16 nt, Salmonella enterica enterica serovar Typhi
caugauagggcagcag

SEQ ID NO: 3637858 - RNA, 19 nt, Salmonella enterica enterica serovar Typhi
caugauaguaucgcugcua

SEQ ID NO: 3637859 - RNA, 23 nt, Salmonella enterica enterica serovar Typhi
caugauaguaucgcugcuaaacg

SEQ ID NO: 3637860 - RNA, 15 nt, Salmonella enterica enterica serovar Typhi
caugauaucgccaau

SEQ ID NO: 3637861 - RNA, 21 nt, Salmonella enterica enterica serovar Typhi
caugaucauacugccgccgug

SEQ ID NO: 3637862 - RNA, 22 nt, Salmonella enterica enterica serovar Typhi
caugauccguucgaucagcugg

SEQ ID NO: 3637863 - RNA, 16 nt, Salmonella enterica enterica serovar Typhi
caugaucgccgccauc

SEQ ID NO: 3637864 - RNA, 21 nt, Salmonella enterica enterica serovar Typhi
caugaucggcuggguuuccgg

SEQ ID NO: 3637865 - RNA, 19 nt, Salmonella enterica enterica serovar Typhi
caugaucucuugcauaaua

SEQ ID NO: 3637866 - RNA, 13 nt, Salmonella enterica enterica serovar Typhi
caugaucuuuccu

SEQ ID NO: 3637867 - RNA, 14 nt, Salmonella enterica enterica serovar Typhi
caugaugaucuuca

SEQ ID NO: 3637868 - RNA, 15 nt, Salmonella enterica enterica serovar Typhi
caugaugaucuucag

SEQ ID NO: 3637869 - RNA, 16 nt, Salmonella enterica enterica serovar Typhi
caugaugaucuucagc

SEQ ID NO: 3637870 - RNA, 13 nt, Salmonella enterica enterica serovar Typhi
caugaugccaaau

SEQ ID NO: 3637871 - RNA, 19 nt, Salmonella enterica enterica serovar Typhi
caugaugccacgagaaauc

SEQ ID NO: 3637872 - RNA, 23 nt, Salmonella enterica enterica serovar Typhi
caugaugccacgagaaauccaca

SEQ ID NO: 3637873 - RNA, 20 nt, Salmonella enterica enterica serovar Typhi
caugauggcgaacagcccca

SEQ ID NO: 3637874 - RNA, 14 nt, Salmonella enterica enterica serovar Typhi
caugauggcguaau

SEQ ID NO: 3637875 - RNA, 16 nt, Salmonella enterica enterica serovar Typhi
caugauggcguaaucc

SEQ ID NO: 3637876 - RNA, 22 nt, Salmonella enterica enterica serovar Typhi
caugaugggcgcacagcgccau

SEQ ID NO: 3637877 - RNA, 15 nt, Salmonella enterica enterica serovar Typhi
caugauggugaacag

SEQ ID NO: 3637878 - RNA, 18 nt, Salmonella enterica enterica serovar Typhi
caugauguucauccauau

SEQ ID NO: 3637879 - RNA, 16 nt, Salmonella enterica enterica serovar Typhi
caugcaacuucaccuc

SEQ ID NO: 3637880 - RNA, 18 nt, Salmonella enterica enterica serovar Typhi
caugcaagagucccagaa

SEQ ID NO: 3637881 - RNA, 15 nt, Salmonella enterica enterica serovar Typhi
caugcaauuugaggu

SEQ ID NO: 3637882 - RNA, 16 nt, Salmonella enterica enterica serovar Typhi
caugcaccacgacggc

SEQ ID NO: 3637883 - RNA, 20 nt, Salmonella enterica enterica serovar Typhi
caugcaccagucccagcccc

SEQ ID NO: 3637884 - RNA, 21 nt, Salmonella enterica enterica serovar Typhi
caugcacgcuuuuuugcuggc

SEQ ID NO: 3637885 - RNA, 22 nt, Salmonella enterica enterica serovar Typhi
caugcagagcaacgagaaccca

SEQ ID NO: 3637886 - RNA, 18 nt, Salmonella enterica enterica serovar Typhi
caugcauaaugcagccau

SEQ ID NO: 3637887 - RNA, 21 nt, Salmonella enterica enterica serovar Typhi
caugcauuaaugggcgaaaac

SEQ ID NO: 3637888 - RNA, 13 nt, Salmonella enterica enterica serovar Typhi
caugccagaagca

SEQ ID NO: 3637889 - RNA, 16 nt, Salmonella enterica enterica serovar Typhi
caugccagaagcaaau

SEQ ID NO: 3637890 - RNA, 21 nt, Salmonella enterica enterica serovar Typhi
caugccagaagcaaauucagg

SEQ ID NO: 3637891 - RNA, 15 nt, Salmonella enterica enterica serovar Typhi
caugccagaauugca

SEQ ID NO: 3637892 - RNA, 17 nt, Salmonella enterica enterica serovar Typhi
caugccagauuuuccag

SEQ ID NO: 3637893 - RNA, 22 nt, Salmonella enterica enterica serovar Typhi
caugccagcaguuuuucaaucu

SEQ ID NO: 3637894 - RNA, 21 nt, Salmonella enterica enterica serovar Typhi
caugccauaaucgauauaauu

SEQ ID NO: 3637895 - RNA, 18 nt, Salmonella enterica enterica serovar Typhi
caugccauacuccugccu

SEQ ID NO: 3637896 - RNA, 16 nt, Salmonella enterica enterica serovar Typhi
caugccaucucuuaau

SEQ ID NO: 3637897 - RNA, 15 nt, Salmonella enterica enterica serovar Typhi
caugcccacaggcag

SEQ ID NO: 3637898 - RNA, 20 nt, Salmonella enterica enterica serovar Typhi
caugcccaguuuacccagcg

SEQ ID NO: 3637899 - RNA, 13 nt, Salmonella enterica enterica serovar Typhi
caugccgccagac

SEQ ID NO: 3637900 - RNA, 15 nt, Salmonella enterica enterica serovar Typhi
caugccgcugcuggc

SEQ ID NO: 3637901 - RNA, 18 nt, Salmonella enterica enterica serovar Typhi
caugccggcuuuccgcac

SEQ ID NO: 3637902 - RNA, 16 nt, Salmonella enterica enterica serovar Typhi
caugccugauggcgcu

SEQ ID NO: 3637903 - RNA, 18 nt, Salmonella enterica enterica serovar Typhi
caugccuucuuugccuuu

SEQ ID NO: 3637904 - RNA, 18 nt, Salmonella enterica enterica serovar Typhi
caugcgacgugucgcgua

SEQ ID NO: 3637905 - RNA, 18 nt, Salmonella enterica enterica serovar Typhi
caugcgaucgggcaaucc

SEQ ID NO: 3637906 - RNA, 18 nt, Salmonella enterica enterica serovar Typhi
caugcgcagaaacugauc

SEQ ID NO: 3637907 - RNA, 21 nt, Salmonella enterica enterica serovar Typhi
caugcgcggcggguugaugau

SEQ ID NO: 3637908 - RNA, 22 nt, Salmonella enterica enterica serovar Typhi
caugcgcgucccggcagugcau

SEQ ID NO: 3637909 - RNA, 15 nt, Salmonella enterica enterica serovar Typhi
caugcggcgccauca

SEQ ID NO: 3637910 - RNA, 23 nt, Salmonella enterica enterica serovar Typhi
caugcgggggaaucuuauuuucc

SEQ ID NO: 3637911 - RNA, 19 nt, Salmonella enterica enterica serovar Typhi
caugcggugcaugaauauc

SEQ ID NO: 3637912 - RNA, 23 nt, Salmonella enterica enterica serovar Typhi
caugcguccgcccagaaagauca

SEQ ID NO: 3637913 - RNA, 18 nt, Salmonella enterica enterica serovar Typhi
caugcgucuucauuuucg

SEQ ID NO: 3637914 - RNA, 15 nt, Salmonella enterica enterica serovar Typhi
caugcguuagauaua

SEQ ID NO: 3637915 - RNA, 21 nt, Salmonella enterica enterica serovar Typhi
caugcuacaggcaaguuuaau

SEQ ID NO: 3637916 - RNA, 15 nt, Salmonella enterica enterica serovar Typhi
caugcuauucagcag

SEQ ID NO: 3637917 - RNA, 19 nt, Salmonella enterica enterica serovar Typhi
caugcuauucagcaguuca

SEQ ID NO: 3637918 - RNA, 20 nt, Salmonella enterica enterica serovar Typhi
caugcucaugcgaucgggca

SEQ ID NO: 3637919 - RNA, 20 nt, Salmonella enterica enterica serovar Typhi
caugcucauuuugauaaauc

SEQ ID NO: 3637920 - RNA, 18 nt, Salmonella enterica enterica serovar Typhi
caugcugaugacuaaugg

SEQ ID NO: 3637921 - RNA, 23 nt, Salmonella enterica enterica serovar Typhi
caugcugaugacuaauggcauuu

SEQ ID NO: 3637922 - RNA, 21 nt, Salmonella enterica enterica serovar Typhi
caugcugcaccgcaucaaacu

SEQ ID NO: 3637923 - RNA, 22 nt, Salmonella enterica enterica serovar Typhi
caugcuguauaaacucagcaau

SEQ ID NO: 3637924 - RNA, 14 nt, Salmonella enterica enterica serovar Typhi
caugcugugugacc

SEQ ID NO: 3637925 - RNA, 18 nt, Salmonella enterica enterica serovar Typhi
caugcuguuaccguaagc

SEQ ID NO: 3637926 - RNA, 15 nt, Salmonella enterica enterica serovar Typhi
caugcuucucaaaga

SEQ ID NO: 3637927 - RNA, 17 nt, Salmonella enterica enterica serovar Typhi
caugcuugcuuugcggc

SEQ ID NO: 3637928 - RNA, 16 nt, Salmonella enterica enterica serovar Typhi
caugcuuucaauaaau

SEQ ID NO: 3637929 - RNA, 23 nt, Salmonella enterica enterica serovar Typhi
cauggcaaaacuaaacccggccu

SEQ ID NO: 3637930 - RNA, 21 nt, Salmonella enterica enterica serovar Typhi
cauggcaaaagacauccccgc

SEQ ID NO: 3637931 - RNA, 20 nt, Salmonella enterica enterica serovar Typhi
cauggcagauaaaccacgcc

SEQ ID NO: 3637932 - RNA, 15 nt, Salmonella enterica enterica serovar Typhi
cauggcagccccggc

SEQ ID NO: 3637933 - RNA, 18 nt, Salmonella enterica enterica serovar Typhi
cauggcaggcagcacaau

SEQ ID NO: 3637934 - RNA, 13 nt, Salmonella enterica enterica serovar Typhi
cauggcccaaaag

SEQ ID NO: 3637935 - RNA, 17 nt, Salmonella enterica enterica serovar Typhi
cauggcccuuuugcccg

SEQ ID NO: 3637936 - RNA, 17 nt, Salmonella enterica enterica serovar Typhi
cauggccuucaaucagc

SEQ ID NO: 3637937 - RNA, 17 nt, Salmonella enterica enterica serovar Typhi
cauggcgaagugcagcg

SEQ ID NO: 3637938 - RNA, 20 nt, Salmonella enterica enterica serovar Typhi
cauggcgcauuaucgauuug

SEQ ID NO: 3637939 - RNA, 13 nt, Salmonella enterica enterica serovar Typhi
cauggcgccacca

SEQ ID NO: 3637940 - RNA, 15 nt, Salmonella enterica enterica serovar Typhi
cauggcgccaccagc

SEQ ID NO: 3637941 - RNA, 17 nt, Salmonella enterica enterica serovar Typhi
cauggcgcgacauggcg

SEQ ID NO: 3637942 - RNA, 16 nt, Salmonella enterica enterica serovar Typhi
cauggcggcgacaaug

SEQ ID NO: 3637943 - RNA, 19 nt, Salmonella enterica enterica serovar Typhi
cauggcggcgacaaugcuc

SEQ ID NO: 3637944 - RNA, 17 nt, Salmonella enterica enterica serovar Typhi
cauggcggucgccauau

SEQ ID NO: 3637945 - RNA, 20 nt, Salmonella enterica enterica serovar Typhi
cauggcgucggcgacuuuca

SEQ ID NO: 3637946 - RNA, 16 nt, Salmonella enterica enterica serovar Typhi
cauggcguuaaugcgc

SEQ ID NO: 3637947 - RNA, 12 nt, Salmonella enterica enterica serovar Typhi
cauggcuauucc

SEQ ID NO: 3637948 - RNA, 17 nt, Salmonella enterica enterica serovar Typhi
cauggcuggcauauugc

SEQ ID NO: 3637949 - RNA, 18 nt, Salmonella enterica enterica serovar Typhi
cauggcuugaucgcgcag

SEQ ID NO: 3637950 - RNA, 14 nt, Salmonella enterica enterica serovar Typhi
caugggaaauaacg

SEQ ID NO: 3637951 - RNA, 15 nt, Salmonella enterica enterica serovar Typhi
caugggaaauaacgu

SEQ ID NO: 3637952 - RNA, 17 nt, Salmonella enterica enterica serovar Typhi
caugggaaauaacguua

SEQ ID NO: 3637953 - RNA, 19 nt, Salmonella enterica enterica serovar Typhi
caugggacgggucuccauc

SEQ ID NO: 3637954 - RNA, 20 nt, Salmonella enterica enterica serovar Typhi
caugggcagcuugccgccaa

SEQ ID NO: 3637955 - RNA, 20 nt, Salmonella enterica enterica serovar Typhi
caugggcgcggcgaacuggu

SEQ ID NO: 3637956 - RNA, 18 nt, Salmonella enterica enterica serovar Typhi
caugggcgggauccugca

SEQ ID NO: 3637957 - RNA, 19 nt, Salmonella enterica enterica serovar Typhi
caugggcgucuuaaugcuc

SEQ ID NO: 3637958 - RNA, 23 nt, Salmonella enterica enterica serovar Typhi
cauggggugaggcaucgcccugu

SEQ ID NO: 3637959 - RNA, 16 nt, Salmonella enterica enterica serovar Typhi
cauggguaaagcccau

SEQ ID NO: 3637960 - RNA, 15 nt, Salmonella enterica enterica serovar Typhi
cauggguuugaccca

SEQ ID NO: 3637961 - RNA, 15 nt, Salmonella enterica enterica serovar Typhi
caugguacucaacau

SEQ ID NO: 3637962 - RNA, 16 nt, Salmonella enterica enterica serovar Typhi
caugguagucaaauuc

SEQ ID NO: 3637963 - RNA, 14 nt, Salmonella enterica enterica serovar Typhi
caugguguucagau

SEQ ID NO: 3637964 - RNA, 21 nt, Salmonella enterica enterica serovar Typhi
caugguguucagauggccaau

SEQ ID NO: 3637965 - RNA, 24 nt, Salmonella enterica enterica serovar Typhi
caugguguugguacacagcacaau

SEQ ID NO: 3637966 - RNA, 22 nt, Salmonella enterica enterica serovar Typhi
caugguuaaaaucacuaagacc

SEQ ID NO: 3637967 - RNA, 14 nt, Salmonella enterica enterica serovar Typhi
caugguuaaccacc

SEQ ID NO: 3637968 - RNA, 18 nt, Salmonella enterica enterica serovar Typhi
caugguugaaaaaagccg

SEQ ID NO: 3637969 - RNA, 15 nt, Salmonella enterica enterica serovar Typhi
caugguugacuuaca

SEQ ID NO: 3637970 - RNA, 22 nt, Salmonella enterica enterica serovar Typhi
caugguugacuuacaaaaaaua

SEQ ID NO: 3637971 - RNA, 13 nt, Salmonella enterica enterica serovar Typhi
cauguaaaugacg

SEQ ID NO: 3637972 - RNA, 15 nt, Salmonella enterica enterica serovar Typhi
cauguaccauuguca

SEQ ID NO: 3637973 - RNA, 20 nt, Salmonella enterica enterica serovar Typhi
cauguacgcaggcgacuggc

SEQ ID NO: 3637974 - RNA, 20 nt, Salmonella enterica enterica serovar Typhi
cauguacggguccuuuuuug

SEQ ID NO: 3637975 - RNA, 18 nt, Salmonella enterica enterica serovar Typhi
cauguagaauagcgccgu

SEQ ID NO: 3637976 - RNA, 21 nt, Salmonella enterica enterica serovar Typhi
cauguagcgcggcagcgcgca

SEQ ID NO: 3637977 - RNA, 23 nt, Salmonella enterica enterica serovar Typhi
cauguccgauagcauuauugcca

SEQ ID NO: 3637978 - RNA, 17 nt, Salmonella enterica enterica serovar Typhi
cauguccggcgacucca

SEQ ID NO: 3637979 - RNA, 13 nt, Salmonella enterica enterica serovar Typhi
caugucguuagaa

SEQ ID NO: 3637980 - RNA, 14 nt, Salmonella enterica enterica serovar Typhi
caugugcagcaucc

SEQ ID NO: 3637981 - RNA, 16 nt, Salmonella enterica enterica serovar Typhi
caugugguaggcuuca

SEQ ID NO: 3637982 - RNA, 22 nt, Salmonella enterica enterica serovar Typhi
cauguuaauugucagcucuuug

SEQ ID NO: 3637983 - RNA, 22 nt, Salmonella enterica enterica serovar Typhi
cauguuagcaaaaaugccguua

SEQ ID NO: 3637984 - RNA, 17 nt, Salmonella enterica enterica serovar Typhi
cauguucccaugucagc

SEQ ID NO: 3637985 - RNA, 17 nt, Salmonella enterica enterica serovar Typhi
cauguuccgccccgccu

SEQ ID NO: 3637986 - RNA, 14 nt, Salmonella enterica enterica serovar Typhi
cauguugaccaggu

SEQ ID NO: 3637987 - RNA, 17 nt, Salmonella enterica enterica serovar Typhi
cauguugccaugaucca

SEQ ID NO: 3637988 - RNA, 19 nt, Salmonella enterica enterica serovar Typhi
cauguugcguaaauaaaua

SEQ ID NO: 3637989 - RNA, 15 nt, Salmonella enterica enterica serovar Typhi
cauguuuccccuucu

SEQ ID NO: 3637990 - RNA, 15 nt, Salmonella enterica enterica serovar Typhi
cauuaaaaaaacaug

SEQ ID NO: 3637991 - RNA, 13 nt, Salmonella enterica enterica serovar Typhi
cauuaaaaaaacg

SEQ ID NO: 3637992 - RNA, 14 nt, Salmonella enterica enterica serovar Typhi
cauuaaaugcgcca

SEQ ID NO: 3637993 - RNA, 17 nt, Salmonella enterica enterica serovar Typhi
cauuaacaaaucauuuc

SEQ ID NO: 3637994 - RNA, 22 nt, Salmonella enterica enterica serovar Typhi
cauuaacaucagaaaaaagcca

SEQ ID NO: 3637995 - RNA, 15 nt, Salmonella enterica enterica serovar Typhi
cauuaacccggcccc

SEQ ID NO: 3637996 - RNA, 17 nt, Salmonella enterica enterica serovar Typhi
cauuaacccggccccga

SEQ ID NO: 3637997 - RNA, 23 nt, Salmonella enterica enterica serovar Typhi
cauuaacgaggcgcuugcuaccc

SEQ ID NO: 3637998 - RNA, 12 nt, Salmonella enterica enterica serovar Typhi
cauuaacgccau

SEQ ID NO: 3637999 - RNA, 22 nt, Salmonella enterica enterica serovar Typhi
cauuaagcccauaaagcacugg

SEQ ID NO: 3638000 - RNA, 16 nt, Salmonella enterica enterica serovar Typhi
cauuaauacacugcgu

SEQ ID NO: 3638001 - RNA, 16 nt, Salmonella enterica enterica serovar Typhi
cauuaauaugcgcaau

SEQ ID NO: 3638002 - RNA, 23 nt, Salmonella enterica enterica serovar Typhi
cauuaauccccggcgaaagaaaa

SEQ ID NO: 3638003 - RNA, 17 nt, Salmonella enterica enterica serovar Typhi
cauuaaucgccauugca

SEQ ID NO: 3638004 - RNA, 18 nt, Salmonella enterica enterica serovar Typhi
cauuacaauguacagaau

SEQ ID NO: 3638005 - RNA, 13 nt, Salmonella enterica enterica serovar Typhi
cauuacauccuca

SEQ ID NO: 3638006 - RNA, 20 nt, Salmonella enterica enterica serovar Typhi
cauuacccaauaaugaacga

SEQ ID NO: 3638007 - RNA, 13 nt, Salmonella enterica enterica serovar Typhi
cauuacccccgcc

SEQ ID NO: 3638008 - RNA, 21 nt, Salmonella enterica enterica serovar Typhi
cauuaccgcccuguccuccau

SEQ ID NO: 3638009 - RNA, 16 nt, Salmonella enterica enterica serovar Typhi
cauuaccuggcaacau

SEQ ID NO: 3638010 - RNA, 14 nt, Salmonella enterica enterica serovar Typhi
cauuacucguccuu

SEQ ID NO: 3638011 - RNA, 14 nt, Salmonella enterica enterica serovar Typhi
cauuagccgccagc

SEQ ID NO: 3638012 - RNA, 15 nt, Salmonella enterica enterica serovar Typhi
cauuagcgcgauaaa

SEQ ID NO: 3638013 - RNA, 20 nt, Salmonella enterica enterica serovar Typhi
cauuagcgcgauaaaaccac

SEQ ID NO: 3638014 - RNA, 15 nt, Salmonella enterica enterica serovar Typhi
cauuauaagcgccaa

SEQ ID NO: 3638015 - RNA, 20 nt, Salmonella enterica enterica serovar Typhi
cauuauaagcgccaacggcc

SEQ ID NO: 3638016 - RNA, 17 nt, Salmonella enterica enterica serovar Typhi
cauuauauagucuuaau

SEQ ID NO: 3638017 - RNA, 13 nt, Salmonella enterica enterica serovar Typhi
cauuaucaccauu

SEQ ID NO: 3638018 - RNA, 17 nt, Salmonella enterica enterica serovar Typhi
cauuaucgaucugagcg

SEQ ID NO: 3638019 - RNA, 14 nt, Salmonella enterica enterica serovar Typhi
cauuaugcuggguu

SEQ ID NO: 3638020 - RNA, 17 nt, Salmonella enterica enterica serovar Typhi
cauuauguuuugaacau

SEQ ID NO: 3638021 - RNA, 20 nt, Salmonella enterica enterica serovar Typhi
cauuauuaaauuaacaccca

SEQ ID NO: 3638022 - RNA, 17 nt, Salmonella enterica enterica serovar Typhi
cauuauugaucucuuca

SEQ ID NO: 3638023 - RNA, 15 nt, Salmonella enterica enterica serovar Typhi
cauuauugcaucaau

SEQ ID NO: 3638024 - RNA, 16 nt, Salmonella enterica enterica serovar Typhi
cauuauuuggauuacg

SEQ ID NO: 3638025 - RNA, 20 nt, Salmonella enterica enterica serovar Typhi
cauuauuuuagugaaaaaau

SEQ ID NO: 3638026 - RNA, 15 nt, Salmonella enterica enterica serovar Typhi
cauuauuuuuaaaua

SEQ ID NO: 3638027 - RNA, 16 nt, Salmonella enterica enterica serovar Typhi
cauuauuuuuaaauaa

SEQ ID NO: 3638028 - RNA, 15 nt, Salmonella enterica enterica serovar Typhi
cauucacacuccagg

SEQ ID NO: 3638029 - RNA, 20 nt, Salmonella enterica enterica serovar Typhi
cauucacccaauaaauaaua

SEQ ID NO: 3638030 - RNA, 17 nt, Salmonella enterica enterica serovar Typhi
cauucagcaacugcgua

SEQ ID NO: 3638031 - RNA, 19 nt, Salmonella enterica enterica serovar Typhi
cauucagcagcgcccagcc

SEQ ID NO: 3638032 - RNA, 19 nt, Salmonella enterica enterica serovar Typhi
cauucaggcaggcgaaacc

SEQ ID NO: 3638033 - RNA, 23 nt, Salmonella enterica enterica serovar Typhi
cauucaggcaggcgaaaccggcc

SEQ ID NO: 3638034 - RNA, 15 nt, Salmonella enterica enterica serovar Typhi
cauucaggccucugc

SEQ ID NO: 3638035 - RNA, 17 nt, Salmonella enterica enterica serovar Typhi
cauucaggccucugcuu

SEQ ID NO: 3638036 - RNA, 14 nt, Salmonella enterica enterica serovar Typhi
cauucaggcuuucc

SEQ ID NO: 3638037 - RNA, 17 nt, Salmonella enterica enterica serovar Typhi
cauucagggaaucagcg

SEQ ID NO: 3638038 - RNA, 22 nt, Salmonella enterica enterica serovar Typhi
cauucaguacgcuuuggcaggc

SEQ ID NO: 3638039 - RNA, 20 nt, Salmonella enterica enterica serovar Typhi
cauucauaagcaaacagugg

SEQ ID NO: 3638040 - RNA, 20 nt, Salmonella enterica enterica serovar Typhi
cauucauaucgccugcggca

SEQ ID NO: 3638041 - RNA, 16 nt, Salmonella enterica enterica serovar Typhi
cauucauugccgccag

SEQ ID NO: 3638042 - RNA, 19 nt, Salmonella enterica enterica serovar Typhi
cauucauuuuaucgauaau

SEQ ID NO: 3638043 - RNA, 12 nt, Salmonella enterica enterica serovar Typhi
cauuccagaccu

SEQ ID NO: 3638044 - RNA, 12 nt, Salmonella enterica enterica serovar Typhi
cauuccagccgg

SEQ ID NO: 3638045 - RNA, 14 nt, Salmonella enterica enterica serovar Typhi
cauucccagcgccc

SEQ ID NO: 3638046 - RNA, 13 nt, Salmonella enterica enterica serovar Typhi
cauuccccacgcc

SEQ ID NO: 3638047 - RNA, 16 nt, Salmonella enterica enterica serovar Typhi
cauucccgccaauaac

SEQ ID NO: 3638048 - RNA, 18 nt, Salmonella enterica enterica serovar Typhi
cauucccgccaauaacca

SEQ ID NO: 3638049 - RNA, 17 nt, Salmonella enterica enterica serovar Typhi
cauucccguaaaagaag

SEQ ID NO: 3638050 - RNA, 12 nt, Salmonella enterica enterica serovar Typhi
cauuccgccugc

SEQ ID NO: 3638051 - RNA, 22 nt, Salmonella enterica enterica serovar Typhi
cauuccgcgcaaauacugaaau

SEQ ID NO: 3638052 - RNA, 17 nt, Salmonella enterica enterica serovar Typhi
cauuccggccaucgccg

SEQ ID NO: 3638053 - RNA, 16 nt, Salmonella enterica enterica serovar Typhi
cauuccugccgccgca

SEQ ID NO: 3638054 - RNA, 17 nt, Salmonella enterica enterica serovar Typhi
cauuccuuuagcuucca

SEQ ID NO: 3638055 - RNA, 17 nt, Salmonella enterica enterica serovar Typhi
cauucgaauccuccugu

SEQ ID NO: 3638056 - RNA, 17 nt, Salmonella enterica enterica serovar Typhi
cauucgacgcugaaccu

SEQ ID NO: 3638057 - RNA, 17 nt, Salmonella enterica enterica serovar Typhi
cauucgauaaccgccga

SEQ ID NO: 3638058 - RNA, 21 nt, Salmonella enterica enterica serovar Typhi
cauucgauaaccgccgacagu

SEQ ID NO: 3638059 - RNA, 23 nt, Salmonella enterica enterica serovar Typhi
cauucgcagcaaaaucuucuggc

SEQ ID NO: 3638060 - RNA, 22 nt, Salmonella enterica enterica serovar Typhi
cauucgccaccaggcucaaauu

SEQ ID NO: 3638061 - RNA, 17 nt, Salmonella enterica enterica serovar Typhi
cauucgccagcggaucg

SEQ ID NO: 3638062 - RNA, 17 nt, Salmonella enterica enterica serovar Typhi
cauucgcccagucauca

SEQ ID NO: 3638063 - RNA, 16 nt, Salmonella enterica enterica serovar Typhi
cauucgccccagcaua

SEQ ID NO: 3638064 - RNA, 16 nt, Salmonella enterica enterica serovar Typhi
cauucgcucaggacag

SEQ ID NO: 3638065 - RNA, 16 nt, Salmonella enterica enterica serovar Typhi
cauucgcuugcccggc

SEQ ID NO: 3638066 - RNA, 14 nt, Salmonella enterica enterica serovar Typhi
cauucgucaaauuc

SEQ ID NO: 3638067 - RNA, 17 nt, Salmonella enterica enterica serovar Typhi
cauucuaccggcugugg

SEQ ID NO: 3638068 - RNA, 18 nt, Salmonella enterica enterica serovar Typhi
cauucuccgggauagcaa

SEQ ID NO: 3638069 - RNA, 18 nt, Salmonella enterica enterica serovar Typhi
cauucucugucgccgccc

SEQ ID NO: 3638070 - RNA, 15 nt, Salmonella enterica enterica serovar Typhi
cauucucuugccugc

SEQ ID NO: 3638071 - RNA, 18 nt, Salmonella enterica enterica serovar Typhi
cauucugacggcccuuuu

SEQ ID NO: 3638072 - RNA, 23 nt, Salmonella enterica enterica serovar Typhi
cauucugauuuuacuaaugaauu

SEQ ID NO: 3638073 - RNA, 21 nt, Salmonella enterica enterica serovar Typhi
cauucugcaggcgggugcgca

SEQ ID NO: 3638074 - RNA, 19 nt, Salmonella enterica enterica serovar Typhi
cauucugcuuaccagaccg

SEQ ID NO: 3638075 - RNA, 12 nt, Salmonella enterica enterica serovar Typhi
cauucugucaga

SEQ ID NO: 3638076 - RNA, 22 nt, Salmonella enterica enterica serovar Typhi
cauucuguuuucgagccuugcc

SEQ ID NO: 3638077 - RNA, 23 nt, Salmonella enterica enterica serovar Typhi
cauucuuugcuuuguaaagcgcc

SEQ ID NO: 3638078 - RNA, 23 nt, Salmonella enterica enterica serovar Typhi
cauucuuuugcccgguggcgcug

SEQ ID NO: 3638079 - RNA, 22 nt, Salmonella enterica enterica serovar Typhi
cauugaccaccauauucgccac

SEQ ID NO: 3638080 - RNA, 18 nt, Salmonella enterica enterica serovar Typhi
cauugagcauucuacagu

SEQ ID NO: 3638081 - RNA, 19 nt, Salmonella enterica enterica serovar Typhi
cauugaggcuacccagaca

SEQ ID NO: 3638082 - RNA, 21 nt, Salmonella enterica enterica serovar Typhi
cauugauauagaguccagcca

SEQ ID NO: 3638083 - RNA, 22 nt, Salmonella enterica enterica serovar Typhi
cauugauauagaguccagccau

SEQ ID NO: 3638084 - RNA, 18 nt, Salmonella enterica enterica serovar Typhi
cauugaucaggcaaaaau

SEQ ID NO: 3638085 - RNA, 19 nt, Salmonella enterica enterica serovar Typhi
cauugaugaugaagcugca

SEQ ID NO: 3638086 - RNA, 17 nt, Salmonella enterica enterica serovar Typhi
cauugcaauaccggcug

SEQ ID NO: 3638087 - RNA, 17 nt, Salmonella enterica enterica serovar Typhi
cauugcaggcuuuuuca

SEQ ID NO: 3638088 - RNA, 16 nt, Salmonella enterica enterica serovar Typhi
cauugccacccauuua

SEQ ID NO: 3638089 - RNA, 23 nt, Salmonella enterica enterica serovar Typhi
cauugccaugcgacuaaccugau

SEQ ID NO: 3638090 - RNA, 19 nt, Salmonella enterica enterica serovar Typhi
cauugccauguuaauacca

SEQ ID NO: 3638091 - RNA, 13 nt, Salmonella enterica enterica serovar Typhi
cauugccgccagu

SEQ ID NO: 3638092 - RNA, 19 nt, Salmonella enterica enterica serovar Typhi
cauugccguuaacugcugc

SEQ ID NO: 3638093 - RNA, 20 nt, Salmonella enterica enterica serovar Typhi
cauugccguuaacugcugcu

SEQ ID NO: 3638094 - RNA, 22 nt, Salmonella enterica enterica serovar Typhi
cauugcgagaaaaaacucagga

SEQ ID NO: 3638095 - RNA, 16 nt, Salmonella enterica enterica serovar Typhi
cauugcgcgccgacag

SEQ ID NO: 3638096 - RNA, 16 nt, Salmonella enterica enterica serovar Typhi
cauugcgcuauuacuc

SEQ ID NO: 3638097 - RNA, 22 nt, Salmonella enterica enterica serovar Typhi
cauugcgcucuaucgccgcccg

SEQ ID NO: 3638098 - RNA, 13 nt, Salmonella enterica enterica serovar Typhi
cauugcguauuuc

SEQ ID NO: 3638099 - RNA, 19 nt, Salmonella enterica enterica serovar Typhi
cauugcuaggaacagugac

SEQ ID NO: 3638100 - RNA, 20 nt, Salmonella enterica enterica serovar Typhi
cauugcugccuuauccggcc

SEQ ID NO: 3638101 - RNA, 15 nt, Salmonella enterica enterica serovar Typhi
cauugcuguggaaaa

SEQ ID NO: 3638102 - RNA, 22 nt, Salmonella enterica enterica serovar Typhi
cauugcuguuaauuucccgcug

SEQ ID NO: 3638103 - RNA, 15 nt, Salmonella enterica enterica serovar Typhi
cauugcuuucuugaa

SEQ ID NO: 3638104 - RNA, 17 nt, Salmonella enterica enterica serovar Typhi
cauuggcaaaccccugc

SEQ ID NO: 3638105 - RNA, 13 nt, Salmonella enterica enterica serovar Typhi
cauuggcaccacc

SEQ ID NO: 3638106 - RNA, 12 nt, Salmonella enterica enterica serovar Typhi
cauuggcaucug

SEQ ID NO: 3638107 - RNA, 17 nt, Salmonella enterica enterica serovar Typhi
cauuggcccggcgcgcg

SEQ ID NO: 3638108 - RNA, 16 nt, Salmonella enterica enterica serovar Typhi
cauuggcgucugcugg

SEQ ID NO: 3638109 - RNA, 19 nt, Salmonella enterica enterica serovar Typhi
cauugguggggcuaaguga

SEQ ID NO: 3638110 - RNA, 21 nt, Salmonella enterica enterica serovar Typhi
cauuguagucaauaaacugga

SEQ ID NO: 3638111 - RNA, 19 nt, Salmonella enterica enterica serovar Typhi
cauuguauuucagggaaaa

SEQ ID NO: 3638112 - RNA, 12 nt, Salmonella enterica enterica serovar Typhi
cauugucaaaaa

SEQ ID NO: 3638113 - RNA, 23 nt, Salmonella enterica enterica serovar Typhi
cauuguccuuuaucugcccuuuc

SEQ ID NO: 3638114 - RNA, 13 nt, Salmonella enterica enterica serovar Typhi
cauuguuaaucca

SEQ ID NO: 3638115 - RNA, 20 nt, Salmonella enterica enterica serovar Typhi
cauuguuauguuuuuagaca

SEQ ID NO: 3638116 - RNA, 19 nt, Salmonella enterica enterica serovar Typhi
cauuguuccugcuggcaaa

SEQ ID NO: 3638117 - RNA, 18 nt, Salmonella enterica enterica serovar Typhi
cauuguugggguuaucgc

SEQ ID NO: 3638118 - RNA, 22 nt, Salmonella enterica enterica serovar Typhi
cauuuaacaggacgcuccauca

SEQ ID NO: 3638119 - RNA, 15 nt, Salmonella enterica enterica serovar Typhi
cauuuaagaaacaau

SEQ ID NO: 3638120 - RNA, 17 nt, Salmonella enterica enterica serovar Typhi
cauuuaaucgccugcgc

SEQ ID NO: 3638121 - RNA, 15 nt, Salmonella enterica enterica serovar Typhi
cauuuaccagugcua

SEQ ID NO: 3638122 - RNA, 16 nt, Salmonella enterica enterica serovar Typhi
cauuuaccuuucccca

SEQ ID NO: 3638123 - RNA, 12 nt, Salmonella enterica enterica serovar Typhi
cauuuacgccaa

SEQ ID NO: 3638124 - RNA, 19 nt, Salmonella enterica enterica serovar Typhi
cauuuacgccagccagaau

SEQ ID NO: 3638125 - RNA, 21 nt, Salmonella enterica enterica serovar Typhi
cauuuauggguuccaguugca

SEQ ID NO: 3638126 - RNA, 15 nt, Salmonella enterica enterica serovar Typhi
cauuuauguuugccc

SEQ ID NO: 3638127 - RNA, 21 nt, Salmonella enterica enterica serovar Typhi
cauuucaagcaggcgaucggc

SEQ ID NO: 3638128 - RNA, 13 nt, Salmonella enterica enterica serovar Typhi
cauuucaaucgcc

SEQ ID NO: 3638129 - RNA, 19 nt, Salmonella enterica enterica serovar Typhi
cauuucaaucgccaccaca

SEQ ID NO: 3638130 - RNA, 15 nt, Salmonella enterica enterica serovar Typhi
cauuucacuuguucu

SEQ ID NO: 3638131 - RNA, 16 nt, Salmonella enterica enterica serovar Typhi
cauuucacuuguucuu

SEQ ID NO: 3638132 - RNA, 19 nt, Salmonella enterica enterica serovar Typhi
cauuucagcgcagaauuua

SEQ ID NO: 3638133 - RNA, 14 nt, Salmonella enterica enterica serovar Typhi
cauuucagucuaau

SEQ ID NO: 3638134 - RNA, 18 nt, Salmonella enterica enterica serovar Typhi
cauuucagucuaauuuau

SEQ ID NO: 3638135 - RNA, 19 nt, Salmonella enterica enterica serovar Typhi
cauuucauauucaaaaucc

SEQ ID NO: 3638136 - RNA, 18 nt, Salmonella enterica enterica serovar Typhi
cauuucccaauaguuuau

SEQ ID NO: 3638137 - RNA, 14 nt, Salmonella enterica enterica serovar Typhi
cauuuccggcgcgc

SEQ ID NO: 3638138 - RNA, 23 nt, Salmonella enterica enterica serovar Typhi
cauuuccggcgcgccuaaaccaa

SEQ ID NO: 3638139 - RNA, 17 nt, Salmonella enterica enterica serovar Typhi
cauuuccggcggcaacc

SEQ ID NO: 3638140 - RNA, 15 nt, Salmonella enterica enterica serovar Typhi
cauuuccucugcgga

SEQ ID NO: 3638141 - RNA, 14 nt, Salmonella enterica enterica serovar Typhi
cauuuccugcauua

SEQ ID NO: 3638142 - RNA, 14 nt, Salmonella enterica enterica serovar Typhi
cauuucgccgccau

SEQ ID NO: 3638143 - RNA, 21 nt, Salmonella enterica enterica serovar Typhi
cauuucgccgccucguaucug

SEQ ID NO: 3638144 - RNA, 16 nt, Salmonella enterica enterica serovar Typhi
cauuucugccugcuuc

SEQ ID NO: 3638145 - RNA, 21 nt, Salmonella enterica enterica serovar Typhi
cauuucuucaagcguuuccag

SEQ ID NO: 3638146 - RNA, 14 nt, Salmonella enterica enterica serovar Typhi
cauuucuuccagca

SEQ ID NO: 3638147 - RNA, 15 nt, Salmonella enterica enterica serovar Typhi
cauuugauuuguuuu

SEQ ID NO: 3638148 - RNA, 17 nt, Salmonella enterica enterica serovar Typhi
cauuugauuuguuuuuu

SEQ ID NO: 3638149 - RNA, 12 nt, Salmonella enterica enterica serovar Typhi
cauuugcagguu

SEQ ID NO: 3638150 - RNA, 22 nt, Salmonella enterica enterica serovar Typhi
cauuugcagguuacucacugcc

SEQ ID NO: 3638151 - RNA, 23 nt, Salmonella enterica enterica serovar Typhi
cauuugcgacaucagccagccgc

SEQ ID NO: 3638152 - RNA, 16 nt, Salmonella enterica enterica serovar Typhi
cauuugcgcauauucc

SEQ ID NO: 3638153 - RNA, 16 nt, Salmonella enterica enterica serovar Typhi
cauuugcuuucaucaa

SEQ ID NO: 3638154 - RNA, 17 nt, Salmonella enterica enterica serovar Typhi
cauuuggcuuaaauaau

SEQ ID NO: 3638155 - RNA, 14 nt, Salmonella enterica enterica serovar Typhi
cauuuguacaaaaa

SEQ ID NO: 3638156 - RNA, 15 nt, Salmonella enterica enterica serovar Typhi
cauuuguacaaaaaa

SEQ ID NO: 3638157 - RNA, 19 nt, Salmonella enterica enterica serovar Typhi
cauuuguagcggcaacagc

SEQ ID NO: 3638158 - RNA, 22 nt, Salmonella enterica enterica serovar Typhi
cauuugucucuuacguugcauu

SEQ ID NO: 3638159 - RNA, 20 nt, Salmonella enterica enterica serovar Typhi
cauuuguuccucgaaacgcu

SEQ ID NO: 3638160 - RNA, 21 nt, Salmonella enterica enterica serovar Typhi
cauuuguuccucgaaacgcug

SEQ ID NO: 3638161 - RNA, 23 nt, Salmonella enterica enterica serovar Typhi
cauuuuaaauacaccaaacgaau

SEQ ID NO: 3638162 - RNA, 17 nt, Salmonella enterica enterica serovar Typhi
cauuuuaccuuuaaacu

SEQ ID NO: 3638163 - RNA, 20 nt, Salmonella enterica enterica serovar Typhi
cauuuuaccuuuaaacuguu

SEQ ID NO: 3638164 - RNA, 14 nt, Salmonella enterica enterica serovar Typhi
cauuuuauccucuu

SEQ ID NO: 3638165 - RNA, 21 nt, Salmonella enterica enterica serovar Typhi
cauuuuaucgacgcuauuuuu

SEQ ID NO: 3638166 - RNA, 15 nt, Salmonella enterica enterica serovar Typhi
cauuuuaucuuuugu

SEQ ID NO: 3638167 - RNA, 18 nt, Salmonella enterica enterica serovar Typhi
cauuuucaccuggaugcu

SEQ ID NO: 3638168 - RNA, 15 nt, Salmonella enterica enterica serovar Typhi
cauuuuccgcugucu

SEQ ID NO: 3638169 - RNA, 17 nt, Salmonella enterica enterica serovar Typhi
cauuuuccgcugucuau

SEQ ID NO: 3638170 - RNA, 19 nt, Salmonella enterica enterica serovar Typhi
cauuuuccggcgacgcuuu

SEQ ID NO: 3638171 - RNA, 15 nt, Salmonella enterica enterica serovar Typhi
cauuuucuuauuuau

SEQ ID NO: 3638172 - RNA, 15 nt, Salmonella enterica enterica serovar Typhi
cauuuucuuuacgcu

SEQ ID NO: 3638173 - RNA, 19 nt, Salmonella enterica enterica serovar Typhi
cauuuugaguugccgaucg

SEQ ID NO: 3638174 - RNA, 20 nt, Salmonella enterica enterica serovar Typhi
cauuuuggggaaaauaccgg

SEQ ID NO: 3638175 - RNA, 19 nt, Salmonella enterica enterica serovar Typhi
cauuuugguuggcgacuuc

SEQ ID NO: 3638176 - RNA, 20 nt, Salmonella enterica enterica serovar Typhi
cauuuuguugcuccagcauc

SEQ ID NO: 3638177 - RNA, 21 nt, Salmonella enterica enterica serovar Typhi
cauuuuuaucaggccugccug

SEQ ID NO: 3638178 - RNA, 12 nt, Salmonella enterica enterica serovar Typhi
cauuuuucucag

SEQ ID NO: 3638179 - RNA, 13 nt, Salmonella enterica enterica serovar Typhi
cauuuuugccauu

SEQ ID NO: 3638180 - RNA, 14 nt, Salmonella enterica enterica serovar Typhi
cauuuuuucagccu

SEQ ID NO: 3638181 - RNA, 21 nt, Salmonella enterica enterica serovar Typhi
cauuuuuugacaacaaaaaga

SEQ ID NO: 3638182 - RNA, 22 nt, Salmonella enterica enterica serovar Typhi
ccaaaaaccguagcguugccaa

SEQ ID NO: 3638183 - RNA, 11 nt, Salmonella enterica enterica serovar Typhi
ccaaaaagaaa

SEQ ID NO: 3638184 - RNA, 14 nt, Salmonella enterica enterica serovar Typhi
ccaaaaauaaaagg

SEQ ID NO: 3638185 - RNA, 16 nt, Salmonella enterica enterica serovar Typhi
ccaaaacccaccagca

SEQ ID NO: 3638186 - RNA, 21 nt, Salmonella enterica enterica serovar Typhi
ccaaaagguuagguuaaauag

SEQ ID NO: 3638187 - RNA, 16 nt, Salmonella enterica enterica serovar Typhi
ccaaaauaauaaaaau

SEQ ID NO: 3638188 - RNA, 19 nt, Salmonella enterica enterica serovar Typhi
ccaaaaugcgcaaagcaua

SEQ ID NO: 3638189 - RNA, 21 nt, Salmonella enterica enterica serovar Typhi
ccaaaauucacgcuucucugg

SEQ ID NO: 3638190 - RNA, 22 nt, Salmonella enterica enterica serovar Typhi
ccaaaccacugauggaguuuca

SEQ ID NO: 3638191 - RNA, 20 nt, Salmonella enterica enterica serovar Typhi
ccaaaccugagcauauaaau

SEQ ID NO: 3638192 - RNA, 19 nt, Salmonella enterica enterica serovar Typhi
ccaaacgaauuuaaauagc

SEQ ID NO: 3638193 - RNA, 19 nt, Salmonella enterica enterica serovar Typhi
ccaaacgcggucaggguga

SEQ ID NO: 3638194 - RNA, 13 nt, Salmonella enterica enterica serovar Typhi
ccaaacggcagcu

SEQ ID NO: 3638195 - RNA, 13 nt, Salmonella enterica enterica serovar Typhi
ccaaacuccucac

SEQ ID NO: 3638196 - RNA, 18 nt, Salmonella enterica enterica serovar Typhi
ccaaacucugaaaaaauu

SEQ ID NO: 3638197 - RNA, 12 nt, Salmonella enterica enterica serovar Typhi
ccaaacugcgga

SEQ ID NO: 3638198 - RNA, 19 nt, Salmonella enterica enterica serovar Typhi
ccaaacugcggaauuuuau

SEQ ID NO: 3638199 - RNA, 15 nt, Salmonella enterica enterica serovar Typhi
ccaaacuggcugugc

SEQ ID NO: 3638200 - RNA, 16 nt, Salmonella enterica enterica serovar Typhi
ccaaacuuacgcagcu

SEQ ID NO: 3638201 - RNA, 15 nt, Salmonella enterica enterica serovar Typhi
ccaaagaaacgcuga

SEQ ID NO: 3638202 - RNA, 14 nt, Salmonella enterica enterica serovar Typhi
ccaaagauaagacc

SEQ ID NO: 3638203 - RNA, 19 nt, Salmonella enterica enterica serovar Typhi
ccaaagcaaucgccagcgc

SEQ ID NO: 3638204 - RNA, 23 nt, Salmonella enterica enterica serovar Typhi
ccaaagcaccauucuucaacaau

SEQ ID NO: 3638205 - RNA, 18 nt, Salmonella enterica enterica serovar Typhi
ccaaagcccgcaaacaga

SEQ ID NO: 3638206 - RNA, 18 nt, Salmonella enterica enterica serovar Typhi
ccaaagcgcauccgguaa

SEQ ID NO: 3638207 - RNA, 16 nt, Salmonella enterica enterica serovar Typhi
ccaaagcgcuacaggg

SEQ ID NO: 3638208 - RNA, 17 nt, Salmonella enterica enterica serovar Typhi
ccaaagcgcugcugcuc

SEQ ID NO: 3638209 - RNA, 18 nt, Salmonella enterica enterica serovar Typhi
ccaaagucaucaauugcu

SEQ ID NO: 3638210 - RNA, 17 nt, Salmonella enterica enterica serovar Typhi
ccaaagugguuccaggc

SEQ ID NO: 3638211 - RNA, 22 nt, Salmonella enterica enterica serovar Typhi
ccaaaguuaaucagcgccgucg

SEQ ID NO: 3638212 - RNA, 15 nt, Salmonella enterica enterica serovar Typhi
ccaaauaacccaggg

SEQ ID NO: 3638213 - RNA, 13 nt, Salmonella enterica enterica serovar Typhi
ccaaauagcgcca

SEQ ID NO: 3638214 - RNA, 15 nt, Salmonella enterica enterica serovar Typhi
ccaaaucaauagaau

SEQ ID NO: 3638215 - RNA, 20 nt, Salmonella enterica enterica serovar Typhi
ccaaaucucccccggcacca

SEQ ID NO: 3638216 - RNA, 16 nt, Salmonella enterica enterica serovar Typhi
ccaaaucuguucuguc

SEQ ID NO: 3638217 - RNA, 18 nt, Salmonella enterica enterica serovar Typhi
ccaaaucuguucugucca

SEQ ID NO: 3638218 - RNA, 13 nt, Salmonella enterica enterica serovar Typhi
ccaacaacccauu

SEQ ID NO: 3638219 - RNA, 21 nt, Salmonella enterica enterica serovar Typhi
ccaacaaggauauccgccagu

SEQ ID NO: 3638220 - RNA, 19 nt, Salmonella enterica enterica serovar Typhi
ccaacaaucagaagaaaua

SEQ ID NO: 3638221 - RNA, 14 nt, Salmonella enterica enterica serovar Typhi
ccaacaaucgcacc

SEQ ID NO: 3638222 - RNA, 18 nt, Salmonella enterica enterica serovar Typhi
ccaacaaucgcaccaggc

SEQ ID NO: 3638223 - RNA, 19 nt, Salmonella enterica enterica serovar Typhi
ccaacacaucgacaugcag

SEQ ID NO: 3638224 - RNA, 12 nt, Salmonella enterica enterica serovar Typhi
ccaacaccagcc

SEQ ID NO: 3638225 - RNA, 15 nt, Salmonella enterica enterica serovar Typhi
ccaacacggcgcuca

SEQ ID NO: 3638226 - RNA, 18 nt, Salmonella enterica enterica serovar Typhi
ccaacacggcgcucagga

SEQ ID NO: 3638227 - RNA, 12 nt, Salmonella enterica enterica serovar Typhi
ccaacagcgcaa

SEQ ID NO: 3638228 - RNA, 13 nt, Salmonella enterica enterica serovar Typhi
ccaacaggaacau

SEQ ID NO: 3638229 - RNA, 22 nt, Salmonella enterica enterica serovar Typhi
ccaacaggaacaucguguccug

SEQ ID NO: 3638230 - RNA, 21 nt, Salmonella enterica enterica serovar Typhi
ccaacagggcggccuccuggc

SEQ ID NO: 3638231 - RNA, 21 nt, Salmonella enterica enterica serovar Typhi
ccaacagguuaaucagcacau

SEQ ID NO: 3638232 - RNA, 12 nt, Salmonella enterica enterica serovar Typhi
ccaacagucaug

SEQ ID NO: 3638233 - RNA, 15 nt, Salmonella enterica enterica serovar Typhi
ccaacagucaugaaa

SEQ ID NO: 3638234 - RNA, 15 nt, Salmonella enterica enterica serovar Typhi
ccaacauacaugccu

SEQ ID NO: 3638235 - RNA, 21 nt, Salmonella enterica enterica serovar Typhi
ccaacauacaugccugcgcca

SEQ ID NO: 3638236 - RNA, 21 nt, Salmonella enterica enterica serovar Typhi
ccaacauagcuaaauaaaaau

SEQ ID NO: 3638237 - RNA, 21 nt, Salmonella enterica enterica serovar Typhi
ccaacaucaguucagaaacgg

SEQ ID NO: 3638238 - RNA, 21 nt, Salmonella enterica enterica serovar Typhi
ccaacauguaauuacggcaca

SEQ ID NO: 3638239 - RNA, 12 nt, Salmonella enterica enterica serovar Typhi
ccaaccaaccca

SEQ ID NO: 3638240 - RNA, 16 nt, Salmonella enterica enterica serovar Typhi
ccaaccaggcaaacca

SEQ ID NO: 3638241 - RNA, 14 nt, Salmonella enterica enterica serovar Typhi
ccaaccgccagcca

SEQ ID NO: 3638242 - RNA, 23 nt, Salmonella enterica enterica serovar Typhi
ccaaccgcgacggggcgcagaaa

SEQ ID NO: 3638243 - RNA, 17 nt, Salmonella enterica enterica serovar Typhi
ccaacgaaacucagcgg

SEQ ID NO: 3638244 - RNA, 14 nt, Salmonella enterica enterica serovar Typhi
ccaacgccaacaua

SEQ ID NO: 3638245 - RNA, 19 nt, Salmonella enterica enterica serovar Typhi
ccaacgcuucacaaccuga

SEQ ID NO: 3638246 - RNA, 22 nt, Salmonella enterica enterica serovar Typhi
ccaacggcgacgcccgccaucu

SEQ ID NO: 3638247 - RNA, 14 nt, Salmonella enterica enterica serovar Typhi
ccaacguauaaaau

SEQ ID NO: 3638248 - RNA, 15 nt, Salmonella enterica enterica serovar Typhi
ccaacugcgccugaa

SEQ ID NO: 3638249 - RNA, 16 nt, Salmonella enterica enterica serovar Typhi
ccaacugcgccugaag

SEQ ID NO: 3638250 - RNA, 17 nt, Salmonella enterica enterica serovar Typhi
ccaacugcgccugaaga

SEQ ID NO: 3638251 - RNA, 21 nt, Salmonella enterica enterica serovar Typhi
ccaacuguauuuugaaaacac

SEQ ID NO: 3638252 - RNA, 17 nt, Salmonella enterica enterica serovar Typhi
ccaacugucgccauccu

SEQ ID NO: 3638253 - RNA, 18 nt, Salmonella enterica enterica serovar Typhi
ccaagaccgccuaacagc

SEQ ID NO: 3638254 - RNA, 21 nt, Salmonella enterica enterica serovar Typhi
ccaagaucgccaagcugugau

SEQ ID NO: 3638255 - RNA, 15 nt, Salmonella enterica enterica serovar Typhi
ccaagauuuuucaga

SEQ ID NO: 3638256 - RNA, 18 nt, Salmonella enterica enterica serovar Typhi
ccaagcaacacggcgaca

SEQ ID NO: 3638257 - RNA, 14 nt, Salmonella enterica enterica serovar Typhi
ccaagcacaaaaag

SEQ ID NO: 3638258 - RNA, 14 nt, Salmonella enterica enterica serovar Typhi
ccaagcagcgccac

SEQ ID NO: 3638259 - RNA, 22 nt, Salmonella enterica enterica serovar Typhi
ccaagcgcgguaaauuucuuga

SEQ ID NO: 3638260 - RNA, 22 nt, Salmonella enterica enterica serovar Typhi
ccaagcggcaacucugugcguu

SEQ ID NO: 3638261 - RNA, 15 nt, Salmonella enterica enterica serovar Typhi
ccaagcguaguacgu

SEQ ID NO: 3638262 - RNA, 23 nt, Salmonella enterica enterica serovar Typhi
ccaaggcaucugcgcaacuggaa

SEQ ID NO: 3638263 - RNA, 20 nt, Salmonella enterica enterica serovar Typhi
ccaaggcaugauuaaagcca

SEQ ID NO: 3638264 - RNA, 18 nt, Salmonella enterica enterica serovar Typhi
ccaaguaauaaagagaac

SEQ ID NO: 3638265 - RNA, 17 nt, Salmonella enterica enterica serovar Typhi
ccaagucuccgcccagc

SEQ ID NO: 3638266 - RNA, 16 nt, Salmonella enterica enterica serovar Typhi
ccaauaacguaaccgc

SEQ ID NO: 3638267 - RNA, 17 nt, Salmonella enterica enterica serovar Typhi
ccaauaacguaaccgcu

SEQ ID NO: 3638268 - RNA, 12 nt, Salmonella enterica enterica serovar Typhi
ccaauaagaacu

SEQ ID NO: 3638269 - RNA, 16 nt, Salmonella enterica enterica serovar Typhi
ccaauaauaaucccaa

SEQ ID NO: 3638270 - RNA, 17 nt, Salmonella enterica enterica serovar Typhi
ccaauaccacaaccgga

SEQ ID NO: 3638271 - RNA, 12 nt, Salmonella enterica enterica serovar Typhi
ccaauacccagc

SEQ ID NO: 3638272 - RNA, 16 nt, Salmonella enterica enterica serovar Typhi
ccaauacccagcgcca

SEQ ID NO: 3638273 - RNA, 17 nt, Salmonella enterica enterica serovar Typhi
ccaauacccagcgccaa

SEQ ID NO: 3638274 - RNA, 23 nt, Salmonella enterica enterica serovar Typhi
ccaauacccagcgccaacgccac

SEQ ID NO: 3638275 - RNA, 15 nt, Salmonella enterica enterica serovar Typhi
ccaauaccggcguaa

SEQ ID NO: 3638276 - RNA, 21 nt, Salmonella enterica enterica serovar Typhi
ccaauaccggcguaauugcgc

SEQ ID NO: 3638277 - RNA, 19 nt, Salmonella enterica enterica serovar Typhi
ccaauagagcaguuaauaa

SEQ ID NO: 3638278 - RNA, 22 nt, Salmonella enterica enterica serovar Typhi
ccaauagagcaguuaauaauga

SEQ ID NO: 3638279 - RNA, 13 nt, Salmonella enterica enterica serovar Typhi
ccaauagcgcuga

SEQ ID NO: 3638280 - RNA, 16 nt, Salmonella enterica enterica serovar Typhi
ccaauaguauccauaa

SEQ ID NO: 3638281 - RNA, 16 nt, Salmonella enterica enterica serovar Typhi
ccaaucaacgccgcca

SEQ ID NO: 3638282 - RNA, 17 nt, Salmonella enterica enterica serovar Typhi
ccaaucagcggguauug

SEQ ID NO: 3638283 - RNA, 22 nt, Salmonella enterica enterica serovar Typhi
ccaaucaugucaaauucaagcc

SEQ ID NO: 3638284 - RNA, 16 nt, Salmonella enterica enterica serovar Typhi
ccaauccugcacccgc

SEQ ID NO: 3638285 - RNA, 15 nt, Salmonella enterica enterica serovar Typhi
ccaaucgagaagcca

SEQ ID NO: 3638286 - RNA, 13 nt, Salmonella enterica enterica serovar Typhi
ccaaucuccagca

SEQ ID NO: 3638287 - RNA, 21 nt, Salmonella enterica enterica serovar Typhi
ccaaugaaauaauuguguaau

SEQ ID NO: 3638288 - RNA, 19 nt, Salmonella enterica enterica serovar Typhi
ccaaugaacccucgaaugu

SEQ ID NO: 3638289 - RNA, 15 nt, Salmonella enterica enterica serovar Typhi
ccaaugacaauaauc

SEQ ID NO: 3638290 - RNA, 12 nt, Salmonella enterica enterica serovar Typhi
ccaaugagcugc

SEQ ID NO: 3638291 - RNA, 14 nt, Salmonella enterica enterica serovar Typhi
ccaaugcgaaaaua

SEQ ID NO: 3638292 - RNA, 22 nt, Salmonella enterica enterica serovar Typhi
ccaaugcuuagucagccuuaau

SEQ ID NO: 3638293 - RNA, 17 nt, Salmonella enterica enterica serovar Typhi
ccaauguacacgaaaua

SEQ ID NO: 3638294 - RNA, 18 nt, Salmonella enterica enterica serovar Typhi
ccaauguacguaaaacca

SEQ ID NO: 3638295 - RNA, 18 nt, Salmonella enterica enterica serovar Typhi
ccaaugucauauuuguga

SEQ ID NO: 3638296 - RNA, 15 nt, Salmonella enterica enterica serovar Typhi
ccaauguuaauaagc

SEQ ID NO: 3638297 - RNA, 21 nt, Salmonella enterica enterica serovar Typhi
ccaauugccacauagcaucca

SEQ ID NO: 3638298 - RNA, 12 nt, Salmonella enterica enterica serovar Typhi
ccaauuuuucac

SEQ ID NO: 3638299 - RNA, 17 nt, Salmonella enterica enterica serovar Typhi
ccacaaaaccguugucg

SEQ ID NO: 3638300 - RNA, 13 nt, Salmonella enterica enterica serovar Typhi
ccacaaaggcgcg

SEQ ID NO: 3638301 - RNA, 16 nt, Salmonella enterica enterica serovar Typhi
ccacaaauucugaaga

SEQ ID NO: 3638302 - RNA, 23 nt, Salmonella enterica enterica serovar Typhi
ccacaaccgcccccaacugagcg

SEQ ID NO: 3638303 - RNA, 12 nt, Salmonella enterica enterica serovar Typhi
ccacaaccggcu

SEQ ID NO: 3638304 - RNA, 16 nt, Salmonella enterica enterica serovar Typhi
ccacaaccggcuggcu

SEQ ID NO: 3638305 - RNA, 18 nt, Salmonella enterica enterica serovar Typhi
ccacaacgugauaaccaa

SEQ ID NO: 3638306 - RNA, 22 nt, Salmonella enterica enterica serovar Typhi
ccacaagagcagcaacccugcc

SEQ ID NO: 3638307 - RNA, 18 nt, Salmonella enterica enterica serovar Typhi
ccacaauugccagcaggu

SEQ ID NO: 3638308 - RNA, 14 nt, Salmonella enterica enterica serovar Typhi
ccacaauuguagcu

SEQ ID NO: 3638309 - RNA, 21 nt, Salmonella enterica enterica serovar Typhi
ccacaccugaugguuauuuuc

SEQ ID NO: 3638310 - RNA, 21 nt, Salmonella enterica enterica serovar Typhi
ccacacggaauccccggcuuc

SEQ ID NO: 3638311 - RNA, 16 nt, Salmonella enterica enterica serovar Typhi
ccacacggcauucacg

SEQ ID NO: 3638312 - RNA, 13 nt, Salmonella enterica enterica serovar Typhi
ccacacugcaucg

SEQ ID NO: 3638313 - RNA, 15 nt, Salmonella enterica enterica serovar Typhi
ccacacugcaucgaa

SEQ ID NO: 3638314 - RNA, 13 nt, Salmonella enterica enterica serovar Typhi
ccacacugcugug

SEQ ID NO: 3638315 - RNA, 22 nt, Salmonella enterica enterica serovar Typhi
ccacagcauaccgugugcagug

SEQ ID NO: 3638316 - RNA, 18 nt, Salmonella enterica enterica serovar Typhi
ccacagccaccgccagca

SEQ ID NO: 3638317 - RNA, 17 nt, Salmonella enterica enterica serovar Typhi
ccacagccgcauuuuuu

SEQ ID NO: 3638318 - RNA, 23 nt, Salmonella enterica enterica serovar Typhi
ccacagccgguuagccacaauga

SEQ ID NO: 3638319 - RNA, 20 nt, Salmonella enterica enterica serovar Typhi
ccacagcgaauuccggccau

SEQ ID NO: 3638320 - RNA, 11 nt, Salmonella enterica enterica serovar Typhi
ccacagcgcca

SEQ ID NO: 3638321 - RNA, 13 nt, Salmonella enterica enterica serovar Typhi
ccacagcgguaua

SEQ ID NO: 3638322 - RNA, 23 nt, Salmonella enterica enterica serovar Typhi
ccacaggaccacguucccgauuc

SEQ ID NO: 3638323 - RNA, 18 nt, Salmonella enterica enterica serovar Typhi
ccacaggcagggcgaugc

SEQ ID NO: 3638324 - RNA, 15 nt, Salmonella enterica enterica serovar Typhi
ccacaggccaacaua

SEQ ID NO: 3638325 - RNA, 16 nt, Salmonella enterica enterica serovar Typhi
ccacaggccaacauag

SEQ ID NO: 3638326 - RNA, 9 nt, Salmonella enterica enterica serovar Typhi
ccacaggcu

SEQ ID NO: 3638327 - RNA, 21 nt, Salmonella enterica enterica serovar Typhi
ccacagucauggcuuuuaccc

SEQ ID NO: 3638328 - RNA, 17 nt, Salmonella enterica enterica serovar Typhi
ccacagucgucuggcgc

SEQ ID NO: 3638329 - RNA, 19 nt, Salmonella enterica enterica serovar Typhi
ccacagugacccgccgcca

SEQ ID NO: 3638330 - RNA, 20 nt, Salmonella enterica enterica serovar Typhi
ccacagugacccgccgccag

SEQ ID NO: 3638331 - RNA, 16 nt, Salmonella enterica enterica serovar Typhi
ccacaguuaacgccaa

SEQ ID NO: 3638332 - RNA, 22 nt, Salmonella enterica enterica serovar Typhi
ccacaguugguucugcucaaug

SEQ ID NO: 3638333 - RNA, 17 nt, Salmonella enterica enterica serovar Typhi
ccacauagcauccagac

SEQ ID NO: 3638334 - RNA, 16 nt, Salmonella enterica enterica serovar Typhi
ccacauauaaguaacu

SEQ ID NO: 3638335 - RNA, 19 nt, Salmonella enterica enterica serovar Typhi
ccacauauaaguaacuggu

SEQ ID NO: 3638336 - RNA, 14 nt, Salmonella enterica enterica serovar Typhi
ccacaucagaccgc

SEQ ID NO: 3638337 - RNA, 17 nt, Salmonella enterica enterica serovar Typhi
ccacauccaccccgguu

SEQ ID NO: 3638338 - RNA, 12 nt, Salmonella enterica enterica serovar Typhi
ccacauccagcg

SEQ ID NO: 3638339 - RNA, 23 nt, Salmonella enterica enterica serovar Typhi
ccacauccagcgccagcgccacc

SEQ ID NO: 3638340 - RNA, 17 nt, Salmonella enterica enterica serovar Typhi
ccacaugaccagcgccg

SEQ ID NO: 3638341 - RNA, 23 nt, Salmonella enterica enterica serovar Typhi
ccacaugccggugcgagaaaaag

SEQ ID NO: 3638342 - RNA, 16 nt, Salmonella enterica enterica serovar Typhi
ccacauuccagaccug

SEQ ID NO: 3638343 - RNA, 12 nt, Salmonella enterica enterica serovar Typhi
ccaccaaagcca

SEQ ID NO: 3638344 - RNA, 17 nt, Salmonella enterica enterica serovar Typhi
ccaccaaagccaggccg

SEQ ID NO: 3638345 - RNA, 11 nt, Salmonella enterica enterica serovar Typhi
ccaccacaaac

SEQ ID NO: 3638346 - RNA, 12 nt, Salmonella enterica enterica serovar Typhi
ccaccacaaagc

SEQ ID NO: 3638347 - RNA, 13 nt, Salmonella enterica enterica serovar Typhi
ccaccaccagcgu

SEQ ID NO: 3638348 - RNA, 19 nt, Salmonella enterica enterica serovar Typhi
ccaccacccagugccacca

SEQ ID NO: 3638349 - RNA, 21 nt, Salmonella enterica enterica serovar Typhi
ccaccacccagugccaccagc

SEQ ID NO: 3638350 - RNA, 13 nt, Salmonella enterica enterica serovar Typhi
ccaccaccgccac

SEQ ID NO: 3638351 - RNA, 14 nt, Salmonella enterica enterica serovar Typhi
ccaccaccuccugc

SEQ ID NO: 3638352 - RNA, 13 nt, Salmonella enterica enterica serovar Typhi
ccaccacgcagcc

SEQ ID NO: 3638353 - RNA, 20 nt, Salmonella enterica enterica serovar Typhi
ccaccacguuaccgcgcagu

SEQ ID NO: 3638354 - RNA, 20 nt, Salmonella enterica enterica serovar Typhi
ccaccagaaucgccagcauc

SEQ ID NO: 3638355 - RNA, 18 nt, Salmonella enterica enterica serovar Typhi
ccaccagccggagccggu

SEQ ID NO: 3638356 - RNA, 13 nt, Salmonella enterica enterica serovar Typhi
ccaccagcgccag

SEQ ID NO: 3638357 - RNA, 16 nt, Salmonella enterica enterica serovar Typhi
ccaccagcgccagcgg

SEQ ID NO: 3638358 - RNA, 18 nt, Salmonella enterica enterica serovar Typhi
ccaccagcgccagcggcu

SEQ ID NO: 3638359 - RNA, 17 nt, Salmonella enterica enterica serovar Typhi
ccaccagcgccaggcca

SEQ ID NO: 3638360 - RNA, 13 nt, Salmonella enterica enterica serovar Typhi
ccaccagcgccau

SEQ ID NO: 3638361 - RNA, 22 nt, Salmonella enterica enterica serovar Typhi
ccaccagcgccauaauccagaa

SEQ ID NO: 3638362 - RNA, 23 nt, Salmonella enterica enterica serovar Typhi
ccaccagcgccauaauccagaau

SEQ ID NO: 3638363 - RNA, 15 nt, Salmonella enterica enterica serovar Typhi
ccaccagcggacggc

SEQ ID NO: 3638364 - RNA, 22 nt, Salmonella enterica enterica serovar Typhi
ccaccagcuuaucugaccaugc

SEQ ID NO: 3638365 - RNA, 18 nt, Salmonella enterica enterica serovar Typhi
ccaccaggaacgccauau

SEQ ID NO: 3638366 - RNA, 21 nt, Salmonella enterica enterica serovar Typhi
ccaccaggaaugcggccaucc

SEQ ID NO: 3638367 - RNA, 15 nt, Salmonella enterica enterica serovar Typhi
ccaccagguucagca

SEQ ID NO: 3638368 - RNA, 17 nt, Salmonella enterica enterica serovar Typhi
ccaccauaggccagcgu

SEQ ID NO: 3638369 - RNA, 19 nt, Salmonella enterica enterica serovar Typhi
ccaccauauucgccaccgc

SEQ ID NO: 3638370 - RNA, 21 nt, Salmonella enterica enterica serovar Typhi
ccaccauauucgccaccgcgc

SEQ ID NO: 3638371 - RNA, 17 nt, Salmonella enterica enterica serovar Typhi
ccaccaucagacccgau

SEQ ID NO: 3638372 - RNA, 13 nt, Salmonella enterica enterica serovar Typhi
ccaccauccgcgc

SEQ ID NO: 3638373 - RNA, 23 nt, Salmonella enterica enterica serovar Typhi
ccaccaugauuagaaacccauau

SEQ ID NO: 3638374 - RNA, 16 nt, Salmonella enterica enterica serovar Typhi
ccaccaugcugguugg

SEQ ID NO: 3638375 - RNA, 23 nt, Salmonella enterica enterica serovar Typhi
ccacccauuuauguuugcccagc

SEQ ID NO: 3638376 - RNA, 13 nt, Salmonella enterica enterica serovar Typhi
ccacccgcuauga

SEQ ID NO: 3638377 - RNA, 15 nt, Salmonella enterica enterica serovar Typhi
ccacccgggaagccc

SEQ ID NO: 3638378 - RNA, 15 nt, Salmonella enterica enterica serovar Typhi
ccacccgguuuacca

SEQ ID NO: 3638379 - RNA, 17 nt, Salmonella enterica enterica serovar Typhi
ccaccgccgccaccaaa

SEQ ID NO: 3638380 - RNA, 15 nt, Salmonella enterica enterica serovar Typhi
ccaccgccucgccaa

SEQ ID NO: 3638381 - RNA, 16 nt, Salmonella enterica enterica serovar Typhi
ccaccgcgcgcuuaau

SEQ ID NO: 3638382 - RNA, 15 nt, Salmonella enterica enterica serovar Typhi
ccaccgcuccgcgca

SEQ ID NO: 3638383 - RNA, 23 nt, Salmonella enterica enterica serovar Typhi
ccaccggaccuaauagccagccc

SEQ ID NO: 3638384 - RNA, 23 nt, Salmonella enterica enterica serovar Typhi
ccaccggagcggcguccgccagc

SEQ ID NO: 3638385 - RNA, 14 nt, Salmonella enterica enterica serovar Typhi
ccaccgggccguca

SEQ ID NO: 3638386 - RNA, 22 nt, Salmonella enterica enterica serovar Typhi
ccaccggguccagucgcgccgc

SEQ ID NO: 3638387 - RNA, 20 nt, Salmonella enterica enterica serovar Typhi
ccaccggguuaaagcccuga

SEQ ID NO: 3638388 - RNA, 16 nt, Salmonella enterica enterica serovar Typhi
ccaccgguauccgcau

SEQ ID NO: 3638389 - RNA, 16 nt, Salmonella enterica enterica serovar Typhi
ccaccucguucaaaca

SEQ ID NO: 3638390 - RNA, 15 nt, Salmonella enterica enterica serovar Typhi
ccaccugaucgccaa

SEQ ID NO: 3638391 - RNA, 15 nt, Salmonella enterica enterica serovar Typhi
ccaccugccaguccg

SEQ ID NO: 3638392 - RNA, 13 nt, Salmonella enterica enterica serovar Typhi
ccaccugcgcguu

SEQ ID NO: 3638393 - RNA, 21 nt, Salmonella enterica enterica serovar Typhi
ccaccuggcccugcaucagcu

SEQ ID NO: 3638394 - RNA, 19 nt, Salmonella enterica enterica serovar Typhi
ccaccuguuucgccaggcc

SEQ ID NO: 3638395 - RNA, 21 nt, Salmonella enterica enterica serovar Typhi
ccaccuuaaucgacuucaugc

SEQ ID NO: 3638396 - RNA, 13 nt, Salmonella enterica enterica serovar Typhi
ccaccuucgcgga

SEQ ID NO: 3638397 - RNA, 19 nt, Salmonella enterica enterica serovar Typhi
ccaccuucucuuuaugcgu

SEQ ID NO: 3638398 - RNA, 15 nt, Salmonella enterica enterica serovar Typhi
ccaccuuucugcucc

SEQ ID NO: 3638399 - RNA, 18 nt, Salmonella enterica enterica serovar Typhi
ccacgaaaauuauuuucg

SEQ ID NO: 3638400 - RNA, 17 nt, Salmonella enterica enterica serovar Typhi
ccacgaacgauauaaaa

SEQ ID NO: 3638401 - RNA, 15 nt, Salmonella enterica enterica serovar Typhi
ccacgacauccggaa

SEQ ID NO: 3638402 - RNA, 18 nt, Salmonella enterica enterica serovar Typhi
ccacgaccuacaccguau

SEQ ID NO: 3638403 - RNA, 17 nt, Salmonella enterica enterica serovar Typhi
ccacgauagacagcacc

SEQ ID NO: 3638404 - RNA, 17 nt, Salmonella enterica enterica serovar Typhi
ccacgaucugauucaau

SEQ ID NO: 3638405 - RNA, 15 nt, Salmonella enterica enterica serovar Typhi
ccacgcagcgcagac

SEQ ID NO: 3638406 - RNA, 17 nt, Salmonella enterica enterica serovar Typhi
ccacgcaggcgaccucg

SEQ ID NO: 3638407 - RNA, 11 nt, Salmonella enterica enterica serovar Typhi
ccacgccaccg

SEQ ID NO: 3638408 - RNA, 20 nt, Salmonella enterica enterica serovar Typhi
ccacgccaccgggccgucag

SEQ ID NO: 3638409 - RNA, 15 nt, Salmonella enterica enterica serovar Typhi
ccacgccagcagcuc

SEQ ID NO: 3638410 - RNA, 17 nt, Salmonella enterica enterica serovar Typhi
ccacgccaucgcggcgc

SEQ ID NO: 3638411 - RNA, 18 nt, Salmonella enterica enterica serovar Typhi
ccacgccauggccgcagc

SEQ ID NO: 3638412 - RNA, 15 nt, Salmonella enterica enterica serovar Typhi
ccacgcccagcgccg

SEQ ID NO: 3638413 - RNA, 13 nt, Salmonella enterica enterica serovar Typhi
ccacgcccagcua

SEQ ID NO: 3638414 - RNA, 13 nt, Salmonella enterica enterica serovar Typhi
ccacgcccgccgc

SEQ ID NO: 3638415 - RNA, 14 nt, Salmonella enterica enterica serovar Typhi
ccacgcccuucacg

SEQ ID NO: 3638416 - RNA, 19 nt, Salmonella enterica enterica serovar Typhi
ccacgcccuucacgccgaa

SEQ ID NO: 3638417 - RNA, 20 nt, Salmonella enterica enterica serovar Typhi
ccacgccgagaaacaccaga

SEQ ID NO: 3638418 - RNA, 20 nt, Salmonella enterica enterica serovar Typhi
ccacgccgcaaggacgccag

SEQ ID NO: 3638419 - RNA, 12 nt, Salmonella enterica enterica serovar Typhi
ccacgccgccau

SEQ ID NO: 3638420 - RNA, 17 nt, Salmonella enterica enterica serovar Typhi
ccacgccgcuaucgacc

SEQ ID NO: 3638421 - RNA, 14 nt, Salmonella enterica enterica serovar Typhi
ccacgccguagcug

SEQ ID NO: 3638422 - RNA, 14 nt, Salmonella enterica enterica serovar Typhi
ccacgccguccgga

SEQ ID NO: 3638423 - RNA, 15 nt, Salmonella enterica enterica serovar Typhi
ccacgccguccggag

SEQ ID NO: 3638424 - RNA, 14 nt, Salmonella enterica enterica serovar Typhi
ccacgcgacgccag

SEQ ID NO: 3638425 - RNA, 16 nt, Salmonella enterica enterica serovar Typhi
ccacgcgagcugccag

SEQ ID NO: 3638426 - RNA, 14 nt, Salmonella enterica enterica serovar Typhi
ccacgcgccgccga

SEQ ID NO: 3638427 - RNA, 17 nt, Salmonella enterica enterica serovar Typhi
ccacgcgcggcaucauu

SEQ ID NO: 3638428 - RNA, 13 nt, Salmonella enterica enterica serovar Typhi
ccacgcggcgugc

SEQ ID NO: 3638429 - RNA, 13 nt, Salmonella enterica enterica serovar Typhi
ccacgcugacgcg

SEQ ID NO: 3638430 - RNA, 14 nt, Salmonella enterica enterica serovar Typhi
ccacgcugccgccg

SEQ ID NO: 3638431 - RNA, 14 nt, Salmonella enterica enterica serovar Typhi
ccacgcuuuuccuu

SEQ ID NO: 3638432 - RNA, 19 nt, Salmonella enterica enterica serovar Typhi
ccacggauaagccagcccu

SEQ ID NO: 3638433 - RNA, 20 nt, Salmonella enterica enterica serovar Typhi
ccacggauauuuaccgccgc

SEQ ID NO: 3638434 - RNA, 15 nt, Salmonella enterica enterica serovar Typhi
ccacggccacagcca

SEQ ID NO: 3638435 - RNA, 15 nt, Salmonella enterica enterica serovar Typhi
ccacggccagcagcc

SEQ ID NO: 3638436 - RNA, 15 nt, Salmonella enterica enterica serovar Typhi
ccacggcuucagcgg

SEQ ID NO: 3638437 - RNA, 18 nt, Salmonella enterica enterica serovar Typhi
ccacggcuucagcggcgc

SEQ ID NO: 3638438 - RNA, 13 nt, Salmonella enterica enterica serovar Typhi
ccacgggcgccac

SEQ ID NO: 3638439 - RNA, 13 nt, Salmonella enterica enterica serovar Typhi
ccacggggcaugc

SEQ ID NO: 3638440 - RNA, 17 nt, Salmonella enterica enterica serovar Typhi
ccacgggguuggcccuc

SEQ ID NO: 3638441 - RNA, 18 nt, Salmonella enterica enterica serovar Typhi
ccacgguuaucuggcgca

SEQ ID NO: 3638442 - RNA, 17 nt, Salmonella enterica enterica serovar Typhi
ccacgguucacggccaa

SEQ ID NO: 3638443 - RNA, 18 nt, Salmonella enterica enterica serovar Typhi
ccacgguucucaccgugg

SEQ ID NO: 3638444 - RNA, 16 nt, Salmonella enterica enterica serovar Typhi
ccacguagcugcggua

SEQ ID NO: 3638445 - RNA, 20 nt, Salmonella enterica enterica serovar Typhi
ccacguauuucgcagcgguc

SEQ ID NO: 3638446 - RNA, 21 nt, Salmonella enterica enterica serovar Typhi
ccacguucggcguguagccaa

SEQ ID NO: 3638447 - RNA, 14 nt, Salmonella enterica enterica serovar Typhi
ccacguucuuccag

SEQ ID NO: 3638448 - RNA, 24 nt, Salmonella enterica enterica serovar Typhi
ccacguuuuccugcgcuugcaugg

SEQ ID NO: 3638449 - RNA, 14 nt, Salmonella enterica enterica serovar Typhi
ccacuaacccggcg

SEQ ID NO: 3638450 - RNA, 18 nt, Salmonella enterica enterica serovar Typhi
ccacuacgcagcuccagc

SEQ ID NO: 3638451 - RNA, 12 nt, Salmonella enterica enterica serovar Typhi
ccacuagcgcuu

SEQ ID NO: 3638452 - RNA, 21 nt, Salmonella enterica enterica serovar Typhi
ccacuauaguugacgccccau

SEQ ID NO: 3638453 - RNA, 15 nt, Salmonella enterica enterica serovar Typhi
ccacucauccagcaa

SEQ ID NO: 3638454 - RNA, 18 nt, Salmonella enterica enterica serovar Typhi
ccacuccgccaguacaua

SEQ ID NO: 3638455 - RNA, 16 nt, Salmonella enterica enterica serovar Typhi
ccacuccggugcccau

SEQ ID NO: 3638456 - RNA, 18 nt, Salmonella enterica enterica serovar Typhi
ccacuccguguugcugcc

SEQ ID NO: 3638457 - RNA, 22 nt, Salmonella enterica enterica serovar Typhi
ccacuccuuacgguaaagcgua

SEQ ID NO: 3638458 - RNA, 14 nt, Salmonella enterica enterica serovar Typhi
ccacucuuccagca

SEQ ID NO: 3638459 - RNA, 14 nt, Salmonella enterica enterica serovar Typhi
ccacucuuucagca

SEQ ID NO: 3638460 - RNA, 17 nt, Salmonella enterica enterica serovar Typhi
ccacucuuuuaaggccc

SEQ ID NO: 3638461 - RNA, 20 nt, Salmonella enterica enterica serovar Typhi
ccacugagcuucaccgccag

SEQ ID NO: 3638462 - RNA, 20 nt, Salmonella enterica enterica serovar Typhi
ccacugauaguccaucaccu

SEQ ID NO: 3638463 - RNA, 22 nt, Salmonella enterica enterica serovar Typhi
ccacugauggaguuucaucagc

SEQ ID NO: 3638464 - RNA, 12 nt, Salmonella enterica enterica serovar Typhi
ccacugcccgcc

SEQ ID NO: 3638465 - RNA, 17 nt, Salmonella enterica enterica serovar Typhi
ccacugcccgccgccac

SEQ ID NO: 3638466 - RNA, 14 nt, Salmonella enterica enterica serovar Typhi
ccacugcccuggaa

SEQ ID NO: 3638467 - RNA, 13 nt, Salmonella enterica enterica serovar Typhi
ccacuggcccccu

SEQ ID NO: 3638468 - RNA, 19 nt, Salmonella enterica enterica serovar Typhi
ccacuggcuuuccugauca

SEQ ID NO: 3638469 - RNA, 16 nt, Salmonella enterica enterica serovar Typhi
ccacuguucguccaua

SEQ ID NO: 3638470 - RNA, 14 nt, Salmonella enterica enterica serovar Typhi
ccacuuaggcagcc

SEQ ID NO: 3638471 - RNA, 21 nt, Salmonella enterica enterica serovar Typhi
ccacuucaacgccgcgcuucu

SEQ ID NO: 3638472 - RNA, 19 nt, Salmonella enterica enterica serovar Typhi
ccacuuccagcgcgccguc

SEQ ID NO: 3638473 - RNA, 18 nt, Salmonella enterica enterica serovar Typhi
ccacuucugacagaauau

SEQ ID NO: 3638474 - RNA, 20 nt, Salmonella enterica enterica serovar Typhi
ccacuucuuccagcggcaga

SEQ ID NO: 3638475 - RNA, 16 nt, Salmonella enterica enterica serovar Typhi
ccacuucuuccagcgu

SEQ ID NO: 3638476 - RNA, 21 nt, Salmonella enterica enterica serovar Typhi
ccacuuucucggcuuuccagc

SEQ ID NO: 3638477 - RNA, 12 nt, Salmonella enterica enterica serovar Typhi
ccacuuugcgcu

SEQ ID NO: 3638478 - RNA, 13 nt, Salmonella enterica enterica serovar Typhi
ccacuuugcgcuc

SEQ ID NO: 3638479 - RNA, 22 nt, Salmonella enterica enterica serovar Typhi
ccagaaaucgcucaugcgcguc

SEQ ID NO: 3638480 - RNA, 17 nt, Salmonella enterica enterica serovar Typhi
ccagaaccguugcgccc

SEQ ID NO: 3638481 - RNA, 21 nt, Salmonella enterica enterica serovar Typhi
ccagaaccucaccguccgcca

SEQ ID NO: 3638482 - RNA, 18 nt, Salmonella enterica enterica serovar Typhi
ccagaacgagaggaggag

SEQ ID NO: 3638483 - RNA, 14 nt, Salmonella enterica enterica serovar Typhi
ccagaacggcagcg

SEQ ID NO: 3638484 - RNA, 23 nt, Salmonella enterica enterica serovar Typhi
ccagaacguugacguuucaguca

SEQ ID NO: 3638485 - RNA, 19 nt, Salmonella enterica enterica serovar Typhi
ccagaacugcgaaaucacc

SEQ ID NO: 3638486 - RNA, 21 nt, Salmonella enterica enterica serovar Typhi
ccagaacugcgaaaucaccga

SEQ ID NO: 3638487 - RNA, 12 nt, Salmonella enterica enterica serovar Typhi
ccagaagaaaau

SEQ ID NO: 3638488 - RNA, 12 nt, Salmonella enterica enterica serovar Typhi
ccagaagcacuu

SEQ ID NO: 3638489 - RNA, 17 nt, Salmonella enterica enterica serovar Typhi
ccagaagcacuucucca

SEQ ID NO: 3638490 - RNA, 18 nt, Salmonella enterica enterica serovar Typhi
ccagaagcgcuuugccaa

SEQ ID NO: 3638491 - RNA, 20 nt, Salmonella enterica enterica serovar Typhi
ccagaagcgcuuugccaaug

SEQ ID NO: 3638492 - RNA, 13 nt, Salmonella enterica enterica serovar Typhi
ccagaaggcaaaa

SEQ ID NO: 3638493 - RNA, 22 nt, Salmonella enterica enterica serovar Typhi
ccagaaggcaaaaugccagccc

SEQ ID NO: 3638494 - RNA, 18 nt, Salmonella enterica enterica serovar Typhi
ccagaaggcgaacauaag

SEQ ID NO: 3638495 - RNA, 19 nt, Salmonella enterica enterica serovar Typhi
ccagaaguagcagagaaaa

SEQ ID NO: 3638496 - RNA, 23 nt, Salmonella enterica enterica serovar Typhi
ccagaaguagcagagaaaagguu

SEQ ID NO: 3638497 - RNA, 18 nt, Salmonella enterica enterica serovar Typhi
ccagaauagcgcagucaa

SEQ ID NO: 3638498 - RNA, 19 nt, Salmonella enterica enterica serovar Typhi
ccagaaucaccgacagcac

SEQ ID NO: 3638499 - RNA, 14 nt, Salmonella enterica enterica serovar Typhi
ccagaaucaccucu

SEQ ID NO: 3638500 - RNA, 14 nt, Salmonella enterica enterica serovar Typhi
ccagaaucagugac

SEQ ID NO: 3638501 - RNA, 22 nt, Salmonella enterica enterica serovar Typhi
ccagaaucaucgcuaucaugcu

SEQ ID NO: 3638502 - RNA, 19 nt, Salmonella enterica enterica serovar Typhi
ccagaaucccacggagaaa

SEQ ID NO: 3638503 - RNA, 22 nt, Salmonella enterica enterica serovar Typhi
ccagaaucccgccuugcggcgc

SEQ ID NO: 3638504 - RNA, 13 nt, Salmonella enterica enterica serovar Typhi
ccagaauccgcgc

SEQ ID NO: 3638505 - RNA, 17 nt, Salmonella enterica enterica serovar Typhi
ccagaaugccagcgccg

SEQ ID NO: 3638506 - RNA, 18 nt, Salmonella enterica enterica serovar Typhi
ccagaaugcccagcaagg

SEQ ID NO: 3638507 - RNA, 21 nt, Salmonella enterica enterica serovar Typhi
ccagaaugcccugcuguucca

SEQ ID NO: 3638508 - RNA, 22 nt, Salmonella enterica enterica serovar Typhi
ccagaauuuccuucgcuuccug

SEQ ID NO: 3638509 - RNA, 17 nt, Salmonella enterica enterica serovar Typhi
ccagacacggugugccg

SEQ ID NO: 3638510 - RNA, 20 nt, Salmonella enterica enterica serovar Typhi
ccagacacggugugccgcca

SEQ ID NO: 3638511 - RNA, 22 nt, Salmonella enterica enterica serovar Typhi
ccagacacuggaaacagccaau

SEQ ID NO: 3638512 - RNA, 15 nt, Salmonella enterica enterica serovar Typhi
ccagacagauaacac

SEQ ID NO: 3638513 - RNA, 18 nt, Salmonella enterica enterica serovar Typhi
ccagacagauaacaccag

SEQ ID NO: 3638514 - RNA, 20 nt, Salmonella enterica enterica serovar Typhi
ccagacagauaacaccagcg

SEQ ID NO: 3638515 - RNA, 14 nt, Salmonella enterica enterica serovar Typhi
ccagacagcccaac

SEQ ID NO: 3638516 - RNA, 19 nt, Salmonella enterica enterica serovar Typhi
ccagacaggacgccagcgc

SEQ ID NO: 3638517 - RNA, 22 nt, Salmonella enterica enterica serovar Typhi
ccagacaucacguucgcgcaua

SEQ ID NO: 3638518 - RNA, 15 nt, Salmonella enterica enterica serovar Typhi
ccagacaugcacaug

SEQ ID NO: 3638519 - RNA, 17 nt, Salmonella enterica enterica serovar Typhi
ccagacaugcacauggu

SEQ ID NO: 3638520 - RNA, 14 nt, Salmonella enterica enterica serovar Typhi
ccagaccaauagag

SEQ ID NO: 3638521 - RNA, 15 nt, Salmonella enterica enterica serovar Typhi
ccagaccaauagaga

SEQ ID NO: 3638522 - RNA, 16 nt, Salmonella enterica enterica serovar Typhi
ccagacccaauaugcc

SEQ ID NO: 3638523 - RNA, 23 nt, Salmonella enterica enterica serovar Typhi
ccagaccccaguaauccggcaac

SEQ ID NO: 3638524 - RNA, 19 nt, Salmonella enterica enterica serovar Typhi
ccagacccgauaguguaaa

SEQ ID NO: 3638525 - RNA, 14 nt, Salmonella enterica enterica serovar Typhi
ccagacccgggacu

SEQ ID NO: 3638526 - RNA, 22 nt, Salmonella enterica enterica serovar Typhi
ccagaccgauauuuugcugcac

SEQ ID NO: 3638527 - RNA, 23 nt, Salmonella enterica enterica serovar Typhi
ccagaccugaauauucggcucca

SEQ ID NO: 3638528 - RNA, 13 nt, Salmonella enterica enterica serovar Typhi
ccagacgccagcc

SEQ ID NO: 3638529 - RNA, 21 nt, Salmonella enterica enterica serovar Typhi
ccagacgccgaucgcgguuca

SEQ ID NO: 3638530 - RNA, 20 nt, Salmonella enterica enterica serovar Typhi
ccagacgcugauagccacgg

SEQ ID NO: 3638531 - RNA, 19 nt, Salmonella enterica enterica serovar Typhi
ccagacggcgcccagccug

SEQ ID NO: 3638532 - RNA, 16 nt, Salmonella enterica enterica serovar Typhi
ccagacugugauggcg

SEQ ID NO: 3638533 - RNA, 14 nt, Salmonella enterica enterica serovar Typhi
ccagacuuuccagc

SEQ ID NO: 3638534 - RNA, 17 nt, Salmonella enterica enterica serovar Typhi
ccagagagaugccgccg

SEQ ID NO: 3638535 - RNA, 21 nt, Salmonella enterica enterica serovar Typhi
ccagagagcguuucuacgcca

SEQ ID NO: 3638536 - RNA, 16 nt, Salmonella enterica enterica serovar Typhi
ccagagccccaaugcu

SEQ ID NO: 3638537 - RNA, 18 nt, Salmonella enterica enterica serovar Typhi
ccagagccccaaugcuuu

SEQ ID NO: 3638538 - RNA, 15 nt, Salmonella enterica enterica serovar Typhi
ccagagcgacaauga

SEQ ID NO: 3638539 - RNA, 22 nt, Salmonella enterica enterica serovar Typhi
ccagagcgacaaugaaccagcc

SEQ ID NO: 3638540 - RNA, 17 nt, Salmonella enterica enterica serovar Typhi
ccagagcgcgcuggcaa

SEQ ID NO: 3638541 - RNA, 18 nt, Salmonella enterica enterica serovar Typhi
ccagaggugaaccauuga

SEQ ID NO: 3638542 - RNA, 17 nt, Salmonella enterica enterica serovar Typhi
ccagaguccggcgccug

SEQ ID NO: 3638543 - RNA, 16 nt, Salmonella enterica enterica serovar Typhi
ccagauaaagcagcga

SEQ ID NO: 3638544 - RNA, 15 nt, Salmonella enterica enterica serovar Typhi
ccagauaaauagcgc

SEQ ID NO: 3638545 - RNA, 18 nt, Salmonella enterica enterica serovar Typhi
ccagauaaauagcgcugg

SEQ ID NO: 3638546 - RNA, 14 nt, Salmonella enterica enterica serovar Typhi
ccagauaaaucagc

SEQ ID NO: 3638547 - RNA, 16 nt, Salmonella enterica enterica serovar Typhi
ccagauaaaucagccc

SEQ ID NO: 3638548 - RNA, 21 nt, Salmonella enterica enterica serovar Typhi
ccagauaagcucuccuggaug

SEQ ID NO: 3638549 - RNA, 14 nt, Salmonella enterica enterica serovar Typhi
ccagauaaggcuca

SEQ ID NO: 3638550 - RNA, 20 nt, Salmonella enterica enterica serovar Typhi
ccagauaaucaaacgcgccg

SEQ ID NO: 3638551 - RNA, 22 nt, Salmonella enterica enterica serovar Typhi
ccagauaaucgccgccagcuca

SEQ ID NO: 3638552 - RNA, 18 nt, Salmonella enterica enterica serovar Typhi
ccagauaauuaugccugu

SEQ ID NO: 3638553 - RNA, 15 nt, Salmonella enterica enterica serovar Typhi
ccagauacacgccuu

SEQ ID NO: 3638554 - RNA, 19 nt, Salmonella enterica enterica serovar Typhi
ccagauacccuuuaucgcg

SEQ ID NO: 3638555 - RNA, 15 nt, Salmonella enterica enterica serovar Typhi
ccagauacgccgcgc

SEQ ID NO: 3638556 - RNA, 14 nt, Salmonella enterica enterica serovar Typhi
ccagauacgcgccg

SEQ ID NO: 3638557 - RNA, 17 nt, Salmonella enterica enterica serovar Typhi
ccagauacgcgccggcc

SEQ ID NO: 3638558 - RNA, 21 nt, Salmonella enterica enterica serovar Typhi
ccagauagcgaucgccgcuau

SEQ ID NO: 3638559 - RNA, 13 nt, Salmonella enterica enterica serovar Typhi
ccagauagcgcug

SEQ ID NO: 3638560 - RNA, 17 nt, Salmonella enterica enterica serovar Typhi
ccagauagcgucuucag

SEQ ID NO: 3638561 - RNA, 15 nt, Salmonella enterica enterica serovar Typhi
ccagauaucccgcca

SEQ ID NO: 3638562 - RNA, 15 nt, Salmonella enterica enterica serovar Typhi
ccagauauuuuuccg

SEQ ID NO: 3638563 - RNA, 12 nt, Salmonella enterica enterica serovar Typhi
ccagaucauuac

SEQ ID NO: 3638564 - RNA, 19 nt, Salmonella enterica enterica serovar Typhi
ccagaucgauauccgugcg

SEQ ID NO: 3638565 - RNA, 21 nt, Salmonella enterica enterica serovar Typhi
ccagaucgcgguaacggccug

SEQ ID NO: 3638566 - RNA, 13 nt, Salmonella enterica enterica serovar Typhi
ccagaucggcaua

SEQ ID NO: 3638567 - RNA, 15 nt, Salmonella enterica enterica serovar Typhi
ccagaugaaacugca

SEQ ID NO: 3638568 - RNA, 15 nt, Salmonella enterica enterica serovar Typhi
ccagaugaagcgcau

SEQ ID NO: 3638569 - RNA, 22 nt, Salmonella enterica enterica serovar Typhi
ccagaugcgaaacguccccugc

SEQ ID NO: 3638570 - RNA, 14 nt, Salmonella enterica enterica serovar Typhi
ccagaugcugggcg

SEQ ID NO: 3638571 - RNA, 18 nt, Salmonella enterica enterica serovar Typhi
ccagaugcugggcguguc

SEQ ID NO: 3638572 - RNA, 23 nt, Salmonella enterica enterica serovar Typhi
ccagaugcuuaaugcucugcugu

SEQ ID NO: 3638573 - RNA, 18 nt, Salmonella enterica enterica serovar Typhi
ccagauggauaaccugcc

SEQ ID NO: 3638574 - RNA, 17 nt, Salmonella enterica enterica serovar Typhi
ccagauggcaagauuaa

SEQ ID NO: 3638575 - RNA, 21 nt, Salmonella enterica enterica serovar Typhi
ccagauggcuaugaagcugga

SEQ ID NO: 3638576 - RNA, 18 nt, Salmonella enterica enterica serovar Typhi
ccagauggcugcacccgg

SEQ ID NO: 3638577 - RNA, 17 nt, Salmonella enterica enterica serovar Typhi
ccagauggggcuuccau

SEQ ID NO: 3638578 - RNA, 21 nt, Salmonella enterica enterica serovar Typhi
ccagauggggcuuccauugca

SEQ ID NO: 3638579 - RNA, 12 nt, Salmonella enterica enterica serovar Typhi
ccagaugguaag

SEQ ID NO: 3638580 - RNA, 18 nt, Salmonella enterica enterica serovar Typhi
ccagaugucgcggauaug

SEQ ID NO: 3638581 - RNA, 20 nt, Salmonella enterica enterica serovar Typhi
ccagauguuauaaacuucaa

SEQ ID NO: 3638582 - RNA, 19 nt, Salmonella enterica enterica serovar Typhi
ccagauuacgcauggucaa

SEQ ID NO: 3638583 - RNA, 20 nt, Salmonella enterica enterica serovar Typhi
ccagauugucgcaaaccacc

SEQ ID NO: 3638584 - RNA, 22 nt, Salmonella enterica enterica serovar Typhi
ccagauugucgcaaaccaccgg

SEQ ID NO: 3638585 - RNA, 18 nt, Salmonella enterica enterica serovar Typhi
ccagauuuuucucacaca

SEQ ID NO: 3638586 - RNA, 11 nt, Salmonella enterica enterica serovar Typhi
ccagcaaaauc

SEQ ID NO: 3638587 - RNA, 14 nt, Salmonella enterica enterica serovar Typhi
ccagcaaaaucacc

SEQ ID NO: 3638588 - RNA, 11 nt, Salmonella enterica enterica serovar Typhi
ccagcaaaauu

SEQ ID NO: 3638589 - RNA, 14 nt, Salmonella enterica enterica serovar Typhi
ccagcaaacuggcg

SEQ ID NO: 3638590 - RNA, 12 nt, Salmonella enterica enterica serovar Typhi
ccagcaaaucgc

SEQ ID NO: 3638591 - RNA, 22 nt, Salmonella enterica enterica serovar Typhi
ccagcaaaucgcccaucacaug

SEQ ID NO: 3638592 - RNA, 14 nt, Salmonella enterica enterica serovar Typhi
ccagcaacacagcc

SEQ ID NO: 3638593 - RNA, 20 nt, Salmonella enterica enterica serovar Typhi
ccagcaacagugggcuauga

SEQ ID NO: 3638594 - RNA, 19 nt, Salmonella enterica enterica serovar Typhi
ccagcaacgcgcuaaaugc

SEQ ID NO: 3638595 - RNA, 14 nt, Salmonella enterica enterica serovar Typhi
ccagcaacggcggg

SEQ ID NO: 3638596 - RNA, 22 nt, Salmonella enterica enterica serovar Typhi
ccagcaacguauuccacggaau

SEQ ID NO: 3638597 - RNA, 15 nt, Salmonella enterica enterica serovar Typhi
ccagcaagcggcgau

SEQ ID NO: 3638598 - RNA, 12 nt, Salmonella enterica enterica serovar Typhi
ccagcaaggcaa

SEQ ID NO: 3638599 - RNA, 18 nt, Salmonella enterica enterica serovar Typhi
ccagcaaggcugccgcca

SEQ ID NO: 3638600 - RNA, 19 nt, Salmonella enterica enterica serovar Typhi
ccagcaaggcugccgccag

SEQ ID NO: 3638601 - RNA, 23 nt, Salmonella enterica enterica serovar Typhi
ccagcaaguauuggcugccgaca

SEQ ID NO: 3638602 - RNA, 15 nt, Salmonella enterica enterica serovar Typhi
ccagcaauaacaccg

SEQ ID NO: 3638603 - RNA, 15 nt, Salmonella enterica enterica serovar Typhi
ccagcaauacccaga

SEQ ID NO: 3638604 - RNA, 18 nt, Salmonella enterica enterica serovar Typhi
ccagcaaugagccgucgc

SEQ ID NO: 3638605 - RNA, 23 nt, Salmonella enterica enterica serovar Typhi
ccagcaaugauaacggcgccacg

SEQ ID NO: 3638606 - RNA, 16 nt, Salmonella enterica enterica serovar Typhi
ccagcaaugauuuuau

SEQ ID NO: 3638607 - RNA, 20 nt, Salmonella enterica enterica serovar Typhi
ccagcacacgcaucccgcca

SEQ ID NO: 3638608 - RNA, 12 nt, Salmonella enterica enterica serovar Typhi
ccagcacagccc

SEQ ID NO: 3638609 - RNA, 15 nt, Salmonella enterica enterica serovar Typhi
ccagcacagcccagu

SEQ ID NO: 3638610 - RNA, 17 nt, Salmonella enterica enterica serovar Typhi
ccagcacagcccaguaa

SEQ ID NO: 3638611 - RNA, 24 nt, Salmonella enterica enterica serovar Typhi
ccagcacauuacaggcaucuucca

SEQ ID NO: 3638612 - RNA, 14 nt, Salmonella enterica enterica serovar Typhi
ccagcaccagcagu

SEQ ID NO: 3638613 - RNA, 15 nt, Salmonella enterica enterica serovar Typhi
ccagcaccaucuuuu

SEQ ID NO: 3638614 - RNA, 16 nt, Salmonella enterica enterica serovar Typhi
ccagcaccaucuuuuc

SEQ ID NO: 3638615 - RNA, 22 nt, Salmonella enterica enterica serovar Typhi
ccagcaccaucuuuuccggcag

SEQ ID NO: 3638616 - RNA, 21 nt, Salmonella enterica enterica serovar Typhi
ccagcaccucaucacccaguc

SEQ ID NO: 3638617 - RNA, 23 nt, Salmonella enterica enterica serovar Typhi
ccagcacgcccauauccagcucg

SEQ ID NO: 3638618 - RNA, 12 nt, Salmonella enterica enterica serovar Typhi
ccagcacgccuu

SEQ ID NO: 3638619 - RNA, 19 nt, Salmonella enterica enterica serovar Typhi
ccagcacuaacagcagcag

SEQ ID NO: 3638620 - RNA, 22 nt, Salmonella enterica enterica serovar Typhi
ccagcagauuagcgaagaaguc

SEQ ID NO: 3638621 - RNA, 16 nt, Salmonella enterica enterica serovar Typhi
ccagcagcagauaagc

SEQ ID NO: 3638622 - RNA, 13 nt, Salmonella enterica enterica serovar Typhi
ccagcagcagcac

SEQ ID NO: 3638623 - RNA, 13 nt, Salmonella enterica enterica serovar Typhi
ccagcagcagccg

SEQ ID NO: 3638624 - RNA, 14 nt, Salmonella enterica enterica serovar Typhi
ccagcagcagcgca

SEQ ID NO: 3638625 - RNA, 21 nt, Salmonella enterica enterica serovar Typhi
ccagcagcauaaaaccgccgc

SEQ ID NO: 3638626 - RNA, 14 nt, Salmonella enterica enterica serovar Typhi
ccagcagccagccg

SEQ ID NO: 3638627 - RNA, 20 nt, Salmonella enterica enterica serovar Typhi
ccagcagccagccguugugc

SEQ ID NO: 3638628 - RNA, 12 nt, Salmonella enterica enterica serovar Typhi
ccagcagcgaca

SEQ ID NO: 3638629 - RNA, 17 nt, Salmonella enterica enterica serovar Typhi
ccagcagcgcaccugcc

SEQ ID NO: 3638630 - RNA, 11 nt, Salmonella enterica enterica serovar Typhi
ccagcagcgcc

SEQ ID NO: 3638631 - RNA, 12 nt, Salmonella enterica enterica serovar Typhi
ccagcagcgcca

SEQ ID NO: 3638632 - RNA, 13 nt, Salmonella enterica enterica serovar Typhi
ccagcagcgccag

SEQ ID NO: 3638633 - RNA, 22 nt, Salmonella enterica enterica serovar Typhi
ccagcagcgccaguuuuucccg

SEQ ID NO: 3638634 - RNA, 18 nt, Salmonella enterica enterica serovar Typhi
ccagcagcgcgaucgccc

SEQ ID NO: 3638635 - RNA, 19 nt, Salmonella enterica enterica serovar Typhi
ccagcagcguuuugcgcgu

SEQ ID NO: 3638636 - RNA, 22 nt, Salmonella enterica enterica serovar Typhi
ccagcagcucgccgaccggcgc

SEQ ID NO: 3638637 - RNA, 16 nt, Salmonella enterica enterica serovar Typhi
ccagcagguaucccaa

SEQ ID NO: 3638638 - RNA, 21 nt, Salmonella enterica enterica serovar Typhi
ccagcaggucgcacuccucug

SEQ ID NO: 3638639 - RNA, 22 nt, Salmonella enterica enterica serovar Typhi
ccagcaggugcggacugggcug

SEQ ID NO: 3638640 - RNA, 17 nt, Salmonella enterica enterica serovar Typhi
ccagcaguucuacgcug

SEQ ID NO: 3638641 - RNA, 15 nt, Salmonella enterica enterica serovar Typhi
ccagcaguugccaua

SEQ ID NO: 3638642 - RNA, 17 nt, Salmonella enterica enterica serovar Typhi
ccagcaguugccauagc

SEQ ID NO: 3638643 - RNA, 14 nt, Salmonella enterica enterica serovar Typhi
ccagcaguugccuu

SEQ ID NO: 3638644 - RNA, 14 nt, Salmonella enterica enterica serovar Typhi
ccagcauaccgccc

SEQ ID NO: 3638645 - RNA, 23 nt, Salmonella enterica enterica serovar Typhi
ccagcauagucgcuccccauaaa

SEQ ID NO: 3638646 - RNA, 19 nt, Salmonella enterica enterica serovar Typhi
ccagcauauuuuccggcgu

SEQ ID NO: 3638647 - RNA, 13 nt, Salmonella enterica enterica serovar Typhi
ccagcaucacgug

SEQ ID NO: 3638648 - RNA, 14 nt, Salmonella enterica enterica serovar Typhi
ccagcaucaggugg

SEQ ID NO: 3638649 - RNA, 20 nt, Salmonella enterica enterica serovar Typhi
ccagcaucaugggcucauca

SEQ ID NO: 3638650 - RNA, 16 nt, Salmonella enterica enterica serovar Typhi
ccagcauccaugccag

SEQ ID NO: 3638651 - RNA, 21 nt, Salmonella enterica enterica serovar Typhi
ccagcauccaugccagcgcgg

SEQ ID NO: 3638652 - RNA, 13 nt, Salmonella enterica enterica serovar Typhi
ccagcaucccgcu

SEQ ID NO: 3638653 - RNA, 12 nt, Salmonella enterica enterica serovar Typhi
ccagcaucgacc

SEQ ID NO: 3638654 - RNA, 13 nt, Salmonella enterica enterica serovar Typhi
ccagcaucgacca

SEQ ID NO: 3638655 - RNA, 17 nt, Salmonella enterica enterica serovar Typhi
ccagcaucgaccaggau

SEQ ID NO: 3638656 - RNA, 18 nt, Salmonella enterica enterica serovar Typhi
ccagcaucggcagcgcca

SEQ ID NO: 3638657 - RNA, 19 nt, Salmonella enterica enterica serovar Typhi
ccagcaucggcagcgccag

SEQ ID NO: 3638658 - RNA, 21 nt, Salmonella enterica enterica serovar Typhi
ccagcaucgguagaaugaaug

SEQ ID NO: 3638659 - RNA, 16 nt, Salmonella enterica enterica serovar Typhi
ccagcaugagccagcc

SEQ ID NO: 3638660 - RNA, 21 nt, Salmonella enterica enterica serovar Typhi
ccagcaugaucauacugccgc

SEQ ID NO: 3638661 - RNA, 15 nt, Salmonella enterica enterica serovar Typhi
ccagcaugcccgcca

SEQ ID NO: 3638662 - RNA, 17 nt, Salmonella enterica enterica serovar Typhi
ccagcaugcccgccagc

SEQ ID NO: 3638663 - RNA, 18 nt, Salmonella enterica enterica serovar Typhi
ccagcauggcgucggcga

SEQ ID NO: 3638664 - RNA, 22 nt, Salmonella enterica enterica serovar Typhi
ccagcauggcgucggcgacuuu

SEQ ID NO: 3638665 - RNA, 17 nt, Salmonella enterica enterica serovar Typhi
ccagcauuaacccggcc

SEQ ID NO: 3638666 - RNA, 18 nt, Salmonella enterica enterica serovar Typhi
ccagcauuucaaucgcgc

SEQ ID NO: 3638667 - RNA, 19 nt, Salmonella enterica enterica serovar Typhi
ccagcauuucaaucgcgcc

SEQ ID NO: 3638668 - RNA, 18 nt, Salmonella enterica enterica serovar Typhi
ccagcauuuccagcuggu

SEQ ID NO: 3638669 - RNA, 20 nt, Salmonella enterica enterica serovar Typhi
ccagcauuuccagcugguua

SEQ ID NO: 3638670 - RNA, 11 nt, Salmonella enterica enterica serovar Typhi
ccagcauuucu

SEQ ID NO: 3638671 - RNA, 16 nt, Salmonella enterica enterica serovar Typhi
ccagcauuucuucaag

SEQ ID NO: 3638672 - RNA, 12 nt, Salmonella enterica enterica serovar Typhi
ccagccaaacaa

SEQ ID NO: 3638673 - RNA, 13 nt, Salmonella enterica enterica serovar Typhi
ccagccacgcgug

SEQ ID NO: 3638674 - RNA, 13 nt, Salmonella enterica enterica serovar Typhi
ccagccacugacu

SEQ ID NO: 3638675 - RNA, 14 nt, Salmonella enterica enterica serovar Typhi
ccagccacugcgcc

SEQ ID NO: 3638676 - RNA, 15 nt, Salmonella enterica enterica serovar Typhi
ccagccacugcgcca

SEQ ID NO: 3638677 - RNA, 18 nt, Salmonella enterica enterica serovar Typhi
ccagccagcgccaccaaa

SEQ ID NO: 3638678 - RNA, 14 nt, Salmonella enterica enterica serovar Typhi
ccagccaggcgauu

SEQ ID NO: 3638679 - RNA, 16 nt, Salmonella enterica enterica serovar Typhi
ccagccaguccuccgg

SEQ ID NO: 3638680 - RNA, 22 nt, Salmonella enterica enterica serovar Typhi
ccagccaguuagcgaucgcgcc

SEQ ID NO: 3638681 - RNA, 21 nt, Salmonella enterica enterica serovar Typhi
ccagccauaaauauuggcggc

SEQ ID NO: 3638682 - RNA, 17 nt, Salmonella enterica enterica serovar Typhi
ccagccauaaaugcuga

SEQ ID NO: 3638683 - RNA, 15 nt, Salmonella enterica enterica serovar Typhi
ccagccauagcagca

SEQ ID NO: 3638684 - RNA, 17 nt, Salmonella enterica enterica serovar Typhi
ccagccauagcagcaaa

SEQ ID NO: 3638685 - RNA, 15 nt, Salmonella enterica enterica serovar Typhi
ccagccauccccaua

SEQ ID NO: 3638686 - RNA, 20 nt, Salmonella enterica enterica serovar Typhi
ccagccauggcccaaaaggu

SEQ ID NO: 3638687 - RNA, 19 nt, Salmonella enterica enterica serovar Typhi
ccagcccaauacgccagcc

SEQ ID NO: 3638688 - RNA, 18 nt, Salmonella enterica enterica serovar Typhi
ccagcccaugaaggagca

SEQ ID NO: 3638689 - RNA, 14 nt, Salmonella enterica enterica serovar Typhi
ccagccccaccguc

SEQ ID NO: 3638690 - RNA, 13 nt, Salmonella enterica enterica serovar Typhi
ccagccccagccc

SEQ ID NO: 3638691 - RNA, 17 nt, Salmonella enterica enterica serovar Typhi
ccagcccccagccgauc

SEQ ID NO: 3638692 - RNA, 21 nt, Salmonella enterica enterica serovar Typhi
ccagccccuucgcuguccauu

SEQ ID NO: 3638693 - RNA, 15 nt, Salmonella enterica enterica serovar Typhi
ccagcccgccgcccu

SEQ ID NO: 3638694 - RNA, 18 nt, Salmonella enterica enterica serovar Typhi
ccagcccgccgcccuccg

SEQ ID NO: 3638695 - RNA, 22 nt, Salmonella enterica enterica serovar Typhi
ccagcccggaaauaaacgccag

SEQ ID NO: 3638696 - RNA, 19 nt, Salmonella enterica enterica serovar Typhi
ccagcccucaacauugccg

SEQ ID NO: 3638697 - RNA, 21 nt, Salmonella enterica enterica serovar Typhi
ccagccgagcgguaagagcca

SEQ ID NO: 3638698 - RNA, 17 nt, Salmonella enterica enterica serovar Typhi
ccagccgaucagcgcca

SEQ ID NO: 3638699 - RNA, 18 nt, Salmonella enterica enterica serovar Typhi
ccagccgaucaucacgaa

SEQ ID NO: 3638700 - RNA, 15 nt, Salmonella enterica enterica serovar Typhi
ccagccgaucuauuu

SEQ ID NO: 3638701 - RNA, 21 nt, Salmonella enterica enterica serovar Typhi
ccagccgauuucauaccacug

SEQ ID NO: 3638702 - RNA, 19 nt, Salmonella enterica enterica serovar Typhi
ccagccgcaucuuauauuu

SEQ ID NO: 3638703 - RNA, 12 nt, Salmonella enterica enterica serovar Typhi
ccagccgcccgc

SEQ ID NO: 3638704 - RNA, 13 nt, Salmonella enterica enterica serovar Typhi
ccagccgccgccg

SEQ ID NO: 3638705 - RNA, 21 nt, Salmonella enterica enterica serovar Typhi
ccagccgcgccaucuccuccu

SEQ ID NO: 3638706 - RNA, 13 nt, Salmonella enterica enterica serovar Typhi
ccagccgcugccu

SEQ ID NO: 3638707 - RNA, 20 nt, Salmonella enterica enterica serovar Typhi
ccagccggaaaagcgcuggc

SEQ ID NO: 3638708 - RNA, 17 nt, Salmonella enterica enterica serovar Typhi
ccagccgggcaggaaaa

SEQ ID NO: 3638709 - RNA, 18 nt, Salmonella enterica enterica serovar Typhi
ccagccguucaccagcca

SEQ ID NO: 3638710 - RNA, 13 nt, Salmonella enterica enterica serovar Typhi
ccagccguuucuu

SEQ ID NO: 3638711 - RNA, 16 nt, Salmonella enterica enterica serovar Typhi
ccagccuaccugccgc

SEQ ID NO: 3638712 - RNA, 15 nt, Salmonella enterica enterica serovar Typhi
ccagccucucccagc

SEQ ID NO: 3638713 - RNA, 22 nt, Salmonella enterica enterica serovar Typhi
ccagccugcuggucugaaucug

SEQ ID NO: 3638714 - RNA, 16 nt, Salmonella enterica enterica serovar Typhi
ccagccugucgggcca

SEQ ID NO: 3638715 - RNA, 15 nt, Salmonella enterica enterica serovar Typhi
ccagcgaaaaccagc

SEQ ID NO: 3638716 - RNA, 16 nt, Salmonella enterica enterica serovar Typhi
ccagcgaaaugcgaau

SEQ ID NO: 3638717 - RNA, 21 nt, Salmonella enterica enterica serovar Typhi
ccagcgaaaugcgaauccggc

SEQ ID NO: 3638718 - RNA, 15 nt, Salmonella enterica enterica serovar Typhi
ccagcgaaccgcggc

SEQ ID NO: 3638719 - RNA, 15 nt, Salmonella enterica enterica serovar Typhi
ccagcgaaccuucca

SEQ ID NO: 3638720 - RNA, 13 nt, Salmonella enterica enterica serovar Typhi
ccagcgaauaaug

SEQ ID NO: 3638721 - RNA, 21 nt, Salmonella enterica enterica serovar Typhi
ccagcgacggcguauucggca

SEQ ID NO: 3638722 - RNA, 20 nt, Salmonella enterica enterica serovar Typhi
ccagcgacgguaauaccaac

SEQ ID NO: 3638723 - RNA, 13 nt, Salmonella enterica enterica serovar Typhi
ccagcgauaaacg

SEQ ID NO: 3638724 - RNA, 16 nt, Salmonella enterica enterica serovar Typhi
ccagcgaugagcgcca

SEQ ID NO: 3638725 - RNA, 19 nt, Salmonella enterica enterica serovar Typhi
ccagcgaugagcgccagca

SEQ ID NO: 3638726 - RNA, 16 nt, Salmonella enterica enterica serovar Typhi
ccagcgauuauuucau

SEQ ID NO: 3638727 - RNA, 23 nt, Salmonella enterica enterica serovar Typhi
ccagcgauuuuuacgccauucau

SEQ ID NO: 3638728 - RNA, 22 nt, Salmonella enterica enterica serovar Typhi
ccagcgcaaagggacacucaag

SEQ ID NO: 3638729 - RNA, 22 nt, Salmonella enterica enterica serovar Typhi
ccagcgcaagcagcgccccgcc

SEQ ID NO: 3638730 - RNA, 15 nt, Salmonella enterica enterica serovar Typhi
ccagcgcagucaaaa

SEQ ID NO: 3638731 - RNA, 21 nt, Salmonella enterica enterica serovar Typhi
ccagcgcauguuucgcuucaa

SEQ ID NO: 3638732 - RNA, 22 nt, Salmonella enterica enterica serovar Typhi
ccagcgcauguuucgcuucaau

SEQ ID NO: 3638733 - RNA, 12 nt, Salmonella enterica enterica serovar Typhi
ccagcgccagaa

SEQ ID NO: 3638734 - RNA, 13 nt, Salmonella enterica enterica serovar Typhi
ccagcgccagccg

SEQ ID NO: 3638735 - RNA, 14 nt, Salmonella enterica enterica serovar Typhi
ccagcgccagcgcc

SEQ ID NO: 3638736 - RNA, 13 nt, Salmonella enterica enterica serovar Typhi
ccagcgccagcgu

SEQ ID NO: 3638737 - RNA, 14 nt, Salmonella enterica enterica serovar Typhi
ccagcgccagcucc

SEQ ID NO: 3638738 - RNA, 14 nt, Salmonella enterica enterica serovar Typhi
ccagcgccaggcca

SEQ ID NO: 3638739 - RNA, 19 nt, Salmonella enterica enterica serovar Typhi
ccagcgccauaauccagaa

SEQ ID NO: 3638740 - RNA, 15 nt, Salmonella enterica enterica serovar Typhi
ccagcgcccccagca

SEQ ID NO: 3638741 - RNA, 14 nt, Salmonella enterica enterica serovar Typhi
ccagcgcccgcuuc

SEQ ID NO: 3638742 - RNA, 18 nt, Salmonella enterica enterica serovar Typhi
ccagcgcccuauccagcg

SEQ ID NO: 3638743 - RNA, 21 nt, Salmonella enterica enterica serovar Typhi
ccagcgccgagaaaaucagug

SEQ ID NO: 3638744 - RNA, 13 nt, Salmonella enterica enterica serovar Typhi
ccagcgccgccag

SEQ ID NO: 3638745 - RNA, 18 nt, Salmonella enterica enterica serovar Typhi
ccagcgccgccagaauca

SEQ ID NO: 3638746 - RNA, 12 nt, Salmonella enterica enterica serovar Typhi
ccagcgccgccg

SEQ ID NO: 3638747 - RNA, 18 nt, Salmonella enterica enterica serovar Typhi
ccagcgccgcgacaagca

SEQ ID NO: 3638748 - RNA, 12 nt, Salmonella enterica enterica serovar Typhi
ccagcgccgcgc

SEQ ID NO: 3638749 - RNA, 13 nt, Salmonella enterica enterica serovar Typhi
ccagcgccgcgcg

SEQ ID NO: 3638750 - RNA, 14 nt, Salmonella enterica enterica serovar Typhi
ccagcgccgcgcga

SEQ ID NO: 3638751 - RNA, 20 nt, Salmonella enterica enterica serovar Typhi
ccagcgccgcggccuccgga

SEQ ID NO: 3638752 - RNA, 12 nt, Salmonella enterica enterica serovar Typhi
ccagcgccggac

SEQ ID NO: 3638753 - RNA, 20 nt, Salmonella enterica enterica serovar Typhi
ccagcgccgucauaccgccc

SEQ ID NO: 3638754 - RNA, 21 nt, Salmonella enterica enterica serovar Typhi
ccagcgccugcuguaaaauau

SEQ ID NO: 3638755 - RNA, 16 nt, Salmonella enterica enterica serovar Typhi
ccagcgccuucuucac

SEQ ID NO: 3638756 - RNA, 16 nt, Salmonella enterica enterica serovar Typhi
ccagcgcgaauuugcc

SEQ ID NO: 3638757 - RNA, 24 nt, Salmonella enterica enterica serovar Typhi
ccagcgcgaauuugccccagauac

SEQ ID NO: 3638758 - RNA, 20 nt, Salmonella enterica enterica serovar Typhi
ccagcgcgaccugcaucccu

SEQ ID NO: 3638759 - RNA, 17 nt, Salmonella enterica enterica serovar Typhi
ccagcgcgccauccuga

SEQ ID NO: 3638760 - RNA, 18 nt, Salmonella enterica enterica serovar Typhi
ccagcgcgccgcagcgcc

SEQ ID NO: 3638761 - RNA, 19 nt, Salmonella enterica enterica serovar Typhi
ccagcgcgccgcagcgccg

SEQ ID NO: 3638762 - RNA, 14 nt, Salmonella enterica enterica serovar Typhi
ccagcgcgccgcca

SEQ ID NO: 3638763 - RNA, 21 nt, Salmonella enterica enterica serovar Typhi
ccagcgcgccgccaacgccaa

SEQ ID NO: 3638764 - RNA, 19 nt, Salmonella enterica enterica serovar Typhi
ccagcgcgggcgaggccuc

SEQ ID NO: 3638765 - RNA, 16 nt, Salmonella enterica enterica serovar Typhi
ccagcgcgugaaccgu

SEQ ID NO: 3638766 - RNA, 16 nt, Salmonella enterica enterica serovar Typhi
ccagcgcguuuuccau

SEQ ID NO: 3638767 - RNA, 18 nt, Salmonella enterica enterica serovar Typhi
ccagcgcuauccaggccg

SEQ ID NO: 3638768 - RNA, 22 nt, Salmonella enterica enterica serovar Typhi
ccagcgcuucuguuaaaaaauu

SEQ ID NO: 3638769 - RNA, 21 nt, Salmonella enterica enterica serovar Typhi
ccagcggaugucggucaucag

SEQ ID NO: 3638770 - RNA, 22 nt, Salmonella enterica enterica serovar Typhi
ccagcggaugucggucaucagg

SEQ ID NO: 3638771 - RNA, 23 nt, Salmonella enterica enterica serovar Typhi
ccagcggcaaaggcauggcaggu

SEQ ID NO: 3638772 - RNA, 22 nt, Salmonella enterica enterica serovar Typhi
ccagcggcagaucguuuacgac

SEQ ID NO: 3638773 - RNA, 14 nt, Salmonella enterica enterica serovar Typhi
ccagcggccagcca

SEQ ID NO: 3638774 - RNA, 13 nt, Salmonella enterica enterica serovar Typhi
ccagcggccauga

SEQ ID NO: 3638775 - RNA, 14 nt, Salmonella enterica enterica serovar Typhi
ccagcggcccgcgc

SEQ ID NO: 3638776 - RNA, 14 nt, Salmonella enterica enterica serovar Typhi
ccagcggcgacaca

SEQ ID NO: 3638777 - RNA, 19 nt, Salmonella enterica enterica serovar Typhi
ccagcggcgccaucaccau

SEQ ID NO: 3638778 - RNA, 20 nt, Salmonella enterica enterica serovar Typhi
ccagcggcgcgcgguuaugc

SEQ ID NO: 3638779 - RNA, 18 nt, Salmonella enterica enterica serovar Typhi
ccagcggcggcuugccuu

SEQ ID NO: 3638780 - RNA, 22 nt, Salmonella enterica enterica serovar Typhi
ccagcgggccgacgauaaacag

SEQ ID NO: 3638781 - RNA, 23 nt, Salmonella enterica enterica serovar Typhi
ccagcgggccgacgauaaacaga

SEQ ID NO: 3638782 - RNA, 13 nt, Salmonella enterica enterica serovar Typhi
ccagcgggccgcu

SEQ ID NO: 3638783 - RNA, 19 nt, Salmonella enterica enterica serovar Typhi
ccagcgguguuugccagac

SEQ ID NO: 3638784 - RNA, 16 nt, Salmonella enterica enterica serovar Typhi
ccagcgguugcgcuuc

SEQ ID NO: 3638785 - RNA, 15 nt, Salmonella enterica enterica serovar Typhi
ccagcguaagcgccc

SEQ ID NO: 3638786 - RNA, 18 nt, Salmonella enterica enterica serovar Typhi
ccagcguacaucuuccau

SEQ ID NO: 3638787 - RNA, 17 nt, Salmonella enterica enterica serovar Typhi
ccagcguaccacgccgc

SEQ ID NO: 3638788 - RNA, 20 nt, Salmonella enterica enterica serovar Typhi
ccagcguaccacgccgcaca

SEQ ID NO: 3638789 - RNA, 21 nt, Salmonella enterica enterica serovar Typhi
ccagcguacguaacuucuugg

SEQ ID NO: 3638790 - RNA, 20 nt, Salmonella enterica enterica serovar Typhi
ccagcguagcuaaacccgua

SEQ ID NO: 3638791 - RNA, 23 nt, Salmonella enterica enterica serovar Typhi
ccagcguaugauagcgagcaaga

SEQ ID NO: 3638792 - RNA, 15 nt, Salmonella enterica enterica serovar Typhi
ccagcgucacaggcu

SEQ ID NO: 3638793 - RNA, 15 nt, Salmonella enterica enterica serovar Typhi
ccagcgucagccaga

SEQ ID NO: 3638794 - RNA, 18 nt, Salmonella enterica enterica serovar Typhi
ccagcgucucagcaggcg

SEQ ID NO: 3638795 - RNA, 23 nt, Salmonella enterica enterica serovar Typhi
ccagcgucuccagacaauccgcg

SEQ ID NO: 3638796 - RNA, 19 nt, Salmonella enterica enterica serovar Typhi
ccagcgugccgagcaacag

SEQ ID NO: 3638797 - RNA, 23 nt, Salmonella enterica enterica serovar Typhi
ccagcgugccgagcaacagaaac

SEQ ID NO: 3638798 - RNA, 15 nt, Salmonella enterica enterica serovar Typhi
ccagcgugcgcagcg

SEQ ID NO: 3638799 - RNA, 16 nt, Salmonella enterica enterica serovar Typhi
ccagcguugaccagcc

SEQ ID NO: 3638800 - RNA, 15 nt, Salmonella enterica enterica serovar Typhi
ccagcuaaccuguuc

SEQ ID NO: 3638801 - RNA, 17 nt, Salmonella enterica enterica serovar Typhi
ccagcuauccaguuucu

SEQ ID NO: 3638802 - RNA, 19 nt, Salmonella enterica enterica serovar Typhi
ccagcuauuuuucaccaua

SEQ ID NO: 3638803 - RNA, 21 nt, Salmonella enterica enterica serovar Typhi
ccagcucaacgccuuugcaau

SEQ ID NO: 3638804 - RNA, 23 nt, Salmonella enterica enterica serovar Typhi
ccagcucaccgagacugcccggc

SEQ ID NO: 3638805 - RNA, 15 nt, Salmonella enterica enterica serovar Typhi
ccagcucaucgaacc

SEQ ID NO: 3638806 - RNA, 21 nt, Salmonella enterica enterica serovar Typhi
ccagcucaugauagggcagca

SEQ ID NO: 3638807 - RNA, 15 nt, Salmonella enterica enterica serovar Typhi
ccagcucauguaguc

SEQ ID NO: 3638808 - RNA, 15 nt, Salmonella enterica enterica serovar Typhi
ccagcucauuuuuac

SEQ ID NO: 3638809 - RNA, 15 nt, Salmonella enterica enterica serovar Typhi
ccagcuccauagaaa

SEQ ID NO: 3638810 - RNA, 18 nt, Salmonella enterica enterica serovar Typhi
ccagcuccauccaccagc

SEQ ID NO: 3638811 - RNA, 16 nt, Salmonella enterica enterica serovar Typhi
ccagcucuacaucgcc

SEQ ID NO: 3638812 - RNA, 20 nt, Salmonella enterica enterica serovar Typhi
ccagcucuacaucgccgcga

SEQ ID NO: 3638813 - RNA, 23 nt, Salmonella enterica enterica serovar Typhi
ccagcucugccgguugaccggcc

SEQ ID NO: 3638814 - RNA, 21 nt, Salmonella enterica enterica serovar Typhi
ccagcucuuuaggcaggaaau

SEQ ID NO: 3638815 - RNA, 14 nt, Salmonella enterica enterica serovar Typhi
ccagcucuuucaau

SEQ ID NO: 3638816 - RNA, 19 nt, Salmonella enterica enterica serovar Typhi
ccagcugacgacgccagcc

SEQ ID NO: 3638817 - RNA, 15 nt, Salmonella enterica enterica serovar Typhi
ccagcugacgcagca

SEQ ID NO: 3638818 - RNA, 23 nt, Salmonella enterica enterica serovar Typhi
ccagcugguuaaccaccucauua

SEQ ID NO: 3638819 - RNA, 11 nt, Salmonella enterica enterica serovar Typhi
ccagcuuaaau

SEQ ID NO: 3638820 - RNA, 16 nt, Salmonella enterica enterica serovar Typhi
ccagcuucgccccggc

SEQ ID NO: 3638821 - RNA, 19 nt, Salmonella enterica enterica serovar Typhi
ccagcuuguuauccaucag

SEQ ID NO: 3638822 - RNA, 21 nt, Salmonella enterica enterica serovar Typhi
ccaggaagaguaucucucugg

SEQ ID NO: 3638823 - RNA, 23 nt, Salmonella enterica enterica serovar Typhi
ccaggaaguaaauuauuccuuga

SEQ ID NO: 3638824 - RNA, 17 nt, Salmonella enterica enterica serovar Typhi
ccaggaauuuucccaua

SEQ ID NO: 3638825 - RNA, 17 nt, Salmonella enterica enterica serovar Typhi
ccaggacaacgccggua

SEQ ID NO: 3638826 - RNA, 15 nt, Salmonella enterica enterica serovar Typhi
ccaggagcauuggaa

SEQ ID NO: 3638827 - RNA, 20 nt, Salmonella enterica enterica serovar Typhi
ccaggauaaccuuccggcac

SEQ ID NO: 3638828 - RNA, 15 nt, Salmonella enterica enterica serovar Typhi
ccaggauaauaauga

SEQ ID NO: 3638829 - RNA, 22 nt, Salmonella enterica enterica serovar Typhi
ccaggauaguacugaccagaca

SEQ ID NO: 3638830 - RNA, 22 nt, Salmonella enterica enterica serovar Typhi
ccaggauccguucaucggcaua

SEQ ID NO: 3638831 - RNA, 15 nt, Salmonella enterica enterica serovar Typhi
ccaggaucgccgccg

SEQ ID NO: 3638832 - RNA, 19 nt, Salmonella enterica enterica serovar Typhi
ccaggaugccaaccaccgc

SEQ ID NO: 3638833 - RNA, 15 nt, Salmonella enterica enterica serovar Typhi
ccaggcaaaaauagg

SEQ ID NO: 3638834 - RNA, 14 nt, Salmonella enterica enterica serovar Typhi
ccaggcaaaacagu

SEQ ID NO: 3638835 - RNA, 14 nt, Salmonella enterica enterica serovar Typhi
ccaggcaaaccagc

SEQ ID NO: 3638836 - RNA, 22 nt, Salmonella enterica enterica serovar Typhi
ccaggcaaagauuaccgggccc

SEQ ID NO: 3638837 - RNA, 13 nt, Salmonella enterica enterica serovar Typhi
ccaggcaaagccc

SEQ ID NO: 3638838 - RNA, 19 nt, Salmonella enterica enterica serovar Typhi
ccaggcaaagccccaguca

SEQ ID NO: 3638839 - RNA, 17 nt, Salmonella enterica enterica serovar Typhi
ccaggcaaucagcagcc

SEQ ID NO: 3638840 - RNA, 19 nt, Salmonella enterica enterica serovar Typhi
ccaggcaaugccccgccgc

SEQ ID NO: 3638841 - RNA, 14 nt, Salmonella enterica enterica serovar Typhi
ccaggcacugcagg

SEQ ID NO: 3638842 - RNA, 16 nt, Salmonella enterica enterica serovar Typhi
ccaggcacuugagaaa

SEQ ID NO: 3638843 - RNA, 13 nt, Salmonella enterica enterica serovar Typhi
ccaggcagaacgc

SEQ ID NO: 3638844 - RNA, 20 nt, Salmonella enterica enterica serovar Typhi
ccaggcagcaccucaauaug

SEQ ID NO: 3638845 - RNA, 12 nt, Salmonella enterica enterica serovar Typhi
ccaggcagcgcg

SEQ ID NO: 3638846 - RNA, 16 nt, Salmonella enterica enterica serovar Typhi
ccaggcauaaaaaaag

SEQ ID NO: 3638847 - RNA, 11 nt, Salmonella enterica enterica serovar Typhi
ccaggcauccg

SEQ ID NO: 3638848 - RNA, 20 nt, Salmonella enterica enterica serovar Typhi
ccaggcauccuugccgguca

SEQ ID NO: 3638849 - RNA, 20 nt, Salmonella enterica enterica serovar Typhi
ccaggcaucgacgccagcgg

SEQ ID NO: 3638850 - RNA, 14 nt, Salmonella enterica enterica serovar Typhi
ccaggcauugauaa

SEQ ID NO: 3638851 - RNA, 19 nt, Salmonella enterica enterica serovar Typhi
ccaggcauuuuauuaccug

SEQ ID NO: 3638852 - RNA, 21 nt, Salmonella enterica enterica serovar Typhi
ccaggccaaaaccacagugac

SEQ ID NO: 3638853 - RNA, 11 nt, Salmonella enterica enterica serovar Typhi
ccaggccagcg

SEQ ID NO: 3638854 - RNA, 16 nt, Salmonella enterica enterica serovar Typhi
ccaggccagcuccgcg

SEQ ID NO: 3638855 - RNA, 13 nt, Salmonella enterica enterica serovar Typhi
ccaggccaucaga

SEQ ID NO: 3638856 - RNA, 23 nt, Salmonella enterica enterica serovar Typhi
ccaggccaugcgccgcgucagca

SEQ ID NO: 3638857 - RNA, 16 nt, Salmonella enterica enterica serovar Typhi
ccaggccgccaccgcc

SEQ ID NO: 3638858 - RNA, 18 nt, Salmonella enterica enterica serovar Typhi
ccaggccgccaccgccuc

SEQ ID NO: 3638859 - RNA, 12 nt, Salmonella enterica enterica serovar Typhi
ccaggccgccag

SEQ ID NO: 3638860 - RNA, 19 nt, Salmonella enterica enterica serovar Typhi
ccaggccggauaaggcgcu

SEQ ID NO: 3638861 - RNA, 18 nt, Salmonella enterica enterica serovar Typhi
ccaggccggcauaaugau

SEQ ID NO: 3638862 - RNA, 21 nt, Salmonella enterica enterica serovar Typhi
ccaggccgucggcgccagcca

SEQ ID NO: 3638863 - RNA, 15 nt, Salmonella enterica enterica serovar Typhi
ccaggccguggcgca

SEQ ID NO: 3638864 - RNA, 16 nt, Salmonella enterica enterica serovar Typhi
ccaggccguggcgcau

SEQ ID NO: 3638865 - RNA, 21 nt, Salmonella enterica enterica serovar Typhi
ccaggccguggcgcaucuccu

SEQ ID NO: 3638866 - RNA, 19 nt, Salmonella enterica enterica serovar Typhi
ccaggcgaaccccaugccg

SEQ ID NO: 3638867 - RNA, 17 nt, Salmonella enterica enterica serovar Typhi
ccaggcgaccagaugca

SEQ ID NO: 3638868 - RNA, 16 nt, Salmonella enterica enterica serovar Typhi
ccaggcgauaccgcgc

SEQ ID NO: 3638869 - RNA, 17 nt, Salmonella enterica enterica serovar Typhi
ccaggcgcgcagcugcc

SEQ ID NO: 3638870 - RNA, 20 nt, Salmonella enterica enterica serovar Typhi
ccaggcgcuauucccaggca

SEQ ID NO: 3638871 - RNA, 20 nt, Salmonella enterica enterica serovar Typhi
ccaggcggguagucccagga

SEQ ID NO: 3638872 - RNA, 16 nt, Salmonella enterica enterica serovar Typhi
ccaggcggugaagacg

SEQ ID NO: 3638873 - RNA, 20 nt, Salmonella enterica enterica serovar Typhi
ccaggcguaagaucccaggg

SEQ ID NO: 3638874 - RNA, 15 nt, Salmonella enterica enterica serovar Typhi
ccaggcguccaguug

SEQ ID NO: 3638875 - RNA, 22 nt, Salmonella enterica enterica serovar Typhi
ccaggcuauaguggauggccca

SEQ ID NO: 3638876 - RNA, 15 nt, Salmonella enterica enterica serovar Typhi
ccaggcuucaucgga

SEQ ID NO: 3638877 - RNA, 22 nt, Salmonella enterica enterica serovar Typhi
ccaggcuuccugcgcugucacc

SEQ ID NO: 3638878 - RNA, 21 nt, Salmonella enterica enterica serovar Typhi
ccaggcuuuaguuuccgguaa

SEQ ID NO: 3638879 - RNA, 15 nt, Salmonella enterica enterica serovar Typhi
ccagggaaugccaua

SEQ ID NO: 3638880 - RNA, 23 nt, Salmonella enterica enterica serovar Typhi
ccagggauugauggccagccccu

SEQ ID NO: 3638881 - RNA, 14 nt, Salmonella enterica enterica serovar Typhi
ccagggcaucaaua

SEQ ID NO: 3638882 - RNA, 18 nt, Salmonella enterica enterica serovar Typhi
ccagggcugcuggccuuc

SEQ ID NO: 3638883 - RNA, 21 nt, Salmonella enterica enterica serovar Typhi
ccaggggaugauuuucaggca

SEQ ID NO: 3638884 - RNA, 18 nt, Salmonella enterica enterica serovar Typhi
ccagggggauccuuauuc

SEQ ID NO: 3638885 - RNA, 21 nt, Salmonella enterica enterica serovar Typhi
ccagggugcaaagaaacguuc

SEQ ID NO: 3638886 - RNA, 19 nt, Salmonella enterica enterica serovar Typhi
ccagguaacauacaaaaag

SEQ ID NO: 3638887 - RNA, 16 nt, Salmonella enterica enterica serovar Typhi
ccagguauuuagccac

SEQ ID NO: 3638888 - RNA, 13 nt, Salmonella enterica enterica serovar Typhi
ccaggucaucacc

SEQ ID NO: 3638889 - RNA, 23 nt, Salmonella enterica enterica serovar Typhi
ccaggucggcuuuuuuuuaugcc

SEQ ID NO: 3638890 - RNA, 18 nt, Salmonella enterica enterica serovar Typhi
ccaggugacuuugcccuu

SEQ ID NO: 3638891 - RNA, 14 nt, Salmonella enterica enterica serovar Typhi
ccaggugccgaggu

SEQ ID NO: 3638892 - RNA, 18 nt, Salmonella enterica enterica serovar Typhi
ccagguggcaauauccug

SEQ ID NO: 3638893 - RNA, 18 nt, Salmonella enterica enterica serovar Typhi
ccaggugucguuaaugcu

SEQ ID NO: 3638894 - RNA, 16 nt, Salmonella enterica enterica serovar Typhi
ccagguuauucaggug

SEQ ID NO: 3638895 - RNA, 18 nt, Salmonella enterica enterica serovar Typhi
ccagguuauucaggugga

SEQ ID NO: 3638896 - RNA, 21 nt, Salmonella enterica enterica serovar Typhi
ccagguuucuggcaacagcca

SEQ ID NO: 3638897 - RNA, 16 nt, Salmonella enterica enterica serovar Typhi
ccagguuuugcucuga

SEQ ID NO: 3638898 - RNA, 20 nt, Salmonella enterica enterica serovar Typhi
ccagguuuuggucagcucac

SEQ ID NO: 3638899 - RNA, 20 nt, Salmonella enterica enterica serovar Typhi
ccaguaaaaucggaccuccg

SEQ ID NO: 3638900 - RNA, 22 nt, Salmonella enterica enterica serovar Typhi
ccaguaaaaucggaccuccgcg

SEQ ID NO: 3638901 - RNA, 15 nt, Salmonella enterica enterica serovar Typhi
ccaguaagggcagcc

SEQ ID NO: 3638902 - RNA, 13 nt, Salmonella enterica enterica serovar Typhi
ccaguaauacgcc

SEQ ID NO: 3638903 - RNA, 23 nt, Salmonella enterica enterica serovar Typhi
ccaguaauaucgccucccugccu

SEQ ID NO: 3638904 - RNA, 12 nt, Salmonella enterica enterica serovar Typhi
ccaguaauccgg

SEQ ID NO: 3638905 - RNA, 17 nt, Salmonella enterica enterica serovar Typhi
ccaguaaugccgugccg

SEQ ID NO: 3638906 - RNA, 15 nt, Salmonella enterica enterica serovar Typhi
ccaguaauucccccg

SEQ ID NO: 3638907 - RNA, 15 nt, Salmonella enterica enterica serovar Typhi
ccaguaauuuuuccg

SEQ ID NO: 3638908 - RNA, 14 nt, Salmonella enterica enterica serovar Typhi
ccaguaauuuuucu

SEQ ID NO: 3638909 - RNA, 19 nt, Salmonella enterica enterica serovar Typhi
ccaguacaaacaaauaaau

SEQ ID NO: 3638910 - RNA, 22 nt, Salmonella enterica enterica serovar Typhi
ccaguacaaacaaauaaaucca

SEQ ID NO: 3638911 - RNA, 22 nt, Salmonella enterica enterica serovar Typhi
ccaguacaauuucuggccccug

SEQ ID NO: 3638912 - RNA, 15 nt, Salmonella enterica enterica serovar Typhi
ccaguaccauaccgg

SEQ ID NO: 3638913 - RNA, 16 nt, Salmonella enterica enterica serovar Typhi
ccaguaccgacgccau

SEQ ID NO: 3638914 - RNA, 13 nt, Salmonella enterica enterica serovar Typhi
ccaguaccgccgc

SEQ ID NO: 3638915 - RNA, 15 nt, Salmonella enterica enterica serovar Typhi
ccaguaccgccgccg

SEQ ID NO: 3638916 - RNA, 22 nt, Salmonella enterica enterica serovar Typhi
ccaguaccgucauuuccggcgc

SEQ ID NO: 3638917 - RNA, 21 nt, Salmonella enterica enterica serovar Typhi
ccaguacuuuggccuaacagu

SEQ ID NO: 3638918 - RNA, 13 nt, Salmonella enterica enterica serovar Typhi
ccaguagcagcga

SEQ ID NO: 3638919 - RNA, 14 nt, Salmonella enterica enterica serovar Typhi
ccaguagcgcgccc

SEQ ID NO: 3638920 - RNA, 18 nt, Salmonella enterica enterica serovar Typhi
ccaguaguugaccugauc

SEQ ID NO: 3638921 - RNA, 21 nt, Salmonella enterica enterica serovar Typhi
ccagucaacgaggugaauaaa

SEQ ID NO: 3638922 - RNA, 22 nt, Salmonella enterica enterica serovar Typhi
ccagucagcaauuaacaaauaa

SEQ ID NO: 3638923 - RNA, 19 nt, Salmonella enterica enterica serovar Typhi
ccagucaggcgaucccggc

SEQ ID NO: 3638924 - RNA, 13 nt, Salmonella enterica enterica serovar Typhi
ccagucaguuuau

SEQ ID NO: 3638925 - RNA, 17 nt, Salmonella enterica enterica serovar Typhi
ccagucaucauaauuca

SEQ ID NO: 3638926 - RNA, 24 nt, Salmonella enterica enterica serovar Typhi
ccagucauccgguucauaauccgg

SEQ ID NO: 3638927 - RNA, 14 nt, Salmonella enterica enterica serovar Typhi
ccagucaucgccgc

SEQ ID NO: 3638928 - RNA, 19 nt, Salmonella enterica enterica serovar Typhi
ccagucauuaauucccgca

SEQ ID NO: 3638929 - RNA, 13 nt, Salmonella enterica enterica serovar Typhi
ccaguccggcaga

SEQ ID NO: 3638930 - RNA, 17 nt, Salmonella enterica enterica serovar Typhi
ccaguccgguauaaaac

SEQ ID NO: 3638931 - RNA, 17 nt, Salmonella enterica enterica serovar Typhi
ccaguccugccaccagc

SEQ ID NO: 3638932 - RNA, 18 nt, Salmonella enterica enterica serovar Typhi
ccaguccugucccugcca

SEQ ID NO: 3638933 - RNA, 15 nt, Salmonella enterica enterica serovar Typhi
ccagucgacucaucu

SEQ ID NO: 3638934 - RNA, 18 nt, Salmonella enterica enterica serovar Typhi
ccagucgacucaucuuuu

SEQ ID NO: 3638935 - RNA, 13 nt, Salmonella enterica enterica serovar Typhi
ccagucgcuccac

SEQ ID NO: 3638936 - RNA, 16 nt, Salmonella enterica enterica serovar Typhi
ccagucggcaaagacc

SEQ ID NO: 3638937 - RNA, 22 nt, Salmonella enterica enterica serovar Typhi
ccagucggcaaagaccaauaaa

SEQ ID NO: 3638938 - RNA, 16 nt, Salmonella enterica enterica serovar Typhi
ccagucgggcgugccg

SEQ ID NO: 3638939 - RNA, 14 nt, Salmonella enterica enterica serovar Typhi
ccagucguaauuca

SEQ ID NO: 3638940 - RNA, 21 nt, Salmonella enterica enterica serovar Typhi
ccagucuuauuguccuguuuc

SEQ ID NO: 3638941 - RNA, 14 nt, Salmonella enterica enterica serovar Typhi
ccagugaaaaaaag

SEQ ID NO: 3638942 - RNA, 13 nt, Salmonella enterica enterica serovar Typhi
ccagugaaauaaa

SEQ ID NO: 3638943 - RNA, 15 nt, Salmonella enterica enterica serovar Typhi
ccagugaaauaaaug

SEQ ID NO: 3638944 - RNA, 16 nt, Salmonella enterica enterica serovar Typhi
ccagugaauccaccac

SEQ ID NO: 3638945 - RNA, 17 nt, Salmonella enterica enterica serovar Typhi
ccagugaauccaccacg

SEQ ID NO: 3638946 - RNA, 23 nt, Salmonella enterica enterica serovar Typhi
ccagugccaccagccggagccgg

SEQ ID NO: 3638947 - RNA, 17 nt, Salmonella enterica enterica serovar Typhi
ccagugccaguuaagca

SEQ ID NO: 3638948 - RNA, 21 nt, Salmonella enterica enterica serovar Typhi
ccaguggucguuagccagaug

SEQ ID NO: 3638949 - RNA, 23 nt, Salmonella enterica enterica serovar Typhi
ccagugguuccauuccagaacga

SEQ ID NO: 3638950 - RNA, 21 nt, Salmonella enterica enterica serovar Typhi
ccagugugcgguggcaacgcu

SEQ ID NO: 3638951 - RNA, 16 nt, Salmonella enterica enterica serovar Typhi
ccaguuauagcgcaga

SEQ ID NO: 3638952 - RNA, 14 nt, Salmonella enterica enterica serovar Typhi
ccaguuaucacggu

SEQ ID NO: 3638953 - RNA, 22 nt, Salmonella enterica enterica serovar Typhi
ccaguuaucaggacauaaaaca

SEQ ID NO: 3638954 - RNA, 21 nt, Salmonella enterica enterica serovar Typhi
ccaguucauaagucauccaga

SEQ ID NO: 3638955 - RNA, 14 nt, Salmonella enterica enterica serovar Typhi
ccaguucauuaaca

SEQ ID NO: 3638956 - RNA, 18 nt, Salmonella enterica enterica serovar Typhi
ccaguucccccgguuacc

SEQ ID NO: 3638957 - RNA, 19 nt, Salmonella enterica enterica serovar Typhi
ccaguucgccuucuucauc

SEQ ID NO: 3638958 - RNA, 22 nt, Salmonella enterica enterica serovar Typhi
ccaguucggcgauuuccagcgc

SEQ ID NO: 3638959 - RNA, 23 nt, Salmonella enterica enterica serovar Typhi
ccaguucucaaucgccgcauggg

SEQ ID NO: 3638960 - RNA, 14 nt, Salmonella enterica enterica serovar Typhi
ccaguucucuucuu

SEQ ID NO: 3638961 - RNA, 23 nt, Salmonella enterica enterica serovar Typhi
ccaguucucuucuuugcgcgucu

SEQ ID NO: 3638962 - RNA, 17 nt, Salmonella enterica enterica serovar Typhi
ccaguucuggcugcgcu

SEQ ID NO: 3638963 - RNA, 17 nt, Salmonella enterica enterica serovar Typhi
ccaguugaucggccagc

SEQ ID NO: 3638964 - RNA, 23 nt, Salmonella enterica enterica serovar Typhi
ccaguugccaggguucaaccuga

SEQ ID NO: 3638965 - RNA, 14 nt, Salmonella enterica enterica serovar Typhi
ccaguugcgcaggg

SEQ ID NO: 3638966 - RNA, 14 nt, Salmonella enterica enterica serovar Typhi
ccaguuggcaacgu

SEQ ID NO: 3638967 - RNA, 20 nt, Salmonella enterica enterica serovar Typhi
ccaguuggcguaccaucagc

SEQ ID NO: 3638968 - RNA, 20 nt, Salmonella enterica enterica serovar Typhi
ccaguuguccgcuggucagc

SEQ ID NO: 3638969 - RNA, 16 nt, Salmonella enterica enterica serovar Typhi
ccaguuguucuuucac

SEQ ID NO: 3638970 - RNA, 14 nt, Salmonella enterica enterica serovar Typhi
ccaguuuccugacc

SEQ ID NO: 3638971 - RNA, 19 nt, Salmonella enterica enterica serovar Typhi
ccaguuuccugacccgcuc

SEQ ID NO: 3638972 - RNA, 13 nt, Salmonella enterica enterica serovar Typhi
ccaguuucucaaa

SEQ ID NO: 3638973 - RNA, 22 nt, Salmonella enterica enterica serovar Typhi
ccaguuucugacguaacuuauc

SEQ ID NO: 3638974 - RNA, 20 nt, Salmonella enterica enterica serovar Typhi
ccaguuuuaaauaucauuua

SEQ ID NO: 3638975 - RNA, 15 nt, Salmonella enterica enterica serovar Typhi
ccaguuuuaagcgca

SEQ ID NO: 3638976 - RNA, 22 nt, Salmonella enterica enterica serovar Typhi
ccaguuuuugcgccagcgcaag

SEQ ID NO: 3638977 - RNA, 13 nt, Salmonella enterica enterica serovar Typhi
ccaguuuuuucca

SEQ ID NO: 3638978 - RNA, 17 nt, Salmonella enterica enterica serovar Typhi
ccaguuuuuuccagcgc

SEQ ID NO: 3638979 - RNA, 23 nt, Salmonella enterica enterica serovar Typhi
ccauaaaaacaauaaauaacgug

SEQ ID NO: 3638980 - RNA, 16 nt, Salmonella enterica enterica serovar Typhi
ccauaaagaagcgugc

SEQ ID NO: 3638981 - RNA, 13 nt, Salmonella enterica enterica serovar Typhi
ccauaaaggccuc

SEQ ID NO: 3638982 - RNA, 12 nt, Salmonella enterica enterica serovar Typhi
ccauaaaugaaa

SEQ ID NO: 3638983 - RNA, 20 nt, Salmonella enterica enterica serovar Typhi
ccauaagcuuaggauaagaa

SEQ ID NO: 3638984 - RNA, 18 nt, Salmonella enterica enterica serovar Typhi
ccauaauaaugacuaauu

SEQ ID NO: 3638985 - RNA, 20 nt, Salmonella enterica enterica serovar Typhi
ccauaauacuuaauucauaa

SEQ ID NO: 3638986 - RNA, 21 nt, Salmonella enterica enterica serovar Typhi
ccauaaugaucguaugcagcc

SEQ ID NO: 3638987 - RNA, 14 nt, Salmonella enterica enterica serovar Typhi
ccauaaugcaauca

SEQ ID NO: 3638988 - RNA, 23 nt, Salmonella enterica enterica serovar Typhi
ccauaauuaccggcacaccggcc

SEQ ID NO: 3638989 - RNA, 13 nt, Salmonella enterica enterica serovar Typhi
ccauacagcccau

SEQ ID NO: 3638990 - RNA, 15 nt, Salmonella enterica enterica serovar Typhi
ccauacagcccauac

SEQ ID NO: 3638991 - RNA, 17 nt, Salmonella enterica enterica serovar Typhi
ccauacaguggccagac

SEQ ID NO: 3638992 - RNA, 15 nt, Salmonella enterica enterica serovar Typhi
ccauacccggcuccc

SEQ ID NO: 3638993 - RNA, 20 nt, Salmonella enterica enterica serovar Typhi
ccauaccuaaugcccgcuug

SEQ ID NO: 3638994 - RNA, 19 nt, Salmonella enterica enterica serovar Typhi
ccauacgcccacgcggcgu

SEQ ID NO: 3638995 - RNA, 20 nt, Salmonella enterica enterica serovar Typhi
ccauacuauccaacagaagg

SEQ ID NO: 3638996 - RNA, 20 nt, Salmonella enterica enterica serovar Typhi
ccauacuccugccugacaau

SEQ ID NO: 3638997 - RNA, 20 nt, Salmonella enterica enterica serovar Typhi
ccauacucuauguucaguag

SEQ ID NO: 3638998 - RNA, 16 nt, Salmonella enterica enterica serovar Typhi
ccauacuuacugcugu

SEQ ID NO: 3638999 - RNA, 13 nt, Salmonella enterica enterica serovar Typhi
ccauacuuugcau

SEQ ID NO: 3639000 - RNA, 22 nt, Salmonella enterica enterica serovar Typhi
ccauagcagcuccgaaacaauc

SEQ ID NO: 3639001 - RNA, 23 nt, Salmonella enterica enterica serovar Typhi
ccauagccaacacauaagccacu

SEQ ID NO: 3639002 - RNA, 20 nt, Salmonella enterica enterica serovar Typhi
ccauagcgcuaugcgcucca

SEQ ID NO: 3639003 - RNA, 21 nt, Salmonella enterica enterica serovar Typhi
ccauagcguuuaaaaagcugc

SEQ ID NO: 3639004 - RNA, 19 nt, Salmonella enterica enterica serovar Typhi
ccauauaacagaauaagcc

SEQ ID NO: 3639005 - RNA, 14 nt, Salmonella enterica enterica serovar Typhi
ccauauauuuacug

SEQ ID NO: 3639006 - RNA, 14 nt, Salmonella enterica enterica serovar Typhi
ccauauucacgcag

SEQ ID NO: 3639007 - RNA, 16 nt, Salmonella enterica enterica serovar Typhi
ccauauugccgcacau

SEQ ID NO: 3639008 - RNA, 12 nt, Salmonella enterica enterica serovar Typhi
ccauauugcugu

SEQ ID NO: 3639009 - RNA, 19 nt, Salmonella enterica enterica serovar Typhi
ccauauuguucaguuucaa

SEQ ID NO: 3639010 - RNA, 17 nt, Salmonella enterica enterica serovar Typhi
ccauauuuuuccagcgc

SEQ ID NO: 3639011 - RNA, 17 nt, Salmonella enterica enterica serovar Typhi
ccauauuuuuucaggaa

SEQ ID NO: 3639012 - RNA, 14 nt, Salmonella enterica enterica serovar Typhi
ccaucaaacgcagc

SEQ ID NO: 3639013 - RNA, 14 nt, Salmonella enterica enterica serovar Typhi
ccaucaaauaauac

SEQ ID NO: 3639014 - RNA, 15 nt, Salmonella enterica enterica serovar Typhi
ccaucaacagcguga

SEQ ID NO: 3639015 - RNA, 17 nt, Salmonella enterica enterica serovar Typhi
ccaucaacaucaucgga

SEQ ID NO: 3639016 - RNA, 19 nt, Salmonella enterica enterica serovar Typhi
ccaucaauaagcgaauugc

SEQ ID NO: 3639017 - RNA, 17 nt, Salmonella enterica enterica serovar Typhi
ccaucaauuuugcgccu

SEQ ID NO: 3639018 - RNA, 17 nt, Salmonella enterica enterica serovar Typhi
ccaucacauguagcgcg

SEQ ID NO: 3639019 - RNA, 18 nt, Salmonella enterica enterica serovar Typhi
ccaucacuuccauccaug

SEQ ID NO: 3639020 - RNA, 13 nt, Salmonella enterica enterica serovar Typhi
ccaucacuuccug

SEQ ID NO: 3639021 - RNA, 21 nt, Salmonella enterica enterica serovar Typhi
ccaucagaaugcuggucacgg

SEQ ID NO: 3639022 - RNA, 14 nt, Salmonella enterica enterica serovar Typhi
ccaucagcacauga

SEQ ID NO: 3639023 - RNA, 23 nt, Salmonella enterica enterica serovar Typhi
ccaucagccgcgcuaucaaaaug

SEQ ID NO: 3639024 - RNA, 13 nt, Salmonella enterica enterica serovar Typhi
ccaucagcgccag

SEQ ID NO: 3639025 - RNA, 20 nt, Salmonella enterica enterica serovar Typhi
ccaucagcgcgggauaacgc

SEQ ID NO: 3639026 - RNA, 19 nt, Salmonella enterica enterica serovar Typhi
ccaucagcgucagcagagu

SEQ ID NO: 3639027 - RNA, 14 nt, Salmonella enterica enterica serovar Typhi
ccaucaggcaauau

SEQ ID NO: 3639028 - RNA, 16 nt, Salmonella enterica enterica serovar Typhi
ccaucaggcaaucuuu

SEQ ID NO: 3639029 - RNA, 16 nt, Salmonella enterica enterica serovar Typhi
ccaucaggcacaaugc

SEQ ID NO: 3639030 - RNA, 15 nt, Salmonella enterica enterica serovar Typhi
ccaucaggcauaaac

SEQ ID NO: 3639031 - RNA, 21 nt, Salmonella enterica enterica serovar Typhi
ccaucaggcaucugaaaugcu

SEQ ID NO: 3639032 - RNA, 18 nt, Salmonella enterica enterica serovar Typhi
ccaucaggcuuugcgcca

SEQ ID NO: 3639033 - RNA, 13 nt, Salmonella enterica enterica serovar Typhi
ccaucauaaagcc

SEQ ID NO: 3639034 - RNA, 15 nt, Salmonella enterica enterica serovar Typhi
ccaucauaccgccaa

SEQ ID NO: 3639035 - RNA, 14 nt, Salmonella enterica enterica serovar Typhi
ccaucauagcccau

SEQ ID NO: 3639036 - RNA, 15 nt, Salmonella enterica enterica serovar Typhi
ccaucauagcccaua

SEQ ID NO: 3639037 - RNA, 16 nt, Salmonella enterica enterica serovar Typhi
ccaucauagcccauac

SEQ ID NO: 3639038 - RNA, 13 nt, Salmonella enterica enterica serovar Typhi
ccaucaugcgcca

SEQ ID NO: 3639039 - RNA, 15 nt, Salmonella enterica enterica serovar Typhi
ccaucaugcgccagg

SEQ ID NO: 3639040 - RNA, 16 nt, Salmonella enterica enterica serovar Typhi
ccaucauggcuuucag

SEQ ID NO: 3639041 - RNA, 21 nt, Salmonella enterica enterica serovar Typhi
ccaucauguugaaauauuuga

SEQ ID NO: 3639042 - RNA, 19 nt, Salmonella enterica enterica serovar Typhi
ccauccagacaugcacaug

SEQ ID NO: 3639043 - RNA, 13 nt, Salmonella enterica enterica serovar Typhi
ccaucccggcgua

SEQ ID NO: 3639044 - RNA, 14 nt, Salmonella enterica enterica serovar Typhi
ccauccggcaaaau

SEQ ID NO: 3639045 - RNA, 15 nt, Salmonella enterica enterica serovar Typhi
ccauccggcaaaauu

SEQ ID NO: 3639046 - RNA, 20 nt, Salmonella enterica enterica serovar Typhi
ccauccggcaaacucagcgg

SEQ ID NO: 3639047 - RNA, 18 nt, Salmonella enterica enterica serovar Typhi
ccauccggcaauuaaccg

SEQ ID NO: 3639048 - RNA, 23 nt, Salmonella enterica enterica serovar Typhi
ccauccggcacggucaaucauca

SEQ ID NO: 3639049 - RNA, 14 nt, Salmonella enterica enterica serovar Typhi
ccauccggcacugu

SEQ ID NO: 3639050 - RNA, 16 nt, Salmonella enterica enterica serovar Typhi
ccauccggcauuuuuu

SEQ ID NO: 3639051 - RNA, 16 nt, Salmonella enterica enterica serovar Typhi
ccauccgggccacucu

SEQ ID NO: 3639052 - RNA, 19 nt, Salmonella enterica enterica serovar Typhi
ccauccgggccacucucca

SEQ ID NO: 3639053 - RNA, 18 nt, Salmonella enterica enterica serovar Typhi
ccauccgugcgaugagau

SEQ ID NO: 3639054 - RNA, 22 nt, Salmonella enterica enterica serovar Typhi
ccauccucauuuuguugcucca

SEQ ID NO: 3639055 - RNA, 17 nt, Salmonella enterica enterica serovar Typhi
ccaucgacagcgccaua

SEQ ID NO: 3639056 - RNA, 23 nt, Salmonella enterica enterica serovar Typhi
ccaucgacgaaauggugugcaug

SEQ ID NO: 3639057 - RNA, 19 nt, Salmonella enterica enterica serovar Typhi
ccaucgcccgggcgauauc

SEQ ID NO: 3639058 - RNA, 14 nt, Salmonella enterica enterica serovar Typhi
ccaucgccgcagag

SEQ ID NO: 3639059 - RNA, 12 nt, Salmonella enterica enterica serovar Typhi
ccaucgccugau

SEQ ID NO: 3639060 - RNA, 20 nt, Salmonella enterica enterica serovar Typhi
ccaucgccugaugaccgccg

SEQ ID NO: 3639061 - RNA, 14 nt, Salmonella enterica enterica serovar Typhi
ccaucgcgccgcug

SEQ ID NO: 3639062 - RNA, 23 nt, Salmonella enterica enterica serovar Typhi
ccaucgcguuguaaucgccugaa

SEQ ID NO: 3639063 - RNA, 22 nt, Salmonella enterica enterica serovar Typhi
ccaucgcuuuacguuuggcggc

SEQ ID NO: 3639064 - RNA, 16 nt, Salmonella enterica enterica serovar Typhi
ccaucggaguccagca

SEQ ID NO: 3639065 - RNA, 23 nt, Salmonella enterica enterica serovar Typhi
ccaucggcaucggucucgcuaua

SEQ ID NO: 3639066 - RNA, 17 nt, Salmonella enterica enterica serovar Typhi
ccaucggcgggcguauc

SEQ ID NO: 3639067 - RNA, 22 nt, Salmonella enterica enterica serovar Typhi
ccaucgggccgcucagcaucgc

SEQ ID NO: 3639068 - RNA, 16 nt, Salmonella enterica enterica serovar Typhi
ccaucggucgcgcgca

SEQ ID NO: 3639069 - RNA, 15 nt, Salmonella enterica enterica serovar Typhi
ccaucgguucucugc

SEQ ID NO: 3639070 - RNA, 18 nt, Salmonella enterica enterica serovar Typhi
ccaucucacgcauggcgu

SEQ ID NO: 3639071 - RNA, 19 nt, Salmonella enterica enterica serovar Typhi
ccaucucauucgccagcgg

SEQ ID NO: 3639072 - RNA, 14 nt, Salmonella enterica enterica serovar Typhi
ccaucuccaucauu

SEQ ID NO: 3639073 - RNA, 22 nt, Salmonella enterica enterica serovar Typhi
ccaucuccugcgauagcugcug

SEQ ID NO: 3639074 - RNA, 16 nt, Salmonella enterica enterica serovar Typhi
ccaucucuuccgcggu

SEQ ID NO: 3639075 - RNA, 22 nt, Salmonella enterica enterica serovar Typhi
ccaucugaacucuuccagauac

SEQ ID NO: 3639076 - RNA, 15 nt, Salmonella enterica enterica serovar Typhi
ccaucuuccagcauc

SEQ ID NO: 3639077 - RNA, 12 nt, Salmonella enterica enterica serovar Typhi
ccaucuuccuca

SEQ ID NO: 3639078 - RNA, 14 nt, Salmonella enterica enterica serovar Typhi
ccaucuuuuuucac

SEQ ID NO: 3639079 - RNA, 21 nt, Salmonella enterica enterica serovar Typhi
ccaugaagcgauuuauccacc

SEQ ID NO: 3639080 - RNA, 22 nt, Salmonella enterica enterica serovar Typhi
ccaugaccaccagcgcgaccgg

SEQ ID NO: 3639081 - RNA, 14 nt, Salmonella enterica enterica serovar Typhi
ccaugacgacaggu

SEQ ID NO: 3639082 - RNA, 17 nt, Salmonella enterica enterica serovar Typhi
ccaugacgaccacagcc

SEQ ID NO: 3639083 - RNA, 19 nt, Salmonella enterica enterica serovar Typhi
ccaugacggguaacgccaa

SEQ ID NO: 3639084 - RNA, 22 nt, Salmonella enterica enterica serovar Typhi
ccaugagcgaaacuccagcgau

SEQ ID NO: 3639085 - RNA, 18 nt, Salmonella enterica enterica serovar Typhi
ccaugauccguucgauca

SEQ ID NO: 3639086 - RNA, 14 nt, Salmonella enterica enterica serovar Typhi
ccaugaucgucagg

SEQ ID NO: 3639087 - RNA, 14 nt, Salmonella enterica enterica serovar Typhi
ccaugauggcguaa

SEQ ID NO: 3639088 - RNA, 14 nt, Salmonella enterica enterica serovar Typhi
ccaugauucauccc

SEQ ID NO: 3639089 - RNA, 12 nt, Salmonella enterica enterica serovar Typhi
ccaugcaaaaaa

SEQ ID NO: 3639090 - RNA, 22 nt, Salmonella enterica enterica serovar Typhi
ccaugcaccagucccagcccca

SEQ ID NO: 3639091 - RNA, 18 nt, Salmonella enterica enterica serovar Typhi
ccaugcauaaugcagcca

SEQ ID NO: 3639092 - RNA, 22 nt, Salmonella enterica enterica serovar Typhi
ccaugccacaacagaagcggcc

SEQ ID NO: 3639093 - RNA, 19 nt, Salmonella enterica enterica serovar Typhi
ccaugcccaguucaaucaa

SEQ ID NO: 3639094 - RNA, 22 nt, Salmonella enterica enterica serovar Typhi
ccaugccggcuuuccgcaccgc

SEQ ID NO: 3639095 - RNA, 15 nt, Salmonella enterica enterica serovar Typhi
ccaugccuuuauuuc

SEQ ID NO: 3639096 - RNA, 19 nt, Salmonella enterica enterica serovar Typhi
ccaugcgacuaaccugauc

SEQ ID NO: 3639097 - RNA, 22 nt, Salmonella enterica enterica serovar Typhi
ccaugcuauccgccgccagcca

SEQ ID NO: 3639098 - RNA, 21 nt, Salmonella enterica enterica serovar Typhi
ccaugcucauccaacugcgcc

SEQ ID NO: 3639099 - RNA, 13 nt, Salmonella enterica enterica serovar Typhi
ccaugcugguugg

SEQ ID NO: 3639100 - RNA, 23 nt, Salmonella enterica enterica serovar Typhi
ccaugcugucgucgacagcgccc

SEQ ID NO: 3639101 - RNA, 21 nt, Salmonella enterica enterica serovar Typhi
ccaugcugugugaccagcagu

SEQ ID NO: 3639102 - RNA, 23 nt, Salmonella enterica enterica serovar Typhi
ccaugcugugugaccagcaguuc

SEQ ID NO: 3639103 - RNA, 15 nt, Salmonella enterica enterica serovar Typhi
ccaugcuuucaauaa

SEQ ID NO: 3639104 - RNA, 21 nt, Salmonella enterica enterica serovar Typhi
ccauggaacauccucuccuga

SEQ ID NO: 3639105 - RNA, 14 nt, Salmonella enterica enterica serovar Typhi
ccauggagaaacag

SEQ ID NO: 3639106 - RNA, 17 nt, Salmonella enterica enterica serovar Typhi
ccauggagagugagcca

SEQ ID NO: 3639107 - RNA, 15 nt, Salmonella enterica enterica serovar Typhi
ccauggcccaaaagg

SEQ ID NO: 3639108 - RNA, 14 nt, Salmonella enterica enterica serovar Typhi
ccauggccgcagcc

SEQ ID NO: 3639109 - RNA, 17 nt, Salmonella enterica enterica serovar Typhi
ccaugggucucauccau

SEQ ID NO: 3639110 - RNA, 23 nt, Salmonella enterica enterica serovar Typhi
ccauggucagacgcucagccuua

SEQ ID NO: 3639111 - RNA, 19 nt, Salmonella enterica enterica serovar Typhi
ccaugguucccgccacuga

SEQ ID NO: 3639112 - RNA, 18 nt, Salmonella enterica enterica serovar Typhi
ccaugucagcgcaaagcc

SEQ ID NO: 3639113 - RNA, 13 nt, Salmonella enterica enterica serovar Typhi
ccauguucaguuc

SEQ ID NO: 3639114 - RNA, 14 nt, Salmonella enterica enterica serovar Typhi
ccauguugagcgcu

SEQ ID NO: 3639115 - RNA, 21 nt, Salmonella enterica enterica serovar Typhi
ccauguugagcgcuugcugcg

SEQ ID NO: 3639116 - RNA, 18 nt, Salmonella enterica enterica serovar Typhi
ccauguugcguaaauaaa

SEQ ID NO: 3639117 - RNA, 19 nt, Salmonella enterica enterica serovar Typhi
ccauguugcguaaauaaau

SEQ ID NO: 3639118 - RNA, 16 nt, Salmonella enterica enterica serovar Typhi
ccauguuuaccaucgc

SEQ ID NO: 3639119 - RNA, 19 nt, Salmonella enterica enterica serovar Typhi
ccauguuuaccaucgcguu

SEQ ID NO: 3639120 - RNA, 14 nt, Salmonella enterica enterica serovar Typhi
ccauguuuguuuaa

SEQ ID NO: 3639121 - RNA, 13 nt, Salmonella enterica enterica serovar Typhi
ccauuaaugcagg

SEQ ID NO: 3639122 - RNA, 21 nt, Salmonella enterica enterica serovar Typhi
ccauuaccuggcaacauagca

SEQ ID NO: 3639123 - RNA, 13 nt, Salmonella enterica enterica serovar Typhi
ccauuagcuguug

SEQ ID NO: 3639124 - RNA, 12 nt, Salmonella enterica enterica serovar Typhi
ccauuauucgga

SEQ ID NO: 3639125 - RNA, 16 nt, Salmonella enterica enterica serovar Typhi
ccauuauuuauuuuca

SEQ ID NO: 3639126 - RNA, 24 nt, Salmonella enterica enterica serovar Typhi
ccauuauuuauuuucauacuauuu

SEQ ID NO: 3639127 - RNA, 18 nt, Salmonella enterica enterica serovar Typhi
ccauucagcuuauucguc

SEQ ID NO: 3639128 - RNA, 14 nt, Salmonella enterica enterica serovar Typhi
ccauuccaggucau

SEQ ID NO: 3639129 - RNA, 14 nt, Salmonella enterica enterica serovar Typhi
ccauucccaccaua

SEQ ID NO: 3639130 - RNA, 15 nt, Salmonella enterica enterica serovar Typhi
ccauuccccacgcca

SEQ ID NO: 3639131 - RNA, 19 nt, Salmonella enterica enterica serovar Typhi
ccauuccgauagcgaaacu

SEQ ID NO: 3639132 - RNA, 15 nt, Salmonella enterica enterica serovar Typhi
ccauuccgccaacgg

SEQ ID NO: 3639133 - RNA, 12 nt, Salmonella enterica enterica serovar Typhi
ccauuccucacg

SEQ ID NO: 3639134 - RNA, 15 nt, Salmonella enterica enterica serovar Typhi
ccauucgcccaguca

SEQ ID NO: 3639135 - RNA, 13 nt, Salmonella enterica enterica serovar Typhi
ccauucugcugau

SEQ ID NO: 3639136 - RNA, 13 nt, Salmonella enterica enterica serovar Typhi
ccauucuucaaca

SEQ ID NO: 3639137 - RNA, 19 nt, Salmonella enterica enterica serovar Typhi
ccauucuuucgcguaaaca

SEQ ID NO: 3639138 - RNA, 22 nt, Salmonella enterica enterica serovar Typhi
ccauucuuucgcguaaacacuc

SEQ ID NO: 3639139 - RNA, 16 nt, Salmonella enterica enterica serovar Typhi
ccauugaugccugccc

SEQ ID NO: 3639140 - RNA, 13 nt, Salmonella enterica enterica serovar Typhi
ccauugccagaua

SEQ ID NO: 3639141 - RNA, 11 nt, Salmonella enterica enterica serovar Typhi
ccauugccgcg

SEQ ID NO: 3639142 - RNA, 20 nt, Salmonella enterica enterica serovar Typhi
ccauugccgcgacaaaaagc

SEQ ID NO: 3639143 - RNA, 16 nt, Salmonella enterica enterica serovar Typhi
ccauugcgagaaaaaa

SEQ ID NO: 3639144 - RNA, 16 nt, Salmonella enterica enterica serovar Typhi
ccauugcuaggaacag

SEQ ID NO: 3639145 - RNA, 22 nt, Salmonella enterica enterica serovar Typhi
ccauugcuaggaacagugacaa

SEQ ID NO: 3639146 - RNA, 16 nt, Salmonella enterica enterica serovar Typhi
ccauugcugacaaaau

SEQ ID NO: 3639147 - RNA, 18 nt, Salmonella enterica enterica serovar Typhi
ccauugcugaggaucacc

SEQ ID NO: 3639148 - RNA, 16 nt, Salmonella enterica enterica serovar Typhi
ccauugcugucgacaa

SEQ ID NO: 3639149 - RNA, 16 nt, Salmonella enterica enterica serovar Typhi
ccauugcuuuuuugau

SEQ ID NO: 3639150 - RNA, 22 nt, Salmonella enterica enterica serovar Typhi
ccauuggcaccaccaggaacgc

SEQ ID NO: 3639151 - RNA, 11 nt, Salmonella enterica enterica serovar Typhi
ccauuucacaa

SEQ ID NO: 3639152 - RNA, 18 nt, Salmonella enterica enterica serovar Typhi
ccauuuccggcgcgccua

SEQ ID NO: 3639153 - RNA, 21 nt, Salmonella enterica enterica serovar Typhi
ccauuucgccuauuuucucuu

SEQ ID NO: 3639154 - RNA, 19 nt, Salmonella enterica enterica serovar Typhi
ccauuugaaucguagcgug

SEQ ID NO: 3639155 - RNA, 14 nt, Salmonella enterica enterica serovar Typhi
ccauuugccagaua

SEQ ID NO: 3639156 - RNA, 16 nt, Salmonella enterica enterica serovar Typhi
ccauuuggcuuaaaua

SEQ ID NO: 3639157 - RNA, 15 nt, Salmonella enterica enterica serovar Typhi
ccauuuuauccucuu

SEQ ID NO: 3639158 - RNA, 13 nt, Salmonella enterica enterica serovar Typhi
cccaaaauaauuc

SEQ ID NO: 3639159 - RNA, 13 nt, Salmonella enterica enterica serovar Typhi
cccaaacaccaac

SEQ ID NO: 3639160 - RNA, 19 nt, Salmonella enterica enterica serovar Typhi
cccaaacgucguaaaaccu

SEQ ID NO: 3639161 - RNA, 23 nt, Salmonella enterica enterica serovar Typhi
cccaaaggaaagguccggcccgc

SEQ ID NO: 3639162 - RNA, 20 nt, Salmonella enterica enterica serovar Typhi
cccaaauaguccagcaucca

SEQ ID NO: 3639163 - RNA, 16 nt, Salmonella enterica enterica serovar Typhi
cccaacaucaguucag

SEQ ID NO: 3639164 - RNA, 15 nt, Salmonella enterica enterica serovar Typhi
cccaacaugguugcu

SEQ ID NO: 3639165 - RNA, 12 nt, Salmonella enterica enterica serovar Typhi
cccaaccagccc

SEQ ID NO: 3639166 - RNA, 14 nt, Salmonella enterica enterica serovar Typhi
cccaacccgaccag

SEQ ID NO: 3639167 - RNA, 17 nt, Salmonella enterica enterica serovar Typhi
cccaaccgaaacguaug

SEQ ID NO: 3639168 - RNA, 17 nt, Salmonella enterica enterica serovar Typhi
cccaacgacagcacuac

SEQ ID NO: 3639169 - RNA, 15 nt, Salmonella enterica enterica serovar Typhi
cccaacugagcgcca

SEQ ID NO: 3639170 - RNA, 14 nt, Salmonella enterica enterica serovar Typhi
cccaagaacaugac

SEQ ID NO: 3639171 - RNA, 14 nt, Salmonella enterica enterica serovar Typhi
cccaauaaugaacg

SEQ ID NO: 3639172 - RNA, 23 nt, Salmonella enterica enterica serovar Typhi
cccaauaaugaacgagcaauaac

SEQ ID NO: 3639173 - RNA, 22 nt, Salmonella enterica enterica serovar Typhi
cccaauaccggcguaauugcgc

SEQ ID NO: 3639174 - RNA, 13 nt, Salmonella enterica enterica serovar Typhi
cccaaucagacgc

SEQ ID NO: 3639175 - RNA, 15 nt, Salmonella enterica enterica serovar Typhi
cccaaugcccccauc

SEQ ID NO: 3639176 - RNA, 13 nt, Salmonella enterica enterica serovar Typhi
cccaaugccgacg

SEQ ID NO: 3639177 - RNA, 15 nt, Salmonella enterica enterica serovar Typhi
cccaauugcugcuau

SEQ ID NO: 3639178 - RNA, 17 nt, Salmonella enterica enterica serovar Typhi
cccacaagaaaugcagg

SEQ ID NO: 3639179 - RNA, 18 nt, Salmonella enterica enterica serovar Typhi
cccacaaucccgccagac

SEQ ID NO: 3639180 - RNA, 14 nt, Salmonella enterica enterica serovar Typhi
cccacacaucacaa

SEQ ID NO: 3639181 - RNA, 22 nt, Salmonella enterica enterica serovar Typhi
cccacacaucacaaucuccaga

SEQ ID NO: 3639182 - RNA, 14 nt, Salmonella enterica enterica serovar Typhi
cccacaccacagcc

SEQ ID NO: 3639183 - RNA, 12 nt, Salmonella enterica enterica serovar Typhi
cccacaccauac

SEQ ID NO: 3639184 - RNA, 17 nt, Salmonella enterica enterica serovar Typhi
cccacacggccaccaua

SEQ ID NO: 3639185 - RNA, 12 nt, Salmonella enterica enterica serovar Typhi
cccacagguagg

SEQ ID NO: 3639186 - RNA, 13 nt, Salmonella enterica enterica serovar Typhi
cccaccaccgcca

SEQ ID NO: 3639187 - RNA, 15 nt, Salmonella enterica enterica serovar Typhi
cccaccaccgccacu

SEQ ID NO: 3639188 - RNA, 13 nt, Salmonella enterica enterica serovar Typhi
cccaccagcgcca

SEQ ID NO: 3639189 - RNA, 20 nt, Salmonella enterica enterica serovar Typhi
cccaccauaaagcgaauaau

SEQ ID NO: 3639190 - RNA, 13 nt, Salmonella enterica enterica serovar Typhi
cccaccgacacaa

SEQ ID NO: 3639191 - RNA, 17 nt, Salmonella enterica enterica serovar Typhi
cccaccgccaaccgccc

SEQ ID NO: 3639192 - RNA, 16 nt, Salmonella enterica enterica serovar Typhi
cccaccugacuguuca

SEQ ID NO: 3639193 - RNA, 17 nt, Salmonella enterica enterica serovar Typhi
cccacgauacgccccug

SEQ ID NO: 3639194 - RNA, 21 nt, Salmonella enterica enterica serovar Typhi
cccacgauacgccccugcugg

SEQ ID NO: 3639195 - RNA, 21 nt, Salmonella enterica enterica serovar Typhi
cccacgcaaaauggccugcug

SEQ ID NO: 3639196 - RNA, 22 nt, Salmonella enterica enterica serovar Typhi
cccacgcaaaauggccugcugg

SEQ ID NO: 3639197 - RNA, 18 nt, Salmonella enterica enterica serovar Typhi
cccacgcauaguccugcc

SEQ ID NO: 3639198 - RNA, 24 nt, Salmonella enterica enterica serovar Typhi
cccacgccagcagcucgccgaccg

SEQ ID NO: 3639199 - RNA, 14 nt, Salmonella enterica enterica serovar Typhi
cccacgcccgccau

SEQ ID NO: 3639200 - RNA, 15 nt, Salmonella enterica enterica serovar Typhi
cccacgcccgccauc

SEQ ID NO: 3639201 - RNA, 19 nt, Salmonella enterica enterica serovar Typhi
cccacggagaaaagcgaaa

SEQ ID NO: 3639202 - RNA, 21 nt, Salmonella enterica enterica serovar Typhi
cccacggagaaaagcgaaaau

SEQ ID NO: 3639203 - RNA, 19 nt, Salmonella enterica enterica serovar Typhi
cccacggaugaucuucaua

SEQ ID NO: 3639204 - RNA, 24 nt, Salmonella enterica enterica serovar Typhi
cccacgggaagaugugccacuccg

SEQ ID NO: 3639205 - RNA, 18 nt, Salmonella enterica enterica serovar Typhi
cccacgguacgacgcggc

SEQ ID NO: 3639206 - RNA, 13 nt, Salmonella enterica enterica serovar Typhi
cccacuaacugcc

SEQ ID NO: 3639207 - RNA, 12 nt, Salmonella enterica enterica serovar Typhi
cccacuauuuuu

SEQ ID NO: 3639208 - RNA, 20 nt, Salmonella enterica enterica serovar Typhi
cccacucaaucauugucauu

SEQ ID NO: 3639209 - RNA, 15 nt, Salmonella enterica enterica serovar Typhi
cccacugcacauccc

SEQ ID NO: 3639210 - RNA, 20 nt, Salmonella enterica enterica serovar Typhi
cccacuuguagcgagcgccg

SEQ ID NO: 3639211 - RNA, 17 nt, Salmonella enterica enterica serovar Typhi
cccacuuuacacgcgcu

SEQ ID NO: 3639212 - RNA, 16 nt, Salmonella enterica enterica serovar Typhi
cccacuuucaccuccg

SEQ ID NO: 3639213 - RNA, 16 nt, Salmonella enterica enterica serovar Typhi
cccacuuucagcuccg

SEQ ID NO: 3639214 - RNA, 18 nt, Salmonella enterica enterica serovar Typhi
cccacuuugcucaccacg

SEQ ID NO: 3639215 - RNA, 19 nt, Salmonella enterica enterica serovar Typhi
cccagaaaauuaacgacaa

SEQ ID NO: 3639216 - RNA, 13 nt, Salmonella enterica enterica serovar Typhi
cccagaaucaccc

SEQ ID NO: 3639217 - RNA, 18 nt, Salmonella enterica enterica serovar Typhi
cccagaaucccgccuugc

SEQ ID NO: 3639218 - RNA, 15 nt, Salmonella enterica enterica serovar Typhi
cccagaauccgcgca

SEQ ID NO: 3639219 - RNA, 16 nt, Salmonella enterica enterica serovar Typhi
cccagaauccgcgcau

SEQ ID NO: 3639220 - RNA, 16 nt, Salmonella enterica enterica serovar Typhi
cccagaaugccgccca

SEQ ID NO: 3639221 - RNA, 23 nt, Salmonella enterica enterica serovar Typhi
cccagaaugccgcccauccagag

SEQ ID NO: 3639222 - RNA, 14 nt, Salmonella enterica enterica serovar Typhi
cccagacagcaaaa

SEQ ID NO: 3639223 - RNA, 21 nt, Salmonella enterica enterica serovar Typhi
cccagacggcgauacugcucc

SEQ ID NO: 3639224 - RNA, 17 nt, Salmonella enterica enterica serovar Typhi
cccagacugugauggcg

SEQ ID NO: 3639225 - RNA, 20 nt, Salmonella enterica enterica serovar Typhi
cccagagucacuagcacuac

SEQ ID NO: 3639226 - RNA, 20 nt, Salmonella enterica enterica serovar Typhi
cccagauaauagcugaaaag

SEQ ID NO: 3639227 - RNA, 19 nt, Salmonella enterica enterica serovar Typhi
cccagauguugauacagaa

SEQ ID NO: 3639228 - RNA, 13 nt, Salmonella enterica enterica serovar Typhi
cccagauuacugc

SEQ ID NO: 3639229 - RNA, 20 nt, Salmonella enterica enterica serovar Typhi
cccagcaaugcacuacgaaa

SEQ ID NO: 3639230 - RNA, 13 nt, Salmonella enterica enterica serovar Typhi
cccagcagcagaa

SEQ ID NO: 3639231 - RNA, 16 nt, Salmonella enterica enterica serovar Typhi
cccagcaucccgcugg

SEQ ID NO: 3639232 - RNA, 21 nt, Salmonella enterica enterica serovar Typhi
cccagcaucccgcuggcgcca

SEQ ID NO: 3639233 - RNA, 22 nt, Salmonella enterica enterica serovar Typhi
cccagcaugggcauccccaugu

SEQ ID NO: 3639234 - RNA, 13 nt, Salmonella enterica enterica serovar Typhi
cccagcauuacug

SEQ ID NO: 3639235 - RNA, 14 nt, Salmonella enterica enterica serovar Typhi
cccagcccugugcc

SEQ ID NO: 3639236 - RNA, 17 nt, Salmonella enterica enterica serovar Typhi
cccagcccugugccgcu

SEQ ID NO: 3639237 - RNA, 21 nt, Salmonella enterica enterica serovar Typhi
cccagccuuccuggucugcca

SEQ ID NO: 3639238 - RNA, 22 nt, Salmonella enterica enterica serovar Typhi
cccagccuuccuggucugccag

SEQ ID NO: 3639239 - RNA, 14 nt, Salmonella enterica enterica serovar Typhi
cccagccuucuccc

SEQ ID NO: 3639240 - RNA, 18 nt, Salmonella enterica enterica serovar Typhi
cccagcgccagccgcgcc

SEQ ID NO: 3639241 - RNA, 19 nt, Salmonella enterica enterica serovar Typhi
cccagcgccagccgcgcca

SEQ ID NO: 3639242 - RNA, 16 nt, Salmonella enterica enterica serovar Typhi
cccagcgcccccagca

SEQ ID NO: 3639243 - RNA, 17 nt, Salmonella enterica enterica serovar Typhi
cccagcgcccccagcaa

SEQ ID NO: 3639244 - RNA, 22 nt, Salmonella enterica enterica serovar Typhi
cccagcgcgaauuugccccaga

SEQ ID NO: 3639245 - RNA, 12 nt, Salmonella enterica enterica serovar Typhi
cccagcgcgccg

SEQ ID NO: 3639246 - RNA, 20 nt, Salmonella enterica enterica serovar Typhi
cccagcgcgccgcagcgccg

SEQ ID NO: 3639247 - RNA, 14 nt, Salmonella enterica enterica serovar Typhi
cccagcgcggccca

SEQ ID NO: 3639248 - RNA, 19 nt, Salmonella enterica enterica serovar Typhi
cccagcgcggcccauucaa

SEQ ID NO: 3639249 - RNA, 22 nt, Salmonella enterica enterica serovar Typhi
cccagcgcuaacggcgguacca

SEQ ID NO: 3639250 - RNA, 23 nt, Salmonella enterica enterica serovar Typhi
cccagcggaugucggucaucagg

SEQ ID NO: 3639251 - RNA, 20 nt, Salmonella enterica enterica serovar Typhi
cccagcgggaacaucacgga

SEQ ID NO: 3639252 - RNA, 22 nt, Salmonella enterica enterica serovar Typhi
cccagcgggugaugcgccagcc

SEQ ID NO: 3639253 - RNA, 17 nt, Salmonella enterica enterica serovar Typhi
cccagcguaccacgccg

SEQ ID NO: 3639254 - RNA, 21 nt, Salmonella enterica enterica serovar Typhi
cccagcucaugauagggcagc

SEQ ID NO: 3639255 - RNA, 22 nt, Salmonella enterica enterica serovar Typhi
cccagcucaugauagggcagca

SEQ ID NO: 3639256 - RNA, 22 nt, Salmonella enterica enterica serovar Typhi
cccagcugagcuaaucacccac

SEQ ID NO: 3639257 - RNA, 18 nt, Salmonella enterica enterica serovar Typhi
cccaggccaugcgccgcg

SEQ ID NO: 3639258 - RNA, 15 nt, Salmonella enterica enterica serovar Typhi
cccaggccgccaccg

SEQ ID NO: 3639259 - RNA, 18 nt, Salmonella enterica enterica serovar Typhi
cccaggccgccaccgccu

SEQ ID NO: 3639260 - RNA, 22 nt, Salmonella enterica enterica serovar Typhi
cccaggccugaugagcgcagcg

SEQ ID NO: 3639261 - RNA, 23 nt, Salmonella enterica enterica serovar Typhi
cccaggcgcguuguccaacuguc

SEQ ID NO: 3639262 - RNA, 18 nt, Salmonella enterica enterica serovar Typhi
cccaggcgcuauucccag

SEQ ID NO: 3639263 - RNA, 13 nt, Salmonella enterica enterica serovar Typhi
cccaggguuuagc

SEQ ID NO: 3639264 - RNA, 20 nt, Salmonella enterica enterica serovar Typhi
cccaggguuuagccccagac

SEQ ID NO: 3639265 - RNA, 19 nt, Salmonella enterica enterica serovar Typhi
cccagguuauucaggugga

SEQ ID NO: 3639266 - RNA, 23 nt, Salmonella enterica enterica serovar Typhi
cccagguuguaucauguuccggc

SEQ ID NO: 3639267 - RNA, 20 nt, Salmonella enterica enterica serovar Typhi
cccagguuucaaugccgccg

SEQ ID NO: 3639268 - RNA, 22 nt, Salmonella enterica enterica serovar Typhi
cccagguuucaaugccgccgau

SEQ ID NO: 3639269 - RNA, 22 nt, Salmonella enterica enterica serovar Typhi
cccagguuuuggucagcucacg

SEQ ID NO: 3639270 - RNA, 19 nt, Salmonella enterica enterica serovar Typhi
cccaguaaauuaacgcgaa

SEQ ID NO: 3639271 - RNA, 18 nt, Salmonella enterica enterica serovar Typhi
cccaguaauccggcaacu

SEQ ID NO: 3639272 - RNA, 17 nt, Salmonella enterica enterica serovar Typhi
cccaguacaaacaaaua

SEQ ID NO: 3639273 - RNA, 14 nt, Salmonella enterica enterica serovar Typhi
cccaguaccagcac

SEQ ID NO: 3639274 - RNA, 17 nt, Salmonella enterica enterica serovar Typhi
cccaguagcagacagcc

SEQ ID NO: 3639275 - RNA, 18 nt, Salmonella enterica enterica serovar Typhi
cccaguagcagacagccg

SEQ ID NO: 3639276 - RNA, 18 nt, Salmonella enterica enterica serovar Typhi
cccaguauugcaccuggg

SEQ ID NO: 3639277 - RNA, 14 nt, Salmonella enterica enterica serovar Typhi
cccagucacggcuc

SEQ ID NO: 3639278 - RNA, 12 nt, Salmonella enterica enterica serovar Typhi
cccagucauccg

SEQ ID NO: 3639279 - RNA, 22 nt, Salmonella enterica enterica serovar Typhi
cccagucauucucuuucugcgc

SEQ ID NO: 3639280 - RNA, 19 nt, Salmonella enterica enterica serovar Typhi
cccaguccacguuuuacuu

SEQ ID NO: 3639281 - RNA, 21 nt, Salmonella enterica enterica serovar Typhi
cccaguccuuccggcgagaga

SEQ ID NO: 3639282 - RNA, 18 nt, Salmonella enterica enterica serovar Typhi
cccagucuuccugcggua

SEQ ID NO: 3639283 - RNA, 15 nt, Salmonella enterica enterica serovar Typhi
cccaguggcaaaauc

SEQ ID NO: 3639284 - RNA, 18 nt, Salmonella enterica enterica serovar Typhi
cccagugucaacugcgcc

SEQ ID NO: 3639285 - RNA, 13 nt, Salmonella enterica enterica serovar Typhi
cccauaaacaggu

SEQ ID NO: 3639286 - RNA, 14 nt, Salmonella enterica enterica serovar Typhi
cccauaaagauggc

SEQ ID NO: 3639287 - RNA, 19 nt, Salmonella enterica enterica serovar Typhi
cccauaaccgaugcacaug

SEQ ID NO: 3639288 - RNA, 11 nt, Salmonella enterica enterica serovar Typhi
cccauaaucac

SEQ ID NO: 3639289 - RNA, 13 nt, Salmonella enterica enterica serovar Typhi
cccauacguuuuu

SEQ ID NO: 3639290 - RNA, 22 nt, Salmonella enterica enterica serovar Typhi
cccauacugacggcgcucuuua

SEQ ID NO: 3639291 - RNA, 15 nt, Salmonella enterica enterica serovar Typhi
cccauacugcccagc

SEQ ID NO: 3639292 - RNA, 19 nt, Salmonella enterica enterica serovar Typhi
cccauauuccagaaaggau

SEQ ID NO: 3639293 - RNA, 20 nt, Salmonella enterica enterica serovar Typhi
cccauauugauggccacauc

SEQ ID NO: 3639294 - RNA, 20 nt, Salmonella enterica enterica serovar Typhi
cccauauuuuuucugccagu

SEQ ID NO: 3639295 - RNA, 22 nt, Salmonella enterica enterica serovar Typhi
cccaucaauaacgauaauuuua

SEQ ID NO: 3639296 - RNA, 13 nt, Salmonella enterica enterica serovar Typhi
cccaucaccugac

SEQ ID NO: 3639297 - RNA, 14 nt, Salmonella enterica enterica serovar Typhi
cccaucagcgccag

SEQ ID NO: 3639298 - RNA, 18 nt, Salmonella enterica enterica serovar Typhi
cccaucaguccccagcgu

SEQ ID NO: 3639299 - RNA, 21 nt, Salmonella enterica enterica serovar Typhi
cccaucauugacuucaacgca

SEQ ID NO: 3639300 - RNA, 11 nt, Salmonella enterica enterica serovar Typhi
cccaucccaga

SEQ ID NO: 3639301 - RNA, 16 nt, Salmonella enterica enterica serovar Typhi
cccauccgcccaccca

SEQ ID NO: 3639302 - RNA, 21 nt, Salmonella enterica enterica serovar Typhi
cccauccgggccacucuccag

SEQ ID NO: 3639303 - RNA, 17 nt, Salmonella enterica enterica serovar Typhi
cccaucuaaccgggccu

SEQ ID NO: 3639304 - RNA, 20 nt, Salmonella enterica enterica serovar Typhi
cccaucuaaccgggccugau

SEQ ID NO: 3639305 - RNA, 15 nt, Salmonella enterica enterica serovar Typhi
cccaucuccagcccg

SEQ ID NO: 3639306 - RNA, 18 nt, Salmonella enterica enterica serovar Typhi
cccaugaugggcaagcgu

SEQ ID NO: 3639307 - RNA, 21 nt, Salmonella enterica enterica serovar Typhi
cccaugaugggcaagcguagu

SEQ ID NO: 3639308 - RNA, 21 nt, Salmonella enterica enterica serovar Typhi
cccaugccgccugccgcgccg

SEQ ID NO: 3639309 - RNA, 20 nt, Salmonella enterica enterica serovar Typhi
cccaugcgggauggccgccg

SEQ ID NO: 3639310 - RNA, 21 nt, Salmonella enterica enterica serovar Typhi
cccaugcgggauggccgccga

SEQ ID NO: 3639311 - RNA, 17 nt, Salmonella enterica enterica serovar Typhi
cccauggaugcgccgcc

SEQ ID NO: 3639312 - RNA, 14 nt, Salmonella enterica enterica serovar Typhi
cccauuaaacuggc

SEQ ID NO: 3639313 - RNA, 17 nt, Salmonella enterica enterica serovar Typhi
cccauuaauaucagccc

SEQ ID NO: 3639314 - RNA, 17 nt, Salmonella enterica enterica serovar Typhi
cccauuaugugcgacgu

SEQ ID NO: 3639315 - RNA, 16 nt, Salmonella enterica enterica serovar Typhi
cccauuccgccugccg

SEQ ID NO: 3639316 - RNA, 18 nt, Salmonella enterica enterica serovar Typhi
cccauugaugccugccca

SEQ ID NO: 3639317 - RNA, 15 nt, Salmonella enterica enterica serovar Typhi
cccauugggccagca

SEQ ID NO: 3639318 - RNA, 15 nt, Salmonella enterica enterica serovar Typhi
cccauugucaucagu

SEQ ID NO: 3639319 - RNA, 23 nt, Salmonella enterica enterica serovar Typhi
cccauuguucuuucauuuuaccu

SEQ ID NO: 3639320 - RNA, 16 nt, Salmonella enterica enterica serovar Typhi
cccauuucaugaccga

SEQ ID NO: 3639321 - RNA, 12 nt, Salmonella enterica enterica serovar Typhi
ccccaaacacca

SEQ ID NO: 3639322 - RNA, 17 nt, Salmonella enterica enterica serovar Typhi
ccccaaacaccaacaaa

SEQ ID NO: 3639323 - RNA, 15 nt, Salmonella enterica enterica serovar Typhi
ccccaaacgcucaua

SEQ ID NO: 3639324 - RNA, 13 nt, Salmonella enterica enterica serovar Typhi
ccccaaccgccag

SEQ ID NO: 3639325 - RNA, 22 nt, Salmonella enterica enterica serovar Typhi
ccccaacgcgcuaucguugcgc

SEQ ID NO: 3639326 - RNA, 17 nt, Salmonella enterica enterica serovar Typhi
ccccaaucuugcguacc

SEQ ID NO: 3639327 - RNA, 16 nt, Salmonella enterica enterica serovar Typhi
ccccaaugauccacag

SEQ ID NO: 3639328 - RNA, 17 nt, Salmonella enterica enterica serovar Typhi
ccccaauugcugcuauu

SEQ ID NO: 3639329 - RNA, 16 nt, Salmonella enterica enterica serovar Typhi
ccccaccgacacaaau

SEQ ID NO: 3639330 - RNA, 21 nt, Salmonella enterica enterica serovar Typhi
ccccacgcugacgcgaucgcc

SEQ ID NO: 3639331 - RNA, 12 nt, Salmonella enterica enterica serovar Typhi
ccccagaaaauu

SEQ ID NO: 3639332 - RNA, 20 nt, Salmonella enterica enterica serovar Typhi
ccccagaccgauauuuugcu

SEQ ID NO: 3639333 - RNA, 22 nt, Salmonella enterica enterica serovar Typhi
ccccagacgcccuucaauauca

SEQ ID NO: 3639334 - RNA, 20 nt, Salmonella enterica enterica serovar Typhi
ccccagaugccguagccaag

SEQ ID NO: 3639335 - RNA, 12 nt, Salmonella enterica enterica serovar Typhi
ccccagcaccga

SEQ ID NO: 3639336 - RNA, 14 nt, Salmonella enterica enterica serovar Typhi
ccccagcaccgaaa

SEQ ID NO: 3639337 - RNA, 12 nt, Salmonella enterica enterica serovar Typhi
ccccagccagag

SEQ ID NO: 3639338 - RNA, 15 nt, Salmonella enterica enterica serovar Typhi
ccccagcgccagccg

SEQ ID NO: 3639339 - RNA, 21 nt, Salmonella enterica enterica serovar Typhi
ccccagggagacggccaccca

SEQ ID NO: 3639340 - RNA, 17 nt, Salmonella enterica enterica serovar Typhi
ccccaguaauccggcaa

SEQ ID NO: 3639341 - RNA, 13 nt, Salmonella enterica enterica serovar Typhi
ccccagucuuccu

SEQ ID NO: 3639342 - RNA, 17 nt, Salmonella enterica enterica serovar Typhi
ccccaguugguuguagc

SEQ ID NO: 3639343 - RNA, 21 nt, Salmonella enterica enterica serovar Typhi
ccccauauugauggccacauc

SEQ ID NO: 3639344 - RNA, 13 nt, Salmonella enterica enterica serovar Typhi
ccccaucccagac

SEQ ID NO: 3639345 - RNA, 14 nt, Salmonella enterica enterica serovar Typhi
ccccaucccggcaa

SEQ ID NO: 3639346 - RNA, 15 nt, Salmonella enterica enterica serovar Typhi
ccccaugacggccug

SEQ ID NO: 3639347 - RNA, 14 nt, Salmonella enterica enterica serovar Typhi
ccccaugugccuug

SEQ ID NO: 3639348 - RNA, 15 nt, Salmonella enterica enterica serovar Typhi
ccccaugugccuugc

SEQ ID NO: 3639349 - RNA, 15 nt, Salmonella enterica enterica serovar Typhi
ccccauucgcguuca

SEQ ID NO: 3639350 - RNA, 20 nt, Salmonella enterica enterica serovar Typhi
cccccagauagaaccacgca

SEQ ID NO: 3639351 - RNA, 11 nt, Salmonella enterica enterica serovar Typhi
cccccagcacg

SEQ ID NO: 3639352 - RNA, 17 nt, Salmonella enterica enterica serovar Typhi
cccccauggccccaugu

SEQ ID NO: 3639353 - RNA, 19 nt, Salmonella enterica enterica serovar Typhi
ccccccgcacagcacauag

SEQ ID NO: 3639354 - RNA, 13 nt, Salmonella enterica enterica serovar Typhi
ccccccuaccgga

SEQ ID NO: 3639355 - RNA, 19 nt, Salmonella enterica enterica serovar Typhi
ccccgaaagucaucugcca

SEQ ID NO: 3639356 - RNA, 22 nt, Salmonella enterica enterica serovar Typhi
ccccgacaaaaccguucugagc

SEQ ID NO: 3639357 - RNA, 17 nt, Salmonella enterica enterica serovar Typhi
ccccgacauucccaguc

SEQ ID NO: 3639358 - RNA, 17 nt, Salmonella enterica enterica serovar Typhi
ccccgacggccucuuca

SEQ ID NO: 3639359 - RNA, 18 nt, Salmonella enterica enterica serovar Typhi
ccccgacugcugcgcuuu

SEQ ID NO: 3639360 - RNA, 19 nt, Salmonella enterica enterica serovar Typhi
ccccgaguaacaccgcggc

SEQ ID NO: 3639361 - RNA, 15 nt, Salmonella enterica enterica serovar Typhi
ccccgaugucgccac

SEQ ID NO: 3639362 - RNA, 20 nt, Salmonella enterica enterica serovar Typhi
ccccgaugucgccacgccgc

SEQ ID NO: 3639363 - RNA, 22 nt, Salmonella enterica enterica serovar Typhi
ccccgaugucgccacgccgccc

SEQ ID NO: 3639364 - RNA, 15 nt, Salmonella enterica enterica serovar Typhi
ccccgcaacggcgcu

SEQ ID NO: 3639365 - RNA, 16 nt, Salmonella enterica enterica serovar Typhi
ccccgcaauugcgcgg

SEQ ID NO: 3639366 - RNA, 20 nt, Salmonella enterica enterica serovar Typhi
ccccgccauaaugcacaaua

SEQ ID NO: 3639367 - RNA, 11 nt, Salmonella enterica enterica serovar Typhi
ccccgccgcca

SEQ ID NO: 3639368 - RNA, 13 nt, Salmonella enterica enterica serovar Typhi
ccccgccgccagu

SEQ ID NO: 3639369 - RNA, 20 nt, Salmonella enterica enterica serovar Typhi
ccccgcuuucagcguugcag

SEQ ID NO: 3639370 - RNA, 11 nt, Salmonella enterica enterica serovar Typhi
ccccggccucg

SEQ ID NO: 3639371 - RNA, 20 nt, Salmonella enterica enterica serovar Typhi
ccccggcgagugccugcugg

SEQ ID NO: 3639372 - RNA, 23 nt, Salmonella enterica enterica serovar Typhi
ccccggcgggguuuuuuuaugcg

SEQ ID NO: 3639373 - RNA, 17 nt, Salmonella enterica enterica serovar Typhi
ccccggcuuuauuacuu

SEQ ID NO: 3639374 - RNA, 17 nt, Salmonella enterica enterica serovar Typhi
ccccgguagccacaccc

SEQ ID NO: 3639375 - RNA, 18 nt, Salmonella enterica enterica serovar Typhi
ccccggucaacgcgccgc

SEQ ID NO: 3639376 - RNA, 16 nt, Salmonella enterica enterica serovar Typhi
ccccggugagcgccgc

SEQ ID NO: 3639377 - RNA, 20 nt, Salmonella enterica enterica serovar Typhi
ccccggugcuuucuccugcg

SEQ ID NO: 3639378 - RNA, 12 nt, Salmonella enterica enterica serovar Typhi
ccccgucagucg

SEQ ID NO: 3639379 - RNA, 14 nt, Salmonella enterica enterica serovar Typhi
ccccgucauauuac

SEQ ID NO: 3639380 - RNA, 14 nt, Salmonella enterica enterica serovar Typhi
ccccguucgacaac

SEQ ID NO: 3639381 - RNA, 18 nt, Salmonella enterica enterica serovar Typhi
ccccguugcucauguuau

SEQ ID NO: 3639382 - RNA, 14 nt, Salmonella enterica enterica serovar Typhi
ccccuaucuggugc

SEQ ID NO: 3639383 - RNA, 23 nt, Salmonella enterica enterica serovar Typhi
ccccucaaacaggcugucugcca

SEQ ID NO: 3639384 - RNA, 13 nt, Salmonella enterica enterica serovar Typhi
ccccuccggccag

SEQ ID NO: 3639385 - RNA, 19 nt, Salmonella enterica enterica serovar Typhi
ccccucuuccaucagccag

SEQ ID NO: 3639386 - RNA, 17 nt, Salmonella enterica enterica serovar Typhi
ccccugacgcgcgcagu

SEQ ID NO: 3639387 - RNA, 20 nt, Salmonella enterica enterica serovar Typhi
ccccugaugcguauccagcg

SEQ ID NO: 3639388 - RNA, 21 nt, Salmonella enterica enterica serovar Typhi
ccccugaugcguauccagcgc

SEQ ID NO: 3639389 - RNA, 19 nt, Salmonella enterica enterica serovar Typhi
ccccugcgcggccugcgcc

SEQ ID NO: 3639390 - RNA, 22 nt, Salmonella enterica enterica serovar Typhi
ccccugcgguuucuaccaccca

SEQ ID NO: 3639391 - RNA, 23 nt, Salmonella enterica enterica serovar Typhi
ccccugcgguuucuaccacccag

SEQ ID NO: 3639392 - RNA, 15 nt, Salmonella enterica enterica serovar Typhi
ccccugcuccugcca

SEQ ID NO: 3639393 - RNA, 21 nt, Salmonella enterica enterica serovar Typhi
ccccuggacgcgagccacagg

SEQ ID NO: 3639394 - RNA, 20 nt, Salmonella enterica enterica serovar Typhi
ccccuguuccagggcuucca

SEQ ID NO: 3639395 - RNA, 18 nt, Salmonella enterica enterica serovar Typhi
ccccuuucgcaaucaugc

SEQ ID NO: 3639396 - RNA, 12 nt, Salmonella enterica enterica serovar Typhi
ccccuuuuucaa

SEQ ID NO: 3639397 - RNA, 21 nt, Salmonella enterica enterica serovar Typhi
cccgaaaagcguaacgccccc

SEQ ID NO: 3639398 - RNA, 12 nt, Salmonella enterica enterica serovar Typhi
cccgaaccugcg

SEQ ID NO: 3639399 - RNA, 13 nt, Salmonella enterica enterica serovar Typhi
cccgaaguggugg

SEQ ID NO: 3639400 - RNA, 20 nt, Salmonella enterica enterica serovar Typhi
cccgacacggcucgccuuug

SEQ ID NO: 3639401 - RNA, 22 nt, Salmonella enterica enterica serovar Typhi
cccgacaggguuugccagcacc

SEQ ID NO: 3639402 - RNA, 13 nt, Salmonella enterica enterica serovar Typhi
cccgaccacgccc

SEQ ID NO: 3639403 - RNA, 14 nt, Salmonella enterica enterica serovar Typhi
cccgacgcgccacu

SEQ ID NO: 3639404 - RNA, 15 nt, Salmonella enterica enterica serovar Typhi
cccgacucugacgcc

SEQ ID NO: 3639405 - RNA, 19 nt, Salmonella enterica enterica serovar Typhi
cccgacucugacgccggua

SEQ ID NO: 3639406 - RNA, 23 nt, Salmonella enterica enterica serovar Typhi
cccgagcgacgcccugcccauga

SEQ ID NO: 3639407 - RNA, 16 nt, Salmonella enterica enterica serovar Typhi
cccgaguuuuaacacu

SEQ ID NO: 3639408 - RNA, 14 nt, Salmonella enterica enterica serovar Typhi
cccgauaagcaagc

SEQ ID NO: 3639409 - RNA, 14 nt, Salmonella enterica enterica serovar Typhi
cccgauacccgccc

SEQ ID NO: 3639410 - RNA, 13 nt, Salmonella enterica enterica serovar Typhi
cccgauacccuga

SEQ ID NO: 3639411 - RNA, 15 nt, Salmonella enterica enterica serovar Typhi
cccgauaccgccagc

SEQ ID NO: 3639412 - RNA, 16 nt, Salmonella enterica enterica serovar Typhi
cccgaucaucuccugu

SEQ ID NO: 3639413 - RNA, 18 nt, Salmonella enterica enterica serovar Typhi
cccgaucuucaucguuac

SEQ ID NO: 3639414 - RNA, 13 nt, Salmonella enterica enterica serovar Typhi
cccgauucugcca

SEQ ID NO: 3639415 - RNA, 14 nt, Salmonella enterica enterica serovar Typhi
cccgauucugccag

SEQ ID NO: 3639416 - RNA, 18 nt, Salmonella enterica enterica serovar Typhi
cccgauucugccaguuca

SEQ ID NO: 3639417 - RNA, 21 nt, Salmonella enterica enterica serovar Typhi
cccgcaaacuaauggcgcagc

SEQ ID NO: 3639418 - RNA, 21 nt, Salmonella enterica enterica serovar Typhi
cccgcaauguuuggauuucgu

SEQ ID NO: 3639419 - RNA, 14 nt, Salmonella enterica enterica serovar Typhi
cccgcacagcacau

SEQ ID NO: 3639420 - RNA, 19 nt, Salmonella enterica enterica serovar Typhi
cccgcacgcgacgcgccag

SEQ ID NO: 3639421 - RNA, 13 nt, Salmonella enterica enterica serovar Typhi
cccgcagccacuc

SEQ ID NO: 3639422 - RNA, 15 nt, Salmonella enterica enterica serovar Typhi
cccgcagccacuccc

SEQ ID NO: 3639423 - RNA, 17 nt, Salmonella enterica enterica serovar Typhi
cccgcaggccuggcugg

SEQ ID NO: 3639424 - RNA, 18 nt, Salmonella enterica enterica serovar Typhi
cccgcauucgcggcaagc

SEQ ID NO: 3639425 - RNA, 17 nt, Salmonella enterica enterica serovar Typhi
cccgcauuuaacaggac

SEQ ID NO: 3639426 - RNA, 14 nt, Salmonella enterica enterica serovar Typhi
cccgccaccgccgc

SEQ ID NO: 3639427 - RNA, 13 nt, Salmonella enterica enterica serovar Typhi
cccgccagaugca

SEQ ID NO: 3639428 - RNA, 12 nt, Salmonella enterica enterica serovar Typhi
cccgccagcacc

SEQ ID NO: 3639429 - RNA, 13 nt, Salmonella enterica enterica serovar Typhi
cccgccagcacca

SEQ ID NO: 3639430 - RNA, 16 nt, Salmonella enterica enterica serovar Typhi
cccgccagcugcgcgc

SEQ ID NO: 3639431 - RNA, 14 nt, Salmonella enterica enterica serovar Typhi
cccgcccacaggcu

SEQ ID NO: 3639432 - RNA, 23 nt, Salmonella enterica enterica serovar Typhi
cccgcccacaggcugcggcacgc

SEQ ID NO: 3639433 - RNA, 15 nt, Salmonella enterica enterica serovar Typhi
cccgcccagcauuac

SEQ ID NO: 3639434 - RNA, 12 nt, Salmonella enterica enterica serovar Typhi
cccgcccugccc

SEQ ID NO: 3639435 - RNA, 15 nt, Salmonella enterica enterica serovar Typhi
cccgcccugcccgcc

SEQ ID NO: 3639436 - RNA, 19 nt, Salmonella enterica enterica serovar Typhi
cccgccgcacacgccgugc

SEQ ID NO: 3639437 - RNA, 21 nt, Salmonella enterica enterica serovar Typhi
cccgccgcacacgccgugcac

SEQ ID NO: 3639438 - RNA, 12 nt, Salmonella enterica enterica serovar Typhi
cccgccgccauu

SEQ ID NO: 3639439 - RNA, 13 nt, Salmonella enterica enterica serovar Typhi
cccgccgccugau

SEQ ID NO: 3639440 - RNA, 16 nt, Salmonella enterica enterica serovar Typhi
cccgccgcgcggcccc

SEQ ID NO: 3639441 - RNA, 22 nt, Salmonella enterica enterica serovar Typhi
cccgccgcggcgguuauccucc

SEQ ID NO: 3639442 - RNA, 19 nt, Salmonella enterica enterica serovar Typhi
cccgccgcugaggauggcg

SEQ ID NO: 3639443 - RNA, 15 nt, Salmonella enterica enterica serovar Typhi
cccgccgcuggcggg

SEQ ID NO: 3639444 - RNA, 20 nt, Salmonella enterica enterica serovar Typhi
cccgccgggcgucacccgcc

SEQ ID NO: 3639445 - RNA, 22 nt, Salmonella enterica enterica serovar Typhi
cccgccgggcgucacccgccgg

SEQ ID NO: 3639446 - RNA, 13 nt, Salmonella enterica enterica serovar Typhi
cccgccugagcgc

SEQ ID NO: 3639447 - RNA, 16 nt, Salmonella enterica enterica serovar Typhi
cccgccugagcgcgca

SEQ ID NO: 3639448 - RNA, 14 nt, Salmonella enterica enterica serovar Typhi
cccgccugcugcaa

SEQ ID NO: 3639449 - RNA, 15 nt, Salmonella enterica enterica serovar Typhi
cccgccuugcggcgc

SEQ ID NO: 3639450 - RNA, 21 nt, Salmonella enterica enterica serovar Typhi
cccgccuugcggcgccaggac

SEQ ID NO: 3639451 - RNA, 18 nt, Salmonella enterica enterica serovar Typhi
cccgcgauaaaaauccug

SEQ ID NO: 3639452 - RNA, 17 nt, Salmonella enterica enterica serovar Typhi
cccgcgcagaaucacuu

SEQ ID NO: 3639453 - RNA, 15 nt, Salmonella enterica enterica serovar Typhi
cccgcgcagcgccag

SEQ ID NO: 3639454 - RNA, 12 nt, Salmonella enterica enterica serovar Typhi
cccgcgccagca

SEQ ID NO: 3639455 - RNA, 13 nt, Salmonella enterica enterica serovar Typhi
cccgcgcucuccg

SEQ ID NO: 3639456 - RNA, 14 nt, Salmonella enterica enterica serovar Typhi
cccgcgcucuccgg

SEQ ID NO: 3639457 - RNA, 16 nt, Salmonella enterica enterica serovar Typhi
cccgcgcuuuccagcc

SEQ ID NO: 3639458 - RNA, 15 nt, Salmonella enterica enterica serovar Typhi
cccgcggcauggucu

SEQ ID NO: 3639459 - RNA, 17 nt, Salmonella enterica enterica serovar Typhi
cccgcguuaagccccuc

SEQ ID NO: 3639460 - RNA, 15 nt, Salmonella enterica enterica serovar Typhi
cccgcuaucaccgcc

SEQ ID NO: 3639461 - RNA, 16 nt, Salmonella enterica enterica serovar Typhi
cccgcuaucaccgccc

SEQ ID NO: 3639462 - RNA, 14 nt, Salmonella enterica enterica serovar Typhi
cccgcuaugaagac

SEQ ID NO: 3639463 - RNA, 23 nt, Salmonella enterica enterica serovar Typhi
cccgcuccagaagcacuucucca

SEQ ID NO: 3639464 - RNA, 23 nt, Salmonella enterica enterica serovar Typhi
cccgcucuucaguaaccagggag

SEQ ID NO: 3639465 - RNA, 13 nt, Salmonella enterica enterica serovar Typhi
cccgcugacgaug

SEQ ID NO: 3639466 - RNA, 16 nt, Salmonella enterica enterica serovar Typhi
cccgcugcgccguucc

SEQ ID NO: 3639467 - RNA, 16 nt, Salmonella enterica enterica serovar Typhi
cccgcuggcgccaccg

SEQ ID NO: 3639468 - RNA, 20 nt, Salmonella enterica enterica serovar Typhi
cccgcuggcuggcguugagc

SEQ ID NO: 3639469 - RNA, 21 nt, Salmonella enterica enterica serovar Typhi
cccggaaauaaacgccagugg

SEQ ID NO: 3639470 - RNA, 22 nt, Salmonella enterica enterica serovar Typhi
cccggaaauggguaucuucauc

SEQ ID NO: 3639471 - RNA, 19 nt, Salmonella enterica enterica serovar Typhi
cccggaacaaaagaaagca

SEQ ID NO: 3639472 - RNA, 20 nt, Salmonella enterica enterica serovar Typhi
cccggaacaaaagaaagcaa

SEQ ID NO: 3639473 - RNA, 16 nt, Salmonella enterica enterica serovar Typhi
cccggacaaggcgcgc

SEQ ID NO: 3639474 - RNA, 17 nt, Salmonella enterica enterica serovar Typhi
cccggacaucauccccg

SEQ ID NO: 3639475 - RNA, 22 nt, Salmonella enterica enterica serovar Typhi
cccggacaucauccccggcagg

SEQ ID NO: 3639476 - RNA, 21 nt, Salmonella enterica enterica serovar Typhi
cccggacgaacaacaucagac

SEQ ID NO: 3639477 - RNA, 21 nt, Salmonella enterica enterica serovar Typhi
cccggacgaaccuggcgguaa

SEQ ID NO: 3639478 - RNA, 20 nt, Salmonella enterica enterica serovar Typhi
cccggacguaccgcuuuauc

SEQ ID NO: 3639479 - RNA, 16 nt, Salmonella enterica enterica serovar Typhi
cccggagagagcaacu

SEQ ID NO: 3639480 - RNA, 20 nt, Salmonella enterica enterica serovar Typhi
cccggaucgcuaauuuuuaa

SEQ ID NO: 3639481 - RNA, 19 nt, Salmonella enterica enterica serovar Typhi
cccggaucggucuggcgca

SEQ ID NO: 3639482 - RNA, 18 nt, Salmonella enterica enterica serovar Typhi
cccggaugauuaucaucu

SEQ ID NO: 3639483 - RNA, 15 nt, Salmonella enterica enterica serovar Typhi
cccggcaacugcgcc

SEQ ID NO: 3639484 - RNA, 19 nt, Salmonella enterica enterica serovar Typhi
cccggcaauuaccgccagc

SEQ ID NO: 3639485 - RNA, 22 nt, Salmonella enterica enterica serovar Typhi
cccggcagcuuuaaucuaccag

SEQ ID NO: 3639486 - RNA, 13 nt, Salmonella enterica enterica serovar Typhi
cccggcaggcugg

SEQ ID NO: 3639487 - RNA, 22 nt, Salmonella enterica enterica serovar Typhi
cccggcauuucugucugacgac

SEQ ID NO: 3639488 - RNA, 12 nt, Salmonella enterica enterica serovar Typhi
cccggcccgccg

SEQ ID NO: 3639489 - RNA, 14 nt, Salmonella enterica enterica serovar Typhi
cccggccugacgca

SEQ ID NO: 3639490 - RNA, 22 nt, Salmonella enterica enterica serovar Typhi
cccggccuucgaacagcucauu

SEQ ID NO: 3639491 - RNA, 16 nt, Salmonella enterica enterica serovar Typhi
cccggcgccagcucaa

SEQ ID NO: 3639492 - RNA, 15 nt, Salmonella enterica enterica serovar Typhi
cccggcgcgacgccg

SEQ ID NO: 3639493 - RNA, 12 nt, Salmonella enterica enterica serovar Typhi
cccggcgcgcca

SEQ ID NO: 3639494 - RNA, 22 nt, Salmonella enterica enterica serovar Typhi
cccggcggaagcgaauggcggc

SEQ ID NO: 3639495 - RNA, 15 nt, Salmonella enterica enterica serovar Typhi
cccggcguagcgcgc

SEQ ID NO: 3639496 - RNA, 18 nt, Salmonella enterica enterica serovar Typhi
cccggcguagcgcguuca

SEQ ID NO: 3639497 - RNA, 19 nt, Salmonella enterica enterica serovar Typhi
cccggcgucauacugccaa

SEQ ID NO: 3639498 - RNA, 11 nt, Salmonella enterica enterica serovar Typhi
cccggcuaaac

SEQ ID NO: 3639499 - RNA, 17 nt, Salmonella enterica enterica serovar Typhi
cccggcucauuaccgac

SEQ ID NO: 3639500 - RNA, 14 nt, Salmonella enterica enterica serovar Typhi
cccgggugcgcagc

SEQ ID NO: 3639501 - RNA, 19 nt, Salmonella enterica enterica serovar Typhi
cccgguaagcgcagcgcca

SEQ ID NO: 3639502 - RNA, 16 nt, Salmonella enterica enterica serovar Typhi
cccgguagcauccgcg

SEQ ID NO: 3639503 - RNA, 16 nt, Salmonella enterica enterica serovar Typhi
cccggucaacgcgccg

SEQ ID NO: 3639504 - RNA, 16 nt, Salmonella enterica enterica serovar Typhi
cccggucauccagcgg

SEQ ID NO: 3639505 - RNA, 14 nt, Salmonella enterica enterica serovar Typhi
cccggucgcgccag

SEQ ID NO: 3639506 - RNA, 17 nt, Salmonella enterica enterica serovar Typhi
cccggucugucgguaaa

SEQ ID NO: 3639507 - RNA, 17 nt, Salmonella enterica enterica serovar Typhi
cccggugagcgccgcgc

SEQ ID NO: 3639508 - RNA, 17 nt, Salmonella enterica enterica serovar Typhi
cccgguggcgcugcgcu

SEQ ID NO: 3639509 - RNA, 12 nt, Salmonella enterica enterica serovar Typhi
cccgguggcggc

SEQ ID NO: 3639510 - RNA, 19 nt, Salmonella enterica enterica serovar Typhi
cccggugucaaagcgccag

SEQ ID NO: 3639511 - RNA, 22 nt, Salmonella enterica enterica serovar Typhi
cccgguucgccgcuucaaaaac

SEQ ID NO: 3639512 - RNA, 13 nt, Salmonella enterica enterica serovar Typhi
cccgguuuaccau

SEQ ID NO: 3639513 - RNA, 18 nt, Salmonella enterica enterica serovar Typhi
cccguaaugcccaggcgg

SEQ ID NO: 3639514 - RNA, 15 nt, Salmonella enterica enterica serovar Typhi
cccguacaaggucgg

SEQ ID NO: 3639515 - RNA, 16 nt, Salmonella enterica enterica serovar Typhi
cccguaucacugauau

SEQ ID NO: 3639516 - RNA, 16 nt, Salmonella enterica enterica serovar Typhi
cccguauucaggcgau

SEQ ID NO: 3639517 - RNA, 16 nt, Salmonella enterica enterica serovar Typhi
cccgucagucgccaga

SEQ ID NO: 3639518 - RNA, 23 nt, Salmonella enterica enterica serovar Typhi
cccgucaugcuucaccucagcaa

SEQ ID NO: 3639519 - RNA, 15 nt, Salmonella enterica enterica serovar Typhi
cccgucccaccacgc

SEQ ID NO: 3639520 - RNA, 15 nt, Salmonella enterica enterica serovar Typhi
cccgugagcuacagc

SEQ ID NO: 3639521 - RNA, 22 nt, Salmonella enterica enterica serovar Typhi
cccguggugggguucccgagcg

SEQ ID NO: 3639522 - RNA, 15 nt, Salmonella enterica enterica serovar Typhi
cccgugguuuuacug

SEQ ID NO: 3639523 - RNA, 22 nt, Salmonella enterica enterica serovar Typhi
cccguuaaauaccagcaccuga

SEQ ID NO: 3639524 - RNA, 21 nt, Salmonella enterica enterica serovar Typhi
cccguuccaggcgaucucguu

SEQ ID NO: 3639525 - RNA, 18 nt, Salmonella enterica enterica serovar Typhi
cccguuccucguccugau

SEQ ID NO: 3639526 - RNA, 15 nt, Salmonella enterica enterica serovar Typhi
cccguugucuucacc

SEQ ID NO: 3639527 - RNA, 21 nt, Salmonella enterica enterica serovar Typhi
cccguuucagccccuugcuga

SEQ ID NO: 3639528 - RNA, 15 nt, Salmonella enterica enterica serovar Typhi
cccguuuuuuccagc

SEQ ID NO: 3639529 - RNA, 20 nt, Salmonella enterica enterica serovar Typhi
cccuaaaaauagcaccaggc

SEQ ID NO: 3639530 - RNA, 19 nt, Salmonella enterica enterica serovar Typhi
cccuaaggcagcaagguac

SEQ ID NO: 3639531 - RNA, 16 nt, Salmonella enterica enterica serovar Typhi
cccuaaggucacgccg

SEQ ID NO: 3639532 - RNA, 17 nt, Salmonella enterica enterica serovar Typhi
cccuacgcuucucucca

SEQ ID NO: 3639533 - RNA, 15 nt, Salmonella enterica enterica serovar Typhi
cccuacugcuuagcu

SEQ ID NO: 3639534 - RNA, 11 nt, Salmonella enterica enterica serovar Typhi
cccuauccgcg

SEQ ID NO: 3639535 - RNA, 15 nt, Salmonella enterica enterica serovar Typhi
cccuauuagcacgcc

SEQ ID NO: 3639536 - RNA, 17 nt, Salmonella enterica enterica serovar Typhi
cccuccaguagcagcga

SEQ ID NO: 3639537 - RNA, 22 nt, Salmonella enterica enterica serovar Typhi
cccuccgcggauuguuuuacuu

SEQ ID NO: 3639538 - RNA, 13 nt, Salmonella enterica enterica serovar Typhi
cccuccggccagc

SEQ ID NO: 3639539 - RNA, 19 nt, Salmonella enterica enterica serovar Typhi
cccuccugcuccaugcugu

SEQ ID NO: 3639540 - RNA, 17 nt, Salmonella enterica enterica serovar Typhi
cccucgacaggaguaua

SEQ ID NO: 3639541 - RNA, 21 nt, Salmonella enterica enterica serovar Typhi
cccucgcaccacgacucaaug

SEQ ID NO: 3639542 - RNA, 12 nt, Salmonella enterica enterica serovar Typhi
cccucgccagca

SEQ ID NO: 3639543 - RNA, 19 nt, Salmonella enterica enterica serovar Typhi
cccucugagcugguguaau

SEQ ID NO: 3639544 - RNA, 16 nt, Salmonella enterica enterica serovar Typhi
cccucugauuggcugu

SEQ ID NO: 3639545 - RNA, 14 nt, Salmonella enterica enterica serovar Typhi
cccucuuccaucag

SEQ ID NO: 3639546 - RNA, 11 nt, Salmonella enterica enterica serovar Typhi
cccugaaacug

SEQ ID NO: 3639547 - RNA, 23 nt, Salmonella enterica enterica serovar Typhi
cccugaaauaacagacuccgucu

SEQ ID NO: 3639548 - RNA, 14 nt, Salmonella enterica enterica serovar Typhi
cccugaauauuaga

SEQ ID NO: 3639549 - RNA, 19 nt, Salmonella enterica enterica serovar Typhi
cccugacaauacugcacgc

SEQ ID NO: 3639550 - RNA, 14 nt, Salmonella enterica enterica serovar Typhi
cccugacgccgcug

SEQ ID NO: 3639551 - RNA, 13 nt, Salmonella enterica enterica serovar Typhi
cccugagcccaca

SEQ ID NO: 3639552 - RNA, 17 nt, Salmonella enterica enterica serovar Typhi
cccugagcccacagcgg

SEQ ID NO: 3639553 - RNA, 19 nt, Salmonella enterica enterica serovar Typhi
cccugagcgcuacgccugu

SEQ ID NO: 3639554 - RNA, 23 nt, Salmonella enterica enterica serovar Typhi
cccugauauacaaaacccauauc

SEQ ID NO: 3639555 - RNA, 19 nt, Salmonella enterica enterica serovar Typhi
cccugaugcguauccagcg

SEQ ID NO: 3639556 - RNA, 22 nt, Salmonella enterica enterica serovar Typhi
cccugaugcguauccagcgcgg

SEQ ID NO: 3639557 - RNA, 14 nt, Salmonella enterica enterica serovar Typhi
cccugauggcgcgc

SEQ ID NO: 3639558 - RNA, 13 nt, Salmonella enterica enterica serovar Typhi
cccugauguagcu

SEQ ID NO: 3639559 - RNA, 21 nt, Salmonella enterica enterica serovar Typhi
cccugcaaacuauguacgcca

SEQ ID NO: 3639560 - RNA, 17 nt, Salmonella enterica enterica serovar Typhi
cccugcauuauccacga

SEQ ID NO: 3639561 - RNA, 17 nt, Salmonella enterica enterica serovar Typhi
cccugccacaaccgccc

SEQ ID NO: 3639562 - RNA, 12 nt, Salmonella enterica enterica serovar Typhi
cccugccacagu

SEQ ID NO: 3639563 - RNA, 20 nt, Salmonella enterica enterica serovar Typhi
cccugccagcguaagcgccc

SEQ ID NO: 3639564 - RNA, 18 nt, Salmonella enterica enterica serovar Typhi
cccugccauucccagccg

SEQ ID NO: 3639565 - RNA, 13 nt, Salmonella enterica enterica serovar Typhi
cccugcccgccag

SEQ ID NO: 3639566 - RNA, 24 nt, Salmonella enterica enterica serovar Typhi
cccugccggaaaaugcgccaggaa

SEQ ID NO: 3639567 - RNA, 22 nt, Salmonella enterica enterica serovar Typhi
cccugccguuugcgccagcccg

SEQ ID NO: 3639568 - RNA, 16 nt, Salmonella enterica enterica serovar Typhi
cccugcgccagacgcg

SEQ ID NO: 3639569 - RNA, 19 nt, Salmonella enterica enterica serovar Typhi
cccugcgccagcauggcgu

SEQ ID NO: 3639570 - RNA, 19 nt, Salmonella enterica enterica serovar Typhi
cccugcgccucaagcgcuu

SEQ ID NO: 3639571 - RNA, 13 nt, Salmonella enterica enterica serovar Typhi
cccugcgcggccu

SEQ ID NO: 3639572 - RNA, 15 nt, Salmonella enterica enterica serovar Typhi
cccugcgcggccugc

SEQ ID NO: 3639573 - RNA, 21 nt, Salmonella enterica enterica serovar Typhi
cccugcgcuucuauccacugg

SEQ ID NO: 3639574 - RNA, 18 nt, Salmonella enterica enterica serovar Typhi
cccugcgcuuucaaccac

SEQ ID NO: 3639575 - RNA, 21 nt, Salmonella enterica enterica serovar Typhi
cccugcggauuacgaauaccg

SEQ ID NO: 3639576 - RNA, 13 nt, Salmonella enterica enterica serovar Typhi
cccugcggcugau

SEQ ID NO: 3639577 - RNA, 22 nt, Salmonella enterica enterica serovar Typhi
cccugcgguagcuccagacagg

SEQ ID NO: 3639578 - RNA, 13 nt, Salmonella enterica enterica serovar Typhi
cccugcucccaca

SEQ ID NO: 3639579 - RNA, 13 nt, Salmonella enterica enterica serovar Typhi
cccugcuccugcc

SEQ ID NO: 3639580 - RNA, 14 nt, Salmonella enterica enterica serovar Typhi
cccugcuccugcca

SEQ ID NO: 3639581 - RNA, 17 nt, Salmonella enterica enterica serovar Typhi
cccugcugauacacaac

SEQ ID NO: 3639582 - RNA, 21 nt, Salmonella enterica enterica serovar Typhi
cccugcuggcgaaccaccagc

SEQ ID NO: 3639583 - RNA, 16 nt, Salmonella enterica enterica serovar Typhi
cccugcuguuccagug

SEQ ID NO: 3639584 - RNA, 14 nt, Salmonella enterica enterica serovar Typhi
cccuggauugugau

SEQ ID NO: 3639585 - RNA, 19 nt, Salmonella enterica enterica serovar Typhi
cccuggcucaauccaggug

SEQ ID NO: 3639586 - RNA, 21 nt, Salmonella enterica enterica serovar Typhi
cccuggcucaauccaggugga

SEQ ID NO: 3639587 - RNA, 16 nt, Salmonella enterica enterica serovar Typhi
cccuggggcgcucuuu

SEQ ID NO: 3639588 - RNA, 21 nt, Salmonella enterica enterica serovar Typhi
cccuguaacagaauuaacgca

SEQ ID NO: 3639589 - RNA, 15 nt, Salmonella enterica enterica serovar Typhi
cccuguaggccugau

SEQ ID NO: 3639590 - RNA, 18 nt, Salmonella enterica enterica serovar Typhi
cccuguuuuuucgccgcg

SEQ ID NO: 3639591 - RNA, 20 nt, Salmonella enterica enterica serovar Typhi
cccuuacgcuuuauucuguc

SEQ ID NO: 3639592 - RNA, 14 nt, Salmonella enterica enterica serovar Typhi
cccuuaucaaaggc

SEQ ID NO: 3639593 - RNA, 11 nt, Salmonella enterica enterica serovar Typhi
cccuuaucugg

SEQ ID NO: 3639594 - RNA, 19 nt, Salmonella enterica enterica serovar Typhi
cccuuaucuggaugaggac

SEQ ID NO: 3639595 - RNA, 21 nt, Salmonella enterica enterica serovar Typhi
cccuuaugucauucaggucua

SEQ ID NO: 3639596 - RNA, 23 nt, Salmonella enterica enterica serovar Typhi
cccuucaauaucaagauccaaca

SEQ ID NO: 3639597 - RNA, 16 nt, Salmonella enterica enterica serovar Typhi
cccuucaccgcuuuuc

SEQ ID NO: 3639598 - RNA, 11 nt, Salmonella enterica enterica serovar Typhi
cccuucaggaa

SEQ ID NO: 3639599 - RNA, 14 nt, Salmonella enterica enterica serovar Typhi
cccuucaucuucca

SEQ ID NO: 3639600 - RNA, 19 nt, Salmonella enterica enterica serovar Typhi
cccuucaugcagcccgcac

SEQ ID NO: 3639601 - RNA, 12 nt, Salmonella enterica enterica serovar Typhi
cccuuccgccau

SEQ ID NO: 3639602 - RNA, 22 nt, Salmonella enterica enterica serovar Typhi
cccuucgacaaucagcaccauu

SEQ ID NO: 3639603 - RNA, 16 nt, Salmonella enterica enterica serovar Typhi
cccuucgaccgucagc

SEQ ID NO: 3639604 - RNA, 14 nt, Salmonella enterica enterica serovar Typhi
cccuucgcccggcg

SEQ ID NO: 3639605 - RNA, 23 nt, Salmonella enterica enterica serovar Typhi
cccuucuccgguaaucaccagau

SEQ ID NO: 3639606 - RNA, 20 nt, Salmonella enterica enterica serovar Typhi
cccuucuuuaugcgccuucu

SEQ ID NO: 3639607 - RNA, 15 nt, Salmonella enterica enterica serovar Typhi
cccuucuuuuacugc

SEQ ID NO: 3639608 - RNA, 21 nt, Salmonella enterica enterica serovar Typhi
cccuucuuuuacugccccgcc

SEQ ID NO: 3639609 - RNA, 22 nt, Salmonella enterica enterica serovar Typhi
cccuugcugacaucgcgauugu

SEQ ID NO: 3639610 - RNA, 23 nt, Salmonella enterica enterica serovar Typhi
cccuuguuauccuaaaucugcca

SEQ ID NO: 3639611 - RNA, 20 nt, Salmonella enterica enterica serovar Typhi
cccuuuaggcggcgccgcgc

SEQ ID NO: 3639612 - RNA, 19 nt, Salmonella enterica enterica serovar Typhi
cccuuucauucgucaaauu

SEQ ID NO: 3639613 - RNA, 13 nt, Salmonella enterica enterica serovar Typhi
cccuuucuuaugc

SEQ ID NO: 3639614 - RNA, 23 nt, Salmonella enterica enterica serovar Typhi
cccuuuucuuuaaacaacgccau

SEQ ID NO: 3639615 - RNA, 18 nt, Salmonella enterica enterica serovar Typhi
cccuuuuuaaaaugaccg

SEQ ID NO: 3639616 - RNA, 11 nt, Salmonella enterica enterica serovar Typhi
cccuuuuucaa

SEQ ID NO: 3639617 - RNA, 13 nt, Salmonella enterica enterica serovar Typhi
cccuuuuugcauu

SEQ ID NO: 3639618 - RNA, 21 nt, Salmonella enterica enterica serovar Typhi
cccuuuuugcauucgcuccuc

SEQ ID NO: 3639619 - RNA, 20 nt, Salmonella enterica enterica serovar Typhi
cccuuuuuuggucagaaagc

SEQ ID NO: 3639620 - RNA, 21 nt, Salmonella enterica enterica serovar Typhi
cccuuuuuugguuauccagca

SEQ ID NO: 3639621 - RNA, 16 nt, Salmonella enterica enterica serovar Typhi
ccgaaagaaagacgcu

SEQ ID NO: 3639622 - RNA, 16 nt, Salmonella enterica enterica serovar Typhi
ccgaaauccaccagcg

SEQ ID NO: 3639623 - RNA, 18 nt, Salmonella enterica enterica serovar Typhi
ccgaaaugaccaccgcau

SEQ ID NO: 3639624 - RNA, 16 nt, Salmonella enterica enterica serovar Typhi
ccgaacgcguccauga

SEQ ID NO: 3639625 - RNA, 19 nt, Salmonella enterica enterica serovar Typhi
ccgaacugcaucccugcuu

SEQ ID NO: 3639626 - RNA, 18 nt, Salmonella enterica enterica serovar Typhi
ccgaagaacagauucauu

SEQ ID NO: 3639627 - RNA, 18 nt, Salmonella enterica enterica serovar Typhi
ccgaagauaaagauauuc

SEQ ID NO: 3639628 - RNA, 13 nt, Salmonella enterica enterica serovar Typhi
ccgaagcaggcgg

SEQ ID NO: 3639629 - RNA, 20 nt, Salmonella enterica enterica serovar Typhi
ccgaauagcgacaaaugaag

SEQ ID NO: 3639630 - RNA, 12 nt, Salmonella enterica enterica serovar Typhi
ccgaaucaggcg

SEQ ID NO: 3639631 - RNA, 12 nt, Salmonella enterica enterica serovar Typhi
ccgaaucuugca

SEQ ID NO: 3639632 - RNA, 18 nt, Salmonella enterica enterica serovar Typhi
ccgaaugcguuuuuucac

SEQ ID NO: 3639633 - RNA, 21 nt, Salmonella enterica enterica serovar Typhi
ccgacaaccccaaacaccaac

SEQ ID NO: 3639634 - RNA, 23 nt, Salmonella enterica enterica serovar Typhi
ccgacaagaaucacguaaucggc

SEQ ID NO: 3639635 - RNA, 18 nt, Salmonella enterica enterica serovar Typhi
ccgacaagccccccgcac

SEQ ID NO: 3639636 - RNA, 20 nt, Salmonella enterica enterica serovar Typhi
ccgacaagguauaucaaccc

SEQ ID NO: 3639637 - RNA, 22 nt, Salmonella enterica enterica serovar Typhi
ccgacaagguauaucaacccgc

SEQ ID NO: 3639638 - RNA, 20 nt, Salmonella enterica enterica serovar Typhi
ccgacaauauucgccgcgau

SEQ ID NO: 3639639 - RNA, 15 nt, Salmonella enterica enterica serovar Typhi
ccgacacgcucaugu

SEQ ID NO: 3639640 - RNA, 13 nt, Salmonella enterica enterica serovar Typhi
ccgacagcggaaa

SEQ ID NO: 3639641 - RNA, 22 nt, Salmonella enterica enterica serovar Typhi
ccgacaggguuugccagcacca

SEQ ID NO: 3639642 - RNA, 17 nt, Salmonella enterica enterica serovar Typhi
ccgacauagcugaacaa

SEQ ID NO: 3639643 - RNA, 18 nt, Salmonella enterica enterica serovar Typhi
ccgacaucgccaguugca

SEQ ID NO: 3639644 - RNA, 21 nt, Salmonella enterica enterica serovar Typhi
ccgaccaaugacgcuauccgc

SEQ ID NO: 3639645 - RNA, 15 nt, Salmonella enterica enterica serovar Typhi
ccgaccaccagcuug

SEQ ID NO: 3639646 - RNA, 15 nt, Salmonella enterica enterica serovar Typhi
ccgaccaccgcccug

SEQ ID NO: 3639647 - RNA, 13 nt, Salmonella enterica enterica serovar Typhi
ccgaccagggcau

SEQ ID NO: 3639648 - RNA, 16 nt, Salmonella enterica enterica serovar Typhi
ccgaccagggcauccc

SEQ ID NO: 3639649 - RNA, 21 nt, Salmonella enterica enterica serovar Typhi
ccgaccaguuuuugcgccagc

SEQ ID NO: 3639650 - RNA, 22 nt, Salmonella enterica enterica serovar Typhi
ccgaccauccagacaugcacau

SEQ ID NO: 3639651 - RNA, 21 nt, Salmonella enterica enterica serovar Typhi
ccgaccauuggcaccaccagg

SEQ ID NO: 3639652 - RNA, 22 nt, Salmonella enterica enterica serovar Typhi
ccgacccauacucuuucccggc

SEQ ID NO: 3639653 - RNA, 17 nt, Salmonella enterica enterica serovar Typhi
ccgaccgccagcagagc

SEQ ID NO: 3639654 - RNA, 22 nt, Salmonella enterica enterica serovar Typhi
ccgaccuggcggucggcuuugu

SEQ ID NO: 3639655 - RNA, 19 nt, Salmonella enterica enterica serovar Typhi
ccgacgauaaacagauaug

SEQ ID NO: 3639656 - RNA, 13 nt, Salmonella enterica enterica serovar Typhi
ccgacgccagcca

SEQ ID NO: 3639657 - RNA, 14 nt, Salmonella enterica enterica serovar Typhi
ccgacgccagccau

SEQ ID NO: 3639658 - RNA, 21 nt, Salmonella enterica enterica serovar Typhi
ccgacgccuguucgagguuca

SEQ ID NO: 3639659 - RNA, 23 nt, Salmonella enterica enterica serovar Typhi
ccgacgcgaauugcgaguaaccu

SEQ ID NO: 3639660 - RNA, 15 nt, Salmonella enterica enterica serovar Typhi
ccgacgcgggccgca

SEQ ID NO: 3639661 - RNA, 14 nt, Salmonella enterica enterica serovar Typhi
ccgacgcucaaccg

SEQ ID NO: 3639662 - RNA, 23 nt, Salmonella enterica enterica serovar Typhi
ccgacggccucuucacgcagcgc

SEQ ID NO: 3639663 - RNA, 19 nt, Salmonella enterica enterica serovar Typhi
ccgacggggcguuaaucac

SEQ ID NO: 3639664 - RNA, 18 nt, Salmonella enterica enterica serovar Typhi
ccgacgguuauugcgcug

SEQ ID NO: 3639665 - RNA, 23 nt, Salmonella enterica enterica serovar Typhi
ccgacguuaaaugucugaauauu

SEQ ID NO: 3639666 - RNA, 16 nt, Salmonella enterica enterica serovar Typhi
ccgacuaccggcacca

SEQ ID NO: 3639667 - RNA, 19 nt, Salmonella enterica enterica serovar Typhi
ccgacuaccggcaccagca

SEQ ID NO: 3639668 - RNA, 17 nt, Salmonella enterica enterica serovar Typhi
ccgacucacgcagcgcu

SEQ ID NO: 3639669 - RNA, 16 nt, Salmonella enterica enterica serovar Typhi
ccgacucugacgccgg

SEQ ID NO: 3639670 - RNA, 20 nt, Salmonella enterica enterica serovar Typhi
ccgacugucgaaaccagcau

SEQ ID NO: 3639671 - RNA, 13 nt, Salmonella enterica enterica serovar Typhi
ccgacuuucaaau

SEQ ID NO: 3639672 - RNA, 18 nt, Salmonella enterica enterica serovar Typhi
ccgacuuuuuugccuuuc

SEQ ID NO: 3639673 - RNA, 22 nt, Salmonella enterica enterica serovar Typhi
ccgacuuuuuugccuuucagau

SEQ ID NO: 3639674 - RNA, 15 nt, Salmonella enterica enterica serovar Typhi
ccgagaaacaccaga

SEQ ID NO: 3639675 - RNA, 18 nt, Salmonella enterica enterica serovar Typhi
ccgagaauuucagcacgc

SEQ ID NO: 3639676 - RNA, 13 nt, Salmonella enterica enterica serovar Typhi
ccgagacugcccg

SEQ ID NO: 3639677 - RNA, 18 nt, Salmonella enterica enterica serovar Typhi
ccgagaguccagcgccag

SEQ ID NO: 3639678 - RNA, 17 nt, Salmonella enterica enterica serovar Typhi
ccgagaucaggccgauu

SEQ ID NO: 3639679 - RNA, 14 nt, Salmonella enterica enterica serovar Typhi
ccgagcauccgcgc

SEQ ID NO: 3639680 - RNA, 19 nt, Salmonella enterica enterica serovar Typhi
ccgagcauuuccgcagcca

SEQ ID NO: 3639681 - RNA, 22 nt, Salmonella enterica enterica serovar Typhi
ccgagccagaacgagaggagga

SEQ ID NO: 3639682 - RNA, 23 nt, Salmonella enterica enterica serovar Typhi
ccgagccgcccuucacaaccauc

SEQ ID NO: 3639683 - RNA, 17 nt, Salmonella enterica enterica serovar Typhi
ccgagccggguuauagc

SEQ ID NO: 3639684 - RNA, 21 nt, Salmonella enterica enterica serovar Typhi
ccgagcgaaggggcgggcagc

SEQ ID NO: 3639685 - RNA, 19 nt, Salmonella enterica enterica serovar Typhi
ccgaggacgggacuugaac

SEQ ID NO: 3639686 - RNA, 16 nt, Salmonella enterica enterica serovar Typhi
ccgaggcuaagccaga

SEQ ID NO: 3639687 - RNA, 19 nt, Salmonella enterica enterica serovar Typhi
ccgaggcuuaauacggcaa

SEQ ID NO: 3639688 - RNA, 22 nt, Salmonella enterica enterica serovar Typhi
ccgaggguggacaugauaagcg

SEQ ID NO: 3639689 - RNA, 14 nt, Salmonella enterica enterica serovar Typhi
ccgaguaacaccgc

SEQ ID NO: 3639690 - RNA, 19 nt, Salmonella enterica enterica serovar Typhi
ccgagucgaucgucgggau

SEQ ID NO: 3639691 - RNA, 19 nt, Salmonella enterica enterica serovar Typhi
ccgagucuacaucaagaga

SEQ ID NO: 3639692 - RNA, 20 nt, Salmonella enterica enterica serovar Typhi
ccgaguggaaucagccagga

SEQ ID NO: 3639693 - RNA, 15 nt, Salmonella enterica enterica serovar Typhi
ccgauaaacggcuuu

SEQ ID NO: 3639694 - RNA, 22 nt, Salmonella enterica enterica serovar Typhi
ccgauaaagcgaccgaucauca

SEQ ID NO: 3639695 - RNA, 18 nt, Salmonella enterica enterica serovar Typhi
ccgauaaauucugucuca

SEQ ID NO: 3639696 - RNA, 17 nt, Salmonella enterica enterica serovar Typhi
ccgauaagcaagcgcca

SEQ ID NO: 3639697 - RNA, 21 nt, Salmonella enterica enterica serovar Typhi
ccgauaagcaagcgccaucgg

SEQ ID NO: 3639698 - RNA, 15 nt, Salmonella enterica enterica serovar Typhi
ccgauaagcgcugua

SEQ ID NO: 3639699 - RNA, 18 nt, Salmonella enterica enterica serovar Typhi
ccgauaaucaccagcccg

SEQ ID NO: 3639700 - RNA, 13 nt, Salmonella enterica enterica serovar Typhi
ccgauaauggcgc

SEQ ID NO: 3639701 - RNA, 17 nt, Salmonella enterica enterica serovar Typhi
ccgauacaggacugacu

SEQ ID NO: 3639702 - RNA, 23 nt, Salmonella enterica enterica serovar Typhi
ccgauacaggacugacugcuguc

SEQ ID NO: 3639703 - RNA, 16 nt, Salmonella enterica enterica serovar Typhi
ccgauagcgccgcgcu

SEQ ID NO: 3639704 - RNA, 16 nt, Salmonella enterica enterica serovar Typhi
ccgauagcguaaagaa

SEQ ID NO: 3639705 - RNA, 17 nt, Salmonella enterica enterica serovar Typhi
ccgauagcuaucacaca

SEQ ID NO: 3639706 - RNA, 20 nt, Salmonella enterica enterica serovar Typhi
ccgauagcuaucacacauau

SEQ ID NO: 3639707 - RNA, 21 nt, Salmonella enterica enterica serovar Typhi
ccgauauauugccggccugau

SEQ ID NO: 3639708 - RNA, 17 nt, Salmonella enterica enterica serovar Typhi
ccgauauggaugcgcug

SEQ ID NO: 3639709 - RNA, 16 nt, Salmonella enterica enterica serovar Typhi
ccgauauggucgcuaa

SEQ ID NO: 3639710 - RNA, 16 nt, Salmonella enterica enterica serovar Typhi
ccgaucaccagcgcau

SEQ ID NO: 3639711 - RNA, 17 nt, Salmonella enterica enterica serovar Typhi
ccgaucaggccgcagac

SEQ ID NO: 3639712 - RNA, 22 nt, Salmonella enterica enterica serovar Typhi
ccgaucaucccgcccagcaaca

SEQ ID NO: 3639713 - RNA, 23 nt, Salmonella enterica enterica serovar Typhi
ccgaucaucguaccaauacccag

SEQ ID NO: 3639714 - RNA, 23 nt, Salmonella enterica enterica serovar Typhi
ccgauccgaagaacagauucauu

SEQ ID NO: 3639715 - RNA, 22 nt, Salmonella enterica enterica serovar Typhi
ccgaucgagucacccugcaaca

SEQ ID NO: 3639716 - RNA, 19 nt, Salmonella enterica enterica serovar Typhi
ccgaucucaugcaacuggc

SEQ ID NO: 3639717 - RNA, 12 nt, Salmonella enterica enterica serovar Typhi
ccgaucucccag

SEQ ID NO: 3639718 - RNA, 13 nt, Salmonella enterica enterica serovar Typhi
ccgaucucccagc

SEQ ID NO: 3639719 - RNA, 15 nt, Salmonella enterica enterica serovar Typhi
ccgaugaacgacgcu

SEQ ID NO: 3639720 - RNA, 22 nt, Salmonella enterica enterica serovar Typhi
ccgaugccgaucaccagcgcau

SEQ ID NO: 3639721 - RNA, 16 nt, Salmonella enterica enterica serovar Typhi
ccgaugcugaauagcc

SEQ ID NO: 3639722 - RNA, 17 nt, Salmonella enterica enterica serovar Typhi
ccgauggcgcugcguuu

SEQ ID NO: 3639723 - RNA, 16 nt, Salmonella enterica enterica serovar Typhi
ccgaugguauuuauuc

SEQ ID NO: 3639724 - RNA, 13 nt, Salmonella enterica enterica serovar Typhi
ccgauucccaguc

SEQ ID NO: 3639725 - RNA, 23 nt, Salmonella enterica enterica serovar Typhi
ccgauuuugucggaauuuccggg

SEQ ID NO: 3639726 - RNA, 18 nt, Salmonella enterica enterica serovar Typhi
ccgauuuuucggcacgcu

SEQ ID NO: 3639727 - RNA, 22 nt, Salmonella enterica enterica serovar Typhi
ccgauuuuuuaucucgccgucg

SEQ ID NO: 3639728 - RNA, 13 nt, Salmonella enterica enterica serovar Typhi
ccgcaaaaaauac

SEQ ID NO: 3639729 - RNA, 12 nt, Salmonella enterica enterica serovar Typhi
ccgcaaaaccuu

SEQ ID NO: 3639730 - RNA, 22 nt, Salmonella enterica enterica serovar Typhi
ccgcaaacgccgugaacgccaa

SEQ ID NO: 3639731 - RNA, 18 nt, Salmonella enterica enterica serovar Typhi
ccgcaaacggaauagcgc

SEQ ID NO: 3639732 - RNA, 20 nt, Salmonella enterica enterica serovar Typhi
ccgcaaaggaccaacaccag

SEQ ID NO: 3639733 - RNA, 20 nt, Salmonella enterica enterica serovar Typhi
ccgcaaaggaucaucggcca

SEQ ID NO: 3639734 - RNA, 15 nt, Salmonella enterica enterica serovar Typhi
ccgcaacggucgguc

SEQ ID NO: 3639735 - RNA, 23 nt, Salmonella enterica enterica serovar Typhi
ccgcaacguccucuuucgacauu

SEQ ID NO: 3639736 - RNA, 18 nt, Salmonella enterica enterica serovar Typhi
ccgcaacugaaaccaggc

SEQ ID NO: 3639737 - RNA, 15 nt, Salmonella enterica enterica serovar Typhi
ccgcaaggacgccag

SEQ ID NO: 3639738 - RNA, 16 nt, Salmonella enterica enterica serovar Typhi
ccgcaauaacgccgau

SEQ ID NO: 3639739 - RNA, 23 nt, Salmonella enterica enterica serovar Typhi
ccgcaauaacgccgauaaccagc

SEQ ID NO: 3639740 - RNA, 15 nt, Salmonella enterica enterica serovar Typhi
ccgcaauacagcccg

SEQ ID NO: 3639741 - RNA, 14 nt, Salmonella enterica enterica serovar Typhi
ccgcaauccuggcu

SEQ ID NO: 3639742 - RNA, 13 nt, Salmonella enterica enterica serovar Typhi
ccgcaaucuggcg

SEQ ID NO: 3639743 - RNA, 14 nt, Salmonella enterica enterica serovar Typhi
ccgcacagaaucgc

SEQ ID NO: 3639744 - RNA, 14 nt, Salmonella enterica enterica serovar Typhi
ccgcacagcagaca

SEQ ID NO: 3639745 - RNA, 23 nt, Salmonella enterica enterica serovar Typhi
ccgcacaggcgacgaaccgcgua

SEQ ID NO: 3639746 - RNA, 18 nt, Salmonella enterica enterica serovar Typhi
ccgcacgcgacgcgccag

SEQ ID NO: 3639747 - RNA, 14 nt, Salmonella enterica enterica serovar Typhi
ccgcagaaaaagcc

SEQ ID NO: 3639748 - RNA, 20 nt, Salmonella enterica enterica serovar Typhi
ccgcagaaggucacgccggg

SEQ ID NO: 3639749 - RNA, 19 nt, Salmonella enterica enterica serovar Typhi
ccgcagacuuuaaccauuc

SEQ ID NO: 3639750 - RNA, 21 nt, Salmonella enterica enterica serovar Typhi
ccgcagauccagcacggccuu

SEQ ID NO: 3639751 - RNA, 22 nt, Salmonella enterica enterica serovar Typhi
ccgcagaucugucgccaugacc

SEQ ID NO: 3639752 - RNA, 23 nt, Salmonella enterica enterica serovar Typhi
ccgcagcacccgcucgcugcauu

SEQ ID NO: 3639753 - RNA, 14 nt, Salmonella enterica enterica serovar Typhi
ccgcagccaacaac

SEQ ID NO: 3639754 - RNA, 21 nt, Salmonella enterica enterica serovar Typhi
ccgcagccaacaacaggccgc

SEQ ID NO: 3639755 - RNA, 12 nt, Salmonella enterica enterica serovar Typhi
ccgcagcccgcc

SEQ ID NO: 3639756 - RNA, 21 nt, Salmonella enterica enterica serovar Typhi
ccgcagcccgcccacaggcug

SEQ ID NO: 3639757 - RNA, 15 nt, Salmonella enterica enterica serovar Typhi
ccgcagccgacgcau

SEQ ID NO: 3639758 - RNA, 13 nt, Salmonella enterica enterica serovar Typhi
ccgcagccgcuca

SEQ ID NO: 3639759 - RNA, 10 nt, Salmonella enterica enterica serovar Typhi
ccgcagccgg

SEQ ID NO: 3639760 - RNA, 12 nt, Salmonella enterica enterica serovar Typhi
ccgcagcgccau

SEQ ID NO: 3639761 - RNA, 13 nt, Salmonella enterica enterica serovar Typhi
ccgcagcgccaua

SEQ ID NO: 3639762 - RNA, 16 nt, Salmonella enterica enterica serovar Typhi
ccgcagcgugccuuca

SEQ ID NO: 3639763 - RNA, 14 nt, Salmonella enterica enterica serovar Typhi
ccgcagcuuauucc

SEQ ID NO: 3639764 - RNA, 17 nt, Salmonella enterica enterica serovar Typhi
ccgcaggacagcgacau

SEQ ID NO: 3639765 - RNA, 22 nt, Salmonella enterica enterica serovar Typhi
ccgcaggacagcgacauccucu

SEQ ID NO: 3639766 - RNA, 18 nt, Salmonella enterica enterica serovar Typhi
ccgcaggagagccagaag

SEQ ID NO: 3639767 - RNA, 14 nt, Salmonella enterica enterica serovar Typhi
ccgcaggccuggcu

SEQ ID NO: 3639768 - RNA, 17 nt, Salmonella enterica enterica serovar Typhi
ccgcaggcucuuuuucu

SEQ ID NO: 3639769 - RNA, 14 nt, Salmonella enterica enterica serovar Typhi
ccgcaggcuuccag

SEQ ID NO: 3639770 - RNA, 20 nt, Salmonella enterica enterica serovar Typhi
ccgcagugaagaauggcgcc

SEQ ID NO: 3639771 - RNA, 18 nt, Salmonella enterica enterica serovar Typhi
ccgcauauauugcgcuuc

SEQ ID NO: 3639772 - RNA, 14 nt, Salmonella enterica enterica serovar Typhi
ccgcaucaaugccc

SEQ ID NO: 3639773 - RNA, 17 nt, Salmonella enterica enterica serovar Typhi
ccgcaucacccgcauau

SEQ ID NO: 3639774 - RNA, 18 nt, Salmonella enterica enterica serovar Typhi
ccgcaucagcaacgcgcc

SEQ ID NO: 3639775 - RNA, 19 nt, Salmonella enterica enterica serovar Typhi
ccgcaucgauacccugcug

SEQ ID NO: 3639776 - RNA, 13 nt, Salmonella enterica enterica serovar Typhi
ccgcaucgccaua

SEQ ID NO: 3639777 - RNA, 14 nt, Salmonella enterica enterica serovar Typhi
ccgcaucgcgccca

SEQ ID NO: 3639778 - RNA, 15 nt, Salmonella enterica enterica serovar Typhi
ccgcaucguuaucau

SEQ ID NO: 3639779 - RNA, 16 nt, Salmonella enterica enterica serovar Typhi
ccgcauuauaaauauc

SEQ ID NO: 3639780 - RNA, 22 nt, Salmonella enterica enterica serovar Typhi
ccgcauucagaaccugcgauac

SEQ ID NO: 3639781 - RNA, 18 nt, Salmonella enterica enterica serovar Typhi
ccgcauugguuucgccua

SEQ ID NO: 3639782 - RNA, 14 nt, Salmonella enterica enterica serovar Typhi
ccgccaaacgcggu

SEQ ID NO: 3639783 - RNA, 14 nt, Salmonella enterica enterica serovar Typhi
ccgccaaagcgccc

SEQ ID NO: 3639784 - RNA, 18 nt, Salmonella enterica enterica serovar Typhi
ccgccaacaccgcaucgc

SEQ ID NO: 3639785 - RNA, 23 nt, Salmonella enterica enterica serovar Typhi
ccgccaacgccaacauagccaca

SEQ ID NO: 3639786 - RNA, 18 nt, Salmonella enterica enterica serovar Typhi
ccgccaacgccagcagcg

SEQ ID NO: 3639787 - RNA, 21 nt, Salmonella enterica enterica serovar Typhi
ccgccaacgguaaguugaaag

SEQ ID NO: 3639788 - RNA, 23 nt, Salmonella enterica enterica serovar Typhi
ccgccaauauccggcacgccagc

SEQ ID NO: 3639789 - RNA, 14 nt, Salmonella enterica enterica serovar Typhi
ccgccaccacgccc

SEQ ID NO: 3639790 - RNA, 12 nt, Salmonella enterica enterica serovar Typhi
ccgccaccagca

SEQ ID NO: 3639791 - RNA, 12 nt, Salmonella enterica enterica serovar Typhi
ccgccacccggc

SEQ ID NO: 3639792 - RNA, 14 nt, Salmonella enterica enterica serovar Typhi
ccgccaccgcgcgc

SEQ ID NO: 3639793 - RNA, 19 nt, Salmonella enterica enterica serovar Typhi
ccgccagaaaagaaccgac

SEQ ID NO: 3639794 - RNA, 16 nt, Salmonella enterica enterica serovar Typhi
ccgccagacucagcca

SEQ ID NO: 3639795 - RNA, 15 nt, Salmonella enterica enterica serovar Typhi
ccgccagauaaagcg

SEQ ID NO: 3639796 - RNA, 15 nt, Salmonella enterica enterica serovar Typhi
ccgccagcaaugccg

SEQ ID NO: 3639797 - RNA, 13 nt, Salmonella enterica enterica serovar Typhi
ccgccagcacagc

SEQ ID NO: 3639798 - RNA, 14 nt, Salmonella enterica enterica serovar Typhi
ccgccagcacagca

SEQ ID NO: 3639799 - RNA, 19 nt, Salmonella enterica enterica serovar Typhi
ccgccagcaccagcagcgc

SEQ ID NO: 3639800 - RNA, 18 nt, Salmonella enterica enterica serovar Typhi
ccgccagcaccaggcucg

SEQ ID NO: 3639801 - RNA, 13 nt, Salmonella enterica enterica serovar Typhi
ccgccagcagagc

SEQ ID NO: 3639802 - RNA, 11 nt, Salmonella enterica enterica serovar Typhi
ccgccagcagu

SEQ ID NO: 3639803 - RNA, 15 nt, Salmonella enterica enterica serovar Typhi
ccgccagcaguugca

SEQ ID NO: 3639804 - RNA, 14 nt, Salmonella enterica enterica serovar Typhi
ccgccagccccacc

SEQ ID NO: 3639805 - RNA, 23 nt, Salmonella enterica enterica serovar Typhi
ccgccagccccaccguccacauc

SEQ ID NO: 3639806 - RNA, 20 nt, Salmonella enterica enterica serovar Typhi
ccgccagcgacauggcgguc

SEQ ID NO: 3639807 - RNA, 19 nt, Salmonella enterica enterica serovar Typhi
ccgccagcgagaugaaaag

SEQ ID NO: 3639808 - RNA, 13 nt, Salmonella enterica enterica serovar Typhi
ccgccagcggcgc

SEQ ID NO: 3639809 - RNA, 22 nt, Salmonella enterica enterica serovar Typhi
ccgccaggcgagcacaccauau

SEQ ID NO: 3639810 - RNA, 23 nt, Salmonella enterica enterica serovar Typhi
ccgccaguaauuuuucucccagc

SEQ ID NO: 3639811 - RNA, 17 nt, Salmonella enterica enterica serovar Typhi
ccgccagucacccugcc

SEQ ID NO: 3639812 - RNA, 14 nt, Salmonella enterica enterica serovar Typhi
ccgccaguuuuuau

SEQ ID NO: 3639813 - RNA, 16 nt, Salmonella enterica enterica serovar Typhi
ccgccauagccggcga

SEQ ID NO: 3639814 - RNA, 16 nt, Salmonella enterica enterica serovar Typhi
ccgccauauauuuacu

SEQ ID NO: 3639815 - RNA, 24 nt, Salmonella enterica enterica serovar Typhi
ccgccauauauuuacugaauaaau

SEQ ID NO: 3639816 - RNA, 15 nt, Salmonella enterica enterica serovar Typhi
ccgccaucacaccaa

SEQ ID NO: 3639817 - RNA, 11 nt, Salmonella enterica enterica serovar Typhi
ccgccaucaug

SEQ ID NO: 3639818 - RNA, 15 nt, Salmonella enterica enterica serovar Typhi
ccgccauccggcaca

SEQ ID NO: 3639819 - RNA, 15 nt, Salmonella enterica enterica serovar Typhi
ccgccauccggccug

SEQ ID NO: 3639820 - RNA, 14 nt, Salmonella enterica enterica serovar Typhi
ccgccauccggcga

SEQ ID NO: 3639821 - RNA, 14 nt, Salmonella enterica enterica serovar Typhi
ccgccaucgccucg

SEQ ID NO: 3639822 - RNA, 17 nt, Salmonella enterica enterica serovar Typhi
ccgccaucgcugacgau

SEQ ID NO: 3639823 - RNA, 16 nt, Salmonella enterica enterica serovar Typhi
ccgccaucguccagcc

SEQ ID NO: 3639824 - RNA, 20 nt, Salmonella enterica enterica serovar Typhi
ccgccaucucauucgccagc

SEQ ID NO: 3639825 - RNA, 17 nt, Salmonella enterica enterica serovar Typhi
ccgccaucuccggcagc

SEQ ID NO: 3639826 - RNA, 18 nt, Salmonella enterica enterica serovar Typhi
ccgccauggcgaauccgu

SEQ ID NO: 3639827 - RNA, 19 nt, Salmonella enterica enterica serovar Typhi
ccgccauugccaguaccga

SEQ ID NO: 3639828 - RNA, 22 nt, Salmonella enterica enterica serovar Typhi
ccgccauugccaguaccgacgc

SEQ ID NO: 3639829 - RNA, 13 nt, Salmonella enterica enterica serovar Typhi
ccgccauuugcgc

SEQ ID NO: 3639830 - RNA, 17 nt, Salmonella enterica enterica serovar Typhi
ccgcccaacagggcggc

SEQ ID NO: 3639831 - RNA, 12 nt, Salmonella enterica enterica serovar Typhi
ccgcccagaacg

SEQ ID NO: 3639832 - RNA, 17 nt, Salmonella enterica enterica serovar Typhi
ccgcccagaacggcagc

SEQ ID NO: 3639833 - RNA, 23 nt, Salmonella enterica enterica serovar Typhi
ccgcccagauguugauacagaaa

SEQ ID NO: 3639834 - RNA, 18 nt, Salmonella enterica enterica serovar Typhi
ccgcccaguaccagcacu

SEQ ID NO: 3639835 - RNA, 13 nt, Salmonella enterica enterica serovar Typhi
ccgcccauccaga

SEQ ID NO: 3639836 - RNA, 22 nt, Salmonella enterica enterica serovar Typhi
ccgcccauuaauaucagcccca

SEQ ID NO: 3639837 - RNA, 22 nt, Salmonella enterica enterica serovar Typhi
ccgccccuguggaaucagucgg

SEQ ID NO: 3639838 - RNA, 13 nt, Salmonella enterica enterica serovar Typhi
ccgcccguccgcu

SEQ ID NO: 3639839 - RNA, 13 nt, Salmonella enterica enterica serovar Typhi
ccgcccguuuccg

SEQ ID NO: 3639840 - RNA, 18 nt, Salmonella enterica enterica serovar Typhi
ccgcccuguccuccaugg

SEQ ID NO: 3639841 - RNA, 20 nt, Salmonella enterica enterica serovar Typhi
ccgccgaacagacggcggcu

SEQ ID NO: 3639842 - RNA, 15 nt, Salmonella enterica enterica serovar Typhi
ccgccgacaccggcc

SEQ ID NO: 3639843 - RNA, 16 nt, Salmonella enterica enterica serovar Typhi
ccgccgacaugacggu

SEQ ID NO: 3639844 - RNA, 14 nt, Salmonella enterica enterica serovar Typhi
ccgccgcaacgcgc

SEQ ID NO: 3639845 - RNA, 14 nt, Salmonella enterica enterica serovar Typhi
ccgccgcacaggcg

SEQ ID NO: 3639846 - RNA, 17 nt, Salmonella enterica enterica serovar Typhi
ccgccgccaaacugcgc

SEQ ID NO: 3639847 - RNA, 19 nt, Salmonella enterica enterica serovar Typhi
ccgccgccagcaccgccgc

SEQ ID NO: 3639848 - RNA, 19 nt, Salmonella enterica enterica serovar Typhi
ccgccgccagccaucccca

SEQ ID NO: 3639849 - RNA, 15 nt, Salmonella enterica enterica serovar Typhi
ccgccgccaucacca

SEQ ID NO: 3639850 - RNA, 14 nt, Salmonella enterica enterica serovar Typhi
ccgccgcccguccg

SEQ ID NO: 3639851 - RNA, 13 nt, Salmonella enterica enterica serovar Typhi
ccgccgcgaccag

SEQ ID NO: 3639852 - RNA, 14 nt, Salmonella enterica enterica serovar Typhi
ccgccgcgagcagc

SEQ ID NO: 3639853 - RNA, 17 nt, Salmonella enterica enterica serovar Typhi
ccgccgcgauguuugcu

SEQ ID NO: 3639854 - RNA, 16 nt, Salmonella enterica enterica serovar Typhi
ccgccgcgcggcccca

SEQ ID NO: 3639855 - RNA, 12 nt, Salmonella enterica enterica serovar Typhi
ccgccgcgguga

SEQ ID NO: 3639856 - RNA, 20 nt, Salmonella enterica enterica serovar Typhi
ccgccgcguccuaccgccgc

SEQ ID NO: 3639857 - RNA, 18 nt, Salmonella enterica enterica serovar Typhi
ccgccgcuauuaccccgc

SEQ ID NO: 3639858 - RNA, 15 nt, Salmonella enterica enterica serovar Typhi
ccgccgcuggcgggc

SEQ ID NO: 3639859 - RNA, 18 nt, Salmonella enterica enterica serovar Typhi
ccgccgcuggucaacacg

SEQ ID NO: 3639860 - RNA, 23 nt, Salmonella enterica enterica serovar Typhi
ccgccggagaggggacucaccgu

SEQ ID NO: 3639861 - RNA, 21 nt, Salmonella enterica enterica serovar Typhi
ccgccggagggcgaacuggcg

SEQ ID NO: 3639862 - RNA, 12 nt, Salmonella enterica enterica serovar Typhi
ccgccggcagca

SEQ ID NO: 3639863 - RNA, 14 nt, Salmonella enterica enterica serovar Typhi
ccgccggcagcagc

SEQ ID NO: 3639864 - RNA, 15 nt, Salmonella enterica enterica serovar Typhi
ccgccggcagcagcu

SEQ ID NO: 3639865 - RNA, 23 nt, Salmonella enterica enterica serovar Typhi
ccgccggggcucccacucuucca

SEQ ID NO: 3639866 - RNA, 17 nt, Salmonella enterica enterica serovar Typhi
ccgccggugacggcgga

SEQ ID NO: 3639867 - RNA, 16 nt, Salmonella enterica enterica serovar Typhi
ccgccgucaucugcgc

SEQ ID NO: 3639868 - RNA, 12 nt, Salmonella enterica enterica serovar Typhi
ccgccguccugg

SEQ ID NO: 3639869 - RNA, 19 nt, Salmonella enterica enterica serovar Typhi
ccgccgucgucaccgccgc

SEQ ID NO: 3639870 - RNA, 12 nt, Salmonella enterica enterica serovar Typhi
ccgccuagcguc

SEQ ID NO: 3639871 - RNA, 19 nt, Salmonella enterica enterica serovar Typhi
ccgccuagcgucccggcaa

SEQ ID NO: 3639872 - RNA, 14 nt, Salmonella enterica enterica serovar Typhi
ccgccuccaggccg

SEQ ID NO: 3639873 - RNA, 16 nt, Salmonella enterica enterica serovar Typhi
ccgccucgaccccuuc

SEQ ID NO: 3639874 - RNA, 14 nt, Salmonella enterica enterica serovar Typhi
ccgccugaaucgcc

SEQ ID NO: 3639875 - RNA, 16 nt, Salmonella enterica enterica serovar Typhi
ccgccugaaucgccgc

SEQ ID NO: 3639876 - RNA, 13 nt, Salmonella enterica enterica serovar Typhi
ccgccugccagau

SEQ ID NO: 3639877 - RNA, 14 nt, Salmonella enterica enterica serovar Typhi
ccgccugccgcgcc

SEQ ID NO: 3639878 - RNA, 15 nt, Salmonella enterica enterica serovar Typhi
ccgccugccgcgccc

SEQ ID NO: 3639879 - RNA, 16 nt, Salmonella enterica enterica serovar Typhi
ccgccugccgcgccgc

SEQ ID NO: 3639880 - RNA, 18 nt, Salmonella enterica enterica serovar Typhi
ccgccugccgcgccgccg

SEQ ID NO: 3639881 - RNA, 12 nt, Salmonella enterica enterica serovar Typhi
ccgccugcugug

SEQ ID NO: 3639882 - RNA, 15 nt, Salmonella enterica enterica serovar Typhi
ccgccuggcgcgacu

SEQ ID NO: 3639883 - RNA, 20 nt, Salmonella enterica enterica serovar Typhi
ccgccuguacuuccgguauc

SEQ ID NO: 3639884 - RNA, 15 nt, Salmonella enterica enterica serovar Typhi
ccgccuuaccgcggu

SEQ ID NO: 3639885 - RNA, 17 nt, Salmonella enterica enterica serovar Typhi
ccgccuuaucaggccug

SEQ ID NO: 3639886 - RNA, 15 nt, Salmonella enterica enterica serovar Typhi
ccgccuugcggcggc

SEQ ID NO: 3639887 - RNA, 21 nt, Salmonella enterica enterica serovar Typhi
ccgcgaaaaacgauauucgcg

SEQ ID NO: 3639888 - RNA, 23 nt, Salmonella enterica enterica serovar Typhi
ccgcgaacaaagccccgggcgcu

SEQ ID NO: 3639889 - RNA, 16 nt, Salmonella enterica enterica serovar Typhi
ccgcgacagucgcaga

SEQ ID NO: 3639890 - RNA, 20 nt, Salmonella enterica enterica serovar Typhi
ccgcgacagucgcagagccc

SEQ ID NO: 3639891 - RNA, 15 nt, Salmonella enterica enterica serovar Typhi
ccgcgacuuuggcuu

SEQ ID NO: 3639892 - RNA, 22 nt, Salmonella enterica enterica serovar Typhi
ccgcgacuuuggcuuuauccgg

SEQ ID NO: 3639893 - RNA, 17 nt, Salmonella enterica enterica serovar Typhi
ccgcgagaacuuccgcc

SEQ ID NO: 3639894 - RNA, 18 nt, Salmonella enterica enterica serovar Typhi
ccgcgaggaucugcuuau

SEQ ID NO: 3639895 - RNA, 23 nt, Salmonella enterica enterica serovar Typhi
ccgcgauaaagaauagccugggc

SEQ ID NO: 3639896 - RNA, 22 nt, Salmonella enterica enterica serovar Typhi
ccgcgaugaucgucgcgaucgc

SEQ ID NO: 3639897 - RNA, 18 nt, Salmonella enterica enterica serovar Typhi
ccgcgaugcaucuugaau

SEQ ID NO: 3639898 - RNA, 22 nt, Salmonella enterica enterica serovar Typhi
ccgcgcaaagcaauaccacgcc

SEQ ID NO: 3639899 - RNA, 22 nt, Salmonella enterica enterica serovar Typhi
ccgcgcaaggcguucacaccgc

SEQ ID NO: 3639900 - RNA, 18 nt, Salmonella enterica enterica serovar Typhi
ccgcgcacaaaaggcugg

SEQ ID NO: 3639901 - RNA, 12 nt, Salmonella enterica enterica serovar Typhi
ccgcgcagcgcc

SEQ ID NO: 3639902 - RNA, 15 nt, Salmonella enterica enterica serovar Typhi
ccgcgcagugcagcg

SEQ ID NO: 3639903 - RNA, 18 nt, Salmonella enterica enterica serovar Typhi
ccgcgcagugcagcggau

SEQ ID NO: 3639904 - RNA, 15 nt, Salmonella enterica enterica serovar Typhi
ccgcgcauagcuggc

SEQ ID NO: 3639905 - RNA, 17 nt, Salmonella enterica enterica serovar Typhi
ccgcgccaaacguggcg

SEQ ID NO: 3639906 - RNA, 13 nt, Salmonella enterica enterica serovar Typhi
ccgcgccacccca

SEQ ID NO: 3639907 - RNA, 16 nt, Salmonella enterica enterica serovar Typhi
ccgcgccagacgccau

SEQ ID NO: 3639908 - RNA, 11 nt, Salmonella enterica enterica serovar Typhi
ccgcgccgccg

SEQ ID NO: 3639909 - RNA, 12 nt, Salmonella enterica enterica serovar Typhi
ccgcgccgccgc

SEQ ID NO: 3639910 - RNA, 14 nt, Salmonella enterica enterica serovar Typhi
ccgcgccgccgccg

SEQ ID NO: 3639911 - RNA, 11 nt, Salmonella enterica enterica serovar Typhi
ccgcgccggac

SEQ ID NO: 3639912 - RNA, 11 nt, Salmonella enterica enterica serovar Typhi
ccgcgccugaa

SEQ ID NO: 3639913 - RNA, 19 nt, Salmonella enterica enterica serovar Typhi
ccgcgccuucgcggugauc

SEQ ID NO: 3639914 - RNA, 13 nt, Salmonella enterica enterica serovar Typhi
ccgcgcgccgccu

SEQ ID NO: 3639915 - RNA, 15 nt, Salmonella enterica enterica serovar Typhi
ccgcgcgcuuuccac

SEQ ID NO: 3639916 - RNA, 14 nt, Salmonella enterica enterica serovar Typhi
ccgcgcggcguucu

SEQ ID NO: 3639917 - RNA, 15 nt, Salmonella enterica enterica serovar Typhi
ccgcgcgucagcgug

SEQ ID NO: 3639918 - RNA, 20 nt, Salmonella enterica enterica serovar Typhi
ccgcgcuaucgggucugcgc

SEQ ID NO: 3639919 - RNA, 20 nt, Salmonella enterica enterica serovar Typhi
ccgcgcucauacgaucgcgc

SEQ ID NO: 3639920 - RNA, 16 nt, Salmonella enterica enterica serovar Typhi
ccgcgcucgccagcau

SEQ ID NO: 3639921 - RNA, 17 nt, Salmonella enterica enterica serovar Typhi
ccgcgcucuccggcaca

SEQ ID NO: 3639922 - RNA, 19 nt, Salmonella enterica enterica serovar Typhi
ccgcgcuuuaugcagucgg

SEQ ID NO: 3639923 - RNA, 19 nt, Salmonella enterica enterica serovar Typhi
ccgcgcuuucuggcgcaga

SEQ ID NO: 3639924 - RNA, 19 nt, Salmonella enterica enterica serovar Typhi
ccgcggagaucgcucccgc

SEQ ID NO: 3639925 - RNA, 17 nt, Salmonella enterica enterica serovar Typhi
ccgcggauagacgauau

SEQ ID NO: 3639926 - RNA, 15 nt, Salmonella enterica enterica serovar Typhi
ccgcggcggacagcg

SEQ ID NO: 3639927 - RNA, 20 nt, Salmonella enterica enterica serovar Typhi
ccgcggcggacagcggcagc

SEQ ID NO: 3639928 - RNA, 19 nt, Salmonella enterica enterica serovar Typhi
ccgcgguacgaaucgccgc

SEQ ID NO: 3639929 - RNA, 13 nt, Salmonella enterica enterica serovar Typhi
ccgcgguccagcc

SEQ ID NO: 3639930 - RNA, 13 nt, Salmonella enterica enterica serovar Typhi
ccgcguaaaaagu

SEQ ID NO: 3639931 - RNA, 20 nt, Salmonella enterica enterica serovar Typhi
ccgcguaccugugcagguac

SEQ ID NO: 3639932 - RNA, 15 nt, Salmonella enterica enterica serovar Typhi
ccgcguagcguuauc

SEQ ID NO: 3639933 - RNA, 13 nt, Salmonella enterica enterica serovar Typhi
ccgcgucccgacc

SEQ ID NO: 3639934 - RNA, 16 nt, Salmonella enterica enterica serovar Typhi
ccgcguuguccccuca

SEQ ID NO: 3639935 - RNA, 19 nt, Salmonella enterica enterica serovar Typhi
ccgcguuuaacgcagcgcg

SEQ ID NO: 3639936 - RNA, 13 nt, Salmonella enterica enterica serovar Typhi
ccgcguuuuagca

SEQ ID NO: 3639937 - RNA, 16 nt, Salmonella enterica enterica serovar Typhi
ccgcuaaaaaacaggc

SEQ ID NO: 3639938 - RNA, 14 nt, Salmonella enterica enterica serovar Typhi
ccgcuacaauccag

SEQ ID NO: 3639939 - RNA, 15 nt, Salmonella enterica enterica serovar Typhi
ccgcuacccggcaca

SEQ ID NO: 3639940 - RNA, 14 nt, Salmonella enterica enterica serovar Typhi
ccgcuacuccgccc

SEQ ID NO: 3639941 - RNA, 15 nt, Salmonella enterica enterica serovar Typhi
ccgcuaucauaccua

SEQ ID NO: 3639942 - RNA, 17 nt, Salmonella enterica enterica serovar Typhi
ccgcuaucgaguugcgc

SEQ ID NO: 3639943 - RNA, 16 nt, Salmonella enterica enterica serovar Typhi
ccgcuaucgccaaacu

SEQ ID NO: 3639944 - RNA, 20 nt, Salmonella enterica enterica serovar Typhi
ccgcuaucugcuccgccagc

SEQ ID NO: 3639945 - RNA, 13 nt, Salmonella enterica enterica serovar Typhi
ccgcuauuaccag

SEQ ID NO: 3639946 - RNA, 19 nt, Salmonella enterica enterica serovar Typhi
ccgcuauucaccagcguca

SEQ ID NO: 3639947 - RNA, 20 nt, Salmonella enterica enterica serovar Typhi
ccgcucaccaccgccgcgag

SEQ ID NO: 3639948 - RNA, 22 nt, Salmonella enterica enterica serovar Typhi
ccgcucauuagggugcagugaa

SEQ ID NO: 3639949 - RNA, 18 nt, Salmonella enterica enterica serovar Typhi
ccgcucccgcauggacaa

SEQ ID NO: 3639950 - RNA, 15 nt, Salmonella enterica enterica serovar Typhi
ccgcucgcccgccgc

SEQ ID NO: 3639951 - RNA, 19 nt, Salmonella enterica enterica serovar Typhi
ccgcucgcccgccgcaaaa

SEQ ID NO: 3639952 - RNA, 17 nt, Salmonella enterica enterica serovar Typhi
ccgcucgccgccucccc

SEQ ID NO: 3639953 - RNA, 19 nt, Salmonella enterica enterica serovar Typhi
ccgcucgcuuacgcggcgc

SEQ ID NO: 3639954 - RNA, 22 nt, Salmonella enterica enterica serovar Typhi
ccgcucgcuuacgcggcgcgcu

SEQ ID NO: 3639955 - RNA, 22 nt, Salmonella enterica enterica serovar Typhi
ccgcucggcauacaccgccagc

SEQ ID NO: 3639956 - RNA, 15 nt, Salmonella enterica enterica serovar Typhi
ccgcucucuucguga

SEQ ID NO: 3639957 - RNA, 13 nt, Salmonella enterica enterica serovar Typhi
ccgcucugcuguu

SEQ ID NO: 3639958 - RNA, 19 nt, Salmonella enterica enterica serovar Typhi
ccgcugacgaccccaggca

SEQ ID NO: 3639959 - RNA, 13 nt, Salmonella enterica enterica serovar Typhi
ccgcugaucgccg

SEQ ID NO: 3639960 - RNA, 19 nt, Salmonella enterica enterica serovar Typhi
ccgcugauguuuugcgccg

SEQ ID NO: 3639961 - RNA, 23 nt, Salmonella enterica enterica serovar Typhi
ccgcugcaaaucaccacauggcc

SEQ ID NO: 3639962 - RNA, 20 nt, Salmonella enterica enterica serovar Typhi
ccgcugcgcucacgcggcgc

SEQ ID NO: 3639963 - RNA, 11 nt, Salmonella enterica enterica serovar Typhi
ccgcugcggaa

SEQ ID NO: 3639964 - RNA, 19 nt, Salmonella enterica enterica serovar Typhi
ccgcugcggucaggaauga

SEQ ID NO: 3639965 - RNA, 19 nt, Salmonella enterica enterica serovar Typhi
ccgcuggcgaccagccugc

SEQ ID NO: 3639966 - RNA, 15 nt, Salmonella enterica enterica serovar Typhi
ccgcuggcgcgggga

SEQ ID NO: 3639967 - RNA, 20 nt, Salmonella enterica enterica serovar Typhi
ccgcuggcuggccagggcau

SEQ ID NO: 3639968 - RNA, 20 nt, Salmonella enterica enterica serovar Typhi
ccgcugguugccuuccugau

SEQ ID NO: 3639969 - RNA, 14 nt, Salmonella enterica enterica serovar Typhi
ccgcugucgccaga

SEQ ID NO: 3639970 - RNA, 21 nt, Salmonella enterica enterica serovar Typhi
ccgcugucgccagaauguuau

SEQ ID NO: 3639971 - RNA, 21 nt, Salmonella enterica enterica serovar Typhi
ccgcuguuaugcacgcgcggc

SEQ ID NO: 3639972 - RNA, 19 nt, Salmonella enterica enterica serovar Typhi
ccgcuuaaauuaccgccgc

SEQ ID NO: 3639973 - RNA, 22 nt, Salmonella enterica enterica serovar Typhi
ccgcuucaaaacagaaccccau

SEQ ID NO: 3639974 - RNA, 14 nt, Salmonella enterica enterica serovar Typhi
ccgcuucacacugg

SEQ ID NO: 3639975 - RNA, 14 nt, Salmonella enterica enterica serovar Typhi
ccgcuucacauacc

SEQ ID NO: 3639976 - RNA, 17 nt, Salmonella enterica enterica serovar Typhi
ccgcuucacgcgcggcu

SEQ ID NO: 3639977 - RNA, 23 nt, Salmonella enterica enterica serovar Typhi
ccgcuucauuggcgucugcuggc

SEQ ID NO: 3639978 - RNA, 12 nt, Salmonella enterica enterica serovar Typhi
ccgcuuccagcg

SEQ ID NO: 3639979 - RNA, 17 nt, Salmonella enterica enterica serovar Typhi
ccgcuuccagcgcgucg

SEQ ID NO: 3639980 - RNA, 18 nt, Salmonella enterica enterica serovar Typhi
ccgcuuccagcgcgucgg

SEQ ID NO: 3639981 - RNA, 16 nt, Salmonella enterica enterica serovar Typhi
ccgcuucgcgcgccag

SEQ ID NO: 3639982 - RNA, 23 nt, Salmonella enterica enterica serovar Typhi
ccgcuucggacuccugacgcuga

SEQ ID NO: 3639983 - RNA, 15 nt, Salmonella enterica enterica serovar Typhi
ccgcuuuaccgccuu

SEQ ID NO: 3639984 - RNA, 13 nt, Salmonella enterica enterica serovar Typhi
ccgcuuugauuug

SEQ ID NO: 3639985 - RNA, 16 nt, Salmonella enterica enterica serovar Typhi
ccgcuuugccgcgcuc

SEQ ID NO: 3639986 - RNA, 16 nt, Salmonella enterica enterica serovar Typhi
ccgcuuugcgaacagc

SEQ ID NO: 3639987 - RNA, 12 nt, Salmonella enterica enterica serovar Typhi
ccgcuuuuccug

SEQ ID NO: 3639988 - RNA, 21 nt, Salmonella enterica enterica serovar Typhi
ccgcuuuugccgcgacuuccg

SEQ ID NO: 3639989 - RNA, 21 nt, Salmonella enterica enterica serovar Typhi
ccgcuuuugguuuuucaacca

SEQ ID NO: 3639990 - RNA, 16 nt, Salmonella enterica enterica serovar Typhi
ccgcuuuuuccagcau

SEQ ID NO: 3639991 - RNA, 17 nt, Salmonella enterica enterica serovar Typhi
ccgcuuuuuucagcggc

SEQ ID NO: 3639992 - RNA, 22 nt, Salmonella enterica enterica serovar Typhi
ccggaaagaauaaucgccgccg

SEQ ID NO: 3639993 - RNA, 23 nt, Salmonella enterica enterica serovar Typhi
ccggaaagaauaaucgccgccgg

SEQ ID NO: 3639994 - RNA, 21 nt, Salmonella enterica enterica serovar Typhi
ccggaaagacggcagcgccau

SEQ ID NO: 3639995 - RNA, 21 nt, Salmonella enterica enterica serovar Typhi
ccggaaaggauauaagcgcca

SEQ ID NO: 3639996 - RNA, 20 nt, Salmonella enterica enterica serovar Typhi
ccggaaauaaacgccagugg

SEQ ID NO: 3639997 - RNA, 14 nt, Salmonella enterica enterica serovar Typhi
ccggaaauaacguu

SEQ ID NO: 3639998 - RNA, 17 nt, Salmonella enterica enterica serovar Typhi
ccggaaaucgcggcgau

SEQ ID NO: 3639999 - RNA, 13 nt, Salmonella enterica enterica serovar Typhi
ccggaaaucugca

SEQ ID NO: 3640000 - RNA, 22 nt, Salmonella enterica enterica serovar Typhi
ccggaaauggucgcuccggaac

SEQ ID NO: 3640001 - RNA, 17 nt, Salmonella enterica enterica serovar Typhi
ccggaacaaaagaaagc

SEQ ID NO: 3640002 - RNA, 13 nt, Salmonella enterica enterica serovar Typhi
ccggaacagaagc

SEQ ID NO: 3640003 - RNA, 14 nt, Salmonella enterica enterica serovar Typhi
ccggaacagggccg

SEQ ID NO: 3640004 - RNA, 17 nt, Salmonella enterica enterica serovar Typhi
ccggaaccuguccuuua

SEQ ID NO: 3640005 - RNA, 18 nt, Salmonella enterica enterica serovar Typhi
ccggaacgcgagaagccc

SEQ ID NO: 3640006 - RNA, 13 nt, Salmonella enterica enterica serovar Typhi
ccggaauacacaa

SEQ ID NO: 3640007 - RNA, 19 nt, Salmonella enterica enterica serovar Typhi
ccggaaucgccugcgucgc

SEQ ID NO: 3640008 - RNA, 21 nt, Salmonella enterica enterica serovar Typhi
ccggaaucgccugcgucgccc

SEQ ID NO: 3640009 - RNA, 20 nt, Salmonella enterica enterica serovar Typhi
ccggaaugguauaaaucccg

SEQ ID NO: 3640010 - RNA, 20 nt, Salmonella enterica enterica serovar Typhi
ccggacaacgcaaacuguau

SEQ ID NO: 3640011 - RNA, 16 nt, Salmonella enterica enterica serovar Typhi
ccggacaaggcgcgcc

SEQ ID NO: 3640012 - RNA, 21 nt, Salmonella enterica enterica serovar Typhi
ccggaccuaauagccagcccc

SEQ ID NO: 3640013 - RNA, 22 nt, Salmonella enterica enterica serovar Typhi
ccggacgcaccagccaggcgau

SEQ ID NO: 3640014 - RNA, 13 nt, Salmonella enterica enterica serovar Typhi
ccggacgccacca

SEQ ID NO: 3640015 - RNA, 14 nt, Salmonella enterica enterica serovar Typhi
ccggacgccaccac

SEQ ID NO: 3640016 - RNA, 18 nt, Salmonella enterica enterica serovar Typhi
ccggacgccagugcgcau

SEQ ID NO: 3640017 - RNA, 17 nt, Salmonella enterica enterica serovar Typhi
ccggacuccagcaacgc

SEQ ID NO: 3640018 - RNA, 20 nt, Salmonella enterica enterica serovar Typhi
ccggacuccaggcaacguug

SEQ ID NO: 3640019 - RNA, 18 nt, Salmonella enterica enterica serovar Typhi
ccggagaccggcgaaauc

SEQ ID NO: 3640020 - RNA, 18 nt, Salmonella enterica enterica serovar Typhi
ccggagaguucauaacgc

SEQ ID NO: 3640021 - RNA, 18 nt, Salmonella enterica enterica serovar Typhi
ccggagauuuaucuucuc

SEQ ID NO: 3640022 - RNA, 22 nt, Salmonella enterica enterica serovar Typhi
ccggaggauauuuauucccccu

SEQ ID NO: 3640023 - RNA, 21 nt, Salmonella enterica enterica serovar Typhi
ccggagggcgaacuggcgguc

SEQ ID NO: 3640024 - RNA, 15 nt, Salmonella enterica enterica serovar Typhi
ccggagguuuuucug

SEQ ID NO: 3640025 - RNA, 22 nt, Salmonella enterica enterica serovar Typhi
ccggauaacggcgcgaaagcgc

SEQ ID NO: 3640026 - RNA, 20 nt, Salmonella enterica enterica serovar Typhi
ccggauaagcaacgcgccau

SEQ ID NO: 3640027 - RNA, 22 nt, Salmonella enterica enterica serovar Typhi
ccggauaagccgcguccggcaa

SEQ ID NO: 3640028 - RNA, 19 nt, Salmonella enterica enterica serovar Typhi
ccggauaagcggcagcgcc

SEQ ID NO: 3640029 - RNA, 21 nt, Salmonella enterica enterica serovar Typhi
ccggauaagcggcagcgccau

SEQ ID NO: 3640030 - RNA, 20 nt, Salmonella enterica enterica serovar Typhi
ccggauaagcgugagcgcau

SEQ ID NO: 3640031 - RNA, 22 nt, Salmonella enterica enterica serovar Typhi
ccggauaagcgugcgccauccg

SEQ ID NO: 3640032 - RNA, 21 nt, Salmonella enterica enterica serovar Typhi
ccggauaaggccacgccgcca

SEQ ID NO: 3640033 - RNA, 22 nt, Salmonella enterica enterica serovar Typhi
ccggauaaggcgcuugcgccau

SEQ ID NO: 3640034 - RNA, 21 nt, Salmonella enterica enterica serovar Typhi
ccggauaaggcgcuugcgccg

SEQ ID NO: 3640035 - RNA, 22 nt, Salmonella enterica enterica serovar Typhi
ccggauaaggcgcuugcgccgc

SEQ ID NO: 3640036 - RNA, 22 nt, Salmonella enterica enterica serovar Typhi
ccggauaaggcguucacgccgc

SEQ ID NO: 3640037 - RNA, 20 nt, Salmonella enterica enterica serovar Typhi
ccggauaauacgaaauugag

SEQ ID NO: 3640038 - RNA, 18 nt, Salmonella enterica enterica serovar Typhi
ccggauaauccagacaaa

SEQ ID NO: 3640039 - RNA, 23 nt, Salmonella enterica enterica serovar Typhi
ccggauaauuuauccaguaacgc

SEQ ID NO: 3640040 - RNA, 16 nt, Salmonella enterica enterica serovar Typhi
ccggauacaagguauc

SEQ ID NO: 3640041 - RNA, 19 nt, Salmonella enterica enterica serovar Typhi
ccggauagcguagcgccau

SEQ ID NO: 3640042 - RNA, 23 nt, Salmonella enterica enterica serovar Typhi
ccggaucaauaaacagcuccgca

SEQ ID NO: 3640043 - RNA, 13 nt, Salmonella enterica enterica serovar Typhi
ccggaucaucuuu

SEQ ID NO: 3640044 - RNA, 16 nt, Salmonella enterica enterica serovar Typhi
ccggaucgaucccggc

SEQ ID NO: 3640045 - RNA, 19 nt, Salmonella enterica enterica serovar Typhi
ccggaucgaucccggcaaa

SEQ ID NO: 3640046 - RNA, 13 nt, Salmonella enterica enterica serovar Typhi
ccggaucgcguuu

SEQ ID NO: 3640047 - RNA, 18 nt, Salmonella enterica enterica serovar Typhi
ccggaucgcuaauuuuua

SEQ ID NO: 3640048 - RNA, 16 nt, Salmonella enterica enterica serovar Typhi
ccggaucggccauauc

SEQ ID NO: 3640049 - RNA, 21 nt, Salmonella enterica enterica serovar Typhi
ccggaugaccagaacauggcc

SEQ ID NO: 3640050 - RNA, 22 nt, Salmonella enterica enterica serovar Typhi
ccggaugaggcgcagccgccau

SEQ ID NO: 3640051 - RNA, 16 nt, Salmonella enterica enterica serovar Typhi
ccggaugccccaucac

SEQ ID NO: 3640052 - RNA, 15 nt, Salmonella enterica enterica serovar Typhi
ccggaugcgacgcgc

SEQ ID NO: 3640053 - RNA, 15 nt, Salmonella enterica enterica serovar Typhi
ccggaugcgccucau

SEQ ID NO: 3640054 - RNA, 23 nt, Salmonella enterica enterica serovar Typhi
ccggaugcgccucaucugcuuca

SEQ ID NO: 3640055 - RNA, 13 nt, Salmonella enterica enterica serovar Typhi
ccggaugcggcua

SEQ ID NO: 3640056 - RNA, 22 nt, Salmonella enterica enterica serovar Typhi
ccggaugcguguucagguuggc

SEQ ID NO: 3640057 - RNA, 19 nt, Salmonella enterica enterica serovar Typhi
ccggauggcgcuaaugcuu

SEQ ID NO: 3640058 - RNA, 14 nt, Salmonella enterica enterica serovar Typhi
ccggauggcggcgc

SEQ ID NO: 3640059 - RNA, 21 nt, Salmonella enterica enterica serovar Typhi
ccggauggcggcgucgccugu

SEQ ID NO: 3640060 - RNA, 23 nt, Salmonella enterica enterica serovar Typhi
ccggauggcggcgugaacgccuu

SEQ ID NO: 3640061 - RNA, 23 nt, Salmonella enterica enterica serovar Typhi
ccggauggcggcgugaccgccuu

SEQ ID NO: 3640062 - RNA, 20 nt, Salmonella enterica enterica serovar Typhi
ccggauggcggcuacgccuu

SEQ ID NO: 3640063 - RNA, 22 nt, Salmonella enterica enterica serovar Typhi
ccggauggcggcugcgccuuau

SEQ ID NO: 3640064 - RNA, 21 nt, Salmonella enterica enterica serovar Typhi
ccggauggcggcuuugaacag

SEQ ID NO: 3640065 - RNA, 16 nt, Salmonella enterica enterica serovar Typhi
ccggaugugagcgcau

SEQ ID NO: 3640066 - RNA, 21 nt, Salmonella enterica enterica serovar Typhi
ccggauuagcgacagcgcuau

SEQ ID NO: 3640067 - RNA, 14 nt, Salmonella enterica enterica serovar Typhi
ccggauuccagaau

SEQ ID NO: 3640068 - RNA, 13 nt, Salmonella enterica enterica serovar Typhi
ccggauuuaccag

SEQ ID NO: 3640069 - RNA, 13 nt, Salmonella enterica enterica serovar Typhi
ccggauuuuaaau

SEQ ID NO: 3640070 - RNA, 20 nt, Salmonella enterica enterica serovar Typhi
ccggcaaaaagaaucgccag

SEQ ID NO: 3640071 - RNA, 17 nt, Salmonella enterica enterica serovar Typhi
ccggcaaaaaucagccc

SEQ ID NO: 3640072 - RNA, 14 nt, Salmonella enterica enterica serovar Typhi
ccggcaaacucagc

SEQ ID NO: 3640073 - RNA, 14 nt, Salmonella enterica enterica serovar Typhi
ccggcaaaggaauu

SEQ ID NO: 3640074 - RNA, 19 nt, Salmonella enterica enterica serovar Typhi
ccggcaacacccgccgaac

SEQ ID NO: 3640075 - RNA, 18 nt, Salmonella enterica enterica serovar Typhi
ccggcaaccugagcgcga

SEQ ID NO: 3640076 - RNA, 12 nt, Salmonella enterica enterica serovar Typhi
ccggcaacugcc

SEQ ID NO: 3640077 - RNA, 21 nt, Salmonella enterica enterica serovar Typhi
ccggcaauuaccgccagcggc

SEQ ID NO: 3640078 - RNA, 19 nt, Salmonella enterica enterica serovar Typhi
ccggcacaaugcccggcau

SEQ ID NO: 3640079 - RNA, 21 nt, Salmonella enterica enterica serovar Typhi
ccggcacaccggccauugccg

SEQ ID NO: 3640080 - RNA, 20 nt, Salmonella enterica enterica serovar Typhi
ccggcacauauuccggcgcu

SEQ ID NO: 3640081 - RNA, 13 nt, Salmonella enterica enterica serovar Typhi
ccggcacauccag

SEQ ID NO: 3640082 - RNA, 21 nt, Salmonella enterica enterica serovar Typhi
ccggcacauccagcgccugcu

SEQ ID NO: 3640083 - RNA, 17 nt, Salmonella enterica enterica serovar Typhi
ccggcaccucguccaga

SEQ ID NO: 3640084 - RNA, 22 nt, Salmonella enterica enterica serovar Typhi
ccggcacgauggucucaaucgc

SEQ ID NO: 3640085 - RNA, 18 nt, Salmonella enterica enterica serovar Typhi
ccggcacggucaaucauc

SEQ ID NO: 3640086 - RNA, 18 nt, Salmonella enterica enterica serovar Typhi
ccggcacuguucggggau

SEQ ID NO: 3640087 - RNA, 23 nt, Salmonella enterica enterica serovar Typhi
ccggcagaaaugaccacguacug

SEQ ID NO: 3640088 - RNA, 19 nt, Salmonella enterica enterica serovar Typhi
ccggcagacgauagcgggu

SEQ ID NO: 3640089 - RNA, 16 nt, Salmonella enterica enterica serovar Typhi
ccggcagccgcugaua

SEQ ID NO: 3640090 - RNA, 18 nt, Salmonella enterica enterica serovar Typhi
ccggcagcguaacgauau

SEQ ID NO: 3640091 - RNA, 23 nt, Salmonella enterica enterica serovar Typhi
ccggcagcgucggcuucaucaca

SEQ ID NO: 3640092 - RNA, 16 nt, Salmonella enterica enterica serovar Typhi
ccggcagcuuuugcgc

SEQ ID NO: 3640093 - RNA, 18 nt, Salmonella enterica enterica serovar Typhi
ccggcaggagcggagaga

SEQ ID NO: 3640094 - RNA, 20 nt, Salmonella enterica enterica serovar Typhi
ccggcaggagcggagagagc

SEQ ID NO: 3640095 - RNA, 15 nt, Salmonella enterica enterica serovar Typhi
ccggcaggcagcgcc

SEQ ID NO: 3640096 - RNA, 20 nt, Salmonella enterica enterica serovar Typhi
ccggcaggcagcgccagcgg

SEQ ID NO: 3640097 - RNA, 14 nt, Salmonella enterica enterica serovar Typhi
ccggcaggcgucau

SEQ ID NO: 3640098 - RNA, 19 nt, Salmonella enterica enterica serovar Typhi
ccggcaggcucaccagccc

SEQ ID NO: 3640099 - RNA, 12 nt, Salmonella enterica enterica serovar Typhi
ccggcaguccau

SEQ ID NO: 3640100 - RNA, 23 nt, Salmonella enterica enterica serovar Typhi
ccggcaguccuugcagccagaac

SEQ ID NO: 3640101 - RNA, 22 nt, Salmonella enterica enterica serovar Typhi
ccggcaguuauuuuacgggcgu

SEQ ID NO: 3640102 - RNA, 23 nt, Salmonella enterica enterica serovar Typhi
ccggcaucauucugcaggcgggu

SEQ ID NO: 3640103 - RNA, 14 nt, Salmonella enterica enterica serovar Typhi
ccggcaucggcagc

SEQ ID NO: 3640104 - RNA, 21 nt, Salmonella enterica enterica serovar Typhi
ccggcaugccauaaucgauau

SEQ ID NO: 3640105 - RNA, 16 nt, Salmonella enterica enterica serovar Typhi
ccggccacagcgccag

SEQ ID NO: 3640106 - RNA, 13 nt, Salmonella enterica enterica serovar Typhi
ccggccagcgcca

SEQ ID NO: 3640107 - RNA, 18 nt, Salmonella enterica enterica serovar Typhi
ccggccauugccgcgccg

SEQ ID NO: 3640108 - RNA, 20 nt, Salmonella enterica enterica serovar Typhi
ccggcccgcuaucaccgccc

SEQ ID NO: 3640109 - RNA, 21 nt, Salmonella enterica enterica serovar Typhi
ccggccuacacguaacccugu

SEQ ID NO: 3640110 - RNA, 13 nt, Salmonella enterica enterica serovar Typhi
ccggccuacagac

SEQ ID NO: 3640111 - RNA, 11 nt, Salmonella enterica enterica serovar Typhi
ccggccuacgu

SEQ ID NO: 3640112 - RNA, 16 nt, Salmonella enterica enterica serovar Typhi
ccggccuacguuuaug

SEQ ID NO: 3640113 - RNA, 20 nt, Salmonella enterica enterica serovar Typhi
ccggccuacucuugagccgg

SEQ ID NO: 3640114 - RNA, 17 nt, Salmonella enterica enterica serovar Typhi
ccggccucgcccgcgau

SEQ ID NO: 3640115 - RNA, 19 nt, Salmonella enterica enterica serovar Typhi
ccggccugcaaaccgccuc

SEQ ID NO: 3640116 - RNA, 22 nt, Salmonella enterica enterica serovar Typhi
ccggccugcagggaauaagcgc

SEQ ID NO: 3640117 - RNA, 13 nt, Salmonella enterica enterica serovar Typhi
ccggccuggcgca

SEQ ID NO: 3640118 - RNA, 22 nt, Salmonella enterica enterica serovar Typhi
ccggcgaaaaccgagcauccgc

SEQ ID NO: 3640119 - RNA, 17 nt, Salmonella enterica enterica serovar Typhi
ccggcgaaauagcguuc

SEQ ID NO: 3640120 - RNA, 20 nt, Salmonella enterica enterica serovar Typhi
ccggcgaaaucgugcgcccc

SEQ ID NO: 3640121 - RNA, 17 nt, Salmonella enterica enterica serovar Typhi
ccggcgaauagcgccag

SEQ ID NO: 3640122 - RNA, 18 nt, Salmonella enterica enterica serovar Typhi
ccggcgacagcgaccacg

SEQ ID NO: 3640123 - RNA, 18 nt, Salmonella enterica enterica serovar Typhi
ccggcgagugccugcugg

SEQ ID NO: 3640124 - RNA, 23 nt, Salmonella enterica enterica serovar Typhi
ccggcgauaacccgcgcauggcc

SEQ ID NO: 3640125 - RNA, 16 nt, Salmonella enterica enterica serovar Typhi
ccggcgauagcggccu

SEQ ID NO: 3640126 - RNA, 17 nt, Salmonella enterica enterica serovar Typhi
ccggcgauagcggccug

SEQ ID NO: 3640127 - RNA, 13 nt, Salmonella enterica enterica serovar Typhi
ccggcgauggugc

SEQ ID NO: 3640128 - RNA, 18 nt, Salmonella enterica enterica serovar Typhi
ccggcgauggugcggcgc

SEQ ID NO: 3640129 - RNA, 16 nt, Salmonella enterica enterica serovar Typhi
ccggcgauguuggcgc

SEQ ID NO: 3640130 - RNA, 14 nt, Salmonella enterica enterica serovar Typhi
ccggcgcagacggc

SEQ ID NO: 3640131 - RNA, 19 nt, Salmonella enterica enterica serovar Typhi
ccggcgcagcaucugcggc

SEQ ID NO: 3640132 - RNA, 14 nt, Salmonella enterica enterica serovar Typhi
ccggcgcagcgccc

SEQ ID NO: 3640133 - RNA, 14 nt, Salmonella enterica enterica serovar Typhi
ccggcgccagaagc

SEQ ID NO: 3640134 - RNA, 19 nt, Salmonella enterica enterica serovar Typhi
ccggcgccagcucaacgcc

SEQ ID NO: 3640135 - RNA, 16 nt, Salmonella enterica enterica serovar Typhi
ccggcgcccauccgcc

SEQ ID NO: 3640136 - RNA, 18 nt, Salmonella enterica enterica serovar Typhi
ccggcgccgaucaucccg

SEQ ID NO: 3640137 - RNA, 19 nt, Salmonella enterica enterica serovar Typhi
ccggcgccgaucaucccgc

SEQ ID NO: 3640138 - RNA, 11 nt, Salmonella enterica enterica serovar Typhi
ccggcgcgcca

SEQ ID NO: 3640139 - RNA, 13 nt, Salmonella enterica enterica serovar Typhi
ccggcgcgccagc

SEQ ID NO: 3640140 - RNA, 15 nt, Salmonella enterica enterica serovar Typhi
ccggcgcgcguggcu

SEQ ID NO: 3640141 - RNA, 16 nt, Salmonella enterica enterica serovar Typhi
ccggcgcgggcgagau

SEQ ID NO: 3640142 - RNA, 15 nt, Salmonella enterica enterica serovar Typhi
ccggcgcguaauucc

SEQ ID NO: 3640143 - RNA, 19 nt, Salmonella enterica enterica serovar Typhi
ccggcgcguuaauaccgug

SEQ ID NO: 3640144 - RNA, 20 nt, Salmonella enterica enterica serovar Typhi
ccggcgcguuaauaccgugc

SEQ ID NO: 3640145 - RNA, 18 nt, Salmonella enterica enterica serovar Typhi
ccggcgcuaaccagcgcu

SEQ ID NO: 3640146 - RNA, 19 nt, Salmonella enterica enterica serovar Typhi
ccggcgcucagccagaaac

SEQ ID NO: 3640147 - RNA, 20 nt, Salmonella enterica enterica serovar Typhi
ccggcgcugcgcggcgugca

SEQ ID NO: 3640148 - RNA, 22 nt, Salmonella enterica enterica serovar Typhi
ccggcgcuggacaaaccacagu

SEQ ID NO: 3640149 - RNA, 18 nt, Salmonella enterica enterica serovar Typhi
ccggcgcuggcgcuggcu

SEQ ID NO: 3640150 - RNA, 15 nt, Salmonella enterica enterica serovar Typhi
ccggcgcuuccugca

SEQ ID NO: 3640151 - RNA, 19 nt, Salmonella enterica enterica serovar Typhi
ccggcggcaaggucugcgc

SEQ ID NO: 3640152 - RNA, 17 nt, Salmonella enterica enterica serovar Typhi
ccggcggcgacuggcua

SEQ ID NO: 3640153 - RNA, 20 nt, Salmonella enterica enterica serovar Typhi
ccggcggucaugcuggcgau

SEQ ID NO: 3640154 - RNA, 23 nt, Salmonella enterica enterica serovar Typhi
ccggcggucgauuuugccuucaa

SEQ ID NO: 3640155 - RNA, 18 nt, Salmonella enterica enterica serovar Typhi
ccggcguaauugcgccug

SEQ ID NO: 3640156 - RNA, 14 nt, Salmonella enterica enterica serovar Typhi
ccggcguagcgcgc

SEQ ID NO: 3640157 - RNA, 23 nt, Salmonella enterica enterica serovar Typhi
ccggcguauugguacaacgcccu

SEQ ID NO: 3640158 - RNA, 17 nt, Salmonella enterica enterica serovar Typhi
ccggcguccccguucug

SEQ ID NO: 3640159 - RNA, 18 nt, Salmonella enterica enterica serovar Typhi
ccggcgucgaucagcgcg

SEQ ID NO: 3640160 - RNA, 17 nt, Salmonella enterica enterica serovar Typhi
ccggcgugacucagcgg

SEQ ID NO: 3640161 - RNA, 13 nt, Salmonella enterica enterica serovar Typhi
ccggcgugauaaa

SEQ ID NO: 3640162 - RNA, 21 nt, Salmonella enterica enterica serovar Typhi
ccggcgugugucccggacaau

SEQ ID NO: 3640163 - RNA, 16 nt, Salmonella enterica enterica serovar Typhi
ccggcguuacuccgcg

SEQ ID NO: 3640164 - RNA, 22 nt, Salmonella enterica enterica serovar Typhi
ccggcguuucguuuagcgccug

SEQ ID NO: 3640165 - RNA, 17 nt, Salmonella enterica enterica serovar Typhi
ccggcguuuuagcgcca

SEQ ID NO: 3640166 - RNA, 18 nt, Salmonella enterica enterica serovar Typhi
ccggcguuuuagcgccau

SEQ ID NO: 3640167 - RNA, 19 nt, Salmonella enterica enterica serovar Typhi
ccggcuaaaugacgcgcga

SEQ ID NO: 3640168 - RNA, 21 nt, Salmonella enterica enterica serovar Typhi
ccggcuaugccggaggauauu

SEQ ID NO: 3640169 - RNA, 23 nt, Salmonella enterica enterica serovar Typhi
ccggcuccgaccaucgccgcgaa

SEQ ID NO: 3640170 - RNA, 13 nt, Salmonella enterica enterica serovar Typhi
ccggcuccggcaa

SEQ ID NO: 3640171 - RNA, 11 nt, Salmonella enterica enterica serovar Typhi
ccggcucgccu

SEQ ID NO: 3640172 - RNA, 18 nt, Salmonella enterica enterica serovar Typhi
ccggcucgccuugcgguu

SEQ ID NO: 3640173 - RNA, 15 nt, Salmonella enterica enterica serovar Typhi
ccggcugccauuauc

SEQ ID NO: 3640174 - RNA, 21 nt, Salmonella enterica enterica serovar Typhi
ccggcugcgucgcuucuuguu

SEQ ID NO: 3640175 - RNA, 19 nt, Salmonella enterica enterica serovar Typhi
ccggcuuaaugcccggccc

SEQ ID NO: 3640176 - RNA, 20 nt, Salmonella enterica enterica serovar Typhi
ccggcuuaaugcccggcccg

SEQ ID NO: 3640177 - RNA, 16 nt, Salmonella enterica enterica serovar Typhi
ccggcuuaccggcuau

SEQ ID NO: 3640178 - RNA, 11 nt, Salmonella enterica enterica serovar Typhi
ccggcuucagc

SEQ ID NO: 3640179 - RNA, 12 nt, Salmonella enterica enterica serovar Typhi
ccggcuucagca

SEQ ID NO: 3640180 - RNA, 16 nt, Salmonella enterica enterica serovar Typhi
ccggcuuccagcggcg

SEQ ID NO: 3640181 - RNA, 22 nt, Salmonella enterica enterica serovar Typhi
ccggcuuuaugauggugagagc

SEQ ID NO: 3640182 - RNA, 16 nt, Salmonella enterica enterica serovar Typhi
ccggcuuuuuucaccu

SEQ ID NO: 3640183 - RNA, 20 nt, Salmonella enterica enterica serovar Typhi
ccgggaaaagcgguaucacg

SEQ ID NO: 3640184 - RNA, 22 nt, Salmonella enterica enterica serovar Typhi
ccgggaaagcggaucggaacgc

SEQ ID NO: 3640185 - RNA, 20 nt, Salmonella enterica enterica serovar Typhi
ccgggaaaucuucuacuuca

SEQ ID NO: 3640186 - RNA, 21 nt, Salmonella enterica enterica serovar Typhi
ccgggaaauggcaauggcggc

SEQ ID NO: 3640187 - RNA, 18 nt, Salmonella enterica enterica serovar Typhi
ccgggaaaugucuggcgc

SEQ ID NO: 3640188 - RNA, 19 nt, Salmonella enterica enterica serovar Typhi
ccgggaaaugucuggcgcu

SEQ ID NO: 3640189 - RNA, 13 nt, Salmonella enterica enterica serovar Typhi
ccgggaacuggca

SEQ ID NO: 3640190 - RNA, 13 nt, Salmonella enterica enterica serovar Typhi
ccgggacuucagg

SEQ ID NO: 3640191 - RNA, 19 nt, Salmonella enterica enterica serovar Typhi
ccgggagaaaacgcggccu

SEQ ID NO: 3640192 - RNA, 14 nt, Salmonella enterica enterica serovar Typhi
ccgggauaaucagg

SEQ ID NO: 3640193 - RNA, 15 nt, Salmonella enterica enterica serovar Typhi
ccgggauaaucaggu

SEQ ID NO: 3640194 - RNA, 13 nt, Salmonella enterica enterica serovar Typhi
ccgggauauaaaa

SEQ ID NO: 3640195 - RNA, 23 nt, Salmonella enterica enterica serovar Typhi
ccgggaucuuuuucagccguuca

SEQ ID NO: 3640196 - RNA, 14 nt, Salmonella enterica enterica serovar Typhi
ccgggcacgauggc

SEQ ID NO: 3640197 - RNA, 21 nt, Salmonella enterica enterica serovar Typhi
ccgggcagacaucgccgugcu

SEQ ID NO: 3640198 - RNA, 22 nt, Salmonella enterica enterica serovar Typhi
ccgggcagcaucucgauuacag

SEQ ID NO: 3640199 - RNA, 16 nt, Salmonella enterica enterica serovar Typhi
ccgggcauaaaaaaag

SEQ ID NO: 3640200 - RNA, 17 nt, Salmonella enterica enterica serovar Typhi
ccgggccaaugccgccu

SEQ ID NO: 3640201 - RNA, 12 nt, Salmonella enterica enterica serovar Typhi
ccgggccacucu

SEQ ID NO: 3640202 - RNA, 20 nt, Salmonella enterica enterica serovar Typhi
ccgggccaucuuuuuucacu

SEQ ID NO: 3640203 - RNA, 13 nt, Salmonella enterica enterica serovar Typhi
ccgggccgucagg

SEQ ID NO: 3640204 - RNA, 16 nt, Salmonella enterica enterica serovar Typhi
ccgggccugagcgcgc

SEQ ID NO: 3640205 - RNA, 17 nt, Salmonella enterica enterica serovar Typhi
ccgggccugagcgcgca

SEQ ID NO: 3640206 - RNA, 17 nt, Salmonella enterica enterica serovar Typhi
ccgggcgacacgcgcgc

SEQ ID NO: 3640207 - RNA, 21 nt, Salmonella enterica enterica serovar Typhi
ccgggcgagauuacugcgugc

SEQ ID NO: 3640208 - RNA, 22 nt, Salmonella enterica enterica serovar Typhi
ccgggcgcaccaguuccccaua

SEQ ID NO: 3640209 - RNA, 16 nt, Salmonella enterica enterica serovar Typhi
ccgggcgcuuaccuaa

SEQ ID NO: 3640210 - RNA, 12 nt, Salmonella enterica enterica serovar Typhi
ccgggcggcgca

SEQ ID NO: 3640211 - RNA, 17 nt, Salmonella enterica enterica serovar Typhi
ccgggcggcgcagcgcg

SEQ ID NO: 3640212 - RNA, 16 nt, Salmonella enterica enterica serovar Typhi
ccgggcgucacccgcc

SEQ ID NO: 3640213 - RNA, 14 nt, Salmonella enterica enterica serovar Typhi
ccgggcugcacgcc

SEQ ID NO: 3640214 - RNA, 18 nt, Salmonella enterica enterica serovar Typhi
ccgggcuggcaaacaggc

SEQ ID NO: 3640215 - RNA, 13 nt, Salmonella enterica enterica serovar Typhi
ccgggcuucagga

SEQ ID NO: 3640216 - RNA, 17 nt, Salmonella enterica enterica serovar Typhi
ccggggaagcgcgcgca

SEQ ID NO: 3640217 - RNA, 14 nt, Salmonella enterica enterica serovar Typhi
ccggggcuggcggc

SEQ ID NO: 3640218 - RNA, 20 nt, Salmonella enterica enterica serovar Typhi
ccggggcuggcggcgauggc

SEQ ID NO: 3640219 - RNA, 19 nt, Salmonella enterica enterica serovar Typhi
ccgggguaucuguuuauuc

SEQ ID NO: 3640220 - RNA, 14 nt, Salmonella enterica enterica serovar Typhi
ccggguaaacgcca

SEQ ID NO: 3640221 - RNA, 15 nt, Salmonella enterica enterica serovar Typhi
ccggguaaacgccau

SEQ ID NO: 3640222 - RNA, 14 nt, Salmonella enterica enterica serovar Typhi
ccggguacaaaaac

SEQ ID NO: 3640223 - RNA, 19 nt, Salmonella enterica enterica serovar Typhi
ccggguaucgcuuucggca

SEQ ID NO: 3640224 - RNA, 22 nt, Salmonella enterica enterica serovar Typhi
ccgggucagcgggguucagacc

SEQ ID NO: 3640225 - RNA, 23 nt, Salmonella enterica enterica serovar Typhi
ccgggucggacgagcgcgucagc

SEQ ID NO: 3640226 - RNA, 20 nt, Salmonella enterica enterica serovar Typhi
ccgggugcaaauccaucuca

SEQ ID NO: 3640227 - RNA, 14 nt, Salmonella enterica enterica serovar Typhi
ccggguuaaagccc

SEQ ID NO: 3640228 - RNA, 20 nt, Salmonella enterica enterica serovar Typhi
ccggguucagcgacaggcug

SEQ ID NO: 3640229 - RNA, 19 nt, Salmonella enterica enterica serovar Typhi
ccggguucgcccggcauga

SEQ ID NO: 3640230 - RNA, 18 nt, Salmonella enterica enterica serovar Typhi
ccgguaaagcagugcagu

SEQ ID NO: 3640231 - RNA, 19 nt, Salmonella enterica enterica serovar Typhi
ccgguaaagcagugcagua

SEQ ID NO: 3640232 - RNA, 22 nt, Salmonella enterica enterica serovar Typhi
ccgguaacgauaaaaugcaaau

SEQ ID NO: 3640233 - RNA, 16 nt, Salmonella enterica enterica serovar Typhi
ccgguaacgccguagg

SEQ ID NO: 3640234 - RNA, 17 nt, Salmonella enterica enterica serovar Typhi
ccgguaagcgcagcgcc

SEQ ID NO: 3640235 - RNA, 19 nt, Salmonella enterica enterica serovar Typhi
ccgguaagcgcagcgccac

SEQ ID NO: 3640236 - RNA, 14 nt, Salmonella enterica enterica serovar Typhi
ccgguagcauccgc

SEQ ID NO: 3640237 - RNA, 15 nt, Salmonella enterica enterica serovar Typhi
ccgguagccaggcgc

SEQ ID NO: 3640238 - RNA, 17 nt, Salmonella enterica enterica serovar Typhi
ccgguagccaggcgcga

SEQ ID NO: 3640239 - RNA, 17 nt, Salmonella enterica enterica serovar Typhi
ccgguagcgagaagccg

SEQ ID NO: 3640240 - RNA, 19 nt, Salmonella enterica enterica serovar Typhi
ccgguagcuucagcggcgc

SEQ ID NO: 3640241 - RNA, 17 nt, Salmonella enterica enterica serovar Typhi
ccgguauaaaaccccuu

SEQ ID NO: 3640242 - RNA, 21 nt, Salmonella enterica enterica serovar Typhi
ccggucaauacaucacgcaac

SEQ ID NO: 3640243 - RNA, 13 nt, Salmonella enterica enterica serovar Typhi
ccggucauccagc

SEQ ID NO: 3640244 - RNA, 18 nt, Salmonella enterica enterica serovar Typhi
ccggucaucgcggaaagc

SEQ ID NO: 3640245 - RNA, 20 nt, Salmonella enterica enterica serovar Typhi
ccggucauguuccaacaaug

SEQ ID NO: 3640246 - RNA, 23 nt, Salmonella enterica enterica serovar Typhi
ccggucgccguuaacuggcgcau

SEQ ID NO: 3640247 - RNA, 21 nt, Salmonella enterica enterica serovar Typhi
ccggucgcgccagcgaccacc

SEQ ID NO: 3640248 - RNA, 20 nt, Salmonella enterica enterica serovar Typhi
ccggucuacaagugauacgg

SEQ ID NO: 3640249 - RNA, 14 nt, Salmonella enterica enterica serovar Typhi
ccggucuggcucac

SEQ ID NO: 3640250 - RNA, 23 nt, Salmonella enterica enterica serovar Typhi
ccggugccguuaauuuucacgca

SEQ ID NO: 3640251 - RNA, 15 nt, Salmonella enterica enterica serovar Typhi
ccggugcgccccagc

SEQ ID NO: 3640252 - RNA, 19 nt, Salmonella enterica enterica serovar Typhi
ccggugcggcaagcgcgcu

SEQ ID NO: 3640253 - RNA, 16 nt, Salmonella enterica enterica serovar Typhi
ccgguggcgccacgcc

SEQ ID NO: 3640254 - RNA, 16 nt, Salmonella enterica enterica serovar Typhi
ccgguggcgcugcgcu

SEQ ID NO: 3640255 - RNA, 17 nt, Salmonella enterica enterica serovar Typhi
ccgguggcgcugcgcuu

SEQ ID NO: 3640256 - RNA, 15 nt, Salmonella enterica enterica serovar Typhi
ccgguggcguggcgc

SEQ ID NO: 3640257 - RNA, 15 nt, Salmonella enterica enterica serovar Typhi
ccggugggcauauga

SEQ ID NO: 3640258 - RNA, 23 nt, Salmonella enterica enterica serovar Typhi
ccgguggucuguucgagggcgau

SEQ ID NO: 3640259 - RNA, 15 nt, Salmonella enterica enterica serovar Typhi
ccgguguagcuggca

SEQ ID NO: 3640260 - RNA, 16 nt, Salmonella enterica enterica serovar Typhi
ccgguuauccauauga

SEQ ID NO: 3640261 - RNA, 21 nt, Salmonella enterica enterica serovar Typhi
ccgguuccagcggccgcuccg

SEQ ID NO: 3640262 - RNA, 17 nt, Salmonella enterica enterica serovar Typhi
ccgguucggcaucgccc

SEQ ID NO: 3640263 - RNA, 18 nt, Salmonella enterica enterica serovar Typhi
ccgguugaccggcccgcu

SEQ ID NO: 3640264 - RNA, 21 nt, Salmonella enterica enterica serovar Typhi
ccgguugcccauuuugcgguu

SEQ ID NO: 3640265 - RNA, 13 nt, Salmonella enterica enterica serovar Typhi
ccgguugcgcgcu

SEQ ID NO: 3640266 - RNA, 21 nt, Salmonella enterica enterica serovar Typhi
ccgguuugucauucgccucaa

SEQ ID NO: 3640267 - RNA, 22 nt, Salmonella enterica enterica serovar Typhi
ccgguuuuacuauugccgauaa

SEQ ID NO: 3640268 - RNA, 13 nt, Salmonella enterica enterica serovar Typhi
ccgguuuuuuaau

SEQ ID NO: 3640269 - RNA, 23 nt, Salmonella enterica enterica serovar Typhi
ccgguuuuuuuuugccugaaaug

SEQ ID NO: 3640270 - RNA, 13 nt, Salmonella enterica enterica serovar Typhi
ccguaaaguuccc

SEQ ID NO: 3640271 - RNA, 13 nt, Salmonella enterica enterica serovar Typhi
ccguaacgaacgc

SEQ ID NO: 3640272 - RNA, 19 nt, Salmonella enterica enterica serovar Typhi
ccguaagcggcggaccagc

SEQ ID NO: 3640273 - RNA, 15 nt, Salmonella enterica enterica serovar Typhi
ccguaauaaguauca

SEQ ID NO: 3640274 - RNA, 19 nt, Salmonella enterica enterica serovar Typhi
ccguaaucaucgcgaucgc

SEQ ID NO: 3640275 - RNA, 23 nt, Salmonella enterica enterica serovar Typhi
ccguacagccuaaaaaaccggcc

SEQ ID NO: 3640276 - RNA, 21 nt, Salmonella enterica enterica serovar Typhi
ccguaccagccguagcugcug

SEQ ID NO: 3640277 - RNA, 15 nt, Salmonella enterica enterica serovar Typhi
ccguacgauguucga

SEQ ID NO: 3640278 - RNA, 16 nt, Salmonella enterica enterica serovar Typhi
ccguacuccagcccau

SEQ ID NO: 3640279 - RNA, 15 nt, Salmonella enterica enterica serovar Typhi
ccguagcgacgccau

SEQ ID NO: 3640280 - RNA, 19 nt, Salmonella enterica enterica serovar Typhi
ccguagcguacuuucaaau

SEQ ID NO: 3640281 - RNA, 19 nt, Salmonella enterica enterica serovar Typhi
ccguaggccggauaagacg

SEQ ID NO: 3640282 - RNA, 16 nt, Salmonella enterica enterica serovar Typhi
ccguaguagguaucca

SEQ ID NO: 3640283 - RNA, 19 nt, Salmonella enterica enterica serovar Typhi
ccguaucacuaauuugcga

SEQ ID NO: 3640284 - RNA, 20 nt, Salmonella enterica enterica serovar Typhi
ccguauguaaacgcauuaau

SEQ ID NO: 3640285 - RNA, 15 nt, Salmonella enterica enterica serovar Typhi
ccguauucaggcgau

SEQ ID NO: 3640286 - RNA, 19 nt, Salmonella enterica enterica serovar Typhi
ccgucaaaacgcgcauccu

SEQ ID NO: 3640287 - RNA, 17 nt, Salmonella enterica enterica serovar Typhi
ccgucaaaaugaucaga

SEQ ID NO: 3640288 - RNA, 18 nt, Salmonella enterica enterica serovar Typhi
ccgucaaagaaaacuuuc

SEQ ID NO: 3640289 - RNA, 22 nt, Salmonella enterica enterica serovar Typhi
ccgucaaaguugguucccagca

SEQ ID NO: 3640290 - RNA, 16 nt, Salmonella enterica enterica serovar Typhi
ccgucaacacgcagac

SEQ ID NO: 3640291 - RNA, 20 nt, Salmonella enterica enterica serovar Typhi
ccgucaaugccuggcagacg

SEQ ID NO: 3640292 - RNA, 12 nt, Salmonella enterica enterica serovar Typhi
ccgucacaaagc

SEQ ID NO: 3640293 - RNA, 20 nt, Salmonella enterica enterica serovar Typhi
ccgucacaccaucccggcgu

SEQ ID NO: 3640294 - RNA, 18 nt, Salmonella enterica enterica serovar Typhi
ccgucacaggcggccagg

SEQ ID NO: 3640295 - RNA, 18 nt, Salmonella enterica enterica serovar Typhi
ccgucagaauggcgcguu

SEQ ID NO: 3640296 - RNA, 17 nt, Salmonella enterica enterica serovar Typhi
ccgucagauucugcggu

SEQ ID NO: 3640297 - RNA, 22 nt, Salmonella enterica enterica serovar Typhi
ccgucaggaacggauaacgacg

SEQ ID NO: 3640298 - RNA, 18 nt, Salmonella enterica enterica serovar Typhi
ccgucagggcgaggccca

SEQ ID NO: 3640299 - RNA, 23 nt, Salmonella enterica enterica serovar Typhi
ccgucagucgccagaaggcaggc

SEQ ID NO: 3640300 - RNA, 18 nt, Salmonella enterica enterica serovar Typhi
ccgucauaaucgcgauac

SEQ ID NO: 3640301 - RNA, 20 nt, Salmonella enterica enterica serovar Typhi
ccgucauauagccgcgcagu

SEQ ID NO: 3640302 - RNA, 16 nt, Salmonella enterica enterica serovar Typhi
ccgucaugauguuugu

SEQ ID NO: 3640303 - RNA, 15 nt, Salmonella enterica enterica serovar Typhi
ccguccacauccagc

SEQ ID NO: 3640304 - RNA, 19 nt, Salmonella enterica enterica serovar Typhi
ccguccacauccagcgcca

SEQ ID NO: 3640305 - RNA, 15 nt, Salmonella enterica enterica serovar Typhi
ccguccaccuggccc

SEQ ID NO: 3640306 - RNA, 21 nt, Salmonella enterica enterica serovar Typhi
ccgucccacgcgccgccgaac

SEQ ID NO: 3640307 - RNA, 20 nt, Salmonella enterica enterica serovar Typhi
ccgucccuuccgccaccagg

SEQ ID NO: 3640308 - RNA, 15 nt, Salmonella enterica enterica serovar Typhi
ccguccgccaggccc

SEQ ID NO: 3640309 - RNA, 17 nt, Salmonella enterica enterica serovar Typhi
ccguccggcaaacccuu

SEQ ID NO: 3640310 - RNA, 17 nt, Salmonella enterica enterica serovar Typhi
ccgucgauaaaauccuc

SEQ ID NO: 3640311 - RNA, 15 nt, Salmonella enterica enterica serovar Typhi
ccgucgaugauggcg

SEQ ID NO: 3640312 - RNA, 17 nt, Salmonella enterica enterica serovar Typhi
ccgucgaugauggcggc

SEQ ID NO: 3640313 - RNA, 23 nt, Salmonella enterica enterica serovar Typhi
ccgucgcgcccacgcgcggcauc

SEQ ID NO: 3640314 - RNA, 13 nt, Salmonella enterica enterica serovar Typhi
ccgucgcgcuuac

SEQ ID NO: 3640315 - RNA, 13 nt, Salmonella enterica enterica serovar Typhi
ccgucgcggcauc

SEQ ID NO: 3640316 - RNA, 17 nt, Salmonella enterica enterica serovar Typhi
ccgucgcggcuuucagc

SEQ ID NO: 3640317 - RNA, 14 nt, Salmonella enterica enterica serovar Typhi
ccgucggcaauaaa

SEQ ID NO: 3640318 - RNA, 18 nt, Salmonella enterica enterica serovar Typhi
ccgucggcaauuaacauu

SEQ ID NO: 3640319 - RNA, 16 nt, Salmonella enterica enterica serovar Typhi
ccgucggcgucugcgc

SEQ ID NO: 3640320 - RNA, 17 nt, Salmonella enterica enterica serovar Typhi
ccgucguagccaccauc

SEQ ID NO: 3640321 - RNA, 19 nt, Salmonella enterica enterica serovar Typhi
ccgucgucaccgccgcgcu

SEQ ID NO: 3640322 - RNA, 16 nt, Salmonella enterica enterica serovar Typhi
ccgucgugccugcggu

SEQ ID NO: 3640323 - RNA, 18 nt, Salmonella enterica enterica serovar Typhi
ccgucguuaacaucauca

SEQ ID NO: 3640324 - RNA, 17 nt, Salmonella enterica enterica serovar Typhi
ccgucguuaaucagcgc

SEQ ID NO: 3640325 - RNA, 16 nt, Salmonella enterica enterica serovar Typhi
ccgucguuacccuccu

SEQ ID NO: 3640326 - RNA, 16 nt, Salmonella enterica enterica serovar Typhi
ccgucucaaaguugcc

SEQ ID NO: 3640327 - RNA, 15 nt, Salmonella enterica enterica serovar Typhi
ccgucucaaccagca

SEQ ID NO: 3640328 - RNA, 19 nt, Salmonella enterica enterica serovar Typhi
ccgucucaaccagcaauga

SEQ ID NO: 3640329 - RNA, 13 nt, Salmonella enterica enterica serovar Typhi
ccgucucaccagg

SEQ ID NO: 3640330 - RNA, 22 nt, Salmonella enterica enterica serovar Typhi
ccgucuccuccuugugggcagc

SEQ ID NO: 3640331 - RNA, 11 nt, Salmonella enterica enterica serovar Typhi
ccgucucgguu

SEQ ID NO: 3640332 - RNA, 20 nt, Salmonella enterica enterica serovar Typhi
ccgucucuuuaucuaacugc

SEQ ID NO: 3640333 - RNA, 22 nt, Salmonella enterica enterica serovar Typhi
ccgucucuuuaucuaacugcgg

SEQ ID NO: 3640334 - RNA, 17 nt, Salmonella enterica enterica serovar Typhi
ccgucucuuuuugcagc

SEQ ID NO: 3640335 - RNA, 14 nt, Salmonella enterica enterica serovar Typhi
ccgucugcaaaauu

SEQ ID NO: 3640336 - RNA, 18 nt, Salmonella enterica enterica serovar Typhi
ccgucuggcgugccgggc

SEQ ID NO: 3640337 - RNA, 18 nt, Salmonella enterica enterica serovar Typhi
ccgucuuacgaucccacg

SEQ ID NO: 3640338 - RNA, 22 nt, Salmonella enterica enterica serovar Typhi
ccgugaauaaugaccagcgccc

SEQ ID NO: 3640339 - RNA, 13 nt, Salmonella enterica enterica serovar Typhi
ccgugaauagagc

SEQ ID NO: 3640340 - RNA, 23 nt, Salmonella enterica enterica serovar Typhi
ccgugaaugcccggcggcgcgau

SEQ ID NO: 3640341 - RNA, 18 nt, Salmonella enterica enterica serovar Typhi
ccgugaauguccugcggc

SEQ ID NO: 3640342 - RNA, 13 nt, Salmonella enterica enterica serovar Typhi
ccgugaauuccgg

SEQ ID NO: 3640343 - RNA, 16 nt, Salmonella enterica enterica serovar Typhi
ccgugaccgcguuauc

SEQ ID NO: 3640344 - RNA, 16 nt, Salmonella enterica enterica serovar Typhi
ccgugacgucccacaa

SEQ ID NO: 3640345 - RNA, 21 nt, Salmonella enterica enterica serovar Typhi
ccgugauaauaguggugcgca

SEQ ID NO: 3640346 - RNA, 23 nt, Salmonella enterica enterica serovar Typhi
ccgugaugcggacgcugacgcca

SEQ ID NO: 3640347 - RNA, 19 nt, Salmonella enterica enterica serovar Typhi
ccgugcaaaaucacgcggc

SEQ ID NO: 3640348 - RNA, 13 nt, Salmonella enterica enterica serovar Typhi
ccgugcccagcau

SEQ ID NO: 3640349 - RNA, 14 nt, Salmonella enterica enterica serovar Typhi
ccgugcccagcauc

SEQ ID NO: 3640350 - RNA, 16 nt, Salmonella enterica enterica serovar Typhi
ccgugccguguaaggc

SEQ ID NO: 3640351 - RNA, 14 nt, Salmonella enterica enterica serovar Typhi
ccgugccugcuccg

SEQ ID NO: 3640352 - RNA, 15 nt, Salmonella enterica enterica serovar Typhi
ccguggcauucgcuu

SEQ ID NO: 3640353 - RNA, 18 nt, Salmonella enterica enterica serovar Typhi
ccguggugaccgccagau

SEQ ID NO: 3640354 - RNA, 17 nt, Salmonella enterica enterica serovar Typhi
ccguggugggguucccg

SEQ ID NO: 3640355 - RNA, 23 nt, Salmonella enterica enterica serovar Typhi
ccgugucaucauuacaggcgaau

SEQ ID NO: 3640356 - RNA, 14 nt, Salmonella enterica enterica serovar Typhi
ccguguccaaacug

SEQ ID NO: 3640357 - RNA, 15 nt, Salmonella enterica enterica serovar Typhi
ccguguggucgcggc

SEQ ID NO: 3640358 - RNA, 23 nt, Salmonella enterica enterica serovar Typhi
ccguuaaaccaaagguauugccu

SEQ ID NO: 3640359 - RNA, 15 nt, Salmonella enterica enterica serovar Typhi
ccguuaacugcugcu

SEQ ID NO: 3640360 - RNA, 13 nt, Salmonella enterica enterica serovar Typhi
ccguuaagcccug

SEQ ID NO: 3640361 - RNA, 13 nt, Salmonella enterica enterica serovar Typhi
ccguuaagcugga

SEQ ID NO: 3640362 - RNA, 18 nt, Salmonella enterica enterica serovar Typhi
ccguuaaucuggccuacg

SEQ ID NO: 3640363 - RNA, 18 nt, Salmonella enterica enterica serovar Typhi
ccguuacgcagucagcac

SEQ ID NO: 3640364 - RNA, 14 nt, Salmonella enterica enterica serovar Typhi
ccguuauccggcaa

SEQ ID NO: 3640365 - RNA, 18 nt, Salmonella enterica enterica serovar Typhi
ccguucauaguuugcaua

SEQ ID NO: 3640366 - RNA, 19 nt, Salmonella enterica enterica serovar Typhi
ccguucaucgguaauauua

SEQ ID NO: 3640367 - RNA, 23 nt, Salmonella enterica enterica serovar Typhi
ccguucaucuaucgccagcgcgu

SEQ ID NO: 3640368 - RNA, 20 nt, Salmonella enterica enterica serovar Typhi
ccguucauucgccccagcau

SEQ ID NO: 3640369 - RNA, 23 nt, Salmonella enterica enterica serovar Typhi
ccguuccauuccagaaucuggcc

SEQ ID NO: 3640370 - RNA, 22 nt, Salmonella enterica enterica serovar Typhi
ccguucccucgacaauuucacc

SEQ ID NO: 3640371 - RNA, 18 nt, Salmonella enterica enterica serovar Typhi
ccguucugugcgccgcug

SEQ ID NO: 3640372 - RNA, 13 nt, Salmonella enterica enterica serovar Typhi
ccguucuuccugg

SEQ ID NO: 3640373 - RNA, 17 nt, Salmonella enterica enterica serovar Typhi
ccguugaccagcugacg

SEQ ID NO: 3640374 - RNA, 20 nt, Salmonella enterica enterica serovar Typhi
ccguugcaauauaguugagc

SEQ ID NO: 3640375 - RNA, 23 nt, Salmonella enterica enterica serovar Typhi
ccguugccacccaaugauccgga

SEQ ID NO: 3640376 - RNA, 17 nt, Salmonella enterica enterica serovar Typhi
ccguugcgcccaucauc

SEQ ID NO: 3640377 - RNA, 14 nt, Salmonella enterica enterica serovar Typhi
ccguugcgucacga

SEQ ID NO: 3640378 - RNA, 16 nt, Salmonella enterica enterica serovar Typhi
ccguuguuuggcagga

SEQ ID NO: 3640379 - RNA, 18 nt, Salmonella enterica enterica serovar Typhi
ccguuuaccggugcagac

SEQ ID NO: 3640380 - RNA, 20 nt, Salmonella enterica enterica serovar Typhi
ccguuuaucguuaccggcuc

SEQ ID NO: 3640381 - RNA, 17 nt, Salmonella enterica enterica serovar Typhi
ccguuucagccccuugc

SEQ ID NO: 3640382 - RNA, 20 nt, Salmonella enterica enterica serovar Typhi
ccguuuccgcaauaagugca

SEQ ID NO: 3640383 - RNA, 21 nt, Salmonella enterica enterica serovar Typhi
ccguuucuuuuucgaucagca

SEQ ID NO: 3640384 - RNA, 12 nt, Salmonella enterica enterica serovar Typhi
ccguuugccaua

SEQ ID NO: 3640385 - RNA, 12 nt, Salmonella enterica enterica serovar Typhi
ccguuuguaaca

SEQ ID NO: 3640386 - RNA, 19 nt, Salmonella enterica enterica serovar Typhi
ccguuuguaacauauuuuu

SEQ ID NO: 3640387 - RNA, 23 nt, Salmonella enterica enterica serovar Typhi
ccguuuguacaucuacuucagca

SEQ ID NO: 3640388 - RNA, 13 nt, Salmonella enterica enterica serovar Typhi
ccguuuguuuauu

SEQ ID NO: 3640389 - RNA, 18 nt, Salmonella enterica enterica serovar Typhi
ccguuuuaccuucugccg

SEQ ID NO: 3640390 - RNA, 21 nt, Salmonella enterica enterica serovar Typhi
ccguuuucgcccccagcacga

SEQ ID NO: 3640391 - RNA, 17 nt, Salmonella enterica enterica serovar Typhi
ccguuuucgucaacaua

SEQ ID NO: 3640392 - RNA, 19 nt, Salmonella enterica enterica serovar Typhi
ccguuuucuccuucaucca

SEQ ID NO: 3640393 - RNA, 23 nt, Salmonella enterica enterica serovar Typhi
ccguuuuuaucuccccaauugcu

SEQ ID NO: 3640394 - RNA, 23 nt, Salmonella enterica enterica serovar Typhi
ccguuuuuuuaugcagccgauag

SEQ ID NO: 3640395 - RNA, 13 nt, Salmonella enterica enterica serovar Typhi
ccuaaagaaaaac

SEQ ID NO: 3640396 - RNA, 21 nt, Salmonella enterica enterica serovar Typhi
ccuaaauccguuaagcccuga

SEQ ID NO: 3640397 - RNA, 21 nt, Salmonella enterica enterica serovar Typhi
ccuaacacaugcaagucgaac

SEQ ID NO: 3640398 - RNA, 16 nt, Salmonella enterica enterica serovar Typhi
ccuaacaggcgcauac

SEQ ID NO: 3640399 - RNA, 15 nt, Salmonella enterica enterica serovar Typhi
ccuaacaucauuccc

SEQ ID NO: 3640400 - RNA, 18 nt, Salmonella enterica enterica serovar Typhi
ccuaagagaaaaccccgu

SEQ ID NO: 3640401 - RNA, 23 nt, Salmonella enterica enterica serovar Typhi
ccuaagccggcaggcagcgccag

SEQ ID NO: 3640402 - RNA, 13 nt, Salmonella enterica enterica serovar Typhi
ccuaauaaaauaa

SEQ ID NO: 3640403 - RNA, 17 nt, Salmonella enterica enterica serovar Typhi
ccuaauagccagcccca

SEQ ID NO: 3640404 - RNA, 14 nt, Salmonella enterica enterica serovar Typhi
ccuaauuuuuaaag

SEQ ID NO: 3640405 - RNA, 23 nt, Salmonella enterica enterica serovar Typhi
ccuacaaggaaagaaaaugccag

SEQ ID NO: 3640406 - RNA, 17 nt, Salmonella enterica enterica serovar Typhi
ccuacaaggcauucagg

SEQ ID NO: 3640407 - RNA, 18 nt, Salmonella enterica enterica serovar Typhi
ccuacaaggcauucaggc

SEQ ID NO: 3640408 - RNA, 19 nt, Salmonella enterica enterica serovar Typhi
ccuacaauggaaaaaucug

SEQ ID NO: 3640409 - RNA, 22 nt, Salmonella enterica enterica serovar Typhi
ccuacagguugucgcaacgugu

SEQ ID NO: 3640410 - RNA, 16 nt, Salmonella enterica enterica serovar Typhi
ccuaccgaggcagggg

SEQ ID NO: 3640411 - RNA, 15 nt, Salmonella enterica enterica serovar Typhi
ccuacgauaucaucg

SEQ ID NO: 3640412 - RNA, 19 nt, Salmonella enterica enterica serovar Typhi
ccuacgauuucgcucgcuu

SEQ ID NO: 3640413 - RNA, 13 nt, Salmonella enterica enterica serovar Typhi
ccuacgcgcaugu

SEQ ID NO: 3640414 - RNA, 21 nt, Salmonella enterica enterica serovar Typhi
ccuacggaaagcuguuguugc

SEQ ID NO: 3640415 - RNA, 19 nt, Salmonella enterica enterica serovar Typhi
ccuacggcuaccgccuguu

SEQ ID NO: 3640416 - RNA, 19 nt, Salmonella enterica enterica serovar Typhi
ccuacugcccuacgcuucu

SEQ ID NO: 3640417 - RNA, 22 nt, Salmonella enterica enterica serovar Typhi
ccuacuuuauuuuucgccagau

SEQ ID NO: 3640418 - RNA, 14 nt, Salmonella enterica enterica serovar Typhi
ccuagcgucccggc

SEQ ID NO: 3640419 - RNA, 14 nt, Salmonella enterica enterica serovar Typhi
ccuaggccagugcc

SEQ ID NO: 3640420 - RNA, 15 nt, Salmonella enterica enterica serovar Typhi
ccuauaacagcgcug

SEQ ID NO: 3640421 - RNA, 17 nt, Salmonella enterica enterica serovar Typhi
ccuauaagcugccucuu

SEQ ID NO: 3640422 - RNA, 18 nt, Salmonella enterica enterica serovar Typhi
ccuauagacaccuuauau

SEQ ID NO: 3640423 - RNA, 22 nt, Salmonella enterica enterica serovar Typhi
ccuaucaggaucaaaaucgcgc

SEQ ID NO: 3640424 - RNA, 22 nt, Salmonella enterica enterica serovar Typhi
ccuaucaggcguugaccgcuuc

SEQ ID NO: 3640425 - RNA, 15 nt, Salmonella enterica enterica serovar Typhi
ccuaucccaauucgu

SEQ ID NO: 3640426 - RNA, 12 nt, Salmonella enterica enterica serovar Typhi
ccuauccggccg

SEQ ID NO: 3640427 - RNA, 13 nt, Salmonella enterica enterica serovar Typhi
ccuaucgccauau

SEQ ID NO: 3640428 - RNA, 18 nt, Salmonella enterica enterica serovar Typhi
ccuaucgcugcgcugcgg

SEQ ID NO: 3640429 - RNA, 17 nt, Salmonella enterica enterica serovar Typhi
ccuauugcaacgccgau

SEQ ID NO: 3640430 - RNA, 21 nt, Salmonella enterica enterica serovar Typhi
ccuauuucaguacagccaaaa

SEQ ID NO: 3640431 - RNA, 18 nt, Salmonella enterica enterica serovar Typhi
ccuauuuuaaauucccag

SEQ ID NO: 3640432 - RNA, 14 nt, Salmonella enterica enterica serovar Typhi
ccuauuuugcaaaa

SEQ ID NO: 3640433 - RNA, 17 nt, Salmonella enterica enterica serovar Typhi
ccuauuuugcaaaacug

SEQ ID NO: 3640434 - RNA, 22 nt, Salmonella enterica enterica serovar Typhi
ccuauuuugcaaaacugaguug

SEQ ID NO: 3640435 - RNA, 19 nt, Salmonella enterica enterica serovar Typhi
ccucaaaauggaaaauaau

SEQ ID NO: 3640436 - RNA, 18 nt, Salmonella enterica enterica serovar Typhi
ccucaacauugccggcau

SEQ ID NO: 3640437 - RNA, 13 nt, Salmonella enterica enterica serovar Typhi
ccucaaccaacgg

SEQ ID NO: 3640438 - RNA, 21 nt, Salmonella enterica enterica serovar Typhi
ccucaacgucgcucagaauag

SEQ ID NO: 3640439 - RNA, 18 nt, Salmonella enterica enterica serovar Typhi
ccucaaguaaaaugcccu

SEQ ID NO: 3640440 - RNA, 19 nt, Salmonella enterica enterica serovar Typhi
ccucaaucggcgauaaacc

SEQ ID NO: 3640441 - RNA, 20 nt, Salmonella enterica enterica serovar Typhi
ccucaaugguuucacgcucu

SEQ ID NO: 3640442 - RNA, 16 nt, Salmonella enterica enterica serovar Typhi
ccucaauugccgccag

SEQ ID NO: 3640443 - RNA, 20 nt, Salmonella enterica enterica serovar Typhi
ccucacacugauggcagacc

SEQ ID NO: 3640444 - RNA, 16 nt, Salmonella enterica enterica serovar Typhi
ccucaccguagcucca

SEQ ID NO: 3640445 - RNA, 17 nt, Salmonella enterica enterica serovar Typhi
ccucaccguccgccagg

SEQ ID NO: 3640446 - RNA, 14 nt, Salmonella enterica enterica serovar Typhi
ccucacgcgucaca

SEQ ID NO: 3640447 - RNA, 23 nt, Salmonella enterica enterica serovar Typhi
ccucacgcuuaucgccaaaccag

SEQ ID NO: 3640448 - RNA, 15 nt, Salmonella enterica enterica serovar Typhi
ccucacguacuacgu

SEQ ID NO: 3640449 - RNA, 12 nt, Salmonella enterica enterica serovar Typhi
ccucacuguuga

SEQ ID NO: 3640450 - RNA, 22 nt, Salmonella enterica enterica serovar Typhi
ccucagaaagcguuggcgugcg

SEQ ID NO: 3640451 - RNA, 19 nt, Salmonella enterica enterica serovar Typhi
ccucagauguaucgcgcuu

SEQ ID NO: 3640452 - RNA, 19 nt, Salmonella enterica enterica serovar Typhi
ccucagcaaugauuuuuag

SEQ ID NO: 3640453 - RNA, 11 nt, Salmonella enterica enterica serovar Typhi
ccucagcaggc

SEQ ID NO: 3640454 - RNA, 16 nt, Salmonella enterica enterica serovar Typhi
ccucagcaggcgggcu

SEQ ID NO: 3640455 - RNA, 12 nt, Salmonella enterica enterica serovar Typhi
ccucagccaccc

SEQ ID NO: 3640456 - RNA, 18 nt, Salmonella enterica enterica serovar Typhi
ccucagucgcuuguaccg

SEQ ID NO: 3640457 - RNA, 20 nt, Salmonella enterica enterica serovar Typhi
ccucauacagcccgcgcaga

SEQ ID NO: 3640458 - RNA, 22 nt, Salmonella enterica enterica serovar Typhi
ccucauacagcccgcgcagaau

SEQ ID NO: 3640459 - RNA, 19 nt, Salmonella enterica enterica serovar Typhi
ccucauauuuguaucuggu

SEQ ID NO: 3640460 - RNA, 12 nt, Salmonella enterica enterica serovar Typhi
ccucaucaugaa

SEQ ID NO: 3640461 - RNA, 18 nt, Salmonella enterica enterica serovar Typhi
ccucauccagauguuaua

SEQ ID NO: 3640462 - RNA, 13 nt, Salmonella enterica enterica serovar Typhi
ccucauccccagc

SEQ ID NO: 3640463 - RNA, 18 nt, Salmonella enterica enterica serovar Typhi
ccucaucccguagcguca

SEQ ID NO: 3640464 - RNA, 15 nt, Salmonella enterica enterica serovar Typhi
ccucaucggcaaaca

SEQ ID NO: 3640465 - RNA, 22 nt, Salmonella enterica enterica serovar Typhi
ccucauuacuggaucgcuccau

SEQ ID NO: 3640466 - RNA, 20 nt, Salmonella enterica enterica serovar Typhi
ccucauuuuguugcuccagc

SEQ ID NO: 3640467 - RNA, 21 nt, Salmonella enterica enterica serovar Typhi
ccucauuuuguugcuccagca

SEQ ID NO: 3640468 - RNA, 13 nt, Salmonella enterica enterica serovar Typhi
ccuccaauucagg

SEQ ID NO: 3640469 - RNA, 14 nt, Salmonella enterica enterica serovar Typhi
ccuccagcgacccu

SEQ ID NO: 3640470 - RNA, 17 nt, Salmonella enterica enterica serovar Typhi
ccuccagcgccuguuga

SEQ ID NO: 3640471 - RNA, 17 nt, Salmonella enterica enterica serovar Typhi
ccuccagcuccgcguau

SEQ ID NO: 3640472 - RNA, 20 nt, Salmonella enterica enterica serovar Typhi
ccuccaguaauucccggcag

SEQ ID NO: 3640473 - RNA, 14 nt, Salmonella enterica enterica serovar Typhi
ccuccauacacugc

SEQ ID NO: 3640474 - RNA, 15 nt, Salmonella enterica enterica serovar Typhi
ccucccugacuggcu

SEQ ID NO: 3640475 - RNA, 12 nt, Salmonella enterica enterica serovar Typhi
ccucccugccua

SEQ ID NO: 3640476 - RNA, 21 nt, Salmonella enterica enterica serovar Typhi
ccuccgcguagcccagcgccg

SEQ ID NO: 3640477 - RNA, 22 nt, Salmonella enterica enterica serovar Typhi
ccuccgcguagcccagcgccgc

SEQ ID NO: 3640478 - RNA, 18 nt, Salmonella enterica enterica serovar Typhi
ccuccggaucgacagcaa

SEQ ID NO: 3640479 - RNA, 17 nt, Salmonella enterica enterica serovar Typhi
ccuccggaugacgccgc

SEQ ID NO: 3640480 - RNA, 13 nt, Salmonella enterica enterica serovar Typhi
ccuccggcacaca

SEQ ID NO: 3640481 - RNA, 16 nt, Salmonella enterica enterica serovar Typhi
ccuccggccagcgcca

SEQ ID NO: 3640482 - RNA, 19 nt, Salmonella enterica enterica serovar Typhi
ccuccggcgacugaaugcc

SEQ ID NO: 3640483 - RNA, 18 nt, Salmonella enterica enterica serovar Typhi
ccuccggcgagcgaugcu

SEQ ID NO: 3640484 - RNA, 13 nt, Salmonella enterica enterica serovar Typhi
ccuccggcuaugc

SEQ ID NO: 3640485 - RNA, 18 nt, Salmonella enterica enterica serovar Typhi
ccuccggcugaagcccca

SEQ ID NO: 3640486 - RNA, 13 nt, Salmonella enterica enterica serovar Typhi
ccuccggcuucag

SEQ ID NO: 3640487 - RNA, 19 nt, Salmonella enterica enterica serovar Typhi
ccuccggugaagguaauuu

SEQ ID NO: 3640488 - RNA, 22 nt, Salmonella enterica enterica serovar Typhi
ccuccguaugaccgccgcgcgu

SEQ ID NO: 3640489 - RNA, 17 nt, Salmonella enterica enterica serovar Typhi
ccuccucauucagcggc

SEQ ID NO: 3640490 - RNA, 18 nt, Salmonella enterica enterica serovar Typhi
ccuccugaauagcuuuca

SEQ ID NO: 3640491 - RNA, 23 nt, Salmonella enterica enterica serovar Typhi
ccuccugauaaccuauuuugcaa

SEQ ID NO: 3640492 - RNA, 12 nt, Salmonella enterica enterica serovar Typhi
ccuccugcucca

SEQ ID NO: 3640493 - RNA, 15 nt, Salmonella enterica enterica serovar Typhi
ccuccuggcguuauc

SEQ ID NO: 3640494 - RNA, 14 nt, Salmonella enterica enterica serovar Typhi
ccuccuuuccugug

SEQ ID NO: 3640495 - RNA, 13 nt, Salmonella enterica enterica serovar Typhi
ccucgaccccuuc

SEQ ID NO: 3640496 - RNA, 17 nt, Salmonella enterica enterica serovar Typhi
ccucgcaaaacauggcu

SEQ ID NO: 3640497 - RNA, 13 nt, Salmonella enterica enterica serovar Typhi
ccucgcacuggcg

SEQ ID NO: 3640498 - RNA, 16 nt, Salmonella enterica enterica serovar Typhi
ccucgcaguuaugcgc

SEQ ID NO: 3640499 - RNA, 17 nt, Salmonella enterica enterica serovar Typhi
ccucgcauaacuucgaa

SEQ ID NO: 3640500 - RNA, 16 nt, Salmonella enterica enterica serovar Typhi
ccucgccaaagcagcg

SEQ ID NO: 3640501 - RNA, 18 nt, Salmonella enterica enterica serovar Typhi
ccucgccaaagcgcugcu

SEQ ID NO: 3640502 - RNA, 13 nt, Salmonella enterica enterica serovar Typhi
ccucgcccgcgau

SEQ ID NO: 3640503 - RNA, 17 nt, Salmonella enterica enterica serovar Typhi
ccucgcggguggccugc

SEQ ID NO: 3640504 - RNA, 17 nt, Salmonella enterica enterica serovar Typhi
ccucgcguagcgccaac

SEQ ID NO: 3640505 - RNA, 17 nt, Salmonella enterica enterica serovar Typhi
ccucgcuuaaaccacca

SEQ ID NO: 3640506 - RNA, 20 nt, Salmonella enterica enterica serovar Typhi
ccucggcaacauaccgggua

SEQ ID NO: 3640507 - RNA, 21 nt, Salmonella enterica enterica serovar Typhi
ccucgguggccuuguagcgcu

SEQ ID NO: 3640508 - RNA, 17 nt, Salmonella enterica enterica serovar Typhi
ccucguaucugucccag

SEQ ID NO: 3640509 - RNA, 17 nt, Salmonella enterica enterica serovar Typhi
ccucguccugauccggc

SEQ ID NO: 3640510 - RNA, 13 nt, Salmonella enterica enterica serovar Typhi
ccucgucuugauu

SEQ ID NO: 3640511 - RNA, 17 nt, Salmonella enterica enterica serovar Typhi
ccucguucccagcggga

SEQ ID NO: 3640512 - RNA, 19 nt, Salmonella enterica enterica serovar Typhi
ccucguucggcgcaccugu

SEQ ID NO: 3640513 - RNA, 17 nt, Salmonella enterica enterica serovar Typhi
ccucguugauguuuuua

SEQ ID NO: 3640514 - RNA, 13 nt, Salmonella enterica enterica serovar Typhi
ccucuacauuuuc

SEQ ID NO: 3640515 - RNA, 22 nt, Salmonella enterica enterica serovar Typhi
ccucuaccggaaaacagccgcc

SEQ ID NO: 3640516 - RNA, 15 nt, Salmonella enterica enterica serovar Typhi
ccucuaccuacacau

SEQ ID NO: 3640517 - RNA, 22 nt, Salmonella enterica enterica serovar Typhi
ccucuauaguaaauugacgcuu

SEQ ID NO: 3640518 - RNA, 18 nt, Salmonella enterica enterica serovar Typhi
ccucuaucuuuucaauca

SEQ ID NO: 3640519 - RNA, 23 nt, Salmonella enterica enterica serovar Typhi
ccucucaccguggugaccgccag

SEQ ID NO: 3640520 - RNA, 22 nt, Salmonella enterica enterica serovar Typhi
ccucucccacugcgaacgcauc

SEQ ID NO: 3640521 - RNA, 22 nt, Salmonella enterica enterica serovar Typhi
ccucucuugccugauggcgcgc

SEQ ID NO: 3640522 - RNA, 19 nt, Salmonella enterica enterica serovar Typhi
ccucugauuggcuguuagu

SEQ ID NO: 3640523 - RNA, 16 nt, Salmonella enterica enterica serovar Typhi
ccucugcaccagaacu

SEQ ID NO: 3640524 - RNA, 20 nt, Salmonella enterica enterica serovar Typhi
ccucugcaccagaacucccu

SEQ ID NO: 3640525 - RNA, 17 nt, Salmonella enterica enterica serovar Typhi
ccucuggccaguuucaa

SEQ ID NO: 3640526 - RNA, 22 nt, Salmonella enterica enterica serovar Typhi
ccucuggccgcgcuuuuuuaac

SEQ ID NO: 3640527 - RNA, 13 nt, Salmonella enterica enterica serovar Typhi
ccucuuaucaggc

SEQ ID NO: 3640528 - RNA, 19 nt, Salmonella enterica enterica serovar Typhi
ccucuuccaucagccaggc

SEQ ID NO: 3640529 - RNA, 13 nt, Salmonella enterica enterica serovar Typhi
ccucuuccgccag

SEQ ID NO: 3640530 - RNA, 18 nt, Salmonella enterica enterica serovar Typhi
ccucuuccgccaggucgc

SEQ ID NO: 3640531 - RNA, 19 nt, Salmonella enterica enterica serovar Typhi
ccucuuccgguagcgccug

SEQ ID NO: 3640532 - RNA, 22 nt, Salmonella enterica enterica serovar Typhi
ccucuuccucgauaucuucaua

SEQ ID NO: 3640533 - RNA, 16 nt, Salmonella enterica enterica serovar Typhi
ccucuugcagcaagaa

SEQ ID NO: 3640534 - RNA, 20 nt, Salmonella enterica enterica serovar Typhi
ccucuuucagaucgccgccg

SEQ ID NO: 3640535 - RNA, 17 nt, Salmonella enterica enterica serovar Typhi
ccucuuucaugcggucu

SEQ ID NO: 3640536 - RNA, 14 nt, Salmonella enterica enterica serovar Typhi
ccucuuucgccauu

SEQ ID NO: 3640537 - RNA, 15 nt, Salmonella enterica enterica serovar Typhi
ccucuuucugauaac

SEQ ID NO: 3640538 - RNA, 12 nt, Salmonella enterica enterica serovar Typhi
ccugaaacgcgg

SEQ ID NO: 3640539 - RNA, 14 nt, Salmonella enterica enterica serovar Typhi
ccugaaacgugcau

SEQ ID NO: 3640540 - RNA, 20 nt, Salmonella enterica enterica serovar Typhi
ccugaaaggucgcgauccgc

SEQ ID NO: 3640541 - RNA, 19 nt, Salmonella enterica enterica serovar Typhi
ccugaaauaacagacuccg

SEQ ID NO: 3640542 - RNA, 20 nt, Salmonella enterica enterica serovar Typhi
ccugaaauacccgacucuuu

SEQ ID NO: 3640543 - RNA, 11 nt, Salmonella enterica enterica serovar Typhi
ccugaacaggg

SEQ ID NO: 3640544 - RNA, 14 nt, Salmonella enterica enterica serovar Typhi
ccugaaccagcggc

SEQ ID NO: 3640545 - RNA, 17 nt, Salmonella enterica enterica serovar Typhi
ccugaacgccuaccgcu

SEQ ID NO: 3640546 - RNA, 18 nt, Salmonella enterica enterica serovar Typhi
ccugaacgccuaccgcuu

SEQ ID NO: 3640547 - RNA, 20 nt, Salmonella enterica enterica serovar Typhi
ccugaagaccuuaucccgcu

SEQ ID NO: 3640548 - RNA, 19 nt, Salmonella enterica enterica serovar Typhi
ccugaagcccuuuagugaa

SEQ ID NO: 3640549 - RNA, 13 nt, Salmonella enterica enterica serovar Typhi
ccugaagcgcagu

SEQ ID NO: 3640550 - RNA, 18 nt, Salmonella enterica enterica serovar Typhi
ccugaaggacaagcugcg

SEQ ID NO: 3640551 - RNA, 18 nt, Salmonella enterica enterica serovar Typhi
ccugaauauuagaguggc

SEQ ID NO: 3640552 - RNA, 14 nt, Salmonella enterica enterica serovar Typhi
ccugaaucauauuc

SEQ ID NO: 3640553 - RNA, 17 nt, Salmonella enterica enterica serovar Typhi
ccugaaugcucucauau

SEQ ID NO: 3640554 - RNA, 19 nt, Salmonella enterica enterica serovar Typhi
ccugaaugcucucauauuc

SEQ ID NO: 3640555 - RNA, 21 nt, Salmonella enterica enterica serovar Typhi
ccugaauuucaauaaucccuu

SEQ ID NO: 3640556 - RNA, 22 nt, Salmonella enterica enterica serovar Typhi
ccugacagcgcgcgaauaucgc

SEQ ID NO: 3640557 - RNA, 15 nt, Salmonella enterica enterica serovar Typhi
ccugacauagcucac

SEQ ID NO: 3640558 - RNA, 23 nt, Salmonella enterica enterica serovar Typhi
ccugacauuacccggccaggcgu

SEQ ID NO: 3640559 - RNA, 16 nt, Salmonella enterica enterica serovar Typhi
ccugacauuuauauua

SEQ ID NO: 3640560 - RNA, 23 nt, Salmonella enterica enterica serovar Typhi
ccugaccauugauuuccgcgcaa

SEQ ID NO: 3640561 - RNA, 19 nt, Salmonella enterica enterica serovar Typhi
ccugaccgauauagccacu

SEQ ID NO: 3640562 - RNA, 20 nt, Salmonella enterica enterica serovar Typhi
ccugaccgauauagccacuc

SEQ ID NO: 3640563 - RNA, 17 nt, Salmonella enterica enterica serovar Typhi
ccugaccgggcucacgc

SEQ ID NO: 3640564 - RNA, 23 nt, Salmonella enterica enterica serovar Typhi
ccugacgcgcagcgauauagcgc

SEQ ID NO: 3640565 - RNA, 14 nt, Salmonella enterica enterica serovar Typhi
ccugacgcugagag

SEQ ID NO: 3640566 - RNA, 20 nt, Salmonella enterica enterica serovar Typhi
ccugacgcugagagaacugc

SEQ ID NO: 3640567 - RNA, 15 nt, Salmonella enterica enterica serovar Typhi
ccugacggcgcuguc

SEQ ID NO: 3640568 - RNA, 17 nt, Salmonella enterica enterica serovar Typhi
ccugacggcgcugucac

SEQ ID NO: 3640569 - RNA, 13 nt, Salmonella enterica enterica serovar Typhi
ccugacgggcauu

SEQ ID NO: 3640570 - RNA, 24 nt, Salmonella enterica enterica serovar Typhi
ccugacggugcgcgacgccgaguu

SEQ ID NO: 3640571 - RNA, 21 nt, Salmonella enterica enterica serovar Typhi
ccugacugcgcgccugcgcug

SEQ ID NO: 3640572 - RNA, 17 nt, Salmonella enterica enterica serovar Typhi
ccugacuuuuccauacu

SEQ ID NO: 3640573 - RNA, 21 nt, Salmonella enterica enterica serovar Typhi
ccugagcagacauauuuucuc

SEQ ID NO: 3640574 - RNA, 16 nt, Salmonella enterica enterica serovar Typhi
ccugagccgaaccccu

SEQ ID NO: 3640575 - RNA, 15 nt, Salmonella enterica enterica serovar Typhi
ccugagcgccgccaa

SEQ ID NO: 3640576 - RNA, 17 nt, Salmonella enterica enterica serovar Typhi
ccugagcgcgcagcugg

SEQ ID NO: 3640577 - RNA, 13 nt, Salmonella enterica enterica serovar Typhi
ccugaguaucaau

SEQ ID NO: 3640578 - RNA, 19 nt, Salmonella enterica enterica serovar Typhi
ccugagucuugccuguccg

SEQ ID NO: 3640579 - RNA, 22 nt, Salmonella enterica enterica serovar Typhi
ccugauaaaaaaacgccgccuu

SEQ ID NO: 3640580 - RNA, 20 nt, Salmonella enterica enterica serovar Typhi
ccugauaagcauagcgccau

SEQ ID NO: 3640581 - RNA, 20 nt, Salmonella enterica enterica serovar Typhi
ccugauaagcgaagcgccau

SEQ ID NO: 3640582 - RNA, 19 nt, Salmonella enterica enterica serovar Typhi
ccugauaagcgcagcgcau

SEQ ID NO: 3640583 - RNA, 18 nt, Salmonella enterica enterica serovar Typhi
ccugauaagcgcagcgcc

SEQ ID NO: 3640584 - RNA, 19 nt, Salmonella enterica enterica serovar Typhi
ccugauaagcgcagcgcca

SEQ ID NO: 3640585 - RNA, 16 nt, Salmonella enterica enterica serovar Typhi
ccugauagcaaucauc

SEQ ID NO: 3640586 - RNA, 19 nt, Salmonella enterica enterica serovar Typhi
ccugauagcacagcgcuau

SEQ ID NO: 3640587 - RNA, 18 nt, Salmonella enterica enterica serovar Typhi
ccugauauacaaaaccca

SEQ ID NO: 3640588 - RNA, 14 nt, Salmonella enterica enterica serovar Typhi
ccugauauccacgc

SEQ ID NO: 3640589 - RNA, 23 nt, Salmonella enterica enterica serovar Typhi
ccugauauugcguaagcagcugc

SEQ ID NO: 3640590 - RNA, 16 nt, Salmonella enterica enterica serovar Typhi
ccugauccagcucuuc

SEQ ID NO: 3640591 - RNA, 22 nt, Salmonella enterica enterica serovar Typhi
ccugauccggaauagagauaga

SEQ ID NO: 3640592 - RNA, 18 nt, Salmonella enterica enterica serovar Typhi
ccugauccggcuguucca

SEQ ID NO: 3640593 - RNA, 19 nt, Salmonella enterica enterica serovar Typhi
ccugauccugcaacagcac

SEQ ID NO: 3640594 - RNA, 21 nt, Salmonella enterica enterica serovar Typhi
ccugaucgccaacgaccggcg

SEQ ID NO: 3640595 - RNA, 19 nt, Salmonella enterica enterica serovar Typhi
ccugaucggccagcgucgc

SEQ ID NO: 3640596 - RNA, 17 nt, Salmonella enterica enterica serovar Typhi
ccugaugacgcugcgcu

SEQ ID NO: 3640597 - RNA, 19 nt, Salmonella enterica enterica serovar Typhi
ccugaugagcgcagcgacu

SEQ ID NO: 3640598 - RNA, 17 nt, Salmonella enterica enterica serovar Typhi
ccugaugauagcgccau

SEQ ID NO: 3640599 - RNA, 23 nt, Salmonella enterica enterica serovar Typhi
ccugaugauagcgccauauaaau

SEQ ID NO: 3640600 - RNA, 22 nt, Salmonella enterica enterica serovar Typhi
ccugaugcgcguuuagcgccag

SEQ ID NO: 3640601 - RNA, 22 nt, Salmonella enterica enterica serovar Typhi
ccugauggcgacguuagcgcau

SEQ ID NO: 3640602 - RNA, 17 nt, Salmonella enterica enterica serovar Typhi
ccugauggcgcgccacu

SEQ ID NO: 3640603 - RNA, 12 nt, Salmonella enterica enterica serovar Typhi
ccugauggcgcu

SEQ ID NO: 3640604 - RNA, 19 nt, Salmonella enterica enterica serovar Typhi
ccugauggcgcuacgccau

SEQ ID NO: 3640605 - RNA, 22 nt, Salmonella enterica enterica serovar Typhi
ccugauggcgcuacguuuaucu

SEQ ID NO: 3640606 - RNA, 19 nt, Salmonella enterica enterica serovar Typhi
ccugauggcguagcgccau

SEQ ID NO: 3640607 - RNA, 21 nt, Salmonella enterica enterica serovar Typhi
ccugauuaaguuuuuuuaaaa

SEQ ID NO: 3640608 - RNA, 19 nt, Salmonella enterica enterica serovar Typhi
ccugauucaccaacugcug

SEQ ID NO: 3640609 - RNA, 14 nt, Salmonella enterica enterica serovar Typhi
ccugauucugcagc

SEQ ID NO: 3640610 - RNA, 18 nt, Salmonella enterica enterica serovar Typhi
ccugauucugcagcgagc

SEQ ID NO: 3640611 - RNA, 16 nt, Salmonella enterica enterica serovar Typhi
ccugauugaccagcau

SEQ ID NO: 3640612 - RNA, 19 nt, Salmonella enterica enterica serovar Typhi
ccugauuuaacgaguugaa

SEQ ID NO: 3640613 - RNA, 13 nt, Salmonella enterica enterica serovar Typhi
ccugauuuaucac

SEQ ID NO: 3640614 - RNA, 14 nt, Salmonella enterica enterica serovar Typhi
ccugauuuaucacg

SEQ ID NO: 3640615 - RNA, 15 nt, Salmonella enterica enterica serovar Typhi
ccugauuuaucacgu

SEQ ID NO: 3640616 - RNA, 20 nt, Salmonella enterica enterica serovar Typhi
ccugcaaagcaaaaaucacc

SEQ ID NO: 3640617 - RNA, 18 nt, Salmonella enterica enterica serovar Typhi
ccugcaaauuaugauuca

SEQ ID NO: 3640618 - RNA, 23 nt, Salmonella enterica enterica serovar Typhi
ccugcaacgcuuuagugccgcca

SEQ ID NO: 3640619 - RNA, 23 nt, Salmonella enterica enterica serovar Typhi
ccugcaaggcaucgucggcgauu

SEQ ID NO: 3640620 - RNA, 12 nt, Salmonella enterica enterica serovar Typhi
ccugcacccgcc

SEQ ID NO: 3640621 - RNA, 15 nt, Salmonella enterica enterica serovar Typhi
ccugcacgccgguuc

SEQ ID NO: 3640622 - RNA, 13 nt, Salmonella enterica enterica serovar Typhi
ccugcacuuccag

SEQ ID NO: 3640623 - RNA, 22 nt, Salmonella enterica enterica serovar Typhi
ccugcacuuccagccacggcgu

SEQ ID NO: 3640624 - RNA, 17 nt, Salmonella enterica enterica serovar Typhi
ccugcaggcgagugcua

SEQ ID NO: 3640625 - RNA, 17 nt, Salmonella enterica enterica serovar Typhi
ccugcagggaauaagcg

SEQ ID NO: 3640626 - RNA, 18 nt, Salmonella enterica enterica serovar Typhi
ccugcagggaauaagcgc

SEQ ID NO: 3640627 - RNA, 20 nt, Salmonella enterica enterica serovar Typhi
ccugcagggaauaagcgccc

SEQ ID NO: 3640628 - RNA, 15 nt, Salmonella enterica enterica serovar Typhi
ccugcaggguaauua

SEQ ID NO: 3640629 - RNA, 22 nt, Salmonella enterica enterica serovar Typhi
ccugcaggguuugcgcagacug

SEQ ID NO: 3640630 - RNA, 23 nt, Salmonella enterica enterica serovar Typhi
ccugcauacucacauucauaaaa

SEQ ID NO: 3640631 - RNA, 16 nt, Salmonella enterica enterica serovar Typhi
ccugccacaggccaac

SEQ ID NO: 3640632 - RNA, 14 nt, Salmonella enterica enterica serovar Typhi
ccugccaccagcgu

SEQ ID NO: 3640633 - RNA, 14 nt, Salmonella enterica enterica serovar Typhi
ccugccagauaguu

SEQ ID NO: 3640634 - RNA, 11 nt, Salmonella enterica enterica serovar Typhi
ccugccagauu

SEQ ID NO: 3640635 - RNA, 16 nt, Salmonella enterica enterica serovar Typhi
ccugccaggccggacu

SEQ ID NO: 3640636 - RNA, 16 nt, Salmonella enterica enterica serovar Typhi
ccugccaguccgcccg

SEQ ID NO: 3640637 - RNA, 18 nt, Salmonella enterica enterica serovar Typhi
ccugccaguccgcccgcc

SEQ ID NO: 3640638 - RNA, 15 nt, Salmonella enterica enterica serovar Typhi
ccugccauucccagc

SEQ ID NO: 3640639 - RNA, 16 nt, Salmonella enterica enterica serovar Typhi
ccugccauucccagcc

SEQ ID NO: 3640640 - RNA, 21 nt, Salmonella enterica enterica serovar Typhi
ccugccccgcucgaaaccauc

SEQ ID NO: 3640641 - RNA, 17 nt, Salmonella enterica enterica serovar Typhi
ccugccgacaggcaggu

SEQ ID NO: 3640642 - RNA, 19 nt, Salmonella enterica enterica serovar Typhi
ccugccgauacguccccau

SEQ ID NO: 3640643 - RNA, 15 nt, Salmonella enterica enterica serovar Typhi
ccugccgcauguccc

SEQ ID NO: 3640644 - RNA, 17 nt, Salmonella enterica enterica serovar Typhi
ccugccgcgaucgcggc

SEQ ID NO: 3640645 - RNA, 22 nt, Salmonella enterica enterica serovar Typhi
ccugccggauuuuacauagcag

SEQ ID NO: 3640646 - RNA, 21 nt, Salmonella enterica enterica serovar Typhi
ccugccgggguaucauaaaag

SEQ ID NO: 3640647 - RNA, 15 nt, Salmonella enterica enterica serovar Typhi
ccugccggguuuaau

SEQ ID NO: 3640648 - RNA, 20 nt, Salmonella enterica enterica serovar Typhi
ccugccgucgcggcuuucag

SEQ ID NO: 3640649 - RNA, 16 nt, Salmonella enterica enterica serovar Typhi
ccugccguuugcgcca

SEQ ID NO: 3640650 - RNA, 15 nt, Salmonella enterica enterica serovar Typhi
ccugccguuuuuaac

SEQ ID NO: 3640651 - RNA, 18 nt, Salmonella enterica enterica serovar Typhi
ccugccuaagccggacgc

SEQ ID NO: 3640652 - RNA, 13 nt, Salmonella enterica enterica serovar Typhi
ccugccucaacau

SEQ ID NO: 3640653 - RNA, 18 nt, Salmonella enterica enterica serovar Typhi
ccugccuuucccauccgc

SEQ ID NO: 3640654 - RNA, 20 nt, Salmonella enterica enterica serovar Typhi
ccugcgagcuguagcgaagg

SEQ ID NO: 3640655 - RNA, 18 nt, Salmonella enterica enterica serovar Typhi
ccugcgauagcugcugac

SEQ ID NO: 3640656 - RNA, 22 nt, Salmonella enterica enterica serovar Typhi
ccugcgaucugugucguccagg

SEQ ID NO: 3640657 - RNA, 14 nt, Salmonella enterica enterica serovar Typhi
ccugcgccguuucu

SEQ ID NO: 3640658 - RNA, 12 nt, Salmonella enterica enterica serovar Typhi
ccugcgcgccaa

SEQ ID NO: 3640659 - RNA, 15 nt, Salmonella enterica enterica serovar Typhi
ccugcgcgccuugcg

SEQ ID NO: 3640660 - RNA, 14 nt, Salmonella enterica enterica serovar Typhi
ccugcgcguaaauu

SEQ ID NO: 3640661 - RNA, 17 nt, Salmonella enterica enterica serovar Typhi
ccugcgcguaaauuuca

SEQ ID NO: 3640662 - RNA, 19 nt, Salmonella enterica enterica serovar Typhi
ccugcgcucauauacccug

SEQ ID NO: 3640663 - RNA, 15 nt, Salmonella enterica enterica serovar Typhi
ccugcgcugacggcg

SEQ ID NO: 3640664 - RNA, 16 nt, Salmonella enterica enterica serovar Typhi
ccugcgcuugcggccg

SEQ ID NO: 3640665 - RNA, 15 nt, Salmonella enterica enterica serovar Typhi
ccugcggaaccgccc

SEQ ID NO: 3640666 - RNA, 19 nt, Salmonella enterica enterica serovar Typhi
ccugcggacgcagcucaua

SEQ ID NO: 3640667 - RNA, 20 nt, Salmonella enterica enterica serovar Typhi
ccugcggccaugaucgccgc

SEQ ID NO: 3640668 - RNA, 23 nt, Salmonella enterica enterica serovar Typhi
ccugcggccaugaucgccgccau

SEQ ID NO: 3640669 - RNA, 17 nt, Salmonella enterica enterica serovar Typhi
ccugcggcgcgcccggc

SEQ ID NO: 3640670 - RNA, 18 nt, Salmonella enterica enterica serovar Typhi
ccugcggguucaucgcca

SEQ ID NO: 3640671 - RNA, 16 nt, Salmonella enterica enterica serovar Typhi
ccugcgguaaacgcuc

SEQ ID NO: 3640672 - RNA, 20 nt, Salmonella enterica enterica serovar Typhi
ccugcgguaaucgccgcgac

SEQ ID NO: 3640673 - RNA, 19 nt, Salmonella enterica enterica serovar Typhi
ccugcgguagcuccagaca

SEQ ID NO: 3640674 - RNA, 18 nt, Salmonella enterica enterica serovar Typhi
ccugcgucgcuucgccaa

SEQ ID NO: 3640675 - RNA, 23 nt, Salmonella enterica enterica serovar Typhi
ccugcgugccguugaccagcuga

SEQ ID NO: 3640676 - RNA, 14 nt, Salmonella enterica enterica serovar Typhi
ccugcucaaucgca

SEQ ID NO: 3640677 - RNA, 11 nt, Salmonella enterica enterica serovar Typhi
ccugcucaugc

SEQ ID NO: 3640678 - RNA, 15 nt, Salmonella enterica enterica serovar Typhi
ccugcucccacagcu

SEQ ID NO: 3640679 - RNA, 12 nt, Salmonella enterica enterica serovar Typhi
ccugcucccaga

SEQ ID NO: 3640680 - RNA, 16 nt, Salmonella enterica enterica serovar Typhi
ccugcucccagauuaa

SEQ ID NO: 3640681 - RNA, 16 nt, Salmonella enterica enterica serovar Typhi
ccugcucccgcugcgg

SEQ ID NO: 3640682 - RNA, 18 nt, Salmonella enterica enterica serovar Typhi
ccugcugacaaaaacggc

SEQ ID NO: 3640683 - RNA, 21 nt, Salmonella enterica enterica serovar Typhi
ccugcugacuacgguugccuu

SEQ ID NO: 3640684 - RNA, 23 nt, Salmonella enterica enterica serovar Typhi
ccugcugcaacauugcaggucug

SEQ ID NO: 3640685 - RNA, 18 nt, Salmonella enterica enterica serovar Typhi
ccugcugccagccgccgc

SEQ ID NO: 3640686 - RNA, 20 nt, Salmonella enterica enterica serovar Typhi
ccugcugccagccgccgccg

SEQ ID NO: 3640687 - RNA, 18 nt, Salmonella enterica enterica serovar Typhi
ccugcugccaucgcuucu

SEQ ID NO: 3640688 - RNA, 13 nt, Salmonella enterica enterica serovar Typhi
ccugcugcgccag

SEQ ID NO: 3640689 - RNA, 16 nt, Salmonella enterica enterica serovar Typhi
ccugcuggcgcaugau

SEQ ID NO: 3640690 - RNA, 15 nt, Salmonella enterica enterica serovar Typhi
ccugcuguaaccccu

SEQ ID NO: 3640691 - RNA, 18 nt, Salmonella enterica enterica serovar Typhi
ccugcuugucgaucauca

SEQ ID NO: 3640692 - RNA, 18 nt, Salmonella enterica enterica serovar Typhi
ccugcuuuuucagcgagg

SEQ ID NO: 3640693 - RNA, 23 nt, Salmonella enterica enterica serovar Typhi
ccuggaaguugaagaaaaacccc

SEQ ID NO: 3640694 - RNA, 22 nt, Salmonella enterica enterica serovar Typhi
ccuggaauuuuuccagcucaga

SEQ ID NO: 3640695 - RNA, 18 nt, Salmonella enterica enterica serovar Typhi
ccuggagagcagcgccag

SEQ ID NO: 3640696 - RNA, 22 nt, Salmonella enterica enterica serovar Typhi
ccuggagagcagcgccagcgac

SEQ ID NO: 3640697 - RNA, 17 nt, Salmonella enterica enterica serovar Typhi
ccuggagcguaagcgcg

SEQ ID NO: 3640698 - RNA, 15 nt, Salmonella enterica enterica serovar Typhi
ccuggaggaacagcg

SEQ ID NO: 3640699 - RNA, 18 nt, Salmonella enterica enterica serovar Typhi
ccuggauaauaagacgcc

SEQ ID NO: 3640700 - RNA, 17 nt, Salmonella enterica enterica serovar Typhi
ccuggauagcaauuuca

SEQ ID NO: 3640701 - RNA, 20 nt, Salmonella enterica enterica serovar Typhi
ccuggaucugcgcauuaacg

SEQ ID NO: 3640702 - RNA, 23 nt, Salmonella enterica enterica serovar Typhi
ccuggaucugcgcauuaacgcca

SEQ ID NO: 3640703 - RNA, 14 nt, Salmonella enterica enterica serovar Typhi
ccuggaugcgcuga

SEQ ID NO: 3640704 - RNA, 23 nt, Salmonella enterica enterica serovar Typhi
ccuggaugcgcugaauagcgcug

SEQ ID NO: 3640705 - RNA, 14 nt, Salmonella enterica enterica serovar Typhi
ccuggaugcuuaaa

SEQ ID NO: 3640706 - RNA, 19 nt, Salmonella enterica enterica serovar Typhi
ccuggaugcuuaaaauccc

SEQ ID NO: 3640707 - RNA, 14 nt, Salmonella enterica enterica serovar Typhi
ccuggauuuuaccu

SEQ ID NO: 3640708 - RNA, 22 nt, Salmonella enterica enterica serovar Typhi
ccuggcacuucgcgccauugau

SEQ ID NO: 3640709 - RNA, 17 nt, Salmonella enterica enterica serovar Typhi
ccuggcagaaaggugaa

SEQ ID NO: 3640710 - RNA, 16 nt, Salmonella enterica enterica serovar Typhi
ccuggcagguauuaau

SEQ ID NO: 3640711 - RNA, 17 nt, Salmonella enterica enterica serovar Typhi
ccuggcaguucagucgg

SEQ ID NO: 3640712 - RNA, 14 nt, Salmonella enterica enterica serovar Typhi
ccuggccaggcuuc

SEQ ID NO: 3640713 - RNA, 24 nt, Salmonella enterica enterica serovar Typhi
ccuggcccggcaguugcuggcgcu

SEQ ID NO: 3640714 - RNA, 17 nt, Salmonella enterica enterica serovar Typhi
ccuggcccugcaucagc

SEQ ID NO: 3640715 - RNA, 13 nt, Salmonella enterica enterica serovar Typhi
ccuggccuccggc

SEQ ID NO: 3640716 - RNA, 14 nt, Salmonella enterica enterica serovar Typhi
ccuggcgaauaaaa

SEQ ID NO: 3640717 - RNA, 19 nt, Salmonella enterica enterica serovar Typhi
ccuggcgaauaaaauucag

SEQ ID NO: 3640718 - RNA, 18 nt, Salmonella enterica enterica serovar Typhi
ccuggcgcuuuaaaccga

SEQ ID NO: 3640719 - RNA, 19 nt, Salmonella enterica enterica serovar Typhi
ccuggcgggaaacagguac

SEQ ID NO: 3640720 - RNA, 20 nt, Salmonella enterica enterica serovar Typhi
ccuggcgggaaacagguacu

SEQ ID NO: 3640721 - RNA, 14 nt, Salmonella enterica enterica serovar Typhi
ccuggcgggcagcc

SEQ ID NO: 3640722 - RNA, 22 nt, Salmonella enterica enterica serovar Typhi
ccuggcgggcagccuucaaguu

SEQ ID NO: 3640723 - RNA, 14 nt, Salmonella enterica enterica serovar Typhi
ccuggcuaucccga

SEQ ID NO: 3640724 - RNA, 20 nt, Salmonella enterica enterica serovar Typhi
ccuggcucaauccaggugga

SEQ ID NO: 3640725 - RNA, 20 nt, Salmonella enterica enterica serovar Typhi
ccuggcugucggcagaaccu

SEQ ID NO: 3640726 - RNA, 20 nt, Salmonella enterica enterica serovar Typhi
ccuggcuucaaccuccugca

SEQ ID NO: 3640727 - RNA, 22 nt, Salmonella enterica enterica serovar Typhi
ccuggguauuuuuuagcgccaa

SEQ ID NO: 3640728 - RNA, 20 nt, Salmonella enterica enterica serovar Typhi
ccugggugagcgucaucggc

SEQ ID NO: 3640729 - RNA, 16 nt, Salmonella enterica enterica serovar Typhi
ccuggguuccaggcgg

SEQ ID NO: 3640730 - RNA, 13 nt, Salmonella enterica enterica serovar Typhi
ccuggucgauaau

SEQ ID NO: 3640731 - RNA, 16 nt, Salmonella enterica enterica serovar Typhi
ccuggugagcuccagc

SEQ ID NO: 3640732 - RNA, 18 nt, Salmonella enterica enterica serovar Typhi
ccugguggcgaauacugu

SEQ ID NO: 3640733 - RNA, 21 nt, Salmonella enterica enterica serovar Typhi
ccugguuuguccaaggcauga

SEQ ID NO: 3640734 - RNA, 13 nt, Salmonella enterica enterica serovar Typhi
ccuguaaaaaauc

SEQ ID NO: 3640735 - RNA, 18 nt, Salmonella enterica enterica serovar Typhi
ccuguaaaaaauccagcg

SEQ ID NO: 3640736 - RNA, 19 nt, Salmonella enterica enterica serovar Typhi
ccuguaaaaaauccagcgu

SEQ ID NO: 3640737 - RNA, 17 nt, Salmonella enterica enterica serovar Typhi
ccuguaaaccgccucca

SEQ ID NO: 3640738 - RNA, 18 nt, Salmonella enterica enterica serovar Typhi
ccuguaaacguuccugcc

SEQ ID NO: 3640739 - RNA, 12 nt, Salmonella enterica enterica serovar Typhi
ccuguaaagcuu

SEQ ID NO: 3640740 - RNA, 16 nt, Salmonella enterica enterica serovar Typhi
ccuguaacaacuguuu

SEQ ID NO: 3640741 - RNA, 21 nt, Salmonella enterica enterica serovar Typhi
ccuguaacaacuguuuuucac

SEQ ID NO: 3640742 - RNA, 14 nt, Salmonella enterica enterica serovar Typhi
ccuguaacacacug

SEQ ID NO: 3640743 - RNA, 20 nt, Salmonella enterica enterica serovar Typhi
ccuguaacgcauaagcgcga

SEQ ID NO: 3640744 - RNA, 17 nt, Salmonella enterica enterica serovar Typhi
ccuguaaggcucucuua

SEQ ID NO: 3640745 - RNA, 16 nt, Salmonella enterica enterica serovar Typhi
ccuguacuugcgccgc

SEQ ID NO: 3640746 - RNA, 14 nt, Salmonella enterica enterica serovar Typhi
ccuguagcagcgcc

SEQ ID NO: 3640747 - RNA, 22 nt, Salmonella enterica enterica serovar Typhi
ccuguaguacaugccauccggc

SEQ ID NO: 3640748 - RNA, 15 nt, Salmonella enterica enterica serovar Typhi
ccuguaucaaaccaa

SEQ ID NO: 3640749 - RNA, 15 nt, Salmonella enterica enterica serovar Typhi
ccuguaucgcuaucc

SEQ ID NO: 3640750 - RNA, 15 nt, Salmonella enterica enterica serovar Typhi
ccuguaucugcugac

SEQ ID NO: 3640751 - RNA, 14 nt, Salmonella enterica enterica serovar Typhi
ccuguauuaccuga

SEQ ID NO: 3640752 - RNA, 21 nt, Salmonella enterica enterica serovar Typhi
ccuguauuuucguuugcauuc

SEQ ID NO: 3640753 - RNA, 18 nt, Salmonella enterica enterica serovar Typhi
ccugucaggcgagcgccu

SEQ ID NO: 3640754 - RNA, 19 nt, Salmonella enterica enterica serovar Typhi
ccugucaguacgucgcaua

SEQ ID NO: 3640755 - RNA, 21 nt, Salmonella enterica enterica serovar Typhi
ccugucgaucauccacccggc

SEQ ID NO: 3640756 - RNA, 16 nt, Salmonella enterica enterica serovar Typhi
ccugucggucuuuuuc

SEQ ID NO: 3640757 - RNA, 15 nt, Salmonella enterica enterica serovar Typhi
ccugucgucaccagc

SEQ ID NO: 3640758 - RNA, 21 nt, Salmonella enterica enterica serovar Typhi
ccugucuauuguuuagacaga

SEQ ID NO: 3640759 - RNA, 14 nt, Salmonella enterica enterica serovar Typhi
ccugucuccucagc

SEQ ID NO: 3640760 - RNA, 17 nt, Salmonella enterica enterica serovar Typhi
ccugucugcgcaacgcu

SEQ ID NO: 3640761 - RNA, 17 nt, Salmonella enterica enterica serovar Typhi
ccugucugucaaaaccc

SEQ ID NO: 3640762 - RNA, 19 nt, Salmonella enterica enterica serovar Typhi
ccugucugucgcgggcgaa

SEQ ID NO: 3640763 - RNA, 15 nt, Salmonella enterica enterica serovar Typhi
ccugucuuaaagaaa

SEQ ID NO: 3640764 - RNA, 16 nt, Salmonella enterica enterica serovar Typhi
ccugugaaguaaaaaa

SEQ ID NO: 3640765 - RNA, 21 nt, Salmonella enterica enterica serovar Typhi
ccugugaaguaaaaaaaccgu

SEQ ID NO: 3640766 - RNA, 20 nt, Salmonella enterica enterica serovar Typhi
ccugugccauacuguuuauc

SEQ ID NO: 3640767 - RNA, 16 nt, Salmonella enterica enterica serovar Typhi
ccugugccgcuggugc

SEQ ID NO: 3640768 - RNA, 19 nt, Salmonella enterica enterica serovar Typhi
ccugugcuuucgccaccag

SEQ ID NO: 3640769 - RNA, 11 nt, Salmonella enterica enterica serovar Typhi
ccugugcuuug

SEQ ID NO: 3640770 - RNA, 19 nt, Salmonella enterica enterica serovar Typhi
ccuguguuacgccaauaau

SEQ ID NO: 3640771 - RNA, 23 nt, Salmonella enterica enterica serovar Typhi
ccuguguuacgccaauaauauug

SEQ ID NO: 3640772 - RNA, 14 nt, Salmonella enterica enterica serovar Typhi
ccuguuaauaccgu

SEQ ID NO: 3640773 - RNA, 14 nt, Salmonella enterica enterica serovar Typhi
ccuguuagggcgcg

SEQ ID NO: 3640774 - RNA, 16 nt, Salmonella enterica enterica serovar Typhi
ccuguuauucaauucu

SEQ ID NO: 3640775 - RNA, 14 nt, Salmonella enterica enterica serovar Typhi
ccuguuauucaggg

SEQ ID NO: 3640776 - RNA, 19 nt, Salmonella enterica enterica serovar Typhi
ccuguucaagcaauaaugc

SEQ ID NO: 3640777 - RNA, 21 nt, Salmonella enterica enterica serovar Typhi
ccuguucaaguggcaaucgac

SEQ ID NO: 3640778 - RNA, 13 nt, Salmonella enterica enterica serovar Typhi
ccuguucaucggc

SEQ ID NO: 3640779 - RNA, 14 nt, Salmonella enterica enterica serovar Typhi
ccuguucgcuuauu

SEQ ID NO: 3640780 - RNA, 22 nt, Salmonella enterica enterica serovar Typhi
ccuguugcgggccagcagccag

SEQ ID NO: 3640781 - RNA, 13 nt, Salmonella enterica enterica serovar Typhi
ccuguuuauauuc

SEQ ID NO: 3640782 - RNA, 13 nt, Salmonella enterica enterica serovar Typhi
ccuguuuaucuga

SEQ ID NO: 3640783 - RNA, 16 nt, Salmonella enterica enterica serovar Typhi
ccuguuuaucugaugc

SEQ ID NO: 3640784 - RNA, 22 nt, Salmonella enterica enterica serovar Typhi
ccuguuucgccaggccgcggcu

SEQ ID NO: 3640785 - RNA, 15 nt, Salmonella enterica enterica serovar Typhi
ccuguuucgcccgcu

SEQ ID NO: 3640786 - RNA, 18 nt, Salmonella enterica enterica serovar Typhi
ccuguuucugcgccgcuu

SEQ ID NO: 3640787 - RNA, 24 nt, Salmonella enterica enterica serovar Typhi
ccuguuucuuaccacgccgcgacu

SEQ ID NO: 3640788 - RNA, 13 nt, Salmonella enterica enterica serovar Typhi
ccuuaaaaaggac

SEQ ID NO: 3640789 - RNA, 16 nt, Salmonella enterica enterica serovar Typhi
ccuuaaccgggcgcuu

SEQ ID NO: 3640790 - RNA, 20 nt, Salmonella enterica enterica serovar Typhi
ccuuaaucaacugcgccaca

SEQ ID NO: 3640791 - RNA, 12 nt, Salmonella enterica enterica serovar Typhi
ccuuaauccagc

SEQ ID NO: 3640792 - RNA, 16 nt, Salmonella enterica enterica serovar Typhi
ccuuaaucgacuucau

SEQ ID NO: 3640793 - RNA, 18 nt, Salmonella enterica enterica serovar Typhi
ccuuacaggcgcaucaga

SEQ ID NO: 3640794 - RNA, 20 nt, Salmonella enterica enterica serovar Typhi
ccuuacaggcgcaucagaaa

SEQ ID NO: 3640795 - RNA, 18 nt, Salmonella enterica enterica serovar Typhi
ccuuacccgaccuacauc

SEQ ID NO: 3640796 - RNA, 14 nt, Salmonella enterica enterica serovar Typhi
ccuuacccggccug

SEQ ID NO: 3640797 - RNA, 17 nt, Salmonella enterica enterica serovar Typhi
ccuuacccggccugcgu

SEQ ID NO: 3640798 - RNA, 23 nt, Salmonella enterica enterica serovar Typhi
ccuuacgcacaugaucuucguug

SEQ ID NO: 3640799 - RNA, 20 nt, Salmonella enterica enterica serovar Typhi
ccuuacgcucgcugauggcg

SEQ ID NO: 3640800 - RNA, 19 nt, Salmonella enterica enterica serovar Typhi
ccuuacuaagccaguucuc

SEQ ID NO: 3640801 - RNA, 18 nt, Salmonella enterica enterica serovar Typhi
ccuuaggccgucagacau

SEQ ID NO: 3640802 - RNA, 15 nt, Salmonella enterica enterica serovar Typhi
ccuuaguaaaaccga

SEQ ID NO: 3640803 - RNA, 17 nt, Salmonella enterica enterica serovar Typhi
ccuuauauuccgcgcau

SEQ ID NO: 3640804 - RNA, 19 nt, Salmonella enterica enterica serovar Typhi
ccuuaucaagccuacaccu

SEQ ID NO: 3640805 - RNA, 14 nt, Salmonella enterica enterica serovar Typhi
ccuuaucaggccug

SEQ ID NO: 3640806 - RNA, 13 nt, Salmonella enterica enterica serovar Typhi
ccuuauccggccc

SEQ ID NO: 3640807 - RNA, 13 nt, Salmonella enterica enterica serovar Typhi
ccuuauccggccu

SEQ ID NO: 3640808 - RNA, 16 nt, Salmonella enterica enterica serovar Typhi
ccuuauccggcgugua

SEQ ID NO: 3640809 - RNA, 18 nt, Salmonella enterica enterica serovar Typhi
ccuuaucgcagucagccu

SEQ ID NO: 3640810 - RNA, 18 nt, Salmonella enterica enterica serovar Typhi
ccuuaucggagucuuauc

SEQ ID NO: 3640811 - RNA, 20 nt, Salmonella enterica enterica serovar Typhi
ccuuaugggucacauccaga

SEQ ID NO: 3640812 - RNA, 21 nt, Salmonella enterica enterica serovar Typhi
ccuuaugggucacauccagac

SEQ ID NO: 3640813 - RNA, 18 nt, Salmonella enterica enterica serovar Typhi
ccuuauucccauuccugc

SEQ ID NO: 3640814 - RNA, 17 nt, Salmonella enterica enterica serovar Typhi
ccuucaaauauauugaa

SEQ ID NO: 3640815 - RNA, 20 nt, Salmonella enterica enterica serovar Typhi
ccuucaaauauauugaaaag

SEQ ID NO: 3640816 - RNA, 23 nt, Salmonella enterica enterica serovar Typhi
ccuucaaauauauugaaaaggga

SEQ ID NO: 3640817 - RNA, 14 nt, Salmonella enterica enterica serovar Typhi
ccuucaacccagca

SEQ ID NO: 3640818 - RNA, 22 nt, Salmonella enterica enterica serovar Typhi
ccuucaacccagcagcagauaa

SEQ ID NO: 3640819 - RNA, 22 nt, Salmonella enterica enterica serovar Typhi
ccuucaaucacaaaauggcuga

SEQ ID NO: 3640820 - RNA, 22 nt, Salmonella enterica enterica serovar Typhi
ccuucaaucacgcccgcagcaa

SEQ ID NO: 3640821 - RNA, 21 nt, Salmonella enterica enterica serovar Typhi
ccuucaauuugaccugaccug

SEQ ID NO: 3640822 - RNA, 16 nt, Salmonella enterica enterica serovar Typhi
ccuucacgaucgagcc

SEQ ID NO: 3640823 - RNA, 14 nt, Salmonella enterica enterica serovar Typhi
ccuucacgccgcca

SEQ ID NO: 3640824 - RNA, 16 nt, Salmonella enterica enterica serovar Typhi
ccuucacggucaaacg

SEQ ID NO: 3640825 - RNA, 22 nt, Salmonella enterica enterica serovar Typhi
ccuucacguuauucggaaugau

SEQ ID NO: 3640826 - RNA, 17 nt, Salmonella enterica enterica serovar Typhi
ccuucacucuucgacau

SEQ ID NO: 3640827 - RNA, 19 nt, Salmonella enterica enterica serovar Typhi
ccuucagaaaauuauuuuc

SEQ ID NO: 3640828 - RNA, 20 nt, Salmonella enterica enterica serovar Typhi
ccuucagaaaauuauuuuca

SEQ ID NO: 3640829 - RNA, 22 nt, Salmonella enterica enterica serovar Typhi
ccuucagauucaaacugauaag

SEQ ID NO: 3640830 - RNA, 13 nt, Salmonella enterica enterica serovar Typhi
ccuucaggcauca

SEQ ID NO: 3640831 - RNA, 21 nt, Salmonella enterica enterica serovar Typhi
ccuucagugauaaagcacagc

SEQ ID NO: 3640832 - RNA, 12 nt, Salmonella enterica enterica serovar Typhi
ccuucauaaaua

SEQ ID NO: 3640833 - RNA, 23 nt, Salmonella enterica enterica serovar Typhi
ccuucauaaugaauacgcuccag

SEQ ID NO: 3640834 - RNA, 15 nt, Salmonella enterica enterica serovar Typhi
ccuucaucaguaacu

SEQ ID NO: 3640835 - RNA, 15 nt, Salmonella enterica enterica serovar Typhi
ccuuccagaaauaaa

SEQ ID NO: 3640836 - RNA, 22 nt, Salmonella enterica enterica serovar Typhi
ccuuccaggcggugaagacgac

SEQ ID NO: 3640837 - RNA, 18 nt, Salmonella enterica enterica serovar Typhi
ccuuccaguaguaaaccg

SEQ ID NO: 3640838 - RNA, 15 nt, Salmonella enterica enterica serovar Typhi
ccuuccccggcagcc

SEQ ID NO: 3640839 - RNA, 23 nt, Salmonella enterica enterica serovar Typhi
ccuuccccggcagccucaggccu

SEQ ID NO: 3640840 - RNA, 22 nt, Salmonella enterica enterica serovar Typhi
ccuuccgcaagcucaccaucuu

SEQ ID NO: 3640841 - RNA, 14 nt, Salmonella enterica enterica serovar Typhi
ccuuccgccaccag

SEQ ID NO: 3640842 - RNA, 20 nt, Salmonella enterica enterica serovar Typhi
ccuuccucgucggcaagaau

SEQ ID NO: 3640843 - RNA, 16 nt, Salmonella enterica enterica serovar Typhi
ccuuccuggucugcca

SEQ ID NO: 3640844 - RNA, 17 nt, Salmonella enterica enterica serovar Typhi
ccuuccuguggaaggca

SEQ ID NO: 3640845 - RNA, 17 nt, Salmonella enterica enterica serovar Typhi
ccuucgaccgucagcag

SEQ ID NO: 3640846 - RNA, 21 nt, Salmonella enterica enterica serovar Typhi
ccuucgacgagguuuccggcg

SEQ ID NO: 3640847 - RNA, 17 nt, Salmonella enterica enterica serovar Typhi
ccuucgaugagcgcgaa

SEQ ID NO: 3640848 - RNA, 20 nt, Salmonella enterica enterica serovar Typhi
ccuucgaugagcgcgaaauc

SEQ ID NO: 3640849 - RNA, 16 nt, Salmonella enterica enterica serovar Typhi
ccuucgcccggcgcgc

SEQ ID NO: 3640850 - RNA, 14 nt, Salmonella enterica enterica serovar Typhi
ccuucgcccucgcc

SEQ ID NO: 3640851 - RNA, 13 nt, Salmonella enterica enterica serovar Typhi
ccuucgccgccca

SEQ ID NO: 3640852 - RNA, 14 nt, Salmonella enterica enterica serovar Typhi
ccuucgccgccgcu

SEQ ID NO: 3640853 - RNA, 19 nt, Salmonella enterica enterica serovar Typhi
ccuucgccgccgcugaauu

SEQ ID NO: 3640854 - RNA, 19 nt, Salmonella enterica enterica serovar Typhi
ccuucgccggguugagcga

SEQ ID NO: 3640855 - RNA, 14 nt, Salmonella enterica enterica serovar Typhi
ccuucgccuucacg

SEQ ID NO: 3640856 - RNA, 20 nt, Salmonella enterica enterica serovar Typhi
ccuucggccuccgcuuccug

SEQ ID NO: 3640857 - RNA, 12 nt, Salmonella enterica enterica serovar Typhi
ccuucgggcgau

SEQ ID NO: 3640858 - RNA, 18 nt, Salmonella enterica enterica serovar Typhi
ccuucgggcgauuuuugc

SEQ ID NO: 3640859 - RNA, 14 nt, Salmonella enterica enterica serovar Typhi
ccuucggugccaua

SEQ ID NO: 3640860 - RNA, 17 nt, Salmonella enterica enterica serovar Typhi
ccuucgguuuuauauuc

SEQ ID NO: 3640861 - RNA, 15 nt, Salmonella enterica enterica serovar Typhi
ccuucgucaaaaugg

SEQ ID NO: 3640862 - RNA, 16 nt, Salmonella enterica enterica serovar Typhi
ccuucgucaaaauggg

SEQ ID NO: 3640863 - RNA, 18 nt, Salmonella enterica enterica serovar Typhi
ccuucgucaggaggccug

SEQ ID NO: 3640864 - RNA, 14 nt, Salmonella enterica enterica serovar Typhi
ccuucuccacucau

SEQ ID NO: 3640865 - RNA, 11 nt, Salmonella enterica enterica serovar Typhi
ccuucuccuuc

SEQ ID NO: 3640866 - RNA, 22 nt, Salmonella enterica enterica serovar Typhi
ccuucucuccuagaaacccauu

SEQ ID NO: 3640867 - RNA, 17 nt, Salmonella enterica enterica serovar Typhi
ccuucucugucgagcau

SEQ ID NO: 3640868 - RNA, 17 nt, Salmonella enterica enterica serovar Typhi
ccuucucuuuaugcguc

SEQ ID NO: 3640869 - RNA, 14 nt, Salmonella enterica enterica serovar Typhi
ccuucugcgcccgc

SEQ ID NO: 3640870 - RNA, 21 nt, Salmonella enterica enterica serovar Typhi
ccuucugcgcccgccugcugu

SEQ ID NO: 3640871 - RNA, 18 nt, Salmonella enterica enterica serovar Typhi
ccuucugguagccagaca

SEQ ID NO: 3640872 - RNA, 19 nt, Salmonella enterica enterica serovar Typhi
ccuucugguagccagacau

SEQ ID NO: 3640873 - RNA, 21 nt, Salmonella enterica enterica serovar Typhi
ccuucuguaagcaauuaauau

SEQ ID NO: 3640874 - RNA, 22 nt, Salmonella enterica enterica serovar Typhi
ccuucugugaaaguuucaggau

SEQ ID NO: 3640875 - RNA, 18 nt, Salmonella enterica enterica serovar Typhi
ccuucuucaucuucaccu

SEQ ID NO: 3640876 - RNA, 17 nt, Salmonella enterica enterica serovar Typhi
ccuucuuccauucccac

SEQ ID NO: 3640877 - RNA, 12 nt, Salmonella enterica enterica serovar Typhi
ccuucuuccccc

SEQ ID NO: 3640878 - RNA, 17 nt, Salmonella enterica enterica serovar Typhi
ccuucuucgccgucaua

SEQ ID NO: 3640879 - RNA, 18 nt, Salmonella enterica enterica serovar Typhi
ccuucuugcucaaaaagc

SEQ ID NO: 3640880 - RNA, 20 nt, Salmonella enterica enterica serovar Typhi
ccuucuuuauucacuuuuuc

SEQ ID NO: 3640881 - RNA, 21 nt, Salmonella enterica enterica serovar Typhi
ccuucuuuauucacuuuuucu

SEQ ID NO: 3640882 - RNA, 16 nt, Salmonella enterica enterica serovar Typhi
ccuucuuuggcuuaau

SEQ ID NO: 3640883 - RNA, 15 nt, Salmonella enterica enterica serovar Typhi
ccuugcccgcgccag

SEQ ID NO: 3640884 - RNA, 20 nt, Salmonella enterica enterica serovar Typhi
ccuugcccguauugaagcga

SEQ ID NO: 3640885 - RNA, 14 nt, Salmonella enterica enterica serovar Typhi
ccuugcgcagccag

SEQ ID NO: 3640886 - RNA, 21 nt, Salmonella enterica enterica serovar Typhi
ccuugcgggcaugggaaauaa

SEQ ID NO: 3640887 - RNA, 23 nt, Salmonella enterica enterica serovar Typhi
ccuugcgggcaugggaaauaacg

SEQ ID NO: 3640888 - RNA, 21 nt, Salmonella enterica enterica serovar Typhi
ccuugcggugagaaacgcgcc

SEQ ID NO: 3640889 - RNA, 16 nt, Salmonella enterica enterica serovar Typhi
ccuugcgguugcagca

SEQ ID NO: 3640890 - RNA, 13 nt, Salmonella enterica enterica serovar Typhi
ccuugugucacau

SEQ ID NO: 3640891 - RNA, 22 nt, Salmonella enterica enterica serovar Typhi
ccuuguugauaaaacgaauacu

SEQ ID NO: 3640892 - RNA, 12 nt, Salmonella enterica enterica serovar Typhi
ccuuguuuuaac

SEQ ID NO: 3640893 - RNA, 15 nt, Salmonella enterica enterica serovar Typhi
ccuuuacugcgccag

SEQ ID NO: 3640894 - RNA, 19 nt, Salmonella enterica enterica serovar Typhi
ccuuuacuucuuugcgauu

SEQ ID NO: 3640895 - RNA, 13 nt, Salmonella enterica enterica serovar Typhi
ccuuuaucgcgca

SEQ ID NO: 3640896 - RNA, 18 nt, Salmonella enterica enterica serovar Typhi
ccuuucaaaaaagagaag

SEQ ID NO: 3640897 - RNA, 12 nt, Salmonella enterica enterica serovar Typhi
ccuuucaacgga

SEQ ID NO: 3640898 - RNA, 22 nt, Salmonella enterica enterica serovar Typhi
ccuuucauucgucaaauucacc

SEQ ID NO: 3640899 - RNA, 11 nt, Salmonella enterica enterica serovar Typhi
ccuuucauuuu

SEQ ID NO: 3640900 - RNA, 13 nt, Salmonella enterica enterica serovar Typhi
ccuuuccugugcu

SEQ ID NO: 3640901 - RNA, 14 nt, Salmonella enterica enterica serovar Typhi
ccuuuccugugcuc

SEQ ID NO: 3640902 - RNA, 23 nt, Salmonella enterica enterica serovar Typhi
ccuuuccuuauuaaagccccuuc

SEQ ID NO: 3640903 - RNA, 17 nt, Salmonella enterica enterica serovar Typhi
ccuuucggacuuccugu

SEQ ID NO: 3640904 - RNA, 15 nt, Salmonella enterica enterica serovar Typhi
ccuuucuguucuuug

SEQ ID NO: 3640905 - RNA, 14 nt, Salmonella enterica enterica serovar Typhi
ccuuugacaaccug

SEQ ID NO: 3640906 - RNA, 13 nt, Salmonella enterica enterica serovar Typhi
ccuuugaccauua

SEQ ID NO: 3640907 - RNA, 12 nt, Salmonella enterica enterica serovar Typhi
ccuuugccuuuc

SEQ ID NO: 3640908 - RNA, 23 nt, Salmonella enterica enterica serovar Typhi
ccuuugcgaauggccuccagcag

SEQ ID NO: 3640909 - RNA, 21 nt, Salmonella enterica enterica serovar Typhi
ccuuugcgcgcgauauccacc

SEQ ID NO: 3640910 - RNA, 24 nt, Salmonella enterica enterica serovar Typhi
ccuuugcgcgcgauauccaccuga

SEQ ID NO: 3640911 - RNA, 23 nt, Salmonella enterica enterica serovar Typhi
ccuuuggaggagagcgucaugaa

SEQ ID NO: 3640912 - RNA, 22 nt, Salmonella enterica enterica serovar Typhi
ccuuuggccuggagaucagcau

SEQ ID NO: 3640913 - RNA, 22 nt, Salmonella enterica enterica serovar Typhi
ccuuugucgaaauugccgcccg

SEQ ID NO: 3640914 - RNA, 23 nt, Salmonella enterica enterica serovar Typhi
ccuuugucgaaauugccgcccgu

SEQ ID NO: 3640915 - RNA, 11 nt, Salmonella enterica enterica serovar Typhi
ccuuugugauc

SEQ ID NO: 3640916 - RNA, 14 nt, Salmonella enterica enterica serovar Typhi
ccuuuuaacgcggu

SEQ ID NO: 3640917 - RNA, 16 nt, Salmonella enterica enterica serovar Typhi
ccuuuuagcacuuuaa

SEQ ID NO: 3640918 - RNA, 14 nt, Salmonella enterica enterica serovar Typhi
ccuuuugacgcuuc

SEQ ID NO: 3640919 - RNA, 20 nt, Salmonella enterica enterica serovar Typhi
ccuuuuucaauuuccaguuu

SEQ ID NO: 3640920 - RNA, 19 nt, Salmonella enterica enterica serovar Typhi
ccuuuuucaugcaauaauc

SEQ ID NO: 3640921 - RNA, 19 nt, Salmonella enterica enterica serovar Typhi
ccuuuuugcauucgcuccu

SEQ ID NO: 3640922 - RNA, 18 nt, Salmonella enterica enterica serovar Typhi
cgaaaacagcuggcgaua

SEQ ID NO: 3640923 - RNA, 22 nt, Salmonella enterica enterica serovar Typhi
cgaaaaccgagcgcaugguaga

SEQ ID NO: 3640924 - RNA, 22 nt, Salmonella enterica enterica serovar Typhi
cgaaaacggcgcaggcaaauca

SEQ ID NO: 3640925 - RNA, 23 nt, Salmonella enterica enterica serovar Typhi
cgaaaacggcgcaggcaaaucaa

SEQ ID NO: 3640926 - RNA, 22 nt, Salmonella enterica enterica serovar Typhi
cgaaaacguugacuuaaaaagc

SEQ ID NO: 3640927 - RNA, 21 nt, Salmonella enterica enterica serovar Typhi
cgaaaaguguguaccagcagc

SEQ ID NO: 3640928 - RNA, 19 nt, Salmonella enterica enterica serovar Typhi
cgaaaauaaacgcuugacu

SEQ ID NO: 3640929 - RNA, 12 nt, Salmonella enterica enterica serovar Typhi
cgaaaaucaucc

SEQ ID NO: 3640930 - RNA, 15 nt, Salmonella enterica enterica serovar Typhi
cgaaaaugcgcauga

SEQ ID NO: 3640931 - RNA, 18 nt, Salmonella enterica enterica serovar Typhi
cgaaacaaucaccugaug

SEQ ID NO: 3640932 - RNA, 18 nt, Salmonella enterica enterica serovar Typhi
cgaaacagauuaaaaagc

SEQ ID NO: 3640933 - RNA, 20 nt, Salmonella enterica enterica serovar Typhi
cgaaacaggaaaaacauggg

SEQ ID NO: 3640934 - RNA, 19 nt, Salmonella enterica enterica serovar Typhi
cgaaacaggucggcaugca

SEQ ID NO: 3640935 - RNA, 23 nt, Salmonella enterica enterica serovar Typhi
cgaaacgaaucucaucagacugu

SEQ ID NO: 3640936 - RNA, 13 nt, Salmonella enterica enterica serovar Typhi
cgaaacggcagcg

SEQ ID NO: 3640937 - RNA, 13 nt, Salmonella enterica enterica serovar Typhi
cgaaacggcggaa

SEQ ID NO: 3640938 - RNA, 19 nt, Salmonella enterica enterica serovar Typhi
cgaaacguccccugcgguu

SEQ ID NO: 3640939 - RNA, 11 nt, Salmonella enterica enterica serovar Typhi
cgaaacucagc

SEQ ID NO: 3640940 - RNA, 13 nt, Salmonella enterica enterica serovar Typhi
cgaaacucagcgg

SEQ ID NO: 3640941 - RNA, 17 nt, Salmonella enterica enterica serovar Typhi
cgaaacucagcggccca

SEQ ID NO: 3640942 - RNA, 19 nt, Salmonella enterica enterica serovar Typhi
cgaaacuccagcgauaaac

SEQ ID NO: 3640943 - RNA, 19 nt, Salmonella enterica enterica serovar Typhi
cgaaagcacuucucgcgca

SEQ ID NO: 3640944 - RNA, 13 nt, Salmonella enterica enterica serovar Typhi
cgaaagcugccuu

SEQ ID NO: 3640945 - RNA, 15 nt, Salmonella enterica enterica serovar Typhi
cgaaagcugccuuuu

SEQ ID NO: 3640946 - RNA, 23 nt, Salmonella enterica enterica serovar Typhi
cgaaaggaagcgggccaguauua

SEQ ID NO: 3640947 - RNA, 16 nt, Salmonella enterica enterica serovar Typhi
cgaaagucaucugcca

SEQ ID NO: 3640948 - RNA, 18 nt, Salmonella enterica enterica serovar Typhi
cgaaagucaucugccagu

SEQ ID NO: 3640949 - RNA, 11 nt, Salmonella enterica enterica serovar Typhi
cgaaauagcgu

SEQ ID NO: 3640950 - RNA, 18 nt, Salmonella enterica enterica serovar Typhi
cgaaaucagagacaaaua

SEQ ID NO: 3640951 - RNA, 16 nt, Salmonella enterica enterica serovar Typhi
cgaaaucaucaauggc

SEQ ID NO: 3640952 - RNA, 14 nt, Salmonella enterica enterica serovar Typhi
cgaaaucguccguu

SEQ ID NO: 3640953 - RNA, 15 nt, Salmonella enterica enterica serovar Typhi
cgaaaugaccaccgc

SEQ ID NO: 3640954 - RNA, 22 nt, Salmonella enterica enterica serovar Typhi
cgaaaugaccaccgcaucggca

SEQ ID NO: 3640955 - RNA, 18 nt, Salmonella enterica enterica serovar Typhi
cgaaauuggccaucaggu

SEQ ID NO: 3640956 - RNA, 17 nt, Salmonella enterica enterica serovar Typhi
cgaaauuuucuucuucg

SEQ ID NO: 3640957 - RNA, 14 nt, Salmonella enterica enterica serovar Typhi
cgaacaacacggcg

SEQ ID NO: 3640958 - RNA, 19 nt, Salmonella enterica enterica serovar Typhi
cgaacaaguaguuguuaua

SEQ ID NO: 3640959 - RNA, 21 nt, Salmonella enterica enterica serovar Typhi
cgaacagaaaaaaugcaccgc

SEQ ID NO: 3640960 - RNA, 13 nt, Salmonella enterica enterica serovar Typhi
cgaacagcccgcu

SEQ ID NO: 3640961 - RNA, 19 nt, Salmonella enterica enterica serovar Typhi
cgaacagcggcaggcggaa

SEQ ID NO: 3640962 - RNA, 20 nt, Salmonella enterica enterica serovar Typhi
cgaacagguuauuguugcua

SEQ ID NO: 3640963 - RNA, 19 nt, Salmonella enterica enterica serovar Typhi
cgaacauccuugcacgcca

SEQ ID NO: 3640964 - RNA, 14 nt, Salmonella enterica enterica serovar Typhi
cgaacaugccgccg

SEQ ID NO: 3640965 - RNA, 15 nt, Salmonella enterica enterica serovar Typhi
cgaacauucuuaugc

SEQ ID NO: 3640966 - RNA, 12 nt, Salmonella enterica enterica serovar Typhi
cgaacauuggaa

SEQ ID NO: 3640967 - RNA, 13 nt, Salmonella enterica enterica serovar Typhi
cgaacauuucagc

SEQ ID NO: 3640968 - RNA, 13 nt, Salmonella enterica enterica serovar Typhi
cgaaccaccagcc

SEQ ID NO: 3640969 - RNA, 19 nt, Salmonella enterica enterica serovar Typhi
cgaaccggcaucggcagcg

SEQ ID NO: 3640970 - RNA, 17 nt, Salmonella enterica enterica serovar Typhi
cgaaccguaaacgccug

SEQ ID NO: 3640971 - RNA, 21 nt, Salmonella enterica enterica serovar Typhi
cgaaccguggccuccggcaga

SEQ ID NO: 3640972 - RNA, 20 nt, Salmonella enterica enterica serovar Typhi
cgaaccugguacaccagacg

SEQ ID NO: 3640973 - RNA, 17 nt, Salmonella enterica enterica serovar Typhi
cgaacgcaucaaagcca

SEQ ID NO: 3640974 - RNA, 20 nt, Salmonella enterica enterica serovar Typhi
cgaacgccgacaucacgcaa

SEQ ID NO: 3640975 - RNA, 15 nt, Salmonella enterica enterica serovar Typhi
cgaacgcuaugcgcc

SEQ ID NO: 3640976 - RNA, 14 nt, Salmonella enterica enterica serovar Typhi
cgaacuccagcgcg

SEQ ID NO: 3640977 - RNA, 13 nt, Salmonella enterica enterica serovar Typhi
cgaacugauggcg

SEQ ID NO: 3640978 - RNA, 15 nt, Salmonella enterica enterica serovar Typhi
cgaacugauggcgcu

SEQ ID NO: 3640979 - RNA, 18 nt, Salmonella enterica enterica serovar Typhi
cgaacugauggcgcuaag

SEQ ID NO: 3640980 - RNA, 23 nt, Salmonella enterica enterica serovar Typhi
cgaacuuacgacgcgccaccauc

SEQ ID NO: 3640981 - RNA, 16 nt, Salmonella enterica enterica serovar Typhi
cgaacuucauccacgc

SEQ ID NO: 3640982 - RNA, 19 nt, Salmonella enterica enterica serovar Typhi
cgaacuucauccacgccga

SEQ ID NO: 3640983 - RNA, 21 nt, Salmonella enterica enterica serovar Typhi
cgaagaacauaaacagcguga

SEQ ID NO: 3640984 - RNA, 22 nt, Salmonella enterica enterica serovar Typhi
cgaagaccgcaucacggcagca

SEQ ID NO: 3640985 - RNA, 17 nt, Salmonella enterica enterica serovar Typhi
cgaagaggaugaaaagu

SEQ ID NO: 3640986 - RNA, 15 nt, Salmonella enterica enterica serovar Typhi
cgaagaucagugaga

SEQ ID NO: 3640987 - RNA, 19 nt, Salmonella enterica enterica serovar Typhi
cgaagauccgcucacgcca

SEQ ID NO: 3640988 - RNA, 21 nt, Salmonella enterica enterica serovar Typhi
cgaagaucgcguacagcgcca

SEQ ID NO: 3640989 - RNA, 15 nt, Salmonella enterica enterica serovar Typhi
cgaagcaggcggaga

SEQ ID NO: 3640990 - RNA, 20 nt, Salmonella enterica enterica serovar Typhi
cgaagccaccggauugccuu

SEQ ID NO: 3640991 - RNA, 23 nt, Salmonella enterica enterica serovar Typhi
cgaagcccaugauggugaacaga

SEQ ID NO: 3640992 - RNA, 19 nt, Salmonella enterica enterica serovar Typhi
cgaagcggcaguugaacuc

SEQ ID NO: 3640993 - RNA, 19 nt, Salmonella enterica enterica serovar Typhi
cgaagcgucauccggcaau

SEQ ID NO: 3640994 - RNA, 20 nt, Salmonella enterica enterica serovar Typhi
cgaaggauaauccgguguuu

SEQ ID NO: 3640995 - RNA, 23 nt, Salmonella enterica enterica serovar Typhi
cgaaggauaauccgguguuuguc

SEQ ID NO: 3640996 - RNA, 17 nt, Salmonella enterica enterica serovar Typhi
cgaaggcaucuucagac

SEQ ID NO: 3640997 - RNA, 21 nt, Salmonella enterica enterica serovar Typhi
cgaaggcuacugcgucgcgcg

SEQ ID NO: 3640998 - RNA, 22 nt, Salmonella enterica enterica serovar Typhi
cgaaggcuuuugcuacgucgcc

SEQ ID NO: 3640999 - RNA, 18 nt, Salmonella enterica enterica serovar Typhi
cgaaggucagauccuuuu

SEQ ID NO: 3641000 - RNA, 14 nt, Salmonella enterica enterica serovar Typhi
cgaagucgccaccc

SEQ ID NO: 3641001 - RNA, 15 nt, Salmonella enterica enterica serovar Typhi
cgaagucgccacccg

SEQ ID NO: 3641002 - RNA, 21 nt, Salmonella enterica enterica serovar Typhi
cgaagugcagcguuuccagcc

SEQ ID NO: 3641003 - RNA, 14 nt, Salmonella enterica enterica serovar Typhi
cgaauaaaacugcc

SEQ ID NO: 3641004 - RNA, 15 nt, Salmonella enterica enterica serovar Typhi
cgaauaacauaauau

SEQ ID NO: 3641005 - RNA, 13 nt, Salmonella enterica enterica serovar Typhi
cgaauaauuauuu

SEQ ID NO: 3641006 - RNA, 16 nt, Salmonella enterica enterica serovar Typhi
cgaauaauuauuuucg

SEQ ID NO: 3641007 - RNA, 19 nt, Salmonella enterica enterica serovar Typhi
cgaauaccgugcacgcugc

SEQ ID NO: 3641008 - RNA, 16 nt, Salmonella enterica enterica serovar Typhi
cgaauaccugaaagag

SEQ ID NO: 3641009 - RNA, 22 nt, Salmonella enterica enterica serovar Typhi
cgaauaccugaaagagcgugcg

SEQ ID NO: 3641010 - RNA, 22 nt, Salmonella enterica enterica serovar Typhi
cgaauacuacugguggaauaaa

SEQ ID NO: 3641011 - RNA, 20 nt, Salmonella enterica enterica serovar Typhi
cgaauacuccugcaacagaa

SEQ ID NO: 3641012 - RNA, 22 nt, Salmonella enterica enterica serovar Typhi
cgaauagcgcgcuaaacgugac

SEQ ID NO: 3641013 - RNA, 19 nt, Salmonella enterica enterica serovar Typhi
cgaauauucauuuccagca

SEQ ID NO: 3641014 - RNA, 16 nt, Salmonella enterica enterica serovar Typhi
cgaaucacauccgcca

SEQ ID NO: 3641015 - RNA, 17 nt, Salmonella enterica enterica serovar Typhi
cgaaucauguuuuucuc

SEQ ID NO: 3641016 - RNA, 18 nt, Salmonella enterica enterica serovar Typhi
cgaauccccaucuccaga

SEQ ID NO: 3641017 - RNA, 12 nt, Salmonella enterica enterica serovar Typhi
cgaauccuccug

SEQ ID NO: 3641018 - RNA, 16 nt, Salmonella enterica enterica serovar Typhi
cgaauccuccuguuga

SEQ ID NO: 3641019 - RNA, 21 nt, Salmonella enterica enterica serovar Typhi
cgaaucgacaauccgccacgc

SEQ ID NO: 3641020 - RNA, 17 nt, Salmonella enterica enterica serovar Typhi
cgaaucgccgcuuuuuc

SEQ ID NO: 3641021 - RNA, 16 nt, Salmonella enterica enterica serovar Typhi
cgaaugcgccagcgag

SEQ ID NO: 3641022 - RNA, 16 nt, Salmonella enterica enterica serovar Typhi
cgaaugcugcaucuua

SEQ ID NO: 3641023 - RNA, 16 nt, Salmonella enterica enterica serovar Typhi
cgaaugugcuuaucac

SEQ ID NO: 3641024 - RNA, 18 nt, Salmonella enterica enterica serovar Typhi
cgaauuaucguucgggag

SEQ ID NO: 3641025 - RNA, 16 nt, Salmonella enterica enterica serovar Typhi
cgaauuccgccugcug

SEQ ID NO: 3641026 - RNA, 22 nt, Salmonella enterica enterica serovar Typhi
cgaauuccuuuuuccgccaccu

SEQ ID NO: 3641027 - RNA, 22 nt, Salmonella enterica enterica serovar Typhi
cgaauucguccacacgccuggc

SEQ ID NO: 3641028 - RNA, 14 nt, Salmonella enterica enterica serovar Typhi
cgaauugucgguuu

SEQ ID NO: 3641029 - RNA, 12 nt, Salmonella enterica enterica serovar Typhi
cgaauuuccagc

SEQ ID NO: 3641030 - RNA, 18 nt, Salmonella enterica enterica serovar Typhi
cgaauuugaaaaaaacau

SEQ ID NO: 3641031 - RNA, 19 nt, Salmonella enterica enterica serovar Typhi
cgacaaaaagcgcgccgaa

SEQ ID NO: 3641032 - RNA, 13 nt, Salmonella enterica enterica serovar Typhi
cgacaaacagcgc

SEQ ID NO: 3641033 - RNA, 15 nt, Salmonella enterica enterica serovar Typhi
cgacaaacagcgccc

SEQ ID NO: 3641034 - RNA, 18 nt, Salmonella enterica enterica serovar Typhi
cgacaaaccacugcugua

SEQ ID NO: 3641035 - RNA, 16 nt, Salmonella enterica enterica serovar Typhi
cgacaaacuccagcuc

SEQ ID NO: 3641036 - RNA, 14 nt, Salmonella enterica enterica serovar Typhi
cgacaacaagucca

SEQ ID NO: 3641037 - RNA, 15 nt, Salmonella enterica enterica serovar Typhi
cgacaacaaguccaa

SEQ ID NO: 3641038 - RNA, 14 nt, Salmonella enterica enterica serovar Typhi
cgacaaccagcgaa

SEQ ID NO: 3641039 - RNA, 21 nt, Salmonella enterica enterica serovar Typhi
cgacaaccuguaggccggaua

SEQ ID NO: 3641040 - RNA, 18 nt, Salmonella enterica enterica serovar Typhi
cgacaacgccuccugccg

SEQ ID NO: 3641041 - RNA, 18 nt, Salmonella enterica enterica serovar Typhi
cgacaacgcguuuauuau

SEQ ID NO: 3641042 - RNA, 16 nt, Salmonella enterica enterica serovar Typhi
cgacaacguuuucagc

SEQ ID NO: 3641043 - RNA, 23 nt, Salmonella enterica enterica serovar Typhi
cgacaacuucuaauuuuuccagc

SEQ ID NO: 3641044 - RNA, 19 nt, Salmonella enterica enterica serovar Typhi
cgacaagcuaauccccagc

SEQ ID NO: 3641045 - RNA, 21 nt, Salmonella enterica enterica serovar Typhi
cgacaagguugaucaggaagu

SEQ ID NO: 3641046 - RNA, 19 nt, Salmonella enterica enterica serovar Typhi
cgacaauauucgccgcgau

SEQ ID NO: 3641047 - RNA, 15 nt, Salmonella enterica enterica serovar Typhi
cgacaaucagcacca

SEQ ID NO: 3641048 - RNA, 15 nt, Salmonella enterica enterica serovar Typhi
cgacaaugaucagac

SEQ ID NO: 3641049 - RNA, 21 nt, Salmonella enterica enterica serovar Typhi
cgacaauggcgacgaucagcg

SEQ ID NO: 3641050 - RNA, 20 nt, Salmonella enterica enterica serovar Typhi
cgacaauggcuagggaaacg

SEQ ID NO: 3641051 - RNA, 15 nt, Salmonella enterica enterica serovar Typhi
cgacaauguccgcca

SEQ ID NO: 3641052 - RNA, 17 nt, Salmonella enterica enterica serovar Typhi
cgacaauguccgccaga

SEQ ID NO: 3641053 - RNA, 14 nt, Salmonella enterica enterica serovar Typhi
cgacacaucaucgc

SEQ ID NO: 3641054 - RNA, 21 nt, Salmonella enterica enterica serovar Typhi
cgacacauucaggcuuuccac

SEQ ID NO: 3641055 - RNA, 18 nt, Salmonella enterica enterica serovar Typhi
cgacacauuucagcgcag

SEQ ID NO: 3641056 - RNA, 15 nt, Salmonella enterica enterica serovar Typhi
cgacacccaauccgg

SEQ ID NO: 3641057 - RNA, 22 nt, Salmonella enterica enterica serovar Typhi
cgacacgcgcgcugcgccugga

SEQ ID NO: 3641058 - RNA, 22 nt, Salmonella enterica enterica serovar Typhi
cgacacgcugcauauaacuuuc

SEQ ID NO: 3641059 - RNA, 18 nt, Salmonella enterica enterica serovar Typhi
cgacacggcgcagauauu

SEQ ID NO: 3641060 - RNA, 15 nt, Salmonella enterica enterica serovar Typhi
cgacacuccgcgcau

SEQ ID NO: 3641061 - RNA, 21 nt, Salmonella enterica enterica serovar Typhi
cgacacugaaacuccgcagcc

SEQ ID NO: 3641062 - RNA, 23 nt, Salmonella enterica enterica serovar Typhi
cgacagaauaugcauauucauau

SEQ ID NO: 3641063 - RNA, 18 nt, Salmonella enterica enterica serovar Typhi
cgacagagaaugcgccgc

SEQ ID NO: 3641064 - RNA, 19 nt, Salmonella enterica enterica serovar Typhi
cgacagagaaugcgccgcc

SEQ ID NO: 3641065 - RNA, 21 nt, Salmonella enterica enterica serovar Typhi
cgacagauuggucagcagccc

SEQ ID NO: 3641066 - RNA, 21 nt, Salmonella enterica enterica serovar Typhi
cgacagccagcauuuccagcu

SEQ ID NO: 3641067 - RNA, 16 nt, Salmonella enterica enterica serovar Typhi
cgacagcccggcgugu

SEQ ID NO: 3641068 - RNA, 15 nt, Salmonella enterica enterica serovar Typhi
cgacagcgcccaacg

SEQ ID NO: 3641069 - RNA, 12 nt, Salmonella enterica enterica serovar Typhi
cgacagcgcgcc

SEQ ID NO: 3641070 - RNA, 14 nt, Salmonella enterica enterica serovar Typhi
cgacagcgcgcgcg

SEQ ID NO: 3641071 - RNA, 14 nt, Salmonella enterica enterica serovar Typhi
cgacagcggcgauu

SEQ ID NO: 3641072 - RNA, 22 nt, Salmonella enterica enterica serovar Typhi
cgacagggcgugaaccagcauc

SEQ ID NO: 3641073 - RNA, 19 nt, Salmonella enterica enterica serovar Typhi
cgacaggguuugccagcac

SEQ ID NO: 3641074 - RNA, 22 nt, Salmonella enterica enterica serovar Typhi
cgacaggguuugccagcaccag

SEQ ID NO: 3641075 - RNA, 13 nt, Salmonella enterica enterica serovar Typhi
cgacaguaacugc

SEQ ID NO: 3641076 - RNA, 14 nt, Salmonella enterica enterica serovar Typhi
cgacaguaacugca

SEQ ID NO: 3641077 - RNA, 16 nt, Salmonella enterica enterica serovar Typhi
cgacaguaacugcaaa

SEQ ID NO: 3641078 - RNA, 18 nt, Salmonella enterica enterica serovar Typhi
cgacaguacgguaauucc

SEQ ID NO: 3641079 - RNA, 20 nt, Salmonella enterica enterica serovar Typhi
cgacaguaguaucauccaua

SEQ ID NO: 3641080 - RNA, 13 nt, Salmonella enterica enterica serovar Typhi
cgacauaaacauu

SEQ ID NO: 3641081 - RNA, 13 nt, Salmonella enterica enterica serovar Typhi
cgacauaaccggc

SEQ ID NO: 3641082 - RNA, 16 nt, Salmonella enterica enterica serovar Typhi
cgacauaaccggcaac

SEQ ID NO: 3641083 - RNA, 21 nt, Salmonella enterica enterica serovar Typhi
cgacauaagcugcgacaacaa

SEQ ID NO: 3641084 - RNA, 15 nt, Salmonella enterica enterica serovar Typhi
cgacauagccuuugu

SEQ ID NO: 3641085 - RNA, 14 nt, Salmonella enterica enterica serovar Typhi
cgacauagcugaac

SEQ ID NO: 3641086 - RNA, 23 nt, Salmonella enterica enterica serovar Typhi
cgacauauuugcgugucaucaaa

SEQ ID NO: 3641087 - RNA, 13 nt, Salmonella enterica enterica serovar Typhi
cgacaucacgcaa

SEQ ID NO: 3641088 - RNA, 17 nt, Salmonella enterica enterica serovar Typhi
cgacaucagccagccgc

SEQ ID NO: 3641089 - RNA, 19 nt, Salmonella enterica enterica serovar Typhi
cgacaucagccagccgcca

SEQ ID NO: 3641090 - RNA, 24 nt, Salmonella enterica enterica serovar Typhi
cgacaucgccaguugcagauuacu

SEQ ID NO: 3641091 - RNA, 21 nt, Salmonella enterica enterica serovar Typhi
cgacaucucaggcaagacaca

SEQ ID NO: 3641092 - RNA, 17 nt, Salmonella enterica enterica serovar Typhi
cgacaugcuccugcauc

SEQ ID NO: 3641093 - RNA, 21 nt, Salmonella enterica enterica serovar Typhi
cgacaugguuaaccaccagcg

SEQ ID NO: 3641094 - RNA, 17 nt, Salmonella enterica enterica serovar Typhi
cgacaugucaugacuua

SEQ ID NO: 3641095 - RNA, 17 nt, Salmonella enterica enterica serovar Typhi
cgacauucgauguuacu

SEQ ID NO: 3641096 - RNA, 13 nt, Salmonella enterica enterica serovar Typhi
cgaccaauauccg

SEQ ID NO: 3641097 - RNA, 15 nt, Salmonella enterica enterica serovar Typhi
cgaccacccgcgacc

SEQ ID NO: 3641098 - RNA, 13 nt, Salmonella enterica enterica serovar Typhi
cgaccacgccacc

SEQ ID NO: 3641099 - RNA, 17 nt, Salmonella enterica enterica serovar Typhi
cgaccacgccaccgccg

SEQ ID NO: 3641100 - RNA, 13 nt, Salmonella enterica enterica serovar Typhi
cgaccacggccac

SEQ ID NO: 3641101 - RNA, 18 nt, Salmonella enterica enterica serovar Typhi
cgaccacggccacagcca

SEQ ID NO: 3641102 - RNA, 15 nt, Salmonella enterica enterica serovar Typhi
cgaccacuccggcau

SEQ ID NO: 3641103 - RNA, 17 nt, Salmonella enterica enterica serovar Typhi
cgaccacuucaacgccg

SEQ ID NO: 3641104 - RNA, 21 nt, Salmonella enterica enterica serovar Typhi
cgaccacuucaacgccgcgcu

SEQ ID NO: 3641105 - RNA, 22 nt, Salmonella enterica enterica serovar Typhi
cgaccacuucaacgccgcgcuu

SEQ ID NO: 3641106 - RNA, 17 nt, Salmonella enterica enterica serovar Typhi
cgaccagcagcgggcug

SEQ ID NO: 3641107 - RNA, 13 nt, Salmonella enterica enterica serovar Typhi
cgaccagccugcc

SEQ ID NO: 3641108 - RNA, 16 nt, Salmonella enterica enterica serovar Typhi
cgaccaggaucagacc

SEQ ID NO: 3641109 - RNA, 18 nt, Salmonella enterica enterica serovar Typhi
cgaccaguccuuccgccg

SEQ ID NO: 3641110 - RNA, 18 nt, Salmonella enterica enterica serovar Typhi
cgaccaguuuuugcgcca

SEQ ID NO: 3641111 - RNA, 21 nt, Salmonella enterica enterica serovar Typhi
cgaccauaaauagccgaccgc

SEQ ID NO: 3641112 - RNA, 12 nt, Salmonella enterica enterica serovar Typhi
cgaccaucgccg

SEQ ID NO: 3641113 - RNA, 19 nt, Salmonella enterica enterica serovar Typhi
cgaccaugacggguaacgc

SEQ ID NO: 3641114 - RNA, 20 nt, Salmonella enterica enterica serovar Typhi
cgaccaugguucccgccacu

SEQ ID NO: 3641115 - RNA, 21 nt, Salmonella enterica enterica serovar Typhi
cgaccauuggcaccaccagga

SEQ ID NO: 3641116 - RNA, 14 nt, Salmonella enterica enterica serovar Typhi
cgacccaccugacu

SEQ ID NO: 3641117 - RNA, 19 nt, Salmonella enterica enterica serovar Typhi
cgacccauaacgggaagcc

SEQ ID NO: 3641118 - RNA, 15 nt, Salmonella enterica enterica serovar Typhi
cgacccaucaauaac

SEQ ID NO: 3641119 - RNA, 18 nt, Salmonella enterica enterica serovar Typhi
cgaccccaauagcgaucg

SEQ ID NO: 3641120 - RNA, 20 nt, Salmonella enterica enterica serovar Typhi
cgaccccuucgcccucgcca

SEQ ID NO: 3641121 - RNA, 12 nt, Salmonella enterica enterica serovar Typhi
cgaccgcagcag

SEQ ID NO: 3641122 - RNA, 19 nt, Salmonella enterica enterica serovar Typhi
cgaccgcaggcucuuuuuc

SEQ ID NO: 3641123 - RNA, 13 nt, Salmonella enterica enterica serovar Typhi
cgaccgccagcag

SEQ ID NO: 3641124 - RNA, 11 nt, Salmonella enterica enterica serovar Typhi
cgaccgccaua

SEQ ID NO: 3641125 - RNA, 21 nt, Salmonella enterica enterica serovar Typhi
cgaccgcgccacggccaacgc

SEQ ID NO: 3641126 - RNA, 14 nt, Salmonella enterica enterica serovar Typhi
cgaccggauugguc

SEQ ID NO: 3641127 - RNA, 21 nt, Salmonella enterica enterica serovar Typhi
cgaccggauuggucugauuca

SEQ ID NO: 3641128 - RNA, 23 nt, Salmonella enterica enterica serovar Typhi
cgaccggcaaaaagaaucgccag

SEQ ID NO: 3641129 - RNA, 11 nt, Salmonella enterica enterica serovar Typhi
cgaccggcagc

SEQ ID NO: 3641130 - RNA, 15 nt, Salmonella enterica enterica serovar Typhi
cgaccggcagcguca

SEQ ID NO: 3641131 - RNA, 11 nt, Salmonella enterica enterica serovar Typhi
cgaccggcucg

SEQ ID NO: 3641132 - RNA, 22 nt, Salmonella enterica enterica serovar Typhi
cgaccggcucgcuguucgccag

SEQ ID NO: 3641133 - RNA, 16 nt, Salmonella enterica enterica serovar Typhi
cgaccggucagccggu

SEQ ID NO: 3641134 - RNA, 14 nt, Salmonella enterica enterica serovar Typhi
cgaccguauccgcc

SEQ ID NO: 3641135 - RNA, 20 nt, Salmonella enterica enterica serovar Typhi
cgaccgugauuuuuaccgcc

SEQ ID NO: 3641136 - RNA, 22 nt, Salmonella enterica enterica serovar Typhi
cgaccgugauuuuuaccgccgg

SEQ ID NO: 3641137 - RNA, 22 nt, Salmonella enterica enterica serovar Typhi
cgaccguuagcgacggcgcgcc

SEQ ID NO: 3641138 - RNA, 13 nt, Salmonella enterica enterica serovar Typhi
cgaccucaucaaa

SEQ ID NO: 3641139 - RNA, 16 nt, Salmonella enterica enterica serovar Typhi
cgaccuggcgcucaau

SEQ ID NO: 3641140 - RNA, 19 nt, Salmonella enterica enterica serovar Typhi
cgaccuguagaugaaacuc

SEQ ID NO: 3641141 - RNA, 14 nt, Salmonella enterica enterica serovar Typhi
cgaccuuauuccca

SEQ ID NO: 3641142 - RNA, 15 nt, Salmonella enterica enterica serovar Typhi
cgacgaaucagcgau

SEQ ID NO: 3641143 - RNA, 18 nt, Salmonella enterica enterica serovar Typhi
cgacgaauggcggcguuu

SEQ ID NO: 3641144 - RNA, 13 nt, Salmonella enterica enterica serovar Typhi
cgacgacuucacc

SEQ ID NO: 3641145 - RNA, 20 nt, Salmonella enterica enterica serovar Typhi
cgacgagguuuccggcggga

SEQ ID NO: 3641146 - RNA, 22 nt, Salmonella enterica enterica serovar Typhi
cgacgagguuuccggcgggagc

SEQ ID NO: 3641147 - RNA, 19 nt, Salmonella enterica enterica serovar Typhi
cgacgauacaacucaucca

SEQ ID NO: 3641148 - RNA, 15 nt, Salmonella enterica enterica serovar Typhi
cgacgcacuccagau

SEQ ID NO: 3641149 - RNA, 12 nt, Salmonella enterica enterica serovar Typhi
cgacgcauugag

SEQ ID NO: 3641150 - RNA, 20 nt, Salmonella enterica enterica serovar Typhi
cgacgcauugagacaugccg

SEQ ID NO: 3641151 - RNA, 13 nt, Salmonella enterica enterica serovar Typhi
cgacgccaaccgc

SEQ ID NO: 3641152 - RNA, 20 nt, Salmonella enterica enterica serovar Typhi
cgacgccaaucggcgucuug

SEQ ID NO: 3641153 - RNA, 14 nt, Salmonella enterica enterica serovar Typhi
cgacgccagccgga

SEQ ID NO: 3641154 - RNA, 14 nt, Salmonella enterica enterica serovar Typhi
cgacgccagcgggu

SEQ ID NO: 3641155 - RNA, 13 nt, Salmonella enterica enterica serovar Typhi
cgacgccaggcgg

SEQ ID NO: 3641156 - RNA, 18 nt, Salmonella enterica enterica serovar Typhi
cgacgcccaaccaguggc

SEQ ID NO: 3641157 - RNA, 23 nt, Salmonella enterica enterica serovar Typhi
cgacgccggagaccggcgaaauc

SEQ ID NO: 3641158 - RNA, 17 nt, Salmonella enterica enterica serovar Typhi
cgacgccuuuaccaccc

SEQ ID NO: 3641159 - RNA, 19 nt, Salmonella enterica enterica serovar Typhi
cgacgcgcacccggcaacg

SEQ ID NO: 3641160 - RNA, 12 nt, Salmonella enterica enterica serovar Typhi
cgacgcgccacc

SEQ ID NO: 3641161 - RNA, 15 nt, Salmonella enterica enterica serovar Typhi
cgacgcgcggcguca

SEQ ID NO: 3641162 - RNA, 19 nt, Salmonella enterica enterica serovar Typhi
cgacgcgcgguugcggcgg

SEQ ID NO: 3641163 - RNA, 17 nt, Salmonella enterica enterica serovar Typhi
cgacgcggcuccggcuu

SEQ ID NO: 3641164 - RNA, 12 nt, Salmonella enterica enterica serovar Typhi
cgacgcgggccg

SEQ ID NO: 3641165 - RNA, 21 nt, Salmonella enterica enterica serovar Typhi
cgacgcguuucacaucgccag

SEQ ID NO: 3641166 - RNA, 17 nt, Salmonella enterica enterica serovar Typhi
cgacgcucuuccucaau

SEQ ID NO: 3641167 - RNA, 13 nt, Salmonella enterica enterica serovar Typhi
cgacgcugccaca

SEQ ID NO: 3641168 - RNA, 14 nt, Salmonella enterica enterica serovar Typhi
cgacgcuguuuaug

SEQ ID NO: 3641169 - RNA, 14 nt, Salmonella enterica enterica serovar Typhi
cgacgcuucacgua

SEQ ID NO: 3641170 - RNA, 23 nt, Salmonella enterica enterica serovar Typhi
cgacggagauuaacagcgcgacc

SEQ ID NO: 3641171 - RNA, 17 nt, Salmonella enterica enterica serovar Typhi
cgacggcgaccggcaaa

SEQ ID NO: 3641172 - RNA, 14 nt, Salmonella enterica enterica serovar Typhi
cgacggcgcagaca

SEQ ID NO: 3641173 - RNA, 20 nt, Salmonella enterica enterica serovar Typhi
cgacgggaaaaagcgcgccc

SEQ ID NO: 3641174 - RNA, 21 nt, Salmonella enterica enterica serovar Typhi
cgacgggauuaaaugacgccc

SEQ ID NO: 3641175 - RNA, 13 nt, Salmonella enterica enterica serovar Typhi
cgacggggcguua

SEQ ID NO: 3641176 - RNA, 19 nt, Salmonella enterica enterica serovar Typhi
cgacgguaauaccaaccgc

SEQ ID NO: 3641177 - RNA, 21 nt, Salmonella enterica enterica serovar Typhi
cgacggucuuuuucgacggca

SEQ ID NO: 3641178 - RNA, 12 nt, Salmonella enterica enterica serovar Typhi
cgacgucaacgg

SEQ ID NO: 3641179 - RNA, 13 nt, Salmonella enterica enterica serovar Typhi
cgacgucaauaaa

SEQ ID NO: 3641180 - RNA, 13 nt, Salmonella enterica enterica serovar Typhi
cgacgucccguca

SEQ ID NO: 3641181 - RNA, 13 nt, Salmonella enterica enterica serovar Typhi
cgacgucuuucuu

SEQ ID NO: 3641182 - RNA, 20 nt, Salmonella enterica enterica serovar Typhi
cgacguuaucgccgacaaac

SEQ ID NO: 3641183 - RNA, 17 nt, Salmonella enterica enterica serovar Typhi
cgacguuaucucgccag

SEQ ID NO: 3641184 - RNA, 22 nt, Salmonella enterica enterica serovar Typhi
cgacguucagcauauccagcgc

SEQ ID NO: 3641185 - RNA, 13 nt, Salmonella enterica enterica serovar Typhi
cgacguugcgccu

SEQ ID NO: 3641186 - RNA, 20 nt, Salmonella enterica enterica serovar Typhi
cgacguuguucgcuucuucu

SEQ ID NO: 3641187 - RNA, 21 nt, Salmonella enterica enterica serovar Typhi
cgacguuugcguaaagcuguu

SEQ ID NO: 3641188 - RNA, 13 nt, Salmonella enterica enterica serovar Typhi
cgacuaccgccga

SEQ ID NO: 3641189 - RNA, 14 nt, Salmonella enterica enterica serovar Typhi
cgacucacgcgcgc

SEQ ID NO: 3641190 - RNA, 17 nt, Salmonella enterica enterica serovar Typhi
cgacucauccagcaucg

SEQ ID NO: 3641191 - RNA, 14 nt, Salmonella enterica enterica serovar Typhi
cgacucauucagca

SEQ ID NO: 3641192 - RNA, 19 nt, Salmonella enterica enterica serovar Typhi
cgacuccaauaauggagau

SEQ ID NO: 3641193 - RNA, 12 nt, Salmonella enterica enterica serovar Typhi
cgacucccaggc

SEQ ID NO: 3641194 - RNA, 19 nt, Salmonella enterica enterica serovar Typhi
cgacucccaggcgcgcagc

SEQ ID NO: 3641195 - RNA, 15 nt, Salmonella enterica enterica serovar Typhi
cgacuccggauagag

SEQ ID NO: 3641196 - RNA, 15 nt, Salmonella enterica enterica serovar Typhi
cgacucuuuuuucag

SEQ ID NO: 3641197 - RNA, 15 nt, Salmonella enterica enterica serovar Typhi
cgacugaccagacag

SEQ ID NO: 3641198 - RNA, 14 nt, Salmonella enterica enterica serovar Typhi
cgacugccgcagac

SEQ ID NO: 3641199 - RNA, 21 nt, Salmonella enterica enterica serovar Typhi
cgacugguaaugucauccagc

SEQ ID NO: 3641200 - RNA, 14 nt, Salmonella enterica enterica serovar Typhi
cgacuguuguucuu

SEQ ID NO: 3641201 - RNA, 20 nt, Salmonella enterica enterica serovar Typhi
cgacuguuguucuucauaca

SEQ ID NO: 3641202 - RNA, 13 nt, Salmonella enterica enterica serovar Typhi
cgacuuaucuucc

SEQ ID NO: 3641203 - RNA, 16 nt, Salmonella enterica enterica serovar Typhi
cgacuuauuugcucag

SEQ ID NO: 3641204 - RNA, 15 nt, Salmonella enterica enterica serovar Typhi
cgacuucgcuuccug

SEQ ID NO: 3641205 - RNA, 23 nt, Salmonella enterica enterica serovar Typhi
cgacuuuaaacuuauccgccauc

SEQ ID NO: 3641206 - RNA, 24 nt, Salmonella enterica enterica serovar Typhi
cgacuuuccgccaccagauaguca

SEQ ID NO: 3641207 - RNA, 21 nt, Salmonella enterica enterica serovar Typhi
cgagaaccaacugccaaacca

SEQ ID NO: 3641208 - RNA, 16 nt, Salmonella enterica enterica serovar Typhi
cgagaagcccagcuca

SEQ ID NO: 3641209 - RNA, 22 nt, Salmonella enterica enterica serovar Typhi
cgagaagcccagcucauaggau

SEQ ID NO: 3641210 - RNA, 15 nt, Salmonella enterica enterica serovar Typhi
cgagaagucggcuuu

SEQ ID NO: 3641211 - RNA, 18 nt, Salmonella enterica enterica serovar Typhi
cgagaaguucucacccau

SEQ ID NO: 3641212 - RNA, 14 nt, Salmonella enterica enterica serovar Typhi
cgagaaugucgcca

SEQ ID NO: 3641213 - RNA, 19 nt, Salmonella enterica enterica serovar Typhi
cgagaauguguucucccug

SEQ ID NO: 3641214 - RNA, 13 nt, Salmonella enterica enterica serovar Typhi
cgagaauuuuaug

SEQ ID NO: 3641215 - RNA, 14 nt, Salmonella enterica enterica serovar Typhi
cgagacccagcgcg

SEQ ID NO: 3641216 - RNA, 13 nt, Salmonella enterica enterica serovar Typhi
cgagacgguguuu

SEQ ID NO: 3641217 - RNA, 23 nt, Salmonella enterica enterica serovar Typhi
cgagacuacccaucacgcccugu

SEQ ID NO: 3641218 - RNA, 15 nt, Salmonella enterica enterica serovar Typhi
cgagacugcccggca

SEQ ID NO: 3641219 - RNA, 17 nt, Salmonella enterica enterica serovar Typhi
cgagacugcccggcaua

SEQ ID NO: 3641220 - RNA, 14 nt, Salmonella enterica enterica serovar Typhi
cgagagaaaaaaau

SEQ ID NO: 3641221 - RNA, 22 nt, Salmonella enterica enterica serovar Typhi
cgagagaauuaacagcgcgacc

SEQ ID NO: 3641222 - RNA, 23 nt, Salmonella enterica enterica serovar Typhi
cgagagaauuaacagcgcgacca

SEQ ID NO: 3641223 - RNA, 18 nt, Salmonella enterica enterica serovar Typhi
cgagagaguauccacaga

SEQ ID NO: 3641224 - RNA, 14 nt, Salmonella enterica enterica serovar Typhi
cgagagucaaggca

SEQ ID NO: 3641225 - RNA, 17 nt, Salmonella enterica enterica serovar Typhi
cgagagugacgacgcca

SEQ ID NO: 3641226 - RNA, 16 nt, Salmonella enterica enterica serovar Typhi
cgagauaaaaacgggu

SEQ ID NO: 3641227 - RNA, 13 nt, Salmonella enterica enterica serovar Typhi
cgagauaaccggg

SEQ ID NO: 3641228 - RNA, 12 nt, Salmonella enterica enterica serovar Typhi
cgagauacgcug

SEQ ID NO: 3641229 - RNA, 20 nt, Salmonella enterica enterica serovar Typhi
cgagauacugcaacgccaga

SEQ ID NO: 3641230 - RNA, 15 nt, Salmonella enterica enterica serovar Typhi
cgagaucgccaccgc

SEQ ID NO: 3641231 - RNA, 21 nt, Salmonella enterica enterica serovar Typhi
cgagauuacugcgugcuggcg

SEQ ID NO: 3641232 - RNA, 14 nt, Salmonella enterica enterica serovar Typhi
cgagauucaauaau

SEQ ID NO: 3641233 - RNA, 18 nt, Salmonella enterica enterica serovar Typhi
cgagauuuuucugcgcca

SEQ ID NO: 3641234 - RNA, 14 nt, Salmonella enterica enterica serovar Typhi
cgagcaauaacgug

SEQ ID NO: 3641235 - RNA, 13 nt, Salmonella enterica enterica serovar Typhi
cgagcaauaguga

SEQ ID NO: 3641236 - RNA, 18 nt, Salmonella enterica enterica serovar Typhi
cgagcacuguagcggcug

SEQ ID NO: 3641237 - RNA, 19 nt, Salmonella enterica enterica serovar Typhi
cgagcacuuuuuccuccug

SEQ ID NO: 3641238 - RNA, 11 nt, Salmonella enterica enterica serovar Typhi
cgagcagccaa

SEQ ID NO: 3641239 - RNA, 14 nt, Salmonella enterica enterica serovar Typhi
cgagcaggacgcgc

SEQ ID NO: 3641240 - RNA, 14 nt, Salmonella enterica enterica serovar Typhi
cgagcaguacgccu

SEQ ID NO: 3641241 - RNA, 14 nt, Salmonella enterica enterica serovar Typhi
cgagcaguucagca

SEQ ID NO: 3641242 - RNA, 22 nt, Salmonella enterica enterica serovar Typhi
cgagcaguucagcagcaccacu

SEQ ID NO: 3641243 - RNA, 18 nt, Salmonella enterica enterica serovar Typhi
cgagcauccgcgcaauau

SEQ ID NO: 3641244 - RNA, 18 nt, Salmonella enterica enterica serovar Typhi
cgagcauuuccgcagcca

SEQ ID NO: 3641245 - RNA, 19 nt, Salmonella enterica enterica serovar Typhi
cgagccaacguauaaaaug

SEQ ID NO: 3641246 - RNA, 17 nt, Salmonella enterica enterica serovar Typhi
cgagccacgcggcauca

SEQ ID NO: 3641247 - RNA, 20 nt, Salmonella enterica enterica serovar Typhi
cgagccauuaaugcaggcag

SEQ ID NO: 3641248 - RNA, 14 nt, Salmonella enterica enterica serovar Typhi
cgagccuugccgca

SEQ ID NO: 3641249 - RNA, 21 nt, Salmonella enterica enterica serovar Typhi
cgagcgaguacguaaugugaa

SEQ ID NO: 3641250 - RNA, 13 nt, Salmonella enterica enterica serovar Typhi
cgagcgauagaga

SEQ ID NO: 3641251 - RNA, 19 nt, Salmonella enterica enterica serovar Typhi
cgagcgaucauaagggagc

SEQ ID NO: 3641252 - RNA, 20 nt, Salmonella enterica enterica serovar Typhi
cgagcgaucauaagggagcu

SEQ ID NO: 3641253 - RNA, 22 nt, Salmonella enterica enterica serovar Typhi
cgagcgccguuaaacugcgcga

SEQ ID NO: 3641254 - RNA, 18 nt, Salmonella enterica enterica serovar Typhi
cgagcgcgucagcgccuc

SEQ ID NO: 3641255 - RNA, 18 nt, Salmonella enterica enterica serovar Typhi
cgagcggccaaagggagc

SEQ ID NO: 3641256 - RNA, 21 nt, Salmonella enterica enterica serovar Typhi
cgagcgguuucucgacggugc

SEQ ID NO: 3641257 - RNA, 20 nt, Salmonella enterica enterica serovar Typhi
cgagcguucugcacgccggu

SEQ ID NO: 3641258 - RNA, 21 nt, Salmonella enterica enterica serovar Typhi
cgagcucaguccagccgccgc

SEQ ID NO: 3641259 - RNA, 18 nt, Salmonella enterica enterica serovar Typhi
cgagcuguaccgucccua

SEQ ID NO: 3641260 - RNA, 16 nt, Salmonella enterica enterica serovar Typhi
cgaggaacaucagcca

SEQ ID NO: 3641261 - RNA, 18 nt, Salmonella enterica enterica serovar Typhi
cgaggaacaucagccagc

SEQ ID NO: 3641262 - RNA, 21 nt, Salmonella enterica enterica serovar Typhi
cgaggaacaucagccagcagc

SEQ ID NO: 3641263 - RNA, 15 nt, Salmonella enterica enterica serovar Typhi
cgaggaacgcgcaga

SEQ ID NO: 3641264 - RNA, 19 nt, Salmonella enterica enterica serovar Typhi
cgaggaacgcgcagaccgu

SEQ ID NO: 3641265 - RNA, 18 nt, Salmonella enterica enterica serovar Typhi
cgaggauaaaaucgccaa

SEQ ID NO: 3641266 - RNA, 20 nt, Salmonella enterica enterica serovar Typhi
cgaggcauaccgcccagaac

SEQ ID NO: 3641267 - RNA, 18 nt, Salmonella enterica enterica serovar Typhi
cgaggcgaaacggcggaa

SEQ ID NO: 3641268 - RNA, 17 nt, Salmonella enterica enterica serovar Typhi
cgaggcguaucccagua

SEQ ID NO: 3641269 - RNA, 18 nt, Salmonella enterica enterica serovar Typhi
cgaggcuuauaacccugu

SEQ ID NO: 3641270 - RNA, 14 nt, Salmonella enterica enterica serovar Typhi
cgagggaaggggau

SEQ ID NO: 3641271 - RNA, 17 nt, Salmonella enterica enterica serovar Typhi
cgagggaggcaaucgca

SEQ ID NO: 3641272 - RNA, 22 nt, Salmonella enterica enterica serovar Typhi
cgaggucaucuuucagaugcag

SEQ ID NO: 3641273 - RNA, 18 nt, Salmonella enterica enterica serovar Typhi
cgaggugaauaaauccuu

SEQ ID NO: 3641274 - RNA, 19 nt, Salmonella enterica enterica serovar Typhi
cgaggugauaaucagcgcu

SEQ ID NO: 3641275 - RNA, 20 nt, Salmonella enterica enterica serovar Typhi
cgaguaauccauagccaaca

SEQ ID NO: 3641276 - RNA, 17 nt, Salmonella enterica enterica serovar Typhi
cgaguagcugagcguca

SEQ ID NO: 3641277 - RNA, 14 nt, Salmonella enterica enterica serovar Typhi
cgagucacccugca

SEQ ID NO: 3641278 - RNA, 13 nt, Salmonella enterica enterica serovar Typhi
cgagucgccgcuu

SEQ ID NO: 3641279 - RNA, 16 nt, Salmonella enterica enterica serovar Typhi
cgagucgucaguucca

SEQ ID NO: 3641280 - RNA, 16 nt, Salmonella enterica enterica serovar Typhi
cgagucuuaccagguc

SEQ ID NO: 3641281 - RNA, 16 nt, Salmonella enterica enterica serovar Typhi
cgagugcguucuucca

SEQ ID NO: 3641282 - RNA, 19 nt, Salmonella enterica enterica serovar Typhi
cgagugcguucuuccacuu

SEQ ID NO: 3641283 - RNA, 15 nt, Salmonella enterica enterica serovar Typhi
cgaguggaaucagcc

SEQ ID NO: 3641284 - RNA, 19 nt, Salmonella enterica enterica serovar Typhi
cgaguggaaucagccagga

SEQ ID NO: 3641285 - RNA, 14 nt, Salmonella enterica enterica serovar Typhi
cgaguuaauagaau

SEQ ID NO: 3641286 - RNA, 13 nt, Salmonella enterica enterica serovar Typhi
cgaguuacguugc

SEQ ID NO: 3641287 - RNA, 14 nt, Salmonella enterica enterica serovar Typhi
cgauaaaaaagccu

SEQ ID NO: 3641288 - RNA, 14 nt, Salmonella enterica enterica serovar Typhi
cgauaaaaacagcg

SEQ ID NO: 3641289 - RNA, 18 nt, Salmonella enterica enterica serovar Typhi
cgauaaaaacccaccagc

SEQ ID NO: 3641290 - RNA, 14 nt, Salmonella enterica enterica serovar Typhi
cgauaaacagauau

SEQ ID NO: 3641291 - RNA, 17 nt, Salmonella enterica enterica serovar Typhi
cgauaaaccagccccac

SEQ ID NO: 3641292 - RNA, 16 nt, Salmonella enterica enterica serovar Typhi
cgauaaaccgcugcca

SEQ ID NO: 3641293 - RNA, 14 nt, Salmonella enterica enterica serovar Typhi
cgauaaacgccagc

SEQ ID NO: 3641294 - RNA, 19 nt, Salmonella enterica enterica serovar Typhi
cgauaaacucaaucaggcu

SEQ ID NO: 3641295 - RNA, 16 nt, Salmonella enterica enterica serovar Typhi
cgauaaagaacgcgcc

SEQ ID NO: 3641296 - RNA, 23 nt, Salmonella enterica enterica serovar Typhi
cgauaaagaacgcgccgaccauu

SEQ ID NO: 3641297 - RNA, 13 nt, Salmonella enterica enterica serovar Typhi
cgauaaagacagg

SEQ ID NO: 3641298 - RNA, 17 nt, Salmonella enterica enterica serovar Typhi
cgauaaaguggcauccg

SEQ ID NO: 3641299 - RNA, 15 nt, Salmonella enterica enterica serovar Typhi
cgauaaauaagaagg

SEQ ID NO: 3641300 - RNA, 16 nt, Salmonella enterica enterica serovar Typhi
cgauaaauaccguaau

SEQ ID NO: 3641301 - RNA, 13 nt, Salmonella enterica enterica serovar Typhi
cgauaaauccucc

SEQ ID NO: 3641302 - RNA, 15 nt, Salmonella enterica enterica serovar Typhi
cgauaaauuucacgu

SEQ ID NO: 3641303 - RNA, 15 nt, Salmonella enterica enterica serovar Typhi
cgauaacacggcugg

SEQ ID NO: 3641304 - RNA, 17 nt, Salmonella enterica enterica serovar Typhi
cgauaacaggaacgccg

SEQ ID NO: 3641305 - RNA, 14 nt, Salmonella enterica enterica serovar Typhi
cgauaaccaccagc

SEQ ID NO: 3641306 - RNA, 15 nt, Salmonella enterica enterica serovar Typhi
cgauaaccaggucac

SEQ ID NO: 3641307 - RNA, 19 nt, Salmonella enterica enterica serovar Typhi
cgauaaccaugcucagcgg

SEQ ID NO: 3641308 - RNA, 12 nt, Salmonella enterica enterica serovar Typhi
cgauaaccgaug

SEQ ID NO: 3641309 - RNA, 17 nt, Salmonella enterica enterica serovar Typhi
cgauaaccucucaccgc

SEQ ID NO: 3641310 - RNA, 14 nt, Salmonella enterica enterica serovar Typhi
cgauaaccuguaaa

SEQ ID NO: 3641311 - RNA, 17 nt, Salmonella enterica enterica serovar Typhi
cgauaacgaccagauac

SEQ ID NO: 3641312 - RNA, 15 nt, Salmonella enterica enterica serovar Typhi
cgauaagcaagcgcc

SEQ ID NO: 3641313 - RNA, 17 nt, Salmonella enterica enterica serovar Typhi
cgauaagcaagcgccau

SEQ ID NO: 3641314 - RNA, 13 nt, Salmonella enterica enterica serovar Typhi
cgauaagcgcugu

SEQ ID NO: 3641315 - RNA, 18 nt, Salmonella enterica enterica serovar Typhi
cgauaagcuuccgccaug

SEQ ID NO: 3641316 - RNA, 21 nt, Salmonella enterica enterica serovar Typhi
cgauaaggucgcuauccagca

SEQ ID NO: 3641317 - RNA, 18 nt, Salmonella enterica enterica serovar Typhi
cgauaauaauuaccacgc

SEQ ID NO: 3641318 - RNA, 22 nt, Salmonella enterica enterica serovar Typhi
cgauaauacgcgcgauuacgcg

SEQ ID NO: 3641319 - RNA, 14 nt, Salmonella enterica enterica serovar Typhi
cgauaaucaccagc

SEQ ID NO: 3641320 - RNA, 22 nt, Salmonella enterica enterica serovar Typhi
cgauaaucuccgccgugcguuu

SEQ ID NO: 3641321 - RNA, 18 nt, Salmonella enterica enterica serovar Typhi
cgauaaugcgguucauuu

SEQ ID NO: 3641322 - RNA, 22 nt, Salmonella enterica enterica serovar Typhi
cgauaauuuuaccuucgcguuu

SEQ ID NO: 3641323 - RNA, 18 nt, Salmonella enterica enterica serovar Typhi
cgauacacgccgacgcau

SEQ ID NO: 3641324 - RNA, 20 nt, Salmonella enterica enterica serovar Typhi
cgauacagacgccaacgcgc

SEQ ID NO: 3641325 - RNA, 14 nt, Salmonella enterica enterica serovar Typhi
cgauaccaguaaua

SEQ ID NO: 3641326 - RNA, 17 nt, Salmonella enterica enterica serovar Typhi
cgauacccgcccagauc

SEQ ID NO: 3641327 - RNA, 13 nt, Salmonella enterica enterica serovar Typhi
cgauacccgcgau

SEQ ID NO: 3641328 - RNA, 22 nt, Salmonella enterica enterica serovar Typhi
cgauaccgaaacgcauacgcag

SEQ ID NO: 3641329 - RNA, 13 nt, Salmonella enterica enterica serovar Typhi
cgauaccggcaac

SEQ ID NO: 3641330 - RNA, 21 nt, Salmonella enterica enterica serovar Typhi
cgauacgacugacuucaucaa

SEQ ID NO: 3641331 - RNA, 22 nt, Salmonella enterica enterica serovar Typhi
cgauacgcagcaccgccgcgau

SEQ ID NO: 3641332 - RNA, 13 nt, Salmonella enterica enterica serovar Typhi
cgauacuaaaacu

SEQ ID NO: 3641333 - RNA, 18 nt, Salmonella enterica enterica serovar Typhi
cgauacuccauugucggc

SEQ ID NO: 3641334 - RNA, 16 nt, Salmonella enterica enterica serovar Typhi
cgauagacagcaccau

SEQ ID NO: 3641335 - RNA, 18 nt, Salmonella enterica enterica serovar Typhi
cgauagacguugagcuca

SEQ ID NO: 3641336 - RNA, 18 nt, Salmonella enterica enterica serovar Typhi
cgauagagaguuccuccu

SEQ ID NO: 3641337 - RNA, 19 nt, Salmonella enterica enterica serovar Typhi
cgauagagaguuccuccug

SEQ ID NO: 3641338 - RNA, 20 nt, Salmonella enterica enterica serovar Typhi
cgauagagaguuccuccugg

SEQ ID NO: 3641339 - RNA, 14 nt, Salmonella enterica enterica serovar Typhi
cgauagaucgccac

SEQ ID NO: 3641340 - RNA, 23 nt, Salmonella enterica enterica serovar Typhi
cgauagcagcgcuuucaccgcgu

SEQ ID NO: 3641341 - RNA, 15 nt, Salmonella enterica enterica serovar Typhi
cgauagcgccccaaa

SEQ ID NO: 3641342 - RNA, 18 nt, Salmonella enterica enterica serovar Typhi
cgauagcguuuuccagcu

SEQ ID NO: 3641343 - RNA, 19 nt, Salmonella enterica enterica serovar Typhi
cgauagcuaucacacauau

SEQ ID NO: 3641344 - RNA, 16 nt, Salmonella enterica enterica serovar Typhi
cgauagcugcugacgu

SEQ ID NO: 3641345 - RNA, 14 nt, Salmonella enterica enterica serovar Typhi
cgauaggcgcguca

SEQ ID NO: 3641346 - RNA, 17 nt, Salmonella enterica enterica serovar Typhi
cgauaggugacuuuccu

SEQ ID NO: 3641347 - RNA, 18 nt, Salmonella enterica enterica serovar Typhi
cgauaguguaaacgcgcc

SEQ ID NO: 3641348 - RNA, 13 nt, Salmonella enterica enterica serovar Typhi
cgauauaagcgcc

SEQ ID NO: 3641349 - RNA, 19 nt, Salmonella enterica enterica serovar Typhi
cgauauaagcgccgucauc

SEQ ID NO: 3641350 - RNA, 22 nt, Salmonella enterica enterica serovar Typhi
cgauauaagcgccgucauccgc

SEQ ID NO: 3641351 - RNA, 17 nt, Salmonella enterica enterica serovar Typhi
cgauauaauuuuauuau

SEQ ID NO: 3641352 - RNA, 23 nt, Salmonella enterica enterica serovar Typhi
cgauauaccacccgcuaugaaga

SEQ ID NO: 3641353 - RNA, 13 nt, Salmonella enterica enterica serovar Typhi
cgauauagcgcau

SEQ ID NO: 3641354 - RNA, 21 nt, Salmonella enterica enterica serovar Typhi
cgauauagcgcauagcggcca

SEQ ID NO: 3641355 - RNA, 22 nt, Salmonella enterica enterica serovar Typhi
cgauauauuuuccguccaccug

SEQ ID NO: 3641356 - RNA, 17 nt, Salmonella enterica enterica serovar Typhi
cgauauccgugccgccg

SEQ ID NO: 3641357 - RNA, 16 nt, Salmonella enterica enterica serovar Typhi
cgauaucgauaaucaa

SEQ ID NO: 3641358 - RNA, 23 nt, Salmonella enterica enterica serovar Typhi
cgauaucgucauuaacgggaaac

SEQ ID NO: 3641359 - RNA, 18 nt, Salmonella enterica enterica serovar Typhi
cgauauuacuuuccagca

SEQ ID NO: 3641360 - RNA, 21 nt, Salmonella enterica enterica serovar Typhi
cgauauucgggcgcaugucag

SEQ ID NO: 3641361 - RNA, 21 nt, Salmonella enterica enterica serovar Typhi
cgaucacccacaucagcggca

SEQ ID NO: 3641362 - RNA, 14 nt, Salmonella enterica enterica serovar Typhi
cgaucacgccgucc

SEQ ID NO: 3641363 - RNA, 20 nt, Salmonella enterica enterica serovar Typhi
cgaucacgcgcaggccgauc

SEQ ID NO: 3641364 - RNA, 20 nt, Salmonella enterica enterica serovar Typhi
cgaucacggcgaaucgccug

SEQ ID NO: 3641365 - RNA, 15 nt, Salmonella enterica enterica serovar Typhi
cgaucacuaccgcca

SEQ ID NO: 3641366 - RNA, 18 nt, Salmonella enterica enterica serovar Typhi
cgaucagacgcugguugu

SEQ ID NO: 3641367 - RNA, 12 nt, Salmonella enterica enterica serovar Typhi
cgaucagcgcca

SEQ ID NO: 3641368 - RNA, 13 nt, Salmonella enterica enterica serovar Typhi
cgaucagcgccac

SEQ ID NO: 3641369 - RNA, 14 nt, Salmonella enterica enterica serovar Typhi
cgaucagcgccacc

SEQ ID NO: 3641370 - RNA, 15 nt, Salmonella enterica enterica serovar Typhi
cgaucagcgccacca

SEQ ID NO: 3641371 - RNA, 19 nt, Salmonella enterica enterica serovar Typhi
cgaucagcgccaccacaaa

SEQ ID NO: 3641372 - RNA, 13 nt, Salmonella enterica enterica serovar Typhi
cgaucagcgcgua

SEQ ID NO: 3641373 - RNA, 17 nt, Salmonella enterica enterica serovar Typhi
cgaucaguggcgccgca

SEQ ID NO: 3641374 - RNA, 22 nt, Salmonella enterica enterica serovar Typhi
cgaucaucauuccgagggugga

SEQ ID NO: 3641375 - RNA, 19 nt, Salmonella enterica enterica serovar Typhi
cgaucaucccgcccagcaa

SEQ ID NO: 3641376 - RNA, 20 nt, Salmonella enterica enterica serovar Typhi
cgaucaucccgcccagcaac

SEQ ID NO: 3641377 - RNA, 22 nt, Salmonella enterica enterica serovar Typhi
cgaucaucccgcccagcaacac

SEQ ID NO: 3641378 - RNA, 21 nt, Salmonella enterica enterica serovar Typhi
cgaucaucguaccaauaccca

SEQ ID NO: 3641379 - RNA, 18 nt, Salmonella enterica enterica serovar Typhi
cgauccacaaucgucgug

SEQ ID NO: 3641380 - RNA, 15 nt, Salmonella enterica enterica serovar Typhi
cgauccagccccagc

SEQ ID NO: 3641381 - RNA, 13 nt, Salmonella enterica enterica serovar Typhi
cgauccaggucuu

SEQ ID NO: 3641382 - RNA, 17 nt, Salmonella enterica enterica serovar Typhi
cgauccauauaaucaaa

SEQ ID NO: 3641383 - RNA, 23 nt, Salmonella enterica enterica serovar Typhi
cgauccccucuuccaucagccag

SEQ ID NO: 3641384 - RNA, 19 nt, Salmonella enterica enterica serovar Typhi
cgaucccgggcgauaaacc

SEQ ID NO: 3641385 - RNA, 12 nt, Salmonella enterica enterica serovar Typhi
cgauccggcagc

SEQ ID NO: 3641386 - RNA, 16 nt, Salmonella enterica enterica serovar Typhi
cgaucgagcgcaauac

SEQ ID NO: 3641387 - RNA, 23 nt, Salmonella enterica enterica serovar Typhi
cgaucgagucaggcgccagaguc

SEQ ID NO: 3641388 - RNA, 12 nt, Salmonella enterica enterica serovar Typhi
cgaucgauaaag

SEQ ID NO: 3641389 - RNA, 10 nt, Salmonella enterica enterica serovar Typhi
cgaucgccac

SEQ ID NO: 3641390 - RNA, 16 nt, Salmonella enterica enterica serovar Typhi
cgaucgccuaauccgc

SEQ ID NO: 3641391 - RNA, 15 nt, Salmonella enterica enterica serovar Typhi
cgaucgcuaaucagg

SEQ ID NO: 3641392 - RNA, 16 nt, Salmonella enterica enterica serovar Typhi
cgaucgcuaaucagga

SEQ ID NO: 3641393 - RNA, 17 nt, Salmonella enterica enterica serovar Typhi
cgaucgcuaaucaggac

SEQ ID NO: 3641394 - RNA, 23 nt, Salmonella enterica enterica serovar Typhi
cgaucgcuggacgucgucaccac

SEQ ID NO: 3641395 - RNA, 20 nt, Salmonella enterica enterica serovar Typhi
cgaucggcuuguuaugcgga

SEQ ID NO: 3641396 - RNA, 14 nt, Salmonella enterica enterica serovar Typhi
cgaucgguuaucac

SEQ ID NO: 3641397 - RNA, 23 nt, Salmonella enterica enterica serovar Typhi
cgaucguaaucacccgcuuccag

SEQ ID NO: 3641398 - RNA, 18 nt, Salmonella enterica enterica serovar Typhi
cgaucguagcaucucuuc

SEQ ID NO: 3641399 - RNA, 15 nt, Salmonella enterica enterica serovar Typhi
cgaucguccgccucc

SEQ ID NO: 3641400 - RNA, 18 nt, Salmonella enterica enterica serovar Typhi
cgaucguccgccuccggc

SEQ ID NO: 3641401 - RNA, 17 nt, Salmonella enterica enterica serovar Typhi
cgaucuacgguaucugc

SEQ ID NO: 3641402 - RNA, 18 nt, Salmonella enterica enterica serovar Typhi
cgaucuauuucauaauaa

SEQ ID NO: 3641403 - RNA, 19 nt, Salmonella enterica enterica serovar Typhi
cgaucucauaaacgccugg

SEQ ID NO: 3641404 - RNA, 16 nt, Salmonella enterica enterica serovar Typhi
cgaucuccaucuccag

SEQ ID NO: 3641405 - RNA, 14 nt, Salmonella enterica enterica serovar Typhi
cgaucucccagccg

SEQ ID NO: 3641406 - RNA, 16 nt, Salmonella enterica enterica serovar Typhi
cgaucucccagccggg

SEQ ID NO: 3641407 - RNA, 12 nt, Salmonella enterica enterica serovar Typhi
cgaucugaaugc

SEQ ID NO: 3641408 - RNA, 12 nt, Salmonella enterica enterica serovar Typhi
cgaucugugucg

SEQ ID NO: 3641409 - RNA, 18 nt, Salmonella enterica enterica serovar Typhi
cgaucuguuggugcgcgu

SEQ ID NO: 3641410 - RNA, 22 nt, Salmonella enterica enterica serovar Typhi
cgaugaaagagcgcgcgcgccu

SEQ ID NO: 3641411 - RNA, 22 nt, Salmonella enterica enterica serovar Typhi
cgaugaaaggucgaaaacggcc

SEQ ID NO: 3641412 - RNA, 17 nt, Salmonella enterica enterica serovar Typhi
cgaugaacaucgacaag

SEQ ID NO: 3641413 - RNA, 16 nt, Salmonella enterica enterica serovar Typhi
cgaugaacgacgcuga

SEQ ID NO: 3641414 - RNA, 13 nt, Salmonella enterica enterica serovar Typhi
cgaugacagcagg

SEQ ID NO: 3641415 - RNA, 14 nt, Salmonella enterica enterica serovar Typhi
cgaugacgacuuuu

SEQ ID NO: 3641416 - RNA, 15 nt, Salmonella enterica enterica serovar Typhi
cgaugacgacuuuuu

SEQ ID NO: 3641417 - RNA, 14 nt, Salmonella enterica enterica serovar Typhi
cgaugacucccagu

SEQ ID NO: 3641418 - RNA, 13 nt, Salmonella enterica enterica serovar Typhi
cgaugagcgccag

SEQ ID NO: 3641419 - RNA, 20 nt, Salmonella enterica enterica serovar Typhi
cgaugagcgcgaaaucaaag

SEQ ID NO: 3641420 - RNA, 19 nt, Salmonella enterica enterica serovar Typhi
cgaugaucgucgcgaucgc

SEQ ID NO: 3641421 - RNA, 17 nt, Salmonella enterica enterica serovar Typhi
cgaugaugaaaaagaau

SEQ ID NO: 3641422 - RNA, 20 nt, Salmonella enterica enterica serovar Typhi
cgaugauuuucaagccaaaa

SEQ ID NO: 3641423 - RNA, 14 nt, Salmonella enterica enterica serovar Typhi
cgaugcaaccccug

SEQ ID NO: 3641424 - RNA, 23 nt, Salmonella enterica enterica serovar Typhi
cgaugcaaccccugacgggcgau

SEQ ID NO: 3641425 - RNA, 23 nt, Salmonella enterica enterica serovar Typhi
cgaugcacaacacgcuuuucagc

SEQ ID NO: 3641426 - RNA, 12 nt, Salmonella enterica enterica serovar Typhi
cgaugcagcacc

SEQ ID NO: 3641427 - RNA, 13 nt, Salmonella enterica enterica serovar Typhi
cgaugcagccugg

SEQ ID NO: 3641428 - RNA, 17 nt, Salmonella enterica enterica serovar Typhi
cgaugccgccgacaacc

SEQ ID NO: 3641429 - RNA, 14 nt, Salmonella enterica enterica serovar Typhi
cgaugccucacccc

SEQ ID NO: 3641430 - RNA, 14 nt, Salmonella enterica enterica serovar Typhi
cgaugcgcuuuucc

SEQ ID NO: 3641431 - RNA, 23 nt, Salmonella enterica enterica serovar Typhi
cgaugcgcuuuuccaggcgacca

SEQ ID NO: 3641432 - RNA, 21 nt, Salmonella enterica enterica serovar Typhi
cgaugcggagauagcggugcc

SEQ ID NO: 3641433 - RNA, 17 nt, Salmonella enterica enterica serovar Typhi
cgaugcgguucaacgcg

SEQ ID NO: 3641434 - RNA, 15 nt, Salmonella enterica enterica serovar Typhi
cgaugcguucaaaaa

SEQ ID NO: 3641435 - RNA, 19 nt, Salmonella enterica enterica serovar Typhi
cgaugcguucaaaaagcug

SEQ ID NO: 3641436 - RNA, 18 nt, Salmonella enterica enterica serovar Typhi
cgaugcuaugauggccga

SEQ ID NO: 3641437 - RNA, 19 nt, Salmonella enterica enterica serovar Typhi
cgaugcucagggcauccgc

SEQ ID NO: 3641438 - RNA, 21 nt, Salmonella enterica enterica serovar Typhi
cgaugcugaauagccagcccc

SEQ ID NO: 3641439 - RNA, 18 nt, Salmonella enterica enterica serovar Typhi
cgaugcuguuucaguaaa

SEQ ID NO: 3641440 - RNA, 16 nt, Salmonella enterica enterica serovar Typhi
cgauggcagugaugga

SEQ ID NO: 3641441 - RNA, 18 nt, Salmonella enterica enterica serovar Typhi
cgauggccagaaugacau

SEQ ID NO: 3641442 - RNA, 20 nt, Salmonella enterica enterica serovar Typhi
cgauggccuguuuaagcuuu

SEQ ID NO: 3641443 - RNA, 16 nt, Salmonella enterica enterica serovar Typhi
cgauggcgauauugug

SEQ ID NO: 3641444 - RNA, 20 nt, Salmonella enterica enterica serovar Typhi
cgauggcgauuuucaccggc

SEQ ID NO: 3641445 - RNA, 13 nt, Salmonella enterica enterica serovar Typhi
cgauggcgcuacg

SEQ ID NO: 3641446 - RNA, 15 nt, Salmonella enterica enterica serovar Typhi
cgauggcgcuccuga

SEQ ID NO: 3641447 - RNA, 17 nt, Salmonella enterica enterica serovar Typhi
cgauggcgcugcgcgca

SEQ ID NO: 3641448 - RNA, 22 nt, Salmonella enterica enterica serovar Typhi
cgauggggcaagcucagcggca

SEQ ID NO: 3641449 - RNA, 15 nt, Salmonella enterica enterica serovar Typhi
cgauggucgccuccg

SEQ ID NO: 3641450 - RNA, 15 nt, Salmonella enterica enterica serovar Typhi
cgauggugcggcgca

SEQ ID NO: 3641451 - RNA, 17 nt, Salmonella enterica enterica serovar Typhi
cgauguaaaaccuggca

SEQ ID NO: 3641452 - RNA, 16 nt, Salmonella enterica enterica serovar Typhi
cgauguaguugccgcc

SEQ ID NO: 3641453 - RNA, 17 nt, Salmonella enterica enterica serovar Typhi
cgauguaguugccgccc

SEQ ID NO: 3641454 - RNA, 18 nt, Salmonella enterica enterica serovar Typhi
cgauguauuuauccacgc

SEQ ID NO: 3641455 - RNA, 14 nt, Salmonella enterica enterica serovar Typhi
cgaugucgccgccg

SEQ ID NO: 3641456 - RNA, 21 nt, Salmonella enterica enterica serovar Typhi
cgauguucgucccugcaacgc

SEQ ID NO: 3641457 - RNA, 21 nt, Salmonella enterica enterica serovar Typhi
cgauguucuugccgccaucuc

SEQ ID NO: 3641458 - RNA, 15 nt, Salmonella enterica enterica serovar Typhi
cgauguuugccacgc

SEQ ID NO: 3641459 - RNA, 18 nt, Salmonella enterica enterica serovar Typhi
cgauguuugccacgccaa

SEQ ID NO: 3641460 - RNA, 17 nt, Salmonella enterica enterica serovar Typhi
cgauuaaugcuccaaua

SEQ ID NO: 3641461 - RNA, 22 nt, Salmonella enterica enterica serovar Typhi
cgauuaaugcuccaauaaauau

SEQ ID NO: 3641462 - RNA, 18 nt, Salmonella enterica enterica serovar Typhi
cgauuacgccagacagca

SEQ ID NO: 3641463 - RNA, 22 nt, Salmonella enterica enterica serovar Typhi
cgauuagcuggcugcgcgggag

SEQ ID NO: 3641464 - RNA, 16 nt, Salmonella enterica enterica serovar Typhi
cgauucaaucugguga

SEQ ID NO: 3641465 - RNA, 17 nt, Salmonella enterica enterica serovar Typhi
cgauucauaugcgccaa

SEQ ID NO: 3641466 - RNA, 16 nt, Salmonella enterica enterica serovar Typhi
cgauucccgaucuuca

SEQ ID NO: 3641467 - RNA, 16 nt, Salmonella enterica enterica serovar Typhi
cgauucgcaugaauuc

SEQ ID NO: 3641468 - RNA, 20 nt, Salmonella enterica enterica serovar Typhi
cgauucucugaggguguuca

SEQ ID NO: 3641469 - RNA, 13 nt, Salmonella enterica enterica serovar Typhi
cgauucugccagu

SEQ ID NO: 3641470 - RNA, 12 nt, Salmonella enterica enterica serovar Typhi
cgauugaucgga

SEQ ID NO: 3641471 - RNA, 22 nt, Salmonella enterica enterica serovar Typhi
cgauugccgguccguucucuca

SEQ ID NO: 3641472 - RNA, 21 nt, Salmonella enterica enterica serovar Typhi
cgauuggccgucucuuucaug

SEQ ID NO: 3641473 - RNA, 13 nt, Salmonella enterica enterica serovar Typhi
cgauugucaucau

SEQ ID NO: 3641474 - RNA, 21 nt, Salmonella enterica enterica serovar Typhi
cgauuuaccucucaccaguag

SEQ ID NO: 3641475 - RNA, 15 nt, Salmonella enterica enterica serovar Typhi
cgauuuauccaccgc

SEQ ID NO: 3641476 - RNA, 19 nt, Salmonella enterica enterica serovar Typhi
cgauuuauccaccgccaga

SEQ ID NO: 3641477 - RNA, 12 nt, Salmonella enterica enterica serovar Typhi
cgauuuauucuu

SEQ ID NO: 3641478 - RNA, 18 nt, Salmonella enterica enterica serovar Typhi
cgauuucauuacgccugu

SEQ ID NO: 3641479 - RNA, 18 nt, Salmonella enterica enterica serovar Typhi
cgauuucauuggucuuca

SEQ ID NO: 3641480 - RNA, 16 nt, Salmonella enterica enterica serovar Typhi
cgauuuuaugcauggu

SEQ ID NO: 3641481 - RNA, 21 nt, Salmonella enterica enterica serovar Typhi
cgauuuucccuucugaaauga

SEQ ID NO: 3641482 - RNA, 18 nt, Salmonella enterica enterica serovar Typhi
cgauuuucuccggaagca

SEQ ID NO: 3641483 - RNA, 22 nt, Salmonella enterica enterica serovar Typhi
cgauuuugacaaugaugguuaa

SEQ ID NO: 3641484 - RNA, 17 nt, Salmonella enterica enterica serovar Typhi
cgauuuugguagcgcug

SEQ ID NO: 3641485 - RNA, 19 nt, Salmonella enterica enterica serovar Typhi
cgauuuuugaucucuuuag

SEQ ID NO: 3641486 - RNA, 14 nt, Salmonella enterica enterica serovar Typhi
cgcaaaaccuucau

SEQ ID NO: 3641487 - RNA, 15 nt, Salmonella enterica enterica serovar Typhi
cgcaaaagcgcgccc

SEQ ID NO: 3641488 - RNA, 12 nt, Salmonella enterica enterica serovar Typhi
cgcaaaaucgca

SEQ ID NO: 3641489 - RNA, 20 nt, Salmonella enterica enterica serovar Typhi
cgcaaaaucgcaaacgccag

SEQ ID NO: 3641490 - RNA, 16 nt, Salmonella enterica enterica serovar Typhi
cgcaaaauucacacca

SEQ ID NO: 3641491 - RNA, 17 nt, Salmonella enterica enterica serovar Typhi
cgcaaacagcacgcccu

SEQ ID NO: 3641492 - RNA, 12 nt, Salmonella enterica enterica serovar Typhi
cgcaaaccgcuu

SEQ ID NO: 3641493 - RNA, 18 nt, Salmonella enterica enterica serovar Typhi
cgcaaacgccugcuccgu

SEQ ID NO: 3641494 - RNA, 14 nt, Salmonella enterica enterica serovar Typhi
cgcaaacugccagg

SEQ ID NO: 3641495 - RNA, 19 nt, Salmonella enterica enterica serovar Typhi
cgcaaacugccaggcaauc

SEQ ID NO: 3641496 - RNA, 16 nt, Salmonella enterica enterica serovar Typhi
cgcaaacugcgcgccc

SEQ ID NO: 3641497 - RNA, 23 nt, Salmonella enterica enterica serovar Typhi
cgcaaacugcgcgcccgccuccg

SEQ ID NO: 3641498 - RNA, 17 nt, Salmonella enterica enterica serovar Typhi
cgcaaacuggccacagc

SEQ ID NO: 3641499 - RNA, 16 nt, Salmonella enterica enterica serovar Typhi
cgcaaagcccaucagc

SEQ ID NO: 3641500 - RNA, 18 nt, Salmonella enterica enterica serovar Typhi
cgcaaagcccaucagcgc

SEQ ID NO: 3641501 - RNA, 20 nt, Salmonella enterica enterica serovar Typhi
cgcaaagcccaucagcgcca

SEQ ID NO: 3641502 - RNA, 22 nt, Salmonella enterica enterica serovar Typhi
cgcaaaguuuucuuccgugccg

SEQ ID NO: 3641503 - RNA, 19 nt, Salmonella enterica enterica serovar Typhi
cgcaaauucaucgccgccg

SEQ ID NO: 3641504 - RNA, 19 nt, Salmonella enterica enterica serovar Typhi
cgcaaauucgucgccgcca

SEQ ID NO: 3641505 - RNA, 13 nt, Salmonella enterica enterica serovar Typhi
cgcaaauucugua

SEQ ID NO: 3641506 - RNA, 14 nt, Salmonella enterica enterica serovar Typhi
cgcaaccacggcgc

SEQ ID NO: 3641507 - RNA, 23 nt, Salmonella enterica enterica serovar Typhi
cgcaacgccggugccugccgccu

SEQ ID NO: 3641508 - RNA, 13 nt, Salmonella enterica enterica serovar Typhi
cgcaacgcgcacg

SEQ ID NO: 3641509 - RNA, 14 nt, Salmonella enterica enterica serovar Typhi
cgcaacgcgcauca

SEQ ID NO: 3641510 - RNA, 17 nt, Salmonella enterica enterica serovar Typhi
cgcaacgcgcaucaacg

SEQ ID NO: 3641511 - RNA, 18 nt, Salmonella enterica enterica serovar Typhi
cgcaacgcuaggcaaccu

SEQ ID NO: 3641512 - RNA, 22 nt, Salmonella enterica enterica serovar Typhi
cgcaacgcuuccaccucuucug

SEQ ID NO: 3641513 - RNA, 23 nt, Salmonella enterica enterica serovar Typhi
cgcaacguguaggcccgguaagc

SEQ ID NO: 3641514 - RNA, 16 nt, Salmonella enterica enterica serovar Typhi
cgcaacguuucuuuca

SEQ ID NO: 3641515 - RNA, 21 nt, Salmonella enterica enterica serovar Typhi
cgcaacguuucuuucaucaga

SEQ ID NO: 3641516 - RNA, 15 nt, Salmonella enterica enterica serovar Typhi
cgcaacucacgccau

SEQ ID NO: 3641517 - RNA, 14 nt, Salmonella enterica enterica serovar Typhi
cgcaacugaaacca

SEQ ID NO: 3641518 - RNA, 19 nt, Salmonella enterica enterica serovar Typhi
cgcaacuuaguguccacuc

SEQ ID NO: 3641519 - RNA, 18 nt, Salmonella enterica enterica serovar Typhi
cgcaagauuccagauagc

SEQ ID NO: 3641520 - RNA, 22 nt, Salmonella enterica enterica serovar Typhi
cgcaagcacugaaugcugacgc

SEQ ID NO: 3641521 - RNA, 12 nt, Salmonella enterica enterica serovar Typhi
cgcaagcagcac

SEQ ID NO: 3641522 - RNA, 13 nt, Salmonella enterica enterica serovar Typhi
cgcaagcagcaca

SEQ ID NO: 3641523 - RNA, 20 nt, Salmonella enterica enterica serovar Typhi
cgcaauacagcccgccagca

SEQ ID NO: 3641524 - RNA, 18 nt, Salmonella enterica enterica serovar Typhi
cgcaauagggggugacau

SEQ ID NO: 3641525 - RNA, 14 nt, Salmonella enterica enterica serovar Typhi
cgcaaucacauaca

SEQ ID NO: 3641526 - RNA, 22 nt, Salmonella enterica enterica serovar Typhi
cgcaaucacauacagcacuucc

SEQ ID NO: 3641527 - RNA, 21 nt, Salmonella enterica enterica serovar Typhi
cgcaaucacgcguuauacgca

SEQ ID NO: 3641528 - RNA, 13 nt, Salmonella enterica enterica serovar Typhi
cgcaauccccugg

SEQ ID NO: 3641529 - RNA, 14 nt, Salmonella enterica enterica serovar Typhi
cgcaaucccggaga

SEQ ID NO: 3641530 - RNA, 16 nt, Salmonella enterica enterica serovar Typhi
cgcaaucggcuuugac

SEQ ID NO: 3641531 - RNA, 18 nt, Salmonella enterica enterica serovar Typhi
cgcaaucuccgccgcuuu

SEQ ID NO: 3641532 - RNA, 21 nt, Salmonella enterica enterica serovar Typhi
cgcaaucucuuuauugcuggu

SEQ ID NO: 3641533 - RNA, 15 nt, Salmonella enterica enterica serovar Typhi
cgcaaucuggcgcaa

SEQ ID NO: 3641534 - RNA, 17 nt, Salmonella enterica enterica serovar Typhi
cgcaaucuggcggacaa

SEQ ID NO: 3641535 - RNA, 15 nt, Salmonella enterica enterica serovar Typhi
cgcaaugccaccaca

SEQ ID NO: 3641536 - RNA, 16 nt, Salmonella enterica enterica serovar Typhi
cgcaaugccaccacac

SEQ ID NO: 3641537 - RNA, 23 nt, Salmonella enterica enterica serovar Typhi
cgcaaugggggcuugcgccauuc

SEQ ID NO: 3641538 - RNA, 13 nt, Salmonella enterica enterica serovar Typhi
cgcaauuccagca

SEQ ID NO: 3641539 - RNA, 22 nt, Salmonella enterica enterica serovar Typhi
cgcaauuccugacugcgcgccu

SEQ ID NO: 3641540 - RNA, 22 nt, Salmonella enterica enterica serovar Typhi
cgcaauucuucuaccagaacga

SEQ ID NO: 3641541 - RNA, 23 nt, Salmonella enterica enterica serovar Typhi
cgcaauugguaauuaaaggcagc

SEQ ID NO: 3641542 - RNA, 15 nt, Salmonella enterica enterica serovar Typhi
cgcacaccagcgcau

SEQ ID NO: 3641543 - RNA, 15 nt, Salmonella enterica enterica serovar Typhi
cgcacacgccgugca

SEQ ID NO: 3641544 - RNA, 12 nt, Salmonella enterica enterica serovar Typhi
cgcacagcgcca

SEQ ID NO: 3641545 - RNA, 13 nt, Salmonella enterica enterica serovar Typhi
cgcacagcgccau

SEQ ID NO: 3641546 - RNA, 18 nt, Salmonella enterica enterica serovar Typhi
cgcacagggugaaaucac

SEQ ID NO: 3641547 - RNA, 13 nt, Salmonella enterica enterica serovar Typhi
cgcacauaaucac

SEQ ID NO: 3641548 - RNA, 17 nt, Salmonella enterica enterica serovar Typhi
cgcacauuuacgccagc

SEQ ID NO: 3641549 - RNA, 12 nt, Salmonella enterica enterica serovar Typhi
cgcaccagccag

SEQ ID NO: 3641550 - RNA, 17 nt, Salmonella enterica enterica serovar Typhi
cgcaccaguuccccaua

SEQ ID NO: 3641551 - RNA, 14 nt, Salmonella enterica enterica serovar Typhi
cgcacccgcgcagg

SEQ ID NO: 3641552 - RNA, 17 nt, Salmonella enterica enterica serovar Typhi
cgcaccgcgaugcugcu

SEQ ID NO: 3641553 - RNA, 17 nt, Salmonella enterica enterica serovar Typhi
cgcaccguugccauacg

SEQ ID NO: 3641554 - RNA, 16 nt, Salmonella enterica enterica serovar Typhi
cgcacgaccugaagcg

SEQ ID NO: 3641555 - RNA, 12 nt, Salmonella enterica enterica serovar Typhi
cgcacgccagau

SEQ ID NO: 3641556 - RNA, 14 nt, Salmonella enterica enterica serovar Typhi
cgcacgccagcggu

SEQ ID NO: 3641557 - RNA, 13 nt, Salmonella enterica enterica serovar Typhi
cgcacgcgcgccc

SEQ ID NO: 3641558 - RNA, 21 nt, Salmonella enterica enterica serovar Typhi
cgcacgcgucaucggcgcgcu

SEQ ID NO: 3641559 - RNA, 12 nt, Salmonella enterica enterica serovar Typhi
cgcacggcguua

SEQ ID NO: 3641560 - RNA, 21 nt, Salmonella enterica enterica serovar Typhi
cgcacuaccagaaacaacacg

SEQ ID NO: 3641561 - RNA, 21 nt, Salmonella enterica enterica serovar Typhi
cgcacuacggcaaacgcuggu

SEQ ID NO: 3641562 - RNA, 12 nt, Salmonella enterica enterica serovar Typhi
cgcacugccuga

SEQ ID NO: 3641563 - RNA, 15 nt, Salmonella enterica enterica serovar Typhi
cgcacuggcgccugc

SEQ ID NO: 3641564 - RNA, 22 nt, Salmonella enterica enterica serovar Typhi
cgcacuggucgggcaggcuucc

SEQ ID NO: 3641565 - RNA, 14 nt, Salmonella enterica enterica serovar Typhi
cgcagaaaaagccc

SEQ ID NO: 3641566 - RNA, 16 nt, Salmonella enterica enterica serovar Typhi
cgcagaagcagaccga

SEQ ID NO: 3641567 - RNA, 18 nt, Salmonella enterica enterica serovar Typhi
cgcagaaggucacgccgg

SEQ ID NO: 3641568 - RNA, 14 nt, Salmonella enterica enterica serovar Typhi
cgcagacacugcca

SEQ ID NO: 3641569 - RNA, 14 nt, Salmonella enterica enterica serovar Typhi
cgcagacaguggcc

SEQ ID NO: 3641570 - RNA, 12 nt, Salmonella enterica enterica serovar Typhi
cgcagacccuuu

SEQ ID NO: 3641571 - RNA, 16 nt, Salmonella enterica enterica serovar Typhi
cgcagaccgcgcucca

SEQ ID NO: 3641572 - RNA, 15 nt, Salmonella enterica enterica serovar Typhi
cgcagagcccagcgc

SEQ ID NO: 3641573 - RNA, 16 nt, Salmonella enterica enterica serovar Typhi
cgcagagcccagcgcg

SEQ ID NO: 3641574 - RNA, 17 nt, Salmonella enterica enterica serovar Typhi
cgcagagugagcaggcu

SEQ ID NO: 3641575 - RNA, 18 nt, Salmonella enterica enterica serovar Typhi
cgcagaguguaggccuga

SEQ ID NO: 3641576 - RNA, 15 nt, Salmonella enterica enterica serovar Typhi
cgcagauacgcguca

SEQ ID NO: 3641577 - RNA, 19 nt, Salmonella enterica enterica serovar Typhi
cgcagauaucuuccagcgc

SEQ ID NO: 3641578 - RNA, 13 nt, Salmonella enterica enterica serovar Typhi
cgcagauccagca

SEQ ID NO: 3641579 - RNA, 18 nt, Salmonella enterica enterica serovar Typhi
cgcagaucguauccagcg

SEQ ID NO: 3641580 - RNA, 16 nt, Salmonella enterica enterica serovar Typhi
cgcagaugcccgcaga

SEQ ID NO: 3641581 - RNA, 17 nt, Salmonella enterica enterica serovar Typhi
cgcagaugcccgcagau

SEQ ID NO: 3641582 - RNA, 12 nt, Salmonella enterica enterica serovar Typhi
cgcagaugcugc

SEQ ID NO: 3641583 - RNA, 18 nt, Salmonella enterica enterica serovar Typhi
cgcagcaaacgccauagc

SEQ ID NO: 3641584 - RNA, 15 nt, Salmonella enterica enterica serovar Typhi
cgcagcaaaucagcu

SEQ ID NO: 3641585 - RNA, 16 nt, Salmonella enterica enterica serovar Typhi
cgcagcaacaguugcu

SEQ ID NO: 3641586 - RNA, 17 nt, Salmonella enterica enterica serovar Typhi
cgcagcacaugcaauuu

SEQ ID NO: 3641587 - RNA, 18 nt, Salmonella enterica enterica serovar Typhi
cgcagcacuucagaacgg

SEQ ID NO: 3641588 - RNA, 18 nt, Salmonella enterica enterica serovar Typhi
cgcagcagagaucaggag

SEQ ID NO: 3641589 - RNA, 14 nt, Salmonella enterica enterica serovar Typhi
cgcagccaacaaca

SEQ ID NO: 3641590 - RNA, 20 nt, Salmonella enterica enterica serovar Typhi
cgcagccaacaacaggccgc

SEQ ID NO: 3641591 - RNA, 15 nt, Salmonella enterica enterica serovar Typhi
cgcagccccagcgcc

SEQ ID NO: 3641592 - RNA, 17 nt, Salmonella enterica enterica serovar Typhi
cgcagccgcaaucagcg

SEQ ID NO: 3641593 - RNA, 17 nt, Salmonella enterica enterica serovar Typhi
cgcagccgccauccggc

SEQ ID NO: 3641594 - RNA, 22 nt, Salmonella enterica enterica serovar Typhi
cgcagcgaaaauccaguaauuu

SEQ ID NO: 3641595 - RNA, 21 nt, Salmonella enterica enterica serovar Typhi
cgcagcgaacucccgggcgcu

SEQ ID NO: 3641596 - RNA, 15 nt, Salmonella enterica enterica serovar Typhi
cgcagcgcaacgccu

SEQ ID NO: 3641597 - RNA, 18 nt, Salmonella enterica enterica serovar Typhi
cgcagcgcauccaccaga

SEQ ID NO: 3641598 - RNA, 21 nt, Salmonella enterica enterica serovar Typhi
cgcagcgcauccaccagaccc

SEQ ID NO: 3641599 - RNA, 18 nt, Salmonella enterica enterica serovar Typhi
cgcagcgccaucaggccc

SEQ ID NO: 3641600 - RNA, 20 nt, Salmonella enterica enterica serovar Typhi
cgcagcgccgacguuaucgc

SEQ ID NO: 3641601 - RNA, 13 nt, Salmonella enterica enterica serovar Typhi
cgcagcgcggcgc

SEQ ID NO: 3641602 - RNA, 22 nt, Salmonella enterica enterica serovar Typhi
cgcagcgcuuuugccgcgccca

SEQ ID NO: 3641603 - RNA, 13 nt, Salmonella enterica enterica serovar Typhi
cgcagcggcugcg

SEQ ID NO: 3641604 - RNA, 16 nt, Salmonella enterica enterica serovar Typhi
cgcagcgucaucaggc

SEQ ID NO: 3641605 - RNA, 16 nt, Salmonella enterica enterica serovar Typhi
cgcagcuccagcucag

SEQ ID NO: 3641606 - RNA, 15 nt, Salmonella enterica enterica serovar Typhi
cgcaggacagcgaca

SEQ ID NO: 3641607 - RNA, 19 nt, Salmonella enterica enterica serovar Typhi
cgcaggacuuucgcuucac

SEQ ID NO: 3641608 - RNA, 21 nt, Salmonella enterica enterica serovar Typhi
cgcaggacuuucgcuucacga

SEQ ID NO: 3641609 - RNA, 14 nt, Salmonella enterica enterica serovar Typhi
cgcaggagagccag

SEQ ID NO: 3641610 - RNA, 16 nt, Salmonella enterica enterica serovar Typhi
cgcaggaggcuuccgc

SEQ ID NO: 3641611 - RNA, 22 nt, Salmonella enterica enterica serovar Typhi
cgcaggauaaagaccggcacaa

SEQ ID NO: 3641612 - RNA, 19 nt, Salmonella enterica enterica serovar Typhi
cgcaggaugcgcugcgcgc

SEQ ID NO: 3641613 - RNA, 12 nt, Salmonella enterica enterica serovar Typhi
cgcaggccaaac

SEQ ID NO: 3641614 - RNA, 13 nt, Salmonella enterica enterica serovar Typhi
cgcaggccggaua

SEQ ID NO: 3641615 - RNA, 12 nt, Salmonella enterica enterica serovar Typhi
cgcaggcgagcg

SEQ ID NO: 3641616 - RNA, 12 nt, Salmonella enterica enterica serovar Typhi
cgcagggcugcu

SEQ ID NO: 3641617 - RNA, 22 nt, Salmonella enterica enterica serovar Typhi
cgcaggggcauuuuccggcgac

SEQ ID NO: 3641618 - RNA, 16 nt, Salmonella enterica enterica serovar Typhi
cgcaggggggaaauga

SEQ ID NO: 3641619 - RNA, 15 nt, Salmonella enterica enterica serovar Typhi
cgcagguaaaaucca

SEQ ID NO: 3641620 - RNA, 20 nt, Salmonella enterica enterica serovar Typhi
cgcaggucuucgucagcgca

SEQ ID NO: 3641621 - RNA, 14 nt, Salmonella enterica enterica serovar Typhi
cgcagguuuuacuu

SEQ ID NO: 3641622 - RNA, 14 nt, Salmonella enterica enterica serovar Typhi
cgcaguaacgucgc

SEQ ID NO: 3641623 - RNA, 22 nt, Salmonella enterica enterica serovar Typhi
cgcagucagccuugaccgccug

SEQ ID NO: 3641624 - RNA, 20 nt, Salmonella enterica enterica serovar Typhi
cgcaguccagaugcgccaga

SEQ ID NO: 3641625 - RNA, 21 nt, Salmonella enterica enterica serovar Typhi
cgcagucgauuuaaugccuau

SEQ ID NO: 3641626 - RNA, 15 nt, Salmonella enterica enterica serovar Typhi
cgcaguuaugcgcau

SEQ ID NO: 3641627 - RNA, 14 nt, Salmonella enterica enterica serovar Typhi
cgcaguucaauauu

SEQ ID NO: 3641628 - RNA, 13 nt, Salmonella enterica enterica serovar Typhi
cgcaguuccagcg

SEQ ID NO: 3641629 - RNA, 22 nt, Salmonella enterica enterica serovar Typhi
cgcaguuugucuucgaugcgcu

SEQ ID NO: 3641630 - RNA, 17 nt, Salmonella enterica enterica serovar Typhi
cgcaguuuguggcgugu

SEQ ID NO: 3641631 - RNA, 16 nt, Salmonella enterica enterica serovar Typhi
cgcauaauccagcagg

SEQ ID NO: 3641632 - RNA, 14 nt, Salmonella enterica enterica serovar Typhi
cgcauaccagccau

SEQ ID NO: 3641633 - RNA, 15 nt, Salmonella enterica enterica serovar Typhi
cgcauaccagccaua

SEQ ID NO: 3641634 - RNA, 22 nt, Salmonella enterica enterica serovar Typhi
cgcauacgccccgguggcggua

SEQ ID NO: 3641635 - RNA, 15 nt, Salmonella enterica enterica serovar Typhi
cgcauacuaccgcug

SEQ ID NO: 3641636 - RNA, 19 nt, Salmonella enterica enterica serovar Typhi
cgcauacucuuggagagca

SEQ ID NO: 3641637 - RNA, 17 nt, Salmonella enterica enterica serovar Typhi
cgcauagaauuucaggg

SEQ ID NO: 3641638 - RNA, 13 nt, Salmonella enterica enterica serovar Typhi
cgcauagcggcca

SEQ ID NO: 3641639 - RNA, 15 nt, Salmonella enterica enterica serovar Typhi
cgcauagcggccaga

SEQ ID NO: 3641640 - RNA, 20 nt, Salmonella enterica enterica serovar Typhi
cgcauagcggccagauggca

SEQ ID NO: 3641641 - RNA, 18 nt, Salmonella enterica enterica serovar Typhi
cgcauaggcuuugcugag

SEQ ID NO: 3641642 - RNA, 21 nt, Salmonella enterica enterica serovar Typhi
cgcauaggcuuugcugagcgc

SEQ ID NO: 3641643 - RNA, 21 nt, Salmonella enterica enterica serovar Typhi
cgcauagguugauauaaaacg

SEQ ID NO: 3641644 - RNA, 15 nt, Salmonella enterica enterica serovar Typhi
cgcauaguccugccg

SEQ ID NO: 3641645 - RNA, 13 nt, Salmonella enterica enterica serovar Typhi
cgcauauccagca

SEQ ID NO: 3641646 - RNA, 15 nt, Salmonella enterica enterica serovar Typhi
cgcauauccagcaga

SEQ ID NO: 3641647 - RNA, 19 nt, Salmonella enterica enterica serovar Typhi
cgcauaucccacugcacgc

SEQ ID NO: 3641648 - RNA, 19 nt, Salmonella enterica enterica serovar Typhi
cgcauauguuuaguacgca

SEQ ID NO: 3641649 - RNA, 13 nt, Salmonella enterica enterica serovar Typhi
cgcauauuuuuua

SEQ ID NO: 3641650 - RNA, 23 nt, Salmonella enterica enterica serovar Typhi
cgcauauuuuuuaccgcccgcuu

SEQ ID NO: 3641651 - RNA, 22 nt, Salmonella enterica enterica serovar Typhi
cgcaucacgcgaagcggcguca

SEQ ID NO: 3641652 - RNA, 14 nt, Salmonella enterica enterica serovar Typhi
cgcaucagaaaaac

SEQ ID NO: 3641653 - RNA, 22 nt, Salmonella enterica enterica serovar Typhi
cgcaucagaaaaaccuccggcu

SEQ ID NO: 3641654 - RNA, 18 nt, Salmonella enterica enterica serovar Typhi
cgcaucaggaucuucauc

SEQ ID NO: 3641655 - RNA, 13 nt, Salmonella enterica enterica serovar Typhi
cgcauccagccac

SEQ ID NO: 3641656 - RNA, 11 nt, Salmonella enterica enterica serovar Typhi
cgcauccagcg

SEQ ID NO: 3641657 - RNA, 13 nt, Salmonella enterica enterica serovar Typhi
cgcauccagcgca

SEQ ID NO: 3641658 - RNA, 13 nt, Salmonella enterica enterica serovar Typhi
cgcauccagcguc

SEQ ID NO: 3641659 - RNA, 14 nt, Salmonella enterica enterica serovar Typhi
cgcauccagggagu

SEQ ID NO: 3641660 - RNA, 14 nt, Salmonella enterica enterica serovar Typhi
cgcaucccgccaac

SEQ ID NO: 3641661 - RNA, 15 nt, Salmonella enterica enterica serovar Typhi
cgcauccggaaucgc

SEQ ID NO: 3641662 - RNA, 12 nt, Salmonella enterica enterica serovar Typhi
cgcauccggcaa

SEQ ID NO: 3641663 - RNA, 14 nt, Salmonella enterica enterica serovar Typhi
cgcauccggccagc

SEQ ID NO: 3641664 - RNA, 22 nt, Salmonella enterica enterica serovar Typhi
cgcauccgggaguuucaugcca

SEQ ID NO: 3641665 - RNA, 16 nt, Salmonella enterica enterica serovar Typhi
cgcauccgguaaacgc

SEQ ID NO: 3641666 - RNA, 16 nt, Salmonella enterica enterica serovar Typhi
cgcauccgucaaaaug

SEQ ID NO: 3641667 - RNA, 21 nt, Salmonella enterica enterica serovar Typhi
cgcaucgaagagcauaugcgc

SEQ ID NO: 3641668 - RNA, 20 nt, Salmonella enterica enterica serovar Typhi
cgcaucgccgcaagcggcaa

SEQ ID NO: 3641669 - RNA, 17 nt, Salmonella enterica enterica serovar Typhi
cgcaucgccgcggcgcu

SEQ ID NO: 3641670 - RNA, 21 nt, Salmonella enterica enterica serovar Typhi
cgcaucgccgcggcgcuggcc

SEQ ID NO: 3641671 - RNA, 19 nt, Salmonella enterica enterica serovar Typhi
cgcaucggcccuguauaca

SEQ ID NO: 3641672 - RNA, 15 nt, Salmonella enterica enterica serovar Typhi
cgcaucgggaaacgg

SEQ ID NO: 3641673 - RNA, 12 nt, Salmonella enterica enterica serovar Typhi
cgcaucgguaau

SEQ ID NO: 3641674 - RNA, 16 nt, Salmonella enterica enterica serovar Typhi
cgcaucuucgcccggc

SEQ ID NO: 3641675 - RNA, 14 nt, Salmonella enterica enterica serovar Typhi
cgcaucuuuuuccc

SEQ ID NO: 3641676 - RNA, 13 nt, Salmonella enterica enterica serovar Typhi
cgcaugaggccug

SEQ ID NO: 3641677 - RNA, 17 nt, Salmonella enterica enterica serovar Typhi
cgcauggcagggcgaua

SEQ ID NO: 3641678 - RNA, 15 nt, Salmonella enterica enterica serovar Typhi
cgcauggcguugcug

SEQ ID NO: 3641679 - RNA, 14 nt, Salmonella enterica enterica serovar Typhi
cgcaugguaaacgc

SEQ ID NO: 3641680 - RNA, 17 nt, Salmonella enterica enterica serovar Typhi
cgcaugugagcaucggc

SEQ ID NO: 3641681 - RNA, 21 nt, Salmonella enterica enterica serovar Typhi
cgcauguuucgcuucaauucg

SEQ ID NO: 3641682 - RNA, 22 nt, Salmonella enterica enterica serovar Typhi
cgcauuaauauuucacgagcga

SEQ ID NO: 3641683 - RNA, 22 nt, Salmonella enterica enterica serovar Typhi
cgcauucaggcgacggaaacgc

SEQ ID NO: 3641684 - RNA, 13 nt, Salmonella enterica enterica serovar Typhi
cgcauucuuuuuu

SEQ ID NO: 3641685 - RNA, 22 nt, Salmonella enterica enterica serovar Typhi
cgcauugagacaugccgccaga

SEQ ID NO: 3641686 - RNA, 16 nt, Salmonella enterica enterica serovar Typhi
cgcauugccacagccu

SEQ ID NO: 3641687 - RNA, 14 nt, Salmonella enterica enterica serovar Typhi
cgcauugccggcga

SEQ ID NO: 3641688 - RNA, 18 nt, Salmonella enterica enterica serovar Typhi
cgcauugcgccccagcac

SEQ ID NO: 3641689 - RNA, 19 nt, Salmonella enterica enterica serovar Typhi
cgcauugcgccccagcaca

SEQ ID NO: 3641690 - RNA, 18 nt, Salmonella enterica enterica serovar Typhi
cgcauugguaaagccggu

SEQ ID NO: 3641691 - RNA, 15 nt, Salmonella enterica enterica serovar Typhi
cgcauuugcuuucau

SEQ ID NO: 3641692 - RNA, 16 nt, Salmonella enterica enterica serovar Typhi
cgcauuuuaccucacg

SEQ ID NO: 3641693 - RNA, 15 nt, Salmonella enterica enterica serovar Typhi
cgcauuuuuaucagg

SEQ ID NO: 3641694 - RNA, 19 nt, Salmonella enterica enterica serovar Typhi
cgcauuuuucuucacgccg

SEQ ID NO: 3641695 - RNA, 17 nt, Salmonella enterica enterica serovar Typhi
cgccaaaaagugaaucg

SEQ ID NO: 3641696 - RNA, 16 nt, Salmonella enterica enterica serovar Typhi
cgccaaaagaggcagc

SEQ ID NO: 3641697 - RNA, 21 nt, Salmonella enterica enterica serovar Typhi
cgccaaaagaggcagcaaagc

SEQ ID NO: 3641698 - RNA, 14 nt, Salmonella enterica enterica serovar Typhi
cgccaaaccggcga

SEQ ID NO: 3641699 - RNA, 15 nt, Salmonella enterica enterica serovar Typhi
cgccaaaccugccac

SEQ ID NO: 3641700 - RNA, 19 nt, Salmonella enterica enterica serovar Typhi
cgccaaaccugccacaggc

SEQ ID NO: 3641701 - RNA, 22 nt, Salmonella enterica enterica serovar Typhi
cgccaaaccugccacaggccaa

SEQ ID NO: 3641702 - RNA, 14 nt, Salmonella enterica enterica serovar Typhi
cgccaaacgggcaa

SEQ ID NO: 3641703 - RNA, 23 nt, Salmonella enterica enterica serovar Typhi
cgccaaagcaaucgccagcgccu

SEQ ID NO: 3641704 - RNA, 18 nt, Salmonella enterica enterica serovar Typhi
cgccaaagcagcugcugg

SEQ ID NO: 3641705 - RNA, 23 nt, Salmonella enterica enterica serovar Typhi
cgccaaagcagugaauccccaga

SEQ ID NO: 3641706 - RNA, 19 nt, Salmonella enterica enterica serovar Typhi
cgccaaagcgauccggcau

SEQ ID NO: 3641707 - RNA, 22 nt, Salmonella enterica enterica serovar Typhi
cgccaaagcgauccggcaucca

SEQ ID NO: 3641708 - RNA, 22 nt, Salmonella enterica enterica serovar Typhi
cgccaaagucauugcugccagu

SEQ ID NO: 3641709 - RNA, 15 nt, Salmonella enterica enterica serovar Typhi
cgccaaccaucggca

SEQ ID NO: 3641710 - RNA, 13 nt, Salmonella enterica enterica serovar Typhi
cgccaaccgccau

SEQ ID NO: 3641711 - RNA, 12 nt, Salmonella enterica enterica serovar Typhi
cgccaaccggcu

SEQ ID NO: 3641712 - RNA, 20 nt, Salmonella enterica enterica serovar Typhi
cgccaaccgugagcgcgccg

SEQ ID NO: 3641713 - RNA, 14 nt, Salmonella enterica enterica serovar Typhi
cgccaaccucccaa

SEQ ID NO: 3641714 - RNA, 23 nt, Salmonella enterica enterica serovar Typhi
cgccaaccucccaaccaguauga

SEQ ID NO: 3641715 - RNA, 15 nt, Salmonella enterica enterica serovar Typhi
cgccaaccugcuggu

SEQ ID NO: 3641716 - RNA, 12 nt, Salmonella enterica enterica serovar Typhi
cgccaacgccac

SEQ ID NO: 3641717 - RNA, 20 nt, Salmonella enterica enterica serovar Typhi
cgccaagaccgccuaacagc

SEQ ID NO: 3641718 - RNA, 13 nt, Salmonella enterica enterica serovar Typhi
cgccaagcgcgga

SEQ ID NO: 3641719 - RNA, 20 nt, Salmonella enterica enterica serovar Typhi
cgccaagcgcggcagcagcu

SEQ ID NO: 3641720 - RNA, 17 nt, Salmonella enterica enterica serovar Typhi
cgccaagcggcaacucu

SEQ ID NO: 3641721 - RNA, 14 nt, Salmonella enterica enterica serovar Typhi
cgccaagcugugau

SEQ ID NO: 3641722 - RNA, 15 nt, Salmonella enterica enterica serovar Typhi
cgccaaguacgccuu

SEQ ID NO: 3641723 - RNA, 16 nt, Salmonella enterica enterica serovar Typhi
cgccaaguucggugac

SEQ ID NO: 3641724 - RNA, 18 nt, Salmonella enterica enterica serovar Typhi
cgccaauaauauugaacg

SEQ ID NO: 3641725 - RNA, 17 nt, Salmonella enterica enterica serovar Typhi
cgccaauaaugccgccg

SEQ ID NO: 3641726 - RNA, 20 nt, Salmonella enterica enterica serovar Typhi
cgccaaucaacgccgccagg

SEQ ID NO: 3641727 - RNA, 20 nt, Salmonella enterica enterica serovar Typhi
cgccaauccaugccggcuuu

SEQ ID NO: 3641728 - RNA, 18 nt, Salmonella enterica enterica serovar Typhi
cgccaaucgcgauaucaa

SEQ ID NO: 3641729 - RNA, 12 nt, Salmonella enterica enterica serovar Typhi
cgccaaucggcg

SEQ ID NO: 3641730 - RNA, 22 nt, Salmonella enterica enterica serovar Typhi
cgccaaucggcgucuugccgca

SEQ ID NO: 3641731 - RNA, 15 nt, Salmonella enterica enterica serovar Typhi
cgccaaucuguaauu

SEQ ID NO: 3641732 - RNA, 11 nt, Salmonella enterica enterica serovar Typhi
cgccaaugaac

SEQ ID NO: 3641733 - RNA, 15 nt, Salmonella enterica enterica serovar Typhi
cgccaaugccgcagc

SEQ ID NO: 3641734 - RNA, 17 nt, Salmonella enterica enterica serovar Typhi
cgccaauggccgccccc

SEQ ID NO: 3641735 - RNA, 19 nt, Salmonella enterica enterica serovar Typhi
cgccaaugguuaacgccgu

SEQ ID NO: 3641736 - RNA, 16 nt, Salmonella enterica enterica serovar Typhi
cgccaauuaaauaucc

SEQ ID NO: 3641737 - RNA, 15 nt, Salmonella enterica enterica serovar Typhi
cgccacaaacugcgc

SEQ ID NO: 3641738 - RNA, 20 nt, Salmonella enterica enterica serovar Typhi
cgccacaauauccgccccgc

SEQ ID NO: 3641739 - RNA, 22 nt, Salmonella enterica enterica serovar Typhi
cgccacaauauccgccccgcug

SEQ ID NO: 3641740 - RNA, 17 nt, Salmonella enterica enterica serovar Typhi
cgccacaccgagacaga

SEQ ID NO: 3641741 - RNA, 22 nt, Salmonella enterica enterica serovar Typhi
cgccacagcggaauagacggcc

SEQ ID NO: 3641742 - RNA, 19 nt, Salmonella enterica enterica serovar Typhi
cgccacaguauuccggcau

SEQ ID NO: 3641743 - RNA, 15 nt, Salmonella enterica enterica serovar Typhi
cgccacaugcggcag

SEQ ID NO: 3641744 - RNA, 18 nt, Salmonella enterica enterica serovar Typhi
cgccacauugaccccaua

SEQ ID NO: 3641745 - RNA, 12 nt, Salmonella enterica enterica serovar Typhi
cgccaccaaaaa

SEQ ID NO: 3641746 - RNA, 22 nt, Salmonella enterica enterica serovar Typhi
cgccaccaaaaacgcccccaga

SEQ ID NO: 3641747 - RNA, 16 nt, Salmonella enterica enterica serovar Typhi
cgccaccaaagccagg

SEQ ID NO: 3641748 - RNA, 20 nt, Salmonella enterica enterica serovar Typhi
cgccaccaaagccaggccgc

SEQ ID NO: 3641749 - RNA, 18 nt, Salmonella enterica enterica serovar Typhi
cgccaccacaaacgccgu

SEQ ID NO: 3641750 - RNA, 19 nt, Salmonella enterica enterica serovar Typhi
cgccaccacauucaggcgg

SEQ ID NO: 3641751 - RNA, 13 nt, Salmonella enterica enterica serovar Typhi
cgccaccaccagc

SEQ ID NO: 3641752 - RNA, 20 nt, Salmonella enterica enterica serovar Typhi
cgccaccacgcccaacgacc

SEQ ID NO: 3641753 - RNA, 17 nt, Salmonella enterica enterica serovar Typhi
cgccaccagcacagccc

SEQ ID NO: 3641754 - RNA, 13 nt, Salmonella enterica enterica serovar Typhi
cgccaccagcgau

SEQ ID NO: 3641755 - RNA, 14 nt, Salmonella enterica enterica serovar Typhi
cgccaccagcgcag

SEQ ID NO: 3641756 - RNA, 20 nt, Salmonella enterica enterica serovar Typhi
cgccaccaggcucaaauugg

SEQ ID NO: 3641757 - RNA, 17 nt, Salmonella enterica enterica serovar Typhi
cgccaccauccggcgcu

SEQ ID NO: 3641758 - RNA, 19 nt, Salmonella enterica enterica serovar Typhi
cgccaccaucgucgccaga

SEQ ID NO: 3641759 - RNA, 21 nt, Salmonella enterica enterica serovar Typhi
cgccaccaucgucgccagacc

SEQ ID NO: 3641760 - RNA, 17 nt, Salmonella enterica enterica serovar Typhi
cgccaccauguugcgca

SEQ ID NO: 3641761 - RNA, 12 nt, Salmonella enterica enterica serovar Typhi
cgccacccggcu

SEQ ID NO: 3641762 - RNA, 13 nt, Salmonella enterica enterica serovar Typhi
cgccaccgcaugg

SEQ ID NO: 3641763 - RNA, 15 nt, Salmonella enterica enterica serovar Typhi
cgccaccgccgccac

SEQ ID NO: 3641764 - RNA, 14 nt, Salmonella enterica enterica serovar Typhi
cgccaccgcgcgca

SEQ ID NO: 3641765 - RNA, 14 nt, Salmonella enterica enterica serovar Typhi
cgccaccgcgcgcu

SEQ ID NO: 3641766 - RNA, 15 nt, Salmonella enterica enterica serovar Typhi
cgccaccgcgcgcuu

SEQ ID NO: 3641767 - RNA, 19 nt, Salmonella enterica enterica serovar Typhi
cgccaccgggcaacacacg

SEQ ID NO: 3641768 - RNA, 22 nt, Salmonella enterica enterica serovar Typhi
cgccaccgggcaacacacgcuu

SEQ ID NO: 3641769 - RNA, 17 nt, Salmonella enterica enterica serovar Typhi
cgccaccgggcaacccg

SEQ ID NO: 3641770 - RNA, 19 nt, Salmonella enterica enterica serovar Typhi
cgccaccguaacuacaaua

SEQ ID NO: 3641771 - RNA, 23 nt, Salmonella enterica enterica serovar Typhi
cgccaccugcccuuucagagcgu

SEQ ID NO: 3641772 - RNA, 22 nt, Salmonella enterica enterica serovar Typhi
cgccaccuguuucgccaggccg

SEQ ID NO: 3641773 - RNA, 17 nt, Salmonella enterica enterica serovar Typhi
cgccaccuuucugcucc

SEQ ID NO: 3641774 - RNA, 21 nt, Salmonella enterica enterica serovar Typhi
cgccacgauagacagcaccau

SEQ ID NO: 3641775 - RNA, 15 nt, Salmonella enterica enterica serovar Typhi
cgccacgcagcgacg

SEQ ID NO: 3641776 - RNA, 13 nt, Salmonella enterica enterica serovar Typhi
cgccacgccaccg

SEQ ID NO: 3641777 - RNA, 15 nt, Salmonella enterica enterica serovar Typhi
cgccacgccgcccgc

SEQ ID NO: 3641778 - RNA, 17 nt, Salmonella enterica enterica serovar Typhi
cgccacgccgcuccaca

SEQ ID NO: 3641779 - RNA, 20 nt, Salmonella enterica enterica serovar Typhi
cgccacgcgacgccagccga

SEQ ID NO: 3641780 - RNA, 17 nt, Salmonella enterica enterica serovar Typhi
cgccacgcgccaggucu

SEQ ID NO: 3641781 - RNA, 15 nt, Salmonella enterica enterica serovar Typhi
cgccacgcuccuucu

SEQ ID NO: 3641782 - RNA, 23 nt, Salmonella enterica enterica serovar Typhi
cgccacggauggccucugccagu

SEQ ID NO: 3641783 - RNA, 16 nt, Salmonella enterica enterica serovar Typhi
cgccacggccagcagc

SEQ ID NO: 3641784 - RNA, 18 nt, Salmonella enterica enterica serovar Typhi
cgccacggccagcagcca

SEQ ID NO: 3641785 - RNA, 22 nt, Salmonella enterica enterica serovar Typhi
cgccacggccagcagccauucg

SEQ ID NO: 3641786 - RNA, 14 nt, Salmonella enterica enterica serovar Typhi
cgccacgucggaua

SEQ ID NO: 3641787 - RNA, 14 nt, Salmonella enterica enterica serovar Typhi
cgccacgucggcga

SEQ ID NO: 3641788 - RNA, 19 nt, Salmonella enterica enterica serovar Typhi
cgccacucuggcgacgcca

SEQ ID NO: 3641789 - RNA, 21 nt, Salmonella enterica enterica serovar Typhi
cgccacucuggcgacgccaau

SEQ ID NO: 3641790 - RNA, 21 nt, Salmonella enterica enterica serovar Typhi
cgccacugaauuacugcguaa

SEQ ID NO: 3641791 - RNA, 20 nt, Salmonella enterica enterica serovar Typhi
cgccacuucacuggcggcaa

SEQ ID NO: 3641792 - RNA, 13 nt, Salmonella enterica enterica serovar Typhi
cgccacuuccagc

SEQ ID NO: 3641793 - RNA, 14 nt, Salmonella enterica enterica serovar Typhi
cgccacuuccagcg

SEQ ID NO: 3641794 - RNA, 21 nt, Salmonella enterica enterica serovar Typhi
cgccacuuccgcuacguucgg

SEQ ID NO: 3641795 - RNA, 20 nt, Salmonella enterica enterica serovar Typhi
cgccacuucuuugaccagcg

SEQ ID NO: 3641796 - RNA, 19 nt, Salmonella enterica enterica serovar Typhi
cgccacuuuuccggcaccu

SEQ ID NO: 3641797 - RNA, 16 nt, Salmonella enterica enterica serovar Typhi
cgccagaauagcgcag

SEQ ID NO: 3641798 - RNA, 23 nt, Salmonella enterica enterica serovar Typhi
cgccagacacuggaaacagccaa

SEQ ID NO: 3641799 - RNA, 23 nt, Salmonella enterica enterica serovar Typhi
cgccagacccacuaacugccgcu

SEQ ID NO: 3641800 - RNA, 15 nt, Salmonella enterica enterica serovar Typhi
cgccagacccagcgc

SEQ ID NO: 3641801 - RNA, 16 nt, Salmonella enterica enterica serovar Typhi
cgccagacccagcgcu

SEQ ID NO: 3641802 - RNA, 18 nt, Salmonella enterica enterica serovar Typhi
cgccagacccgcaauaac

SEQ ID NO: 3641803 - RNA, 23 nt, Salmonella enterica enterica serovar Typhi
cgccagacccgcaauaacgccga

SEQ ID NO: 3641804 - RNA, 17 nt, Salmonella enterica enterica serovar Typhi
cgccagaccgacgccaa

SEQ ID NO: 3641805 - RNA, 18 nt, Salmonella enterica enterica serovar Typhi
cgccagaccgacgccaac

SEQ ID NO: 3641806 - RNA, 16 nt, Salmonella enterica enterica serovar Typhi
cgccagacucagccag

SEQ ID NO: 3641807 - RNA, 21 nt, Salmonella enterica enterica serovar Typhi
cgccagacucagccaggucug

SEQ ID NO: 3641808 - RNA, 14 nt, Salmonella enterica enterica serovar Typhi
cgccagaggcgugc

SEQ ID NO: 3641809 - RNA, 21 nt, Salmonella enterica enterica serovar Typhi
cgccagaggcgugcaugggca

SEQ ID NO: 3641810 - RNA, 14 nt, Salmonella enterica enterica serovar Typhi
cgccagauaaagcg

SEQ ID NO: 3641811 - RNA, 17 nt, Salmonella enterica enterica serovar Typhi
cgccagauaaaucagcc

SEQ ID NO: 3641812 - RNA, 21 nt, Salmonella enterica enterica serovar Typhi
cgccagauaaucgccgccagc

SEQ ID NO: 3641813 - RNA, 15 nt, Salmonella enterica enterica serovar Typhi
cgccagauacacgcc

SEQ ID NO: 3641814 - RNA, 16 nt, Salmonella enterica enterica serovar Typhi
cgccagauacacgccu

SEQ ID NO: 3641815 - RNA, 16 nt, Salmonella enterica enterica serovar Typhi
cgccagauccggcagc

SEQ ID NO: 3641816 - RNA, 20 nt, Salmonella enterica enterica serovar Typhi
cgccagaucgaacagcggca

SEQ ID NO: 3641817 - RNA, 23 nt, Salmonella enterica enterica serovar Typhi
cgccagaucgaacagcggcaggc

SEQ ID NO: 3641818 - RNA, 14 nt, Salmonella enterica enterica serovar Typhi
cgccagaugcaccg

SEQ ID NO: 3641819 - RNA, 22 nt, Salmonella enterica enterica serovar Typhi
cgccagaugcuuaaacugcgcg

SEQ ID NO: 3641820 - RNA, 16 nt, Salmonella enterica enterica serovar Typhi
cgccagaugucggcgg

SEQ ID NO: 3641821 - RNA, 14 nt, Salmonella enterica enterica serovar Typhi
cgccagauuaucca

SEQ ID NO: 3641822 - RNA, 18 nt, Salmonella enterica enterica serovar Typhi
cgccagauuaucggccag

SEQ ID NO: 3641823 - RNA, 19 nt, Salmonella enterica enterica serovar Typhi
cgccagauuaucggccagc

SEQ ID NO: 3641824 - RNA, 23 nt, Salmonella enterica enterica serovar Typhi
cgccagauuaucggccagcgcca

SEQ ID NO: 3641825 - RNA, 21 nt, Salmonella enterica enterica serovar Typhi
cgccagcaaaauuuugcgcag

SEQ ID NO: 3641826 - RNA, 23 nt, Salmonella enterica enterica serovar Typhi
cgccagcaaaauuuugcgcagac

SEQ ID NO: 3641827 - RNA, 13 nt, Salmonella enterica enterica serovar Typhi
cgccagcaacgag

SEQ ID NO: 3641828 - RNA, 23 nt, Salmonella enterica enterica serovar Typhi
cgccagcaacgagcuuuuuucuu

SEQ ID NO: 3641829 - RNA, 13 nt, Salmonella enterica enterica serovar Typhi
cgccagcaacgcg

SEQ ID NO: 3641830 - RNA, 19 nt, Salmonella enterica enterica serovar Typhi
cgccagcaacguuaaggcc

SEQ ID NO: 3641831 - RNA, 20 nt, Salmonella enterica enterica serovar Typhi
cgccagcaaugccgccgcca

SEQ ID NO: 3641832 - RNA, 21 nt, Salmonella enterica enterica serovar Typhi
cgccagcaccacuacuacacc

SEQ ID NO: 3641833 - RNA, 14 nt, Salmonella enterica enterica serovar Typhi
cgccagcaccaggc

SEQ ID NO: 3641834 - RNA, 16 nt, Salmonella enterica enterica serovar Typhi
cgccagcaccaggcuc

SEQ ID NO: 3641835 - RNA, 14 nt, Salmonella enterica enterica serovar Typhi
cgccagcagcagcg

SEQ ID NO: 3641836 - RNA, 17 nt, Salmonella enterica enterica serovar Typhi
cgccagcagcagcgcaa

SEQ ID NO: 3641837 - RNA, 11 nt, Salmonella enterica enterica serovar Typhi
cgccagcagcg

SEQ ID NO: 3641838 - RNA, 13 nt, Salmonella enterica enterica serovar Typhi
cgccagcagcucg

SEQ ID NO: 3641839 - RNA, 15 nt, Salmonella enterica enterica serovar Typhi
cgccagcagcucgcc

SEQ ID NO: 3641840 - RNA, 17 nt, Salmonella enterica enterica serovar Typhi
cgccagcauaccgccca

SEQ ID NO: 3641841 - RNA, 22 nt, Salmonella enterica enterica serovar Typhi
cgccagcauaugcacacgcagc

SEQ ID NO: 3641842 - RNA, 20 nt, Salmonella enterica enterica serovar Typhi
cgccagcaucggcagcgcca

SEQ ID NO: 3641843 - RNA, 13 nt, Salmonella enterica enterica serovar Typhi
cgccagcauggcg

SEQ ID NO: 3641844 - RNA, 14 nt, Salmonella enterica enterica serovar Typhi
cgccagcauuucaa

SEQ ID NO: 3641845 - RNA, 15 nt, Salmonella enterica enterica serovar Typhi
cgccagccacugacu

SEQ ID NO: 3641846 - RNA, 18 nt, Salmonella enterica enterica serovar Typhi
cgccagccacugggugau

SEQ ID NO: 3641847 - RNA, 16 nt, Salmonella enterica enterica serovar Typhi
cgccagccagcgccac

SEQ ID NO: 3641848 - RNA, 23 nt, Salmonella enterica enterica serovar Typhi
cgccagcccgacuaccggcacca

SEQ ID NO: 3641849 - RNA, 14 nt, Salmonella enterica enterica serovar Typhi
cgccagccgccauu

SEQ ID NO: 3641850 - RNA, 14 nt, Salmonella enterica enterica serovar Typhi
cgccagccgcgcca

SEQ ID NO: 3641851 - RNA, 15 nt, Salmonella enterica enterica serovar Typhi
cgccagccgcgccau

SEQ ID NO: 3641852 - RNA, 18 nt, Salmonella enterica enterica serovar Typhi
cgccagccuaucgccaua

SEQ ID NO: 3641853 - RNA, 20 nt, Salmonella enterica enterica serovar Typhi
cgccagcgacgguaauacca

SEQ ID NO: 3641854 - RNA, 19 nt, Salmonella enterica enterica serovar Typhi
cgccagcgagaugaaaagu

SEQ ID NO: 3641855 - RNA, 13 nt, Salmonella enterica enterica serovar Typhi
cgccagcgccacc

SEQ ID NO: 3641856 - RNA, 14 nt, Salmonella enterica enterica serovar Typhi
cgccagcgccaccu

SEQ ID NO: 3641857 - RNA, 16 nt, Salmonella enterica enterica serovar Typhi
cgccagcgccaccugc

SEQ ID NO: 3641858 - RNA, 16 nt, Salmonella enterica enterica serovar Typhi
cgccagcgccagcagc

SEQ ID NO: 3641859 - RNA, 15 nt, Salmonella enterica enterica serovar Typhi
cgccagcgccucuuc

SEQ ID NO: 3641860 - RNA, 20 nt, Salmonella enterica enterica serovar Typhi
cgccagcgcuacccgcugac

SEQ ID NO: 3641861 - RNA, 17 nt, Salmonella enterica enterica serovar Typhi
cgccagcggccagcgua

SEQ ID NO: 3641862 - RNA, 17 nt, Salmonella enterica enterica serovar Typhi
cgccagcggcgccauca

SEQ ID NO: 3641863 - RNA, 17 nt, Salmonella enterica enterica serovar Typhi
cgccagcgggccgguaa

SEQ ID NO: 3641864 - RNA, 18 nt, Salmonella enterica enterica serovar Typhi
cgccagcgguguuugcca

SEQ ID NO: 3641865 - RNA, 18 nt, Salmonella enterica enterica serovar Typhi
cgccagcgucucagcagg

SEQ ID NO: 3641866 - RNA, 14 nt, Salmonella enterica enterica serovar Typhi
cgccagcguugacc

SEQ ID NO: 3641867 - RNA, 18 nt, Salmonella enterica enterica serovar Typhi
cgccagcuaauuuuacuu

SEQ ID NO: 3641868 - RNA, 23 nt, Salmonella enterica enterica serovar Typhi
cgccagcuccauagaaaucagca

SEQ ID NO: 3641869 - RNA, 12 nt, Salmonella enterica enterica serovar Typhi
cgccagcucugc

SEQ ID NO: 3641870 - RNA, 15 nt, Salmonella enterica enterica serovar Typhi
cgccagcugcgcgcu

SEQ ID NO: 3641871 - RNA, 21 nt, Salmonella enterica enterica serovar Typhi
cgccaggaaccgcggucggca

SEQ ID NO: 3641872 - RNA, 17 nt, Salmonella enterica enterica serovar Typhi
cgccaggauaauaauga

SEQ ID NO: 3641873 - RNA, 21 nt, Salmonella enterica enterica serovar Typhi
cgccaggauaauaaugaucgc

SEQ ID NO: 3641874 - RNA, 20 nt, Salmonella enterica enterica serovar Typhi
cgccaggaucgccgccgcga

SEQ ID NO: 3641875 - RNA, 19 nt, Salmonella enterica enterica serovar Typhi
cgccaggcaaucagcagcc

SEQ ID NO: 3641876 - RNA, 19 nt, Salmonella enterica enterica serovar Typhi
cgccaggcauguuaugaau

SEQ ID NO: 3641877 - RNA, 15 nt, Salmonella enterica enterica serovar Typhi
cgccaggccagaugg

SEQ ID NO: 3641878 - RNA, 15 nt, Salmonella enterica enterica serovar Typhi
cgccaggccauugcu

SEQ ID NO: 3641879 - RNA, 18 nt, Salmonella enterica enterica serovar Typhi
cgccaggcccagccgcuc

SEQ ID NO: 3641880 - RNA, 14 nt, Salmonella enterica enterica serovar Typhi
cgccaggcgccacg

SEQ ID NO: 3641881 - RNA, 19 nt, Salmonella enterica enterica serovar Typhi
cgccaggcggguggugagc

SEQ ID NO: 3641882 - RNA, 22 nt, Salmonella enterica enterica serovar Typhi
cgccaggguaucgucaauacgc

SEQ ID NO: 3641883 - RNA, 22 nt, Salmonella enterica enterica serovar Typhi
cgccagguagccgacggccaua

SEQ ID NO: 3641884 - RNA, 21 nt, Salmonella enterica enterica serovar Typhi
cgccaggucucauagcgcccc

SEQ ID NO: 3641885 - RNA, 22 nt, Salmonella enterica enterica serovar Typhi
cgccaggucucauagcgcccca

SEQ ID NO: 3641886 - RNA, 19 nt, Salmonella enterica enterica serovar Typhi
cgccagguuuuacgugccg

SEQ ID NO: 3641887 - RNA, 22 nt, Salmonella enterica enterica serovar Typhi
cgccagguuuuacgugccgccg

SEQ ID NO: 3641888 - RNA, 19 nt, Salmonella enterica enterica serovar Typhi
cgccaguacuuuggccuaa

SEQ ID NO: 3641889 - RNA, 23 nt, Salmonella enterica enterica serovar Typhi
cgccagucauuaauucccgcagc

SEQ ID NO: 3641890 - RNA, 15 nt, Salmonella enterica enterica serovar Typhi
cgccagucccagcac

SEQ ID NO: 3641891 - RNA, 14 nt, Salmonella enterica enterica serovar Typhi
cgccagugcgcaua

SEQ ID NO: 3641892 - RNA, 14 nt, Salmonella enterica enterica serovar Typhi
cgccaguggaugcg

SEQ ID NO: 3641893 - RNA, 16 nt, Salmonella enterica enterica serovar Typhi
cgccaguuauucgacu

SEQ ID NO: 3641894 - RNA, 16 nt, Salmonella enterica enterica serovar Typhi
cgccaguucagcgucu

SEQ ID NO: 3641895 - RNA, 20 nt, Salmonella enterica enterica serovar Typhi
cgccaguucauucgccacca

SEQ ID NO: 3641896 - RNA, 22 nt, Salmonella enterica enterica serovar Typhi
cgccaguucauucgccaccagg

SEQ ID NO: 3641897 - RNA, 15 nt, Salmonella enterica enterica serovar Typhi
cgccaguuggcguac

SEQ ID NO: 3641898 - RNA, 20 nt, Salmonella enterica enterica serovar Typhi
cgccaguuugcgauccagua

SEQ ID NO: 3641899 - RNA, 16 nt, Salmonella enterica enterica serovar Typhi
cgccaguuuuuauacu

SEQ ID NO: 3641900 - RNA, 23 nt, Salmonella enterica enterica serovar Typhi
cgccaguuuuugcgccauugccg

SEQ ID NO: 3641901 - RNA, 22 nt, Salmonella enterica enterica serovar Typhi
cgccauaaaaaacaccugucug

SEQ ID NO: 3641902 - RNA, 22 nt, Salmonella enterica enterica serovar Typhi
cgccauaaaaagcguacaaaaa

SEQ ID NO: 3641903 - RNA, 18 nt, Salmonella enterica enterica serovar Typhi
cgccauaaaucagaucca

SEQ ID NO: 3641904 - RNA, 14 nt, Salmonella enterica enterica serovar Typhi
cgccauaacgccgg

SEQ ID NO: 3641905 - RNA, 22 nt, Salmonella enterica enterica serovar Typhi
cgccauaagaauguccccauau

SEQ ID NO: 3641906 - RNA, 23 nt, Salmonella enterica enterica serovar Typhi
cgccauaauacuuaauucauaac

SEQ ID NO: 3641907 - RNA, 20 nt, Salmonella enterica enterica serovar Typhi
cgccauacaacguaccguug

SEQ ID NO: 3641908 - RNA, 13 nt, Salmonella enterica enterica serovar Typhi
cgccauacguccg

SEQ ID NO: 3641909 - RNA, 15 nt, Salmonella enterica enterica serovar Typhi
cgccauagcaucgac

SEQ ID NO: 3641910 - RNA, 14 nt, Salmonella enterica enterica serovar Typhi
cgccauauacgcca

SEQ ID NO: 3641911 - RNA, 20 nt, Salmonella enterica enterica serovar Typhi
cgccauauaggcauguuccu

SEQ ID NO: 3641912 - RNA, 23 nt, Salmonella enterica enterica serovar Typhi
cgccauauauuuacugaauaaau

SEQ ID NO: 3641913 - RNA, 15 nt, Salmonella enterica enterica serovar Typhi
cgccauauccaagcc

SEQ ID NO: 3641914 - RNA, 17 nt, Salmonella enterica enterica serovar Typhi
cgccauauccccgccau

SEQ ID NO: 3641915 - RNA, 15 nt, Salmonella enterica enterica serovar Typhi
cgccauauccgcaga

SEQ ID NO: 3641916 - RNA, 16 nt, Salmonella enterica enterica serovar Typhi
cgccauaucgccgcca

SEQ ID NO: 3641917 - RNA, 18 nt, Salmonella enterica enterica serovar Typhi
cgccauaucgccgccaca

SEQ ID NO: 3641918 - RNA, 18 nt, Salmonella enterica enterica serovar Typhi
cgccaucaacuccuccgg

SEQ ID NO: 3641919 - RNA, 12 nt, Salmonella enterica enterica serovar Typhi
cgccaucaccag

SEQ ID NO: 3641920 - RNA, 17 nt, Salmonella enterica enterica serovar Typhi
cgccaucagcaaaauac

SEQ ID NO: 3641921 - RNA, 14 nt, Salmonella enterica enterica serovar Typhi
cgccaucaggcaug

SEQ ID NO: 3641922 - RNA, 15 nt, Salmonella enterica enterica serovar Typhi
cgccaucaggcaugc

SEQ ID NO: 3641923 - RNA, 20 nt, Salmonella enterica enterica serovar Typhi
cgccaucaggcaugccaaac

SEQ ID NO: 3641924 - RNA, 16 nt, Salmonella enterica enterica serovar Typhi
cgccaucaugcagccg

SEQ ID NO: 3641925 - RNA, 21 nt, Salmonella enterica enterica serovar Typhi
cgccaucaugcccacaggcag

SEQ ID NO: 3641926 - RNA, 15 nt, Salmonella enterica enterica serovar Typhi
cgccauccggcaaca

SEQ ID NO: 3641927 - RNA, 14 nt, Salmonella enterica enterica serovar Typhi
cgccauccggcaca

SEQ ID NO: 3641928 - RNA, 22 nt, Salmonella enterica enterica serovar Typhi
cgccauccggcacggucaauca

SEQ ID NO: 3641929 - RNA, 13 nt, Salmonella enterica enterica serovar Typhi
cgccauccggccu

SEQ ID NO: 3641930 - RNA, 23 nt, Salmonella enterica enterica serovar Typhi
cgccauccggccuguaaggucuc

SEQ ID NO: 3641931 - RNA, 17 nt, Salmonella enterica enterica serovar Typhi
cgccauccggcggugca

SEQ ID NO: 3641932 - RNA, 23 nt, Salmonella enterica enterica serovar Typhi
cgccauccggcggugcagguugc

SEQ ID NO: 3641933 - RNA, 15 nt, Salmonella enterica enterica serovar Typhi
cgccauccugcaccg

SEQ ID NO: 3641934 - RNA, 13 nt, Salmonella enterica enterica serovar Typhi
cgccauccugccg

SEQ ID NO: 3641935 - RNA, 14 nt, Salmonella enterica enterica serovar Typhi
cgccauccugccgc

SEQ ID NO: 3641936 - RNA, 15 nt, Salmonella enterica enterica serovar Typhi
cgccauccugccgca

SEQ ID NO: 3641937 - RNA, 18 nt, Salmonella enterica enterica serovar Typhi
cgccauccugccgcacca

SEQ ID NO: 3641938 - RNA, 17 nt, Salmonella enterica enterica serovar Typhi
cgccaucgacagcgcca

SEQ ID NO: 3641939 - RNA, 18 nt, Salmonella enterica enterica serovar Typhi
cgccaucgacagcgccau

SEQ ID NO: 3641940 - RNA, 22 nt, Salmonella enterica enterica serovar Typhi
cgccaucgcccggccuccggug

SEQ ID NO: 3641941 - RNA, 16 nt, Salmonella enterica enterica serovar Typhi
cgccaucgccuccaga

SEQ ID NO: 3641942 - RNA, 17 nt, Salmonella enterica enterica serovar Typhi
cgccaucggcgagcggc

SEQ ID NO: 3641943 - RNA, 13 nt, Salmonella enterica enterica serovar Typhi
cgccaucggcuuu

SEQ ID NO: 3641944 - RNA, 21 nt, Salmonella enterica enterica serovar Typhi
cgccaucggcuuuggcaaacg

SEQ ID NO: 3641945 - RNA, 17 nt, Salmonella enterica enterica serovar Typhi
cgccaucgucgccacca

SEQ ID NO: 3641946 - RNA, 18 nt, Salmonella enterica enterica serovar Typhi
cgccaucguuccgguucu

SEQ ID NO: 3641947 - RNA, 16 nt, Salmonella enterica enterica serovar Typhi
cgccaucuccggcagc

SEQ ID NO: 3641948 - RNA, 15 nt, Salmonella enterica enterica serovar Typhi
cgccaucuccuccuc

SEQ ID NO: 3641949 - RNA, 17 nt, Salmonella enterica enterica serovar Typhi
cgccaucuccuccucau

SEQ ID NO: 3641950 - RNA, 16 nt, Salmonella enterica enterica serovar Typhi
cgccaucuuucaccca

SEQ ID NO: 3641951 - RNA, 18 nt, Salmonella enterica enterica serovar Typhi
cgccaugauucaucccgc

SEQ ID NO: 3641952 - RNA, 19 nt, Salmonella enterica enterica serovar Typhi
cgccaugcggaaucacgca

SEQ ID NO: 3641953 - RNA, 13 nt, Salmonella enterica enterica serovar Typhi
cgccaugcggcgc

SEQ ID NO: 3641954 - RNA, 15 nt, Salmonella enterica enterica serovar Typhi
cgccaugcggcgcca

SEQ ID NO: 3641955 - RNA, 18 nt, Salmonella enterica enterica serovar Typhi
cgccaugcggcgccauca

SEQ ID NO: 3641956 - RNA, 22 nt, Salmonella enterica enterica serovar Typhi
cgccaugcugugugaccagcag

SEQ ID NO: 3641957 - RNA, 23 nt, Salmonella enterica enterica serovar Typhi
cgccaugcugugugaccagcagu

SEQ ID NO: 3641958 - RNA, 15 nt, Salmonella enterica enterica serovar Typhi
cgccauggccgcagc

SEQ ID NO: 3641959 - RNA, 18 nt, Salmonella enterica enterica serovar Typhi
cgccauuaaaagccagca

SEQ ID NO: 3641960 - RNA, 13 nt, Salmonella enterica enterica serovar Typhi
cgccauuacgccg

SEQ ID NO: 3641961 - RNA, 17 nt, Salmonella enterica enterica serovar Typhi
cgccauucccgcgacgu

SEQ ID NO: 3641962 - RNA, 22 nt, Salmonella enterica enterica serovar Typhi
cgccauucgcuuccgccgggaa

SEQ ID NO: 3641963 - RNA, 19 nt, Salmonella enterica enterica serovar Typhi
cgccauucucuucuaccac

SEQ ID NO: 3641964 - RNA, 21 nt, Salmonella enterica enterica serovar Typhi
cgccauugaucauuggggaac

SEQ ID NO: 3641965 - RNA, 22 nt, Salmonella enterica enterica serovar Typhi
cgccauuggcaaucaguacgcg

SEQ ID NO: 3641966 - RNA, 13 nt, Salmonella enterica enterica serovar Typhi
cgccauuuccagc

SEQ ID NO: 3641967 - RNA, 14 nt, Salmonella enterica enterica serovar Typhi
cgccauuuccagcc

SEQ ID NO: 3641968 - RNA, 18 nt, Salmonella enterica enterica serovar Typhi
cgccauuugccagauagc

SEQ ID NO: 3641969 - RNA, 16 nt, Salmonella enterica enterica serovar Typhi
cgccauuugcgcggcu

SEQ ID NO: 3641970 - RNA, 20 nt, Salmonella enterica enterica serovar Typhi
cgccauuuuauccaggccag

SEQ ID NO: 3641971 - RNA, 18 nt, Salmonella enterica enterica serovar Typhi
cgccauuuuucgcccaca

SEQ ID NO: 3641972 - RNA, 18 nt, Salmonella enterica enterica serovar Typhi
cgcccaaauaguccagca

SEQ ID NO: 3641973 - RNA, 14 nt, Salmonella enterica enterica serovar Typhi
cgcccaaccagccc

SEQ ID NO: 3641974 - RNA, 18 nt, Salmonella enterica enterica serovar Typhi
cgcccaaccagcccaggu

SEQ ID NO: 3641975 - RNA, 11 nt, Salmonella enterica enterica serovar Typhi
cgcccaaugcc

SEQ ID NO: 3641976 - RNA, 17 nt, Salmonella enterica enterica serovar Typhi
cgcccacaaugacagaa

SEQ ID NO: 3641977 - RNA, 14 nt, Salmonella enterica enterica serovar Typhi
cgcccacgcggcgu

SEQ ID NO: 3641978 - RNA, 16 nt, Salmonella enterica enterica serovar Typhi
cgcccacgcggcgugc

SEQ ID NO: 3641979 - RNA, 18 nt, Salmonella enterica enterica serovar Typhi
cgcccagaaagaucagca

SEQ ID NO: 3641980 - RNA, 14 nt, Salmonella enterica enterica serovar Typhi
cgcccagaacggca

SEQ ID NO: 3641981 - RNA, 20 nt, Salmonella enterica enterica serovar Typhi
cgcccagauaaugccgcugg

SEQ ID NO: 3641982 - RNA, 18 nt, Salmonella enterica enterica serovar Typhi
cgcccagauauccgcgcu

SEQ ID NO: 3641983 - RNA, 16 nt, Salmonella enterica enterica serovar Typhi
cgcccagaucaggccc

SEQ ID NO: 3641984 - RNA, 16 nt, Salmonella enterica enterica serovar Typhi
cgcccagaucgaccuc

SEQ ID NO: 3641985 - RNA, 17 nt, Salmonella enterica enterica serovar Typhi
cgcccagcacuaacagc

SEQ ID NO: 3641986 - RNA, 13 nt, Salmonella enterica enterica serovar Typhi
cgcccagccaaag

SEQ ID NO: 3641987 - RNA, 14 nt, Salmonella enterica enterica serovar Typhi
cgcccagccaaagc

SEQ ID NO: 3641988 - RNA, 12 nt, Salmonella enterica enterica serovar Typhi
cgcccaggccug

SEQ ID NO: 3641989 - RNA, 13 nt, Salmonella enterica enterica serovar Typhi
cgcccaggccuga

SEQ ID NO: 3641990 - RNA, 16 nt, Salmonella enterica enterica serovar Typhi
cgcccaggucgcccag

SEQ ID NO: 3641991 - RNA, 15 nt, Salmonella enterica enterica serovar Typhi
cgcccaguaccagca

SEQ ID NO: 3641992 - RNA, 19 nt, Salmonella enterica enterica serovar Typhi
cgcccagucaucauaauuc

SEQ ID NO: 3641993 - RNA, 17 nt, Salmonella enterica enterica serovar Typhi
cgcccaguccuuccggc

SEQ ID NO: 3641994 - RNA, 13 nt, Salmonella enterica enterica serovar Typhi
cgcccauaaucac

SEQ ID NO: 3641995 - RNA, 12 nt, Salmonella enterica enterica serovar Typhi
cgcccaucauca

SEQ ID NO: 3641996 - RNA, 13 nt, Salmonella enterica enterica serovar Typhi
cgcccauccagag

SEQ ID NO: 3641997 - RNA, 15 nt, Salmonella enterica enterica serovar Typhi
cgcccaucccgaugg

SEQ ID NO: 3641998 - RNA, 14 nt, Salmonella enterica enterica serovar Typhi
cgcccaucccuaau

SEQ ID NO: 3641999 - RNA, 15 nt, Salmonella enterica enterica serovar Typhi
cgcccaucgccacag

SEQ ID NO: 3642000 - RNA, 16 nt, Salmonella enterica enterica serovar Typhi
cgcccaucgccacagc

SEQ ID NO: 3642001 - RNA, 14 nt, Salmonella enterica enterica serovar Typhi
cgcccaucgccuga

SEQ ID NO: 3642002 - RNA, 17 nt, Salmonella enterica enterica serovar Typhi
cgcccaucuccagcccg

SEQ ID NO: 3642003 - RNA, 22 nt, Salmonella enterica enterica serovar Typhi
cgcccaucuccagcccgacgau

SEQ ID NO: 3642004 - RNA, 14 nt, Salmonella enterica enterica serovar Typhi
cgcccauggaugcg

SEQ ID NO: 3642005 - RNA, 20 nt, Salmonella enterica enterica serovar Typhi
cgcccauuagcauuccgccc

SEQ ID NO: 3642006 - RNA, 21 nt, Salmonella enterica enterica serovar Typhi
cgcccauuagcauuccgcccg

SEQ ID NO: 3642007 - RNA, 14 nt, Salmonella enterica enterica serovar Typhi
cgcccauuccgccu

SEQ ID NO: 3642008 - RNA, 16 nt, Salmonella enterica enterica serovar Typhi
cgcccauuccgccugc

SEQ ID NO: 3642009 - RNA, 21 nt, Salmonella enterica enterica serovar Typhi
cgcccauuccgccugccgcgc

SEQ ID NO: 3642010 - RNA, 12 nt, Salmonella enterica enterica serovar Typhi
cgccccaaagcg

SEQ ID NO: 3642011 - RNA, 15 nt, Salmonella enterica enterica serovar Typhi
cgccccaaagcgcau

SEQ ID NO: 3642012 - RNA, 16 nt, Salmonella enterica enterica serovar Typhi
cgccccaaucgccagu

SEQ ID NO: 3642013 - RNA, 12 nt, Salmonella enterica enterica serovar Typhi
cgccccacuggc

SEQ ID NO: 3642014 - RNA, 21 nt, Salmonella enterica enterica serovar Typhi
cgccccacuuucaccuccgcu

SEQ ID NO: 3642015 - RNA, 21 nt, Salmonella enterica enterica serovar Typhi
cgccccagcaugagccagccc

SEQ ID NO: 3642016 - RNA, 23 nt, Salmonella enterica enterica serovar Typhi
cgccccagcaugagccagcccuc

SEQ ID NO: 3642017 - RNA, 22 nt, Salmonella enterica enterica serovar Typhi
cgcccccaugccgccugccgcg

SEQ ID NO: 3642018 - RNA, 12 nt, Salmonella enterica enterica serovar Typhi
cgcccccugcca

SEQ ID NO: 3642019 - RNA, 13 nt, Salmonella enterica enterica serovar Typhi
cgcccccugccag

SEQ ID NO: 3642020 - RNA, 14 nt, Salmonella enterica enterica serovar Typhi
cgcccccugccagc

SEQ ID NO: 3642021 - RNA, 13 nt, Salmonella enterica enterica serovar Typhi
cgccccgaccagg

SEQ ID NO: 3642022 - RNA, 14 nt, Salmonella enterica enterica serovar Typhi
cgccccgcuucccg

SEQ ID NO: 3642023 - RNA, 15 nt, Salmonella enterica enterica serovar Typhi
cgcccgaccacgccc

SEQ ID NO: 3642024 - RNA, 15 nt, Salmonella enterica enterica serovar Typhi
cgcccgauagcguaa

SEQ ID NO: 3642025 - RNA, 14 nt, Salmonella enterica enterica serovar Typhi
cgcccgcaaaagcg

SEQ ID NO: 3642026 - RNA, 15 nt, Salmonella enterica enterica serovar Typhi
cgcccgcaccgccga

SEQ ID NO: 3642027 - RNA, 11 nt, Salmonella enterica enterica serovar Typhi
cgcccgccaga

SEQ ID NO: 3642028 - RNA, 13 nt, Salmonella enterica enterica serovar Typhi
cgcccgccaucug

SEQ ID NO: 3642029 - RNA, 13 nt, Salmonella enterica enterica serovar Typhi
cgcccgccgccag

SEQ ID NO: 3642030 - RNA, 13 nt, Salmonella enterica enterica serovar Typhi
cgcccgccgccug

SEQ ID NO: 3642031 - RNA, 13 nt, Salmonella enterica enterica serovar Typhi
cgcccgccgcgaa

SEQ ID NO: 3642032 - RNA, 22 nt, Salmonella enterica enterica serovar Typhi
cgcccgcgauaaaaauccugcu

SEQ ID NO: 3642033 - RNA, 23 nt, Salmonella enterica enterica serovar Typhi
cgcccgcgauaaaaauccugcuc

SEQ ID NO: 3642034 - RNA, 12 nt, Salmonella enterica enterica serovar Typhi
cgcccgcggcga

SEQ ID NO: 3642035 - RNA, 20 nt, Salmonella enterica enterica serovar Typhi
cgcccgcuucaucugaggau

SEQ ID NO: 3642036 - RNA, 23 nt, Salmonella enterica enterica serovar Typhi
cgcccggagggguuuucgccagc

SEQ ID NO: 3642037 - RNA, 17 nt, Salmonella enterica enterica serovar Typhi
cgcccggauaacggcgc

SEQ ID NO: 3642038 - RNA, 17 nt, Salmonella enterica enterica serovar Typhi
cgcccggaucacggccu

SEQ ID NO: 3642039 - RNA, 14 nt, Salmonella enterica enterica serovar Typhi
cgcccggcgccagc

SEQ ID NO: 3642040 - RNA, 20 nt, Salmonella enterica enterica serovar Typhi
cgcccgguaaacgcgccauc

SEQ ID NO: 3642041 - RNA, 16 nt, Salmonella enterica enterica serovar Typhi
cgcccgguagcauccg

SEQ ID NO: 3642042 - RNA, 13 nt, Salmonella enterica enterica serovar Typhi
cgcccgguuuugu

SEQ ID NO: 3642043 - RNA, 12 nt, Salmonella enterica enterica serovar Typhi
cgcccguacaga

SEQ ID NO: 3642044 - RNA, 18 nt, Salmonella enterica enterica serovar Typhi
cgcccguaccgcggcgcu

SEQ ID NO: 3642045 - RNA, 18 nt, Salmonella enterica enterica serovar Typhi
cgcccguagcgacgccau

SEQ ID NO: 3642046 - RNA, 18 nt, Salmonella enterica enterica serovar Typhi
cgcccguuuuuuccagcg

SEQ ID NO: 3642047 - RNA, 14 nt, Salmonella enterica enterica serovar Typhi
cgcccuccuccagc

SEQ ID NO: 3642048 - RNA, 15 nt, Salmonella enterica enterica serovar Typhi
cgcccucgccacggu

SEQ ID NO: 3642049 - RNA, 15 nt, Salmonella enterica enterica serovar Typhi
cgcccucgccagcaa

SEQ ID NO: 3642050 - RNA, 16 nt, Salmonella enterica enterica serovar Typhi
cgcccugaagggcggc

SEQ ID NO: 3642051 - RNA, 13 nt, Salmonella enterica enterica serovar Typhi
cgcccugacgccg

SEQ ID NO: 3642052 - RNA, 15 nt, Salmonella enterica enterica serovar Typhi
cgcccugacgccgcu

SEQ ID NO: 3642053 - RNA, 23 nt, Salmonella enterica enterica serovar Typhi
cgcccugaggaguauuauccauu

SEQ ID NO: 3642054 - RNA, 18 nt, Salmonella enterica enterica serovar Typhi
cgcccugcccaugaagcg

SEQ ID NO: 3642055 - RNA, 16 nt, Salmonella enterica enterica serovar Typhi
cgcccugcccgccagg

SEQ ID NO: 3642056 - RNA, 14 nt, Salmonella enterica enterica serovar Typhi
cgcccugcgccagc

SEQ ID NO: 3642057 - RNA, 14 nt, Salmonella enterica enterica serovar Typhi
cgcccugcgcgccu

SEQ ID NO: 3642058 - RNA, 15 nt, Salmonella enterica enterica serovar Typhi
cgcccugcgcgccuu

SEQ ID NO: 3642059 - RNA, 12 nt, Salmonella enterica enterica serovar Typhi
cgcccugcggaa

SEQ ID NO: 3642060 - RNA, 15 nt, Salmonella enterica enterica serovar Typhi
cgcccugcggacagg

SEQ ID NO: 3642061 - RNA, 19 nt, Salmonella enterica enterica serovar Typhi
cgcccugcgguagcgccga

SEQ ID NO: 3642062 - RNA, 13 nt, Salmonella enterica enterica serovar Typhi
cgcccugcuccca

SEQ ID NO: 3642063 - RNA, 21 nt, Salmonella enterica enterica serovar Typhi
cgcccuggaggaacagcgccg

SEQ ID NO: 3642064 - RNA, 23 nt, Salmonella enterica enterica serovar Typhi
cgcccuggcgggaaacagguacu

SEQ ID NO: 3642065 - RNA, 18 nt, Salmonella enterica enterica serovar Typhi
cgcccugggcuucgucga

SEQ ID NO: 3642066 - RNA, 23 nt, Salmonella enterica enterica serovar Typhi
cgcccuguaaaggauugccgccg

SEQ ID NO: 3642067 - RNA, 15 nt, Salmonella enterica enterica serovar Typhi
cgcccuguaagaggc

SEQ ID NO: 3642068 - RNA, 20 nt, Salmonella enterica enterica serovar Typhi
cgcccuguauacaggcaugg

SEQ ID NO: 3642069 - RNA, 15 nt, Salmonella enterica enterica serovar Typhi
cgcccugucauuaag

SEQ ID NO: 3642070 - RNA, 15 nt, Salmonella enterica enterica serovar Typhi
cgcccuguccuccau

SEQ ID NO: 3642071 - RNA, 20 nt, Salmonella enterica enterica serovar Typhi
cgcccuguggaaacuccagc

SEQ ID NO: 3642072 - RNA, 23 nt, Salmonella enterica enterica serovar Typhi
cgcccuguggaaacuccagcggc

SEQ ID NO: 3642073 - RNA, 14 nt, Salmonella enterica enterica serovar Typhi
cgcccuucacgccg

SEQ ID NO: 3642074 - RNA, 15 nt, Salmonella enterica enterica serovar Typhi
cgcccuucacgccga

SEQ ID NO: 3642075 - RNA, 16 nt, Salmonella enterica enterica serovar Typhi
cgcccuucaucuucca

SEQ ID NO: 3642076 - RNA, 15 nt, Salmonella enterica enterica serovar Typhi
cgcccuuccgucagc

SEQ ID NO: 3642077 - RNA, 15 nt, Salmonella enterica enterica serovar Typhi
cgcccuugccgcuuc

SEQ ID NO: 3642078 - RNA, 23 nt, Salmonella enterica enterica serovar Typhi
cgcccuuuuaguucaaccugcgc

SEQ ID NO: 3642079 - RNA, 16 nt, Salmonella enterica enterica serovar Typhi
cgccgaaauuuucccg

SEQ ID NO: 3642080 - RNA, 19 nt, Salmonella enterica enterica serovar Typhi
cgccgaacaacacggcggc

SEQ ID NO: 3642081 - RNA, 16 nt, Salmonella enterica enterica serovar Typhi
cgccgaacacgcauaa

SEQ ID NO: 3642082 - RNA, 14 nt, Salmonella enterica enterica serovar Typhi
cgccgaagcaggcg

SEQ ID NO: 3642083 - RNA, 15 nt, Salmonella enterica enterica serovar Typhi
cgccgaagcaggcgg

SEQ ID NO: 3642084 - RNA, 14 nt, Salmonella enterica enterica serovar Typhi
cgccgaagccagcg

SEQ ID NO: 3642085 - RNA, 15 nt, Salmonella enterica enterica serovar Typhi
cgccgaagccagcgc

SEQ ID NO: 3642086 - RNA, 12 nt, Salmonella enterica enterica serovar Typhi
cgccgaagugug

SEQ ID NO: 3642087 - RNA, 23 nt, Salmonella enterica enterica serovar Typhi
cgccgacaacgcuucuggcguaa

SEQ ID NO: 3642088 - RNA, 21 nt, Salmonella enterica enterica serovar Typhi
cgccgacauaagugcaggcug

SEQ ID NO: 3642089 - RNA, 17 nt, Salmonella enterica enterica serovar Typhi
cgccgacaucgccaccg

SEQ ID NO: 3642090 - RNA, 17 nt, Salmonella enterica enterica serovar Typhi
cgccgacauucccugcg

SEQ ID NO: 3642091 - RNA, 14 nt, Salmonella enterica enterica serovar Typhi
cgccgaccaccagc

SEQ ID NO: 3642092 - RNA, 21 nt, Salmonella enterica enterica serovar Typhi
cgccgaccacuucaacgccgc

SEQ ID NO: 3642093 - RNA, 14 nt, Salmonella enterica enterica serovar Typhi
cgccgaccauccag

SEQ ID NO: 3642094 - RNA, 15 nt, Salmonella enterica enterica serovar Typhi
cgccgaccauccaga

SEQ ID NO: 3642095 - RNA, 23 nt, Salmonella enterica enterica serovar Typhi
cgccgaccauuggcaccaccagg

SEQ ID NO: 3642096 - RNA, 17 nt, Salmonella enterica enterica serovar Typhi
cgccgacgaccggcagc

SEQ ID NO: 3642097 - RNA, 18 nt, Salmonella enterica enterica serovar Typhi
cgccgacggaacccagca

SEQ ID NO: 3642098 - RNA, 22 nt, Salmonella enterica enterica serovar Typhi
cgccgacguaguucaacgccug

SEQ ID NO: 3642099 - RNA, 17 nt, Salmonella enterica enterica serovar Typhi
cgccgacucacgcagcg

SEQ ID NO: 3642100 - RNA, 21 nt, Salmonella enterica enterica serovar Typhi
cgccgagaaaauaccgcacau

SEQ ID NO: 3642101 - RNA, 13 nt, Salmonella enterica enterica serovar Typhi
cgccgagccgccc

SEQ ID NO: 3642102 - RNA, 13 nt, Salmonella enterica enterica serovar Typhi
cgccgagcgccgu

SEQ ID NO: 3642103 - RNA, 19 nt, Salmonella enterica enterica serovar Typhi
cgccgaggcuaagccagaa

SEQ ID NO: 3642104 - RNA, 16 nt, Salmonella enterica enterica serovar Typhi
cgccgaguagcugagc

SEQ ID NO: 3642105 - RNA, 22 nt, Salmonella enterica enterica serovar Typhi
cgccgaguagcugagcgucagg

SEQ ID NO: 3642106 - RNA, 19 nt, Salmonella enterica enterica serovar Typhi
cgccgagugcuugcauuuu

SEQ ID NO: 3642107 - RNA, 18 nt, Salmonella enterica enterica serovar Typhi
cgccgauaaauccuccgg

SEQ ID NO: 3642108 - RNA, 22 nt, Salmonella enterica enterica serovar Typhi
cgccgauaaauccuccggcgcg

SEQ ID NO: 3642109 - RNA, 14 nt, Salmonella enterica enterica serovar Typhi
cgccgauacugccc

SEQ ID NO: 3642110 - RNA, 21 nt, Salmonella enterica enterica serovar Typhi
cgccgauuaaugcuccaauaa

SEQ ID NO: 3642111 - RNA, 17 nt, Salmonella enterica enterica serovar Typhi
cgccgcaaaacgcguau

SEQ ID NO: 3642112 - RNA, 19 nt, Salmonella enterica enterica serovar Typhi
cgccgcaaacgccgagccg

SEQ ID NO: 3642113 - RNA, 20 nt, Salmonella enterica enterica serovar Typhi
cgccgcaaauuccaccacgu

SEQ ID NO: 3642114 - RNA, 15 nt, Salmonella enterica enterica serovar Typhi
cgccgcacguaacgu

SEQ ID NO: 3642115 - RNA, 18 nt, Salmonella enterica enterica serovar Typhi
cgccgcaggccaucauac

SEQ ID NO: 3642116 - RNA, 13 nt, Salmonella enterica enterica serovar Typhi
cgccgcaucgcgg

SEQ ID NO: 3642117 - RNA, 21 nt, Salmonella enterica enterica serovar Typhi
cgccgccaaacugcgcgccgc

SEQ ID NO: 3642118 - RNA, 22 nt, Salmonella enterica enterica serovar Typhi
cgccgccaaacugcgcgccgcc

SEQ ID NO: 3642119 - RNA, 22 nt, Salmonella enterica enterica serovar Typhi
cgccgccaaagcgcccgauaau

SEQ ID NO: 3642120 - RNA, 15 nt, Salmonella enterica enterica serovar Typhi
cgccgccaacgccaa

SEQ ID NO: 3642121 - RNA, 21 nt, Salmonella enterica enterica serovar Typhi
cgccgccaagauuaagaccgu

SEQ ID NO: 3642122 - RNA, 13 nt, Salmonella enterica enterica serovar Typhi
cgccgccaccaaa

SEQ ID NO: 3642123 - RNA, 21 nt, Salmonella enterica enterica serovar Typhi
cgccgccaccauguugcgcag

SEQ ID NO: 3642124 - RNA, 22 nt, Salmonella enterica enterica serovar Typhi
cgccgccaccauguugcgcagc

SEQ ID NO: 3642125 - RNA, 20 nt, Salmonella enterica enterica serovar Typhi
cgccgccagauagccgcgcu

SEQ ID NO: 3642126 - RNA, 18 nt, Salmonella enterica enterica serovar Typhi
cgccgccagauuauccag

SEQ ID NO: 3642127 - RNA, 12 nt, Salmonella enterica enterica serovar Typhi
cgccgccagcac

SEQ ID NO: 3642128 - RNA, 14 nt, Salmonella enterica enterica serovar Typhi
cgccgccagcaccg

SEQ ID NO: 3642129 - RNA, 13 nt, Salmonella enterica enterica serovar Typhi
cgccgccagccau

SEQ ID NO: 3642130 - RNA, 14 nt, Salmonella enterica enterica serovar Typhi
cgccgccagccaua

SEQ ID NO: 3642131 - RNA, 14 nt, Salmonella enterica enterica serovar Typhi
cgccgccagccgau

SEQ ID NO: 3642132 - RNA, 13 nt, Salmonella enterica enterica serovar Typhi
cgccgccagcuca

SEQ ID NO: 3642133 - RNA, 20 nt, Salmonella enterica enterica serovar Typhi
cgccgccaggauaauaauga

SEQ ID NO: 3642134 - RNA, 13 nt, Salmonella enterica enterica serovar Typhi
cgccgccaggucu

SEQ ID NO: 3642135 - RNA, 14 nt, Salmonella enterica enterica serovar Typhi
cgccgccaggucuu

SEQ ID NO: 3642136 - RNA, 14 nt, Salmonella enterica enterica serovar Typhi
cgccgccaucaacg

SEQ ID NO: 3642137 - RNA, 18 nt, Salmonella enterica enterica serovar Typhi
cgccgccauccgacaacc

SEQ ID NO: 3642138 - RNA, 14 nt, Salmonella enterica enterica serovar Typhi
cgccgccauccggc

SEQ ID NO: 3642139 - RNA, 18 nt, Salmonella enterica enterica serovar Typhi
cgccgccauccggcauca

SEQ ID NO: 3642140 - RNA, 22 nt, Salmonella enterica enterica serovar Typhi
cgccgccauuuuauccaggcca

SEQ ID NO: 3642141 - RNA, 15 nt, Salmonella enterica enterica serovar Typhi
cgccgcccacgcugu

SEQ ID NO: 3642142 - RNA, 15 nt, Salmonella enterica enterica serovar Typhi
cgccgcccagcgggu

SEQ ID NO: 3642143 - RNA, 20 nt, Salmonella enterica enterica serovar Typhi
cgccgcccccaugccgccug

SEQ ID NO: 3642144 - RNA, 14 nt, Salmonella enterica enterica serovar Typhi
cgccgcccgccuga

SEQ ID NO: 3642145 - RNA, 15 nt, Salmonella enterica enterica serovar Typhi
cgccgccgaacagac

SEQ ID NO: 3642146 - RNA, 15 nt, Salmonella enterica enterica serovar Typhi
cgccgccgccaacgc

SEQ ID NO: 3642147 - RNA, 13 nt, Salmonella enterica enterica serovar Typhi
cgccgccgccaga

SEQ ID NO: 3642148 - RNA, 14 nt, Salmonella enterica enterica serovar Typhi
cgccgccgccaucg

SEQ ID NO: 3642149 - RNA, 14 nt, Salmonella enterica enterica serovar Typhi
cgccgccgcguccu

SEQ ID NO: 3642150 - RNA, 24 nt, Salmonella enterica enterica serovar Typhi
cgccgccggccugacgaccguugc

SEQ ID NO: 3642151 - RNA, 13 nt, Salmonella enterica enterica serovar Typhi
cgccgccgggccg

SEQ ID NO: 3642152 - RNA, 18 nt, Salmonella enterica enterica serovar Typhi
cgccgccgggccgccgau

SEQ ID NO: 3642153 - RNA, 20 nt, Salmonella enterica enterica serovar Typhi
cgccgccucuucaaacggca

SEQ ID NO: 3642154 - RNA, 12 nt, Salmonella enterica enterica serovar Typhi
cgccgccugaug

SEQ ID NO: 3642155 - RNA, 15 nt, Salmonella enterica enterica serovar Typhi
cgccgccugcacggc

SEQ ID NO: 3642156 - RNA, 14 nt, Salmonella enterica enterica serovar Typhi
cgccgccugcgcca

SEQ ID NO: 3642157 - RNA, 17 nt, Salmonella enterica enterica serovar Typhi
cgccgccugcgccaacg

SEQ ID NO: 3642158 - RNA, 22 nt, Salmonella enterica enterica serovar Typhi
cgccgcgauaaagaauagccug

SEQ ID NO: 3642159 - RNA, 21 nt, Salmonella enterica enterica serovar Typhi
cgccgcgcaguuuuuauccuc

SEQ ID NO: 3642160 - RNA, 14 nt, Salmonella enterica enterica serovar Typhi
cgccgcgcguucca

SEQ ID NO: 3642161 - RNA, 14 nt, Salmonella enterica enterica serovar Typhi
cgccgcggcgguua

SEQ ID NO: 3642162 - RNA, 22 nt, Salmonella enterica enterica serovar Typhi
cgccgcggcgguuauccuccgg

SEQ ID NO: 3642163 - RNA, 22 nt, Salmonella enterica enterica serovar Typhi
cgccgcguaaauccacauucca

SEQ ID NO: 3642164 - RNA, 19 nt, Salmonella enterica enterica serovar Typhi
cgccgcguuucucgccggu

SEQ ID NO: 3642165 - RNA, 20 nt, Salmonella enterica enterica serovar Typhi
cgccgcuaugcaauuguucc

SEQ ID NO: 3642166 - RNA, 18 nt, Salmonella enterica enterica serovar Typhi
cgccgcucuucagcgucc

SEQ ID NO: 3642167 - RNA, 13 nt, Salmonella enterica enterica serovar Typhi
cgccgcuggcggg

SEQ ID NO: 3642168 - RNA, 22 nt, Salmonella enterica enterica serovar Typhi
cgccgcuggcuggccagggcau

SEQ ID NO: 3642169 - RNA, 19 nt, Salmonella enterica enterica serovar Typhi
cgccgcuguuuucacucuu

SEQ ID NO: 3642170 - RNA, 13 nt, Salmonella enterica enterica serovar Typhi
cgccgcuuccccc

SEQ ID NO: 3642171 - RNA, 16 nt, Salmonella enterica enterica serovar Typhi
cgccgcuuccggcagg

SEQ ID NO: 3642172 - RNA, 20 nt, Salmonella enterica enterica serovar Typhi
cgccgcuuuaaucaccaugg

SEQ ID NO: 3642173 - RNA, 20 nt, Salmonella enterica enterica serovar Typhi
cgccgcuuuuuucagcggca

SEQ ID NO: 3642174 - RNA, 19 nt, Salmonella enterica enterica serovar Typhi
cgccggaaaaaaugggcug

SEQ ID NO: 3642175 - RNA, 19 nt, Salmonella enterica enterica serovar Typhi
cgccggaaagaaacgccgc

SEQ ID NO: 3642176 - RNA, 22 nt, Salmonella enterica enterica serovar Typhi
cgccggaaagaauaaucgccgc

SEQ ID NO: 3642177 - RNA, 21 nt, Salmonella enterica enterica serovar Typhi
cgccggaauggcgacgacgcu

SEQ ID NO: 3642178 - RNA, 15 nt, Salmonella enterica enterica serovar Typhi
cgccggacuccagca

SEQ ID NO: 3642179 - RNA, 20 nt, Salmonella enterica enterica serovar Typhi
cgccggagagcauuuguagc

SEQ ID NO: 3642180 - RNA, 20 nt, Salmonella enterica enterica serovar Typhi
cgccggagaggggacucacc

SEQ ID NO: 3642181 - RNA, 19 nt, Salmonella enterica enterica serovar Typhi
cgccggaucgggcuuccag

SEQ ID NO: 3642182 - RNA, 20 nt, Salmonella enterica enterica serovar Typhi
cgccggaugaggacauaaac

SEQ ID NO: 3642183 - RNA, 18 nt, Salmonella enterica enterica serovar Typhi
cgccggauuuaccagcgc

SEQ ID NO: 3642184 - RNA, 20 nt, Salmonella enterica enterica serovar Typhi
cgccggauuuaccagcgcuu

SEQ ID NO: 3642185 - RNA, 20 nt, Salmonella enterica enterica serovar Typhi
cgccggcaaagguugccgca

SEQ ID NO: 3642186 - RNA, 17 nt, Salmonella enterica enterica serovar Typhi
cgccggcaacacccgcc

SEQ ID NO: 3642187 - RNA, 21 nt, Salmonella enterica enterica serovar Typhi
cgccggcagacgauagcgggu

SEQ ID NO: 3642188 - RNA, 14 nt, Salmonella enterica enterica serovar Typhi
cgccggccccgcuu

SEQ ID NO: 3642189 - RNA, 13 nt, Salmonella enterica enterica serovar Typhi
cgccggccuguua

SEQ ID NO: 3642190 - RNA, 15 nt, Salmonella enterica enterica serovar Typhi
cgccggcgcguaauu

SEQ ID NO: 3642191 - RNA, 15 nt, Salmonella enterica enterica serovar Typhi
cgccgggaauuauua

SEQ ID NO: 3642192 - RNA, 17 nt, Salmonella enterica enterica serovar Typhi
cgccgggauauuuccgc

SEQ ID NO: 3642193 - RNA, 17 nt, Salmonella enterica enterica serovar Typhi
cgccgggaugcuuuccg

SEQ ID NO: 3642194 - RNA, 14 nt, Salmonella enterica enterica serovar Typhi
cgccgggcggcgca

SEQ ID NO: 3642195 - RNA, 23 nt, Salmonella enterica enterica serovar Typhi
cgccgggcgucacccgccggcag

SEQ ID NO: 3642196 - RNA, 20 nt, Salmonella enterica enterica serovar Typhi
cgccggggauaucaaugcgc

SEQ ID NO: 3642197 - RNA, 14 nt, Salmonella enterica enterica serovar Typhi
cgccggggcagcaa

SEQ ID NO: 3642198 - RNA, 19 nt, Salmonella enterica enterica serovar Typhi
cgccggguuuggcgggcuu

SEQ ID NO: 3642199 - RNA, 17 nt, Salmonella enterica enterica serovar Typhi
cgccgguagccagccaa

SEQ ID NO: 3642200 - RNA, 22 nt, Salmonella enterica enterica serovar Typhi
cgccggucacugaccggcguuu

SEQ ID NO: 3642201 - RNA, 20 nt, Salmonella enterica enterica serovar Typhi
cgccggucaugccaucccgc

SEQ ID NO: 3642202 - RNA, 15 nt, Salmonella enterica enterica serovar Typhi
cgccggucgccagca

SEQ ID NO: 3642203 - RNA, 19 nt, Salmonella enterica enterica serovar Typhi
cgccggugccugccgccuc

SEQ ID NO: 3642204 - RNA, 19 nt, Salmonella enterica enterica serovar Typhi
cgccgguugcgcugguugg

SEQ ID NO: 3642205 - RNA, 13 nt, Salmonella enterica enterica serovar Typhi
cgccgguuuaucc

SEQ ID NO: 3642206 - RNA, 20 nt, Salmonella enterica enterica serovar Typhi
cgccgguuuauccccgcugg

SEQ ID NO: 3642207 - RNA, 22 nt, Salmonella enterica enterica serovar Typhi
cgccguaaaacaacagcggcgu

SEQ ID NO: 3642208 - RNA, 15 nt, Salmonella enterica enterica serovar Typhi
cgccguaaccgccug

SEQ ID NO: 3642209 - RNA, 14 nt, Salmonella enterica enterica serovar Typhi
cgccguacuccagc

SEQ ID NO: 3642210 - RNA, 17 nt, Salmonella enterica enterica serovar Typhi
cgccguacuccagccca

SEQ ID NO: 3642211 - RNA, 17 nt, Salmonella enterica enterica serovar Typhi
cgccguagaacgggccg

SEQ ID NO: 3642212 - RNA, 16 nt, Salmonella enterica enterica serovar Typhi
cgccguagcugcgcgc

SEQ ID NO: 3642213 - RNA, 21 nt, Salmonella enterica enterica serovar Typhi
cgccguagcugcgcgccgcaa

SEQ ID NO: 3642214 - RNA, 14 nt, Salmonella enterica enterica serovar Typhi
cgccguauucuuac

SEQ ID NO: 3642215 - RNA, 20 nt, Salmonella enterica enterica serovar Typhi
cgccgucacaaagcccaccg

SEQ ID NO: 3642216 - RNA, 18 nt, Salmonella enterica enterica serovar Typhi
cgccgucacguucgguac

SEQ ID NO: 3642217 - RNA, 15 nt, Salmonella enterica enterica serovar Typhi
cgccgucaggcuugc

SEQ ID NO: 3642218 - RNA, 14 nt, Salmonella enterica enterica serovar Typhi
cgccgucauaaaac

SEQ ID NO: 3642219 - RNA, 12 nt, Salmonella enterica enterica serovar Typhi
cgccgucauccg

SEQ ID NO: 3642220 - RNA, 15 nt, Salmonella enterica enterica serovar Typhi
cgccguccagcacca

SEQ ID NO: 3642221 - RNA, 18 nt, Salmonella enterica enterica serovar Typhi
cgccguccagcaccaccu

SEQ ID NO: 3642222 - RNA, 19 nt, Salmonella enterica enterica serovar Typhi
cgccguccauuucaaugca

SEQ ID NO: 3642223 - RNA, 13 nt, Salmonella enterica enterica serovar Typhi
cgccguccggcga

SEQ ID NO: 3642224 - RNA, 14 nt, Salmonella enterica enterica serovar Typhi
cgccguccggcgaa

SEQ ID NO: 3642225 - RNA, 18 nt, Salmonella enterica enterica serovar Typhi
cgccgucgccaucaccag

SEQ ID NO: 3642226 - RNA, 13 nt, Salmonella enterica enterica serovar Typhi
cgccgucgcgcuu

SEQ ID NO: 3642227 - RNA, 15 nt, Salmonella enterica enterica serovar Typhi
cgccgugaacgccaa

SEQ ID NO: 3642228 - RNA, 23 nt, Salmonella enterica enterica serovar Typhi
cgccgugaauuucugcugccagc

SEQ ID NO: 3642229 - RNA, 16 nt, Salmonella enterica enterica serovar Typhi
cgccgugacggcguaa

SEQ ID NO: 3642230 - RNA, 19 nt, Salmonella enterica enterica serovar Typhi
cgccgugauaaauacgcug

SEQ ID NO: 3642231 - RNA, 15 nt, Salmonella enterica enterica serovar Typhi
cgccgugcggcgugu

SEQ ID NO: 3642232 - RNA, 18 nt, Salmonella enterica enterica serovar Typhi
cgccgugucuggcgaacg

SEQ ID NO: 3642233 - RNA, 17 nt, Salmonella enterica enterica serovar Typhi
cgccguguugugugccg

SEQ ID NO: 3642234 - RNA, 21 nt, Salmonella enterica enterica serovar Typhi
cgccguguugugugccgcgcu

SEQ ID NO: 3642235 - RNA, 16 nt, Salmonella enterica enterica serovar Typhi
cgccguuaaaccguua

SEQ ID NO: 3642236 - RNA, 21 nt, Salmonella enterica enterica serovar Typhi
cgccguuaaccgucuggcugc

SEQ ID NO: 3642237 - RNA, 15 nt, Salmonella enterica enterica serovar Typhi
cgccguuaucggccu

SEQ ID NO: 3642238 - RNA, 15 nt, Salmonella enterica enterica serovar Typhi
cgccguuuguuuauu

SEQ ID NO: 3642239 - RNA, 22 nt, Salmonella enterica enterica serovar Typhi
cgccguuuguuuauugccgcuu

SEQ ID NO: 3642240 - RNA, 15 nt, Salmonella enterica enterica serovar Typhi
cgccuaaaucaagca

SEQ ID NO: 3642241 - RNA, 16 nt, Salmonella enterica enterica serovar Typhi
cgccuaacagcgccgc

SEQ ID NO: 3642242 - RNA, 21 nt, Salmonella enterica enterica serovar Typhi
cgccuaacagcgccgcgccga

SEQ ID NO: 3642243 - RNA, 13 nt, Salmonella enterica enterica serovar Typhi
cgccuaaugaagc

SEQ ID NO: 3642244 - RNA, 17 nt, Salmonella enterica enterica serovar Typhi
cgccuaccagcacauga

SEQ ID NO: 3642245 - RNA, 18 nt, Salmonella enterica enterica serovar Typhi
cgccuagcgucccggcaa

SEQ ID NO: 3642246 - RNA, 21 nt, Salmonella enterica enterica serovar Typhi
cgccuaucgccagcaggguca

SEQ ID NO: 3642247 - RNA, 12 nt, Salmonella enterica enterica serovar Typhi
cgccuauuguuc

SEQ ID NO: 3642248 - RNA, 14 nt, Salmonella enterica enterica serovar Typhi
cgccucaaaucagg

SEQ ID NO: 3642249 - RNA, 19 nt, Salmonella enterica enterica serovar Typhi
cgccucaaggaagagaucg

SEQ ID NO: 3642250 - RNA, 18 nt, Salmonella enterica enterica serovar Typhi
cgccucaauugccgccag

SEQ ID NO: 3642251 - RNA, 15 nt, Salmonella enterica enterica serovar Typhi
cgccucaucugcuuc

SEQ ID NO: 3642252 - RNA, 16 nt, Salmonella enterica enterica serovar Typhi
cgccuccagcgauagu

SEQ ID NO: 3642253 - RNA, 16 nt, Salmonella enterica enterica serovar Typhi
cgccuccccugccggc

SEQ ID NO: 3642254 - RNA, 18 nt, Salmonella enterica enterica serovar Typhi
cgccuccccugccggcgg

SEQ ID NO: 3642255 - RNA, 14 nt, Salmonella enterica enterica serovar Typhi
cgccucccugccua

SEQ ID NO: 3642256 - RNA, 16 nt, Salmonella enterica enterica serovar Typhi
cgccuccgacaacaag

SEQ ID NO: 3642257 - RNA, 20 nt, Salmonella enterica enterica serovar Typhi
cgccuccguaugaccgccgc

SEQ ID NO: 3642258 - RNA, 18 nt, Salmonella enterica enterica serovar Typhi
cgccucgcgauccgccag

SEQ ID NO: 3642259 - RNA, 21 nt, Salmonella enterica enterica serovar Typhi
cgccucguaucugucccagcc

SEQ ID NO: 3642260 - RNA, 20 nt, Salmonella enterica enterica serovar Typhi
cgccucuggcguacgcagau

SEQ ID NO: 3642261 - RNA, 21 nt, Salmonella enterica enterica serovar Typhi
cgccugaaaggcacgcuccug

SEQ ID NO: 3642262 - RNA, 23 nt, Salmonella enterica enterica serovar Typhi
cgccugaacgcgugguugcguaa

SEQ ID NO: 3642263 - RNA, 17 nt, Salmonella enterica enterica serovar Typhi
cgccugaauaaucggcg

SEQ ID NO: 3642264 - RNA, 24 nt, Salmonella enterica enterica serovar Typhi
cgccugacgcggacgccaccacag

SEQ ID NO: 3642265 - RNA, 20 nt, Salmonella enterica enterica serovar Typhi
cgccugauccggccuacaag

SEQ ID NO: 3642266 - RNA, 15 nt, Salmonella enterica enterica serovar Typhi
cgccugaucgcgcag

SEQ ID NO: 3642267 - RNA, 22 nt, Salmonella enterica enterica serovar Typhi
cgccugauggcgcuacgcuuau

SEQ ID NO: 3642268 - RNA, 16 nt, Salmonella enterica enterica serovar Typhi
cgccugauuuaaugaa

SEQ ID NO: 3642269 - RNA, 24 nt, Salmonella enterica enterica serovar Typhi
cgccugcaauguugaaucccacgc

SEQ ID NO: 3642270 - RNA, 13 nt, Salmonella enterica enterica serovar Typhi
cgccugcauaaug

SEQ ID NO: 3642271 - RNA, 14 nt, Salmonella enterica enterica serovar Typhi
cgccugcauaaugc

SEQ ID NO: 3642272 - RNA, 20 nt, Salmonella enterica enterica serovar Typhi
cgccugccaacauggggagc

SEQ ID NO: 3642273 - RNA, 18 nt, Salmonella enterica enterica serovar Typhi
cgccugccaggauccguu

SEQ ID NO: 3642274 - RNA, 15 nt, Salmonella enterica enterica serovar Typhi
cgccugccgcgccgc

SEQ ID NO: 3642275 - RNA, 20 nt, Salmonella enterica enterica serovar Typhi
cgccugccgcgccgccgccu

SEQ ID NO: 3642276 - RNA, 13 nt, Salmonella enterica enterica serovar Typhi
cgccugcgcgccu

SEQ ID NO: 3642277 - RNA, 14 nt, Salmonella enterica enterica serovar Typhi
cgccugcgcgccug

SEQ ID NO: 3642278 - RNA, 22 nt, Salmonella enterica enterica serovar Typhi
cgccugcgcucauauacccugc

SEQ ID NO: 3642279 - RNA, 21 nt, Salmonella enterica enterica serovar Typhi
cgccugcggaaucuccggcga

SEQ ID NO: 3642280 - RNA, 14 nt, Salmonella enterica enterica serovar Typhi
cgccugcggcguaa

SEQ ID NO: 3642281 - RNA, 20 nt, Salmonella enterica enterica serovar Typhi
cgccugcgguuuaaugcuau

SEQ ID NO: 3642282 - RNA, 11 nt, Salmonella enterica enterica serovar Typhi
cgccugcugca

SEQ ID NO: 3642283 - RNA, 15 nt, Salmonella enterica enterica serovar Typhi
cgccugcugccagcc

SEQ ID NO: 3642284 - RNA, 20 nt, Salmonella enterica enterica serovar Typhi
cgccugcugccagccgccgc

SEQ ID NO: 3642285 - RNA, 14 nt, Salmonella enterica enterica serovar Typhi
cgccugcugccugc

SEQ ID NO: 3642286 - RNA, 11 nt, Salmonella enterica enterica serovar Typhi
cgccugcugcg

SEQ ID NO: 3642287 - RNA, 15 nt, Salmonella enterica enterica serovar Typhi
cgccugcuucacgua

SEQ ID NO: 3642288 - RNA, 16 nt, Salmonella enterica enterica serovar Typhi
cgccuggaucgugcgg

SEQ ID NO: 3642289 - RNA, 14 nt, Salmonella enterica enterica serovar Typhi
cgccuggcaguuca

SEQ ID NO: 3642290 - RNA, 19 nt, Salmonella enterica enterica serovar Typhi
cgccuggcaguucagucgg

SEQ ID NO: 3642291 - RNA, 17 nt, Salmonella enterica enterica serovar Typhi
cgccuggcgaaacgccu

SEQ ID NO: 3642292 - RNA, 21 nt, Salmonella enterica enterica serovar Typhi
cgccuggcuugcggguuuuga

SEQ ID NO: 3642293 - RNA, 19 nt, Salmonella enterica enterica serovar Typhi
cgccugggugggcggaaaa

SEQ ID NO: 3642294 - RNA, 22 nt, Salmonella enterica enterica serovar Typhi
cgccuguaaggcucucuuacca

SEQ ID NO: 3642295 - RNA, 14 nt, Salmonella enterica enterica serovar Typhi
cgccuguagcguaa

SEQ ID NO: 3642296 - RNA, 14 nt, Salmonella enterica enterica serovar Typhi
cgccuguccggccu

SEQ ID NO: 3642297 - RNA, 15 nt, Salmonella enterica enterica serovar Typhi
cgccugucuccagcg

SEQ ID NO: 3642298 - RNA, 17 nt, Salmonella enterica enterica serovar Typhi
cgccugucuccagcgcc

SEQ ID NO: 3642299 - RNA, 15 nt, Salmonella enterica enterica serovar Typhi
cgccugugcuggcga

SEQ ID NO: 3642300 - RNA, 21 nt, Salmonella enterica enterica serovar Typhi
cgccugugguuuaaaacggug

SEQ ID NO: 3642301 - RNA, 14 nt, Salmonella enterica enterica serovar Typhi
cgccuguuaauggu

SEQ ID NO: 3642302 - RNA, 19 nt, Salmonella enterica enterica serovar Typhi
cgccuguuagggcgcggcu

SEQ ID NO: 3642303 - RNA, 14 nt, Salmonella enterica enterica serovar Typhi
cgccuguugauuac

SEQ ID NO: 3642304 - RNA, 15 nt, Salmonella enterica enterica serovar Typhi
cgccuguuuacugac

SEQ ID NO: 3642305 - RNA, 18 nt, Salmonella enterica enterica serovar Typhi
cgccuguuuacugacgcc

SEQ ID NO: 3642306 - RNA, 15 nt, Salmonella enterica enterica serovar Typhi
cgccuuauccggccu

SEQ ID NO: 3642307 - RNA, 20 nt, Salmonella enterica enterica serovar Typhi
cgccuuauccggccuacaac

SEQ ID NO: 3642308 - RNA, 19 nt, Salmonella enterica enterica serovar Typhi
cgccuuauccggccuacag

SEQ ID NO: 3642309 - RNA, 20 nt, Salmonella enterica enterica serovar Typhi
cgccuuauccggccuacaga

SEQ ID NO: 3642310 - RNA, 18 nt, Salmonella enterica enterica serovar Typhi
cgccuuauccggccuacg

SEQ ID NO: 3642311 - RNA, 18 nt, Salmonella enterica enterica serovar Typhi
cgccuucacacugcgccg

SEQ ID NO: 3642312 - RNA, 23 nt, Salmonella enterica enterica serovar Typhi
cgccuucacacugcgccgccagc

SEQ ID NO: 3642313 - RNA, 16 nt, Salmonella enterica enterica serovar Typhi
cgccuucagcgcgccc

SEQ ID NO: 3642314 - RNA, 15 nt, Salmonella enterica enterica serovar Typhi
cgccuuccacuuuca

SEQ ID NO: 3642315 - RNA, 12 nt, Salmonella enterica enterica serovar Typhi
cgccuuccagcg

SEQ ID NO: 3642316 - RNA, 12 nt, Salmonella enterica enterica serovar Typhi
cgccuuccaguu

SEQ ID NO: 3642317 - RNA, 14 nt, Salmonella enterica enterica serovar Typhi
cgccuuccuccagc

SEQ ID NO: 3642318 - RNA, 22 nt, Salmonella enterica enterica serovar Typhi
cgccuucgaaccggguauugaa

SEQ ID NO: 3642319 - RNA, 21 nt, Salmonella enterica enterica serovar Typhi
cgccuucgauuaguccgucgg

SEQ ID NO: 3642320 - RNA, 15 nt, Salmonella enterica enterica serovar Typhi
cgccuucggccugaa

SEQ ID NO: 3642321 - RNA, 22 nt, Salmonella enterica enterica serovar Typhi
cgccuucggcgucgugcugggc

SEQ ID NO: 3642322 - RNA, 18 nt, Salmonella enterica enterica serovar Typhi
cgccuucguuauaaggcc

SEQ ID NO: 3642323 - RNA, 15 nt, Salmonella enterica enterica serovar Typhi
cgccuucuucaucuu

SEQ ID NO: 3642324 - RNA, 14 nt, Salmonella enterica enterica serovar Typhi
cgccuugcccgcgc

SEQ ID NO: 3642325 - RNA, 14 nt, Salmonella enterica enterica serovar Typhi
cgccuugcggcggc

SEQ ID NO: 3642326 - RNA, 18 nt, Salmonella enterica enterica serovar Typhi
cgccuugcggcggcguuu

SEQ ID NO: 3642327 - RNA, 19 nt, Salmonella enterica enterica serovar Typhi
cgccuuucuccauggucag

SEQ ID NO: 3642328 - RNA, 19 nt, Salmonella enterica enterica serovar Typhi
cgccuuuucccccagcauu

SEQ ID NO: 3642329 - RNA, 23 nt, Salmonella enterica enterica serovar Typhi
cgccuuuuuuaaauuugaccucg

SEQ ID NO: 3642330 - RNA, 12 nt, Salmonella enterica enterica serovar Typhi
cgcgaaaacagc

SEQ ID NO: 3642331 - RNA, 23 nt, Salmonella enterica enterica serovar Typhi
cgcgaaaauaccccagcgcgccg

SEQ ID NO: 3642332 - RNA, 16 nt, Salmonella enterica enterica serovar Typhi
cgcgaaaaucgguaac

SEQ ID NO: 3642333 - RNA, 19 nt, Salmonella enterica enterica serovar Typhi
cgcgaaaaucgguaacauc

SEQ ID NO: 3642334 - RNA, 15 nt, Salmonella enterica enterica serovar Typhi
cgcgaaacaggucgg

SEQ ID NO: 3642335 - RNA, 20 nt, Salmonella enterica enterica serovar Typhi
cgcgaaaucaaagaccuccg

SEQ ID NO: 3642336 - RNA, 22 nt, Salmonella enterica enterica serovar Typhi
cgcgaaaucaaagaccuccgcc

SEQ ID NO: 3642337 - RNA, 19 nt, Salmonella enterica enterica serovar Typhi
cgcgaacauuacauccuca

SEQ ID NO: 3642338 - RNA, 22 nt, Salmonella enterica enterica serovar Typhi
cgcgaauaaaugagaucccggg

SEQ ID NO: 3642339 - RNA, 15 nt, Salmonella enterica enterica serovar Typhi
cgcgaauaauuauuu

SEQ ID NO: 3642340 - RNA, 20 nt, Salmonella enterica enterica serovar Typhi
cgcgaauagccagacagccc

SEQ ID NO: 3642341 - RNA, 17 nt, Salmonella enterica enterica serovar Typhi
cgcgaauaguggcgcgc

SEQ ID NO: 3642342 - RNA, 18 nt, Salmonella enterica enterica serovar Typhi
cgcgaauaguggcgcgcc

SEQ ID NO: 3642343 - RNA, 14 nt, Salmonella enterica enterica serovar Typhi
cgcgaauauacgca

SEQ ID NO: 3642344 - RNA, 20 nt, Salmonella enterica enterica serovar Typhi
cgcgaaucgacaauccgcca

SEQ ID NO: 3642345 - RNA, 21 nt, Salmonella enterica enterica serovar Typhi
cgcgaaucgacaauccgccac

SEQ ID NO: 3642346 - RNA, 24 nt, Salmonella enterica enterica serovar Typhi
cgcgaaucgacaauccgccacgcu

SEQ ID NO: 3642347 - RNA, 18 nt, Salmonella enterica enterica serovar Typhi
cgcgaaucgcuucacggc

SEQ ID NO: 3642348 - RNA, 21 nt, Salmonella enterica enterica serovar Typhi
cgcgaauuccuuuuuccgcca

SEQ ID NO: 3642349 - RNA, 15 nt, Salmonella enterica enterica serovar Typhi
cgcgaauuucaaucg

SEQ ID NO: 3642350 - RNA, 18 nt, Salmonella enterica enterica serovar Typhi
cgcgaauuucaaucgcca

SEQ ID NO: 3642351 - RNA, 18 nt, Salmonella enterica enterica serovar Typhi
cgcgaauuucacgcagca

SEQ ID NO: 3642352 - RNA, 14 nt, Salmonella enterica enterica serovar Typhi
cgcgacaacgccau

SEQ ID NO: 3642353 - RNA, 15 nt, Salmonella enterica enterica serovar Typhi
cgcgacaacgccgga

SEQ ID NO: 3642354 - RNA, 14 nt, Salmonella enterica enterica serovar Typhi
cgcgacaaugccau

SEQ ID NO: 3642355 - RNA, 15 nt, Salmonella enterica enterica serovar Typhi
cgcgacagcgcgcca

SEQ ID NO: 3642356 - RNA, 12 nt, Salmonella enterica enterica serovar Typhi
cgcgacagcgcu

SEQ ID NO: 3642357 - RNA, 15 nt, Salmonella enterica enterica serovar Typhi
cgcgacauccgcuuu

SEQ ID NO: 3642358 - RNA, 22 nt, Salmonella enterica enterica serovar Typhi
cgcgacaucguuuccagcgaau

SEQ ID NO: 3642359 - RNA, 12 nt, Salmonella enterica enterica serovar Typhi
cgcgaccagcag

SEQ ID NO: 3642360 - RNA, 17 nt, Salmonella enterica enterica serovar Typhi
cgcgaccagcagcauca

SEQ ID NO: 3642361 - RNA, 13 nt, Salmonella enterica enterica serovar Typhi
cgcgaccagcgcg

SEQ ID NO: 3642362 - RNA, 16 nt, Salmonella enterica enterica serovar Typhi
cgcgaccagcgcgcca

SEQ ID NO: 3642363 - RNA, 18 nt, Salmonella enterica enterica serovar Typhi
cgcgaccagcgcgccaaa

SEQ ID NO: 3642364 - RNA, 17 nt, Salmonella enterica enterica serovar Typhi
cgcgacccagcgcauga

SEQ ID NO: 3642365 - RNA, 13 nt, Salmonella enterica enterica serovar Typhi
cgcgaccgcauca

SEQ ID NO: 3642366 - RNA, 18 nt, Salmonella enterica enterica serovar Typhi
cgcgaccgcaucaaugcc

SEQ ID NO: 3642367 - RNA, 15 nt, Salmonella enterica enterica serovar Typhi
cgcgacgacgccagc

SEQ ID NO: 3642368 - RNA, 21 nt, Salmonella enterica enterica serovar Typhi
cgcgacgacgccagccagcca

SEQ ID NO: 3642369 - RNA, 20 nt, Salmonella enterica enterica serovar Typhi
cgcgacgcccaugcaaccag

SEQ ID NO: 3642370 - RNA, 16 nt, Salmonella enterica enterica serovar Typhi
cgcgacgccugggcga

SEQ ID NO: 3642371 - RNA, 13 nt, Salmonella enterica enterica serovar Typhi
cgcgacggcagcc

SEQ ID NO: 3642372 - RNA, 14 nt, Salmonella enterica enterica serovar Typhi
cgcgacguccgcca

SEQ ID NO: 3642373 - RNA, 19 nt, Salmonella enterica enterica serovar Typhi
cgcgacucccaggcgcgca

SEQ ID NO: 3642374 - RNA, 21 nt, Salmonella enterica enterica serovar Typhi
cgcgacucccaggcgcgcagc

SEQ ID NO: 3642375 - RNA, 16 nt, Salmonella enterica enterica serovar Typhi
cgcgacuuaucuucca

SEQ ID NO: 3642376 - RNA, 21 nt, Salmonella enterica enterica serovar Typhi
cgcgacuuaucuuccacgccg

SEQ ID NO: 3642377 - RNA, 19 nt, Salmonella enterica enterica serovar Typhi
cgcgacuuggaaaguugcg

SEQ ID NO: 3642378 - RNA, 22 nt, Salmonella enterica enterica serovar Typhi
cgcgacuuuaaucaccugccag

SEQ ID NO: 3642379 - RNA, 18 nt, Salmonella enterica enterica serovar Typhi
cgcgacuuuuuucaccca

SEQ ID NO: 3642380 - RNA, 16 nt, Salmonella enterica enterica serovar Typhi
cgcgagaacugcugca

SEQ ID NO: 3642381 - RNA, 20 nt, Salmonella enterica enterica serovar Typhi
cgcgagaagaagaauuauua

SEQ ID NO: 3642382 - RNA, 22 nt, Salmonella enterica enterica serovar Typhi
cgcgagaagcccggccacagcg

SEQ ID NO: 3642383 - RNA, 23 nt, Salmonella enterica enterica serovar Typhi
cgcgagaccaucgcgugacgcag

SEQ ID NO: 3642384 - RNA, 24 nt, Salmonella enterica enterica serovar Typhi
cgcgagagucgccaggaucgccgc

SEQ ID NO: 3642385 - RNA, 23 nt, Salmonella enterica enterica serovar Typhi
cgcgagcguucuauuuggccugc

SEQ ID NO: 3642386 - RNA, 23 nt, Salmonella enterica enterica serovar Typhi
cgcgaggcuuauaacccugucug

SEQ ID NO: 3642387 - RNA, 22 nt, Salmonella enterica enterica serovar Typhi
cgcgaguguaaagauuaauaau

SEQ ID NO: 3642388 - RNA, 21 nt, Salmonella enterica enterica serovar Typhi
cgcgauaaaaaacgcccagau

SEQ ID NO: 3642389 - RNA, 20 nt, Salmonella enterica enterica serovar Typhi
cgcgauaaaaacccaccagc

SEQ ID NO: 3642390 - RNA, 23 nt, Salmonella enterica enterica serovar Typhi
cgcgauaauaauuaccacgcagc

SEQ ID NO: 3642391 - RNA, 21 nt, Salmonella enterica enterica serovar Typhi
cgcgauacacuccggcgcgcg

SEQ ID NO: 3642392 - RNA, 17 nt, Salmonella enterica enterica serovar Typhi
cgcgauacccgcgauca

SEQ ID NO: 3642393 - RNA, 21 nt, Salmonella enterica enterica serovar Typhi
cgcgauacccgcgaucacuac

SEQ ID NO: 3642394 - RNA, 15 nt, Salmonella enterica enterica serovar Typhi
cgcgauacgcagcac

SEQ ID NO: 3642395 - RNA, 20 nt, Salmonella enterica enterica serovar Typhi
cgcgauagaccacgccauca

SEQ ID NO: 3642396 - RNA, 20 nt, Salmonella enterica enterica serovar Typhi
cgcgauauccaccaccugau

SEQ ID NO: 3642397 - RNA, 23 nt, Salmonella enterica enterica serovar Typhi
cgcgauauccaccaccugauucu

SEQ ID NO: 3642398 - RNA, 15 nt, Salmonella enterica enterica serovar Typhi
cgcgauauccaccug

SEQ ID NO: 3642399 - RNA, 17 nt, Salmonella enterica enterica serovar Typhi
cgcgauauuacuccagc

SEQ ID NO: 3642400 - RNA, 17 nt, Salmonella enterica enterica serovar Typhi
cgcgaucaaucacgccg

SEQ ID NO: 3642401 - RNA, 19 nt, Salmonella enterica enterica serovar Typhi
cgcgaucaaucacgccgau

SEQ ID NO: 3642402 - RNA, 14 nt, Salmonella enterica enterica serovar Typhi
cgcgaucacagaca

SEQ ID NO: 3642403 - RNA, 19 nt, Salmonella enterica enterica serovar Typhi
cgcgaucacagacagaugc

SEQ ID NO: 3642404 - RNA, 18 nt, Salmonella enterica enterica serovar Typhi
cgcgaucacuaccgccau

SEQ ID NO: 3642405 - RNA, 22 nt, Salmonella enterica enterica serovar Typhi
cgcgaucaguucuugcaggcag

SEQ ID NO: 3642406 - RNA, 14 nt, Salmonella enterica enterica serovar Typhi
cgcgauccgccagc

SEQ ID NO: 3642407 - RNA, 16 nt, Salmonella enterica enterica serovar Typhi
cgcgauccgccagcgu

SEQ ID NO: 3642408 - RNA, 17 nt, Salmonella enterica enterica serovar Typhi
cgcgaucgccccgacca

SEQ ID NO: 3642409 - RNA, 14 nt, Salmonella enterica enterica serovar Typhi
cgcgaucgcggcaa

SEQ ID NO: 3642410 - RNA, 18 nt, Salmonella enterica enterica serovar Typhi
cgcgaugagcugcgauaa

SEQ ID NO: 3642411 - RNA, 14 nt, Salmonella enterica enterica serovar Typhi
cgcgauggcgucac

SEQ ID NO: 3642412 - RNA, 18 nt, Salmonella enterica enterica serovar Typhi
cgcgauguuugcucgcca

SEQ ID NO: 3642413 - RNA, 23 nt, Salmonella enterica enterica serovar Typhi
cgcgauuuuuuuccgcccgccuu

SEQ ID NO: 3642414 - RNA, 18 nt, Salmonella enterica enterica serovar Typhi
cgcgcaaagccuuuccgc

SEQ ID NO: 3642415 - RNA, 18 nt, Salmonella enterica enterica serovar Typhi
cgcgcaaccgcaucacgc

SEQ ID NO: 3642416 - RNA, 23 nt, Salmonella enterica enterica serovar Typhi
cgcgcaaccgcaucacgcgaagc

SEQ ID NO: 3642417 - RNA, 17 nt, Salmonella enterica enterica serovar Typhi
cgcgcaauaugcggcgc

SEQ ID NO: 3642418 - RNA, 18 nt, Salmonella enterica enterica serovar Typhi
cgcgcacagggugaaauc

SEQ ID NO: 3642419 - RNA, 17 nt, Salmonella enterica enterica serovar Typhi
cgcgcaccuucucuccu

SEQ ID NO: 3642420 - RNA, 13 nt, Salmonella enterica enterica serovar Typhi
cgcgcacgcgcgc

SEQ ID NO: 3642421 - RNA, 14 nt, Salmonella enterica enterica serovar Typhi
cgcgcacgcgcgcg

SEQ ID NO: 3642422 - RNA, 21 nt, Salmonella enterica enterica serovar Typhi
cgcgcagaaucacuucauccg

SEQ ID NO: 3642423 - RNA, 13 nt, Salmonella enterica enterica serovar Typhi
cgcgcagcaggcc

SEQ ID NO: 3642424 - RNA, 20 nt, Salmonella enterica enterica serovar Typhi
cgcgcagcgauauagcgcau

SEQ ID NO: 3642425 - RNA, 12 nt, Salmonella enterica enterica serovar Typhi
cgcgcagcugcc

SEQ ID NO: 3642426 - RNA, 15 nt, Salmonella enterica enterica serovar Typhi
cgcgcagcugggccu

SEQ ID NO: 3642427 - RNA, 23 nt, Salmonella enterica enterica serovar Typhi
cgcgcaggucuucgucagcgcau

SEQ ID NO: 3642428 - RNA, 18 nt, Salmonella enterica enterica serovar Typhi
cgcgcaguacggcgcaca

SEQ ID NO: 3642429 - RNA, 13 nt, Salmonella enterica enterica serovar Typhi
cgcgcagugcagc

SEQ ID NO: 3642430 - RNA, 18 nt, Salmonella enterica enterica serovar Typhi
cgcgcaguucauccacgc

SEQ ID NO: 3642431 - RNA, 14 nt, Salmonella enterica enterica serovar Typhi
cgcgcaguuccagc

SEQ ID NO: 3642432 - RNA, 15 nt, Salmonella enterica enterica serovar Typhi
cgcgcaguuccagcg

SEQ ID NO: 3642433 - RNA, 19 nt, Salmonella enterica enterica serovar Typhi
cgcgcauagcuggcguagc

SEQ ID NO: 3642434 - RNA, 20 nt, Salmonella enterica enterica serovar Typhi
cgcgcaucccacaccacacg

SEQ ID NO: 3642435 - RNA, 12 nt, Salmonella enterica enterica serovar Typhi
cgcgcauccggg

SEQ ID NO: 3642436 - RNA, 18 nt, Salmonella enterica enterica serovar Typhi
cgcgcauggcagggcgau

SEQ ID NO: 3642437 - RNA, 23 nt, Salmonella enterica enterica serovar Typhi
cgcgcauggcagggcgauaucca

SEQ ID NO: 3642438 - RNA, 17 nt, Salmonella enterica enterica serovar Typhi
cgcgccaaacggcagcu

SEQ ID NO: 3642439 - RNA, 17 nt, Salmonella enterica enterica serovar Typhi
cgcgccaaugcgaaaau

SEQ ID NO: 3642440 - RNA, 19 nt, Salmonella enterica enterica serovar Typhi
cgcgccaauggccgccccc

SEQ ID NO: 3642441 - RNA, 22 nt, Salmonella enterica enterica serovar Typhi
cgcgccaccaucgucgccagac

SEQ ID NO: 3642442 - RNA, 21 nt, Salmonella enterica enterica serovar Typhi
cgcgccacggccaacgcgccc

SEQ ID NO: 3642443 - RNA, 15 nt, Salmonella enterica enterica serovar Typhi
cgcgccagacgccau

SEQ ID NO: 3642444 - RNA, 23 nt, Salmonella enterica enterica serovar Typhi
cgcgccagaugcuuaaacugcgc

SEQ ID NO: 3642445 - RNA, 15 nt, Salmonella enterica enterica serovar Typhi
cgcgccagcaggucg

SEQ ID NO: 3642446 - RNA, 12 nt, Salmonella enterica enterica serovar Typhi
cgcgccagccaa

SEQ ID NO: 3642447 - RNA, 12 nt, Salmonella enterica enterica serovar Typhi
cgcgccagcgac

SEQ ID NO: 3642448 - RNA, 13 nt, Salmonella enterica enterica serovar Typhi
cgcgccagcgucg

SEQ ID NO: 3642449 - RNA, 13 nt, Salmonella enterica enterica serovar Typhi
cgcgccagggcgc

SEQ ID NO: 3642450 - RNA, 22 nt, Salmonella enterica enterica serovar Typhi
cgcgccaggucucauagcgccc

SEQ ID NO: 3642451 - RNA, 21 nt, Salmonella enterica enterica serovar Typhi
cgcgccauccggcauuaccgc

SEQ ID NO: 3642452 - RNA, 17 nt, Salmonella enterica enterica serovar Typhi
cgcgccaucgucaccgg

SEQ ID NO: 3642453 - RNA, 17 nt, Salmonella enterica enterica serovar Typhi
cgcgccaucuccuccuc

SEQ ID NO: 3642454 - RNA, 17 nt, Salmonella enterica enterica serovar Typhi
cgcgccauuugccagau

SEQ ID NO: 3642455 - RNA, 17 nt, Salmonella enterica enterica serovar Typhi
cgcgcccaucuccagcc

SEQ ID NO: 3642456 - RNA, 14 nt, Salmonella enterica enterica serovar Typhi
cgcgcccgacgcgc

SEQ ID NO: 3642457 - RNA, 20 nt, Salmonella enterica enterica serovar Typhi
cgcgcccgccaccagcacag

SEQ ID NO: 3642458 - RNA, 21 nt, Salmonella enterica enterica serovar Typhi
cgcgcccgccaucaugcccac

SEQ ID NO: 3642459 - RNA, 15 nt, Salmonella enterica enterica serovar Typhi
cgcgcccgccgccaa

SEQ ID NO: 3642460 - RNA, 16 nt, Salmonella enterica enterica serovar Typhi
cgcgccgcaggccgga

SEQ ID NO: 3642461 - RNA, 16 nt, Salmonella enterica enterica serovar Typhi
cgcgccgcaucuucca

SEQ ID NO: 3642462 - RNA, 22 nt, Salmonella enterica enterica serovar Typhi
cgcgccgccaacgccaacauag

SEQ ID NO: 3642463 - RNA, 13 nt, Salmonella enterica enterica serovar Typhi
cgcgccgcgcagc

SEQ ID NO: 3642464 - RNA, 21 nt, Salmonella enterica enterica serovar Typhi
cgcgccgcuggcgaccagccu

SEQ ID NO: 3642465 - RNA, 23 nt, Salmonella enterica enterica serovar Typhi
cgcgccggaugacggcagcgcgu

SEQ ID NO: 3642466 - RNA, 11 nt, Salmonella enterica enterica serovar Typhi
cgcgccggcaa

SEQ ID NO: 3642467 - RNA, 17 nt, Salmonella enterica enterica serovar Typhi
cgcgccgguagcgagaa

SEQ ID NO: 3642468 - RNA, 17 nt, Salmonella enterica enterica serovar Typhi
cgcgccggucgccagca

SEQ ID NO: 3642469 - RNA, 11 nt, Salmonella enterica enterica serovar Typhi
cgcgccguucg

SEQ ID NO: 3642470 - RNA, 16 nt, Salmonella enterica enterica serovar Typhi
cgcgccuccccugccg

SEQ ID NO: 3642471 - RNA, 22 nt, Salmonella enterica enterica serovar Typhi
cgcgccuccccugccggcggca

SEQ ID NO: 3642472 - RNA, 12 nt, Salmonella enterica enterica serovar Typhi
cgcgccugccaa

SEQ ID NO: 3642473 - RNA, 23 nt, Salmonella enterica enterica serovar Typhi
cgcgccugcgcuggaaucaucca

SEQ ID NO: 3642474 - RNA, 18 nt, Salmonella enterica enterica serovar Typhi
cgcgccuggaucugcgca

SEQ ID NO: 3642475 - RNA, 20 nt, Salmonella enterica enterica serovar Typhi
cgcgccuggaucugcgcauu

SEQ ID NO: 3642476 - RNA, 20 nt, Salmonella enterica enterica serovar Typhi
cgcgcgaaacgcacccgcgc

SEQ ID NO: 3642477 - RNA, 12 nt, Salmonella enterica enterica serovar Typhi
cgcgcgaaggcg

SEQ ID NO: 3642478 - RNA, 11 nt, Salmonella enterica enterica serovar Typhi
cgcgcgaccca

SEQ ID NO: 3642479 - RNA, 19 nt, Salmonella enterica enterica serovar Typhi
cgcgcgacuuaucuuccac

SEQ ID NO: 3642480 - RNA, 14 nt, Salmonella enterica enterica serovar Typhi
cgcgcgaugcugcu

SEQ ID NO: 3642481 - RNA, 16 nt, Salmonella enterica enterica serovar Typhi
cgcgcgccacgcaugg

SEQ ID NO: 3642482 - RNA, 13 nt, Salmonella enterica enterica serovar Typhi
cgcgcgccgauaa

SEQ ID NO: 3642483 - RNA, 13 nt, Salmonella enterica enterica serovar Typhi
cgcgcgccgccuc

SEQ ID NO: 3642484 - RNA, 19 nt, Salmonella enterica enterica serovar Typhi
cgcgcgccgcuuccggcag

SEQ ID NO: 3642485 - RNA, 20 nt, Salmonella enterica enterica serovar Typhi
cgcgcgccugaugcgccgcc

SEQ ID NO: 3642486 - RNA, 19 nt, Salmonella enterica enterica serovar Typhi
cgcgcgcuuucaccgccuc

SEQ ID NO: 3642487 - RNA, 20 nt, Salmonella enterica enterica serovar Typhi
cgcgcggauauggcggcggc

SEQ ID NO: 3642488 - RNA, 17 nt, Salmonella enterica enterica serovar Typhi
cgcgcggauucuccagg

SEQ ID NO: 3642489 - RNA, 15 nt, Salmonella enterica enterica serovar Typhi
cgcgcggcaggccuu

SEQ ID NO: 3642490 - RNA, 14 nt, Salmonella enterica enterica serovar Typhi
cgcgcggugaaagu

SEQ ID NO: 3642491 - RNA, 22 nt, Salmonella enterica enterica serovar Typhi
cgcgcgguugggcuuccgucgg

SEQ ID NO: 3642492 - RNA, 15 nt, Salmonella enterica enterica serovar Typhi
cgcgcgguuuauccc

SEQ ID NO: 3642493 - RNA, 22 nt, Salmonella enterica enterica serovar Typhi
cgcgcguccacggcgggacgcu

SEQ ID NO: 3642494 - RNA, 15 nt, Salmonella enterica enterica serovar Typhi
cgcgcguuaugccga

SEQ ID NO: 3642495 - RNA, 21 nt, Salmonella enterica enterica serovar Typhi
cgcgcuagugccgccaggcaa

SEQ ID NO: 3642496 - RNA, 16 nt, Salmonella enterica enterica serovar Typhi
cgcgcuauuccaguuu

SEQ ID NO: 3642497 - RNA, 21 nt, Salmonella enterica enterica serovar Typhi
cgcgcucauacgaucgcgcac

SEQ ID NO: 3642498 - RNA, 13 nt, Salmonella enterica enterica serovar Typhi
cgcgcucgccagc

SEQ ID NO: 3642499 - RNA, 13 nt, Salmonella enterica enterica serovar Typhi
cgcgcucuccggc

SEQ ID NO: 3642500 - RNA, 14 nt, Salmonella enterica enterica serovar Typhi
cgcgcugaucgcca

SEQ ID NO: 3642501 - RNA, 13 nt, Salmonella enterica enterica serovar Typhi
cgcgcugccgccc

SEQ ID NO: 3642502 - RNA, 15 nt, Salmonella enterica enterica serovar Typhi
cgcgcugccgcccuu

SEQ ID NO: 3642503 - RNA, 14 nt, Salmonella enterica enterica serovar Typhi
cgcgcugcgccgca

SEQ ID NO: 3642504 - RNA, 23 nt, Salmonella enterica enterica serovar Typhi
cgcgcugcggcggcggaaaauag

SEQ ID NO: 3642505 - RNA, 20 nt, Salmonella enterica enterica serovar Typhi
cgcgcugcggcgucugccuu

SEQ ID NO: 3642506 - RNA, 20 nt, Salmonella enterica enterica serovar Typhi
cgcgcuggugggacuguuca

SEQ ID NO: 3642507 - RNA, 17 nt, Salmonella enterica enterica serovar Typhi
cgcgcuguauaaucccg

SEQ ID NO: 3642508 - RNA, 22 nt, Salmonella enterica enterica serovar Typhi
cgcgcuguuuauccacaggcga

SEQ ID NO: 3642509 - RNA, 22 nt, Salmonella enterica enterica serovar Typhi
cgcgcuuacgcuccugcgguac

SEQ ID NO: 3642510 - RNA, 21 nt, Salmonella enterica enterica serovar Typhi
cgcgcuugcguguuugggcga

SEQ ID NO: 3642511 - RNA, 24 nt, Salmonella enterica enterica serovar Typhi
cgcgcuuuagggcuuccucgccac

SEQ ID NO: 3642512 - RNA, 14 nt, Salmonella enterica enterica serovar Typhi
cgcgcuuucaaucg

SEQ ID NO: 3642513 - RNA, 17 nt, Salmonella enterica enterica serovar Typhi
cgcgcuuucuggcgcag

SEQ ID NO: 3642514 - RNA, 19 nt, Salmonella enterica enterica serovar Typhi
cgcgcuuuucgccagcgca

SEQ ID NO: 3642515 - RNA, 18 nt, Salmonella enterica enterica serovar Typhi
cgcgcuuuuuuggcguag

SEQ ID NO: 3642516 - RNA, 19 nt, Salmonella enterica enterica serovar Typhi
cgcggaacuggugaaacag

SEQ ID NO: 3642517 - RNA, 19 nt, Salmonella enterica enterica serovar Typhi
cgcggaagaaauagaacag

SEQ ID NO: 3642518 - RNA, 14 nt, Salmonella enterica enterica serovar Typhi
cgcggaagccacgu

SEQ ID NO: 3642519 - RNA, 13 nt, Salmonella enterica enterica serovar Typhi
cgcggaaggcgcc

SEQ ID NO: 3642520 - RNA, 13 nt, Salmonella enterica enterica serovar Typhi
cgcggaaucguca

SEQ ID NO: 3642521 - RNA, 19 nt, Salmonella enterica enterica serovar Typhi
cgcggaccuuuugccgccc

SEQ ID NO: 3642522 - RNA, 17 nt, Salmonella enterica enterica serovar Typhi
cgcggacgaccaauucc

SEQ ID NO: 3642523 - RNA, 18 nt, Salmonella enterica enterica serovar Typhi
cgcggagagucgaccagc

SEQ ID NO: 3642524 - RNA, 16 nt, Salmonella enterica enterica serovar Typhi
cgcggauagucauaau

SEQ ID NO: 3642525 - RNA, 18 nt, Salmonella enterica enterica serovar Typhi
cgcggauaugcagcagcc

SEQ ID NO: 3642526 - RNA, 19 nt, Salmonella enterica enterica serovar Typhi
cgcggauaugcagcagcca

SEQ ID NO: 3642527 - RNA, 19 nt, Salmonella enterica enterica serovar Typhi
cgcggauauggcggcggcu

SEQ ID NO: 3642528 - RNA, 13 nt, Salmonella enterica enterica serovar Typhi
cgcggaucggcac

SEQ ID NO: 3642529 - RNA, 18 nt, Salmonella enterica enterica serovar Typhi
cgcggaucggcacacagc

SEQ ID NO: 3642530 - RNA, 18 nt, Salmonella enterica enterica serovar Typhi
cgcggaugcuaucgcgga

SEQ ID NO: 3642531 - RNA, 17 nt, Salmonella enterica enterica serovar Typhi
cgcggaugguggcguaa

SEQ ID NO: 3642532 - RNA, 17 nt, Salmonella enterica enterica serovar Typhi
cgcggauuaagcgaauc

SEQ ID NO: 3642533 - RNA, 15 nt, Salmonella enterica enterica serovar Typhi
cgcggauugccgccc

SEQ ID NO: 3642534 - RNA, 19 nt, Salmonella enterica enterica serovar Typhi
cgcggcaaccagcccauga

SEQ ID NO: 3642535 - RNA, 17 nt, Salmonella enterica enterica serovar Typhi
cgcggcaauuuccgcug

SEQ ID NO: 3642536 - RNA, 22 nt, Salmonella enterica enterica serovar Typhi
cgcggcacacaacacggcggcu

SEQ ID NO: 3642537 - RNA, 13 nt, Salmonella enterica enterica serovar Typhi
cgcggcacacagc

SEQ ID NO: 3642538 - RNA, 19 nt, Salmonella enterica enterica serovar Typhi
cgcggcacacuuucaucag

SEQ ID NO: 3642539 - RNA, 13 nt, Salmonella enterica enterica serovar Typhi
cgcggcagccgga

SEQ ID NO: 3642540 - RNA, 13 nt, Salmonella enterica enterica serovar Typhi
cgcggcaggaaug

SEQ ID NO: 3642541 - RNA, 14 nt, Salmonella enterica enterica serovar Typhi
cgcggcaucaagca

SEQ ID NO: 3642542 - RNA, 15 nt, Salmonella enterica enterica serovar Typhi
cgcggcauuaaaugc

SEQ ID NO: 3642543 - RNA, 17 nt, Salmonella enterica enterica serovar Typhi
cgcggcauuaaaugcgc

SEQ ID NO: 3642544 - RNA, 13 nt, Salmonella enterica enterica serovar Typhi
cgcggccaaaacc

SEQ ID NO: 3642545 - RNA, 20 nt, Salmonella enterica enterica serovar Typhi
cgcggccaaaacccaccagc

SEQ ID NO: 3642546 - RNA, 22 nt, Salmonella enterica enterica serovar Typhi
cgcggccaaaacccaccagcag

SEQ ID NO: 3642547 - RNA, 13 nt, Salmonella enterica enterica serovar Typhi
cgcggccaccaga

SEQ ID NO: 3642548 - RNA, 16 nt, Salmonella enterica enterica serovar Typhi
cgcggccaccgccagu

SEQ ID NO: 3642549 - RNA, 19 nt, Salmonella enterica enterica serovar Typhi
cgcggccagaaugcccagc

SEQ ID NO: 3642550 - RNA, 22 nt, Salmonella enterica enterica serovar Typhi
cgcggcccauucaacgggcgau

SEQ ID NO: 3642551 - RNA, 14 nt, Salmonella enterica enterica serovar Typhi
cgcggccugcgugc

SEQ ID NO: 3642552 - RNA, 19 nt, Salmonella enterica enterica serovar Typhi
cgcggcgaaaaagccggcg

SEQ ID NO: 3642553 - RNA, 21 nt, Salmonella enterica enterica serovar Typhi
cgcggcgaaaaagccggcgga

SEQ ID NO: 3642554 - RNA, 21 nt, Salmonella enterica enterica serovar Typhi
cgcggcgaaauaggccgcgau

SEQ ID NO: 3642555 - RNA, 21 nt, Salmonella enterica enterica serovar Typhi
cgcggcgacggacucgcgcag

SEQ ID NO: 3642556 - RNA, 18 nt, Salmonella enterica enterica serovar Typhi
cgcggcgcaaaucgccau

SEQ ID NO: 3642557 - RNA, 22 nt, Salmonella enterica enterica serovar Typhi
cgcggcgcugaguuucucccgc

SEQ ID NO: 3642558 - RNA, 21 nt, Salmonella enterica enterica serovar Typhi
cgcggcggacaacgcuccagc

SEQ ID NO: 3642559 - RNA, 13 nt, Salmonella enterica enterica serovar Typhi
cgcggcggaccgc

SEQ ID NO: 3642560 - RNA, 18 nt, Salmonella enterica enterica serovar Typhi
cgcggcguaccgcgcgcc

SEQ ID NO: 3642561 - RNA, 21 nt, Salmonella enterica enterica serovar Typhi
cgcggcgugaugccagccaua

SEQ ID NO: 3642562 - RNA, 13 nt, Salmonella enterica enterica serovar Typhi
cgcggcgugcgcu

SEQ ID NO: 3642563 - RNA, 17 nt, Salmonella enterica enterica serovar Typhi
cgcggcguucugcgcca

SEQ ID NO: 3642564 - RNA, 14 nt, Salmonella enterica enterica serovar Typhi
cgcggcuacagaca

SEQ ID NO: 3642565 - RNA, 15 nt, Salmonella enterica enterica serovar Typhi
cgcggcuaccggacu

SEQ ID NO: 3642566 - RNA, 18 nt, Salmonella enterica enterica serovar Typhi
cgcggcugguaagagagc

SEQ ID NO: 3642567 - RNA, 17 nt, Salmonella enterica enterica serovar Typhi
cgcggcuuauccggcuu

SEQ ID NO: 3642568 - RNA, 15 nt, Salmonella enterica enterica serovar Typhi
cgcgggaaugcgcgc

SEQ ID NO: 3642569 - RNA, 18 nt, Salmonella enterica enterica serovar Typhi
cgcgggccauacacucaa

SEQ ID NO: 3642570 - RNA, 14 nt, Salmonella enterica enterica serovar Typhi
cgcgggccugccug

SEQ ID NO: 3642571 - RNA, 14 nt, Salmonella enterica enterica serovar Typhi
cgcgggcggcguuu

SEQ ID NO: 3642572 - RNA, 12 nt, Salmonella enterica enterica serovar Typhi
cgcggggaacac

SEQ ID NO: 3642573 - RNA, 16 nt, Salmonella enterica enterica serovar Typhi
cgcggguucuuuccac

SEQ ID NO: 3642574 - RNA, 17 nt, Salmonella enterica enterica serovar Typhi
cgcgguaaauuccgcag

SEQ ID NO: 3642575 - RNA, 18 nt, Salmonella enterica enterica serovar Typhi
cgcgguauucauaccuuu

SEQ ID NO: 3642576 - RNA, 23 nt, Salmonella enterica enterica serovar Typhi
cgcgguauuucgcaacgccgccg

SEQ ID NO: 3642577 - RNA, 18 nt, Salmonella enterica enterica serovar Typhi
cgcgguauuucgccgccg

SEQ ID NO: 3642578 - RNA, 19 nt, Salmonella enterica enterica serovar Typhi
cgcgguauuucgccgccgc

SEQ ID NO: 3642579 - RNA, 21 nt, Salmonella enterica enterica serovar Typhi
cgcggucaacguuaacugcug

SEQ ID NO: 3642580 - RNA, 14 nt, Salmonella enterica enterica serovar Typhi
cgcggucagcggcg

SEQ ID NO: 3642581 - RNA, 18 nt, Salmonella enterica enterica serovar Typhi
cgcggucagcggcgcgcc

SEQ ID NO: 3642582 - RNA, 23 nt, Salmonella enterica enterica serovar Typhi
cgcggucagggugaaucccgcca

SEQ ID NO: 3642583 - RNA, 15 nt, Salmonella enterica enterica serovar Typhi
cgcggucgccugccg

SEQ ID NO: 3642584 - RNA, 12 nt, Salmonella enterica enterica serovar Typhi
cgcggucggcag

SEQ ID NO: 3642585 - RNA, 16 nt, Salmonella enterica enterica serovar Typhi
cgcggucggcaggcgg

SEQ ID NO: 3642586 - RNA, 22 nt, Salmonella enterica enterica serovar Typhi
cgcggucgggauauaugcaaaa

SEQ ID NO: 3642587 - RNA, 16 nt, Salmonella enterica enterica serovar Typhi
cgcggucgucaucggc

SEQ ID NO: 3642588 - RNA, 22 nt, Salmonella enterica enterica serovar Typhi
cgcggugaaggcaaaacaccau

SEQ ID NO: 3642589 - RNA, 23 nt, Salmonella enterica enterica serovar Typhi
cgcggugccgauggcuaaagcgc

SEQ ID NO: 3642590 - RNA, 15 nt, Salmonella enterica enterica serovar Typhi
cgcgguugucggcgc

SEQ ID NO: 3642591 - RNA, 12 nt, Salmonella enterica enterica serovar Typhi
cgcgguuuaucc

SEQ ID NO: 3642592 - RNA, 18 nt, Salmonella enterica enterica serovar Typhi
cgcgguuucguggcgcug

SEQ ID NO: 3642593 - RNA, 17 nt, Salmonella enterica enterica serovar Typhi
cgcguaaacuuccgcca

SEQ ID NO: 3642594 - RNA, 19 nt, Salmonella enterica enterica serovar Typhi
cgcguaaacuuccgccagc

SEQ ID NO: 3642595 - RNA, 14 nt, Salmonella enterica enterica serovar Typhi
cgcguaaauccaca

SEQ ID NO: 3642596 - RNA, 13 nt, Salmonella enterica enterica serovar Typhi
cgcguaacagcgg

SEQ ID NO: 3642597 - RNA, 17 nt, Salmonella enterica enterica serovar Typhi
cgcguaaccccugcccg

SEQ ID NO: 3642598 - RNA, 23 nt, Salmonella enterica enterica serovar Typhi
cgcguaaguuugcguacucagca

SEQ ID NO: 3642599 - RNA, 19 nt, Salmonella enterica enterica serovar Typhi
cgcguaaucuuccacccgc

SEQ ID NO: 3642600 - RNA, 23 nt, Salmonella enterica enterica serovar Typhi
cgcguaauuugcgacauggcgac

SEQ ID NO: 3642601 - RNA, 15 nt, Salmonella enterica enterica serovar Typhi
cgcguacagcgccau

SEQ ID NO: 3642602 - RNA, 17 nt, Salmonella enterica enterica serovar Typhi
cgcguacagcgccauga

SEQ ID NO: 3642603 - RNA, 12 nt, Salmonella enterica enterica serovar Typhi
cgcguaccagcg

SEQ ID NO: 3642604 - RNA, 13 nt, Salmonella enterica enterica serovar Typhi
cgcguaccagcgc

SEQ ID NO: 3642605 - RNA, 17 nt, Salmonella enterica enterica serovar Typhi
cgcguacccggcuuaca

SEQ ID NO: 3642606 - RNA, 17 nt, Salmonella enterica enterica serovar Typhi
cgcguaccucagcaugu

SEQ ID NO: 3642607 - RNA, 20 nt, Salmonella enterica enterica serovar Typhi
cgcguacuuucgccaguuca

SEQ ID NO: 3642608 - RNA, 18 nt, Salmonella enterica enterica serovar Typhi
cgcguagcccacagguag

SEQ ID NO: 3642609 - RNA, 18 nt, Salmonella enterica enterica serovar Typhi
cgcguagcccagcgccgc

SEQ ID NO: 3642610 - RNA, 14 nt, Salmonella enterica enterica serovar Typhi
cgcguagcuggccu

SEQ ID NO: 3642611 - RNA, 17 nt, Salmonella enterica enterica serovar Typhi
cgcguauaacgccgccc

SEQ ID NO: 3642612 - RNA, 17 nt, Salmonella enterica enterica serovar Typhi
cgcguauucucaaccag

SEQ ID NO: 3642613 - RNA, 17 nt, Salmonella enterica enterica serovar Typhi
cgcgucaaauagagaaa

SEQ ID NO: 3642614 - RNA, 23 nt, Salmonella enterica enterica serovar Typhi
cgcgucacaaaaacacccgcagc

SEQ ID NO: 3642615 - RNA, 14 nt, Salmonella enterica enterica serovar Typhi
cgcgucacaagcuc

SEQ ID NO: 3642616 - RNA, 19 nt, Salmonella enterica enterica serovar Typhi
cgcgucagcaaaauggcaa

SEQ ID NO: 3642617 - RNA, 17 nt, Salmonella enterica enterica serovar Typhi
cgcgucagggcaaggcg

SEQ ID NO: 3642618 - RNA, 16 nt, Salmonella enterica enterica serovar Typhi
cgcgucagggcgauaa

SEQ ID NO: 3642619 - RNA, 17 nt, Salmonella enterica enterica serovar Typhi
cgcgucagggcgauaau

SEQ ID NO: 3642620 - RNA, 17 nt, Salmonella enterica enterica serovar Typhi
cgcgucaucggcgcgcu

SEQ ID NO: 3642621 - RNA, 15 nt, Salmonella enterica enterica serovar Typhi
cgcguccagcccgcu

SEQ ID NO: 3642622 - RNA, 15 nt, Salmonella enterica enterica serovar Typhi
cgcguccauuacucu

SEQ ID NO: 3642623 - RNA, 14 nt, Salmonella enterica enterica serovar Typhi
cgcgucccucucca

SEQ ID NO: 3642624 - RNA, 15 nt, Salmonella enterica enterica serovar Typhi
cgcgucccucuccag

SEQ ID NO: 3642625 - RNA, 12 nt, Salmonella enterica enterica serovar Typhi
cgcgucgccauc

SEQ ID NO: 3642626 - RNA, 12 nt, Salmonella enterica enterica serovar Typhi
cgcgucgcuguu

SEQ ID NO: 3642627 - RNA, 16 nt, Salmonella enterica enterica serovar Typhi
cgcgucguucacgcca

SEQ ID NO: 3642628 - RNA, 22 nt, Salmonella enterica enterica serovar Typhi
cgcgucguucacgucgcgaagc

SEQ ID NO: 3642629 - RNA, 21 nt, Salmonella enterica enterica serovar Typhi
cgcgucugaaugacgccgucu

SEQ ID NO: 3642630 - RNA, 19 nt, Salmonella enterica enterica serovar Typhi
cgcgucuguguuuauccgg

SEQ ID NO: 3642631 - RNA, 19 nt, Salmonella enterica enterica serovar Typhi
cgcgugaauugcgguuuau

SEQ ID NO: 3642632 - RNA, 22 nt, Salmonella enterica enterica serovar Typhi
cgcgugaauugcgguuuauccc

SEQ ID NO: 3642633 - RNA, 21 nt, Salmonella enterica enterica serovar Typhi
cgcgugacgacuaccgccgau

SEQ ID NO: 3642634 - RNA, 18 nt, Salmonella enterica enterica serovar Typhi
cgcgugacgcaguaauac

SEQ ID NO: 3642635 - RNA, 16 nt, Salmonella enterica enterica serovar Typhi
cgcgugagaucguuau

SEQ ID NO: 3642636 - RNA, 19 nt, Salmonella enterica enterica serovar Typhi
cgcgugcgcugcggccaga

SEQ ID NO: 3642637 - RNA, 20 nt, Salmonella enterica enterica serovar Typhi
cgcgugcuguaccgcguccu

SEQ ID NO: 3642638 - RNA, 20 nt, Salmonella enterica enterica serovar Typhi
cgcguguuuguaaaaauaga

SEQ ID NO: 3642639 - RNA, 23 nt, Salmonella enterica enterica serovar Typhi
cgcguuaauauccuucagcguuu

SEQ ID NO: 3642640 - RNA, 18 nt, Salmonella enterica enterica serovar Typhi
cgcguuaauuuuccccgc

SEQ ID NO: 3642641 - RNA, 17 nt, Salmonella enterica enterica serovar Typhi
cgcguuauagccgccaa

SEQ ID NO: 3642642 - RNA, 19 nt, Salmonella enterica enterica serovar Typhi
cgcguucgccgucacgccg

SEQ ID NO: 3642643 - RNA, 14 nt, Salmonella enterica enterica serovar Typhi
cgcguucgcgcagu

SEQ ID NO: 3642644 - RNA, 20 nt, Salmonella enterica enterica serovar Typhi
cgcguucgcuucgaggauaa

SEQ ID NO: 3642645 - RNA, 14 nt, Salmonella enterica enterica serovar Typhi
cgcguucuggcgau

SEQ ID NO: 3642646 - RNA, 23 nt, Salmonella enterica enterica serovar Typhi
cgcguugacguuuaccugaacaa

SEQ ID NO: 3642647 - RNA, 22 nt, Salmonella enterica enterica serovar Typhi
cgcguugcuuaucaggccuaca

SEQ ID NO: 3642648 - RNA, 15 nt, Salmonella enterica enterica serovar Typhi
cgcguuggcggcuuu

SEQ ID NO: 3642649 - RNA, 14 nt, Salmonella enterica enterica serovar Typhi
cgcguuuagcgcca

SEQ ID NO: 3642650 - RNA, 15 nt, Salmonella enterica enterica serovar Typhi
cgcguuuagcgccag

SEQ ID NO: 3642651 - RNA, 17 nt, Salmonella enterica enterica serovar Typhi
cgcguuuagcgccagca

SEQ ID NO: 3642652 - RNA, 15 nt, Salmonella enterica enterica serovar Typhi
cgcguuuaucaccaa

SEQ ID NO: 3642653 - RNA, 14 nt, Salmonella enterica enterica serovar Typhi
cgcguuuaucgcau

SEQ ID NO: 3642654 - RNA, 14 nt, Salmonella enterica enterica serovar Typhi
cgcguuuuccagca

SEQ ID NO: 3642655 - RNA, 13 nt, Salmonella enterica enterica serovar Typhi
cgcguuuuccauu

SEQ ID NO: 3642656 - RNA, 16 nt, Salmonella enterica enterica serovar Typhi
cgcguuuuccauuuua

SEQ ID NO: 3642657 - RNA, 14 nt, Salmonella enterica enterica serovar Typhi
cgcguuuugccgcu

SEQ ID NO: 3642658 - RNA, 16 nt, Salmonella enterica enterica serovar Typhi
cgcguuuuuucaugaa

SEQ ID NO: 3642659 - RNA, 15 nt, Salmonella enterica enterica serovar Typhi
cgcuaaaauccacgu

SEQ ID NO: 3642660 - RNA, 16 nt, Salmonella enterica enterica serovar Typhi
cgcuaaacagcgccgc

SEQ ID NO: 3642661 - RNA, 20 nt, Salmonella enterica enterica serovar Typhi
cgcuaaacagcgccgcgaau

SEQ ID NO: 3642662 - RNA, 23 nt, Salmonella enterica enterica serovar Typhi
cgcuaaaccacaugaccagcgcc

SEQ ID NO: 3642663 - RNA, 23 nt, Salmonella enterica enterica serovar Typhi
cgcuaaaugacaaauagaagcca

SEQ ID NO: 3642664 - RNA, 22 nt, Salmonella enterica enterica serovar Typhi
cgcuaaccagcgcuucgccugc

SEQ ID NO: 3642665 - RNA, 15 nt, Salmonella enterica enterica serovar Typhi
cgcuaaccauugcgg

SEQ ID NO: 3642666 - RNA, 16 nt, Salmonella enterica enterica serovar Typhi
cgcuaaccggcggcgu

SEQ ID NO: 3642667 - RNA, 21 nt, Salmonella enterica enterica serovar Typhi
cgcuaaucccgcucgccaggu

SEQ ID NO: 3642668 - RNA, 23 nt, Salmonella enterica enterica serovar Typhi
cgcuaauguacgccuaaaaauga

SEQ ID NO: 3642669 - RNA, 17 nt, Salmonella enterica enterica serovar Typhi
cgcuaauuuucagggug

SEQ ID NO: 3642670 - RNA, 17 nt, Salmonella enterica enterica serovar Typhi
cgcuaauuuuuaaauga

SEQ ID NO: 3642671 - RNA, 18 nt, Salmonella enterica enterica serovar Typhi
cgcuacaauccaggacgu

SEQ ID NO: 3642672 - RNA, 22 nt, Salmonella enterica enterica serovar Typhi
cgcuacauccgccagccgccau

SEQ ID NO: 3642673 - RNA, 17 nt, Salmonella enterica enterica serovar Typhi
cgcuaccagcgcggcgc

SEQ ID NO: 3642674 - RNA, 14 nt, Salmonella enterica enterica serovar Typhi
cgcuacccggcaca

SEQ ID NO: 3642675 - RNA, 12 nt, Salmonella enterica enterica serovar Typhi
cgcuaccgcaau

SEQ ID NO: 3642676 - RNA, 16 nt, Salmonella enterica enterica serovar Typhi
cgcuacgcuuaucagg

SEQ ID NO: 3642677 - RNA, 20 nt, Salmonella enterica enterica serovar Typhi
cgcuacgcuuaucaggccua

SEQ ID NO: 3642678 - RNA, 18 nt, Salmonella enterica enterica serovar Typhi
cgcuacgcuuaucgggcc

SEQ ID NO: 3642679 - RNA, 15 nt, Salmonella enterica enterica serovar Typhi
cgcuacggcguuuca

SEQ ID NO: 3642680 - RNA, 14 nt, Salmonella enterica enterica serovar Typhi
cgcuacguuuaucu

SEQ ID NO: 3642681 - RNA, 18 nt, Salmonella enterica enterica serovar Typhi
cgcuacuccgcccuaauc

SEQ ID NO: 3642682 - RNA, 16 nt, Salmonella enterica enterica serovar Typhi
cgcuacugccgccauc

SEQ ID NO: 3642683 - RNA, 19 nt, Salmonella enterica enterica serovar Typhi
cgcuagcgcuuacccgacc

SEQ ID NO: 3642684 - RNA, 15 nt, Salmonella enterica enterica serovar Typhi
cgcuagcuggcaggg

SEQ ID NO: 3642685 - RNA, 13 nt, Salmonella enterica enterica serovar Typhi
cgcuauaucacgc

SEQ ID NO: 3642686 - RNA, 14 nt, Salmonella enterica enterica serovar Typhi
cgcuauauuccagc

SEQ ID NO: 3642687 - RNA, 13 nt, Salmonella enterica enterica serovar Typhi
cgcuaucaaaaug

SEQ ID NO: 3642688 - RNA, 21 nt, Salmonella enterica enterica serovar Typhi
cgcuaucaacgccuccaggcu

SEQ ID NO: 3642689 - RNA, 16 nt, Salmonella enterica enterica serovar Typhi
cgcuaucaggcacuga

SEQ ID NO: 3642690 - RNA, 17 nt, Salmonella enterica enterica serovar Typhi
cgcuaucaggcacugaa

SEQ ID NO: 3642691 - RNA, 12 nt, Salmonella enterica enterica serovar Typhi
cgcuauccagca

SEQ ID NO: 3642692 - RNA, 14 nt, Salmonella enterica enterica serovar Typhi
cgcuauccagcagu

SEQ ID NO: 3642693 - RNA, 14 nt, Salmonella enterica enterica serovar Typhi
cgcuauccgcauau

SEQ ID NO: 3642694 - RNA, 20 nt, Salmonella enterica enterica serovar Typhi
cgcuauccggcccauuuggc

SEQ ID NO: 3642695 - RNA, 14 nt, Salmonella enterica enterica serovar Typhi
cgcuauccggcuuu

SEQ ID NO: 3642696 - RNA, 20 nt, Salmonella enterica enterica serovar Typhi
cgcuaucucuuccagcgucu

SEQ ID NO: 3642697 - RNA, 17 nt, Salmonella enterica enterica serovar Typhi
cgcuaucugcuccgcca

SEQ ID NO: 3642698 - RNA, 19 nt, Salmonella enterica enterica serovar Typhi
cgcuaucuuugagcagaua

SEQ ID NO: 3642699 - RNA, 18 nt, Salmonella enterica enterica serovar Typhi
cgcuauggugcgggguuu

SEQ ID NO: 3642700 - RNA, 22 nt, Salmonella enterica enterica serovar Typhi
cgcuauguaagguucccugcgc

SEQ ID NO: 3642701 - RNA, 12 nt, Salmonella enterica enterica serovar Typhi
cgcuauuaccag

SEQ ID NO: 3642702 - RNA, 19 nt, Salmonella enterica enterica serovar Typhi
cgcuauugagcgacgccgc

SEQ ID NO: 3642703 - RNA, 13 nt, Salmonella enterica enterica serovar Typhi
cgcuauuuaaccc

SEQ ID NO: 3642704 - RNA, 20 nt, Salmonella enterica enterica serovar Typhi
cgcucaaauacgcgauaaaa

SEQ ID NO: 3642705 - RNA, 16 nt, Salmonella enterica enterica serovar Typhi
cgcucaagaugauagc

SEQ ID NO: 3642706 - RNA, 21 nt, Salmonella enterica enterica serovar Typhi
cgcucaagcgaaaaaauaauc

SEQ ID NO: 3642707 - RNA, 18 nt, Salmonella enterica enterica serovar Typhi
cgcucaagcugggcguua

SEQ ID NO: 3642708 - RNA, 16 nt, Salmonella enterica enterica serovar Typhi
cgcucaauagccagaa

SEQ ID NO: 3642709 - RNA, 13 nt, Salmonella enterica enterica serovar Typhi
cgcucaaucagcg

SEQ ID NO: 3642710 - RNA, 13 nt, Salmonella enterica enterica serovar Typhi
cgcucacgauaac

SEQ ID NO: 3642711 - RNA, 13 nt, Salmonella enterica enterica serovar Typhi
cgcucacgcagau

SEQ ID NO: 3642712 - RNA, 16 nt, Salmonella enterica enterica serovar Typhi
cgcucaggcgcgcgcu

SEQ ID NO: 3642713 - RNA, 15 nt, Salmonella enterica enterica serovar Typhi
cgcucaugccacgcc

SEQ ID NO: 3642714 - RNA, 16 nt, Salmonella enterica enterica serovar Typhi
cgcucaugcgccuggc

SEQ ID NO: 3642715 - RNA, 21 nt, Salmonella enterica enterica serovar Typhi
cgcucaugcgccuggcgguaa

SEQ ID NO: 3642716 - RNA, 15 nt, Salmonella enterica enterica serovar Typhi
cgcucaugcgcgucc

SEQ ID NO: 3642717 - RNA, 17 nt, Salmonella enterica enterica serovar Typhi
cgcucauuuuauugaua

SEQ ID NO: 3642718 - RNA, 15 nt, Salmonella enterica enterica serovar Typhi
cgcuccacgcguccu

SEQ ID NO: 3642719 - RNA, 16 nt, Salmonella enterica enterica serovar Typhi
cgcuccagaccaccag

SEQ ID NO: 3642720 - RNA, 14 nt, Salmonella enterica enterica serovar Typhi
cgcuccagcuggcu

SEQ ID NO: 3642721 - RNA, 12 nt, Salmonella enterica enterica serovar Typhi
cgcuccagggcu

SEQ ID NO: 3642722 - RNA, 13 nt, Salmonella enterica enterica serovar Typhi
cgcuccaucacgg

SEQ ID NO: 3642723 - RNA, 21 nt, Salmonella enterica enterica serovar Typhi
cgcuccaucauaucgcgcagc

SEQ ID NO: 3642724 - RNA, 15 nt, Salmonella enterica enterica serovar Typhi
cgcucccccggcgau

SEQ ID NO: 3642725 - RNA, 19 nt, Salmonella enterica enterica serovar Typhi
cgcuccccguuccaccgcc

SEQ ID NO: 3642726 - RNA, 17 nt, Salmonella enterica enterica serovar Typhi
cgcucccuucccccaga

SEQ ID NO: 3642727 - RNA, 20 nt, Salmonella enterica enterica serovar Typhi
cgcucccuucccccagaaug

SEQ ID NO: 3642728 - RNA, 13 nt, Salmonella enterica enterica serovar Typhi
cgcuccggaacgc

SEQ ID NO: 3642729 - RNA, 12 nt, Salmonella enterica enterica serovar Typhi
cgcuccggcagg

SEQ ID NO: 3642730 - RNA, 21 nt, Salmonella enterica enterica serovar Typhi
cgcuccugcgguacggccagc

SEQ ID NO: 3642731 - RNA, 14 nt, Salmonella enterica enterica serovar Typhi
cgcucgacguccag

SEQ ID NO: 3642732 - RNA, 22 nt, Salmonella enterica enterica serovar Typhi
cgcucgauuugcccuuccagca

SEQ ID NO: 3642733 - RNA, 24 nt, Salmonella enterica enterica serovar Typhi
cgcucgccagcauacgucugcgcu

SEQ ID NO: 3642734 - RNA, 14 nt, Salmonella enterica enterica serovar Typhi
cgcucgccagcccg

SEQ ID NO: 3642735 - RNA, 15 nt, Salmonella enterica enterica serovar Typhi
cgcucgccauaucuu

SEQ ID NO: 3642736 - RNA, 13 nt, Salmonella enterica enterica serovar Typhi
cgcucgccgccuc

SEQ ID NO: 3642737 - RNA, 16 nt, Salmonella enterica enterica serovar Typhi
cgcucgccgccucccc

SEQ ID NO: 3642738 - RNA, 13 nt, Salmonella enterica enterica serovar Typhi
cgcucgcgccacg

SEQ ID NO: 3642739 - RNA, 23 nt, Salmonella enterica enterica serovar Typhi
cgcucgcucaucacaucgcgcag

SEQ ID NO: 3642740 - RNA, 23 nt, Salmonella enterica enterica serovar Typhi
cgcucgcuggugccaaucuccag

SEQ ID NO: 3642741 - RNA, 20 nt, Salmonella enterica enterica serovar Typhi
cgcucgcuuacgcggcgcgc

SEQ ID NO: 3642742 - RNA, 13 nt, Salmonella enterica enterica serovar Typhi
cgcucggccagau

SEQ ID NO: 3642743 - RNA, 21 nt, Salmonella enterica enterica serovar Typhi
cgcucgucgcgacguccgcca

SEQ ID NO: 3642744 - RNA, 21 nt, Salmonella enterica enterica serovar Typhi
cgcucguuauaauugcccgca

SEQ ID NO: 3642745 - RNA, 16 nt, Salmonella enterica enterica serovar Typhi
cgcucuauauccugcc

SEQ ID NO: 3642746 - RNA, 17 nt, Salmonella enterica enterica serovar Typhi
cgcucuauauccugccc

SEQ ID NO: 3642747 - RNA, 14 nt, Salmonella enterica enterica serovar Typhi
cgcucuaucgccug

SEQ ID NO: 3642748 - RNA, 22 nt, Salmonella enterica enterica serovar Typhi
cgcucucauagccgacccgcau

SEQ ID NO: 3642749 - RNA, 14 nt, Salmonella enterica enterica serovar Typhi
cgcucuccggcaca

SEQ ID NO: 3642750 - RNA, 16 nt, Salmonella enterica enterica serovar Typhi
cgcucucgccgcgcuc

SEQ ID NO: 3642751 - RNA, 22 nt, Salmonella enterica enterica serovar Typhi
cgcucucgccgcgcuccaucau

SEQ ID NO: 3642752 - RNA, 22 nt, Salmonella enterica enterica serovar Typhi
cgcucucuucgugacccgccag

SEQ ID NO: 3642753 - RNA, 13 nt, Salmonella enterica enterica serovar Typhi
cgcucugccuuuu

SEQ ID NO: 3642754 - RNA, 14 nt, Salmonella enterica enterica serovar Typhi
cgcucuuaccgcua

SEQ ID NO: 3642755 - RNA, 12 nt, Salmonella enterica enterica serovar Typhi
cgcucuuauugc

SEQ ID NO: 3642756 - RNA, 19 nt, Salmonella enterica enterica serovar Typhi
cgcucuuccgccagcgcca

SEQ ID NO: 3642757 - RNA, 21 nt, Salmonella enterica enterica serovar Typhi
cgcucuucgccaaucgccgcc

SEQ ID NO: 3642758 - RNA, 23 nt, Salmonella enterica enterica serovar Typhi
cgcucuucgccaaucgccgccgc

SEQ ID NO: 3642759 - RNA, 22 nt, Salmonella enterica enterica serovar Typhi
cgcucuuuaaugauguccagaa

SEQ ID NO: 3642760 - RNA, 21 nt, Salmonella enterica enterica serovar Typhi
cgcugaagcuugaaccgggua

SEQ ID NO: 3642761 - RNA, 16 nt, Salmonella enterica enterica serovar Typhi
cgcugaaguccgcgau

SEQ ID NO: 3642762 - RNA, 18 nt, Salmonella enterica enterica serovar Typhi
cgcugaauagcgcugcgg

SEQ ID NO: 3642763 - RNA, 22 nt, Salmonella enterica enterica serovar Typhi
cgcugaccacgccgccgcgucc

SEQ ID NO: 3642764 - RNA, 14 nt, Salmonella enterica enterica serovar Typhi
cgcugaccgccgga

SEQ ID NO: 3642765 - RNA, 12 nt, Salmonella enterica enterica serovar Typhi
cgcugaccucaa

SEQ ID NO: 3642766 - RNA, 21 nt, Salmonella enterica enterica serovar Typhi
cgcugacgaucaugccgccca

SEQ ID NO: 3642767 - RNA, 12 nt, Salmonella enterica enterica serovar Typhi
cgcugacgccga

SEQ ID NO: 3642768 - RNA, 17 nt, Salmonella enterica enterica serovar Typhi
cgcugacgcugcccgcc

SEQ ID NO: 3642769 - RNA, 14 nt, Salmonella enterica enterica serovar Typhi
cgcugacggcggca

SEQ ID NO: 3642770 - RNA, 16 nt, Salmonella enterica enterica serovar Typhi
cgcugacggcggcaga

SEQ ID NO: 3642771 - RNA, 17 nt, Salmonella enterica enterica serovar Typhi
cgcugagaugaccauau

SEQ ID NO: 3642772 - RNA, 20 nt, Salmonella enterica enterica serovar Typhi
cgcugagcggcucauccagc

SEQ ID NO: 3642773 - RNA, 22 nt, Salmonella enterica enterica serovar Typhi
cgcugagucagaaacggccugg

SEQ ID NO: 3642774 - RNA, 21 nt, Salmonella enterica enterica serovar Typhi
cgcugagucauccuuccccca

SEQ ID NO: 3642775 - RNA, 22 nt, Salmonella enterica enterica serovar Typhi
cgcugagucuaacccguugccg

SEQ ID NO: 3642776 - RNA, 19 nt, Salmonella enterica enterica serovar Typhi
cgcugaguuucucccgcca

SEQ ID NO: 3642777 - RNA, 23 nt, Salmonella enterica enterica serovar Typhi
cgcugaguuucucccgccagaug

SEQ ID NO: 3642778 - RNA, 17 nt, Salmonella enterica enterica serovar Typhi
cgcugauaauuaaugcg

SEQ ID NO: 3642779 - RNA, 20 nt, Salmonella enterica enterica serovar Typhi
cgcugauacgcuggcacagg

SEQ ID NO: 3642780 - RNA, 16 nt, Salmonella enterica enterica serovar Typhi
cgcugauagccacggc

SEQ ID NO: 3642781 - RNA, 12 nt, Salmonella enterica enterica serovar Typhi
cgcugaucgccg

SEQ ID NO: 3642782 - RNA, 17 nt, Salmonella enterica enterica serovar Typhi
cgcugaugaaaacccag

SEQ ID NO: 3642783 - RNA, 14 nt, Salmonella enterica enterica serovar Typhi
cgcugaugacgcgc

SEQ ID NO: 3642784 - RNA, 19 nt, Salmonella enterica enterica serovar Typhi
cgcugaugacgcgccggau

SEQ ID NO: 3642785 - RNA, 11 nt, Salmonella enterica enterica serovar Typhi
cgcugauggcg

SEQ ID NO: 3642786 - RNA, 14 nt, Salmonella enterica enterica serovar Typhi
cgcugauucguuuu

SEQ ID NO: 3642787 - RNA, 15 nt, Salmonella enterica enterica serovar Typhi
cgcugauuugccaaa

SEQ ID NO: 3642788 - RNA, 14 nt, Salmonella enterica enterica serovar Typhi
cgcugcacaaucgc

SEQ ID NO: 3642789 - RNA, 18 nt, Salmonella enterica enterica serovar Typhi
cgcugcacaaucgccagc

SEQ ID NO: 3642790 - RNA, 14 nt, Salmonella enterica enterica serovar Typhi
cgcugcauccugua

SEQ ID NO: 3642791 - RNA, 19 nt, Salmonella enterica enterica serovar Typhi
cgcugcauccuguaccacc

SEQ ID NO: 3642792 - RNA, 23 nt, Salmonella enterica enterica serovar Typhi
cgcugcauccuguaccaccacgc

SEQ ID NO: 3642793 - RNA, 20 nt, Salmonella enterica enterica serovar Typhi
cgcugcaucguuugcaguuc

SEQ ID NO: 3642794 - RNA, 14 nt, Salmonella enterica enterica serovar Typhi
cgcugcauuguucc

SEQ ID NO: 3642795 - RNA, 13 nt, Salmonella enterica enterica serovar Typhi
cgcugccgccgcu

SEQ ID NO: 3642796 - RNA, 17 nt, Salmonella enterica enterica serovar Typhi
cgcugccgcuuauccgg

SEQ ID NO: 3642797 - RNA, 18 nt, Salmonella enterica enterica serovar Typhi
cgcugccgcuuauccggc

SEQ ID NO: 3642798 - RNA, 18 nt, Salmonella enterica enterica serovar Typhi
cgcugccgucaaugccug

SEQ ID NO: 3642799 - RNA, 15 nt, Salmonella enterica enterica serovar Typhi
cgcugcgcaccugca

SEQ ID NO: 3642800 - RNA, 14 nt, Salmonella enterica enterica serovar Typhi
cgcugcgcaggcgu

SEQ ID NO: 3642801 - RNA, 23 nt, Salmonella enterica enterica serovar Typhi
cgcugcgcauuagcaauaaucuc

SEQ ID NO: 3642802 - RNA, 14 nt, Salmonella enterica enterica serovar Typhi
cgcugcgccagauc

SEQ ID NO: 3642803 - RNA, 20 nt, Salmonella enterica enterica serovar Typhi
cgcugcgcucaucaggccug

SEQ ID NO: 3642804 - RNA, 22 nt, Salmonella enterica enterica serovar Typhi
cgcugcgcuuacacacccggcc

SEQ ID NO: 3642805 - RNA, 23 nt, Salmonella enterica enterica serovar Typhi
cgcugcgcuuaccgggccgacag

SEQ ID NO: 3642806 - RNA, 20 nt, Salmonella enterica enterica serovar Typhi
cgcugcgcuuaucaggccua

SEQ ID NO: 3642807 - RNA, 16 nt, Salmonella enterica enterica serovar Typhi
cgcugcgcuuauccgg

SEQ ID NO: 3642808 - RNA, 22 nt, Salmonella enterica enterica serovar Typhi
cgcugcggcguggagcauucca

SEQ ID NO: 3642809 - RNA, 17 nt, Salmonella enterica enterica serovar Typhi
cgcugcggucaggaaug

SEQ ID NO: 3642810 - RNA, 16 nt, Salmonella enterica enterica serovar Typhi
cgcugcgucaggcgau

SEQ ID NO: 3642811 - RNA, 17 nt, Salmonella enterica enterica serovar Typhi
cgcugcgucaggcgaua

SEQ ID NO: 3642812 - RNA, 23 nt, Salmonella enterica enterica serovar Typhi
cgcugcucauuuaugcgcugggc

SEQ ID NO: 3642813 - RNA, 14 nt, Salmonella enterica enterica serovar Typhi
cgcugcuccggcuu

SEQ ID NO: 3642814 - RNA, 20 nt, Salmonella enterica enterica serovar Typhi
cgcugcugaccuuaauccag

SEQ ID NO: 3642815 - RNA, 14 nt, Salmonella enterica enterica serovar Typhi
cgcugcuucacgga

SEQ ID NO: 3642816 - RNA, 13 nt, Salmonella enterica enterica serovar Typhi
cgcuggaagagaa

SEQ ID NO: 3642817 - RNA, 23 nt, Salmonella enterica enterica serovar Typhi
cgcuggagccuguuccagcugcg

SEQ ID NO: 3642818 - RNA, 21 nt, Salmonella enterica enterica serovar Typhi
cgcuggcaauaaagcagggcg

SEQ ID NO: 3642819 - RNA, 15 nt, Salmonella enterica enterica serovar Typhi
cgcuggcacuggcag

SEQ ID NO: 3642820 - RNA, 20 nt, Salmonella enterica enterica serovar Typhi
cgcuggcgcaaagaaggcau

SEQ ID NO: 3642821 - RNA, 13 nt, Salmonella enterica enterica serovar Typhi
cgcuggcgccacc

SEQ ID NO: 3642822 - RNA, 17 nt, Salmonella enterica enterica serovar Typhi
cgcuggcgccaccgcug

SEQ ID NO: 3642823 - RNA, 13 nt, Salmonella enterica enterica serovar Typhi
cgcuggcgccgca

SEQ ID NO: 3642824 - RNA, 20 nt, Salmonella enterica enterica serovar Typhi
cgcuggcgcggggaacaccc

SEQ ID NO: 3642825 - RNA, 13 nt, Salmonella enterica enterica serovar Typhi
cgcuggcgcugca

SEQ ID NO: 3642826 - RNA, 23 nt, Salmonella enterica enterica serovar Typhi
cgcuggcggguagcgcauaacgc

SEQ ID NO: 3642827 - RNA, 11 nt, Salmonella enterica enterica serovar Typhi
cgcuggcguac

SEQ ID NO: 3642828 - RNA, 23 nt, Salmonella enterica enterica serovar Typhi
cgcuggcuaacgccuugaauacg

SEQ ID NO: 3642829 - RNA, 15 nt, Salmonella enterica enterica serovar Typhi
cgcugggcgauaaaa

SEQ ID NO: 3642830 - RNA, 22 nt, Salmonella enterica enterica serovar Typhi
cgcuggguaauagaugcgucgc

SEQ ID NO: 3642831 - RNA, 16 nt, Salmonella enterica enterica serovar Typhi
cgcuggguuuuuccgc

SEQ ID NO: 3642832 - RNA, 18 nt, Salmonella enterica enterica serovar Typhi
cgcuggguuuuuccgcuu

SEQ ID NO: 3642833 - RNA, 16 nt, Salmonella enterica enterica serovar Typhi
cgcugguaaauccggc

SEQ ID NO: 3642834 - RNA, 15 nt, Salmonella enterica enterica serovar Typhi
cgcuggucaacacgc

SEQ ID NO: 3642835 - RNA, 14 nt, Salmonella enterica enterica serovar Typhi
cgcuggucagcgcg

SEQ ID NO: 3642836 - RNA, 17 nt, Salmonella enterica enterica serovar Typhi
cgcuggucagcgcgcca

SEQ ID NO: 3642837 - RNA, 18 nt, Salmonella enterica enterica serovar Typhi
cgcuggucagcgcgccaa

SEQ ID NO: 3642838 - RNA, 16 nt, Salmonella enterica enterica serovar Typhi
cgcuggugccaaucuc

SEQ ID NO: 3642839 - RNA, 14 nt, Salmonella enterica enterica serovar Typhi
cgcugguuccccgu

SEQ ID NO: 3642840 - RNA, 15 nt, Salmonella enterica enterica serovar Typhi
cgcugguuggcgcgc

SEQ ID NO: 3642841 - RNA, 15 nt, Salmonella enterica enterica serovar Typhi
cgcuguaacccgccg

SEQ ID NO: 3642842 - RNA, 19 nt, Salmonella enterica enterica serovar Typhi
cgcuguaacccgccgccau

SEQ ID NO: 3642843 - RNA, 15 nt, Salmonella enterica enterica serovar Typhi
cgcuguaccggcagg

SEQ ID NO: 3642844 - RNA, 14 nt, Salmonella enterica enterica serovar Typhi
cgcuguagcgccaa

SEQ ID NO: 3642845 - RNA, 22 nt, Salmonella enterica enterica serovar Typhi
cgcugucaccagcagcauuuca

SEQ ID NO: 3642846 - RNA, 18 nt, Salmonella enterica enterica serovar Typhi
cgcuguccagauagggcc

SEQ ID NO: 3642847 - RNA, 23 nt, Salmonella enterica enterica serovar Typhi
cgcuguccagauagggccaggcg

SEQ ID NO: 3642848 - RNA, 17 nt, Salmonella enterica enterica serovar Typhi
cgcugucgccgcgcaca

SEQ ID NO: 3642849 - RNA, 15 nt, Salmonella enterica enterica serovar Typhi
cgcugucuauccacu

SEQ ID NO: 3642850 - RNA, 19 nt, Salmonella enterica enterica serovar Typhi
cgcugugauccauguugcc

SEQ ID NO: 3642851 - RNA, 17 nt, Salmonella enterica enterica serovar Typhi
cgcugugguuuauccgc

SEQ ID NO: 3642852 - RNA, 20 nt, Salmonella enterica enterica serovar Typhi
cgcuguuaugcacgcgcggc

SEQ ID NO: 3642853 - RNA, 15 nt, Salmonella enterica enterica serovar Typhi
cgcuguucgccggau

SEQ ID NO: 3642854 - RNA, 15 nt, Salmonella enterica enterica serovar Typhi
cgcuguucuugcugc

SEQ ID NO: 3642855 - RNA, 15 nt, Salmonella enterica enterica serovar Typhi
cgcuguuuauccaca

SEQ ID NO: 3642856 - RNA, 15 nt, Salmonella enterica enterica serovar Typhi
cgcuguuuuccgcuu

SEQ ID NO: 3642857 - RNA, 17 nt, Salmonella enterica enterica serovar Typhi
cgcuuaacuccggcgac

SEQ ID NO: 3642858 - RNA, 22 nt, Salmonella enterica enterica serovar Typhi
cgcuuaaucuugaguuuggccu

SEQ ID NO: 3642859 - RNA, 16 nt, Salmonella enterica enterica serovar Typhi
cgcuuacaauuuaucu

SEQ ID NO: 3642860 - RNA, 18 nt, Salmonella enterica enterica serovar Typhi
cgcuuacaauuuaucugc

SEQ ID NO: 3642861 - RNA, 16 nt, Salmonella enterica enterica serovar Typhi
cgcuuacacacccggc

SEQ ID NO: 3642862 - RNA, 22 nt, Salmonella enterica enterica serovar Typhi
cgcuuacacacccggccuauca

SEQ ID NO: 3642863 - RNA, 15 nt, Salmonella enterica enterica serovar Typhi
cgcuuacaucgccau

SEQ ID NO: 3642864 - RNA, 21 nt, Salmonella enterica enterica serovar Typhi
cgcuuaccacuuugcgcuccu

SEQ ID NO: 3642865 - RNA, 19 nt, Salmonella enterica enterica serovar Typhi
cgcuuaccaggccuacacg

SEQ ID NO: 3642866 - RNA, 13 nt, Salmonella enterica enterica serovar Typhi
cgcuuacccagca

SEQ ID NO: 3642867 - RNA, 18 nt, Salmonella enterica enterica serovar Typhi
cgcuuacgcggcgcgcuc

SEQ ID NO: 3642868 - RNA, 16 nt, Salmonella enterica enterica serovar Typhi
cgcuuacgcuccugcg

SEQ ID NO: 3642869 - RNA, 20 nt, Salmonella enterica enterica serovar Typhi
cgcuuacgcuuacccggccu

SEQ ID NO: 3642870 - RNA, 17 nt, Salmonella enterica enterica serovar Typhi
cgcuuacugugccgccg

SEQ ID NO: 3642871 - RNA, 12 nt, Salmonella enterica enterica serovar Typhi
cgcuuagcggcg

SEQ ID NO: 3642872 - RNA, 17 nt, Salmonella enterica enterica serovar Typhi
cgcuuagcuucccgcau

SEQ ID NO: 3642873 - RNA, 17 nt, Salmonella enterica enterica serovar Typhi
cgcuuaucaggccuaca

SEQ ID NO: 3642874 - RNA, 20 nt, Salmonella enterica enterica serovar Typhi
cgcuuaucaggccuacaacg

SEQ ID NO: 3642875 - RNA, 19 nt, Salmonella enterica enterica serovar Typhi
cgcuuaucaggccuacaag

SEQ ID NO: 3642876 - RNA, 17 nt, Salmonella enterica enterica serovar Typhi
cgcuuaucaggccuacc

SEQ ID NO: 3642877 - RNA, 12 nt, Salmonella enterica enterica serovar Typhi
cgcuuauccgcu

SEQ ID NO: 3642878 - RNA, 13 nt, Salmonella enterica enterica serovar Typhi
cgcuuauccggcc

SEQ ID NO: 3642879 - RNA, 18 nt, Salmonella enterica enterica serovar Typhi
cgcuuauccggccuacag

SEQ ID NO: 3642880 - RNA, 18 nt, Salmonella enterica enterica serovar Typhi
cgcuuauccggccuaccg

SEQ ID NO: 3642881 - RNA, 21 nt, Salmonella enterica enterica serovar Typhi
cgcuuauccggcuuauccggc

SEQ ID NO: 3642882 - RNA, 19 nt, Salmonella enterica enterica serovar Typhi
cgcuuauuccuccgccgau

SEQ ID NO: 3642883 - RNA, 22 nt, Salmonella enterica enterica serovar Typhi
cgcuucaccuuucgccgccaga

SEQ ID NO: 3642884 - RNA, 19 nt, Salmonella enterica enterica serovar Typhi
cgcuucacgcgcggcuacu

SEQ ID NO: 3642885 - RNA, 18 nt, Salmonella enterica enterica serovar Typhi
cgcuuccaguccagcgcg

SEQ ID NO: 3642886 - RNA, 18 nt, Salmonella enterica enterica serovar Typhi
cgcuuccugccaggccgg

SEQ ID NO: 3642887 - RNA, 23 nt, Salmonella enterica enterica serovar Typhi
cgcuucgcagcgauauuucuccg

SEQ ID NO: 3642888 - RNA, 14 nt, Salmonella enterica enterica serovar Typhi
cgcuucgcgcgcca

SEQ ID NO: 3642889 - RNA, 20 nt, Salmonella enterica enterica serovar Typhi
cgcuucgcuuaccaggccua

SEQ ID NO: 3642890 - RNA, 20 nt, Salmonella enterica enterica serovar Typhi
cgcuucgcuuaucaggccua

SEQ ID NO: 3642891 - RNA, 17 nt, Salmonella enterica enterica serovar Typhi
cgcuucgcuuauccggc

SEQ ID NO: 3642892 - RNA, 19 nt, Salmonella enterica enterica serovar Typhi
cgcuucgcuuauccggccu

SEQ ID NO: 3642893 - RNA, 20 nt, Salmonella enterica enterica serovar Typhi
cgcuucgcuuauccggccua

SEQ ID NO: 3642894 - RNA, 20 nt, Salmonella enterica enterica serovar Typhi
cgcuucgcuuaucuggccua

SEQ ID NO: 3642895 - RNA, 15 nt, Salmonella enterica enterica serovar Typhi
cgcuucguauuucuu

SEQ ID NO: 3642896 - RNA, 16 nt, Salmonella enterica enterica serovar Typhi
cgcuucuauuaccgca

SEQ ID NO: 3642897 - RNA, 18 nt, Salmonella enterica enterica serovar Typhi
cgcuucugauuauugaca

SEQ ID NO: 3642898 - RNA, 14 nt, Salmonella enterica enterica serovar Typhi
cgcuucugccgcca

SEQ ID NO: 3642899 - RNA, 12 nt, Salmonella enterica enterica serovar Typhi
cgcuucuggaau

SEQ ID NO: 3642900 - RNA, 17 nt, Salmonella enterica enterica serovar Typhi
cgcuucuucaugggcgu

SEQ ID NO: 3642901 - RNA, 13 nt, Salmonella enterica enterica serovar Typhi
cgcuucuucggca

SEQ ID NO: 3642902 - RNA, 17 nt, Salmonella enterica enterica serovar Typhi
cgcuucuucuaccaccu

SEQ ID NO: 3642903 - RNA, 17 nt, Salmonella enterica enterica serovar Typhi
cgcuugauccagcucgc

SEQ ID NO: 3642904 - RNA, 13 nt, Salmonella enterica enterica serovar Typhi
cgcuugcgccgcc

SEQ ID NO: 3642905 - RNA, 15 nt, Salmonella enterica enterica serovar Typhi
cgcuugcgccgccau

SEQ ID NO: 3642906 - RNA, 15 nt, Salmonella enterica enterica serovar Typhi
cgcuugcgcguucgg

SEQ ID NO: 3642907 - RNA, 23 nt, Salmonella enterica enterica serovar Typhi
cgcuuggugcguaccucauggua

SEQ ID NO: 3642908 - RNA, 14 nt, Salmonella enterica enterica serovar Typhi
cgcuuuaagcgcug

SEQ ID NO: 3642909 - RNA, 20 nt, Salmonella enterica enterica serovar Typhi
cgcuuuaagcgcugccgcaa

SEQ ID NO: 3642910 - RNA, 14 nt, Salmonella enterica enterica serovar Typhi
cgcuuuaauaccgg

SEQ ID NO: 3642911 - RNA, 20 nt, Salmonella enterica enterica serovar Typhi
cgcuuuaaucaguucauagc

SEQ ID NO: 3642912 - RNA, 17 nt, Salmonella enterica enterica serovar Typhi
cgcuuuaccgccuuccu

SEQ ID NO: 3642913 - RNA, 22 nt, Salmonella enterica enterica serovar Typhi
cgcuuuaugcgcuuccagcaug

SEQ ID NO: 3642914 - RNA, 16 nt, Salmonella enterica enterica serovar Typhi
cgcuuucaccgccuca

SEQ ID NO: 3642915 - RNA, 13 nt, Salmonella enterica enterica serovar Typhi
cgcuuucauacga

SEQ ID NO: 3642916 - RNA, 18 nt, Salmonella enterica enterica serovar Typhi
cgcuuuccaguugcggca

SEQ ID NO: 3642917 - RNA, 23 nt, Salmonella enterica enterica serovar Typhi
cgcuuuccggggugaauuuuuug

SEQ ID NO: 3642918 - RNA, 20 nt, Salmonella enterica enterica serovar Typhi
cgcuuucgccacgcucacuu

SEQ ID NO: 3642919 - RNA, 14 nt, Salmonella enterica enterica serovar Typhi
cgcuuucgcggccu

SEQ ID NO: 3642920 - RNA, 20 nt, Salmonella enterica enterica serovar Typhi
cgcuuucgucguccacucuu

SEQ ID NO: 3642921 - RNA, 17 nt, Salmonella enterica enterica serovar Typhi
cgcuuugagcugcugcu

SEQ ID NO: 3642922 - RNA, 16 nt, Salmonella enterica enterica serovar Typhi
cgcuuugccagcaucg

SEQ ID NO: 3642923 - RNA, 19 nt, Salmonella enterica enterica serovar Typhi
cgcuuugcggcuaucuucu

SEQ ID NO: 3642924 - RNA, 20 nt, Salmonella enterica enterica serovar Typhi
cgcuuugcuuauccggccua

SEQ ID NO: 3642925 - RNA, 17 nt, Salmonella enterica enterica serovar Typhi
cgcuuugucaccggagu

SEQ ID NO: 3642926 - RNA, 14 nt, Salmonella enterica enterica serovar Typhi
cgcuuuguuuucca

SEQ ID NO: 3642927 - RNA, 16 nt, Salmonella enterica enterica serovar Typhi
cgcuuuucagcgccag

SEQ ID NO: 3642928 - RNA, 13 nt, Salmonella enterica enterica serovar Typhi
cgcuuuuccccgc

SEQ ID NO: 3642929 - RNA, 20 nt, Salmonella enterica enterica serovar Typhi
cgcuuuucgguuacguucgg

SEQ ID NO: 3642930 - RNA, 13 nt, Salmonella enterica enterica serovar Typhi
cgcuuuucuggcu

SEQ ID NO: 3642931 - RNA, 20 nt, Salmonella enterica enterica serovar Typhi
cgcuuuugccgcgacuuccg

SEQ ID NO: 3642932 - RNA, 17 nt, Salmonella enterica enterica serovar Typhi
cgcuuuugguuuuucaa

SEQ ID NO: 3642933 - RNA, 23 nt, Salmonella enterica enterica serovar Typhi
cgcuuuuuccagcauuagcgcca

SEQ ID NO: 3642934 - RNA, 18 nt, Salmonella enterica enterica serovar Typhi
cgcuuuuugcgccagcgc

SEQ ID NO: 3642935 - RNA, 19 nt, Salmonella enterica enterica serovar Typhi
cgcuuuuuuauuguuucua

SEQ ID NO: 3642936 - RNA, 18 nt, Salmonella enterica enterica serovar Typhi
cgcuuuuuugcuggcugg

SEQ ID NO: 3642937 - RNA, 23 nt, Salmonella enterica enterica serovar Typhi
cggaaaaaugucgcuuaucgccu

SEQ ID NO: 3642938 - RNA, 14 nt, Salmonella enterica enterica serovar Typhi
cggaaaaucugcgc

SEQ ID NO: 3642939 - RNA, 20 nt, Salmonella enterica enterica serovar Typhi
cggaaaauggguaucgccuu

SEQ ID NO: 3642940 - RNA, 14 nt, Salmonella enterica enterica serovar Typhi
cggaaaccaguuca

SEQ ID NO: 3642941 - RNA, 16 nt, Salmonella enterica enterica serovar Typhi
cggaaaccccagguca

SEQ ID NO: 3642942 - RNA, 14 nt, Salmonella enterica enterica serovar Typhi
cggaaacgcuguuc

SEQ ID NO: 3642943 - RNA, 20 nt, Salmonella enterica enterica serovar Typhi
cggaaacgucauuuuuucaa

SEQ ID NO: 3642944 - RNA, 17 nt, Salmonella enterica enterica serovar Typhi
cggaaacuauccuggcc

SEQ ID NO: 3642945 - RNA, 20 nt, Salmonella enterica enterica serovar Typhi
cggaaagacggcagcgccau

SEQ ID NO: 3642946 - RNA, 16 nt, Salmonella enterica enterica serovar Typhi
cggaaagcuguuguug

SEQ ID NO: 3642947 - RNA, 19 nt, Salmonella enterica enterica serovar Typhi
cggaaaggauauaagcgcc

SEQ ID NO: 3642948 - RNA, 21 nt, Salmonella enterica enterica serovar Typhi
cggaaaggauauaagcgccau

SEQ ID NO: 3642949 - RNA, 16 nt, Salmonella enterica enterica serovar Typhi
cggaaauagcgccauc

SEQ ID NO: 3642950 - RNA, 20 nt, Salmonella enterica enterica serovar Typhi
cggaaaucaaaccaucccag

SEQ ID NO: 3642951 - RNA, 23 nt, Salmonella enterica enterica serovar Typhi
cggaaaucacaaacaccaccagu

SEQ ID NO: 3642952 - RNA, 15 nt, Salmonella enterica enterica serovar Typhi
cggaaaucgcggcga

SEQ ID NO: 3642953 - RNA, 12 nt, Salmonella enterica enterica serovar Typhi
cggaaauggucg

SEQ ID NO: 3642954 - RNA, 19 nt, Salmonella enterica enterica serovar Typhi
cggaaauuagcccgcuuca

SEQ ID NO: 3642955 - RNA, 14 nt, Salmonella enterica enterica serovar Typhi
cggaacaccagcgc

SEQ ID NO: 3642956 - RNA, 17 nt, Salmonella enterica enterica serovar Typhi
cggaacaccagcgccgc

SEQ ID NO: 3642957 - RNA, 16 nt, Salmonella enterica enterica serovar Typhi
cggaacaggcuuuuca

SEQ ID NO: 3642958 - RNA, 16 nt, Salmonella enterica enterica serovar Typhi
cggaacagggccgcau

SEQ ID NO: 3642959 - RNA, 19 nt, Salmonella enterica enterica serovar Typhi
cggaaccaaaauagauaau

SEQ ID NO: 3642960 - RNA, 17 nt, Salmonella enterica enterica serovar Typhi
cggaaccaaaugcccag

SEQ ID NO: 3642961 - RNA, 14 nt, Salmonella enterica enterica serovar Typhi
cggaacccagcaaa

SEQ ID NO: 3642962 - RNA, 16 nt, Salmonella enterica enterica serovar Typhi
cggaacccagcaaauc

SEQ ID NO: 3642963 - RNA, 20 nt, Salmonella enterica enterica serovar Typhi
cggaaccgcguuugcgucgu

SEQ ID NO: 3642964 - RNA, 16 nt, Salmonella enterica enterica serovar Typhi
cggaacuggugaaaca

SEQ ID NO: 3642965 - RNA, 18 nt, Salmonella enterica enterica serovar Typhi
cggaagacuggcgcagca

SEQ ID NO: 3642966 - RNA, 19 nt, Salmonella enterica enterica serovar Typhi
cggaagacuggcgcagcaa

SEQ ID NO: 3642967 - RNA, 21 nt, Salmonella enterica enterica serovar Typhi
cggaagacuggcgcagcaaac

SEQ ID NO: 3642968 - RNA, 18 nt, Salmonella enterica enterica serovar Typhi
cggaagcagauaccagcc

SEQ ID NO: 3642969 - RNA, 21 nt, Salmonella enterica enterica serovar Typhi
cggaagcgaauggcggcacua

SEQ ID NO: 3642970 - RNA, 15 nt, Salmonella enterica enterica serovar Typhi
cggaagcgaccggcg

SEQ ID NO: 3642971 - RNA, 22 nt, Salmonella enterica enterica serovar Typhi
cggaagcgauugucggcgccgg

SEQ ID NO: 3642972 - RNA, 15 nt, Salmonella enterica enterica serovar Typhi
cggaagcugaccagg

SEQ ID NO: 3642973 - RNA, 21 nt, Salmonella enterica enterica serovar Typhi
cggaagcugaccagggcaaau

SEQ ID NO: 3642974 - RNA, 21 nt, Salmonella enterica enterica serovar Typhi
cggaagcuuuuaguuacgcac

SEQ ID NO: 3642975 - RNA, 22 nt, Salmonella enterica enterica serovar Typhi
cggaaggcuaccgcugggauga

SEQ ID NO: 3642976 - RNA, 16 nt, Salmonella enterica enterica serovar Typhi
cggaaguauacaucca

SEQ ID NO: 3642977 - RNA, 16 nt, Salmonella enterica enterica serovar Typhi
cggaagugcucuccac

SEQ ID NO: 3642978 - RNA, 23 nt, Salmonella enterica enterica serovar Typhi
cggaauaacuccagugcagaaag

SEQ ID NO: 3642979 - RNA, 15 nt, Salmonella enterica enterica serovar Typhi
cggaauaccgucaaa

SEQ ID NO: 3642980 - RNA, 21 nt, Salmonella enterica enterica serovar Typhi
cggaauaccgucaaaacgcgc

SEQ ID NO: 3642981 - RNA, 19 nt, Salmonella enterica enterica serovar Typhi
cggaauaugcgcuuuuuuc

SEQ ID NO: 3642982 - RNA, 22 nt, Salmonella enterica enterica serovar Typhi
cggaauccaucccccugccguu

SEQ ID NO: 3642983 - RNA, 20 nt, Salmonella enterica enterica serovar Typhi
cggaauccccgccgccagua

SEQ ID NO: 3642984 - RNA, 18 nt, Salmonella enterica enterica serovar Typhi
cggaaucggacacuugca

SEQ ID NO: 3642985 - RNA, 15 nt, Salmonella enterica enterica serovar Typhi
cggaaugaugugcua

SEQ ID NO: 3642986 - RNA, 17 nt, Salmonella enterica enterica serovar Typhi
cggaaugaugugcuauu

SEQ ID NO: 3642987 - RNA, 23 nt, Salmonella enterica enterica serovar Typhi
cggaauggauaacgaaaaggguc

SEQ ID NO: 3642988 - RNA, 15 nt, Salmonella enterica enterica serovar Typhi
cggaauggcgacgac

SEQ ID NO: 3642989 - RNA, 23 nt, Salmonella enterica enterica serovar Typhi
cggaauucuguucaguggcguag

SEQ ID NO: 3642990 - RNA, 15 nt, Salmonella enterica enterica serovar Typhi
cggacaaggcgcgcc

SEQ ID NO: 3642991 - RNA, 15 nt, Salmonella enterica enterica serovar Typhi
cggacacccgcagcc

SEQ ID NO: 3642992 - RNA, 16 nt, Salmonella enterica enterica serovar Typhi
cggacacgcucauaaa

SEQ ID NO: 3642993 - RNA, 12 nt, Salmonella enterica enterica serovar Typhi
cggacacuaauu

SEQ ID NO: 3642994 - RNA, 23 nt, Salmonella enterica enterica serovar Typhi
cggacagcagcauauaaauuccg

SEQ ID NO: 3642995 - RNA, 12 nt, Salmonella enterica enterica serovar Typhi
cggacaucccaa

SEQ ID NO: 3642996 - RNA, 14 nt, Salmonella enterica enterica serovar Typhi
cggaccccucuucu

SEQ ID NO: 3642997 - RNA, 15 nt, Salmonella enterica enterica serovar Typhi
cggaccccucuucuu

SEQ ID NO: 3642998 - RNA, 19 nt, Salmonella enterica enterica serovar Typhi
cggaccgauaacaggaacg

SEQ ID NO: 3642999 - RNA, 12 nt, Salmonella enterica enterica serovar Typhi
cggaccggcgac

SEQ ID NO: 3643000 - RNA, 20 nt, Salmonella enterica enterica serovar Typhi
cggaccuaauagccagcccc

SEQ ID NO: 3643001 - RNA, 12 nt, Salmonella enterica enterica serovar Typhi
cggaccuccgcg

SEQ ID NO: 3643002 - RNA, 19 nt, Salmonella enterica enterica serovar Typhi
cggacgaacaacaucagac

SEQ ID NO: 3643003 - RNA, 20 nt, Salmonella enterica enterica serovar Typhi
cggacgaaccuggcgguaaa

SEQ ID NO: 3643004 - RNA, 20 nt, Salmonella enterica enterica serovar Typhi
cggacgagcgcgucagcgcc

SEQ ID NO: 3643005 - RNA, 17 nt, Salmonella enterica enterica serovar Typhi
cggacgcaccagccagg

SEQ ID NO: 3643006 - RNA, 16 nt, Salmonella enterica enterica serovar Typhi
cggacgccagugcgca

SEQ ID NO: 3643007 - RNA, 16 nt, Salmonella enterica enterica serovar Typhi
cggacgccgaugguaa

SEQ ID NO: 3643008 - RNA, 20 nt, Salmonella enterica enterica serovar Typhi
cggacgccgggugaucgucg

SEQ ID NO: 3643009 - RNA, 14 nt, Salmonella enterica enterica serovar Typhi
cggacguugcuccg

SEQ ID NO: 3643010 - RNA, 12 nt, Salmonella enterica enterica serovar Typhi
cggacucagggu

SEQ ID NO: 3643011 - RNA, 12 nt, Salmonella enterica enterica serovar Typhi
cggacuccagca

SEQ ID NO: 3643012 - RNA, 21 nt, Salmonella enterica enterica serovar Typhi
cggacugauagcgaggcagca

SEQ ID NO: 3643013 - RNA, 21 nt, Salmonella enterica enterica serovar Typhi
cggacugcggccugcaaagac

SEQ ID NO: 3643014 - RNA, 22 nt, Salmonella enterica enterica serovar Typhi
cggagaacgguucauccagcag

SEQ ID NO: 3643015 - RNA, 17 nt, Salmonella enterica enterica serovar Typhi
cggagagagcaacuggc

SEQ ID NO: 3643016 - RNA, 18 nt, Salmonella enterica enterica serovar Typhi
cggagagcggauaauccg

SEQ ID NO: 3643017 - RNA, 15 nt, Salmonella enterica enterica serovar Typhi
cggagauacuuucuu

SEQ ID NO: 3643018 - RNA, 17 nt, Salmonella enterica enterica serovar Typhi
cggagauuaacagcgcg

SEQ ID NO: 3643019 - RNA, 21 nt, Salmonella enterica enterica serovar Typhi
cggagauuaacagcgcgacca

SEQ ID NO: 3643020 - RNA, 23 nt, Salmonella enterica enterica serovar Typhi
cggagauuaacagcgcgaccagc

SEQ ID NO: 3643021 - RNA, 18 nt, Salmonella enterica enterica serovar Typhi
cggagauuucauccucuu

SEQ ID NO: 3643022 - RNA, 14 nt, Salmonella enterica enterica serovar Typhi
cggagcaaaaaaug

SEQ ID NO: 3643023 - RNA, 23 nt, Salmonella enterica enterica serovar Typhi
cggagcgcuuuuuuuaugcguua

SEQ ID NO: 3643024 - RNA, 18 nt, Salmonella enterica enterica serovar Typhi
cggagcggcguccgccag

SEQ ID NO: 3643025 - RNA, 15 nt, Salmonella enterica enterica serovar Typhi
cggagcuaauaugaa

SEQ ID NO: 3643026 - RNA, 14 nt, Salmonella enterica enterica serovar Typhi
cggaggcacugccu

SEQ ID NO: 3643027 - RNA, 20 nt, Salmonella enterica enterica serovar Typhi
cggagguuuucucauccagc

SEQ ID NO: 3643028 - RNA, 18 nt, Salmonella enterica enterica serovar Typhi
cggaguagacccacauau

SEQ ID NO: 3643029 - RNA, 15 nt, Salmonella enterica enterica serovar Typhi
cggagugcgcggcga

SEQ ID NO: 3643030 - RNA, 23 nt, Salmonella enterica enterica serovar Typhi
cggagugcgcggcgaaaaagccg

SEQ ID NO: 3643031 - RNA, 23 nt, Salmonella enterica enterica serovar Typhi
cggauaaacgcgucuucaucagc

SEQ ID NO: 3643032 - RNA, 17 nt, Salmonella enterica enterica serovar Typhi
cggauaaacgcugcgca

SEQ ID NO: 3643033 - RNA, 20 nt, Salmonella enterica enterica serovar Typhi
cggauaaacgcugcgcaaca

SEQ ID NO: 3643034 - RNA, 19 nt, Salmonella enterica enterica serovar Typhi
cggauaaauagugacgccg

SEQ ID NO: 3643035 - RNA, 22 nt, Salmonella enterica enterica serovar Typhi
cggauaaauagugacgccgcca

SEQ ID NO: 3643036 - RNA, 13 nt, Salmonella enterica enterica serovar Typhi
cggauaaccgacg

SEQ ID NO: 3643037 - RNA, 20 nt, Salmonella enterica enterica serovar Typhi
cggauaacgacgacgcagcu

SEQ ID NO: 3643038 - RNA, 14 nt, Salmonella enterica enterica serovar Typhi
cggauaacgcgcug

SEQ ID NO: 3643039 - RNA, 16 nt, Salmonella enterica enterica serovar Typhi
cggauaagcaacgcgc

SEQ ID NO: 3643040 - RNA, 18 nt, Salmonella enterica enterica serovar Typhi
cggauaagcgcagcgcca

SEQ ID NO: 3643041 - RNA, 19 nt, Salmonella enterica enterica serovar Typhi
cggauaagcgcagcgccau

SEQ ID NO: 3643042 - RNA, 16 nt, Salmonella enterica enterica serovar Typhi
cggauaagcggcagcg

SEQ ID NO: 3643043 - RNA, 20 nt, Salmonella enterica enterica serovar Typhi
cggauaagcggcagcgccau

SEQ ID NO: 3643044 - RNA, 18 nt, Salmonella enterica enterica serovar Typhi
cggauaagcguagcgcca

SEQ ID NO: 3643045 - RNA, 19 nt, Salmonella enterica enterica serovar Typhi
cggauaagcgugagcgcau

SEQ ID NO: 3643046 - RNA, 14 nt, Salmonella enterica enterica serovar Typhi
cggauaaggcgcuu

SEQ ID NO: 3643047 - RNA, 20 nt, Salmonella enterica enterica serovar Typhi
cggauaaggcggagccgcca

SEQ ID NO: 3643048 - RNA, 23 nt, Salmonella enterica enterica serovar Typhi
cggauaagguguuuacgccgcca

SEQ ID NO: 3643049 - RNA, 14 nt, Salmonella enterica enterica serovar Typhi
cggauaaguaaguu

SEQ ID NO: 3643050 - RNA, 21 nt, Salmonella enterica enterica serovar Typhi
cggauacaagguauccgccau

SEQ ID NO: 3643051 - RNA, 19 nt, Salmonella enterica enterica serovar Typhi
cggauaccggcgcagcauc

SEQ ID NO: 3643052 - RNA, 22 nt, Salmonella enterica enterica serovar Typhi
cggauaccggcgcagcaucugc

SEQ ID NO: 3643053 - RNA, 18 nt, Salmonella enterica enterica serovar Typhi
cggauacggcugucagga

SEQ ID NO: 3643054 - RNA, 16 nt, Salmonella enterica enterica serovar Typhi
cggauagcguagcgcc

SEQ ID NO: 3643055 - RNA, 14 nt, Salmonella enterica enterica serovar Typhi
cggauagcucgcug

SEQ ID NO: 3643056 - RNA, 21 nt, Salmonella enterica enterica serovar Typhi
cggauagcucgcuguagcgcc

SEQ ID NO: 3643057 - RNA, 14 nt, Salmonella enterica enterica serovar Typhi
cggauaucagacag

SEQ ID NO: 3643058 - RNA, 19 nt, Salmonella enterica enterica serovar Typhi
cggaucaaaaaggugagca

SEQ ID NO: 3643059 - RNA, 21 nt, Salmonella enterica enterica serovar Typhi
cggaucacggccuucgcagau

SEQ ID NO: 3643060 - RNA, 21 nt, Salmonella enterica enterica serovar Typhi
cggaucaggcguuagccgcca

SEQ ID NO: 3643061 - RNA, 14 nt, Salmonella enterica enterica serovar Typhi
cggaucaggcguug

SEQ ID NO: 3643062 - RNA, 13 nt, Salmonella enterica enterica serovar Typhi
cggauccagaacu

SEQ ID NO: 3643063 - RNA, 16 nt, Salmonella enterica enterica serovar Typhi
cggaucgacagcaaug

SEQ ID NO: 3643064 - RNA, 15 nt, Salmonella enterica enterica serovar Typhi
cggaucgaucccggc

SEQ ID NO: 3643065 - RNA, 19 nt, Salmonella enterica enterica serovar Typhi
cggaucgaucucgauauuc

SEQ ID NO: 3643066 - RNA, 19 nt, Salmonella enterica enterica serovar Typhi
cggaucgccgauaaagugg

SEQ ID NO: 3643067 - RNA, 23 nt, Salmonella enterica enterica serovar Typhi
cggaucgcggcccucuaagcgcu

SEQ ID NO: 3643068 - RNA, 15 nt, Salmonella enterica enterica serovar Typhi
cggaucggaacgcga

SEQ ID NO: 3643069 - RNA, 17 nt, Salmonella enterica enterica serovar Typhi
cggaucggucuggcgca

SEQ ID NO: 3643070 - RNA, 16 nt, Salmonella enterica enterica serovar Typhi
cggaugaaacaguccg

SEQ ID NO: 3643071 - RNA, 21 nt, Salmonella enterica enterica serovar Typhi
cggaugaaacaguccggcgaa

SEQ ID NO: 3643072 - RNA, 13 nt, Salmonella enterica enterica serovar Typhi
cggaugaccagaa

SEQ ID NO: 3643073 - RNA, 15 nt, Salmonella enterica enterica serovar Typhi
cggaugacgccgcuu

SEQ ID NO: 3643074 - RNA, 15 nt, Salmonella enterica enterica serovar Typhi
cggaugaucuucaua

SEQ ID NO: 3643075 - RNA, 17 nt, Salmonella enterica enterica serovar Typhi
cggaugaucuucauaaa

SEQ ID NO: 3643076 - RNA, 20 nt, Salmonella enterica enterica serovar Typhi
cggaugcagucugguaacgc

SEQ ID NO: 3643077 - RNA, 11 nt, Salmonella enterica enterica serovar Typhi
cggaugccagu

SEQ ID NO: 3643078 - RNA, 17 nt, Salmonella enterica enterica serovar Typhi
cggaugcgccaucccau

SEQ ID NO: 3643079 - RNA, 16 nt, Salmonella enterica enterica serovar Typhi
cggauggaauuuugca

SEQ ID NO: 3643080 - RNA, 14 nt, Salmonella enterica enterica serovar Typhi
cggauggcgcggca

SEQ ID NO: 3643081 - RNA, 14 nt, Salmonella enterica enterica serovar Typhi
cggauggcggcgca

SEQ ID NO: 3643082 - RNA, 12 nt, Salmonella enterica enterica serovar Typhi
cggaugggcaga

SEQ ID NO: 3643083 - RNA, 13 nt, Salmonella enterica enterica serovar Typhi
cggaugugcauug

SEQ ID NO: 3643084 - RNA, 16 nt, Salmonella enterica enterica serovar Typhi
cggauuaaagacgccg

SEQ ID NO: 3643085 - RNA, 20 nt, Salmonella enterica enterica serovar Typhi
cggauuaagcgaauccagcg

SEQ ID NO: 3643086 - RNA, 18 nt, Salmonella enterica enterica serovar Typhi
cggauuagcgacagcgcu

SEQ ID NO: 3643087 - RNA, 19 nt, Salmonella enterica enterica serovar Typhi
cggauuaucguccggcauc

SEQ ID NO: 3643088 - RNA, 16 nt, Salmonella enterica enterica serovar Typhi
cggauuauuggucagu

SEQ ID NO: 3643089 - RNA, 22 nt, Salmonella enterica enterica serovar Typhi
cggauucucuaacgucagcgcc

SEQ ID NO: 3643090 - RNA, 14 nt, Salmonella enterica enterica serovar Typhi
cggauucuuccucu

SEQ ID NO: 3643091 - RNA, 20 nt, Salmonella enterica enterica serovar Typhi
cggauucuucgaugaugccg

SEQ ID NO: 3643092 - RNA, 18 nt, Salmonella enterica enterica serovar Typhi
cggauugccgcgcucaau

SEQ ID NO: 3643093 - RNA, 22 nt, Salmonella enterica enterica serovar Typhi
cggauugccgcgcucaaucuga

SEQ ID NO: 3643094 - RNA, 17 nt, Salmonella enterica enterica serovar Typhi
cggauuggucugauuca

SEQ ID NO: 3643095 - RNA, 17 nt, Salmonella enterica enterica serovar Typhi
cggauugugaaauucga

SEQ ID NO: 3643096 - RNA, 21 nt, Salmonella enterica enterica serovar Typhi
cggauuguuguucauggucag

SEQ ID NO: 3643097 - RNA, 19 nt, Salmonella enterica enterica serovar Typhi
cggauuuaccagcgcuucu

SEQ ID NO: 3643098 - RNA, 18 nt, Salmonella enterica enterica serovar Typhi
cggauuuagcggcagcca

SEQ ID NO: 3643099 - RNA, 14 nt, Salmonella enterica enterica serovar Typhi
cggcaaaaacguug

SEQ ID NO: 3643100 - RNA, 18 nt, Salmonella enterica enterica serovar Typhi
cggcaaaacgccgcagaa

SEQ ID NO: 3643101 - RNA, 23 nt, Salmonella enterica enterica serovar Typhi
cggcaaaauuaccaggcgguaug

SEQ ID NO: 3643102 - RNA, 24 nt, Salmonella enterica enterica serovar Typhi
cggcaaaccaugaucgucaggcgc

SEQ ID NO: 3643103 - RNA, 18 nt, Salmonella enterica enterica serovar Typhi
cggcaaaccuaccggcau

SEQ ID NO: 3643104 - RNA, 19 nt, Salmonella enterica enterica serovar Typhi
cggcaaaccuaccggcaua

SEQ ID NO: 3643105 - RNA, 13 nt, Salmonella enterica enterica serovar Typhi
cggcaaacgcugg

SEQ ID NO: 3643106 - RNA, 15 nt, Salmonella enterica enterica serovar Typhi
cggcaaacgcuggug

SEQ ID NO: 3643107 - RNA, 21 nt, Salmonella enterica enterica serovar Typhi
cggcaaacgggcgaccgucgg

SEQ ID NO: 3643108 - RNA, 23 nt, Salmonella enterica enterica serovar Typhi
cggcaaacggggggauucauuau

SEQ ID NO: 3643109 - RNA, 13 nt, Salmonella enterica enterica serovar Typhi
cggcaaacucagc

SEQ ID NO: 3643110 - RNA, 13 nt, Salmonella enterica enterica serovar Typhi
cggcaaagaaaaa

SEQ ID NO: 3643111 - RNA, 19 nt, Salmonella enterica enterica serovar Typhi
cggcaaagauaaucugaau

SEQ ID NO: 3643112 - RNA, 20 nt, Salmonella enterica enterica serovar Typhi
cggcaaagguugccgcaaua

SEQ ID NO: 3643113 - RNA, 16 nt, Salmonella enterica enterica serovar Typhi
cggcaaaguuccaggu

SEQ ID NO: 3643114 - RNA, 18 nt, Salmonella enterica enterica serovar Typhi
cggcaaauacaucgccac

SEQ ID NO: 3643115 - RNA, 14 nt, Salmonella enterica enterica serovar Typhi
cggcaaauucuuuu

SEQ ID NO: 3643116 - RNA, 20 nt, Salmonella enterica enterica serovar Typhi
cggcaaauucuuuucacgca

SEQ ID NO: 3643117 - RNA, 14 nt, Salmonella enterica enterica serovar Typhi
cggcaacaguaccu

SEQ ID NO: 3643118 - RNA, 16 nt, Salmonella enterica enterica serovar Typhi
cggcaaccaaagucca

SEQ ID NO: 3643119 - RNA, 13 nt, Salmonella enterica enterica serovar Typhi
cggcaacucgccg

SEQ ID NO: 3643120 - RNA, 22 nt, Salmonella enterica enterica serovar Typhi
cggcaagagauucaggccgcca

SEQ ID NO: 3643121 - RNA, 15 nt, Salmonella enterica enterica serovar Typhi
cggcaagaucauccg

SEQ ID NO: 3643122 - RNA, 17 nt, Salmonella enterica enterica serovar Typhi
cggcaagcgcugggcga

SEQ ID NO: 3643123 - RNA, 18 nt, Salmonella enterica enterica serovar Typhi
cggcaagcgggcguugcu

SEQ ID NO: 3643124 - RNA, 17 nt, Salmonella enterica enterica serovar Typhi
cggcaaggaaaaccagu

SEQ ID NO: 3643125 - RNA, 17 nt, Salmonella enterica enterica serovar Typhi
cggcaaggucugcgccc

SEQ ID NO: 3643126 - RNA, 15 nt, Salmonella enterica enterica serovar Typhi
cggcaauaaacuccc

SEQ ID NO: 3643127 - RNA, 23 nt, Salmonella enterica enterica serovar Typhi
cggcaauaaacucccgcauauau

SEQ ID NO: 3643128 - RNA, 19 nt, Salmonella enterica enterica serovar Typhi
cggcaauaugcuguuuaug

SEQ ID NO: 3643129 - RNA, 16 nt, Salmonella enterica enterica serovar Typhi
cggcaauauugccgca

SEQ ID NO: 3643130 - RNA, 13 nt, Salmonella enterica enterica serovar Typhi
cggcaaucaauac

SEQ ID NO: 3643131 - RNA, 15 nt, Salmonella enterica enterica serovar Typhi
cggcaaucaauacag

SEQ ID NO: 3643132 - RNA, 13 nt, Salmonella enterica enterica serovar Typhi
cggcaaucucacu

SEQ ID NO: 3643133 - RNA, 18 nt, Salmonella enterica enterica serovar Typhi
cggcaaugcggguuucgu

SEQ ID NO: 3643134 - RNA, 21 nt, Salmonella enterica enterica serovar Typhi
cggcaauggccgcagcgccau

SEQ ID NO: 3643135 - RNA, 20 nt, Salmonella enterica enterica serovar Typhi
cggcaauuaccgccagcggc

SEQ ID NO: 3643136 - RNA, 17 nt, Salmonella enterica enterica serovar Typhi
cggcaauuuacaaccgu

SEQ ID NO: 3643137 - RNA, 19 nt, Salmonella enterica enterica serovar Typhi
cggcacauauuccggcgcu

SEQ ID NO: 3643138 - RNA, 22 nt, Salmonella enterica enterica serovar Typhi
cggcacauauuccggcgcuggc

SEQ ID NO: 3643139 - RNA, 17 nt, Salmonella enterica enterica serovar Typhi
cggcacauccagcgccu

SEQ ID NO: 3643140 - RNA, 17 nt, Salmonella enterica enterica serovar Typhi
cggcacauucaccacgc

SEQ ID NO: 3643141 - RNA, 11 nt, Salmonella enterica enterica serovar Typhi
cggcaccagca

SEQ ID NO: 3643142 - RNA, 14 nt, Salmonella enterica enterica serovar Typhi
cggcaccagcaaug

SEQ ID NO: 3643143 - RNA, 20 nt, Salmonella enterica enterica serovar Typhi
cggcaccauguggcgcggcc

SEQ ID NO: 3643144 - RNA, 19 nt, Salmonella enterica enterica serovar Typhi
cggcaccauuggcgcguca

SEQ ID NO: 3643145 - RNA, 12 nt, Salmonella enterica enterica serovar Typhi
cggcacgccgaa

SEQ ID NO: 3643146 - RNA, 17 nt, Salmonella enterica enterica serovar Typhi
cggcacgguaaaccucu

SEQ ID NO: 3643147 - RNA, 16 nt, Salmonella enterica enterica serovar Typhi
cggcacguuuuccagg

SEQ ID NO: 3643148 - RNA, 17 nt, Salmonella enterica enterica serovar Typhi
cggcacguuuuccaggu

SEQ ID NO: 3643149 - RNA, 20 nt, Salmonella enterica enterica serovar Typhi
cggcacguuuuccagguugu

SEQ ID NO: 3643150 - RNA, 14 nt, Salmonella enterica enterica serovar Typhi
cggcacuaaagcgu

SEQ ID NO: 3643151 - RNA, 12 nt, Salmonella enterica enterica serovar Typhi
cggcacuacagc

SEQ ID NO: 3643152 - RNA, 16 nt, Salmonella enterica enterica serovar Typhi
cggcacucaccucuuc

SEQ ID NO: 3643153 - RNA, 23 nt, Salmonella enterica enterica serovar Typhi
cggcacugacucuuccgggcgcg

SEQ ID NO: 3643154 - RNA, 18 nt, Salmonella enterica enterica serovar Typhi
cggcacugcuuccugccg

SEQ ID NO: 3643155 - RNA, 21 nt, Salmonella enterica enterica serovar Typhi
cggcagaauuaacucaucaca

SEQ ID NO: 3643156 - RNA, 14 nt, Salmonella enterica enterica serovar Typhi
cggcagacggcugg

SEQ ID NO: 3643157 - RNA, 14 nt, Salmonella enterica enterica serovar Typhi
cggcagcacccggc

SEQ ID NO: 3643158 - RNA, 16 nt, Salmonella enterica enterica serovar Typhi
cggcagccaauuuagg

SEQ ID NO: 3643159 - RNA, 14 nt, Salmonella enterica enterica serovar Typhi
cggcagccagcgua

SEQ ID NO: 3643160 - RNA, 15 nt, Salmonella enterica enterica serovar Typhi
cggcagccagcguau

SEQ ID NO: 3643161 - RNA, 17 nt, Salmonella enterica enterica serovar Typhi
cggcagccgacagcgua

SEQ ID NO: 3643162 - RNA, 13 nt, Salmonella enterica enterica serovar Typhi
cggcagccgccac

SEQ ID NO: 3643163 - RNA, 20 nt, Salmonella enterica enterica serovar Typhi
cggcagccgccaccacaaag

SEQ ID NO: 3643164 - RNA, 21 nt, Salmonella enterica enterica serovar Typhi
cggcagccugccgcaucugac

SEQ ID NO: 3643165 - RNA, 23 nt, Salmonella enterica enterica serovar Typhi
cggcagcgcauaagccacuucaa

SEQ ID NO: 3643166 - RNA, 12 nt, Salmonella enterica enterica serovar Typhi
cggcagcgccag

SEQ ID NO: 3643167 - RNA, 13 nt, Salmonella enterica enterica serovar Typhi
cggcagcgcgcac

SEQ ID NO: 3643168 - RNA, 13 nt, Salmonella enterica enterica serovar Typhi
cggcagcgcgccg

SEQ ID NO: 3643169 - RNA, 17 nt, Salmonella enterica enterica serovar Typhi
cggcagcgcgccgcccu

SEQ ID NO: 3643170 - RNA, 16 nt, Salmonella enterica enterica serovar Typhi
cggcagcguccgccau

SEQ ID NO: 3643171 - RNA, 23 nt, Salmonella enterica enterica serovar Typhi
cggcagcucugccuguagcagcg

SEQ ID NO: 3643172 - RNA, 16 nt, Salmonella enterica enterica serovar Typhi
cggcagcucuuccaga

SEQ ID NO: 3643173 - RNA, 12 nt, Salmonella enterica enterica serovar Typhi
cggcagcuucca

SEQ ID NO: 3643174 - RNA, 18 nt, Salmonella enterica enterica serovar Typhi
cggcagcuuccagcaaac

SEQ ID NO: 3643175 - RNA, 15 nt, Salmonella enterica enterica serovar Typhi
cggcaggcagcgcca

SEQ ID NO: 3643176 - RNA, 16 nt, Salmonella enterica enterica serovar Typhi
cggcaggcagcgccag

SEQ ID NO: 3643177 - RNA, 17 nt, Salmonella enterica enterica serovar Typhi
cggcaggcagcgccagc

SEQ ID NO: 3643178 - RNA, 20 nt, Salmonella enterica enterica serovar Typhi
cggcaggccggagcugauac

SEQ ID NO: 3643179 - RNA, 19 nt, Salmonella enterica enterica serovar Typhi
cggcaggccuuucggcagc

SEQ ID NO: 3643180 - RNA, 17 nt, Salmonella enterica enterica serovar Typhi
cggcaggcuggcgguaa

SEQ ID NO: 3643181 - RNA, 23 nt, Salmonella enterica enterica serovar Typhi
cggcagguagucauauucacggc

SEQ ID NO: 3643182 - RNA, 20 nt, Salmonella enterica enterica serovar Typhi
cggcaguccuugcagccaga

SEQ ID NO: 3643183 - RNA, 20 nt, Salmonella enterica enterica serovar Typhi
cggcaguguuucccaacaau

SEQ ID NO: 3643184 - RNA, 23 nt, Salmonella enterica enterica serovar Typhi
cggcaguucaggcucgcaaauaa

SEQ ID NO: 3643185 - RNA, 19 nt, Salmonella enterica enterica serovar Typhi
cggcauaagccaguccugc

SEQ ID NO: 3643186 - RNA, 22 nt, Salmonella enterica enterica serovar Typhi
cggcauaagccaguccugccac

SEQ ID NO: 3643187 - RNA, 16 nt, Salmonella enterica enterica serovar Typhi
cggcauacugucgcgc

SEQ ID NO: 3643188 - RNA, 11 nt, Salmonella enterica enterica serovar Typhi
cggcauagcug

SEQ ID NO: 3643189 - RNA, 17 nt, Salmonella enterica enterica serovar Typhi
cggcauaugcaggucgc

SEQ ID NO: 3643190 - RNA, 22 nt, Salmonella enterica enterica serovar Typhi
cggcaucaagcauaaaccggcg

SEQ ID NO: 3643191 - RNA, 22 nt, Salmonella enterica enterica serovar Typhi
cggcaucacaggcuuauaccga

SEQ ID NO: 3643192 - RNA, 14 nt, Salmonella enterica enterica serovar Typhi
cggcaucagauggc

SEQ ID NO: 3643193 - RNA, 22 nt, Salmonella enterica enterica serovar Typhi
cggcaucaucuaccuucacgca

SEQ ID NO: 3643194 - RNA, 15 nt, Salmonella enterica enterica serovar Typhi
cggcauccagcgcuc

SEQ ID NO: 3643195 - RNA, 17 nt, Salmonella enterica enterica serovar Typhi
cggcaucccaggcgucc

SEQ ID NO: 3643196 - RNA, 14 nt, Salmonella enterica enterica serovar Typhi
cggcaucgccgccc

SEQ ID NO: 3643197 - RNA, 17 nt, Salmonella enterica enterica serovar Typhi
cggcaucggcagcguca

SEQ ID NO: 3643198 - RNA, 20 nt, Salmonella enterica enterica serovar Typhi
cggcaucgggaacggcauac

SEQ ID NO: 3643199 - RNA, 16 nt, Salmonella enterica enterica serovar Typhi
cggcaucucgccauaa

SEQ ID NO: 3643200 - RNA, 20 nt, Salmonella enterica enterica serovar Typhi
cggcaucuuuaaccgccugc

SEQ ID NO: 3643201 - RNA, 22 nt, Salmonella enterica enterica serovar Typhi
cggcaucuuuaaccgccugcuc

SEQ ID NO: 3643202 - RNA, 19 nt, Salmonella enterica enterica serovar Typhi
cggcaugaauugccguggu

SEQ ID NO: 3643203 - RNA, 18 nt, Salmonella enterica enterica serovar Typhi
cggcauguccggcgacuc

SEQ ID NO: 3643204 - RNA, 23 nt, Salmonella enterica enterica serovar Typhi
cggcauguccggcgacuccagaa

SEQ ID NO: 3643205 - RNA, 19 nt, Salmonella enterica enterica serovar Typhi
cggcauuaugcaggcgucg

SEQ ID NO: 3643206 - RNA, 23 nt, Salmonella enterica enterica serovar Typhi
cggcauuaugcaggcgucgggca

SEQ ID NO: 3643207 - RNA, 19 nt, Salmonella enterica enterica serovar Typhi
cggcauuggcguuaccggc

SEQ ID NO: 3643208 - RNA, 21 nt, Salmonella enterica enterica serovar Typhi
cggcauuucaccgucaauaac

SEQ ID NO: 3643209 - RNA, 21 nt, Salmonella enterica enterica serovar Typhi
cggcauuuuucucaggacgcc

SEQ ID NO: 3643210 - RNA, 14 nt, Salmonella enterica enterica serovar Typhi
cggccaaagcgcga

SEQ ID NO: 3643211 - RNA, 22 nt, Salmonella enterica enterica serovar Typhi
cggccaaagcgcgacuggaacg

SEQ ID NO: 3643212 - RNA, 13 nt, Salmonella enterica enterica serovar Typhi
cggccaaauugcu

SEQ ID NO: 3643213 - RNA, 16 nt, Salmonella enterica enterica serovar Typhi
cggccaaccccggcaa

SEQ ID NO: 3643214 - RNA, 16 nt, Salmonella enterica enterica serovar Typhi
cggccaacgcgcccuc

SEQ ID NO: 3643215 - RNA, 13 nt, Salmonella enterica enterica serovar Typhi
cggccacagccau

SEQ ID NO: 3643216 - RNA, 15 nt, Salmonella enterica enterica serovar Typhi
cggccacagcgccag

SEQ ID NO: 3643217 - RNA, 17 nt, Salmonella enterica enterica serovar Typhi
cggccacagcgccagac

SEQ ID NO: 3643218 - RNA, 14 nt, Salmonella enterica enterica serovar Typhi
cggccaccaggccu

SEQ ID NO: 3643219 - RNA, 18 nt, Salmonella enterica enterica serovar Typhi
cggccacccauccccaua

SEQ ID NO: 3643220 - RNA, 23 nt, Salmonella enterica enterica serovar Typhi
cggccacccauccccauauucca

SEQ ID NO: 3643221 - RNA, 15 nt, Salmonella enterica enterica serovar Typhi
cggccacgcgcguca

SEQ ID NO: 3643222 - RNA, 14 nt, Salmonella enterica enterica serovar Typhi
cggccacuauuucg

SEQ ID NO: 3643223 - RNA, 17 nt, Salmonella enterica enterica serovar Typhi
cggccacuccgccacaa

SEQ ID NO: 3643224 - RNA, 23 nt, Salmonella enterica enterica serovar Typhi
cggccagacaauacuuaaaccug

SEQ ID NO: 3643225 - RNA, 18 nt, Salmonella enterica enterica serovar Typhi
cggccagauaacgcgcau

SEQ ID NO: 3643226 - RNA, 21 nt, Salmonella enterica enterica serovar Typhi
cggccagauaaguuugcagau

SEQ ID NO: 3643227 - RNA, 17 nt, Salmonella enterica enterica serovar Typhi
cggccagauggcaaacg

SEQ ID NO: 3643228 - RNA, 13 nt, Salmonella enterica enterica serovar Typhi
cggccagcaaaau

SEQ ID NO: 3643229 - RNA, 18 nt, Salmonella enterica enterica serovar Typhi
cggccagcaaaaucacca

SEQ ID NO: 3643230 - RNA, 12 nt, Salmonella enterica enterica serovar Typhi
cggccagcgcag

SEQ ID NO: 3643231 - RNA, 14 nt, Salmonella enterica enterica serovar Typhi
cggccagcgcaggc

SEQ ID NO: 3643232 - RNA, 16 nt, Salmonella enterica enterica serovar Typhi
cggccagcgcaggcug

SEQ ID NO: 3643233 - RNA, 17 nt, Salmonella enterica enterica serovar Typhi
cggccagcgucaucaga

SEQ ID NO: 3643234 - RNA, 20 nt, Salmonella enterica enterica serovar Typhi
cggccaggcaaagauccacc

SEQ ID NO: 3643235 - RNA, 22 nt, Salmonella enterica enterica serovar Typhi
cggccaggcaaagauccaccag

SEQ ID NO: 3643236 - RNA, 17 nt, Salmonella enterica enterica serovar Typhi
cggccaguagcgggggc

SEQ ID NO: 3643237 - RNA, 18 nt, Salmonella enterica enterica serovar Typhi
cggccaguagcgggggcc

SEQ ID NO: 3643238 - RNA, 20 nt, Salmonella enterica enterica serovar Typhi
cggccagucgcucuaacuga

SEQ ID NO: 3643239 - RNA, 19 nt, Salmonella enterica enterica serovar Typhi
cggccaguguacauagcuu

SEQ ID NO: 3643240 - RNA, 22 nt, Salmonella enterica enterica serovar Typhi
cggccauggaacauccucuccu

SEQ ID NO: 3643241 - RNA, 22 nt, Salmonella enterica enterica serovar Typhi
cggccauggagagugagccacg

SEQ ID NO: 3643242 - RNA, 19 nt, Salmonella enterica enterica serovar Typhi
cggccauuaacacacaauc

SEQ ID NO: 3643243 - RNA, 17 nt, Salmonella enterica enterica serovar Typhi
cggccauucgcggcgua

SEQ ID NO: 3643244 - RNA, 18 nt, Salmonella enterica enterica serovar Typhi
cggccauugccgcgccga

SEQ ID NO: 3643245 - RNA, 13 nt, Salmonella enterica enterica serovar Typhi
cggcccaggcauc

SEQ ID NO: 3643246 - RNA, 16 nt, Salmonella enterica enterica serovar Typhi
cggcccaggcaucgac

SEQ ID NO: 3643247 - RNA, 18 nt, Salmonella enterica enterica serovar Typhi
cggcccauaaacagguca

SEQ ID NO: 3643248 - RNA, 13 nt, Salmonella enterica enterica serovar Typhi
cggcccccggcca

SEQ ID NO: 3643249 - RNA, 18 nt, Salmonella enterica enterica serovar Typhi
cggcccccggccauagcg

SEQ ID NO: 3643250 - RNA, 19 nt, Salmonella enterica enterica serovar Typhi
cggcccgcuaucaccgccc

SEQ ID NO: 3643251 - RNA, 20 nt, Salmonella enterica enterica serovar Typhi
cggcccgggagaacgccggg

SEQ ID NO: 3643252 - RNA, 22 nt, Salmonella enterica enterica serovar Typhi
cggcccuggcucaauccaggug

SEQ ID NO: 3643253 - RNA, 15 nt, Salmonella enterica enterica serovar Typhi
cggccggaugccagu

SEQ ID NO: 3643254 - RNA, 16 nt, Salmonella enterica enterica serovar Typhi
cggccuacaacucagc

SEQ ID NO: 3643255 - RNA, 13 nt, Salmonella enterica enterica serovar Typhi
cggccucccagcu

SEQ ID NO: 3643256 - RNA, 15 nt, Salmonella enterica enterica serovar Typhi
cggccuccgcuuccu

SEQ ID NO: 3643257 - RNA, 18 nt, Salmonella enterica enterica serovar Typhi
cggccuccgcuuccugcg

SEQ ID NO: 3643258 - RNA, 13 nt, Salmonella enterica enterica serovar Typhi
cggccuccgguga

SEQ ID NO: 3643259 - RNA, 22 nt, Salmonella enterica enterica serovar Typhi
cggccugacgaccguugccgau

SEQ ID NO: 3643260 - RNA, 14 nt, Salmonella enterica enterica serovar Typhi
cggccugacgcagc

SEQ ID NO: 3643261 - RNA, 12 nt, Salmonella enterica enterica serovar Typhi
cggccugcgcca

SEQ ID NO: 3643262 - RNA, 16 nt, Salmonella enterica enterica serovar Typhi
cggccugcgguguaga

SEQ ID NO: 3643263 - RNA, 14 nt, Salmonella enterica enterica serovar Typhi
cggccuggcccggc

SEQ ID NO: 3643264 - RNA, 16 nt, Salmonella enterica enterica serovar Typhi
cggccuggcucuuccg

SEQ ID NO: 3643265 - RNA, 21 nt, Salmonella enterica enterica serovar Typhi
cggccugucuccucagcaggc

SEQ ID NO: 3643266 - RNA, 15 nt, Salmonella enterica enterica serovar Typhi
cggccuguuuuucug

SEQ ID NO: 3643267 - RNA, 19 nt, Salmonella enterica enterica serovar Typhi
cggccuucgcagaucgccu

SEQ ID NO: 3643268 - RNA, 14 nt, Salmonella enterica enterica serovar Typhi
cggccuugccgcca

SEQ ID NO: 3643269 - RNA, 21 nt, Salmonella enterica enterica serovar Typhi
cggccuuuuuccgucagcaac

SEQ ID NO: 3643270 - RNA, 18 nt, Salmonella enterica enterica serovar Typhi
cggcgaaaaagccggcgg

SEQ ID NO: 3643271 - RNA, 18 nt, Salmonella enterica enterica serovar Typhi
cggcgaaaaccgagcauc

SEQ ID NO: 3643272 - RNA, 16 nt, Salmonella enterica enterica serovar Typhi
cggcgaaaccgauuuc

SEQ ID NO: 3643273 - RNA, 15 nt, Salmonella enterica enterica serovar Typhi
cggcgaaagaagcgc

SEQ ID NO: 3643274 - RNA, 19 nt, Salmonella enterica enterica serovar Typhi
cggcgaaccggcaucggca

SEQ ID NO: 3643275 - RNA, 20 nt, Salmonella enterica enterica serovar Typhi
cggcgaaccggcaucggcag

SEQ ID NO: 3643276 - RNA, 21 nt, Salmonella enterica enterica serovar Typhi
cggcgaaccggcaucggcagc

SEQ ID NO: 3643277 - RNA, 11 nt, Salmonella enterica enterica serovar Typhi
cggcgaaucgc

SEQ ID NO: 3643278 - RNA, 18 nt, Salmonella enterica enterica serovar Typhi
cggcgaaucgcagagcgu

SEQ ID NO: 3643279 - RNA, 18 nt, Salmonella enterica enterica serovar Typhi
cggcgaauuaaucgucga

SEQ ID NO: 3643280 - RNA, 16 nt, Salmonella enterica enterica serovar Typhi
cggcgacaagaauaug

SEQ ID NO: 3643281 - RNA, 16 nt, Salmonella enterica enterica serovar Typhi
cggcgacaucgccaaa

SEQ ID NO: 3643282 - RNA, 14 nt, Salmonella enterica enterica serovar Typhi
cggcgaccggcaaa

SEQ ID NO: 3643283 - RNA, 16 nt, Salmonella enterica enterica serovar Typhi
cggcgacggacucgcg

SEQ ID NO: 3643284 - RNA, 21 nt, Salmonella enterica enterica serovar Typhi
cggcgacggacucgcgcagaa

SEQ ID NO: 3643285 - RNA, 18 nt, Salmonella enterica enterica serovar Typhi
cggcgacuauugcgccga

SEQ ID NO: 3643286 - RNA, 22 nt, Salmonella enterica enterica serovar Typhi
cggcgauaaaugucaggaucag

SEQ ID NO: 3643287 - RNA, 16 nt, Salmonella enterica enterica serovar Typhi
cggcgauagcgcccca

SEQ ID NO: 3643288 - RNA, 17 nt, Salmonella enterica enterica serovar Typhi
cggcgauuuccagcgcc

SEQ ID NO: 3643289 - RNA, 19 nt, Salmonella enterica enterica serovar Typhi
cggcgauuuccagcgccgc

SEQ ID NO: 3643290 - RNA, 21 nt, Salmonella enterica enterica serovar Typhi
cggcgauuugccccggcgcug

SEQ ID NO: 3643291 - RNA, 15 nt, Salmonella enterica enterica serovar Typhi
cggcgcaaaucgcca

SEQ ID NO: 3643292 - RNA, 17 nt, Salmonella enterica enterica serovar Typhi
cggcgcaaauggcugcg

SEQ ID NO: 3643293 - RNA, 15 nt, Salmonella enterica enterica serovar Typhi
cggcgcacugccuga

SEQ ID NO: 3643294 - RNA, 18 nt, Salmonella enterica enterica serovar Typhi
cggcgcacuuccucuccc

SEQ ID NO: 3643295 - RNA, 13 nt, Salmonella enterica enterica serovar Typhi
cggcgcagcgacc

SEQ ID NO: 3643296 - RNA, 23 nt, Salmonella enterica enterica serovar Typhi
cggcgcagcgaccuccgcgcagc

SEQ ID NO: 3643297 - RNA, 18 nt, Salmonella enterica enterica serovar Typhi
cggcgcauuuucggcagc

SEQ ID NO: 3643298 - RNA, 18 nt, Salmonella enterica enterica serovar Typhi
cggcgccaaucaccgcca

SEQ ID NO: 3643299 - RNA, 21 nt, Salmonella enterica enterica serovar Typhi
cggcgccaaucaccgccagca

SEQ ID NO: 3643300 - RNA, 21 nt, Salmonella enterica enterica serovar Typhi
cggcgccaauuaacucuuccg

SEQ ID NO: 3643301 - RNA, 15 nt, Salmonella enterica enterica serovar Typhi
cggcgccacgcgcca

SEQ ID NO: 3643302 - RNA, 22 nt, Salmonella enterica enterica serovar Typhi
cggcgccauaguccauuacgca

SEQ ID NO: 3643303 - RNA, 16 nt, Salmonella enterica enterica serovar Typhi
cggcgccaucaaucca

SEQ ID NO: 3643304 - RNA, 14 nt, Salmonella enterica enterica serovar Typhi
cggcgccaucacca

SEQ ID NO: 3643305 - RNA, 15 nt, Salmonella enterica enterica serovar Typhi
cggcgccaucaugca

SEQ ID NO: 3643306 - RNA, 22 nt, Salmonella enterica enterica serovar Typhi
cggcgcccagcuuacgcgcaga

SEQ ID NO: 3643307 - RNA, 15 nt, Salmonella enterica enterica serovar Typhi
cggcgcccauccgcc

SEQ ID NO: 3643308 - RNA, 23 nt, Salmonella enterica enterica serovar Typhi
cggcgccgaucaucccgcccagc

SEQ ID NO: 3643309 - RNA, 13 nt, Salmonella enterica enterica serovar Typhi
cggcgccggcgcg

SEQ ID NO: 3643310 - RNA, 24 nt, Salmonella enterica enterica serovar Typhi
cggcgcgaaacaggucggcaugca

SEQ ID NO: 3643311 - RNA, 17 nt, Salmonella enterica enterica serovar Typhi
cggcgcgaaagcgccuu

SEQ ID NO: 3643312 - RNA, 14 nt, Salmonella enterica enterica serovar Typhi
cggcgcgacgccgc

SEQ ID NO: 3643313 - RNA, 19 nt, Salmonella enterica enterica serovar Typhi
cggcgcgcaguauugccga

SEQ ID NO: 3643314 - RNA, 10 nt, Salmonella enterica enterica serovar Typhi
cggcgcgcca

SEQ ID NO: 3643315 - RNA, 13 nt, Salmonella enterica enterica serovar Typhi
cggcgcgccgcuc

SEQ ID NO: 3643316 - RNA, 24 nt, Salmonella enterica enterica serovar Typhi
cggcgcgccgcuggcgaccagccu

SEQ ID NO: 3643317 - RNA, 14 nt, Salmonella enterica enterica serovar Typhi
cggcgcgccggcaa

SEQ ID NO: 3643318 - RNA, 15 nt, Salmonella enterica enterica serovar Typhi
cggcgcgcgcgguuc

SEQ ID NO: 3643319 - RNA, 13 nt, Salmonella enterica enterica serovar Typhi
cggcgcgcguggc

SEQ ID NO: 3643320 - RNA, 17 nt, Salmonella enterica enterica serovar Typhi
cggcgcgcucuacguug

SEQ ID NO: 3643321 - RNA, 17 nt, Salmonella enterica enterica serovar Typhi
cggcgcgcucuuuuucu

SEQ ID NO: 3643322 - RNA, 16 nt, Salmonella enterica enterica serovar Typhi
cggcgcgcugccgccc

SEQ ID NO: 3643323 - RNA, 16 nt, Salmonella enterica enterica serovar Typhi
cggcgcgcuggcgugg

SEQ ID NO: 3643324 - RNA, 19 nt, Salmonella enterica enterica serovar Typhi
cggcgcggauagucauaau

SEQ ID NO: 3643325 - RNA, 14 nt, Salmonella enterica enterica serovar Typhi
cggcgcgucgcugu

SEQ ID NO: 3643326 - RNA, 19 nt, Salmonella enterica enterica serovar Typhi
cggcgcguuuuggcagaca

SEQ ID NO: 3643327 - RNA, 19 nt, Salmonella enterica enterica serovar Typhi
cggcgcugaugacgcgccg

SEQ ID NO: 3643328 - RNA, 22 nt, Salmonella enterica enterica serovar Typhi
cggcgcugcgcggcgugcagau

SEQ ID NO: 3643329 - RNA, 16 nt, Salmonella enterica enterica serovar Typhi
cggcggaaaagcgccc

SEQ ID NO: 3643330 - RNA, 13 nt, Salmonella enterica enterica serovar Typhi
cggcggaaaauag

SEQ ID NO: 3643331 - RNA, 21 nt, Salmonella enterica enterica serovar Typhi
cggcggaagcgaauggcggca

SEQ ID NO: 3643332 - RNA, 21 nt, Salmonella enterica enterica serovar Typhi
cggcggagacagaacaggaug

SEQ ID NO: 3643333 - RNA, 16 nt, Salmonella enterica enterica serovar Typhi
cggcggaggccagacu

SEQ ID NO: 3643334 - RNA, 17 nt, Salmonella enterica enterica serovar Typhi
cggcggaugaucgccuc

SEQ ID NO: 3643335 - RNA, 13 nt, Salmonella enterica enterica serovar Typhi
cggcggcaguccc

SEQ ID NO: 3643336 - RNA, 18 nt, Salmonella enterica enterica serovar Typhi
cggcggcuuuaaugccgc

SEQ ID NO: 3643337 - RNA, 16 nt, Salmonella enterica enterica serovar Typhi
cggcgggagcucuacc

SEQ ID NO: 3643338 - RNA, 17 nt, Salmonella enterica enterica serovar Typhi
cggcggguauggcaaug

SEQ ID NO: 3643339 - RNA, 13 nt, Salmonella enterica enterica serovar Typhi
cggcggucgccgc

SEQ ID NO: 3643340 - RNA, 13 nt, Salmonella enterica enterica serovar Typhi
cggcggucugcgc

SEQ ID NO: 3643341 - RNA, 21 nt, Salmonella enterica enterica serovar Typhi
cggcgguuauccgccagcgca

SEQ ID NO: 3643342 - RNA, 20 nt, Salmonella enterica enterica serovar Typhi
cggcgguuauccuccggguc

SEQ ID NO: 3643343 - RNA, 16 nt, Salmonella enterica enterica serovar Typhi
cggcguaaaacuggcu

SEQ ID NO: 3643344 - RNA, 15 nt, Salmonella enterica enterica serovar Typhi
cggcguaacccagug

SEQ ID NO: 3643345 - RNA, 20 nt, Salmonella enterica enterica serovar Typhi
cggcguaacggcugacgccc

SEQ ID NO: 3643346 - RNA, 19 nt, Salmonella enterica enterica serovar Typhi
cggcguaagaucgcggggc

SEQ ID NO: 3643347 - RNA, 13 nt, Salmonella enterica enterica serovar Typhi
cggcguaauguug

SEQ ID NO: 3643348 - RNA, 16 nt, Salmonella enterica enterica serovar Typhi
cggcguaccagaaugc

SEQ ID NO: 3643349 - RNA, 18 nt, Salmonella enterica enterica serovar Typhi
cggcguagcgcguucagg

SEQ ID NO: 3643350 - RNA, 16 nt, Salmonella enterica enterica serovar Typhi
cggcgucaaaucgccg

SEQ ID NO: 3643351 - RNA, 14 nt, Salmonella enterica enterica serovar Typhi
cggcgucaacucag

SEQ ID NO: 3643352 - RNA, 21 nt, Salmonella enterica enterica serovar Typhi
cggcgucaccaccgcaggcag

SEQ ID NO: 3643353 - RNA, 21 nt, Salmonella enterica enterica serovar Typhi
cggcgucacguucgucgccgg

SEQ ID NO: 3643354 - RNA, 22 nt, Salmonella enterica enterica serovar Typhi
cggcgucauacugccaaccauu

SEQ ID NO: 3643355 - RNA, 12 nt, Salmonella enterica enterica serovar Typhi
cggcgucauccc

SEQ ID NO: 3643356 - RNA, 15 nt, Salmonella enterica enterica serovar Typhi
cggcguccaucaccg

SEQ ID NO: 3643357 - RNA, 14 nt, Salmonella enterica enterica serovar Typhi
cggcguccgccagc

SEQ ID NO: 3643358 - RNA, 20 nt, Salmonella enterica enterica serovar Typhi
cggcguccggcacgcgcagc

SEQ ID NO: 3643359 - RNA, 13 nt, Salmonella enterica enterica serovar Typhi
cggcgucgccaga

SEQ ID NO: 3643360 - RNA, 15 nt, Salmonella enterica enterica serovar Typhi
cggcgucgccugucc

SEQ ID NO: 3643361 - RNA, 14 nt, Salmonella enterica enterica serovar Typhi
cggcgucugaugaa

SEQ ID NO: 3643362 - RNA, 16 nt, Salmonella enterica enterica serovar Typhi
cggcgucugcgcgcug

SEQ ID NO: 3643363 - RNA, 22 nt, Salmonella enterica enterica serovar Typhi
cggcgucuucauccucgccaua

SEQ ID NO: 3643364 - RNA, 23 nt, Salmonella enterica enterica serovar Typhi
cggcgucuucauccucgccauaa

SEQ ID NO: 3643365 - RNA, 22 nt, Salmonella enterica enterica serovar Typhi
cggcgugaaagcgcuugauaau

SEQ ID NO: 3643366 - RNA, 14 nt, Salmonella enterica enterica serovar Typhi
cggcgugaacgccu

SEQ ID NO: 3643367 - RNA, 12 nt, Salmonella enterica enterica serovar Typhi
cggcgugaacgu

SEQ ID NO: 3643368 - RNA, 14 nt, Salmonella enterica enterica serovar Typhi
cggcgugaaucccc

SEQ ID NO: 3643369 - RNA, 16 nt, Salmonella enterica enterica serovar Typhi
cggcguggaaccgccg

SEQ ID NO: 3643370 - RNA, 17 nt, Salmonella enterica enterica serovar Typhi
cggcguggagcauucca

SEQ ID NO: 3643371 - RNA, 22 nt, Salmonella enterica enterica serovar Typhi
cggcguguaaacagaugcucac

SEQ ID NO: 3643372 - RNA, 16 nt, Salmonella enterica enterica serovar Typhi
cggcgugucagggcgg

SEQ ID NO: 3643373 - RNA, 13 nt, Salmonella enterica enterica serovar Typhi
cggcguuacuccg

SEQ ID NO: 3643374 - RNA, 18 nt, Salmonella enterica enterica serovar Typhi
cggcguuacuccgcggua

SEQ ID NO: 3643375 - RNA, 22 nt, Salmonella enterica enterica serovar Typhi
cggcguuauacgccugccuggu

SEQ ID NO: 3643376 - RNA, 19 nt, Salmonella enterica enterica serovar Typhi
cggcguuggcgauuuccag

SEQ ID NO: 3643377 - RNA, 22 nt, Salmonella enterica enterica serovar Typhi
cggcguuuuaauauccuggcga

SEQ ID NO: 3643378 - RNA, 19 nt, Salmonella enterica enterica serovar Typhi
cggcuaaacugcgaugcgc

SEQ ID NO: 3643379 - RNA, 17 nt, Salmonella enterica enterica serovar Typhi
cggcuaaucaccaccuc

SEQ ID NO: 3643380 - RNA, 20 nt, Salmonella enterica enterica serovar Typhi
cggcuaccccggcgcggcgc

SEQ ID NO: 3643381 - RNA, 16 nt, Salmonella enterica enterica serovar Typhi
cggcuaccgaaggcgc

SEQ ID NO: 3643382 - RNA, 13 nt, Salmonella enterica enterica serovar Typhi
cggcuaccgccug

SEQ ID NO: 3643383 - RNA, 21 nt, Salmonella enterica enterica serovar Typhi
cggcuacgaaccgagcggucg

SEQ ID NO: 3643384 - RNA, 22 nt, Salmonella enterica enterica serovar Typhi
cggcuacugccagcgucgcuga

SEQ ID NO: 3643385 - RNA, 19 nt, Salmonella enterica enterica serovar Typhi
cggcucaaacggccugcgc

SEQ ID NO: 3643386 - RNA, 22 nt, Salmonella enterica enterica serovar Typhi
cggcucaccagcugacgcagca

SEQ ID NO: 3643387 - RNA, 13 nt, Salmonella enterica enterica serovar Typhi
cggcucagcaauc

SEQ ID NO: 3643388 - RNA, 13 nt, Salmonella enterica enterica serovar Typhi
cggcucauccagc

SEQ ID NO: 3643389 - RNA, 17 nt, Salmonella enterica enterica serovar Typhi
cggcucauccagcaaca

SEQ ID NO: 3643390 - RNA, 17 nt, Salmonella enterica enterica serovar Typhi
cggcuccagguugcuca

SEQ ID NO: 3643391 - RNA, 22 nt, Salmonella enterica enterica serovar Typhi
cggcuccagguugcucagguua

SEQ ID NO: 3643392 - RNA, 12 nt, Salmonella enterica enterica serovar Typhi
cggcucccauuu

SEQ ID NO: 3643393 - RNA, 22 nt, Salmonella enterica enterica serovar Typhi
cggcuccggcaaauucuuccgc

SEQ ID NO: 3643394 - RNA, 17 nt, Salmonella enterica enterica serovar Typhi
cggcucgaacuguucug

SEQ ID NO: 3643395 - RNA, 14 nt, Salmonella enterica enterica serovar Typhi
cggcugaaccaccc

SEQ ID NO: 3643396 - RNA, 12 nt, Salmonella enterica enterica serovar Typhi
cggcugaagcug

SEQ ID NO: 3643397 - RNA, 15 nt, Salmonella enterica enterica serovar Typhi
cggcugaagcugccg

SEQ ID NO: 3643398 - RNA, 16 nt, Salmonella enterica enterica serovar Typhi
cggcugaccugaacgc

SEQ ID NO: 3643399 - RNA, 20 nt, Salmonella enterica enterica serovar Typhi
cggcugacgcccaucagcau

SEQ ID NO: 3643400 - RNA, 22 nt, Salmonella enterica enterica serovar Typhi
cggcugauggcguuccacccag

SEQ ID NO: 3643401 - RNA, 18 nt, Salmonella enterica enterica serovar Typhi
cggcugccauuaucacca

SEQ ID NO: 3643402 - RNA, 13 nt, Salmonella enterica enterica serovar Typhi
cggcugccugccg

SEQ ID NO: 3643403 - RNA, 23 nt, Salmonella enterica enterica serovar Typhi
cggcugccuuuuuuaauggcgcu

SEQ ID NO: 3643404 - RNA, 19 nt, Salmonella enterica enterica serovar Typhi
cggcuggacgucaugccgc

SEQ ID NO: 3643405 - RNA, 22 nt, Salmonella enterica enterica serovar Typhi
cggcuggacgucaugccgccac

SEQ ID NO: 3643406 - RNA, 18 nt, Salmonella enterica enterica serovar Typhi
cggcuggcgcaacuggcg

SEQ ID NO: 3643407 - RNA, 13 nt, Salmonella enterica enterica serovar Typhi
cggcuggcuauag

SEQ ID NO: 3643408 - RNA, 17 nt, Salmonella enterica enterica serovar Typhi
cggcugggcgaggccac

SEQ ID NO: 3643409 - RNA, 20 nt, Salmonella enterica enterica serovar Typhi
cggcugggcgaggccacgca

SEQ ID NO: 3643410 - RNA, 17 nt, Salmonella enterica enterica serovar Typhi
cggcuggguuuccggau

SEQ ID NO: 3643411 - RNA, 23 nt, Salmonella enterica enterica serovar Typhi
cggcuguaccuuaaccgggcgcu

SEQ ID NO: 3643412 - RNA, 17 nt, Salmonella enterica enterica serovar Typhi
cggcuguagccagccug

SEQ ID NO: 3643413 - RNA, 19 nt, Salmonella enterica enterica serovar Typhi
cggcuguagccagccugaa

SEQ ID NO: 3643414 - RNA, 13 nt, Salmonella enterica enterica serovar Typhi
cggcuguucacgu

SEQ ID NO: 3643415 - RNA, 16 nt, Salmonella enterica enterica serovar Typhi
cggcuuaaauggcgcu

SEQ ID NO: 3643416 - RNA, 18 nt, Salmonella enterica enterica serovar Typhi
cggcuuaaugcccggccc

SEQ ID NO: 3643417 - RNA, 19 nt, Salmonella enterica enterica serovar Typhi
cggcuuaaugcccggcccg

SEQ ID NO: 3643418 - RNA, 21 nt, Salmonella enterica enterica serovar Typhi
cggcuuauccggccugcacga

SEQ ID NO: 3643419 - RNA, 14 nt, Salmonella enterica enterica serovar Typhi
cggcuuccggcagc

SEQ ID NO: 3643420 - RNA, 15 nt, Salmonella enterica enterica serovar Typhi
cggcuucuccaccau

SEQ ID NO: 3643421 - RNA, 19 nt, Salmonella enterica enterica serovar Typhi
cggcuugaguuuuccgcca

SEQ ID NO: 3643422 - RNA, 17 nt, Salmonella enterica enterica serovar Typhi
cggcuuuaaugccgccg

SEQ ID NO: 3643423 - RNA, 13 nt, Salmonella enterica enterica serovar Typhi
cggcuuuccagcu

SEQ ID NO: 3643424 - RNA, 16 nt, Salmonella enterica enterica serovar Typhi
cggcuuuccgcaccgc

SEQ ID NO: 3643425 - RNA, 22 nt, Salmonella enterica enterica serovar Typhi
cggcuuugaacagcgucaucca

SEQ ID NO: 3643426 - RNA, 17 nt, Salmonella enterica enterica serovar Typhi
cgggaaaagcguccggg

SEQ ID NO: 3643427 - RNA, 20 nt, Salmonella enterica enterica serovar Typhi
cgggaaaagguuucggcgau

SEQ ID NO: 3643428 - RNA, 19 nt, Salmonella enterica enterica serovar Typhi
cgggaaacuguuugaacga

SEQ ID NO: 3643429 - RNA, 17 nt, Salmonella enterica enterica serovar Typhi
cgggaaagggcggcagc

SEQ ID NO: 3643430 - RNA, 15 nt, Salmonella enterica enterica serovar Typhi
cgggaaaucacguuu

SEQ ID NO: 3643431 - RNA, 15 nt, Salmonella enterica enterica serovar Typhi
cgggaaguccuucuc

SEQ ID NO: 3643432 - RNA, 23 nt, Salmonella enterica enterica serovar Typhi
cgggaauaacgcgagaagaagaa

SEQ ID NO: 3643433 - RNA, 19 nt, Salmonella enterica enterica serovar Typhi
cgggacggcggccagcauu

SEQ ID NO: 3643434 - RNA, 17 nt, Salmonella enterica enterica serovar Typhi
cgggacguuucgauaac

SEQ ID NO: 3643435 - RNA, 17 nt, Salmonella enterica enterica serovar Typhi
cgggacugacugagcca

SEQ ID NO: 3643436 - RNA, 19 nt, Salmonella enterica enterica serovar Typhi
cgggacuucaggcauccag

SEQ ID NO: 3643437 - RNA, 22 nt, Salmonella enterica enterica serovar Typhi
cgggacuucaggcauccagacc

SEQ ID NO: 3643438 - RNA, 18 nt, Salmonella enterica enterica serovar Typhi
cgggacuuuaaacgucau

SEQ ID NO: 3643439 - RNA, 22 nt, Salmonella enterica enterica serovar Typhi
cgggacuuuaaacgucaugcug

SEQ ID NO: 3643440 - RNA, 12 nt, Salmonella enterica enterica serovar Typhi
cgggagcaaaau

SEQ ID NO: 3643441 - RNA, 23 nt, Salmonella enterica enterica serovar Typhi
cgggagcucuaccagaccacgca

SEQ ID NO: 3643442 - RNA, 15 nt, Salmonella enterica enterica serovar Typhi
cgggauaaccaccgc

SEQ ID NO: 3643443 - RNA, 20 nt, Salmonella enterica enterica serovar Typhi
cgggauagcacuacccagau

SEQ ID NO: 3643444 - RNA, 14 nt, Salmonella enterica enterica serovar Typhi
cgggauauaaaauu

SEQ ID NO: 3643445 - RNA, 16 nt, Salmonella enterica enterica serovar Typhi
cgggauccugcaaaau

SEQ ID NO: 3643446 - RNA, 15 nt, Salmonella enterica enterica serovar Typhi
cgggaucgaaccgcc

SEQ ID NO: 3643447 - RNA, 16 nt, Salmonella enterica enterica serovar Typhi
cgggaucgaaccgccg

SEQ ID NO: 3643448 - RNA, 21 nt, Salmonella enterica enterica serovar Typhi
cgggaucgauauaucgcguca

SEQ ID NO: 3643449 - RNA, 17 nt, Salmonella enterica enterica serovar Typhi
cgggaucgcagaaauau

SEQ ID NO: 3643450 - RNA, 22 nt, Salmonella enterica enterica serovar Typhi
cgggaucgccagaucgaacagc

SEQ ID NO: 3643451 - RNA, 14 nt, Salmonella enterica enterica serovar Typhi
cgggaucuccagaa

SEQ ID NO: 3643452 - RNA, 15 nt, Salmonella enterica enterica serovar Typhi
cgggaugguuaaauu

SEQ ID NO: 3643453 - RNA, 20 nt, Salmonella enterica enterica serovar Typhi
cgggaugguuaaauucauau

SEQ ID NO: 3643454 - RNA, 20 nt, Salmonella enterica enterica serovar Typhi
cgggauugccgccgcgcugg

SEQ ID NO: 3643455 - RNA, 18 nt, Salmonella enterica enterica serovar Typhi
cgggauuuuaagcaucca

SEQ ID NO: 3643456 - RNA, 16 nt, Salmonella enterica enterica serovar Typhi
cgggcaaaagggccau

SEQ ID NO: 3643457 - RNA, 16 nt, Salmonella enterica enterica serovar Typhi
cgggcaaaaugcgucg

SEQ ID NO: 3643458 - RNA, 15 nt, Salmonella enterica enterica serovar Typhi
cgggcaaugccacca

SEQ ID NO: 3643459 - RNA, 21 nt, Salmonella enterica enterica serovar Typhi
cgggcaaugccaccagcgcca

SEQ ID NO: 3643460 - RNA, 22 nt, Salmonella enterica enterica serovar Typhi
cgggcaaugccaccagcgccau

SEQ ID NO: 3643461 - RNA, 23 nt, Salmonella enterica enterica serovar Typhi
cgggcaaugccaccagcgccaua

SEQ ID NO: 3643462 - RNA, 20 nt, Salmonella enterica enterica serovar Typhi
cgggcaaugccacugcccuc

SEQ ID NO: 3643463 - RNA, 17 nt, Salmonella enterica enterica serovar Typhi
cgggcagacaucgccgu

SEQ ID NO: 3643464 - RNA, 22 nt, Salmonella enterica enterica serovar Typhi
cgggcagacaugaccgcacagc

SEQ ID NO: 3643465 - RNA, 21 nt, Salmonella enterica enterica serovar Typhi
cgggcagauggucgcauggcu

SEQ ID NO: 3643466 - RNA, 13 nt, Salmonella enterica enterica serovar Typhi
cgggcagcagcag

SEQ ID NO: 3643467 - RNA, 23 nt, Salmonella enterica enterica serovar Typhi
cgggcaggcuuccacgcacgccg

SEQ ID NO: 3643468 - RNA, 14 nt, Salmonella enterica enterica serovar Typhi
cgggcauaaccucu

SEQ ID NO: 3643469 - RNA, 18 nt, Salmonella enterica enterica serovar Typhi
cgggcauacucuccucca

SEQ ID NO: 3643470 - RNA, 15 nt, Salmonella enterica enterica serovar Typhi
cgggcaucgccgcaa

SEQ ID NO: 3643471 - RNA, 14 nt, Salmonella enterica enterica serovar Typhi
cgggcauugugccg

SEQ ID NO: 3643472 - RNA, 15 nt, Salmonella enterica enterica serovar Typhi
cgggcauuguuaauc

SEQ ID NO: 3643473 - RNA, 16 nt, Salmonella enterica enterica serovar Typhi
cgggccagcagccagg

SEQ ID NO: 3643474 - RNA, 16 nt, Salmonella enterica enterica serovar Typhi
cgggccgccgcagcag

SEQ ID NO: 3643475 - RNA, 13 nt, Salmonella enterica enterica serovar Typhi
cgggccgcgcugc

SEQ ID NO: 3643476 - RNA, 20 nt, Salmonella enterica enterica serovar Typhi
cgggccgcgcugcgccugcu

SEQ ID NO: 3643477 - RNA, 15 nt, Salmonella enterica enterica serovar Typhi
cgggccugagcgcgc

SEQ ID NO: 3643478 - RNA, 13 nt, Salmonella enterica enterica serovar Typhi
cgggccugccagg

SEQ ID NO: 3643479 - RNA, 16 nt, Salmonella enterica enterica serovar Typhi
cgggccugugccugac

SEQ ID NO: 3643480 - RNA, 19 nt, Salmonella enterica enterica serovar Typhi
cgggccuguguaggccgga

SEQ ID NO: 3643481 - RNA, 15 nt, Salmonella enterica enterica serovar Typhi
cgggcgaagccugac

SEQ ID NO: 3643482 - RNA, 16 nt, Salmonella enterica enterica serovar Typhi
cgggcgaccgucgggc

SEQ ID NO: 3643483 - RNA, 16 nt, Salmonella enterica enterica serovar Typhi
cgggcgauaaaccagc

SEQ ID NO: 3643484 - RNA, 23 nt, Salmonella enterica enterica serovar Typhi
cgggcgauaaccucucaccgccu

SEQ ID NO: 3643485 - RNA, 22 nt, Salmonella enterica enterica serovar Typhi
cgggcgauuauaaggucgauau

SEQ ID NO: 3643486 - RNA, 17 nt, Salmonella enterica enterica serovar Typhi
cgggcgcguuaaugcau

SEQ ID NO: 3643487 - RNA, 19 nt, Salmonella enterica enterica serovar Typhi
cgggcgcuaaacccaacgu

SEQ ID NO: 3643488 - RNA, 23 nt, Salmonella enterica enterica serovar Typhi
cgggcggaaagcauucgcagcag

SEQ ID NO: 3643489 - RNA, 14 nt, Salmonella enterica enterica serovar Typhi
cgggcggcgcagcg

SEQ ID NO: 3643490 - RNA, 17 nt, Salmonella enterica enterica serovar Typhi
cgggcggcugucccaga

SEQ ID NO: 3643491 - RNA, 17 nt, Salmonella enterica enterica serovar Typhi
cgggcgguauuauccgc

SEQ ID NO: 3643492 - RNA, 22 nt, Salmonella enterica enterica serovar Typhi
cgggcgguauuauccgccgcaa

SEQ ID NO: 3643493 - RNA, 19 nt, Salmonella enterica enterica serovar Typhi
cgggcguauagccaggcag

SEQ ID NO: 3643494 - RNA, 22 nt, Salmonella enterica enterica serovar Typhi
cgggcgucacccgccggcagca

SEQ ID NO: 3643495 - RNA, 13 nt, Salmonella enterica enterica serovar Typhi
cgggcgucgaaau

SEQ ID NO: 3643496 - RNA, 23 nt, Salmonella enterica enterica serovar Typhi
cgggcguuucacauuccggcgcg

SEQ ID NO: 3643497 - RNA, 15 nt, Salmonella enterica enterica serovar Typhi
cgggcugaacgccag

SEQ ID NO: 3643498 - RNA, 15 nt, Salmonella enterica enterica serovar Typhi
cgggcugcacgccau

SEQ ID NO: 3643499 - RNA, 22 nt, Salmonella enterica enterica serovar Typhi
cgggcuggccggcgcaauguuc

SEQ ID NO: 3643500 - RNA, 23 nt, Salmonella enterica enterica serovar Typhi
cgggcuuccaguacgcugacgaa

SEQ ID NO: 3643501 - RNA, 23 nt, Salmonella enterica enterica serovar Typhi
cgggcuuuguugucuauaaagcg

SEQ ID NO: 3643502 - RNA, 19 nt, Salmonella enterica enterica serovar Typhi
cggggaucguucugcugau

SEQ ID NO: 3643503 - RNA, 15 nt, Salmonella enterica enterica serovar Typhi
cggggauggcggauu

SEQ ID NO: 3643504 - RNA, 20 nt, Salmonella enterica enterica serovar Typhi
cggggauuuuuuugcccggu

SEQ ID NO: 3643505 - RNA, 21 nt, Salmonella enterica enterica serovar Typhi
cggggauuuuuuugcccggug

SEQ ID NO: 3643506 - RNA, 23 nt, Salmonella enterica enterica serovar Typhi
cggggcaucuauuuaacagagag

SEQ ID NO: 3643507 - RNA, 13 nt, Salmonella enterica enterica serovar Typhi
cggggcgcaaaau

SEQ ID NO: 3643508 - RNA, 18 nt, Salmonella enterica enterica serovar Typhi
cggggcguuaaucaccgg

SEQ ID NO: 3643509 - RNA, 22 nt, Salmonella enterica enterica serovar Typhi
cggggcguuaaucaccggcgcg

SEQ ID NO: 3643510 - RNA, 22 nt, Salmonella enterica enterica serovar Typhi
cggggcucccacucuuccagca

SEQ ID NO: 3643511 - RNA, 17 nt, Salmonella enterica enterica serovar Typhi
cgggggacgcgacgccc

SEQ ID NO: 3643512 - RNA, 17 nt, Salmonella enterica enterica serovar Typhi
cgggggcgaucagcagg

SEQ ID NO: 3643513 - RNA, 20 nt, Salmonella enterica enterica serovar Typhi
cgggggcgaucagcagguca

SEQ ID NO: 3643514 - RNA, 17 nt, Salmonella enterica enterica serovar Typhi
cgggggcguucgcguuc

SEQ ID NO: 3643515 - RNA, 16 nt, Salmonella enterica enterica serovar Typhi
cggggguuauucagcg

SEQ ID NO: 3643516 - RNA, 15 nt, Salmonella enterica enterica serovar Typhi
cgggguaaaauggac

SEQ ID NO: 3643517 - RNA, 18 nt, Salmonella enterica enterica serovar Typhi
cgggguaguuaucacguu

SEQ ID NO: 3643518 - RNA, 17 nt, Salmonella enterica enterica serovar Typhi
cggggucuuccagcaga

SEQ ID NO: 3643519 - RNA, 21 nt, Salmonella enterica enterica serovar Typhi
cgggguuagcguuucaaccgc

SEQ ID NO: 3643520 - RNA, 22 nt, Salmonella enterica enterica serovar Typhi
cggguaaacaaacacagccauc

SEQ ID NO: 3643521 - RNA, 13 nt, Salmonella enterica enterica serovar Typhi
cggguaacgucga

SEQ ID NO: 3643522 - RNA, 14 nt, Salmonella enterica enterica serovar Typhi
cggguaaggcaucg

SEQ ID NO: 3643523 - RNA, 21 nt, Salmonella enterica enterica serovar Typhi
cggguaaggcgaagucgccac

SEQ ID NO: 3643524 - RNA, 21 nt, Salmonella enterica enterica serovar Typhi
cggguaaggcguagccgccac

SEQ ID NO: 3643525 - RNA, 17 nt, Salmonella enterica enterica serovar Typhi
cggguagaaauuccuuc

SEQ ID NO: 3643526 - RNA, 15 nt, Salmonella enterica enterica serovar Typhi
cggguagagcuuuuc

SEQ ID NO: 3643527 - RNA, 14 nt, Salmonella enterica enterica serovar Typhi
cggguagucccagg

SEQ ID NO: 3643528 - RNA, 20 nt, Salmonella enterica enterica serovar Typhi
cggguauguuuuagcagagu

SEQ ID NO: 3643529 - RNA, 17 nt, Salmonella enterica enterica serovar Typhi
cgggucagauucagcau

SEQ ID NO: 3643530 - RNA, 13 nt, Salmonella enterica enterica serovar Typhi
cgggucagcgucu

SEQ ID NO: 3643531 - RNA, 14 nt, Salmonella enterica enterica serovar Typhi
cgggucggacgagc

SEQ ID NO: 3643532 - RNA, 20 nt, Salmonella enterica enterica serovar Typhi
cgggugaauaacuucacgcu

SEQ ID NO: 3643533 - RNA, 14 nt, Salmonella enterica enterica serovar Typhi
cgggugacuggucu

SEQ ID NO: 3643534 - RNA, 16 nt, Salmonella enterica enterica serovar Typhi
cgggugaucugcgccg

SEQ ID NO: 3643535 - RNA, 14 nt, Salmonella enterica enterica serovar Typhi
cgggugcagcguca

SEQ ID NO: 3643536 - RNA, 23 nt, Salmonella enterica enterica serovar Typhi
cgggugcauauacguugcggcgc

SEQ ID NO: 3643537 - RNA, 21 nt, Salmonella enterica enterica serovar Typhi
cgggugcgcagccccagcgcc

SEQ ID NO: 3643538 - RNA, 23 nt, Salmonella enterica enterica serovar Typhi
cgggugcgcagccccagcgccag

SEQ ID NO: 3643539 - RNA, 12 nt, Salmonella enterica enterica serovar Typhi
cgggugcggcgc

SEQ ID NO: 3643540 - RNA, 17 nt, Salmonella enterica enterica serovar Typhi
cggguggccuaacgcca

SEQ ID NO: 3643541 - RNA, 18 nt, Salmonella enterica enterica serovar Typhi
cggguggccuaacgccag

SEQ ID NO: 3643542 - RNA, 15 nt, Salmonella enterica enterica serovar Typhi
cggguuaaagcccug

SEQ ID NO: 3643543 - RNA, 15 nt, Salmonella enterica enterica serovar Typhi
cggguuagacucagc

SEQ ID NO: 3643544 - RNA, 12 nt, Salmonella enterica enterica serovar Typhi
cggguugcugau

SEQ ID NO: 3643545 - RNA, 20 nt, Salmonella enterica enterica serovar Typhi
cggguuuggucagguaagcu

SEQ ID NO: 3643546 - RNA, 12 nt, Salmonella enterica enterica serovar Typhi
cggguuuuccug

SEQ ID NO: 3643547 - RNA, 13 nt, Salmonella enterica enterica serovar Typhi
cgguaaacaccac

SEQ ID NO: 3643548 - RNA, 21 nt, Salmonella enterica enterica serovar Typhi
cgguaaaccuguuuguuuauu

SEQ ID NO: 3643549 - RNA, 17 nt, Salmonella enterica enterica serovar Typhi
cgguaaacgcucgccgu

SEQ ID NO: 3643550 - RNA, 18 nt, Salmonella enterica enterica serovar Typhi
cgguaaacgugccacagu

SEQ ID NO: 3643551 - RNA, 19 nt, Salmonella enterica enterica serovar Typhi
cgguaaacgugcuggaugg

SEQ ID NO: 3643552 - RNA, 21 nt, Salmonella enterica enterica serovar Typhi
cgguaaagacaccguucuggc

SEQ ID NO: 3643553 - RNA, 15 nt, Salmonella enterica enterica serovar Typhi
cgguaaaggcgaccg

SEQ ID NO: 3643554 - RNA, 19 nt, Salmonella enterica enterica serovar Typhi
cgguaaaggucgccgcauc

SEQ ID NO: 3643555 - RNA, 22 nt, Salmonella enterica enterica serovar Typhi
cgguaaauuucuugaucaaucu

SEQ ID NO: 3643556 - RNA, 23 nt, Salmonella enterica enterica serovar Typhi
cgguaacgacuuauuugcucagu

SEQ ID NO: 3643557 - RNA, 23 nt, Salmonella enterica enterica serovar Typhi
cgguaagaaugcgcgucaggcca

SEQ ID NO: 3643558 - RNA, 19 nt, Salmonella enterica enterica serovar Typhi
cgguaagagcguuacccag

SEQ ID NO: 3643559 - RNA, 15 nt, Salmonella enterica enterica serovar Typhi
cgguaagccaccaga

SEQ ID NO: 3643560 - RNA, 13 nt, Salmonella enterica enterica serovar Typhi
cgguaagccgaaa

SEQ ID NO: 3643561 - RNA, 17 nt, Salmonella enterica enterica serovar Typhi
cgguaagcgcagcgcca

SEQ ID NO: 3643562 - RNA, 18 nt, Salmonella enterica enterica serovar Typhi
cgguaagcgcagcgccac

SEQ ID NO: 3643563 - RNA, 19 nt, Salmonella enterica enterica serovar Typhi
cgguaagcgccugcugcgc

SEQ ID NO: 3643564 - RNA, 19 nt, Salmonella enterica enterica serovar Typhi
cgguaagcgcuagcgccac

SEQ ID NO: 3643565 - RNA, 20 nt, Salmonella enterica enterica serovar Typhi
cgguaagcuguuccggcuuc

SEQ ID NO: 3643566 - RNA, 16 nt, Salmonella enterica enterica serovar Typhi
cgguaagucugauaac

SEQ ID NO: 3643567 - RNA, 23 nt, Salmonella enterica enterica serovar Typhi
cgguaauauauuucacuucauca

SEQ ID NO: 3643568 - RNA, 21 nt, Salmonella enterica enterica serovar Typhi
cgguaaucaccagaucggcau

SEQ ID NO: 3643569 - RNA, 22 nt, Salmonella enterica enterica serovar Typhi
cgguaaucaccagaucggcauc

SEQ ID NO: 3643570 - RNA, 16 nt, Salmonella enterica enterica serovar Typhi
cgguaaucccuucacg

SEQ ID NO: 3643571 - RNA, 18 nt, Salmonella enterica enterica serovar Typhi
cgguaaucgccugccagc

SEQ ID NO: 3643572 - RNA, 18 nt, Salmonella enterica enterica serovar Typhi
cgguaaucugccagcuua

SEQ ID NO: 3643573 - RNA, 22 nt, Salmonella enterica enterica serovar Typhi
cgguaauugcuugcccgauggc

SEQ ID NO: 3643574 - RNA, 13 nt, Salmonella enterica enterica serovar Typhi
cgguaccggcauu

SEQ ID NO: 3643575 - RNA, 17 nt, Salmonella enterica enterica serovar Typhi
cgguacgcagcaggcag

SEQ ID NO: 3643576 - RNA, 18 nt, Salmonella enterica enterica serovar Typhi
cgguacgcgucugaauga

SEQ ID NO: 3643577 - RNA, 16 nt, Salmonella enterica enterica serovar Typhi
cgguacggaacgucca

SEQ ID NO: 3643578 - RNA, 17 nt, Salmonella enterica enterica serovar Typhi
cgguagagcgcggucag

SEQ ID NO: 3643579 - RNA, 19 nt, Salmonella enterica enterica serovar Typhi
cgguagagcgcggucaggu

SEQ ID NO: 3643580 - RNA, 22 nt, Salmonella enterica enterica serovar Typhi
cgguagcaaaggcuaccgggca

SEQ ID NO: 3643581 - RNA, 17 nt, Salmonella enterica enterica serovar Typhi
cgguagcacuuuaaaca

SEQ ID NO: 3643582 - RNA, 16 nt, Salmonella enterica enterica serovar Typhi
cgguagcuccagacag

SEQ ID NO: 3643583 - RNA, 13 nt, Salmonella enterica enterica serovar Typhi
cgguagguuuaaa

SEQ ID NO: 3643584 - RNA, 22 nt, Salmonella enterica enterica serovar Typhi
cgguaguccgccagcaccugau

SEQ ID NO: 3643585 - RNA, 14 nt, Salmonella enterica enterica serovar Typhi
cgguauaacugccu

SEQ ID NO: 3643586 - RNA, 16 nt, Salmonella enterica enterica serovar Typhi
cgguauccgcauucua

SEQ ID NO: 3643587 - RNA, 22 nt, Salmonella enterica enterica serovar Typhi
cgguaucgacaaccgccugcgu

SEQ ID NO: 3643588 - RNA, 23 nt, Salmonella enterica enterica serovar Typhi
cgguauuaucaauaguuaauuaa

SEQ ID NO: 3643589 - RNA, 15 nt, Salmonella enterica enterica serovar Typhi
cgguauuauccgccg

SEQ ID NO: 3643590 - RNA, 22 nt, Salmonella enterica enterica serovar Typhi
cgguauugugccgcgccugcca

SEQ ID NO: 3643591 - RNA, 20 nt, Salmonella enterica enterica serovar Typhi
cgguauuuuucaccucacuc

SEQ ID NO: 3643592 - RNA, 21 nt, Salmonella enterica enterica serovar Typhi
cggucaaaagcugcauccggg

SEQ ID NO: 3643593 - RNA, 18 nt, Salmonella enterica enterica serovar Typhi
cggucaacgcgccgccaa

SEQ ID NO: 3643594 - RNA, 12 nt, Salmonella enterica enterica serovar Typhi
cggucagccagc

SEQ ID NO: 3643595 - RNA, 15 nt, Salmonella enterica enterica serovar Typhi
cggucagcggcgcgc

SEQ ID NO: 3643596 - RNA, 22 nt, Salmonella enterica enterica serovar Typhi
cggucagcggcgcgccgcucga

SEQ ID NO: 3643597 - RNA, 22 nt, Salmonella enterica enterica serovar Typhi
cggucaggaagcggacuaccug

SEQ ID NO: 3643598 - RNA, 23 nt, Salmonella enterica enterica serovar Typhi
cggucagggcuuacucccuggug

SEQ ID NO: 3643599 - RNA, 19 nt, Salmonella enterica enterica serovar Typhi
cggucagggugaaucccgc

SEQ ID NO: 3643600 - RNA, 22 nt, Salmonella enterica enterica serovar Typhi
cggucagggugaaucccgccau

SEQ ID NO: 3643601 - RNA, 23 nt, Salmonella enterica enterica serovar Typhi
cggucagggugaaucccgccauc

SEQ ID NO: 3643602 - RNA, 14 nt, Salmonella enterica enterica serovar Typhi
cggucagguagcag

SEQ ID NO: 3643603 - RNA, 14 nt, Salmonella enterica enterica serovar Typhi
cggucaguacgccc

SEQ ID NO: 3643604 - RNA, 15 nt, Salmonella enterica enterica serovar Typhi
cggucauccagcggu

SEQ ID NO: 3643605 - RNA, 17 nt, Salmonella enterica enterica serovar Typhi
cggucauuaauccccgg

SEQ ID NO: 3643606 - RNA, 18 nt, Salmonella enterica enterica serovar Typhi
cggucauuaauccccggc

SEQ ID NO: 3643607 - RNA, 22 nt, Salmonella enterica enterica serovar Typhi
cggucauucauugucuuuuucu

SEQ ID NO: 3643608 - RNA, 21 nt, Salmonella enterica enterica serovar Typhi
cgguccggcgcuaaccagcgc

SEQ ID NO: 3643609 - RNA, 21 nt, Salmonella enterica enterica serovar Typhi
cgguccguuuucgcccccagc

SEQ ID NO: 3643610 - RNA, 17 nt, Salmonella enterica enterica serovar Typhi
cggucgagcguaauucc

SEQ ID NO: 3643611 - RNA, 22 nt, Salmonella enterica enterica serovar Typhi
cggucgagcuuuugcugcgcca

SEQ ID NO: 3643612 - RNA, 17 nt, Salmonella enterica enterica serovar Typhi
cggucgcgccagcgacc

SEQ ID NO: 3643613 - RNA, 13 nt, Salmonella enterica enterica serovar Typhi
cggucgcgcgcag

SEQ ID NO: 3643614 - RNA, 17 nt, Salmonella enterica enterica serovar Typhi
cggucgcggagaucauc

SEQ ID NO: 3643615 - RNA, 14 nt, Salmonella enterica enterica serovar Typhi
cggucggcgcguca

SEQ ID NO: 3643616 - RNA, 21 nt, Salmonella enterica enterica serovar Typhi
cggucgggauauaugcaaaac

SEQ ID NO: 3643617 - RNA, 23 nt, Salmonella enterica enterica serovar Typhi
cggucguaaacacgacgccgccg

SEQ ID NO: 3643618 - RNA, 13 nt, Salmonella enterica enterica serovar Typhi
cggucugacggcc

SEQ ID NO: 3643619 - RNA, 22 nt, Salmonella enterica enterica serovar Typhi
cggucugcuucagccacuggcu

SEQ ID NO: 3643620 - RNA, 15 nt, Salmonella enterica enterica serovar Typhi
cggucuggcgcauaa

SEQ ID NO: 3643621 - RNA, 15 nt, Salmonella enterica enterica serovar Typhi
cggucuuuuucgcag

SEQ ID NO: 3643622 - RNA, 13 nt, Salmonella enterica enterica serovar Typhi
cggugaagacgac

SEQ ID NO: 3643623 - RNA, 14 nt, Salmonella enterica enterica serovar Typhi
cggugaccugccuu

SEQ ID NO: 3643624 - RNA, 21 nt, Salmonella enterica enterica serovar Typhi
cggugaccugccuuucccauc

SEQ ID NO: 3643625 - RNA, 16 nt, Salmonella enterica enterica serovar Typhi
cggugacgcgaucguc

SEQ ID NO: 3643626 - RNA, 19 nt, Salmonella enterica enterica serovar Typhi
cggugacggaaaccagcau

SEQ ID NO: 3643627 - RNA, 19 nt, Salmonella enterica enterica serovar Typhi
cggugacgucaagaucgcg

SEQ ID NO: 3643628 - RNA, 14 nt, Salmonella enterica enterica serovar Typhi
cggugauauugugu

SEQ ID NO: 3643629 - RNA, 21 nt, Salmonella enterica enterica serovar Typhi
cggugaucccaggccggcaua

SEQ ID NO: 3643630 - RNA, 23 nt, Salmonella enterica enterica serovar Typhi
cggugaugaucaauaacgccggu

SEQ ID NO: 3643631 - RNA, 22 nt, Salmonella enterica enterica serovar Typhi
cggugaugcgccugucuccagc

SEQ ID NO: 3643632 - RNA, 17 nt, Salmonella enterica enterica serovar Typhi
cggugcagaccucugca

SEQ ID NO: 3643633 - RNA, 19 nt, Salmonella enterica enterica serovar Typhi
cggugccauuccagccggu

SEQ ID NO: 3643634 - RNA, 23 nt, Salmonella enterica enterica serovar Typhi
cggugccguuaauuuucacgcac

SEQ ID NO: 3643635 - RNA, 16 nt, Salmonella enterica enterica serovar Typhi
cggugccugccgccuc

SEQ ID NO: 3643636 - RNA, 21 nt, Salmonella enterica enterica serovar Typhi
cggugccuuguucgcagguca

SEQ ID NO: 3643637 - RNA, 22 nt, Salmonella enterica enterica serovar Typhi
cggugcgagaaaaagcaauaau

SEQ ID NO: 3643638 - RNA, 17 nt, Salmonella enterica enterica serovar Typhi
cggugcggcaagcgcgc

SEQ ID NO: 3643639 - RNA, 16 nt, Salmonella enterica enterica serovar Typhi
cggugcggucacaggc

SEQ ID NO: 3643640 - RNA, 19 nt, Salmonella enterica enterica serovar Typhi
cggugcggucacaggcaua

SEQ ID NO: 3643641 - RNA, 17 nt, Salmonella enterica enterica serovar Typhi
cggugcuguagcugccc

SEQ ID NO: 3643642 - RNA, 20 nt, Salmonella enterica enterica serovar Typhi
cggugcuguagcugcccgga

SEQ ID NO: 3643643 - RNA, 13 nt, Salmonella enterica enterica serovar Typhi
cgguggcgccacg

SEQ ID NO: 3643644 - RNA, 13 nt, Salmonella enterica enterica serovar Typhi
cgguggcgcugcg

SEQ ID NO: 3643645 - RNA, 16 nt, Salmonella enterica enterica serovar Typhi
cgguggcgcugugcuu

SEQ ID NO: 3643646 - RNA, 16 nt, Salmonella enterica enterica serovar Typhi
cgguggucaucgcggc

SEQ ID NO: 3643647 - RNA, 14 nt, Salmonella enterica enterica serovar Typhi
cgguguacagcgcg

SEQ ID NO: 3643648 - RNA, 15 nt, Salmonella enterica enterica serovar Typhi
cgguguaccccgccu

SEQ ID NO: 3643649 - RNA, 17 nt, Salmonella enterica enterica serovar Typhi
cggugucaaagcgccag

SEQ ID NO: 3643650 - RNA, 19 nt, Salmonella enterica enterica serovar Typhi
cggugucaaagcgccagau

SEQ ID NO: 3643651 - RNA, 14 nt, Salmonella enterica enterica serovar Typhi
cggugucagacacc

SEQ ID NO: 3643652 - RNA, 15 nt, Salmonella enterica enterica serovar Typhi
cgguguccaucaggc

SEQ ID NO: 3643653 - RNA, 14 nt, Salmonella enterica enterica serovar Typhi
cgguguccggcgca

SEQ ID NO: 3643654 - RNA, 18 nt, Salmonella enterica enterica serovar Typhi
cggugugaccagcgcguu

SEQ ID NO: 3643655 - RNA, 16 nt, Salmonella enterica enterica serovar Typhi
cgguguuaaccagaua

SEQ ID NO: 3643656 - RNA, 19 nt, Salmonella enterica enterica serovar Typhi
cgguguuuagacacauuga

SEQ ID NO: 3643657 - RNA, 19 nt, Salmonella enterica enterica serovar Typhi
cgguuaaaaacagccagca

SEQ ID NO: 3643658 - RNA, 13 nt, Salmonella enterica enterica serovar Typhi
cgguuaauacgcc

SEQ ID NO: 3643659 - RNA, 13 nt, Salmonella enterica enterica serovar Typhi
cgguuacuccuua

SEQ ID NO: 3643660 - RNA, 18 nt, Salmonella enterica enterica serovar Typhi
cgguuagccacaaugaca

SEQ ID NO: 3643661 - RNA, 14 nt, Salmonella enterica enterica serovar Typhi
cgguuauaaccgga

SEQ ID NO: 3643662 - RNA, 14 nt, Salmonella enterica enterica serovar Typhi
cgguuauaauaaua

SEQ ID NO: 3643663 - RNA, 16 nt, Salmonella enterica enterica serovar Typhi
cgguuauaccgccauc

SEQ ID NO: 3643664 - RNA, 20 nt, Salmonella enterica enterica serovar Typhi
cgguuauccgccagcgcaac

SEQ ID NO: 3643665 - RNA, 17 nt, Salmonella enterica enterica serovar Typhi
cgguuauccuccggguc

SEQ ID NO: 3643666 - RNA, 19 nt, Salmonella enterica enterica serovar Typhi
cgguuaucggcaaacgggc

SEQ ID NO: 3643667 - RNA, 19 nt, Salmonella enterica enterica serovar Typhi
cgguuaugaccaauggcgc

SEQ ID NO: 3643668 - RNA, 13 nt, Salmonella enterica enterica serovar Typhi
cgguuaugccugc

SEQ ID NO: 3643669 - RNA, 20 nt, Salmonella enterica enterica serovar Typhi
cgguuaugccugccagcauu

SEQ ID NO: 3643670 - RNA, 15 nt, Salmonella enterica enterica serovar Typhi
cgguuaugcgauuuc

SEQ ID NO: 3643671 - RNA, 13 nt, Salmonella enterica enterica serovar Typhi
cgguucaggcuua

SEQ ID NO: 3643672 - RNA, 16 nt, Salmonella enterica enterica serovar Typhi
cgguucaucuucgccu

SEQ ID NO: 3643673 - RNA, 15 nt, Salmonella enterica enterica serovar Typhi
cgguuccggggaaag

SEQ ID NO: 3643674 - RNA, 14 nt, Salmonella enterica enterica serovar Typhi
cgguucgccgcgcg

SEQ ID NO: 3643675 - RNA, 14 nt, Salmonella enterica enterica serovar Typhi
cgguucucccggca

SEQ ID NO: 3643676 - RNA, 15 nt, Salmonella enterica enterica serovar Typhi
cgguucucugccauc

SEQ ID NO: 3643677 - RNA, 22 nt, Salmonella enterica enterica serovar Typhi
cgguucuucccacuccgcccag

SEQ ID NO: 3643678 - RNA, 12 nt, Salmonella enterica enterica serovar Typhi
cgguugacgcug

SEQ ID NO: 3643679 - RNA, 13 nt, Salmonella enterica enterica serovar Typhi
cgguugcugauaa

SEQ ID NO: 3643680 - RNA, 22 nt, Salmonella enterica enterica serovar Typhi
cgguuggccagcauggcgguca

SEQ ID NO: 3643681 - RNA, 15 nt, Salmonella enterica enterica serovar Typhi
cgguuggcuccagua

SEQ ID NO: 3643682 - RNA, 17 nt, Salmonella enterica enterica serovar Typhi
cgguugggcagaaacgu

SEQ ID NO: 3643683 - RNA, 14 nt, Salmonella enterica enterica serovar Typhi
cgguuguucagugc

SEQ ID NO: 3643684 - RNA, 18 nt, Salmonella enterica enterica serovar Typhi
cgguuguuuacacggcaa

SEQ ID NO: 3643685 - RNA, 11 nt, Salmonella enterica enterica serovar Typhi
cgguuuauccc

SEQ ID NO: 3643686 - RNA, 20 nt, Salmonella enterica enterica serovar Typhi
cgguuucaacuuccaccacc

SEQ ID NO: 3643687 - RNA, 21 nt, Salmonella enterica enterica serovar Typhi
cgguuucaacuuccaccaccu

SEQ ID NO: 3643688 - RNA, 14 nt, Salmonella enterica enterica serovar Typhi
cgguuuccauggca

SEQ ID NO: 3643689 - RNA, 20 nt, Salmonella enterica enterica serovar Typhi
cgguuuccggcauccagcgc

SEQ ID NO: 3643690 - RNA, 16 nt, Salmonella enterica enterica serovar Typhi
cgguuucgcggcguuc

SEQ ID NO: 3643691 - RNA, 20 nt, Salmonella enterica enterica serovar Typhi
cgguuucuaccacccagcca

SEQ ID NO: 3643692 - RNA, 17 nt, Salmonella enterica enterica serovar Typhi
cgguuucuccagccucg

SEQ ID NO: 3643693 - RNA, 15 nt, Salmonella enterica enterica serovar Typhi
cgguuucugcgcgcu

SEQ ID NO: 3643694 - RNA, 19 nt, Salmonella enterica enterica serovar Typhi
cgguuuguaagugcccgga

SEQ ID NO: 3643695 - RNA, 22 nt, Salmonella enterica enterica serovar Typhi
cgguuuuauccccuucaggaau

SEQ ID NO: 3643696 - RNA, 21 nt, Salmonella enterica enterica serovar Typhi
cgguuuuauuaacgugcugcc

SEQ ID NO: 3643697 - RNA, 17 nt, Salmonella enterica enterica serovar Typhi
cgguuuugcgccauccu

SEQ ID NO: 3643698 - RNA, 16 nt, Salmonella enterica enterica serovar Typhi
cgguuuuuauggaagg

SEQ ID NO: 3643699 - RNA, 13 nt, Salmonella enterica enterica serovar Typhi
cgguuuuuccgcu

SEQ ID NO: 3643700 - RNA, 22 nt, Salmonella enterica enterica serovar Typhi
cgguuuuuuuguggccugcuua

SEQ ID NO: 3643701 - RNA, 14 nt, Salmonella enterica enterica serovar Typhi
cguaaaaccgcgcu

SEQ ID NO: 3643702 - RNA, 12 nt, Salmonella enterica enterica serovar Typhi
cguaaaacugca

SEQ ID NO: 3643703 - RNA, 18 nt, Salmonella enterica enterica serovar Typhi
cguaaaacugcaccaacg

SEQ ID NO: 3643704 - RNA, 15 nt, Salmonella enterica enterica serovar Typhi
cguaaaacuuuucug

SEQ ID NO: 3643705 - RNA, 13 nt, Salmonella enterica enterica serovar Typhi
cguaaaaucagca

SEQ ID NO: 3643706 - RNA, 15 nt, Salmonella enterica enterica serovar Typhi
cguaaaaucagcauc

SEQ ID NO: 3643707 - RNA, 18 nt, Salmonella enterica enterica serovar Typhi
cguaaacacguuaucuga

SEQ ID NO: 3643708 - RNA, 19 nt, Salmonella enterica enterica serovar Typhi
cguaaaccccuucaccgcu

SEQ ID NO: 3643709 - RNA, 16 nt, Salmonella enterica enterica serovar Typhi
cguaaacggcagccgc

SEQ ID NO: 3643710 - RNA, 19 nt, Salmonella enterica enterica serovar Typhi
cguaaacggcagccgccac

SEQ ID NO: 3643711 - RNA, 14 nt, Salmonella enterica enterica serovar Typhi
cguaaagccaucca

SEQ ID NO: 3643712 - RNA, 18 nt, Salmonella enterica enterica serovar Typhi
cguaaagcgcauccagcu

SEQ ID NO: 3643713 - RNA, 22 nt, Salmonella enterica enterica serovar Typhi
cguaaagggaagaucauuauca

SEQ ID NO: 3643714 - RNA, 17 nt, Salmonella enterica enterica serovar Typhi
cguaaauacccaggcca

SEQ ID NO: 3643715 - RNA, 19 nt, Salmonella enterica enterica serovar Typhi
cguaaauacccaggccauc

SEQ ID NO: 3643716 - RNA, 19 nt, Salmonella enterica enterica serovar Typhi
cguaaauccacauuccaga

SEQ ID NO: 3643717 - RNA, 23 nt, Salmonella enterica enterica serovar Typhi
cguaaauccuccaucaugggcgc

SEQ ID NO: 3643718 - RNA, 22 nt, Salmonella enterica enterica serovar Typhi
cguaaauuauuuuacgcgggau

SEQ ID NO: 3643719 - RNA, 20 nt, Salmonella enterica enterica serovar Typhi
cguaaauuccuuguuuuaac

SEQ ID NO: 3643720 - RNA, 23 nt, Salmonella enterica enterica serovar Typhi
cguaaauucucuauacugcugac

SEQ ID NO: 3643721 - RNA, 18 nt, Salmonella enterica enterica serovar Typhi
cguaacagacgcaucuuu

SEQ ID NO: 3643722 - RNA, 12 nt, Salmonella enterica enterica serovar Typhi
cguaacccagug

SEQ ID NO: 3643723 - RNA, 14 nt, Salmonella enterica enterica serovar Typhi
cguaaccgcaaaug

SEQ ID NO: 3643724 - RNA, 13 nt, Salmonella enterica enterica serovar Typhi
cguaaccgcagcg

SEQ ID NO: 3643725 - RNA, 16 nt, Salmonella enterica enterica serovar Typhi
cguaaccgcagcgccu

SEQ ID NO: 3643726 - RNA, 12 nt, Salmonella enterica enterica serovar Typhi
cguaacgccaca

SEQ ID NO: 3643727 - RNA, 15 nt, Salmonella enterica enterica serovar Typhi
cguaacguagcaauc

SEQ ID NO: 3643728 - RNA, 15 nt, Salmonella enterica enterica serovar Typhi
cguaacucggcagcg

SEQ ID NO: 3643729 - RNA, 18 nt, Salmonella enterica enterica serovar Typhi
cguaacuugauuccuggc

SEQ ID NO: 3643730 - RNA, 11 nt, Salmonella enterica enterica serovar Typhi
cguaagaaaag

SEQ ID NO: 3643731 - RNA, 14 nt, Salmonella enterica enterica serovar Typhi
cguaagaccagauu

SEQ ID NO: 3643732 - RNA, 14 nt, Salmonella enterica enterica serovar Typhi
cguaagaucccagg

SEQ ID NO: 3643733 - RNA, 20 nt, Salmonella enterica enterica serovar Typhi
cguaagccaguucucuucuu

SEQ ID NO: 3643734 - RNA, 14 nt, Salmonella enterica enterica serovar Typhi
cguaagcgacaucu

SEQ ID NO: 3643735 - RNA, 12 nt, Salmonella enterica enterica serovar Typhi
cguaagcgcguu

SEQ ID NO: 3643736 - RNA, 21 nt, Salmonella enterica enterica serovar Typhi
cguaagcgcuaugcccaccgc

SEQ ID NO: 3643737 - RNA, 16 nt, Salmonella enterica enterica serovar Typhi
cguaagucguaccggc

SEQ ID NO: 3643738 - RNA, 17 nt, Salmonella enterica enterica serovar Typhi
cguaauaaaauuuccca

SEQ ID NO: 3643739 - RNA, 15 nt, Salmonella enterica enterica serovar Typhi
cguaauacgaucuuc

SEQ ID NO: 3643740 - RNA, 19 nt, Salmonella enterica enterica serovar Typhi
cguaauacguaaaccgcuc

SEQ ID NO: 3643741 - RNA, 15 nt, Salmonella enterica enterica serovar Typhi
cguaauccggccugg

SEQ ID NO: 3643742 - RNA, 14 nt, Salmonella enterica enterica serovar Typhi
cguaaucggccugu

SEQ ID NO: 3643743 - RNA, 21 nt, Salmonella enterica enterica serovar Typhi
cguaaucuuuucauauuauuu

SEQ ID NO: 3643744 - RNA, 20 nt, Salmonella enterica enterica serovar Typhi
cguaaugagcgucgccagac

SEQ ID NO: 3643745 - RNA, 19 nt, Salmonella enterica enterica serovar Typhi
cguaaugccgaccagcguc

SEQ ID NO: 3643746 - RNA, 20 nt, Salmonella enterica enterica serovar Typhi
cguaaugcgccccggcggcg

SEQ ID NO: 3643747 - RNA, 17 nt, Salmonella enterica enterica serovar Typhi
cguaauggguaaaaaua

SEQ ID NO: 3643748 - RNA, 19 nt, Salmonella enterica enterica serovar Typhi
cguaauuaaccgcgccgcu

SEQ ID NO: 3643749 - RNA, 22 nt, Salmonella enterica enterica serovar Typhi
cguaauuaaccgcgccgcuggc

SEQ ID NO: 3643750 - RNA, 15 nt, Salmonella enterica enterica serovar Typhi
cguaauugcgccugg

SEQ ID NO: 3643751 - RNA, 17 nt, Salmonella enterica enterica serovar Typhi
cguaauuguugccccgc

SEQ ID NO: 3643752 - RNA, 20 nt, Salmonella enterica enterica serovar Typhi
cguaauuguugccccgcuuu

SEQ ID NO: 3643753 - RNA, 18 nt, Salmonella enterica enterica serovar Typhi
cguaauuucauagaccgc

SEQ ID NO: 3643754 - RNA, 18 nt, Salmonella enterica enterica serovar Typhi
cguaauuugcgacauggc

SEQ ID NO: 3643755 - RNA, 19 nt, Salmonella enterica enterica serovar Typhi
cguaauuugcgacauggcg

SEQ ID NO: 3643756 - RNA, 21 nt, Salmonella enterica enterica serovar Typhi
cguacacaggggccacaggcg

SEQ ID NO: 3643757 - RNA, 12 nt, Salmonella enterica enterica serovar Typhi
cguacagcgcca

SEQ ID NO: 3643758 - RNA, 19 nt, Salmonella enterica enterica serovar Typhi
cguacaggcggaaaucaac

SEQ ID NO: 3643759 - RNA, 12 nt, Salmonella enterica enterica serovar Typhi
cguacagguugu

SEQ ID NO: 3643760 - RNA, 20 nt, Salmonella enterica enterica serovar Typhi
cguacauguccagaucuuca

SEQ ID NO: 3643761 - RNA, 22 nt, Salmonella enterica enterica serovar Typhi
cguaccacgccgcacacagcag

SEQ ID NO: 3643762 - RNA, 13 nt, Salmonella enterica enterica serovar Typhi
cguaccagcgccc

SEQ ID NO: 3643763 - RNA, 17 nt, Salmonella enterica enterica serovar Typhi
cguaccaggcagcgcgc

SEQ ID NO: 3643764 - RNA, 13 nt, Salmonella enterica enterica serovar Typhi
cguaccccaaucu

SEQ ID NO: 3643765 - RNA, 21 nt, Salmonella enterica enterica serovar Typhi
cguacccggcuuacaacauug

SEQ ID NO: 3643766 - RNA, 16 nt, Salmonella enterica enterica serovar Typhi
cguaccgaagaacaua

SEQ ID NO: 3643767 - RNA, 20 nt, Salmonella enterica enterica serovar Typhi
cguaccgaagaacauaaaca

SEQ ID NO: 3643768 - RNA, 14 nt, Salmonella enterica enterica serovar Typhi
cguaccgcgcgccc

SEQ ID NO: 3643769 - RNA, 18 nt, Salmonella enterica enterica serovar Typhi
cguaccgcguuuaacgca

SEQ ID NO: 3643770 - RNA, 16 nt, Salmonella enterica enterica serovar Typhi
cguaccugcgcgcagg

SEQ ID NO: 3643771 - RNA, 13 nt, Salmonella enterica enterica serovar Typhi
cguacggaaggua

SEQ ID NO: 3643772 - RNA, 14 nt, Salmonella enterica enterica serovar Typhi
cguacggcuucaau

SEQ ID NO: 3643773 - RNA, 18 nt, Salmonella enterica enterica serovar Typhi
cguacgggcaaagcgacg

SEQ ID NO: 3643774 - RNA, 19 nt, Salmonella enterica enterica serovar Typhi
cguacuaaagagcgccuga

SEQ ID NO: 3643775 - RNA, 22 nt, Salmonella enterica enterica serovar Typhi
cguacuaaagagcgccugaccg

SEQ ID NO: 3643776 - RNA, 22 nt, Salmonella enterica enterica serovar Typhi
cguacucagaucggcagacagu

SEQ ID NO: 3643777 - RNA, 19 nt, Salmonella enterica enterica serovar Typhi
cguacucggauagcuacga

SEQ ID NO: 3643778 - RNA, 16 nt, Salmonella enterica enterica serovar Typhi
cguacucuaggcgcug

SEQ ID NO: 3643779 - RNA, 21 nt, Salmonella enterica enterica serovar Typhi
cguacugaaauaacucuggau

SEQ ID NO: 3643780 - RNA, 15 nt, Salmonella enterica enterica serovar Typhi
cguacuggucggcga

SEQ ID NO: 3643781 - RNA, 16 nt, Salmonella enterica enterica serovar Typhi
cguagaccgcccagga

SEQ ID NO: 3643782 - RNA, 22 nt, Salmonella enterica enterica serovar Typhi
cguagauauuccccacgccgac

SEQ ID NO: 3643783 - RNA, 12 nt, Salmonella enterica enterica serovar Typhi
cguagaucgcca

SEQ ID NO: 3643784 - RNA, 15 nt, Salmonella enterica enterica serovar Typhi
cguagaucuuuugcg

SEQ ID NO: 3643785 - RNA, 12 nt, Salmonella enterica enterica serovar Typhi
cguagcagcgcg

SEQ ID NO: 3643786 - RNA, 24 nt, Salmonella enterica enterica serovar Typhi
cguagcaucucuucgacaucuuca

SEQ ID NO: 3643787 - RNA, 21 nt, Salmonella enterica enterica serovar Typhi
cguagcccagcgccgcaucgc

SEQ ID NO: 3643788 - RNA, 16 nt, Salmonella enterica enterica serovar Typhi
cguagccgcagaacca

SEQ ID NO: 3643789 - RNA, 12 nt, Salmonella enterica enterica serovar Typhi
cguagccgcgcg

SEQ ID NO: 3643790 - RNA, 14 nt, Salmonella enterica enterica serovar Typhi
cguagccgcgcgcc

SEQ ID NO: 3643791 - RNA, 12 nt, Salmonella enterica enterica serovar Typhi
cguagcgccaac

SEQ ID NO: 3643792 - RNA, 14 nt, Salmonella enterica enterica serovar Typhi
cguagcgccauccg

SEQ ID NO: 3643793 - RNA, 20 nt, Salmonella enterica enterica serovar Typhi
cguagcgcgcggauauggcg

SEQ ID NO: 3643794 - RNA, 15 nt, Salmonella enterica enterica serovar Typhi
cguagcgcguucagg

SEQ ID NO: 3643795 - RNA, 20 nt, Salmonella enterica enterica serovar Typhi
cguagcguaaugcagcgucu

SEQ ID NO: 3643796 - RNA, 13 nt, Salmonella enterica enterica serovar Typhi
cguagcgucaaca

SEQ ID NO: 3643797 - RNA, 17 nt, Salmonella enterica enterica serovar Typhi
cguagcguugccaaaag

SEQ ID NO: 3643798 - RNA, 13 nt, Salmonella enterica enterica serovar Typhi
cguagcuccagac

SEQ ID NO: 3643799 - RNA, 20 nt, Salmonella enterica enterica serovar Typhi
cguaggccgaauaagacgcu

SEQ ID NO: 3643800 - RNA, 17 nt, Salmonella enterica enterica serovar Typhi
cguaggccggaagacgu

SEQ ID NO: 3643801 - RNA, 19 nt, Salmonella enterica enterica serovar Typhi
cguaggccggauaagacgc

SEQ ID NO: 3643802 - RNA, 20 nt, Salmonella enterica enterica serovar Typhi
cguaggccggauaagacgcg

SEQ ID NO: 3643803 - RNA, 18 nt, Salmonella enterica enterica serovar Typhi
cguaggccggauaaggcg

SEQ ID NO: 3643804 - RNA, 18 nt, Salmonella enterica enterica serovar Typhi
cguaggccugauaagcgc

SEQ ID NO: 3643805 - RNA, 23 nt, Salmonella enterica enterica serovar Typhi
cguaggguacagagguaagaugu

SEQ ID NO: 3643806 - RNA, 19 nt, Salmonella enterica enterica serovar Typhi
cguaggguagaucacgcca

SEQ ID NO: 3643807 - RNA, 24 nt, Salmonella enterica enterica serovar Typhi
cguaggguagaucacgccagcgcu

SEQ ID NO: 3643808 - RNA, 13 nt, Salmonella enterica enterica serovar Typhi
cguagguaagaua

SEQ ID NO: 3643809 - RNA, 13 nt, Salmonella enterica enterica serovar Typhi
cguaguacgcgcg

SEQ ID NO: 3643810 - RNA, 13 nt, Salmonella enterica enterica serovar Typhi
cguaguacguucc

SEQ ID NO: 3643811 - RNA, 18 nt, Salmonella enterica enterica serovar Typhi
cguaguagguauccagca

SEQ ID NO: 3643812 - RNA, 17 nt, Salmonella enterica enterica serovar Typhi
cguagugcuucucuuca

SEQ ID NO: 3643813 - RNA, 15 nt, Salmonella enterica enterica serovar Typhi
cguaguggcauggca

SEQ ID NO: 3643814 - RNA, 14 nt, Salmonella enterica enterica serovar Typhi
cguauaauuaagcu

SEQ ID NO: 3643815 - RNA, 16 nt, Salmonella enterica enterica serovar Typhi
cguauagcccagaauc

SEQ ID NO: 3643816 - RNA, 18 nt, Salmonella enterica enterica serovar Typhi
cguauaucgcgauaaacu

SEQ ID NO: 3643817 - RNA, 19 nt, Salmonella enterica enterica serovar Typhi
cguauccccagucuuccug

SEQ ID NO: 3643818 - RNA, 21 nt, Salmonella enterica enterica serovar Typhi
cguaucgcucaggagcgccug

SEQ ID NO: 3643819 - RNA, 14 nt, Salmonella enterica enterica serovar Typhi
cguaucuuccagcg

SEQ ID NO: 3643820 - RNA, 22 nt, Salmonella enterica enterica serovar Typhi
cguaucuuccggugugaccagc

SEQ ID NO: 3643821 - RNA, 14 nt, Salmonella enterica enterica serovar Typhi
cguauggcgucgug

SEQ ID NO: 3643822 - RNA, 22 nt, Salmonella enterica enterica serovar Typhi
cguauuaagccaacguugaaaa

SEQ ID NO: 3643823 - RNA, 19 nt, Salmonella enterica enterica serovar Typhi
cguauuaauugcuuugcaa

SEQ ID NO: 3643824 - RNA, 12 nt, Salmonella enterica enterica serovar Typhi
cguauuacaagu

SEQ ID NO: 3643825 - RNA, 20 nt, Salmonella enterica enterica serovar Typhi
cguauuaucaaaucuucauu

SEQ ID NO: 3643826 - RNA, 15 nt, Salmonella enterica enterica serovar Typhi
cguauuauccacccc

SEQ ID NO: 3643827 - RNA, 16 nt, Salmonella enterica enterica serovar Typhi
cguauucaccucccug

SEQ ID NO: 3643828 - RNA, 19 nt, Salmonella enterica enterica serovar Typhi
cguauuccacggaauacga

SEQ ID NO: 3643829 - RNA, 17 nt, Salmonella enterica enterica serovar Typhi
cguauucggaauaaugu

SEQ ID NO: 3643830 - RNA, 19 nt, Salmonella enterica enterica serovar Typhi
cguauucucaaccagccga

SEQ ID NO: 3643831 - RNA, 14 nt, Salmonella enterica enterica serovar Typhi
cguauugagcugga

SEQ ID NO: 3643832 - RNA, 18 nt, Salmonella enterica enterica serovar Typhi
cguauugcauaaugccug

SEQ ID NO: 3643833 - RNA, 20 nt, Salmonella enterica enterica serovar Typhi
cguauugccggauaagacgc

SEQ ID NO: 3643834 - RNA, 21 nt, Salmonella enterica enterica serovar Typhi
cguauugccggauaagacgca

SEQ ID NO: 3643835 - RNA, 17 nt, Salmonella enterica enterica serovar Typhi
cguauuucacuuuugcc

SEQ ID NO: 3643836 - RNA, 17 nt, Salmonella enterica enterica serovar Typhi
cguauuuuauuuuucaa

SEQ ID NO: 3643837 - RNA, 12 nt, Salmonella enterica enterica serovar Typhi
cgucaaaacagg

SEQ ID NO: 3643838 - RNA, 13 nt, Salmonella enterica enterica serovar Typhi
cgucaaaacgcgc

SEQ ID NO: 3643839 - RNA, 15 nt, Salmonella enterica enterica serovar Typhi
cgucaaaacgcgcau

SEQ ID NO: 3643840 - RNA, 12 nt, Salmonella enterica enterica serovar Typhi
cgucaaaccggc

SEQ ID NO: 3643841 - RNA, 13 nt, Salmonella enterica enterica serovar Typhi
cgucaaacgucca

SEQ ID NO: 3643842 - RNA, 13 nt, Salmonella enterica enterica serovar Typhi
cgucaaagaaaac

SEQ ID NO: 3643843 - RNA, 21 nt, Salmonella enterica enterica serovar Typhi
cgucaaauagagaaaauaaca

SEQ ID NO: 3643844 - RNA, 12 nt, Salmonella enterica enterica serovar Typhi
cgucaagacgcu

SEQ ID NO: 3643845 - RNA, 14 nt, Salmonella enterica enterica serovar Typhi
cgucaagaucgcgc

SEQ ID NO: 3643846 - RNA, 19 nt, Salmonella enterica enterica serovar Typhi
cgucaaguagccaguuuuc

SEQ ID NO: 3643847 - RNA, 19 nt, Salmonella enterica enterica serovar Typhi
cgucaauaaucgcgcgcgu

SEQ ID NO: 3643848 - RNA, 15 nt, Salmonella enterica enterica serovar Typhi
cgucaaugcugcuuu

SEQ ID NO: 3643849 - RNA, 15 nt, Salmonella enterica enterica serovar Typhi
cgucaaugugaaucc

SEQ ID NO: 3643850 - RNA, 22 nt, Salmonella enterica enterica serovar Typhi
cgucaaugugaauccaggccag

SEQ ID NO: 3643851 - RNA, 19 nt, Salmonella enterica enterica serovar Typhi
cgucacaagcucacaacga

SEQ ID NO: 3643852 - RNA, 13 nt, Salmonella enterica enterica serovar Typhi
cgucacaaucgcg

SEQ ID NO: 3643853 - RNA, 14 nt, Salmonella enterica enterica serovar Typhi
cgucacaaucgcgc

SEQ ID NO: 3643854 - RNA, 14 nt, Salmonella enterica enterica serovar Typhi
cgucacagaccccg

SEQ ID NO: 3643855 - RNA, 18 nt, Salmonella enterica enterica serovar Typhi
cgucaccaccgcaggcag

SEQ ID NO: 3643856 - RNA, 13 nt, Salmonella enterica enterica serovar Typhi
cgucaccagcagg

SEQ ID NO: 3643857 - RNA, 16 nt, Salmonella enterica enterica serovar Typhi
cgucacccgccggcag

SEQ ID NO: 3643858 - RNA, 17 nt, Salmonella enterica enterica serovar Typhi
cgucacccgccggcagc

SEQ ID NO: 3643859 - RNA, 19 nt, Salmonella enterica enterica serovar Typhi
cgucacccgccggcagcag

SEQ ID NO: 3643860 - RNA, 21 nt, Salmonella enterica enterica serovar Typhi
cgucacccgccggcagcagcu

SEQ ID NO: 3643861 - RNA, 20 nt, Salmonella enterica enterica serovar Typhi
cgucacccuauuuugcgccu

SEQ ID NO: 3643862 - RNA, 15 nt, Salmonella enterica enterica serovar Typhi
cgucaccgccgcgcu

SEQ ID NO: 3643863 - RNA, 18 nt, Salmonella enterica enterica serovar Typhi
cgucaccgggcugcagcc

SEQ ID NO: 3643864 - RNA, 18 nt, Salmonella enterica enterica serovar Typhi
cgucaccugauagcgggu

SEQ ID NO: 3643865 - RNA, 19 nt, Salmonella enterica enterica serovar Typhi
cgucacgaaugucgcguca

SEQ ID NO: 3643866 - RNA, 12 nt, Salmonella enterica enterica serovar Typhi
cgucacgaccgg

SEQ ID NO: 3643867 - RNA, 14 nt, Salmonella enterica enterica serovar Typhi
cgucacgaccggcg

SEQ ID NO: 3643868 - RNA, 15 nt, Salmonella enterica enterica serovar Typhi
cgucacgccaucagg

SEQ ID NO: 3643869 - RNA, 17 nt, Salmonella enterica enterica serovar Typhi
cgucacgccgacgaccg

SEQ ID NO: 3643870 - RNA, 16 nt, Salmonella enterica enterica serovar Typhi
cgucacgucagcgucg

SEQ ID NO: 3643871 - RNA, 18 nt, Salmonella enterica enterica serovar Typhi
cgucacguuauaccacug

SEQ ID NO: 3643872 - RNA, 18 nt, Salmonella enterica enterica serovar Typhi
cgucacugaaccugccuu

SEQ ID NO: 3643873 - RNA, 22 nt, Salmonella enterica enterica serovar Typhi
cgucacuuccggaugcgccuca

SEQ ID NO: 3643874 - RNA, 13 nt, Salmonella enterica enterica serovar Typhi
cgucacuuuauca

SEQ ID NO: 3643875 - RNA, 15 nt, Salmonella enterica enterica serovar Typhi
cgucagacaggccug

SEQ ID NO: 3643876 - RNA, 19 nt, Salmonella enterica enterica serovar Typhi
cgucagacaggccugguua

SEQ ID NO: 3643877 - RNA, 18 nt, Salmonella enterica enterica serovar Typhi
cgucagaccggcaaucaa

SEQ ID NO: 3643878 - RNA, 17 nt, Salmonella enterica enterica serovar Typhi
cgucagacggcuccagc

SEQ ID NO: 3643879 - RNA, 19 nt, Salmonella enterica enterica serovar Typhi
cgucagacggcuccagcgc

SEQ ID NO: 3643880 - RNA, 22 nt, Salmonella enterica enterica serovar Typhi
cgucagaugcguuuucugcauu

SEQ ID NO: 3643881 - RNA, 11 nt, Salmonella enterica enterica serovar Typhi
cgucagauucu

SEQ ID NO: 3643882 - RNA, 17 nt, Salmonella enterica enterica serovar Typhi
cgucagcacgccgcccg

SEQ ID NO: 3643883 - RNA, 20 nt, Salmonella enterica enterica serovar Typhi
cgucagccacuucuuccagc

SEQ ID NO: 3643884 - RNA, 23 nt, Salmonella enterica enterica serovar Typhi
cgucagccacuucuuccagcggc

SEQ ID NO: 3643885 - RNA, 21 nt, Salmonella enterica enterica serovar Typhi
cgucagccccguacaaggucg

SEQ ID NO: 3643886 - RNA, 20 nt, Salmonella enterica enterica serovar Typhi
cgucagcgaccauugcguau

SEQ ID NO: 3643887 - RNA, 19 nt, Salmonella enterica enterica serovar Typhi
cgucagcgcauaccggcca

SEQ ID NO: 3643888 - RNA, 18 nt, Salmonella enterica enterica serovar Typhi
cgucagcgcccgauaaau

SEQ ID NO: 3643889 - RNA, 15 nt, Salmonella enterica enterica serovar Typhi
cgucagcgccuccgc

SEQ ID NO: 3643890 - RNA, 18 nt, Salmonella enterica enterica serovar Typhi
cgucaggaucguaacagg

SEQ ID NO: 3643891 - RNA, 20 nt, Salmonella enterica enterica serovar Typhi
cgucaggccgccgcaaaagc

SEQ ID NO: 3643892 - RNA, 21 nt, Salmonella enterica enterica serovar Typhi
cgucaggccgccgcaaaagcc

SEQ ID NO: 3643893 - RNA, 18 nt, Salmonella enterica enterica serovar Typhi
cgucaggccgccgcacag

SEQ ID NO: 3643894 - RNA, 19 nt, Salmonella enterica enterica serovar Typhi
cgucaggccgccgcacagg

SEQ ID NO: 3643895 - RNA, 20 nt, Salmonella enterica enterica serovar Typhi
cgucaggcgaaguuccgggc

SEQ ID NO: 3643896 - RNA, 17 nt, Salmonella enterica enterica serovar Typhi
cgucaggguaugucggu

SEQ ID NO: 3643897 - RNA, 18 nt, Salmonella enterica enterica serovar Typhi
cgucagguuuaaucggcg

SEQ ID NO: 3643898 - RNA, 15 nt, Salmonella enterica enterica serovar Typhi
cgucaguaaaagccc

SEQ ID NO: 3643899 - RNA, 18 nt, Salmonella enterica enterica serovar Typhi
cgucaguaaaagcccgcc

SEQ ID NO: 3643900 - RNA, 20 nt, Salmonella enterica enterica serovar Typhi
cgucaguaaacuuucagacc

SEQ ID NO: 3643901 - RNA, 16 nt, Salmonella enterica enterica serovar Typhi
cgucaguaccagcgag

SEQ ID NO: 3643902 - RNA, 22 nt, Salmonella enterica enterica serovar Typhi
cgucaguaccagcgagauaacc

SEQ ID NO: 3643903 - RNA, 15 nt, Salmonella enterica enterica serovar Typhi
cgucagucgccagaa

SEQ ID NO: 3643904 - RNA, 21 nt, Salmonella enterica enterica serovar Typhi
cgucagugagcccuccuccag

SEQ ID NO: 3643905 - RNA, 17 nt, Salmonella enterica enterica serovar Typhi
cgucauaucauccagcc

SEQ ID NO: 3643906 - RNA, 21 nt, Salmonella enterica enterica serovar Typhi
cgucaucaggcguuguaauaa

SEQ ID NO: 3643907 - RNA, 12 nt, Salmonella enterica enterica serovar Typhi
cgucaucaugcu

SEQ ID NO: 3643908 - RNA, 12 nt, Salmonella enterica enterica serovar Typhi
cgucaucccggu

SEQ ID NO: 3643909 - RNA, 13 nt, Salmonella enterica enterica serovar Typhi
cgucauccggcaa

SEQ ID NO: 3643910 - RNA, 19 nt, Salmonella enterica enterica serovar Typhi
cgucauccggcaagcgcug

SEQ ID NO: 3643911 - RNA, 14 nt, Salmonella enterica enterica serovar Typhi
cgucauccggcaua

SEQ ID NO: 3643912 - RNA, 13 nt, Salmonella enterica enterica serovar Typhi
cgucauccuccug

SEQ ID NO: 3643913 - RNA, 13 nt, Salmonella enterica enterica serovar Typhi
cgucauccugcaa

SEQ ID NO: 3643914 - RNA, 18 nt, Salmonella enterica enterica serovar Typhi
cgucaucgcccagguugu

SEQ ID NO: 3643915 - RNA, 20 nt, Salmonella enterica enterica serovar Typhi
cgucaucgcuccagacggcg

SEQ ID NO: 3643916 - RNA, 21 nt, Salmonella enterica enterica serovar Typhi
cgucaucgcuccagacggcgc

SEQ ID NO: 3643917 - RNA, 15 nt, Salmonella enterica enterica serovar Typhi
cgucaucgcuucuau

SEQ ID NO: 3643918 - RNA, 23 nt, Salmonella enterica enterica serovar Typhi
cgucaugauguuugucuuuucca

SEQ ID NO: 3643919 - RNA, 13 nt, Salmonella enterica enterica serovar Typhi
cgucaugccgcca

SEQ ID NO: 3643920 - RNA, 22 nt, Salmonella enterica enterica serovar Typhi
cgucaugcuucaccucagcaaa

SEQ ID NO: 3643921 - RNA, 13 nt, Salmonella enterica enterica serovar Typhi
cgucauuuaccag

SEQ ID NO: 3643922 - RNA, 13 nt, Salmonella enterica enterica serovar Typhi
cgucauuuacugc

SEQ ID NO: 3643923 - RNA, 14 nt, Salmonella enterica enterica serovar Typhi
cgucauuuccggcg

SEQ ID NO: 3643924 - RNA, 22 nt, Salmonella enterica enterica serovar Typhi
cguccaacuggcuuucauccaa

SEQ ID NO: 3643925 - RNA, 21 nt, Salmonella enterica enterica serovar Typhi
cguccacacgccuggccaggc

SEQ ID NO: 3643926 - RNA, 13 nt, Salmonella enterica enterica serovar Typhi
cguccacauccag

SEQ ID NO: 3643927 - RNA, 19 nt, Salmonella enterica enterica serovar Typhi
cguccacauccagcgccag

SEQ ID NO: 3643928 - RNA, 15 nt, Salmonella enterica enterica serovar Typhi
cguccacauccccgc

SEQ ID NO: 3643929 - RNA, 22 nt, Salmonella enterica enterica serovar Typhi
cguccacggauauuuaccgccg

SEQ ID NO: 3643930 - RNA, 12 nt, Salmonella enterica enterica serovar Typhi
cguccacucuuc

SEQ ID NO: 3643931 - RNA, 14 nt, Salmonella enterica enterica serovar Typhi
cguccacucuuccg

SEQ ID NO: 3643932 - RNA, 19 nt, Salmonella enterica enterica serovar Typhi
cguccacucuuccgggcga

SEQ ID NO: 3643933 - RNA, 21 nt, Salmonella enterica enterica serovar Typhi
cguccagauaaugaucaacgc

SEQ ID NO: 3643934 - RNA, 22 nt, Salmonella enterica enterica serovar Typhi
cguccagauacgcgccggccgg

SEQ ID NO: 3643935 - RNA, 19 nt, Salmonella enterica enterica serovar Typhi
cguccagcgcgugaaccgu

SEQ ID NO: 3643936 - RNA, 11 nt, Salmonella enterica enterica serovar Typhi
cguccagcggc

SEQ ID NO: 3643937 - RNA, 19 nt, Salmonella enterica enterica serovar Typhi
cguccaggccugauaagca

SEQ ID NO: 3643938 - RNA, 12 nt, Salmonella enterica enterica serovar Typhi
cguccaggcucg

SEQ ID NO: 3643939 - RNA, 23 nt, Salmonella enterica enterica serovar Typhi
cguccaguccugucccugccagc

SEQ ID NO: 3643940 - RNA, 19 nt, Salmonella enterica enterica serovar Typhi
cguccaguguccgcuguua

SEQ ID NO: 3643941 - RNA, 14 nt, Salmonella enterica enterica serovar Typhi
cguccauaagcgcg

SEQ ID NO: 3643942 - RNA, 16 nt, Salmonella enterica enterica serovar Typhi
cguccauaagcgcggc

SEQ ID NO: 3643943 - RNA, 20 nt, Salmonella enterica enterica serovar Typhi
cgucccaccacgcagccaug

SEQ ID NO: 3643944 - RNA, 15 nt, Salmonella enterica enterica serovar Typhi
cgucccacgcgccgc

SEQ ID NO: 3643945 - RNA, 23 nt, Salmonella enterica enterica serovar Typhi
cgucccacgcgccgccgaacaga

SEQ ID NO: 3643946 - RNA, 13 nt, Salmonella enterica enterica serovar Typhi
cgucccagcgcac

SEQ ID NO: 3643947 - RNA, 20 nt, Salmonella enterica enterica serovar Typhi
cgucccaugacgacagguuu

SEQ ID NO: 3643948 - RNA, 18 nt, Salmonella enterica enterica serovar Typhi
cguccccagccagagauc

SEQ ID NO: 3643949 - RNA, 16 nt, Salmonella enterica enterica serovar Typhi
cguccccguucugacc

SEQ ID NO: 3643950 - RNA, 17 nt, Salmonella enterica enterica serovar Typhi
cguccccuauacgccau

SEQ ID NO: 3643951 - RNA, 13 nt, Salmonella enterica enterica serovar Typhi
cguccccugcggu

SEQ ID NO: 3643952 - RNA, 18 nt, Salmonella enterica enterica serovar Typhi
cguccccuggacgcgagc

SEQ ID NO: 3643953 - RNA, 19 nt, Salmonella enterica enterica serovar Typhi
cgucccguuuuucccgcug

SEQ ID NO: 3643954 - RNA, 13 nt, Salmonella enterica enterica serovar Typhi
cgucccucgccgg

SEQ ID NO: 3643955 - RNA, 15 nt, Salmonella enterica enterica serovar Typhi
cgucccugccacagu

SEQ ID NO: 3643956 - RNA, 19 nt, Salmonella enterica enterica serovar Typhi
cgucccuuucccuuccagc

SEQ ID NO: 3643957 - RNA, 22 nt, Salmonella enterica enterica serovar Typhi
cguccgauggacucccaggugu

SEQ ID NO: 3643958 - RNA, 16 nt, Salmonella enterica enterica serovar Typhi
cguccgccagaugcac

SEQ ID NO: 3643959 - RNA, 14 nt, Salmonella enterica enterica serovar Typhi
cguccgccaggccc

SEQ ID NO: 3643960 - RNA, 12 nt, Salmonella enterica enterica serovar Typhi
cguccgccuccg

SEQ ID NO: 3643961 - RNA, 22 nt, Salmonella enterica enterica serovar Typhi
cguccgcuaaucucgaccuggc

SEQ ID NO: 3643962 - RNA, 16 nt, Salmonella enterica enterica serovar Typhi
cguccggaaaauccuc

SEQ ID NO: 3643963 - RNA, 12 nt, Salmonella enterica enterica serovar Typhi
cguccggcugcc

SEQ ID NO: 3643964 - RNA, 20 nt, Salmonella enterica enterica serovar Typhi
cguccgucagauccgcaaga

SEQ ID NO: 3643965 - RNA, 21 nt, Salmonella enterica enterica serovar Typhi
cguccugaaucgcuugcgcgu

SEQ ID NO: 3643966 - RNA, 12 nt, Salmonella enterica enterica serovar Typhi
cguccugcggcu

SEQ ID NO: 3643967 - RNA, 20 nt, Salmonella enterica enterica serovar Typhi
cguccuucacguuauucgga

SEQ ID NO: 3643968 - RNA, 22 nt, Salmonella enterica enterica serovar Typhi
cgucgaacugaauagucggcug

SEQ ID NO: 3643969 - RNA, 20 nt, Salmonella enterica enterica serovar Typhi
cgucgacaaagccgacgcca

SEQ ID NO: 3643970 - RNA, 19 nt, Salmonella enterica enterica serovar Typhi
cgucgaccauacgcagcau

SEQ ID NO: 3643971 - RNA, 15 nt, Salmonella enterica enterica serovar Typhi
cgucgacgccuucca

SEQ ID NO: 3643972 - RNA, 22 nt, Salmonella enterica enterica serovar Typhi
cgucgaggaagcugcgcagcac

SEQ ID NO: 3643973 - RNA, 13 nt, Salmonella enterica enterica serovar Typhi
cgucgcacgaauc

SEQ ID NO: 3643974 - RNA, 14 nt, Salmonella enterica enterica serovar Typhi
cgucgccaaagcag

SEQ ID NO: 3643975 - RNA, 15 nt, Salmonella enterica enterica serovar Typhi
cgucgccaaucagca

SEQ ID NO: 3643976 - RNA, 19 nt, Salmonella enterica enterica serovar Typhi
cgucgccagacccagcgcu

SEQ ID NO: 3643977 - RNA, 14 nt, Salmonella enterica enterica serovar Typhi
cgucgccagcaacg

SEQ ID NO: 3643978 - RNA, 14 nt, Salmonella enterica enterica serovar Typhi
cgucgccagcgucu

SEQ ID NO: 3643979 - RNA, 14 nt, Salmonella enterica enterica serovar Typhi
cgucgccagggcgg

SEQ ID NO: 3643980 - RNA, 22 nt, Salmonella enterica enterica serovar Typhi
cgucgccauauccaagccccuc

SEQ ID NO: 3643981 - RNA, 17 nt, Salmonella enterica enterica serovar Typhi
cgucgccggaaugcgaa

SEQ ID NO: 3643982 - RNA, 21 nt, Salmonella enterica enterica serovar Typhi
cgucgccuguuucugcgccgc

SEQ ID NO: 3643983 - RNA, 18 nt, Salmonella enterica enterica serovar Typhi
cgucgcgaauaauuauuu

SEQ ID NO: 3643984 - RNA, 13 nt, Salmonella enterica enterica serovar Typhi
cgucgcgaaucgu

SEQ ID NO: 3643985 - RNA, 15 nt, Salmonella enterica enterica serovar Typhi
cgucgcgacguccgc

SEQ ID NO: 3643986 - RNA, 15 nt, Salmonella enterica enterica serovar Typhi
cgucgcgaucacaga

SEQ ID NO: 3643987 - RNA, 14 nt, Salmonella enterica enterica serovar Typhi
cgucgcgcgccgcc

SEQ ID NO: 3643988 - RNA, 16 nt, Salmonella enterica enterica serovar Typhi
cgucgcgcgccgccuc

SEQ ID NO: 3643989 - RNA, 14 nt, Salmonella enterica enterica serovar Typhi
cgucgcgcgcugug

SEQ ID NO: 3643990 - RNA, 18 nt, Salmonella enterica enterica serovar Typhi
cgucgcguucagcgccug

SEQ ID NO: 3643991 - RNA, 23 nt, Salmonella enterica enterica serovar Typhi
cgucgggccgcgcugcgccugcu

SEQ ID NO: 3643992 - RNA, 17 nt, Salmonella enterica enterica serovar Typhi
cgucgggggcgacaaac

SEQ ID NO: 3643993 - RNA, 16 nt, Salmonella enterica enterica serovar Typhi
cgucggugcugccgcu

SEQ ID NO: 3643994 - RNA, 14 nt, Salmonella enterica enterica serovar Typhi
cgucguaaaaccug

SEQ ID NO: 3643995 - RNA, 15 nt, Salmonella enterica enterica serovar Typhi
cgucguaaaaccugc

SEQ ID NO: 3643996 - RNA, 21 nt, Salmonella enterica enterica serovar Typhi
cgucguacucaccaguccggc

SEQ ID NO: 3643997 - RNA, 23 nt, Salmonella enterica enterica serovar Typhi
cgucgucaaaggaauagccgcgc

SEQ ID NO: 3643998 - RNA, 15 nt, Salmonella enterica enterica serovar Typhi
cgucgucccaggcca

SEQ ID NO: 3643999 - RNA, 22 nt, Salmonella enterica enterica serovar Typhi
cgucgucccgcgaguacgcaca

SEQ ID NO: 3644000 - RNA, 15 nt, Salmonella enterica enterica serovar Typhi
cgucgucggugggcu

SEQ ID NO: 3644001 - RNA, 17 nt, Salmonella enterica enterica serovar Typhi
cgucgugcagcgccgcc

SEQ ID NO: 3644002 - RNA, 22 nt, Salmonella enterica enterica serovar Typhi
cgucguuaacaucaucaggccu

SEQ ID NO: 3644003 - RNA, 22 nt, Salmonella enterica enterica serovar Typhi
cgucguuacccuccugcaaucc

SEQ ID NO: 3644004 - RNA, 15 nt, Salmonella enterica enterica serovar Typhi
cgucguuccgccagg

SEQ ID NO: 3644005 - RNA, 14 nt, Salmonella enterica enterica serovar Typhi
cgucguugccuuug

SEQ ID NO: 3644006 - RNA, 17 nt, Salmonella enterica enterica serovar Typhi
cgucguuucguguuguc

SEQ ID NO: 3644007 - RNA, 19 nt, Salmonella enterica enterica serovar Typhi
cgucuccagacaauccgcg

SEQ ID NO: 3644008 - RNA, 15 nt, Salmonella enterica enterica serovar Typhi
cgucucccaaaugaa

SEQ ID NO: 3644009 - RNA, 21 nt, Salmonella enterica enterica serovar Typhi
cgucuccggcgcgccgcuggc

SEQ ID NO: 3644010 - RNA, 15 nt, Salmonella enterica enterica serovar Typhi
cgucucgauacgcug

SEQ ID NO: 3644011 - RNA, 14 nt, Salmonella enterica enterica serovar Typhi
cgucucggccuggc

SEQ ID NO: 3644012 - RNA, 22 nt, Salmonella enterica enterica serovar Typhi
cgucugcaaugguaaaacgcug

SEQ ID NO: 3644013 - RNA, 16 nt, Salmonella enterica enterica serovar Typhi
cgucugcccuccugaa

SEQ ID NO: 3644014 - RNA, 14 nt, Salmonella enterica enterica serovar Typhi
cgucuggcgaaaac

SEQ ID NO: 3644015 - RNA, 18 nt, Salmonella enterica enterica serovar Typhi
cgucuggcgaaaacggcg

SEQ ID NO: 3644016 - RNA, 16 nt, Salmonella enterica enterica serovar Typhi
cgucugguaauaggcc

SEQ ID NO: 3644017 - RNA, 23 nt, Salmonella enterica enterica serovar Typhi
cgucuggugauccagcguagcgg

SEQ ID NO: 3644018 - RNA, 17 nt, Salmonella enterica enterica serovar Typhi
cgucuguguuuauccgg

SEQ ID NO: 3644019 - RNA, 12 nt, Salmonella enterica enterica serovar Typhi
cgucuuaaaauu

SEQ ID NO: 3644020 - RNA, 20 nt, Salmonella enterica enterica serovar Typhi
cgucuuaaugcucuccagca

SEQ ID NO: 3644021 - RNA, 19 nt, Salmonella enterica enterica serovar Typhi
cgucuucaggucauucagg

SEQ ID NO: 3644022 - RNA, 18 nt, Salmonella enterica enterica serovar Typhi
cgucuucaucguucauug

SEQ ID NO: 3644023 - RNA, 13 nt, Salmonella enterica enterica serovar Typhi
cgucuugccgcaa

SEQ ID NO: 3644024 - RNA, 17 nt, Salmonella enterica enterica serovar Typhi
cgucuuuugcugcuuug

SEQ ID NO: 3644025 - RNA, 22 nt, Salmonella enterica enterica serovar Typhi
cgugaaaaugcguccagaggau

SEQ ID NO: 3644026 - RNA, 18 nt, Salmonella enterica enterica serovar Typhi
cgugaaauauccuccgcc

SEQ ID NO: 3644027 - RNA, 16 nt, Salmonella enterica enterica serovar Typhi
cgugaaccagcauccc

SEQ ID NO: 3644028 - RNA, 19 nt, Salmonella enterica enterica serovar Typhi
cgugaaccagcaucccacg

SEQ ID NO: 3644029 - RNA, 21 nt, Salmonella enterica enterica serovar Typhi
cgugaaccagcaucccacgaa

SEQ ID NO: 3644030 - RNA, 13 nt, Salmonella enterica enterica serovar Typhi
cgugaacgccaaa

SEQ ID NO: 3644031 - RNA, 18 nt, Salmonella enterica enterica serovar Typhi
cgugaagaaacggaaauc

SEQ ID NO: 3644032 - RNA, 21 nt, Salmonella enterica enterica serovar Typhi
cgugaauaaugaccagcgccc

SEQ ID NO: 3644033 - RNA, 14 nt, Salmonella enterica enterica serovar Typhi
cgugaauauggaaa

SEQ ID NO: 3644034 - RNA, 20 nt, Salmonella enterica enterica serovar Typhi
cgugaaucaucaucauccgc

SEQ ID NO: 3644035 - RNA, 13 nt, Salmonella enterica enterica serovar Typhi
cgugaauggucac

SEQ ID NO: 3644036 - RNA, 19 nt, Salmonella enterica enterica serovar Typhi
cgugaauguccugcggcac

SEQ ID NO: 3644037 - RNA, 18 nt, Salmonella enterica enterica serovar Typhi
cgugaauugcgguuuauc

SEQ ID NO: 3644038 - RNA, 20 nt, Salmonella enterica enterica serovar Typhi
cgugaauugcgguuuauccc

SEQ ID NO: 3644039 - RNA, 17 nt, Salmonella enterica enterica serovar Typhi
cgugaauuucugcugcc

SEQ ID NO: 3644040 - RNA, 20 nt, Salmonella enterica enterica serovar Typhi
cgugaauuucugcugccagc

SEQ ID NO: 3644041 - RNA, 16 nt, Salmonella enterica enterica serovar Typhi
cgugacaguuaccccg

SEQ ID NO: 3644042 - RNA, 12 nt, Salmonella enterica enterica serovar Typhi
cgugaccaucgc

SEQ ID NO: 3644043 - RNA, 15 nt, Salmonella enterica enterica serovar Typhi
cgugaccccaggcau

SEQ ID NO: 3644044 - RNA, 14 nt, Salmonella enterica enterica serovar Typhi
cgugacccgccagc

SEQ ID NO: 3644045 - RNA, 13 nt, Salmonella enterica enterica serovar Typhi
cgugacggcggaa

SEQ ID NO: 3644046 - RNA, 16 nt, Salmonella enterica enterica serovar Typhi
cgugacuguucacauc

SEQ ID NO: 3644047 - RNA, 18 nt, Salmonella enterica enterica serovar Typhi
cgugagaaguaagcgcca

SEQ ID NO: 3644048 - RNA, 19 nt, Salmonella enterica enterica serovar Typhi
cgugagaaguaagcgccag

SEQ ID NO: 3644049 - RNA, 22 nt, Salmonella enterica enterica serovar Typhi
cgugagaucguuauuaaacaga

SEQ ID NO: 3644050 - RNA, 16 nt, Salmonella enterica enterica serovar Typhi
cgugagccggacacug

SEQ ID NO: 3644051 - RNA, 13 nt, Salmonella enterica enterica serovar Typhi
cgugagcgcaucc

SEQ ID NO: 3644052 - RNA, 13 nt, Salmonella enterica enterica serovar Typhi
cgugagcgcgccg

SEQ ID NO: 3644053 - RNA, 14 nt, Salmonella enterica enterica serovar Typhi
cgugagcgcgccgc

SEQ ID NO: 3644054 - RNA, 13 nt, Salmonella enterica enterica serovar Typhi
cgugagcgcguca

SEQ ID NO: 3644055 - RNA, 17 nt, Salmonella enterica enterica serovar Typhi
cgugagcuacagcguua

SEQ ID NO: 3644056 - RNA, 22 nt, Salmonella enterica enterica serovar Typhi
cgugagcugucgcucgcggcag

SEQ ID NO: 3644057 - RNA, 15 nt, Salmonella enterica enterica serovar Typhi
cgugaggcugaagcg

SEQ ID NO: 3644058 - RNA, 17 nt, Salmonella enterica enterica serovar Typhi
cgugaguuucaguauca

SEQ ID NO: 3644059 - RNA, 13 nt, Salmonella enterica enterica serovar Typhi
cgugaguuuuaac

SEQ ID NO: 3644060 - RNA, 21 nt, Salmonella enterica enterica serovar Typhi
cgugauaaaacauuccaucgc

SEQ ID NO: 3644061 - RNA, 22 nt, Salmonella enterica enterica serovar Typhi
cgugauaaacgguucagucagc

SEQ ID NO: 3644062 - RNA, 19 nt, Salmonella enterica enterica serovar Typhi
cgugauaaagcugacgcgc

SEQ ID NO: 3644063 - RNA, 23 nt, Salmonella enterica enterica serovar Typhi
cgugauaauaguggugcgcaucc

SEQ ID NO: 3644064 - RNA, 13 nt, Salmonella enterica enterica serovar Typhi
cgugaucacuccc

SEQ ID NO: 3644065 - RNA, 16 nt, Salmonella enterica enterica serovar Typhi
cgugaucgccaaagcg

SEQ ID NO: 3644066 - RNA, 21 nt, Salmonella enterica enterica serovar Typhi
cgugauugagcagaucagcac

SEQ ID NO: 3644067 - RNA, 22 nt, Salmonella enterica enterica serovar Typhi
cgugauugagcagaucagcacg

SEQ ID NO: 3644068 - RNA, 14 nt, Salmonella enterica enterica serovar Typhi
cgugcaaugucaug

SEQ ID NO: 3644069 - RNA, 19 nt, Salmonella enterica enterica serovar Typhi
cgugcaaugucaugacugg

SEQ ID NO: 3644070 - RNA, 14 nt, Salmonella enterica enterica serovar Typhi
cgugcagaugguau

SEQ ID NO: 3644071 - RNA, 15 nt, Salmonella enterica enterica serovar Typhi
cgugcaggacagaca

SEQ ID NO: 3644072 - RNA, 23 nt, Salmonella enterica enterica serovar Typhi
cgugcaguuuugcuucaugcaca

SEQ ID NO: 3644073 - RNA, 22 nt, Salmonella enterica enterica serovar Typhi
cgugcaugggauacgccagcag

SEQ ID NO: 3644074 - RNA, 20 nt, Salmonella enterica enterica serovar Typhi
cgugccagaaacaagaagca

SEQ ID NO: 3644075 - RNA, 18 nt, Salmonella enterica enterica serovar Typhi
cgugccaugaccauucac

SEQ ID NO: 3644076 - RNA, 15 nt, Salmonella enterica enterica serovar Typhi
cgugccauuaacgca

SEQ ID NO: 3644077 - RNA, 18 nt, Salmonella enterica enterica serovar Typhi
cgugccgccgcgaaaacg

SEQ ID NO: 3644078 - RNA, 14 nt, Salmonella enterica enterica serovar Typhi
cgugccguccggca

SEQ ID NO: 3644079 - RNA, 15 nt, Salmonella enterica enterica serovar Typhi
cgugccuucaaauau

SEQ ID NO: 3644080 - RNA, 13 nt, Salmonella enterica enterica serovar Typhi
cgugccuuccgca

SEQ ID NO: 3644081 - RNA, 18 nt, Salmonella enterica enterica serovar Typhi
cgugcgauagcgucccgu

SEQ ID NO: 3644082 - RNA, 21 nt, Salmonella enterica enterica serovar Typhi
cgugcgccgugaaauauccuc

SEQ ID NO: 3644083 - RNA, 13 nt, Salmonella enterica enterica serovar Typhi
cgugcggcugacg

SEQ ID NO: 3644084 - RNA, 18 nt, Salmonella enterica enterica serovar Typhi
cgugcucauuugcggcgu

SEQ ID NO: 3644085 - RNA, 17 nt, Salmonella enterica enterica serovar Typhi
cgugcucucaccaucau

SEQ ID NO: 3644086 - RNA, 18 nt, Salmonella enterica enterica serovar Typhi
cgugcucucaccaucaua

SEQ ID NO: 3644087 - RNA, 18 nt, Salmonella enterica enterica serovar Typhi
cgugcugacggagcuggc

SEQ ID NO: 3644088 - RNA, 20 nt, Salmonella enterica enterica serovar Typhi
cgugcugaucccgcgcgccu

SEQ ID NO: 3644089 - RNA, 12 nt, Salmonella enterica enterica serovar Typhi
cguggaaaagag

SEQ ID NO: 3644090 - RNA, 20 nt, Salmonella enterica enterica serovar Typhi
cguggaucucgucgccggug

SEQ ID NO: 3644091 - RNA, 21 nt, Salmonella enterica enterica serovar Typhi
cguggauuuuuugucuguaua

SEQ ID NO: 3644092 - RNA, 16 nt, Salmonella enterica enterica serovar Typhi
cguggcaaggaacagu

SEQ ID NO: 3644093 - RNA, 14 nt, Salmonella enterica enterica serovar Typhi
cguggcaaucagca

SEQ ID NO: 3644094 - RNA, 15 nt, Salmonella enterica enterica serovar Typhi
cguggcaaucagcaa

SEQ ID NO: 3644095 - RNA, 11 nt, Salmonella enterica enterica serovar Typhi
cguggcaucuu

SEQ ID NO: 3644096 - RNA, 21 nt, Salmonella enterica enterica serovar Typhi
cguggcauucgcuugcccggc

SEQ ID NO: 3644097 - RNA, 21 nt, Salmonella enterica enterica serovar Typhi
cguggccgauauugccuucac

SEQ ID NO: 3644098 - RNA, 16 nt, Salmonella enterica enterica serovar Typhi
cguggcggcagagcca

SEQ ID NO: 3644099 - RNA, 13 nt, Salmonella enterica enterica serovar Typhi
cgugguauuacaa

SEQ ID NO: 3644100 - RNA, 21 nt, Salmonella enterica enterica serovar Typhi
cguggucauuaggcguaauua

SEQ ID NO: 3644101 - RNA, 16 nt, Salmonella enterica enterica serovar Typhi
cguggugacacaauau

SEQ ID NO: 3644102 - RNA, 12 nt, Salmonella enterica enterica serovar Typhi
cguggugcggga

SEQ ID NO: 3644103 - RNA, 13 nt, Salmonella enterica enterica serovar Typhi
cgugguuuccggc

SEQ ID NO: 3644104 - RNA, 16 nt, Salmonella enterica enterica serovar Typhi
cguguaaacagaugcu

SEQ ID NO: 3644105 - RNA, 17 nt, Salmonella enterica enterica serovar Typhi
cguguaaacagaugcuc

SEQ ID NO: 3644106 - RNA, 16 nt, Salmonella enterica enterica serovar Typhi
cguguaaggcaaucgc

SEQ ID NO: 3644107 - RNA, 13 nt, Salmonella enterica enterica serovar Typhi
cguguaauuucau

SEQ ID NO: 3644108 - RNA, 17 nt, Salmonella enterica enterica serovar Typhi
cguguagccaguacgcg

SEQ ID NO: 3644109 - RNA, 22 nt, Salmonella enterica enterica serovar Typhi
cguguauuccagucgcuccacc

SEQ ID NO: 3644110 - RNA, 23 nt, Salmonella enterica enterica serovar Typhi
cgugucagacccgauagcgccgc

SEQ ID NO: 3644111 - RNA, 21 nt, Salmonella enterica enterica serovar Typhi
cguguccaaacuggcugugcc

SEQ ID NO: 3644112 - RNA, 22 nt, Salmonella enterica enterica serovar Typhi
cgugucgcguaacgccuccacc

SEQ ID NO: 3644113 - RNA, 16 nt, Salmonella enterica enterica serovar Typhi
cgugucgggaauugcc

SEQ ID NO: 3644114 - RNA, 22 nt, Salmonella enterica enterica serovar Typhi
cgugugcgguauagaucagacg

SEQ ID NO: 3644115 - RNA, 16 nt, Salmonella enterica enterica serovar Typhi
cguguggccugcucua

SEQ ID NO: 3644116 - RNA, 20 nt, Salmonella enterica enterica serovar Typhi
cguguggcggaaugaccuga

SEQ ID NO: 3644117 - RNA, 13 nt, Salmonella enterica enterica serovar Typhi
cguguuauuuuca

SEQ ID NO: 3644118 - RNA, 21 nt, Salmonella enterica enterica serovar Typhi
cguguuauuuucaaaaacaag

SEQ ID NO: 3644119 - RNA, 14 nt, Salmonella enterica enterica serovar Typhi
cguguucagguugg

SEQ ID NO: 3644120 - RNA, 20 nt, Salmonella enterica enterica serovar Typhi
cguguugauuaaugcgauaa

SEQ ID NO: 3644121 - RNA, 19 nt, Salmonella enterica enterica serovar Typhi
cguguugcagcccaccggc

SEQ ID NO: 3644122 - RNA, 13 nt, Salmonella enterica enterica serovar Typhi
cguguuguccggc

SEQ ID NO: 3644123 - RNA, 18 nt, Salmonella enterica enterica serovar Typhi
cguuaaacaccucaccgg

SEQ ID NO: 3644124 - RNA, 13 nt, Salmonella enterica enterica serovar Typhi
cguuaaacugcgc

SEQ ID NO: 3644125 - RNA, 15 nt, Salmonella enterica enterica serovar Typhi
cguuaaauaccagca

SEQ ID NO: 3644126 - RNA, 16 nt, Salmonella enterica enterica serovar Typhi
cguuaaauaccagcac

SEQ ID NO: 3644127 - RNA, 15 nt, Salmonella enterica enterica serovar Typhi
cguuaacggcgccac

SEQ ID NO: 3644128 - RNA, 20 nt, Salmonella enterica enterica serovar Typhi
cguuaacguaaagccaucca

SEQ ID NO: 3644129 - RNA, 15 nt, Salmonella enterica enterica serovar Typhi
cguuaacugcugcgc

SEQ ID NO: 3644130 - RNA, 21 nt, Salmonella enterica enterica serovar Typhi
cguuaaguagcggaaccagcc

SEQ ID NO: 3644131 - RNA, 22 nt, Salmonella enterica enterica serovar Typhi
cguuaauccaaauccgcauuuc

SEQ ID NO: 3644132 - RNA, 19 nt, Salmonella enterica enterica serovar Typhi
cguuaaucuggccuacgga

SEQ ID NO: 3644133 - RNA, 20 nt, Salmonella enterica enterica serovar Typhi
cguuaaugcuguccugcaaa

SEQ ID NO: 3644134 - RNA, 15 nt, Salmonella enterica enterica serovar Typhi
cguuaccaaucugcg

SEQ ID NO: 3644135 - RNA, 13 nt, Salmonella enterica enterica serovar Typhi
cguuaccagcauc

SEQ ID NO: 3644136 - RNA, 17 nt, Salmonella enterica enterica serovar Typhi
cguuacccagacagcaa

SEQ ID NO: 3644137 - RNA, 23 nt, Salmonella enterica enterica serovar Typhi
cguuaccccgcagcgaaaaucca

SEQ ID NO: 3644138 - RNA, 17 nt, Salmonella enterica enterica serovar Typhi
cguuaccccuuuuucaa

SEQ ID NO: 3644139 - RNA, 18 nt, Salmonella enterica enterica serovar Typhi
cguuacccgugcgcgucg

SEQ ID NO: 3644140 - RNA, 23 nt, Salmonella enterica enterica serovar Typhi
cguuaccggcuccggcaaauucu

SEQ ID NO: 3644141 - RNA, 16 nt, Salmonella enterica enterica serovar Typhi
cguuaccgggcaaacg

SEQ ID NO: 3644142 - RNA, 22 nt, Salmonella enterica enterica serovar Typhi
cguuacgcgccacgccauugcu

SEQ ID NO: 3644143 - RNA, 15 nt, Salmonella enterica enterica serovar Typhi
cguuacgcgcugcaa

SEQ ID NO: 3644144 - RNA, 20 nt, Salmonella enterica enterica serovar Typhi
cguuacuguuuuaucaggga

SEQ ID NO: 3644145 - RNA, 15 nt, Salmonella enterica enterica serovar Typhi
cguuacuucccccau

SEQ ID NO: 3644146 - RNA, 21 nt, Salmonella enterica enterica serovar Typhi
cguuagcacauuggcgagcag

SEQ ID NO: 3644147 - RNA, 13 nt, Salmonella enterica enterica serovar Typhi
cguuagccgccau

SEQ ID NO: 3644148 - RNA, 18 nt, Salmonella enterica enterica serovar Typhi
cguuagccgccauccggc

SEQ ID NO: 3644149 - RNA, 19 nt, Salmonella enterica enterica serovar Typhi
cguuagcgacggcgcgccg

SEQ ID NO: 3644150 - RNA, 21 nt, Salmonella enterica enterica serovar Typhi
cguuagcgagguucccgccgc

SEQ ID NO: 3644151 - RNA, 12 nt, Salmonella enterica enterica serovar Typhi
cguuagcgcaaa

SEQ ID NO: 3644152 - RNA, 18 nt, Salmonella enterica enterica serovar Typhi
cguuagcgccauccggca

SEQ ID NO: 3644153 - RNA, 22 nt, Salmonella enterica enterica serovar Typhi
cguuagcgccauccggcauuuc

SEQ ID NO: 3644154 - RNA, 18 nt, Salmonella enterica enterica serovar Typhi
cguuagcgucauccggca

SEQ ID NO: 3644155 - RNA, 22 nt, Salmonella enterica enterica serovar Typhi
cguuagcucuuucauuucugcc

SEQ ID NO: 3644156 - RNA, 14 nt, Salmonella enterica enterica serovar Typhi
cguuauaaggccug

SEQ ID NO: 3644157 - RNA, 20 nt, Salmonella enterica enterica serovar Typhi
cguuaucaaaaaaaaccaga

SEQ ID NO: 3644158 - RNA, 13 nt, Salmonella enterica enterica serovar Typhi
cguuauccgccug

SEQ ID NO: 3644159 - RNA, 14 nt, Salmonella enterica enterica serovar Typhi
cguuaucggccugc

SEQ ID NO: 3644160 - RNA, 13 nt, Salmonella enterica enterica serovar Typhi
cguuaucucgcca

SEQ ID NO: 3644161 - RNA, 16 nt, Salmonella enterica enterica serovar Typhi
cguuaucuguaauuga

SEQ ID NO: 3644162 - RNA, 12 nt, Salmonella enterica enterica serovar Typhi
cguuauggaagu

SEQ ID NO: 3644163 - RNA, 14 nt, Salmonella enterica enterica serovar Typhi
cguuauucgcuggc

SEQ ID NO: 3644164 - RNA, 18 nt, Salmonella enterica enterica serovar Typhi
cguucaaaaucaaacaga

SEQ ID NO: 3644165 - RNA, 19 nt, Salmonella enterica enterica serovar Typhi
cguucacaccgccgccagc

SEQ ID NO: 3644166 - RNA, 21 nt, Salmonella enterica enterica serovar Typhi
cguucacaccgccgccagcca

SEQ ID NO: 3644167 - RNA, 17 nt, Salmonella enterica enterica serovar Typhi
cguucaccacaacccac

SEQ ID NO: 3644168 - RNA, 19 nt, Salmonella enterica enterica serovar Typhi
cguucaccagccacugcgc

SEQ ID NO: 3644169 - RNA, 15 nt, Salmonella enterica enterica serovar Typhi
cguucacgccgccau

SEQ ID NO: 3644170 - RNA, 15 nt, Salmonella enterica enterica serovar Typhi
cguucacguaaucgc

SEQ ID NO: 3644171 - RNA, 16 nt, Salmonella enterica enterica serovar Typhi
cguucagauaggcgcg

SEQ ID NO: 3644172 - RNA, 22 nt, Salmonella enterica enterica serovar Typhi
cguucagcauauccagcgccug

SEQ ID NO: 3644173 - RNA, 12 nt, Salmonella enterica enterica serovar Typhi
cguucagccagc

SEQ ID NO: 3644174 - RNA, 19 nt, Salmonella enterica enterica serovar Typhi
cguucauaguuugcauaac

SEQ ID NO: 3644175 - RNA, 13 nt, Salmonella enterica enterica serovar Typhi
cguucaucaggca

SEQ ID NO: 3644176 - RNA, 14 nt, Salmonella enterica enterica serovar Typhi
cguucaucaggcaa

SEQ ID NO: 3644177 - RNA, 14 nt, Salmonella enterica enterica serovar Typhi
cguucauccgacca

SEQ ID NO: 3644178 - RNA, 15 nt, Salmonella enterica enterica serovar Typhi
cguucaugucggccu

SEQ ID NO: 3644179 - RNA, 21 nt, Salmonella enterica enterica serovar Typhi
cguuccacacguccauccggg

SEQ ID NO: 3644180 - RNA, 13 nt, Salmonella enterica enterica serovar Typhi
cguuccagcagcg

SEQ ID NO: 3644181 - RNA, 22 nt, Salmonella enterica enterica serovar Typhi
cguuccauuccagaaucuggcc

SEQ ID NO: 3644182 - RNA, 15 nt, Salmonella enterica enterica serovar Typhi
cguuccccaacagcg

SEQ ID NO: 3644183 - RNA, 18 nt, Salmonella enterica enterica serovar Typhi
cguucccgaaaauccgga

SEQ ID NO: 3644184 - RNA, 13 nt, Salmonella enterica enterica serovar Typhi
cguuccgccagau

SEQ ID NO: 3644185 - RNA, 20 nt, Salmonella enterica enterica serovar Typhi
cguuccguucgcgucacaau

SEQ ID NO: 3644186 - RNA, 23 nt, Salmonella enterica enterica serovar Typhi
cguuccguucgcgucacaaucgc

SEQ ID NO: 3644187 - RNA, 14 nt, Salmonella enterica enterica serovar Typhi
cguuccuuaucagc

SEQ ID NO: 3644188 - RNA, 22 nt, Salmonella enterica enterica serovar Typhi
cguucgauagcguuuuccagcu

SEQ ID NO: 3644189 - RNA, 16 nt, Salmonella enterica enterica serovar Typhi
cguucgcccugcgcca

SEQ ID NO: 3644190 - RNA, 19 nt, Salmonella enterica enterica serovar Typhi
cguucgcgaauuucacgca

SEQ ID NO: 3644191 - RNA, 18 nt, Salmonella enterica enterica serovar Typhi
cguucgcgcaauucuucu

SEQ ID NO: 3644192 - RNA, 16 nt, Salmonella enterica enterica serovar Typhi
cguucgcggaacggcg

SEQ ID NO: 3644193 - RNA, 17 nt, Salmonella enterica enterica serovar Typhi
cguucgcggaacggcga

SEQ ID NO: 3644194 - RNA, 22 nt, Salmonella enterica enterica serovar Typhi
cguucgcggggguuauucagcg

SEQ ID NO: 3644195 - RNA, 19 nt, Salmonella enterica enterica serovar Typhi
cguucgcguucuggaagug

SEQ ID NO: 3644196 - RNA, 21 nt, Salmonella enterica enterica serovar Typhi
cguucggaagacugcuccggc

SEQ ID NO: 3644197 - RNA, 22 nt, Salmonella enterica enterica serovar Typhi
cguucggaaucggacacuugca

SEQ ID NO: 3644198 - RNA, 20 nt, Salmonella enterica enterica serovar Typhi
cguucggacuggggauggcc

SEQ ID NO: 3644199 - RNA, 20 nt, Salmonella enterica enterica serovar Typhi
cguucggcaaaacgccgcag

SEQ ID NO: 3644200 - RNA, 13 nt, Salmonella enterica enterica serovar Typhi
cguucggguuuuc

SEQ ID NO: 3644201 - RNA, 22 nt, Salmonella enterica enterica serovar Typhi
cguucgguuuccggcauccagc

SEQ ID NO: 3644202 - RNA, 18 nt, Salmonella enterica enterica serovar Typhi
cguucguugauagcgacg

SEQ ID NO: 3644203 - RNA, 19 nt, Salmonella enterica enterica serovar Typhi
cguucucaauccgcagcag

SEQ ID NO: 3644204 - RNA, 19 nt, Salmonella enterica enterica serovar Typhi
cguucugaccugcgcaaau

SEQ ID NO: 3644205 - RNA, 11 nt, Salmonella enterica enterica serovar Typhi
cguucuuccug

SEQ ID NO: 3644206 - RNA, 15 nt, Salmonella enterica enterica serovar Typhi
cguucuucgauaaag

SEQ ID NO: 3644207 - RNA, 21 nt, Salmonella enterica enterica serovar Typhi
cguucuugcccgguggcgcug

SEQ ID NO: 3644208 - RNA, 17 nt, Salmonella enterica enterica serovar Typhi
cguucuuuccaguucug

SEQ ID NO: 3644209 - RNA, 11 nt, Salmonella enterica enterica serovar Typhi
cguugaaaacg

SEQ ID NO: 3644210 - RNA, 13 nt, Salmonella enterica enterica serovar Typhi
cguugaaauccuc

SEQ ID NO: 3644211 - RNA, 21 nt, Salmonella enterica enterica serovar Typhi
cguugaauauuggcaucaagc

SEQ ID NO: 3644212 - RNA, 22 nt, Salmonella enterica enterica serovar Typhi
cguugaccagccuaccugccgc

SEQ ID NO: 3644213 - RNA, 24 nt, Salmonella enterica enterica serovar Typhi
cguugaccagccuaccugccgcca

SEQ ID NO: 3644214 - RNA, 12 nt, Salmonella enterica enterica serovar Typhi
cguugaccagcg

SEQ ID NO: 3644215 - RNA, 22 nt, Salmonella enterica enterica serovar Typhi
cguugaccgcuucgccuucgcc

SEQ ID NO: 3644216 - RNA, 14 nt, Salmonella enterica enterica serovar Typhi
cguugacgggcgac

SEQ ID NO: 3644217 - RNA, 15 nt, Salmonella enterica enterica serovar Typhi
cguugacgugagaga

SEQ ID NO: 3644218 - RNA, 15 nt, Salmonella enterica enterica serovar Typhi
cucggucaacauucc

SEQ ID NO: 3644219 - RNA, 15 nt, Salmonella enterica enterica serovar Typhi
cucggugccgcugcu

SEQ ID NO: 3644220 - RNA, 24 nt, Salmonella enterica enterica serovar Typhi
cucguaagagaggcuuuaugcuga

SEQ ID NO: 3644221 - RNA, 15 nt, Salmonella enterica enterica serovar Typhi
cucguaagaggcgug

SEQ ID NO: 3644222 - RNA, 18 nt, Salmonella enterica enterica serovar Typhi
cucguacacgcgcccgcc

SEQ ID NO: 3644223 - RNA, 20 nt, Salmonella enterica enterica serovar Typhi
cucguauaucgcgauaaacu

SEQ ID NO: 3644224 - RNA, 12 nt, Salmonella enterica enterica serovar Typhi
cucguauuauug

SEQ ID NO: 3644225 - RNA, 15 nt, Salmonella enterica enterica serovar Typhi
cucgucgccagggcg

SEQ ID NO: 3644226 - RNA, 21 nt, Salmonella enterica enterica serovar Typhi
cucgucggcaagaauuucaau

SEQ ID NO: 3644227 - RNA, 19 nt, Salmonella enterica enterica serovar Typhi
cucgucuguuuugccuugc

SEQ ID NO: 3644228 - RNA, 21 nt, Salmonella enterica enterica serovar Typhi
cucgugcaggccggauaagcc

SEQ ID NO: 3644229 - RNA, 15 nt, Salmonella enterica enterica serovar Typhi
cucguguaaggcuuc

SEQ ID NO: 3644230 - RNA, 21 nt, Salmonella enterica enterica serovar Typhi
cucguguaaggcuuccggcag

SEQ ID NO: 3644231 - RNA, 21 nt, Salmonella enterica enterica serovar Typhi
cucguuaauccaaauccgcau

SEQ ID NO: 3644232 - RNA, 14 nt, Salmonella enterica enterica serovar Typhi
cucguucggucagg

SEQ ID NO: 3644233 - RNA, 18 nt, Salmonella enterica enterica serovar Typhi
cucguugccauugguuca

SEQ ID NO: 3644234 - RNA, 13 nt, Salmonella enterica enterica serovar Typhi
cucuaaaaaggaa

SEQ ID NO: 3644235 - RNA, 22 nt, Salmonella enterica enterica serovar Typhi
cucuaaaucuuuuugugcaauc

SEQ ID NO: 3644236 - RNA, 18 nt, Salmonella enterica enterica serovar Typhi
cucuaaaugggcaggaga

SEQ ID NO: 3644237 - RNA, 24 nt, Salmonella enterica enterica serovar Typhi
cucuaacgucagcgccacccauuu

SEQ ID NO: 3644238 - RNA, 19 nt, Salmonella enterica enterica serovar Typhi
cucuacgccggcgcguaau

SEQ ID NO: 3644239 - RNA, 14 nt, Salmonella enterica enterica serovar Typhi
cucuacucgcggac

SEQ ID NO: 3644240 - RNA, 19 nt, Salmonella enterica enterica serovar Typhi
cucuacuuuccugaaggua

SEQ ID NO: 3644241 - RNA, 16 nt, Salmonella enterica enterica serovar Typhi
cucuaggcgcugcugg

SEQ ID NO: 3644242 - RNA, 18 nt, Salmonella enterica enterica serovar Typhi
cucuauaccauaaaugaa

SEQ ID NO: 3644243 - RNA, 23 nt, Salmonella enterica enterica serovar Typhi
cucuauagauuucgcgucagggc

SEQ ID NO: 3644244 - RNA, 14 nt, Salmonella enterica enterica serovar Typhi
cucuaucagcgccu

SEQ ID NO: 3644245 - RNA, 19 nt, Salmonella enterica enterica serovar Typhi
cucuauugauuggcaagaa

SEQ ID NO: 3644246 - RNA, 12 nt, Salmonella enterica enterica serovar Typhi
cucuauuuuuua

SEQ ID NO: 3644247 - RNA, 17 nt, Salmonella enterica enterica serovar Typhi
cucucaccaguagcgcg

SEQ ID NO: 3644248 - RNA, 16 nt, Salmonella enterica enterica serovar Typhi
cucucaccgccuaggc

SEQ ID NO: 3644249 - RNA, 23 nt, Salmonella enterica enterica serovar Typhi
cucucaccgccuaggccagugcc

SEQ ID NO: 3644250 - RNA, 22 nt, Salmonella enterica enterica serovar Typhi
cucucagcgucggugaagaaaa

SEQ ID NO: 3644251 - RNA, 23 nt, Salmonella enterica enterica serovar Typhi
cucucaggcaguaacucaauauc

SEQ ID NO: 3644252 - RNA, 14 nt, Salmonella enterica enterica serovar Typhi
cucuccacgccgca

SEQ ID NO: 3644253 - RNA, 17 nt, Salmonella enterica enterica serovar Typhi
cucuccagcaggguauu

SEQ ID NO: 3644254 - RNA, 16 nt, Salmonella enterica enterica serovar Typhi
cucucccaggcauccu

SEQ ID NO: 3644255 - RNA, 18 nt, Salmonella enterica enterica serovar Typhi
cucuccgcaauuaauuua

SEQ ID NO: 3644256 - RNA, 23 nt, Salmonella enterica enterica serovar Typhi
cucuccgguugcugauaacgugc

SEQ ID NO: 3644257 - RNA, 14 nt, Salmonella enterica enterica serovar Typhi
cucuccugaagcca

SEQ ID NO: 3644258 - RNA, 22 nt, Salmonella enterica enterica serovar Typhi
cucuccugaauugcaaggcgac

SEQ ID NO: 3644259 - RNA, 20 nt, Salmonella enterica enterica serovar Typhi
cucucgugcaggccggauaa

SEQ ID NO: 3644260 - RNA, 15 nt, Salmonella enterica enterica serovar Typhi
cucucguucccgccu

SEQ ID NO: 3644261 - RNA, 21 nt, Salmonella enterica enterica serovar Typhi
cucucuggcgcauuccagacc

SEQ ID NO: 3644262 - RNA, 19 nt, Salmonella enterica enterica serovar Typhi
cucucuuucaccagcgcca

SEQ ID NO: 3644263 - RNA, 21 nt, Salmonella enterica enterica serovar Typhi
cucucuuucgguagccacaga

SEQ ID NO: 3644264 - RNA, 14 nt, Salmonella enterica enterica serovar Typhi
cucugaaacgcuuc

SEQ ID NO: 3644265 - RNA, 17 nt, Salmonella enterica enterica serovar Typhi
cucugauuucgacgaua

SEQ ID NO: 3644266 - RNA, 23 nt, Salmonella enterica enterica serovar Typhi
cucugauuucgacgauaaaaaaa

SEQ ID NO: 3644267 - RNA, 21 nt, Salmonella enterica enterica serovar Typhi
cucugcaaagaaauugggcuu

SEQ ID NO: 3644268 - RNA, 18 nt, Salmonella enterica enterica serovar Typhi
cucugccaguugcucaua

SEQ ID NO: 3644269 - RNA, 20 nt, Salmonella enterica enterica serovar Typhi
cucugccucagcaagaaguu

SEQ ID NO: 3644270 - RNA, 21 nt, Salmonella enterica enterica serovar Typhi
cucugccuguagcagcgccag

SEQ ID NO: 3644271 - RNA, 14 nt, Salmonella enterica enterica serovar Typhi
cucugcgacgccag

SEQ ID NO: 3644272 - RNA, 13 nt, Salmonella enterica enterica serovar Typhi
cucugcuuuuuca

SEQ ID NO: 3644273 - RNA, 22 nt, Salmonella enterica enterica serovar Typhi
cucugguaguuguaauaaacag

SEQ ID NO: 3644274 - RNA, 15 nt, Salmonella enterica enterica serovar Typhi
cucugucgccgcccg

SEQ ID NO: 3644275 - RNA, 18 nt, Salmonella enterica enterica serovar Typhi
cucuuaccgcuaaaauac

SEQ ID NO: 3644276 - RNA, 15 nt, Salmonella enterica enterica serovar Typhi
cucuuacguugcauu

SEQ ID NO: 3644277 - RNA, 22 nt, Salmonella enterica enterica serovar Typhi
cucuuauugcucuuccggcaua

SEQ ID NO: 3644278 - RNA, 23 nt, Salmonella enterica enterica serovar Typhi
cucuucaauuuccaucuguaaca

SEQ ID NO: 3644279 - RNA, 18 nt, Salmonella enterica enterica serovar Typhi
cucuucagcguccggaaa

SEQ ID NO: 3644280 - RNA, 20 nt, Salmonella enterica enterica serovar Typhi
cucuucaguaaccagggagg

SEQ ID NO: 3644281 - RNA, 22 nt, Salmonella enterica enterica serovar Typhi
cucuucaguaagcguaccauuc

SEQ ID NO: 3644282 - RNA, 17 nt, Salmonella enterica enterica serovar Typhi
cucuucaucgcgccucc

SEQ ID NO: 3644283 - RNA, 23 nt, Salmonella enterica enterica serovar Typhi
cucuucaucgcgccuccccugcc

SEQ ID NO: 3644284 - RNA, 16 nt, Salmonella enterica enterica serovar Typhi
cucuucaucuguggca

SEQ ID NO: 3644285 - RNA, 15 nt, Salmonella enterica enterica serovar Typhi
cucuucaucuuuuuc

SEQ ID NO: 3644286 - RNA, 13 nt, Salmonella enterica enterica serovar Typhi
cucuuccaccauc

SEQ ID NO: 3644287 - RNA, 15 nt, Salmonella enterica enterica serovar Typhi
cucuuccagcgucuc

SEQ ID NO: 3644288 - RNA, 15 nt, Salmonella enterica enterica serovar Typhi
cucuuccaucagcca

SEQ ID NO: 3644289 - RNA, 20 nt, Salmonella enterica enterica serovar Typhi
cucuuccgcgguccagccgg

SEQ ID NO: 3644290 - RNA, 17 nt, Salmonella enterica enterica serovar Typhi
cucuuccggcauaaaaa

SEQ ID NO: 3644291 - RNA, 18 nt, Salmonella enterica enterica serovar Typhi
cucuuccgguacacgcag

SEQ ID NO: 3644292 - RNA, 15 nt, Salmonella enterica enterica serovar Typhi
cucuuccuccccagg

SEQ ID NO: 3644293 - RNA, 17 nt, Salmonella enterica enterica serovar Typhi
cucuuccuccccaggcg

SEQ ID NO: 3644294 - RNA, 16 nt, Salmonella enterica enterica serovar Typhi
cucuucgacaucuuca

SEQ ID NO: 3644295 - RNA, 12 nt, Salmonella enterica enterica serovar Typhi
cucuucggcuuc

SEQ ID NO: 3644296 - RNA, 16 nt, Salmonella enterica enterica serovar Typhi
cucuucgugacccgcc

SEQ ID NO: 3644297 - RNA, 16 nt, Salmonella enterica enterica serovar Typhi
cucuucguuauuuucc

SEQ ID NO: 3644298 - RNA, 18 nt, Salmonella enterica enterica serovar Typhi
cucuucucugaaaagagu

SEQ ID NO: 3644299 - RNA, 17 nt, Salmonella enterica enterica serovar Typhi
cucuucuggcucccgca

SEQ ID NO: 3644300 - RNA, 16 nt, Salmonella enterica enterica serovar Typhi
cucuucuuccggcgau

SEQ ID NO: 3644301 - RNA, 13 nt, Salmonella enterica enterica serovar Typhi
cucuucuuuuaau

SEQ ID NO: 3644302 - RNA, 22 nt, Salmonella enterica enterica serovar Typhi
cucuucuuuuaauugccaggcg

SEQ ID NO: 3644303 - RNA, 23 nt, Salmonella enterica enterica serovar Typhi
cucuugccccacauguuggcauu

SEQ ID NO: 3644304 - RNA, 15 nt, Salmonella enterica enterica serovar Typhi
cucuuggguuauuuc

SEQ ID NO: 3644305 - RNA, 12 nt, Salmonella enterica enterica serovar Typhi
cucuuguuucuc

SEQ ID NO: 3644306 - RNA, 13 nt, Salmonella enterica enterica serovar Typhi
cucuuuaaagcgc

SEQ ID NO: 3644307 - RNA, 13 nt, Salmonella enterica enterica serovar Typhi
cucuuuaacaauu

SEQ ID NO: 3644308 - RNA, 20 nt, Salmonella enterica enterica serovar Typhi
cucuuuaaugauguccagaa

SEQ ID NO: 3644309 - RNA, 15 nt, Salmonella enterica enterica serovar Typhi
cucuuuaucaaacaa

SEQ ID NO: 3644310 - RNA, 21 nt, Salmonella enterica enterica serovar Typhi
cucuuucaccagcgccagaau

SEQ ID NO: 3644311 - RNA, 13 nt, Salmonella enterica enterica serovar Typhi
cucuuucagacca

SEQ ID NO: 3644312 - RNA, 13 nt, Salmonella enterica enterica serovar Typhi
cucuuucuccaca

SEQ ID NO: 3644313 - RNA, 16 nt, Salmonella enterica enterica serovar Typhi
cucuuugaacagccag

SEQ ID NO: 3644314 - RNA, 21 nt, Salmonella enterica enterica serovar Typhi
cucuuugaacagccagaagcc

SEQ ID NO: 3644315 - RNA, 16 nt, Salmonella enterica enterica serovar Typhi
cucuuuuaauuuucug

SEQ ID NO: 3644316 - RNA, 14 nt, Salmonella enterica enterica serovar Typhi
cucuuuugcuucaa

SEQ ID NO: 3644317 - RNA, 17 nt, Salmonella enterica enterica serovar Typhi
cucuuuuuccgccugau

SEQ ID NO: 3644318 - RNA, 20 nt, Salmonella enterica enterica serovar Typhi
cucuuuuuccgccugaucuu

SEQ ID NO: 3644319 - RNA, 12 nt, Salmonella enterica enterica serovar Typhi
cucuuuuucuuu

SEQ ID NO: 3644320 - RNA, 13 nt, Salmonella enterica enterica serovar Typhi
cugaaaaaauucc

SEQ ID NO: 3644321 - RNA, 12 nt, Salmonella enterica enterica serovar Typhi
cugaaaaagggu

SEQ ID NO: 3644322 - RNA, 12 nt, Salmonella enterica enterica serovar Typhi
cugaaaaauccc

SEQ ID NO: 3644323 - RNA, 19 nt, Salmonella enterica enterica serovar Typhi
cugaaaaauccccccuccu

SEQ ID NO: 3644324 - RNA, 23 nt, Salmonella enterica enterica serovar Typhi
cugaaaaucaaaucggcgccggc

SEQ ID NO: 3644325 - RNA, 22 nt, Salmonella enterica enterica serovar Typhi
cugaaaaugugguauuaaccca

SEQ ID NO: 3644326 - RNA, 12 nt, Salmonella enterica enterica serovar Typhi
cugaaacgggaa

SEQ ID NO: 3644327 - RNA, 16 nt, Salmonella enterica enterica serovar Typhi
cugaaagaagacgaaa

SEQ ID NO: 3644328 - RNA, 21 nt, Salmonella enterica enterica serovar Typhi
cugaaagccgacccgcaucag

SEQ ID NO: 3644329 - RNA, 12 nt, Salmonella enterica enterica serovar Typhi
cugaaagcgccu

SEQ ID NO: 3644330 - RNA, 22 nt, Salmonella enterica enterica serovar Typhi
cugaaauacccgacucuuuuuu

SEQ ID NO: 3644331 - RNA, 19 nt, Salmonella enterica enterica serovar Typhi
cugaaauuucuuuuccaga

SEQ ID NO: 3644332 - RNA, 23 nt, Salmonella enterica enterica serovar Typhi
cugaacauacuuucucuccuuca

SEQ ID NO: 3644333 - RNA, 15 nt, Salmonella enterica enterica serovar Typhi
cugaacauagccauc

SEQ ID NO: 3644334 - RNA, 15 nt, Salmonella enterica enterica serovar Typhi
cugaaccaacagcug

SEQ ID NO: 3644335 - RNA, 19 nt, Salmonella enterica enterica serovar Typhi
cugaaccaacagcuggguc

SEQ ID NO: 3644336 - RNA, 13 nt, Salmonella enterica enterica serovar Typhi
cugaaccagcgcc

SEQ ID NO: 3644337 - RNA, 13 nt, Salmonella enterica enterica serovar Typhi
cugaaccugccuu

SEQ ID NO: 3644338 - RNA, 19 nt, Salmonella enterica enterica serovar Typhi
cugaacgggugguuucccu

SEQ ID NO: 3644339 - RNA, 21 nt, Salmonella enterica enterica serovar Typhi
cugaacucaucaugauauaau

SEQ ID NO: 3644340 - RNA, 23 nt, Salmonella enterica enterica serovar Typhi
cugaacucuuccagauacggguu

SEQ ID NO: 3644341 - RNA, 21 nt, Salmonella enterica enterica serovar Typhi
cugaacuuuuugcaggagcuc

SEQ ID NO: 3644342 - RNA, 17 nt, Salmonella enterica enterica serovar Typhi
cugaagaaaaggaaugc

SEQ ID NO: 3644343 - RNA, 14 nt, Salmonella enterica enterica serovar Typhi
cugaagauaaaauu

SEQ ID NO: 3644344 - RNA, 13 nt, Salmonella enterica enterica serovar Typhi
cugaagccccaac

SEQ ID NO: 3644345 - RNA, 19 nt, Salmonella enterica enterica serovar Typhi
cugaagcgcaguguuaauc

SEQ ID NO: 3644346 - RNA, 20 nt, Salmonella enterica enterica serovar Typhi
cugaagcguaacagcgcuau

SEQ ID NO: 3644347 - RNA, 12 nt, Salmonella enterica enterica serovar Typhi
cugaaggcgcuc

SEQ ID NO: 3644348 - RNA, 17 nt, Salmonella enterica enterica serovar Typhi
cugaaguaucgacgcag

SEQ ID NO: 3644349 - RNA, 21 nt, Salmonella enterica enterica serovar Typhi
cugaaguaucgacgcagacaa

SEQ ID NO: 3644350 - RNA, 20 nt, Salmonella enterica enterica serovar Typhi
cugaauaaauaguauaacga

SEQ ID NO: 3644351 - RNA, 21 nt, Salmonella enterica enterica serovar Typhi
cugaauaaauaguauaacgau

SEQ ID NO: 3644352 - RNA, 17 nt, Salmonella enterica enterica serovar Typhi
cugaauaacagcaccau

SEQ ID NO: 3644353 - RNA, 11 nt, Salmonella enterica enterica serovar Typhi
cugaauaaucg

SEQ ID NO: 3644354 - RNA, 22 nt, Salmonella enterica enterica serovar Typhi
cugaauaaucggcgucauuuuc

SEQ ID NO: 3644355 - RNA, 21 nt, Salmonella enterica enterica serovar Typhi
cugaauaaugguaaauuuauc

SEQ ID NO: 3644356 - RNA, 17 nt, Salmonella enterica enterica serovar Typhi
cugaauaucgucaguau

SEQ ID NO: 3644357 - RNA, 18 nt, Salmonella enterica enterica serovar Typhi
cugaauauggccaguccc

SEQ ID NO: 3644358 - RNA, 22 nt, Salmonella enterica enterica serovar Typhi
cugaaucagauacggcuccagc

SEQ ID NO: 3644359 - RNA, 16 nt, Salmonella enterica enterica serovar Typhi
cugaaucucuucccag

SEQ ID NO: 3644360 - RNA, 21 nt, Salmonella enterica enterica serovar Typhi
cugaaucucuucccagcgcac

SEQ ID NO: 3644361 - RNA, 19 nt, Salmonella enterica enterica serovar Typhi
cugaaucugcggcugcgug

SEQ ID NO: 3644362 - RNA, 20 nt, Salmonella enterica enterica serovar Typhi
cugaaucuugcgcagcauau

SEQ ID NO: 3644363 - RNA, 21 nt, Salmonella enterica enterica serovar Typhi
cugaaugccuuuuacaauaac

SEQ ID NO: 3644364 - RNA, 14 nt, Salmonella enterica enterica serovar Typhi
cugaaugcucucau

SEQ ID NO: 3644365 - RNA, 21 nt, Salmonella enterica enterica serovar Typhi
cugaauuuaauggucuuaaau

SEQ ID NO: 3644366 - RNA, 23 nt, Salmonella enterica enterica serovar Typhi
cugaauuuacgccguccggcgaa

SEQ ID NO: 3644367 - RNA, 22 nt, Salmonella enterica enterica serovar Typhi
cugacaacacauccgcagcgaa

SEQ ID NO: 3644368 - RNA, 23 nt, Salmonella enterica enterica serovar Typhi
cugacagagcucgucaaaaauca

SEQ ID NO: 3644369 - RNA, 16 nt, Salmonella enterica enterica serovar Typhi
cugacagccaaacugc

SEQ ID NO: 3644370 - RNA, 18 nt, Salmonella enterica enterica serovar Typhi
cugacagggucgcaauac

SEQ ID NO: 3644371 - RNA, 13 nt, Salmonella enterica enterica serovar Typhi
cugacauaaucau

SEQ ID NO: 3644372 - RNA, 17 nt, Salmonella enterica enterica serovar Typhi
cugacaucucuuuuaau

SEQ ID NO: 3644373 - RNA, 15 nt, Salmonella enterica enterica serovar Typhi
cugacauuuauauua

SEQ ID NO: 3644374 - RNA, 21 nt, Salmonella enterica enterica serovar Typhi
cugacauuugcaucaaacuuc

SEQ ID NO: 3644375 - RNA, 17 nt, Salmonella enterica enterica serovar Typhi
cugaccaacaacagaua

SEQ ID NO: 3644376 - RNA, 19 nt, Salmonella enterica enterica serovar Typhi
cugaccaacgucagcaucu

SEQ ID NO: 3644377 - RNA, 15 nt, Salmonella enterica enterica serovar Typhi
cugaccacauuuucu

SEQ ID NO: 3644378 - RNA, 16 nt, Salmonella enterica enterica serovar Typhi
cugaccacauuuucuc

SEQ ID NO: 3644379 - RNA, 17 nt, Salmonella enterica enterica serovar Typhi
cugaccaccggcccggu

SEQ ID NO: 3644380 - RNA, 14 nt, Salmonella enterica enterica serovar Typhi
cugaccagacagau

SEQ ID NO: 3644381 - RNA, 14 nt, Salmonella enterica enterica serovar Typhi
cugaccagggcaaa

SEQ ID NO: 3644382 - RNA, 22 nt, Salmonella enterica enterica serovar Typhi
cugaccaugcauauaagagacg

SEQ ID NO: 3644383 - RNA, 14 nt, Salmonella enterica enterica serovar Typhi
cugaccaugccaca

SEQ ID NO: 3644384 - RNA, 16 nt, Salmonella enterica enterica serovar Typhi
cugaccgagaucaggc

SEQ ID NO: 3644385 - RNA, 18 nt, Salmonella enterica enterica serovar Typhi
cugaccgccccguaucau

SEQ ID NO: 3644386 - RNA, 20 nt, Salmonella enterica enterica serovar Typhi
cugaccgcgaucgcuggacg

SEQ ID NO: 3644387 - RNA, 13 nt, Salmonella enterica enterica serovar Typhi
cugaccgcuccag

SEQ ID NO: 3644388 - RNA, 19 nt, Salmonella enterica enterica serovar Typhi
cugaccgguaaauuucacu

SEQ ID NO: 3644389 - RNA, 15 nt, Salmonella enterica enterica serovar Typhi
cugaccucaauccgu

SEQ ID NO: 3644390 - RNA, 13 nt, Salmonella enterica enterica serovar Typhi
cugaccuuaaucc

SEQ ID NO: 3644391 - RNA, 17 nt, Salmonella enterica enterica serovar Typhi
cugaccuuaauccagca

SEQ ID NO: 3644392 - RNA, 16 nt, Salmonella enterica enterica serovar Typhi
cugacgaaaaccgucc

SEQ ID NO: 3644393 - RNA, 21 nt, Salmonella enterica enterica serovar Typhi
cugacgaaagucauccaguac

SEQ ID NO: 3644394 - RNA, 19 nt, Salmonella enterica enterica serovar Typhi
cugacgaagaacuuaggau

SEQ ID NO: 3644395 - RNA, 17 nt, Salmonella enterica enterica serovar Typhi
cugacgaauagcgcgcu

SEQ ID NO: 3644396 - RNA, 17 nt, Salmonella enterica enterica serovar Typhi
cugacgacgccagcccu

SEQ ID NO: 3644397 - RNA, 16 nt, Salmonella enterica enterica serovar Typhi
cugacgagguuaucag

SEQ ID NO: 3644398 - RNA, 16 nt, Salmonella enterica enterica serovar Typhi
cugacgaguggcggac

SEQ ID NO: 3644399 - RNA, 15 nt, Salmonella enterica enterica serovar Typhi
cugacgcaaucuguu

SEQ ID NO: 3644400 - RNA, 17 nt, Salmonella enterica enterica serovar Typhi
cugacgcagcuucugau

SEQ ID NO: 3644401 - RNA, 17 nt, Salmonella enterica enterica serovar Typhi
cugacgccauucauucc

SEQ ID NO: 3644402 - RNA, 18 nt, Salmonella enterica enterica serovar Typhi
cugacgcccaucagcauc

SEQ ID NO: 3644403 - RNA, 23 nt, Salmonella enterica enterica serovar Typhi
cugacgccgguauucauaugcuc

SEQ ID NO: 3644404 - RNA, 16 nt, Salmonella enterica enterica serovar Typhi
cugacgccugaaaugc

SEQ ID NO: 3644405 - RNA, 13 nt, Salmonella enterica enterica serovar Typhi
cugacgcgccugg

SEQ ID NO: 3644406 - RNA, 18 nt, Salmonella enterica enterica serovar Typhi
cugacgcggacgccacca

SEQ ID NO: 3644407 - RNA, 22 nt, Salmonella enterica enterica serovar Typhi
cugacgcguuuuuucaugaauc

SEQ ID NO: 3644408 - RNA, 16 nt, Salmonella enterica enterica serovar Typhi
cugacgcugcgccugg

SEQ ID NO: 3644409 - RNA, 23 nt, Salmonella enterica enterica serovar Typhi
cugacggccugucuccucagcag

SEQ ID NO: 3644410 - RNA, 19 nt, Salmonella enterica enterica serovar Typhi
cugacgggcauuguuaauc

SEQ ID NO: 3644411 - RNA, 17 nt, Salmonella enterica enterica serovar Typhi
cugacguagauucugau

SEQ ID NO: 3644412 - RNA, 19 nt, Salmonella enterica enterica serovar Typhi
cugacuacgguugccuuuc

SEQ ID NO: 3644413 - RNA, 16 nt, Salmonella enterica enterica serovar Typhi
cugacuauacccaaaa

SEQ ID NO: 3644414 - RNA, 18 nt, Salmonella enterica enterica serovar Typhi
cugacuauccacagcgaa

SEQ ID NO: 3644415 - RNA, 15 nt, Salmonella enterica enterica serovar Typhi
cugacuaucuggaua

SEQ ID NO: 3644416 - RNA, 15 nt, Salmonella enterica enterica serovar Typhi
cugacuauugcugag

SEQ ID NO: 3644417 - RNA, 15 nt, Salmonella enterica enterica serovar Typhi
cugacucaucacauc

SEQ ID NO: 3644418 - RNA, 14 nt, Salmonella enterica enterica serovar Typhi
cugacuccagcugg

SEQ ID NO: 3644419 - RNA, 21 nt, Salmonella enterica enterica serovar Typhi
cugacugaucgauccacuucc

SEQ ID NO: 3644420 - RNA, 18 nt, Salmonella enterica enterica serovar Typhi
cugacugcaaaucugccg

SEQ ID NO: 3644421 - RNA, 13 nt, Salmonella enterica enterica serovar Typhi
cugacugcauaau

SEQ ID NO: 3644422 - RNA, 19 nt, Salmonella enterica enterica serovar Typhi
cugacugcauaauggugga

SEQ ID NO: 3644423 - RNA, 19 nt, Salmonella enterica enterica serovar Typhi
cugacugcgugagugugga

SEQ ID NO: 3644424 - RNA, 14 nt, Salmonella enterica enterica serovar Typhi
cugacugcugucau

SEQ ID NO: 3644425 - RNA, 13 nt, Salmonella enterica enterica serovar Typhi
cugacuguaauuu

SEQ ID NO: 3644426 - RNA, 15 nt, Salmonella enterica enterica serovar Typhi
cugacuguucacgca

SEQ ID NO: 3644427 - RNA, 21 nt, Salmonella enterica enterica serovar Typhi
cugacuguucacgcagcgcau

SEQ ID NO: 3644428 - RNA, 19 nt, Salmonella enterica enterica serovar Typhi
cugacuuacaggcuggaaa

SEQ ID NO: 3644429 - RNA, 12 nt, Salmonella enterica enterica serovar Typhi
cugacuuuccug

SEQ ID NO: 3644430 - RNA, 12 nt, Salmonella enterica enterica serovar Typhi
cugacuuuucca

SEQ ID NO: 3644431 - RNA, 19 nt, Salmonella enterica enterica serovar Typhi
cugagaaaaauacgccaga

SEQ ID NO: 3644432 - RNA, 20 nt, Salmonella enterica enterica serovar Typhi
cugagaaaaauacgccagau

SEQ ID NO: 3644433 - RNA, 20 nt, Salmonella enterica enterica serovar Typhi
cugagaaaagggcgcaccaa

SEQ ID NO: 3644434 - RNA, 17 nt, Salmonella enterica enterica serovar Typhi
cugagacgugugauugu

SEQ ID NO: 3644435 - RNA, 18 nt, Salmonella enterica enterica serovar Typhi
cugagaugaccauaugcg

SEQ ID NO: 3644436 - RNA, 21 nt, Salmonella enterica enterica serovar Typhi
cugagaugaccauaugcggca

SEQ ID NO: 3644437 - RNA, 23 nt, Salmonella enterica enterica serovar Typhi
cugagauggcacgauaaccagau

SEQ ID NO: 3644438 - RNA, 21 nt, Salmonella enterica enterica serovar Typhi
cugagcaaaaccagacgccga

SEQ ID NO: 3644439 - RNA, 20 nt, Salmonella enterica enterica serovar Typhi
cugagccaauuuaugccgga

SEQ ID NO: 3644440 - RNA, 14 nt, Salmonella enterica enterica serovar Typhi
cugagccgcccggc

SEQ ID NO: 3644441 - RNA, 16 nt, Salmonella enterica enterica serovar Typhi
cugagcgaauguauaa

SEQ ID NO: 3644442 - RNA, 19 nt, Salmonella enterica enterica serovar Typhi
cugagcgcgagcaugugua

SEQ ID NO: 3644443 - RNA, 23 nt, Salmonella enterica enterica serovar Typhi
cugagcgcgcagcugggccugcu

SEQ ID NO: 3644444 - RNA, 16 nt, Salmonella enterica enterica serovar Typhi
cugagcggcucaucca

SEQ ID NO: 3644445 - RNA, 19 nt, Salmonella enterica enterica serovar Typhi
cugagcggcucauccagca

SEQ ID NO: 3644446 - RNA, 14 nt, Salmonella enterica enterica serovar Typhi
cugagcuaacgacc

SEQ ID NO: 3644447 - RNA, 16 nt, Salmonella enterica enterica serovar Typhi
cugagcuaaucaccca

SEQ ID NO: 3644448 - RNA, 14 nt, Salmonella enterica enterica serovar Typhi
cugaggcgcuggcu

SEQ ID NO: 3644449 - RNA, 17 nt, Salmonella enterica enterica serovar Typhi
cugaggcguugcuccag

SEQ ID NO: 3644450 - RNA, 18 nt, Salmonella enterica enterica serovar Typhi
cugaggcuauugucauug

SEQ ID NO: 3644451 - RNA, 22 nt, Salmonella enterica enterica serovar Typhi
cugaguauaaaacucgccgcga

SEQ ID NO: 3644452 - RNA, 13 nt, Salmonella enterica enterica serovar Typhi
cugaguauagagc

SEQ ID NO: 3644453 - RNA, 12 nt, Salmonella enterica enterica serovar Typhi
cugaguauguua

SEQ ID NO: 3644454 - RNA, 14 nt, Salmonella enterica enterica serovar Typhi
cugaguggucugga

SEQ ID NO: 3644455 - RNA, 22 nt, Salmonella enterica enterica serovar Typhi
cugaguuacgaucguuugccca

SEQ ID NO: 3644456 - RNA, 18 nt, Salmonella enterica enterica serovar Typhi
cugauaaaacgcaggcag

SEQ ID NO: 3644457 - RNA, 13 nt, Salmonella enterica enterica serovar Typhi
cugauaaaagccc

SEQ ID NO: 3644458 - RNA, 11 nt, Salmonella enterica enterica serovar Typhi
cugauaaaauu

SEQ ID NO: 3644459 - RNA, 18 nt, Salmonella enterica enterica serovar Typhi
cugauaacgauaagugaa

SEQ ID NO: 3644460 - RNA, 20 nt, Salmonella enterica enterica serovar Typhi
cugauaagacugauauccau

SEQ ID NO: 3644461 - RNA, 14 nt, Salmonella enterica enterica serovar Typhi
cugauaagcacagg

SEQ ID NO: 3644462 - RNA, 17 nt, Salmonella enterica enterica serovar Typhi
cugauaagcauagcgcc

SEQ ID NO: 3644463 - RNA, 18 nt, Salmonella enterica enterica serovar Typhi
cugauaagcgaagcgcca

SEQ ID NO: 3644464 - RNA, 19 nt, Salmonella enterica enterica serovar Typhi
cugauaagcgcagcgccau

SEQ ID NO: 3644465 - RNA, 19 nt, Salmonella enterica enterica serovar Typhi
cugauaagguaaagccgcc

SEQ ID NO: 3644466 - RNA, 16 nt, Salmonella enterica enterica serovar Typhi
cugauaaucgagacug

SEQ ID NO: 3644467 - RNA, 17 nt, Salmonella enterica enterica serovar Typhi
cugauaccccagcgauc

SEQ ID NO: 3644468 - RNA, 21 nt, Salmonella enterica enterica serovar Typhi
cugauacggaaauagcgccau

SEQ ID NO: 3644469 - RNA, 15 nt, Salmonella enterica enterica serovar Typhi
cugauagcacagcgc

SEQ ID NO: 3644470 - RNA, 12 nt, Salmonella enterica enterica serovar Typhi
cugauagcccau

SEQ ID NO: 3644471 - RNA, 19 nt, Salmonella enterica enterica serovar Typhi
cugauagcccauccagcac

SEQ ID NO: 3644472 - RNA, 13 nt, Salmonella enterica enterica serovar Typhi
cugauagcgggua

SEQ ID NO: 3644473 - RNA, 19 nt, Salmonella enterica enterica serovar Typhi
cugauagggacacauuucu

SEQ ID NO: 3644474 - RNA, 20 nt, Salmonella enterica enterica serovar Typhi
cugauagggacacauuucuu

SEQ ID NO: 3644475 - RNA, 16 nt, Salmonella enterica enterica serovar Typhi
cugauagugaucgcca

SEQ ID NO: 3644476 - RNA, 21 nt, Salmonella enterica enterica serovar Typhi
cugauauugcguaagcagcug

SEQ ID NO: 3644477 - RNA, 16 nt, Salmonella enterica enterica serovar Typhi
cugauauuuuuacuga

SEQ ID NO: 3644478 - RNA, 17 nt, Salmonella enterica enterica serovar Typhi
cugauauuuuuacugau

SEQ ID NO: 3644479 - RNA, 15 nt, Salmonella enterica enterica serovar Typhi
cugaucccgcgcgcc

SEQ ID NO: 3644480 - RNA, 18 nt, Salmonella enterica enterica serovar Typhi
cugauccuguaaaaaauc

SEQ ID NO: 3644481 - RNA, 20 nt, Salmonella enterica enterica serovar Typhi
cugaucgacgaaaucccggc

SEQ ID NO: 3644482 - RNA, 18 nt, Salmonella enterica enterica serovar Typhi
cugaucgaggucgccaaa

SEQ ID NO: 3644483 - RNA, 22 nt, Salmonella enterica enterica serovar Typhi
cugaucgccacgccuaaacuga

SEQ ID NO: 3644484 - RNA, 15 nt, Salmonella enterica enterica serovar Typhi
cugaucggccagcgu

SEQ ID NO: 3644485 - RNA, 20 nt, Salmonella enterica enterica serovar Typhi
cugaucgugauaggccagac

SEQ ID NO: 3644486 - RNA, 13 nt, Salmonella enterica enterica serovar Typhi
cugaugaauacgc

SEQ ID NO: 3644487 - RNA, 16 nt, Salmonella enterica enterica serovar Typhi
cugaugacgcgccgga

SEQ ID NO: 3644488 - RNA, 17 nt, Salmonella enterica enterica serovar Typhi
cugaugagcaggccagg

SEQ ID NO: 3644489 - RNA, 17 nt, Salmonella enterica enterica serovar Typhi
cugaugagcgcagcgac

SEQ ID NO: 3644490 - RNA, 21 nt, Salmonella enterica enterica serovar Typhi
cugaugauggaacagacgccu

SEQ ID NO: 3644491 - RNA, 18 nt, Salmonella enterica enterica serovar Typhi
cugaugauuggccuccac

SEQ ID NO: 3644492 - RNA, 13 nt, Salmonella enterica enterica serovar Typhi
cugaugccgucga

SEQ ID NO: 3644493 - RNA, 18 nt, Salmonella enterica enterica serovar Typhi
cugaugccgucgacgccg

SEQ ID NO: 3644494 - RNA, 14 nt, Salmonella enterica enterica serovar Typhi
cugaugccugaagg

SEQ ID NO: 3644495 - RNA, 22 nt, Salmonella enterica enterica serovar Typhi
cugaugcgcguuuagcgccagc

SEQ ID NO: 3644496 - RNA, 24 nt, Salmonella enterica enterica serovar Typhi
cugaugcgcguuuagcgccagcag

SEQ ID NO: 3644497 - RNA, 19 nt, Salmonella enterica enterica serovar Typhi
cugaugcguuguaccguuu

SEQ ID NO: 3644498 - RNA, 22 nt, Salmonella enterica enterica serovar Typhi
cugaugcguuguaccguuuucc

SEQ ID NO: 3644499 - RNA, 16 nt, Salmonella enterica enterica serovar Typhi
cugaugcuggcgccau

SEQ ID NO: 3644500 - RNA, 18 nt, Salmonella enterica enterica serovar Typhi
cugauggcgcuacgcuua

SEQ ID NO: 3644501 - RNA, 21 nt, Salmonella enterica enterica serovar Typhi
cugauggcguggcgcaguaaa

SEQ ID NO: 3644502 - RNA, 14 nt, Salmonella enterica enterica serovar Typhi
cugauggcguucca

SEQ ID NO: 3644503 - RNA, 16 nt, Salmonella enterica enterica serovar Typhi
cugauguccgcagccg

SEQ ID NO: 3644504 - RNA, 14 nt, Salmonella enterica enterica serovar Typhi
cugauguuccggca

SEQ ID NO: 3644505 - RNA, 17 nt, Salmonella enterica enterica serovar Typhi
cugauuaauaugaacca

SEQ ID NO: 3644506 - RNA, 19 nt, Salmonella enterica enterica serovar Typhi
cugauuaauaugaaccaau

SEQ ID NO: 3644507 - RNA, 22 nt, Salmonella enterica enterica serovar Typhi
cugauuacguugauuaucaccc

SEQ ID NO: 3644508 - RNA, 15 nt, Salmonella enterica enterica serovar Typhi
cugauuauucaguac

SEQ ID NO: 3644509 - RNA, 13 nt, Salmonella enterica enterica serovar Typhi
cugauucaauuaa

SEQ ID NO: 3644510 - RNA, 19 nt, Salmonella enterica enterica serovar Typhi
cugauugacuaucagccgc

SEQ ID NO: 3644511 - RNA, 20 nt, Salmonella enterica enterica serovar Typhi
cugauuucgacgauaaaaaa

SEQ ID NO: 3644512 - RNA, 13 nt, Salmonella enterica enterica serovar Typhi
cugauuugccaaa

SEQ ID NO: 3644513 - RNA, 16 nt, Salmonella enterica enterica serovar Typhi
cugauuuguaggccug

SEQ ID NO: 3644514 - RNA, 13 nt, Salmonella enterica enterica serovar Typhi
cugauuuuacuga

SEQ ID NO: 3644515 - RNA, 14 nt, Salmonella enterica enterica serovar Typhi
cugauuuucuccag

SEQ ID NO: 3644516 - RNA, 15 nt, Salmonella enterica enterica serovar Typhi
cugauuuucuccagc

SEQ ID NO: 3644517 - RNA, 13 nt, Salmonella enterica enterica serovar Typhi
cugauuuuuccau

SEQ ID NO: 3644518 - RNA, 16 nt, Salmonella enterica enterica serovar Typhi
cugcaaaaagccuugc

SEQ ID NO: 3644519 - RNA, 20 nt, Salmonella enterica enterica serovar Typhi
cugcaaaaagccuugcugaa

SEQ ID NO: 3644520 - RNA, 13 nt, Salmonella enterica enterica serovar Typhi
cugcaaaauuugu

SEQ ID NO: 3644521 - RNA, 19 nt, Salmonella enterica enterica serovar Typhi
cugcaaauaccacaucaga

SEQ ID NO: 3644522 - RNA, 14 nt, Salmonella enterica enterica serovar Typhi
cugcaaaucugccg

SEQ ID NO: 3644523 - RNA, 21 nt, Salmonella enterica enterica serovar Typhi
cugcaaaucugccgucaucga

SEQ ID NO: 3644524 - RNA, 18 nt, Salmonella enterica enterica serovar Typhi
cugcaaaucuucggcaaa

SEQ ID NO: 3644525 - RNA, 14 nt, Salmonella enterica enterica serovar Typhi
cugcaacagcacca

SEQ ID NO: 3644526 - RNA, 16 nt, Salmonella enterica enterica serovar Typhi
cugcaacagcacggga

SEQ ID NO: 3644527 - RNA, 19 nt, Salmonella enterica enterica serovar Typhi
cugcaacauuacugaccga

SEQ ID NO: 3644528 - RNA, 17 nt, Salmonella enterica enterica serovar Typhi
cugcaacgccugcggau

SEQ ID NO: 3644529 - RNA, 17 nt, Salmonella enterica enterica serovar Typhi
cugcaacuccugggcaa

SEQ ID NO: 3644530 - RNA, 16 nt, Salmonella enterica enterica serovar Typhi
cugcaagaagcguuga

SEQ ID NO: 3644531 - RNA, 17 nt, Salmonella enterica enterica serovar Typhi
cugcaauagcagaucgc

SEQ ID NO: 3644532 - RNA, 18 nt, Salmonella enterica enterica serovar Typhi
cugcaaucguucuugcac

SEQ ID NO: 3644533 - RNA, 22 nt, Salmonella enterica enterica serovar Typhi
cugcaaugguaaaacgcuggcc

SEQ ID NO: 3644534 - RNA, 13 nt, Salmonella enterica enterica serovar Typhi
cugcaauucauag

SEQ ID NO: 3644535 - RNA, 21 nt, Salmonella enterica enterica serovar Typhi
cugcacaacauuccgcuucca

SEQ ID NO: 3644536 - RNA, 17 nt, Salmonella enterica enterica serovar Typhi
cugcacaauaccaauaa

SEQ ID NO: 3644537 - RNA, 14 nt, Salmonella enterica enterica serovar Typhi
cugcacaaucgcca

SEQ ID NO: 3644538 - RNA, 17 nt, Salmonella enterica enterica serovar Typhi
cugcacaaucgccagcc

SEQ ID NO: 3644539 - RNA, 23 nt, Salmonella enterica enterica serovar Typhi
cugcacauugcaggcuuuuucau

SEQ ID NO: 3644540 - RNA, 18 nt, Salmonella enterica enterica serovar Typhi
cugcaccuuuuuuuccag

SEQ ID NO: 3644541 - RNA, 20 nt, Salmonella enterica enterica serovar Typhi
cugcaccuuuuuuuccagcg

SEQ ID NO: 3644542 - RNA, 24 nt, Salmonella enterica enterica serovar Typhi
cugcaccuuuuuuuccagcgucug

SEQ ID NO: 3644543 - RNA, 16 nt, Salmonella enterica enterica serovar Typhi
cugcacgaaauguaga

SEQ ID NO: 3644544 - RNA, 17 nt, Salmonella enterica enterica serovar Typhi
cugcacgaaauguagag

SEQ ID NO: 3644545 - RNA, 16 nt, Salmonella enterica enterica serovar Typhi
cugcacguaccugcuc

SEQ ID NO: 3644546 - RNA, 22 nt, Salmonella enterica enterica serovar Typhi
cugcacguuuugcucuucuucc

SEQ ID NO: 3644547 - RNA, 17 nt, Salmonella enterica enterica serovar Typhi
cugcacuuccagccacg

SEQ ID NO: 3644548 - RNA, 22 nt, Salmonella enterica enterica serovar Typhi
cugcacuuuaaaccacaccuga

SEQ ID NO: 3644549 - RNA, 21 nt, Salmonella enterica enterica serovar Typhi
cugcagaaucccgauaaucaa

SEQ ID NO: 3644550 - RNA, 22 nt, Salmonella enterica enterica serovar Typhi
cugcagaaucccgauaaucaau

SEQ ID NO: 3644551 - RNA, 13 nt, Salmonella enterica enterica serovar Typhi
cugcagaaucucu

SEQ ID NO: 3644552 - RNA, 23 nt, Salmonella enterica enterica serovar Typhi
cugcagacccacuuucagcuccg

SEQ ID NO: 3644553 - RNA, 20 nt, Salmonella enterica enterica serovar Typhi
cugcagaccuauauggcgca

SEQ ID NO: 3644554 - RNA, 22 nt, Salmonella enterica enterica serovar Typhi
cugcagauuuugcucccuggug

SEQ ID NO: 3644555 - RNA, 11 nt, Salmonella enterica enterica serovar Typhi
cugcagccaua

SEQ ID NO: 3644556 - RNA, 17 nt, Salmonella enterica enterica serovar Typhi
cugcagcccuuacgcuu

SEQ ID NO: 3644557 - RNA, 13 nt, Salmonella enterica enterica serovar Typhi
cugcagcgccaga

SEQ ID NO: 3644558 - RNA, 15 nt, Salmonella enterica enterica serovar Typhi
cugcagcuccgcaau

SEQ ID NO: 3644559 - RNA, 18 nt, Salmonella enterica enterica serovar Typhi
cugcagggaauaagcgcc

SEQ ID NO: 3644560 - RNA, 13 nt, Salmonella enterica enterica serovar Typhi
cugcagggccgcg

SEQ ID NO: 3644561 - RNA, 16 nt, Salmonella enterica enterica serovar Typhi
cugcagggugaagaug

SEQ ID NO: 3644562 - RNA, 18 nt, Salmonella enterica enterica serovar Typhi
cugcauaaauaucugcau

SEQ ID NO: 3644563 - RNA, 21 nt, Salmonella enterica enterica serovar Typhi
cugcauaauggcgacggccac

SEQ ID NO: 3644564 - RNA, 21 nt, Salmonella enterica enterica serovar Typhi
cugcauacucacauucauaaa

SEQ ID NO: 3644565 - RNA, 15 nt, Salmonella enterica enterica serovar Typhi
cugcauauuuuucau

SEQ ID NO: 3644566 - RNA, 17 nt, Salmonella enterica enterica serovar Typhi
cugcauauuuuucauuc

SEQ ID NO: 3644567 - RNA, 13 nt, Salmonella enterica enterica serovar Typhi
cugcaucaacagg

SEQ ID NO: 3644568 - RNA, 15 nt, Salmonella enterica enterica serovar Typhi
cugcaucaccucaga

SEQ ID NO: 3644569 - RNA, 13 nt, Salmonella enterica enterica serovar Typhi
cugcaucagcucg

SEQ ID NO: 3644570 - RNA, 15 nt, Salmonella enterica enterica serovar Typhi
cugcauccuguacca

SEQ ID NO: 3644571 - RNA, 19 nt, Salmonella enterica enterica serovar Typhi
cugcauccuguaccaccac

SEQ ID NO: 3644572 - RNA, 19 nt, Salmonella enterica enterica serovar Typhi
cugcaucgugagcgcguca

SEQ ID NO: 3644573 - RNA, 19 nt, Salmonella enterica enterica serovar Typhi
cugcaucguuugcaguucc

SEQ ID NO: 3644574 - RNA, 20 nt, Salmonella enterica enterica serovar Typhi
cugcaucguuugcaguuccg

SEQ ID NO: 3644575 - RNA, 13 nt, Salmonella enterica enterica serovar Typhi
cugcaucuccagc

SEQ ID NO: 3644576 - RNA, 20 nt, Salmonella enterica enterica serovar Typhi
cugcauguaguaagccauuc

SEQ ID NO: 3644577 - RNA, 17 nt, Salmonella enterica enterica serovar Typhi
cugcauuaacggcaaca

SEQ ID NO: 3644578 - RNA, 11 nt, Salmonella enterica enterica serovar Typhi
cugcauucagg

SEQ ID NO: 3644579 - RNA, 18 nt, Salmonella enterica enterica serovar Typhi
cugcauuugcugccgugg

SEQ ID NO: 3644580 - RNA, 21 nt, Salmonella enterica enterica serovar Typhi
cugccaaccauuaacuccgga

SEQ ID NO: 3644581 - RNA, 20 nt, Salmonella enterica enterica serovar Typhi
cugccaaugaaauaauugug

SEQ ID NO: 3644582 - RNA, 13 nt, Salmonella enterica enterica serovar Typhi
cugccacaacggc

SEQ ID NO: 3644583 - RNA, 14 nt, Salmonella enterica enterica serovar Typhi
cugccacaggccaa

SEQ ID NO: 3644584 - RNA, 16 nt, Salmonella enterica enterica serovar Typhi
cugccacaucgccagc

SEQ ID NO: 3644585 - RNA, 16 nt, Salmonella enterica enterica serovar Typhi
cugccaccagcguacc

SEQ ID NO: 3644586 - RNA, 22 nt, Salmonella enterica enterica serovar Typhi
cugccaccgcuccgcgcauccg

SEQ ID NO: 3644587 - RNA, 20 nt, Salmonella enterica enterica serovar Typhi
cugccacgcuuuuccuucca

SEQ ID NO: 3644588 - RNA, 20 nt, Salmonella enterica enterica serovar Typhi
cugccagcaaggcaagaaag

SEQ ID NO: 3644589 - RNA, 15 nt, Salmonella enterica enterica serovar Typhi
cugccagccgcucug

SEQ ID NO: 3644590 - RNA, 22 nt, Salmonella enterica enterica serovar Typhi
cugccagcuuaaaucgcggcgc

SEQ ID NO: 3644591 - RNA, 22 nt, Salmonella enterica enterica serovar Typhi
cugccagguuauuucgcgcagu

SEQ ID NO: 3644592 - RNA, 18 nt, Salmonella enterica enterica serovar Typhi
cugccaguagauggcgcu

SEQ ID NO: 3644593 - RNA, 24 nt, Salmonella enterica enterica serovar Typhi
cugccaguagcggaauaucuuccc

SEQ ID NO: 3644594 - RNA, 19 nt, Salmonella enterica enterica serovar Typhi
cugccaguaguugaauaac

SEQ ID NO: 3644595 - RNA, 19 nt, Salmonella enterica enterica serovar Typhi
cugccagucugcccggcaa

SEQ ID NO: 3644596 - RNA, 13 nt, Salmonella enterica enterica serovar Typhi
cugccaucaggca

SEQ ID NO: 3644597 - RNA, 15 nt, Salmonella enterica enterica serovar Typhi
cugccaucauccagu

SEQ ID NO: 3644598 - RNA, 14 nt, Salmonella enterica enterica serovar Typhi
cugccauuucugcu

SEQ ID NO: 3644599 - RNA, 22 nt, Salmonella enterica enterica serovar Typhi
cugccauuucugcucacgguuu

SEQ ID NO: 3644600 - RNA, 13 nt, Salmonella enterica enterica serovar Typhi
cugcccaccuucg

SEQ ID NO: 3644601 - RNA, 22 nt, Salmonella enterica enterica serovar Typhi
cugcccaucuaaccgggccuga

SEQ ID NO: 3644602 - RNA, 20 nt, Salmonella enterica enterica serovar Typhi
cugcccauguuuaccaucgc

SEQ ID NO: 3644603 - RNA, 15 nt, Salmonella enterica enterica serovar Typhi
cugccccagacgccc

SEQ ID NO: 3644604 - RNA, 18 nt, Salmonella enterica enterica serovar Typhi
cugccccagacgcccuuc

SEQ ID NO: 3644605 - RNA, 18 nt, Salmonella enterica enterica serovar Typhi
cugccccgccacagccgc

SEQ ID NO: 3644606 - RNA, 20 nt, Salmonella enterica enterica serovar Typhi
cugccccgccacagccgcau

SEQ ID NO: 3644607 - RNA, 17 nt, Salmonella enterica enterica serovar Typhi
cugccccggugagcgcc

SEQ ID NO: 3644608 - RNA, 17 nt, Salmonella enterica enterica serovar Typhi
cugcccgccgccaccau

SEQ ID NO: 3644609 - RNA, 16 nt, Salmonella enterica enterica serovar Typhi
cugcccgcguuuccac

SEQ ID NO: 3644610 - RNA, 15 nt, Salmonella enterica enterica serovar Typhi
cugcccuacgcuucu

SEQ ID NO: 3644611 - RNA, 20 nt, Salmonella enterica enterica serovar Typhi
cugcccuacgcuucucucca

SEQ ID NO: 3644612 - RNA, 21 nt, Salmonella enterica enterica serovar Typhi
cugcccuacgcuucucuccau

SEQ ID NO: 3644613 - RNA, 17 nt, Salmonella enterica enterica serovar Typhi
cugcccugacucgcacc

SEQ ID NO: 3644614 - RNA, 12 nt, Salmonella enterica enterica serovar Typhi
cugcccugcggu

SEQ ID NO: 3644615 - RNA, 13 nt, Salmonella enterica enterica serovar Typhi
cugcccugcggua

SEQ ID NO: 3644616 - RNA, 17 nt, Salmonella enterica enterica serovar Typhi
cugccgacaacgccucc

SEQ ID NO: 3644617 - RNA, 22 nt, Salmonella enterica enterica serovar Typhi
cugccgacgcccucaauaucuu

SEQ ID NO: 3644618 - RNA, 21 nt, Salmonella enterica enterica serovar Typhi
cugccgauagcaucgcugaug

SEQ ID NO: 3644619 - RNA, 23 nt, Salmonella enterica enterica serovar Typhi
cugccgaugaaagagcgcgcgcg

SEQ ID NO: 3644620 - RNA, 13 nt, Salmonella enterica enterica serovar Typhi
cugccgcaccagu

SEQ ID NO: 3644621 - RNA, 19 nt, Salmonella enterica enterica serovar Typhi
cugccgcaccagucggcaa

SEQ ID NO: 3644622 - RNA, 15 nt, Salmonella enterica enterica serovar Typhi
cugccgcagccgcuc

SEQ ID NO: 3644623 - RNA, 16 nt, Salmonella enterica enterica serovar Typhi
cugccgccacgccgcu

SEQ ID NO: 3644624 - RNA, 20 nt, Salmonella enterica enterica serovar Typhi
cugccgccauuugcgcggcu

SEQ ID NO: 3644625 - RNA, 18 nt, Salmonella enterica enterica serovar Typhi
cugccgcgcccgccaucg

SEQ ID NO: 3644626 - RNA, 17 nt, Salmonella enterica enterica serovar Typhi
cugccgcgccugauuca

SEQ ID NO: 3644627 - RNA, 15 nt, Salmonella enterica enterica serovar Typhi
cugccgcgcgguauu

SEQ ID NO: 3644628 - RNA, 23 nt, Salmonella enterica enterica serovar Typhi
cugccggcuuaccagcgggccgc

SEQ ID NO: 3644629 - RNA, 15 nt, Salmonella enterica enterica serovar Typhi
cugccgggguaucau

SEQ ID NO: 3644630 - RNA, 13 nt, Salmonella enterica enterica serovar Typhi
cugccgguucggc

SEQ ID NO: 3644631 - RNA, 21 nt, Salmonella enterica enterica serovar Typhi
cugccguaaacaggcaggccc

SEQ ID NO: 3644632 - RNA, 16 nt, Salmonella enterica enterica serovar Typhi
cugccguagcguacuu

SEQ ID NO: 3644633 - RNA, 21 nt, Salmonella enterica enterica serovar Typhi
cugccgucaaugccuggcaga

SEQ ID NO: 3644634 - RNA, 15 nt, Salmonella enterica enterica serovar Typhi
cugccgucaauuuua

SEQ ID NO: 3644635 - RNA, 13 nt, Salmonella enterica enterica serovar Typhi
cugccgucaucga

SEQ ID NO: 3644636 - RNA, 14 nt, Salmonella enterica enterica serovar Typhi
cugccgucccagcg

SEQ ID NO: 3644637 - RNA, 18 nt, Salmonella enterica enterica serovar Typhi
cugccgucccagcggaug

SEQ ID NO: 3644638 - RNA, 21 nt, Salmonella enterica enterica serovar Typhi
cugccgugguccggcgucaac

SEQ ID NO: 3644639 - RNA, 19 nt, Salmonella enterica enterica serovar Typhi
cugccguuaaucuggccua

SEQ ID NO: 3644640 - RNA, 17 nt, Salmonella enterica enterica serovar Typhi
cugccguuugcgccagc

SEQ ID NO: 3644641 - RNA, 20 nt, Salmonella enterica enterica serovar Typhi
cugccguuuuuaacgccggc

SEQ ID NO: 3644642 - RNA, 13 nt, Salmonella enterica enterica serovar Typhi
cugccuaaagaaa

SEQ ID NO: 3644643 - RNA, 13 nt, Salmonella enterica enterica serovar Typhi
cugccuacugccc

SEQ ID NO: 3644644 - RNA, 23 nt, Salmonella enterica enterica serovar Typhi
cugccucaacaaguccuucuucc

SEQ ID NO: 3644645 - RNA, 12 nt, Salmonella enterica enterica serovar Typhi
cugccugcuuca

SEQ ID NO: 3644646 - RNA, 22 nt, Salmonella enterica enterica serovar Typhi
cugccuggcucauucuccggga

SEQ ID NO: 3644647 - RNA, 18 nt, Salmonella enterica enterica serovar Typhi
cugccuguagcagcgcca

SEQ ID NO: 3644648 - RNA, 22 nt, Salmonella enterica enterica serovar Typhi
cugccuguuuacggcaggcccg

SEQ ID NO: 3644649 - RNA, 17 nt, Salmonella enterica enterica serovar Typhi
cugccuuauccggccug

SEQ ID NO: 3644650 - RNA, 16 nt, Salmonella enterica enterica serovar Typhi
cugccuucugaaaguu

SEQ ID NO: 3644651 - RNA, 22 nt, Salmonella enterica enterica serovar Typhi
cugccuuuaacaaauuaaaucc

SEQ ID NO: 3644652 - RNA, 19 nt, Salmonella enterica enterica serovar Typhi
cugccuuuguacagcuugc

SEQ ID NO: 3644653 - RNA, 21 nt, Salmonella enterica enterica serovar Typhi
cugccuuuguacagcuugccg

SEQ ID NO: 3644654 - RNA, 18 nt, Salmonella enterica enterica serovar Typhi
cugccuuuuuuauugccu

SEQ ID NO: 3644655 - RNA, 15 nt, Salmonella enterica enterica serovar Typhi
cugcgaaaagcgugc

SEQ ID NO: 3644656 - RNA, 15 nt, Salmonella enterica enterica serovar Typhi
cugcgaacagcgcuc

SEQ ID NO: 3644657 - RNA, 20 nt, Salmonella enterica enterica serovar Typhi
cugcgaguuuaugguugucu

SEQ ID NO: 3644658 - RNA, 20 nt, Salmonella enterica enterica serovar Typhi
cugcgcaacauucugcuucc

SEQ ID NO: 3644659 - RNA, 15 nt, Salmonella enterica enterica serovar Typhi
cugcgcaacuggaag

SEQ ID NO: 3644660 - RNA, 14 nt, Salmonella enterica enterica serovar Typhi
cugcgcaaucauga

SEQ ID NO: 3644661 - RNA, 23 nt, Salmonella enterica enterica serovar Typhi
cugcgcaggucgccagaagccgu

SEQ ID NO: 3644662 - RNA, 22 nt, Salmonella enterica enterica serovar Typhi
cugcgccaaaucgguaaauguc

SEQ ID NO: 3644663 - RNA, 14 nt, Salmonella enterica enterica serovar Typhi
cugcgccagaucag

SEQ ID NO: 3644664 - RNA, 16 nt, Salmonella enterica enterica serovar Typhi
cugcgccagcauggcg

SEQ ID NO: 3644665 - RNA, 12 nt, Salmonella enterica enterica serovar Typhi
cugcgccagccg

SEQ ID NO: 3644666 - RNA, 14 nt, Salmonella enterica enterica serovar Typhi
cugcgccagccgga

SEQ ID NO: 3644667 - RNA, 15 nt, Salmonella enterica enterica serovar Typhi
cugcgccagccugcu

SEQ ID NO: 3644668 - RNA, 14 nt, Salmonella enterica enterica serovar Typhi
cugcgccagcgccg

SEQ ID NO: 3644669 - RNA, 15 nt, Salmonella enterica enterica serovar Typhi
cugcgccagcggcac

SEQ ID NO: 3644670 - RNA, 17 nt, Salmonella enterica enterica serovar Typhi
cugcgccagcggcacug

SEQ ID NO: 3644671 - RNA, 15 nt, Salmonella enterica enterica serovar Typhi
cugcgccauauccuc

SEQ ID NO: 3644672 - RNA, 23 nt, Salmonella enterica enterica serovar Typhi
cugcgccauguucauaaagugcc

SEQ ID NO: 3644673 - RNA, 18 nt, Salmonella enterica enterica serovar Typhi
cugcgccauugcgggagc

SEQ ID NO: 3644674 - RNA, 23 nt, Salmonella enterica enterica serovar Typhi
cugcgccauugcgggagcuugcc

SEQ ID NO: 3644675 - RNA, 16 nt, Salmonella enterica enterica serovar Typhi
cugcgcccgcaagcug

SEQ ID NO: 3644676 - RNA, 14 nt, Salmonella enterica enterica serovar Typhi
cugcgcccgccugc

SEQ ID NO: 3644677 - RNA, 13 nt, Salmonella enterica enterica serovar Typhi
cugcgccgccagc

SEQ ID NO: 3644678 - RNA, 22 nt, Salmonella enterica enterica serovar Typhi
cugcgccguuccguucgcguca

SEQ ID NO: 3644679 - RNA, 23 nt, Salmonella enterica enterica serovar Typhi
cugcgccugaaaggcacgcuccu

SEQ ID NO: 3644680 - RNA, 15 nt, Salmonella enterica enterica serovar Typhi
cugcgccugcucagc

SEQ ID NO: 3644681 - RNA, 13 nt, Salmonella enterica enterica serovar Typhi
cugcgcgccaaac

SEQ ID NO: 3644682 - RNA, 23 nt, Salmonella enterica enterica serovar Typhi
cugcgcgccaaaccguucacgcu

SEQ ID NO: 3644683 - RNA, 13 nt, Salmonella enterica enterica serovar Typhi
cugcgcgccgcag

SEQ ID NO: 3644684 - RNA, 22 nt, Salmonella enterica enterica serovar Typhi
cugcgcgccgcccugcaucaug

SEQ ID NO: 3644685 - RNA, 20 nt, Salmonella enterica enterica serovar Typhi
cugcgcgcgaugcugcucca

SEQ ID NO: 3644686 - RNA, 20 nt, Salmonella enterica enterica serovar Typhi
cugcgcggcaaugagcggcc

SEQ ID NO: 3644687 - RNA, 14 nt, Salmonella enterica enterica serovar Typhi
cugcgcguucugcu

SEQ ID NO: 3644688 - RNA, 16 nt, Salmonella enterica enterica serovar Typhi
cugcgcguucugcucc

SEQ ID NO: 3644689 - RNA, 17 nt, Salmonella enterica enterica serovar Typhi
cugcgcugcggucaggg

SEQ ID NO: 3644690 - RNA, 19 nt, Salmonella enterica enterica serovar Typhi
cugcgcuuaucaggccuac

SEQ ID NO: 3644691 - RNA, 23 nt, Salmonella enterica enterica serovar Typhi
cugcgcuuaucaggccuaccagc

SEQ ID NO: 3644692 - RNA, 24 nt, Salmonella enterica enterica serovar Typhi
cugcgcuuaucaggccuaccagcc

SEQ ID NO: 3644693 - RNA, 11 nt, Salmonella enterica enterica serovar Typhi
cugcgcuuugu

SEQ ID NO: 3644694 - RNA, 19 nt, Salmonella enterica enterica serovar Typhi
cugcggaacuaacccgcag

SEQ ID NO: 3644695 - RNA, 13 nt, Salmonella enterica enterica serovar Typhi
cugcggaauuuua

SEQ ID NO: 3644696 - RNA, 20 nt, Salmonella enterica enterica serovar Typhi
cugcggcaaaauuagccagu

SEQ ID NO: 3644697 - RNA, 17 nt, Salmonella enterica enterica serovar Typhi
cugcggcaguucuaaca

SEQ ID NO: 3644698 - RNA, 22 nt, Salmonella enterica enterica serovar Typhi
cugcggcauacuuucgcgcggc

SEQ ID NO: 3644699 - RNA, 21 nt, Salmonella enterica enterica serovar Typhi
cugcggcauuacgcgccucuu

SEQ ID NO: 3644700 - RNA, 13 nt, Salmonella enterica enterica serovar Typhi
cugcggccaugau

SEQ ID NO: 3644701 - RNA, 21 nt, Salmonella enterica enterica serovar Typhi
cugcggccaugaucgccgcca

SEQ ID NO: 3644702 - RNA, 23 nt, Salmonella enterica enterica serovar Typhi
cugcggcccauaaacaggucaca

SEQ ID NO: 3644703 - RNA, 15 nt, Salmonella enterica enterica serovar Typhi
cugcggcgucugccu

SEQ ID NO: 3644704 - RNA, 15 nt, Salmonella enterica enterica serovar Typhi
cugcggcguggagca

SEQ ID NO: 3644705 - RNA, 15 nt, Salmonella enterica enterica serovar Typhi
cugcggcugacgcga

SEQ ID NO: 3644706 - RNA, 19 nt, Salmonella enterica enterica serovar Typhi
cugcggcugacgcgaugac

SEQ ID NO: 3644707 - RNA, 14 nt, Salmonella enterica enterica serovar Typhi
cugcggguagucau

SEQ ID NO: 3644708 - RNA, 17 nt, Salmonella enterica enterica serovar Typhi
cugcguaggggcgaccg

SEQ ID NO: 3644709 - RNA, 14 nt, Salmonella enterica enterica serovar Typhi
cugcguccugcuua

SEQ ID NO: 3644710 - RNA, 15 nt, Salmonella enterica enterica serovar Typhi
cugcgugaagacaca

SEQ ID NO: 3644711 - RNA, 14 nt, Salmonella enterica enterica serovar Typhi
cugcgugagccgga

SEQ ID NO: 3644712 - RNA, 18 nt, Salmonella enterica enterica serovar Typhi
cugcgugaugcaucagaa

SEQ ID NO: 3644713 - RNA, 23 nt, Salmonella enterica enterica serovar Typhi
cugcgugccguugaccagcugac

SEQ ID NO: 3644714 - RNA, 22 nt, Salmonella enterica enterica serovar Typhi
cugcguggucguaaaacugcac

SEQ ID NO: 3644715 - RNA, 20 nt, Salmonella enterica enterica serovar Typhi
cugcguugcucgccagccug

SEQ ID NO: 3644716 - RNA, 20 nt, Salmonella enterica enterica serovar Typhi
cugcuaaaacagcucacccc

SEQ ID NO: 3644717 - RNA, 20 nt, Salmonella enterica enterica serovar Typhi
cugcuaaacgagccgucauc

SEQ ID NO: 3644718 - RNA, 23 nt, Salmonella enterica enterica serovar Typhi
cugcucaauacuuuccgggccgg

SEQ ID NO: 3644719 - RNA, 21 nt, Salmonella enterica enterica serovar Typhi
cugcucacgguuuagcucugu

SEQ ID NO: 3644720 - RNA, 21 nt, Salmonella enterica enterica serovar Typhi
cugcucauuuaugcgcugggc

SEQ ID NO: 3644721 - RNA, 22 nt, Salmonella enterica enterica serovar Typhi
cugcucauuuaugcgcugggca

SEQ ID NO: 3644722 - RNA, 16 nt, Salmonella enterica enterica serovar Typhi
cugcucccucacgcgu

SEQ ID NO: 3644723 - RNA, 22 nt, Salmonella enterica enterica serovar Typhi
cugcuccggcuuaaugcccggc

SEQ ID NO: 3644724 - RNA, 18 nt, Salmonella enterica enterica serovar Typhi
cugcucgaagaugaggag

SEQ ID NO: 3644725 - RNA, 19 nt, Salmonella enterica enterica serovar Typhi
cugcucgcgacgcagaccc

SEQ ID NO: 3644726 - RNA, 22 nt, Salmonella enterica enterica serovar Typhi
cugcucggguaaggcaucguug

SEQ ID NO: 3644727 - RNA, 14 nt, Salmonella enterica enterica serovar Typhi
cugcucguaaagca

SEQ ID NO: 3644728 - RNA, 22 nt, Salmonella enterica enterica serovar Typhi
cugcucguaaguuuccugcgcg

SEQ ID NO: 3644729 - RNA, 21 nt, Salmonella enterica enterica serovar Typhi
cugcucguuaaauccucccau

SEQ ID NO: 3644730 - RNA, 14 nt, Salmonella enterica enterica serovar Typhi
cugcucuccacgcc

SEQ ID NO: 3644731 - RNA, 17 nt, Salmonella enterica enterica serovar Typhi
cugcucucgggcagguu

SEQ ID NO: 3644732 - RNA, 20 nt, Salmonella enterica enterica serovar Typhi
cugcugaaaaagaacaauaa

SEQ ID NO: 3644733 - RNA, 19 nt, Salmonella enterica enterica serovar Typhi
cugcugaaagccgcgacgg

SEQ ID NO: 3644734 - RNA, 17 nt, Salmonella enterica enterica serovar Typhi
cugcugaaaugccuggu

SEQ ID NO: 3644735 - RNA, 15 nt, Salmonella enterica enterica serovar Typhi
cugcugaacacaaug

SEQ ID NO: 3644736 - RNA, 16 nt, Salmonella enterica enterica serovar Typhi
cugcugacacccucug

SEQ ID NO: 3644737 - RNA, 18 nt, Salmonella enterica enterica serovar Typhi
cugcugaccuuaauccag

SEQ ID NO: 3644738 - RNA, 22 nt, Salmonella enterica enterica serovar Typhi
cugcugaccuuaauccagcagu

SEQ ID NO: 3644739 - RNA, 19 nt, Salmonella enterica enterica serovar Typhi
cugcugacguagauucuga

SEQ ID NO: 3644740 - RNA, 15 nt, Salmonella enterica enterica serovar Typhi
cugcugauaauacug

SEQ ID NO: 3644741 - RNA, 22 nt, Salmonella enterica enterica serovar Typhi
cugcugauaguccaguacccgc

SEQ ID NO: 3644742 - RNA, 13 nt, Salmonella enterica enterica serovar Typhi
cugcugaugccag

SEQ ID NO: 3644743 - RNA, 15 nt, Salmonella enterica enterica serovar Typhi
cugcugaugcugguu

SEQ ID NO: 3644744 - RNA, 16 nt, Salmonella enterica enterica serovar Typhi
cugcugcauccgcgcu

SEQ ID NO: 3644745 - RNA, 14 nt, Salmonella enterica enterica serovar Typhi
cugcugccagccgc

SEQ ID NO: 3644746 - RNA, 21 nt, Salmonella enterica enterica serovar Typhi
cugcugccagccgccgccgga

SEQ ID NO: 3644747 - RNA, 15 nt, Salmonella enterica enterica serovar Typhi
cugcugccagcgccg

SEQ ID NO: 3644748 - RNA, 18 nt, Salmonella enterica enterica serovar Typhi
cugcugccagcgccgccg

SEQ ID NO: 3644749 - RNA, 13 nt, Salmonella enterica enterica serovar Typhi
cugcugccaucgc

SEQ ID NO: 3644750 - RNA, 15 nt, Salmonella enterica enterica serovar Typhi
cugcugccgcagcac

SEQ ID NO: 3644751 - RNA, 11 nt, Salmonella enterica enterica serovar Typhi
cugcugcgcca

SEQ ID NO: 3644752 - RNA, 13 nt, Salmonella enterica enterica serovar Typhi
cugcugcgccagc

SEQ ID NO: 3644753 - RNA, 12 nt, Salmonella enterica enterica serovar Typhi
cugcugcgccuu

SEQ ID NO: 3644754 - RNA, 16 nt, Salmonella enterica enterica serovar Typhi
cugcugcgccuuuacc

SEQ ID NO: 3644755 - RNA, 14 nt, Salmonella enterica enterica serovar Typhi
cugcugcgcgugcu

SEQ ID NO: 3644756 - RNA, 21 nt, Salmonella enterica enterica serovar Typhi
cugcugcguggucguaaaacu

SEQ ID NO: 3644757 - RNA, 12 nt, Salmonella enterica enterica serovar Typhi
cugcugcucccu

SEQ ID NO: 3644758 - RNA, 21 nt, Salmonella enterica enterica serovar Typhi
cugcugcucccucacgcguca

SEQ ID NO: 3644759 - RNA, 22 nt, Salmonella enterica enterica serovar Typhi
cugcugcucgguuuugccgaca

SEQ ID NO: 3644760 - RNA, 12 nt, Salmonella enterica enterica serovar Typhi
cugcuggaaagg

SEQ ID NO: 3644761 - RNA, 18 nt, Salmonella enterica enterica serovar Typhi
cugcuggaaaucuuucuc

SEQ ID NO: 3644762 - RNA, 14 nt, Salmonella enterica enterica serovar Typhi
cugcuggccuucca

SEQ ID NO: 3644763 - RNA, 17 nt, Salmonella enterica enterica serovar Typhi
cugcuggcgagcaggaa

SEQ ID NO: 3644764 - RNA, 15 nt, Salmonella enterica enterica serovar Typhi
cugcugguagagcau

SEQ ID NO: 3644765 - RNA, 17 nt, Salmonella enterica enterica serovar Typhi
cugcuggucauaacgcu

SEQ ID NO: 3644766 - RNA, 15 nt, Salmonella enterica enterica serovar Typhi
cugcuguagcugucc

SEQ ID NO: 3644767 - RNA, 17 nt, Salmonella enterica enterica serovar Typhi
cugcuguccgccagcaa

SEQ ID NO: 3644768 - RNA, 18 nt, Salmonella enterica enterica serovar Typhi
cugcugugacaucgcccc

SEQ ID NO: 3644769 - RNA, 17 nt, Salmonella enterica enterica serovar Typhi
cugcuguguccagguca

SEQ ID NO: 3644770 - RNA, 22 nt, Salmonella enterica enterica serovar Typhi
cugcuguguccaggucaucacc

SEQ ID NO: 3644771 - RNA, 15 nt, Salmonella enterica enterica serovar Typhi
cugcuguuucugguc

SEQ ID NO: 3644772 - RNA, 22 nt, Salmonella enterica enterica serovar Typhi
cugcuuaucgauaucugccugc

SEQ ID NO: 3644773 - RNA, 22 nt, Salmonella enterica enterica serovar Typhi
cugcuuaugaucgcccagccac

SEQ ID NO: 3644774 - RNA, 12 nt, Salmonella enterica enterica serovar Typhi
cugcuucagcca

SEQ ID NO: 3644775 - RNA, 16 nt, Salmonella enterica enterica serovar Typhi
cugcuucagccacugg

SEQ ID NO: 3644776 - RNA, 13 nt, Salmonella enterica enterica serovar Typhi
cugcuuccagaau

SEQ ID NO: 3644777 - RNA, 14 nt, Salmonella enterica enterica serovar Typhi
cugcuuccugccgc

SEQ ID NO: 3644778 - RNA, 18 nt, Salmonella enterica enterica serovar Typhi
cugcuucggaaugacaaa

SEQ ID NO: 3644779 - RNA, 19 nt, Salmonella enterica enterica serovar Typhi
cugcuugucgaucaucaga

SEQ ID NO: 3644780 - RNA, 15 nt, Salmonella enterica enterica serovar Typhi
cugcuuguucuuuuc

SEQ ID NO: 3644781 - RNA, 15 nt, Salmonella enterica enterica serovar Typhi
cugcuuucugucacc

SEQ ID NO: 3644782 - RNA, 16 nt, Salmonella enterica enterica serovar Typhi
cugcuuuggccgguuc

SEQ ID NO: 3644783 - RNA, 14 nt, Salmonella enterica enterica serovar Typhi
cugcuuuuccggca

SEQ ID NO: 3644784 - RNA, 16 nt, Salmonella enterica enterica serovar Typhi
cuggaaaaaacggggc

SEQ ID NO: 3644785 - RNA, 16 nt, Salmonella enterica enterica serovar Typhi
cuggaaaaaagcgccc

SEQ ID NO: 3644786 - RNA, 22 nt, Salmonella enterica enterica serovar Typhi
cuggaaaucuuucuccugguuu

SEQ ID NO: 3644787 - RNA, 20 nt, Salmonella enterica enterica serovar Typhi
cuggaacaaaccgacuuuca

SEQ ID NO: 3644788 - RNA, 22 nt, Salmonella enterica enterica serovar Typhi
cuggaacaguaaucgcacggcu

SEQ ID NO: 3644789 - RNA, 14 nt, Salmonella enterica enterica serovar Typhi
cuggaagaacugga

SEQ ID NO: 3644790 - RNA, 17 nt, Salmonella enterica enterica serovar Typhi
cuggaagaacuggauga

SEQ ID NO: 3644791 - RNA, 23 nt, Salmonella enterica enterica serovar Typhi
cuggaagagaacguucguugucc

SEQ ID NO: 3644792 - RNA, 19 nt, Salmonella enterica enterica serovar Typhi
cuggaagccccucuuauug

SEQ ID NO: 3644793 - RNA, 22 nt, Salmonella enterica enterica serovar Typhi
cuggaagcgcccaggccgggcg

SEQ ID NO: 3644794 - RNA, 18 nt, Salmonella enterica enterica serovar Typhi
cuggaaguuuugcuggaa

SEQ ID NO: 3644795 - RNA, 19 nt, Salmonella enterica enterica serovar Typhi
cuggaaucauccaccagaa

SEQ ID NO: 3644796 - RNA, 16 nt, Salmonella enterica enterica serovar Typhi
cuggaauuuuuccagc

SEQ ID NO: 3644797 - RNA, 17 nt, Salmonella enterica enterica serovar Typhi
cuggacaaaccacagug

SEQ ID NO: 3644798 - RNA, 20 nt, Salmonella enterica enterica serovar Typhi
cuggacauauuccagaagcg

SEQ ID NO: 3644799 - RNA, 20 nt, Salmonella enterica enterica serovar Typhi
cuggacauguuccgccccgc

SEQ ID NO: 3644800 - RNA, 22 nt, Salmonella enterica enterica serovar Typhi
cuggacauguuccgccccgccu

SEQ ID NO: 3644801 - RNA, 15 nt, Salmonella enterica enterica serovar Typhi
cuggagaaugggauu

SEQ ID NO: 3644802 - RNA, 17 nt, Salmonella enterica enterica serovar Typhi
cuggagagcaacgccau

SEQ ID NO: 3644803 - RNA, 19 nt, Salmonella enterica enterica serovar Typhi
cuggagagcagcgccagcg

SEQ ID NO: 3644804 - RNA, 20 nt, Salmonella enterica enterica serovar Typhi
cuggagagcagcgccagcga

SEQ ID NO: 3644805 - RNA, 15 nt, Salmonella enterica enterica serovar Typhi
cuggagaucagcaug

SEQ ID NO: 3644806 - RNA, 18 nt, Salmonella enterica enterica serovar Typhi
cuggagcaggaaaucaua

SEQ ID NO: 3644807 - RNA, 20 nt, Salmonella enterica enterica serovar Typhi
cuggagcaggugcggcuggg

SEQ ID NO: 3644808 - RNA, 13 nt, Salmonella enterica enterica serovar Typhi
cuggagccacauc

SEQ ID NO: 3644809 - RNA, 21 nt, Salmonella enterica enterica serovar Typhi
cuggagcgcauuuuacugccg

SEQ ID NO: 3644810 - RNA, 16 nt, Salmonella enterica enterica serovar Typhi
cuggaggaacagcgcc

SEQ ID NO: 3644811 - RNA, 16 nt, Salmonella enterica enterica serovar Typhi
cuggaggcggaagugc

SEQ ID NO: 3644812 - RNA, 22 nt, Salmonella enterica enterica serovar Typhi
cuggaguuuaaacacucuccac

SEQ ID NO: 3644813 - RNA, 14 nt, Salmonella enterica enterica serovar Typhi
cuggauaaaagguc

SEQ ID NO: 3644814 - RNA, 15 nt, Salmonella enterica enterica serovar Typhi
cuggauaauaagacg

SEQ ID NO: 3644815 - RNA, 20 nt, Salmonella enterica enterica serovar Typhi
cuggauaauggcuaugccga

SEQ ID NO: 3644816 - RNA, 21 nt, Salmonella enterica enterica serovar Typhi
cuggaucacuuuugccgucag

SEQ ID NO: 3644817 - RNA, 16 nt, Salmonella enterica enterica serovar Typhi
cuggaugacugaauua

SEQ ID NO: 3644818 - RNA, 15 nt, Salmonella enterica enterica serovar Typhi
cuggaugaggcgcug

SEQ ID NO: 3644819 - RNA, 12 nt, Salmonella enterica enterica serovar Typhi
cuggaugauaaa

SEQ ID NO: 3644820 - RNA, 12 nt, Salmonella enterica enterica serovar Typhi
cuggauggcaga

SEQ ID NO: 3644821 - RNA, 17 nt, Salmonella enterica enterica serovar Typhi
cuggauguccgacgccg

SEQ ID NO: 3644822 - RNA, 14 nt, Salmonella enterica enterica serovar Typhi
cuggauuaucaaua

SEQ ID NO: 3644823 - RNA, 13 nt, Salmonella enterica enterica serovar Typhi
cuggcaaaacgca

SEQ ID NO: 3644824 - RNA, 14 nt, Salmonella enterica enterica serovar Typhi
cuggcaacagccau

SEQ ID NO: 3644825 - RNA, 14 nt, Salmonella enterica enterica serovar Typhi
cuggcaacauuaau

SEQ ID NO: 3644826 - RNA, 14 nt, Salmonella enterica enterica serovar Typhi
cuggcaaucaugcg

SEQ ID NO: 3644827 - RNA, 16 nt, Salmonella enterica enterica serovar Typhi
cuggcacagggcaaua

SEQ ID NO: 3644828 - RNA, 14 nt, Salmonella enterica enterica serovar Typhi
cuggcacuggcagc

SEQ ID NO: 3644829 - RNA, 13 nt, Salmonella enterica enterica serovar Typhi
cuggcagccucgu

SEQ ID NO: 3644830 - RNA, 21 nt, Salmonella enterica enterica serovar Typhi
cuggcagguauuaauccugcg

SEQ ID NO: 3644831 - RNA, 20 nt, Salmonella enterica enterica serovar Typhi
cuggcaguccacguagcugc

SEQ ID NO: 3644832 - RNA, 21 nt, Salmonella enterica enterica serovar Typhi
cuggcagugauccaucgguuc

SEQ ID NO: 3644833 - RNA, 20 nt, Salmonella enterica enterica serovar Typhi
cuggcauaaaaagccauccc

SEQ ID NO: 3644834 - RNA, 16 nt, Salmonella enterica enterica serovar Typhi
cuggcauggcucgccg

SEQ ID NO: 3644835 - RNA, 18 nt, Salmonella enterica enterica serovar Typhi
cuggcauggcucgccgcu

SEQ ID NO: 3644836 - RNA, 16 nt, Salmonella enterica enterica serovar Typhi
cuggcauggugcagcc

SEQ ID NO: 3644837 - RNA, 16 nt, Salmonella enterica enterica serovar Typhi
cuggcauuacgcuggc

SEQ ID NO: 3644838 - RNA, 17 nt, Salmonella enterica enterica serovar Typhi
cuggcauuuuacuucug

SEQ ID NO: 3644839 - RNA, 23 nt, Salmonella enterica enterica serovar Typhi
cuggcauuuuuauuuaacgccag

SEQ ID NO: 3644840 - RNA, 22 nt, Salmonella enterica enterica serovar Typhi
cuggccaauuuuucacaugcaa

SEQ ID NO: 3644841 - RNA, 14 nt, Salmonella enterica enterica serovar Typhi
cuggccacagcaaa

SEQ ID NO: 3644842 - RNA, 23 nt, Salmonella enterica enterica serovar Typhi
cuggccacgccgaggcauucagc

SEQ ID NO: 3644843 - RNA, 17 nt, Salmonella enterica enterica serovar Typhi
cuggccacggagugcgc

SEQ ID NO: 3644844 - RNA, 14 nt, Salmonella enterica enterica serovar Typhi
cuggccaggcuuuc

SEQ ID NO: 3644845 - RNA, 13 nt, Salmonella enterica enterica serovar Typhi
cuggccagggcau

SEQ ID NO: 3644846 - RNA, 14 nt, Salmonella enterica enterica serovar Typhi
cuggccagggcauc

SEQ ID NO: 3644847 - RNA, 17 nt, Salmonella enterica enterica serovar Typhi
cuggccaguucgucuuc

SEQ ID NO: 3644848 - RNA, 14 nt, Salmonella enterica enterica serovar Typhi
cuggccaguuucaa

SEQ ID NO: 3644849 - RNA, 18 nt, Salmonella enterica enterica serovar Typhi
cuggccaguuucaaugcc

SEQ ID NO: 3644850 - RNA, 17 nt, Salmonella enterica enterica serovar Typhi
cuggccauuucaucauu

SEQ ID NO: 3644851 - RNA, 15 nt, Salmonella enterica enterica serovar Typhi
cuggccgaauagcug

SEQ ID NO: 3644852 - RNA, 15 nt, Salmonella enterica enterica serovar Typhi
cuggccgcgauggug

SEQ ID NO: 3644853 - RNA, 18 nt, Salmonella enterica enterica serovar Typhi
cuggccgcgcuuuuuuaa

SEQ ID NO: 3644854 - RNA, 17 nt, Salmonella enterica enterica serovar Typhi
cuggccguuuucccggc

SEQ ID NO: 3644855 - RNA, 16 nt, Salmonella enterica enterica serovar Typhi
cuggccucccaguucc

SEQ ID NO: 3644856 - RNA, 17 nt, Salmonella enterica enterica serovar Typhi
cuggccucccaguuccc

SEQ ID NO: 3644857 - RNA, 13 nt, Salmonella enterica enterica serovar Typhi
cuggccuccggcg

SEQ ID NO: 3644858 - RNA, 23 nt, Salmonella enterica enterica serovar Typhi
cuggccugauaagcgcagcgcca

SEQ ID NO: 3644859 - RNA, 20 nt, Salmonella enterica enterica serovar Typhi
cuggcgaauccgggaaaugg

SEQ ID NO: 3644860 - RNA, 18 nt, Salmonella enterica enterica serovar Typhi
cuggcgacauuaaaggac

SEQ ID NO: 3644861 - RNA, 17 nt, Salmonella enterica enterica serovar Typhi
cuggcgaccgccaccau

SEQ ID NO: 3644862 - RNA, 22 nt, Salmonella enterica enterica serovar Typhi
cuggcgaccgccaccauccggc

SEQ ID NO: 3644863 - RNA, 19 nt, Salmonella enterica enterica serovar Typhi
cuggcgagaaagugguggg

SEQ ID NO: 3644864 - RNA, 19 nt, Salmonella enterica enterica serovar Typhi
cuggcgauuuucauagcug

SEQ ID NO: 3644865 - RNA, 14 nt, Salmonella enterica enterica serovar Typhi
cuggcgcaaccggc

SEQ ID NO: 3644866 - RNA, 19 nt, Salmonella enterica enterica serovar Typhi
cuggcgcacauugcugccu

SEQ ID NO: 3644867 - RNA, 22 nt, Salmonella enterica enterica serovar Typhi
cuggcgcacgcgucaucggcgc

SEQ ID NO: 3644868 - RNA, 12 nt, Salmonella enterica enterica serovar Typhi
cuggcgccggag

SEQ ID NO: 3644869 - RNA, 23 nt, Salmonella enterica enterica serovar Typhi
cuggcgcgcgcgccuaccgccau

SEQ ID NO: 3644870 - RNA, 16 nt, Salmonella enterica enterica serovar Typhi
cuggcgcggggaacac

SEQ ID NO: 3644871 - RNA, 18 nt, Salmonella enterica enterica serovar Typhi
cuggcgcggggaacacag

SEQ ID NO: 3644872 - RNA, 19 nt, Salmonella enterica enterica serovar Typhi
cuggcgcggggaacacaga

SEQ ID NO: 3644873 - RNA, 17 nt, Salmonella enterica enterica serovar Typhi
cuggcgcggggaacacc

SEQ ID NO: 3644874 - RNA, 22 nt, Salmonella enterica enterica serovar Typhi
cuggcgcggggaacacggacag

SEQ ID NO: 3644875 - RNA, 18 nt, Salmonella enterica enterica serovar Typhi
cuggcgcucaaucagaau

SEQ ID NO: 3644876 - RNA, 15 nt, Salmonella enterica enterica serovar Typhi
cuggcgcuggcugcc

SEQ ID NO: 3644877 - RNA, 19 nt, Salmonella enterica enterica serovar Typhi
cuggcggaauggcgggcgc

SEQ ID NO: 3644878 - RNA, 17 nt, Salmonella enterica enterica serovar Typhi
cuggcggagcugcgcuu

SEQ ID NO: 3644879 - RNA, 21 nt, Salmonella enterica enterica serovar Typhi
cuggcgggcagccuucaaguu

SEQ ID NO: 3644880 - RNA, 20 nt, Salmonella enterica enterica serovar Typhi
cuggcgguaaauacgcggca

SEQ ID NO: 3644881 - RNA, 20 nt, Salmonella enterica enterica serovar Typhi
cuggcggucgggaacgcugu

SEQ ID NO: 3644882 - RNA, 21 nt, Salmonella enterica enterica serovar Typhi
cuggcguaaaugugcgccagc

SEQ ID NO: 3644883 - RNA, 14 nt, Salmonella enterica enterica serovar Typhi
cuggcgucgccaaa

SEQ ID NO: 3644884 - RNA, 18 nt, Salmonella enterica enterica serovar Typhi
cuggcgucgccaaagcag

SEQ ID NO: 3644885 - RNA, 19 nt, Salmonella enterica enterica serovar Typhi
cuggcgugacguguggcgc

SEQ ID NO: 3644886 - RNA, 17 nt, Salmonella enterica enterica serovar Typhi
cuggcgugccgggcugg

SEQ ID NO: 3644887 - RNA, 13 nt, Salmonella enterica enterica serovar Typhi
cuggcguuaaaua

SEQ ID NO: 3644888 - RNA, 13 nt, Salmonella enterica enterica serovar Typhi
cuggcguuaucau

SEQ ID NO: 3644889 - RNA, 17 nt, Salmonella enterica enterica serovar Typhi
cuggcguuaucguccgu

SEQ ID NO: 3644890 - RNA, 16 nt, Salmonella enterica enterica serovar Typhi
cuggcuaccacauucu

SEQ ID NO: 3644891 - RNA, 15 nt, Salmonella enterica enterica serovar Typhi
cuggcuaucgccgua

SEQ ID NO: 3644892 - RNA, 15 nt, Salmonella enterica enterica serovar Typhi
cuggcucaauccagg

SEQ ID NO: 3644893 - RNA, 14 nt, Salmonella enterica enterica serovar Typhi
cuggcucacugacu

SEQ ID NO: 3644894 - RNA, 19 nt, Salmonella enterica enterica serovar Typhi
cuggcucacugacuaucca

SEQ ID NO: 3644895 - RNA, 12 nt, Salmonella enterica enterica serovar Typhi
cuggcucauucu

SEQ ID NO: 3644896 - RNA, 15 nt, Salmonella enterica enterica serovar Typhi
cuggcucggccuguc

SEQ ID NO: 3644897 - RNA, 17 nt, Salmonella enterica enterica serovar Typhi
cuggcuggcgcugacga

SEQ ID NO: 3644898 - RNA, 18 nt, Salmonella enterica enterica serovar Typhi
cuggcuggucagcguacc

SEQ ID NO: 3644899 - RNA, 21 nt, Salmonella enterica enterica serovar Typhi
cuggcugugccaauaacgccu

SEQ ID NO: 3644900 - RNA, 18 nt, Salmonella enterica enterica serovar Typhi
cuggcuuacaggcacgcc

SEQ ID NO: 3644901 - RNA, 15 nt, Salmonella enterica enterica serovar Typhi
cuggcuuaccugcuc

SEQ ID NO: 3644902 - RNA, 15 nt, Salmonella enterica enterica serovar Typhi
cuggcuuacucgccc

SEQ ID NO: 3644903 - RNA, 22 nt, Salmonella enterica enterica serovar Typhi
cuggcuucaaccuccugcaauc

SEQ ID NO: 3644904 - RNA, 13 nt, Salmonella enterica enterica serovar Typhi
cuggcuucagccu

SEQ ID NO: 3644905 - RNA, 13 nt, Salmonella enterica enterica serovar Typhi
cuggcuugccaga

SEQ ID NO: 3644906 - RNA, 21 nt, Salmonella enterica enterica serovar Typhi
cuggcuugcgcuauccgcgcu

SEQ ID NO: 3644907 - RNA, 16 nt, Salmonella enterica enterica serovar Typhi
cuggcuuuggcuaauu

SEQ ID NO: 3644908 - RNA, 17 nt, Salmonella enterica enterica serovar Typhi
cugggaauaggccgcca

SEQ ID NO: 3644909 - RNA, 19 nt, Salmonella enterica enterica serovar Typhi
cugggagccgcugcucauu

SEQ ID NO: 3644910 - RNA, 21 nt, Salmonella enterica enterica serovar Typhi
cugggauucggcaacacccac

SEQ ID NO: 3644911 - RNA, 12 nt, Salmonella enterica enterica serovar Typhi
cugggccugcuc

SEQ ID NO: 3644912 - RNA, 22 nt, Salmonella enterica enterica serovar Typhi
cugggcgagggaggcaaucgca

SEQ ID NO: 3644913 - RNA, 13 nt, Salmonella enterica enterica serovar Typhi
cugggcgcaugag

SEQ ID NO: 3644914 - RNA, 23 nt, Salmonella enterica enterica serovar Typhi
cugggcggcaacccgcuccagaa

SEQ ID NO: 3644915 - RNA, 17 nt, Salmonella enterica enterica serovar Typhi
cugggcugagaaaaauu

SEQ ID NO: 3644916 - RNA, 13 nt, Salmonella enterica enterica serovar Typhi
cuggggauggccg

SEQ ID NO: 3644917 - RNA, 17 nt, Salmonella enterica enterica serovar Typhi
cuggggucgucagcgga

SEQ ID NO: 3644918 - RNA, 18 nt, Salmonella enterica enterica serovar Typhi
cuggguaagcgcagcgcc

SEQ ID NO: 3644919 - RNA, 16 nt, Salmonella enterica enterica serovar Typhi
cuggguagaguaaccc

SEQ ID NO: 3644920 - RNA, 18 nt, Salmonella enterica enterica serovar Typhi
cuggguagcuucugucug

SEQ ID NO: 3644921 - RNA, 15 nt, Salmonella enterica enterica serovar Typhi
cuggguaugcagugg

SEQ ID NO: 3644922 - RNA, 20 nt, Salmonella enterica enterica serovar Typhi
cuggguaugcagugggccgg

SEQ ID NO: 3644923 - RNA, 20 nt, Salmonella enterica enterica serovar Typhi
cuggguauuuuuuagcgcca

SEQ ID NO: 3644924 - RNA, 18 nt, Salmonella enterica enterica serovar Typhi
cugggucugcugggcgau

SEQ ID NO: 3644925 - RNA, 23 nt, Salmonella enterica enterica serovar Typhi
cugggugaugcgggacugcugcu

SEQ ID NO: 3644926 - RNA, 16 nt, Salmonella enterica enterica serovar Typhi
cugggugugaucgccg

SEQ ID NO: 3644927 - RNA, 18 nt, Salmonella enterica enterica serovar Typhi
cuggguuccgggcgcacc

SEQ ID NO: 3644928 - RNA, 14 nt, Salmonella enterica enterica serovar Typhi
cuggguugcccaaa

SEQ ID NO: 3644929 - RNA, 18 nt, Salmonella enterica enterica serovar Typhi
cuggguuucccauugggc

SEQ ID NO: 3644930 - RNA, 18 nt, Salmonella enterica enterica serovar Typhi
cuggguuugcagcagagu

SEQ ID NO: 3644931 - RNA, 12 nt, Salmonella enterica enterica serovar Typhi
cugguaaaccgg

SEQ ID NO: 3644932 - RNA, 19 nt, Salmonella enterica enterica serovar Typhi
cugguaaccguaacgcucc

SEQ ID NO: 3644933 - RNA, 23 nt, Salmonella enterica enterica serovar Typhi
cugguaaccguaacgcuccugga

SEQ ID NO: 3644934 - RNA, 14 nt, Salmonella enterica enterica serovar Typhi
cugguaagcguagc

SEQ ID NO: 3644935 - RNA, 15 nt, Salmonella enterica enterica serovar Typhi
cugguaaggcaaaua

SEQ ID NO: 3644936 - RNA, 16 nt, Salmonella enterica enterica serovar Typhi
cugguaaggcaaauau

SEQ ID NO: 3644937 - RNA, 14 nt, Salmonella enterica enterica serovar Typhi
cugguacguccauc

SEQ ID NO: 3644938 - RNA, 17 nt, Salmonella enterica enterica serovar Typhi
cugguacguccauccgc

SEQ ID NO: 3644939 - RNA, 21 nt, Salmonella enterica enterica serovar Typhi
cugguacguccauccgccggg

SEQ ID NO: 3644940 - RNA, 21 nt, Salmonella enterica enterica serovar Typhi
cugguagcccucgcaaagcug

SEQ ID NO: 3644941 - RNA, 23 nt, Salmonella enterica enterica serovar Typhi
cugguaggucaacccuauugcca

SEQ ID NO: 3644942 - RNA, 12 nt, Salmonella enterica enterica serovar Typhi
cugguaguccuc

SEQ ID NO: 3644943 - RNA, 19 nt, Salmonella enterica enterica serovar Typhi
cuggucaacacgcggucgu

SEQ ID NO: 3644944 - RNA, 13 nt, Salmonella enterica enterica serovar Typhi
cuggucacgguuu

SEQ ID NO: 3644945 - RNA, 21 nt, Salmonella enterica enterica serovar Typhi
cuggucauggcuuagcgccag

SEQ ID NO: 3644946 - RNA, 15 nt, Salmonella enterica enterica serovar Typhi
cuggucgccagcgcc

SEQ ID NO: 3644947 - RNA, 16 nt, Salmonella enterica enterica serovar Typhi
cuggucgcucugcgca

SEQ ID NO: 3644948 - RNA, 18 nt, Salmonella enterica enterica serovar Typhi
cuggucggcgaccagcag

SEQ ID NO: 3644949 - RNA, 13 nt, Salmonella enterica enterica serovar Typhi
cuggucgggcagg

SEQ ID NO: 3644950 - RNA, 15 nt, Salmonella enterica enterica serovar Typhi
cuggucgggcaggcu

SEQ ID NO: 3644951 - RNA, 18 nt, Salmonella enterica enterica serovar Typhi
cuggucggugauugucca

SEQ ID NO: 3644952 - RNA, 22 nt, Salmonella enterica enterica serovar Typhi
cuggucguaagaauuauuacca

SEQ ID NO: 3644953 - RNA, 17 nt, Salmonella enterica enterica serovar Typhi
cuggucugaaucugcuc

SEQ ID NO: 3644954 - RNA, 14 nt, Salmonella enterica enterica serovar Typhi
cuggugaaacaggu

SEQ ID NO: 3644955 - RNA, 20 nt, Salmonella enterica enterica serovar Typhi
cuggugaaacguguuuaucc

SEQ ID NO: 3644956 - RNA, 21 nt, Salmonella enterica enterica serovar Typhi
cuggugaaacguguuuauccc

SEQ ID NO: 3644957 - RNA, 17 nt, Salmonella enterica enterica serovar Typhi
cuggugacgaugauaac

SEQ ID NO: 3644958 - RNA, 18 nt, Salmonella enterica enterica serovar Typhi
cuggugacgaugauaaca

SEQ ID NO: 3644959 - RNA, 15 nt, Salmonella enterica enterica serovar Typhi
cuggugauaaagcag

SEQ ID NO: 3644960 - RNA, 14 nt, Salmonella enterica enterica serovar Typhi
cuggugaucuggcc

SEQ ID NO: 3644961 - RNA, 18 nt, Salmonella enterica enterica serovar Typhi
cuggugcagcaagcggcu

SEQ ID NO: 3644962 - RNA, 19 nt, Salmonella enterica enterica serovar Typhi
cuggugcccgcaaaaccuu

SEQ ID NO: 3644963 - RNA, 17 nt, Salmonella enterica enterica serovar Typhi
cuggugcugugccugcc

SEQ ID NO: 3644964 - RNA, 18 nt, Salmonella enterica enterica serovar Typhi
cuggugcugugccugccu

SEQ ID NO: 3644965 - RNA, 16 nt, Salmonella enterica enterica serovar Typhi
cuggugggacuguuca

SEQ ID NO: 3644966 - RNA, 16 nt, Salmonella enterica enterica serovar Typhi
cuggugugaacaucac

SEQ ID NO: 3644967 - RNA, 16 nt, Salmonella enterica enterica serovar Typhi
cugguuaacgccgcca

SEQ ID NO: 3644968 - RNA, 20 nt, Salmonella enterica enterica serovar Typhi
cugguuaaugaccugccgcg

SEQ ID NO: 3644969 - RNA, 24 nt, Salmonella enterica enterica serovar Typhi
cugguuaaugccuucgccgccgcu

SEQ ID NO: 3644970 - RNA, 13 nt, Salmonella enterica enterica serovar Typhi
cugguuauaugaa

SEQ ID NO: 3644971 - RNA, 13 nt, Salmonella enterica enterica serovar Typhi
cugguucaacauc

SEQ ID NO: 3644972 - RNA, 12 nt, Salmonella enterica enterica serovar Typhi
cugguugucuca

SEQ ID NO: 3644973 - RNA, 14 nt, Salmonella enterica enterica serovar Typhi
cugguuucaauacu

SEQ ID NO: 3644974 - RNA, 18 nt, Salmonella enterica enterica serovar Typhi
cugguuuuagcuuauccc

SEQ ID NO: 3644975 - RNA, 18 nt, Salmonella enterica enterica serovar Typhi
cugguuuugcguaaucca

SEQ ID NO: 3644976 - RNA, 15 nt, Salmonella enterica enterica serovar Typhi
cugguuuuuccauuc

SEQ ID NO: 3644977 - RNA, 12 nt, Salmonella enterica enterica serovar Typhi
cuguaaaaggga

SEQ ID NO: 3644978 - RNA, 14 nt, Salmonella enterica enterica serovar Typhi
cuguaaaccgccuc

SEQ ID NO: 3644979 - RNA, 20 nt, Salmonella enterica enterica serovar Typhi
cuguaaaccgccuccaggcc

SEQ ID NO: 3644980 - RNA, 21 nt, Salmonella enterica enterica serovar Typhi
cuguaaaccgccuccaggccg

SEQ ID NO: 3644981 - RNA, 14 nt, Salmonella enterica enterica serovar Typhi
cuguaaaucugccg

SEQ ID NO: 3644982 - RNA, 20 nt, Salmonella enterica enterica serovar Typhi
cuguaacaacuguuuuucac

SEQ ID NO: 3644983 - RNA, 14 nt, Salmonella enterica enterica serovar Typhi
cuguaacaguaucc

SEQ ID NO: 3644984 - RNA, 15 nt, Salmonella enterica enterica serovar Typhi
cuguaacaguauccg

SEQ ID NO: 3644985 - RNA, 14 nt, Salmonella enterica enterica serovar Typhi
cuguaaccccugcg

SEQ ID NO: 3644986 - RNA, 21 nt, Salmonella enterica enterica serovar Typhi
cuguaaccuuaaaaggcgcuc

SEQ ID NO: 3644987 - RNA, 17 nt, Salmonella enterica enterica serovar Typhi
cuguaacuucggccagc

SEQ ID NO: 3644988 - RNA, 14 nt, Salmonella enterica enterica serovar Typhi
cuguaagaggcaua

SEQ ID NO: 3644989 - RNA, 23 nt, Salmonella enterica enterica serovar Typhi
cuguaauagauaugaaagaagga

SEQ ID NO: 3644990 - RNA, 17 nt, Salmonella enterica enterica serovar Typhi
cuguaauagugcgcggg

SEQ ID NO: 3644991 - RNA, 13 nt, Salmonella enterica enterica serovar Typhi
cuguaaugaggca

SEQ ID NO: 3644992 - RNA, 18 nt, Salmonella enterica enterica serovar Typhi
cuguaauuauaaauauua

SEQ ID NO: 3644993 - RNA, 20 nt, Salmonella enterica enterica serovar Typhi
cuguaauuauaaauauuaau

SEQ ID NO: 3644994 - RNA, 23 nt, Salmonella enterica enterica serovar Typhi
cuguaauuauaaauauuaaugaa

SEQ ID NO: 3644995 - RNA, 16 nt, Salmonella enterica enterica serovar Typhi
cuguaauuucgcuggc

SEQ ID NO: 3644996 - RNA, 19 nt, Salmonella enterica enterica serovar Typhi
cuguacaaaaucaucauca

SEQ ID NO: 3644997 - RNA, 13 nt, Salmonella enterica enterica serovar Typhi
cuguacauaucca

SEQ ID NO: 3644998 - RNA, 14 nt, Salmonella enterica enterica serovar Typhi
cuguaccaccacgc

SEQ ID NO: 3644999 - RNA, 13 nt, Salmonella enterica enterica serovar Typhi
cuguaccaccaga

SEQ ID NO: 3645000 - RNA, 12 nt, Salmonella enterica enterica serovar Typhi
cuguaccaggac

SEQ ID NO: 3645001 - RNA, 17 nt, Salmonella enterica enterica serovar Typhi
cuguaccgcguccugac

SEQ ID NO: 3645002 - RNA, 22 nt, Salmonella enterica enterica serovar Typhi
cuguaccguuuuguaggccgga

SEQ ID NO: 3645003 - RNA, 18 nt, Salmonella enterica enterica serovar Typhi
cuguaccugauccagcuc

SEQ ID NO: 3645004 - RNA, 15 nt, Salmonella enterica enterica serovar Typhi
cuguacgccacggcu

SEQ ID NO: 3645005 - RNA, 14 nt, Salmonella enterica enterica serovar Typhi
cuguacgcccagcc

SEQ ID NO: 3645006 - RNA, 15 nt, Salmonella enterica enterica serovar Typhi
cuguacgcccagccg

SEQ ID NO: 3645007 - RNA, 16 nt, Salmonella enterica enterica serovar Typhi
cuguacgcccagccgu

SEQ ID NO: 3645008 - RNA, 13 nt, Salmonella enterica enterica serovar Typhi
cuguacgccucuu

SEQ ID NO: 3645009 - RNA, 14 nt, Salmonella enterica enterica serovar Typhi
cuguacgccucuuu

SEQ ID NO: 3645010 - RNA, 19 nt, Salmonella enterica enterica serovar Typhi
cuguacgcgggaaauaccu

SEQ ID NO: 3645011 - RNA, 20 nt, Salmonella enterica enterica serovar Typhi
cuguacggagcuaauaugaa

SEQ ID NO: 3645012 - RNA, 17 nt, Salmonella enterica enterica serovar Typhi
cuguagauaccuacuuu

SEQ ID NO: 3645013 - RNA, 15 nt, Salmonella enterica enterica serovar Typhi
cuguagauugcgcgc

SEQ ID NO: 3645014 - RNA, 20 nt, Salmonella enterica enterica serovar Typhi
cuguagcaguggagaggcca

SEQ ID NO: 3645015 - RNA, 13 nt, Salmonella enterica enterica serovar Typhi
cuguagccagccu

SEQ ID NO: 3645016 - RNA, 22 nt, Salmonella enterica enterica serovar Typhi
cuguagccagccugaacgggug

SEQ ID NO: 3645017 - RNA, 23 nt, Salmonella enterica enterica serovar Typhi
cuguagcgucucaucaaaaaggc

SEQ ID NO: 3645018 - RNA, 21 nt, Salmonella enterica enterica serovar Typhi
cuguagcguuucacgcgcgcc

SEQ ID NO: 3645019 - RNA, 18 nt, Salmonella enterica enterica serovar Typhi
cuguaggaucaaccaccu

SEQ ID NO: 3645020 - RNA, 22 nt, Salmonella enterica enterica serovar Typhi
cuguagggcacugggcgauacc

SEQ ID NO: 3645021 - RNA, 14 nt, Salmonella enterica enterica serovar Typhi
cuguagggucgccg

SEQ ID NO: 3645022 - RNA, 20 nt, Salmonella enterica enterica serovar Typhi
cuguagguucgguaugccuu

SEQ ID NO: 3645023 - RNA, 17 nt, Salmonella enterica enterica serovar Typhi
cuguaguuagagauaua

SEQ ID NO: 3645024 - RNA, 15 nt, Salmonella enterica enterica serovar Typhi
cuguauaaacucagc

SEQ ID NO: 3645025 - RNA, 23 nt, Salmonella enterica enterica serovar Typhi
cuguauaaauaaccgguaacugu

SEQ ID NO: 3645026 - RNA, 18 nt, Salmonella enterica enterica serovar Typhi
cuguauacauacauacca

SEQ ID NO: 3645027 - RNA, 17 nt, Salmonella enterica enterica serovar Typhi
cuguaucgacauaguac

SEQ ID NO: 3645028 - RNA, 17 nt, Salmonella enterica enterica serovar Typhi
cuguaucugcugacacc

SEQ ID NO: 3645029 - RNA, 20 nt, Salmonella enterica enterica serovar Typhi
cuguauucguccauaagcgc

SEQ ID NO: 3645030 - RNA, 17 nt, Salmonella enterica enterica serovar Typhi
cuguauuuucguuugca

SEQ ID NO: 3645031 - RNA, 13 nt, Salmonella enterica enterica serovar Typhi
cugucaccagcag

SEQ ID NO: 3645032 - RNA, 14 nt, Salmonella enterica enterica serovar Typhi
cugucaccagcagc

SEQ ID NO: 3645033 - RNA, 20 nt, Salmonella enterica enterica serovar Typhi
cugucacuccggcugcacca

SEQ ID NO: 3645034 - RNA, 17 nt, Salmonella enterica enterica serovar Typhi
cugucagaaaucugaau

SEQ ID NO: 3645035 - RNA, 18 nt, Salmonella enterica enterica serovar Typhi
cugucagaaaucugaaug

SEQ ID NO: 3645036 - RNA, 13 nt, Salmonella enterica enterica serovar Typhi
cugucagccgcac

SEQ ID NO: 3645037 - RNA, 18 nt, Salmonella enterica enterica serovar Typhi
cugucauaggcgacaggc

SEQ ID NO: 3645038 - RNA, 13 nt, Salmonella enterica enterica serovar Typhi
cugucaucaucaa

SEQ ID NO: 3645039 - RNA, 23 nt, Salmonella enterica enterica serovar Typhi
cugucaucgaaggcgauaccggu

SEQ ID NO: 3645040 - RNA, 23 nt, Salmonella enterica enterica serovar Typhi
cuguccagccgcccuucuccggu

SEQ ID NO: 3645041 - RNA, 14 nt, Salmonella enterica enterica serovar Typhi
cugucccugccagc

SEQ ID NO: 3645042 - RNA, 21 nt, Salmonella enterica enterica serovar Typhi
cugucccuucgcccggcgcgc

SEQ ID NO: 3645043 - RNA, 21 nt, Salmonella enterica enterica serovar Typhi
cuguccgccuuaucaggccug

SEQ ID NO: 3645044 - RNA, 13 nt, Salmonella enterica enterica serovar Typhi
cuguccggguauc

SEQ ID NO: 3645045 - RNA, 19 nt, Salmonella enterica enterica serovar Typhi
cuguccggguaucugggcg

SEQ ID NO: 3645046 - RNA, 21 nt, Salmonella enterica enterica serovar Typhi
cugucgauaacagcauaaacg

SEQ ID NO: 3645047 - RNA, 14 nt, Salmonella enterica enterica serovar Typhi
cugucgaugauauc

SEQ ID NO: 3645048 - RNA, 21 nt, Salmonella enterica enterica serovar Typhi
cugucgaugauauccagcacg

SEQ ID NO: 3645049 - RNA, 21 nt, Salmonella enterica enterica serovar Typhi
cugucgcaauuuaccuauuuc

SEQ ID NO: 3645050 - RNA, 14 nt, Salmonella enterica enterica serovar Typhi
cugucgccaccacu

SEQ ID NO: 3645051 - RNA, 15 nt, Salmonella enterica enterica serovar Typhi
cugucgccaccacuc

SEQ ID NO: 3645052 - RNA, 13 nt, Salmonella enterica enterica serovar Typhi
cugucgccgcgca

SEQ ID NO: 3645053 - RNA, 20 nt, Salmonella enterica enterica serovar Typhi
cugucgccgcguaaauccac

SEQ ID NO: 3645054 - RNA, 19 nt, Salmonella enterica enterica serovar Typhi
cugucggcagaaccugacc

SEQ ID NO: 3645055 - RNA, 16 nt, Salmonella enterica enterica serovar Typhi
cugucgggagccucuu

SEQ ID NO: 3645056 - RNA, 17 nt, Salmonella enterica enterica serovar Typhi
cugucggucagauucag

SEQ ID NO: 3645057 - RNA, 15 nt, Salmonella enterica enterica serovar Typhi
cugucggucuuuuuc

SEQ ID NO: 3645058 - RNA, 13 nt, Salmonella enterica enterica serovar Typhi
cugucguauuuau

SEQ ID NO: 3645059 - RNA, 16 nt, Salmonella enterica enterica serovar Typhi
cugucguauuuauuuu

SEQ ID NO: 3645060 - RNA, 19 nt, Salmonella enterica enterica serovar Typhi
cugucguauuuauuuucug

SEQ ID NO: 3645061 - RNA, 23 nt, Salmonella enterica enterica serovar Typhi
cugucguuucauguaaaugacgc

SEQ ID NO: 3645062 - RNA, 20 nt, Salmonella enterica enterica serovar Typhi
cugucucuuuagaaaaagaa

SEQ ID NO: 3645063 - RNA, 14 nt, Salmonella enterica enterica serovar Typhi
cugucugaaucagu

SEQ ID NO: 3645064 - RNA, 15 nt, Salmonella enterica enterica serovar Typhi
cugucugccaugccu

SEQ ID NO: 3645065 - RNA, 22 nt, Salmonella enterica enterica serovar Typhi
cugucuuacacugauaccccag

SEQ ID NO: 3645066 - RNA, 14 nt, Salmonella enterica enterica serovar Typhi
cugucuuguuuuuc

SEQ ID NO: 3645067 - RNA, 20 nt, Salmonella enterica enterica serovar Typhi
cugugacaucgccccggccu

SEQ ID NO: 3645068 - RNA, 23 nt, Salmonella enterica enterica serovar Typhi
cugugacaucgccccggccuuau

SEQ ID NO: 3645069 - RNA, 22 nt, Salmonella enterica enterica serovar Typhi
cugugacggcaacugaaaacag

SEQ ID NO: 3645070 - RNA, 18 nt, Salmonella enterica enterica serovar Typhi
cugugagaaggugguggg

SEQ ID NO: 3645071 - RNA, 16 nt, Salmonella enterica enterica serovar Typhi
cugugagccuaaaaca

SEQ ID NO: 3645072 - RNA, 22 nt, Salmonella enterica enterica serovar Typhi
cugugauaaaaacgccuugccc

SEQ ID NO: 3645073 - RNA, 12 nt, Salmonella enterica enterica serovar Typhi
cugugaucgaau

SEQ ID NO: 3645074 - RNA, 17 nt, Salmonella enterica enterica serovar Typhi
cugugcaaaauuacuuc

SEQ ID NO: 3645075 - RNA, 21 nt, Salmonella enterica enterica serovar Typhi
cugugcaacaucuuaccggug

SEQ ID NO: 3645076 - RNA, 13 nt, Salmonella enterica enterica serovar Typhi
cugugccagccca

SEQ ID NO: 3645077 - RNA, 21 nt, Salmonella enterica enterica serovar Typhi
cugugccagcucguuauuucc

SEQ ID NO: 3645078 - RNA, 20 nt, Salmonella enterica enterica serovar Typhi
cugugccgucguacucacca

SEQ ID NO: 3645079 - RNA, 13 nt, Salmonella enterica enterica serovar Typhi
cugugccugccug

SEQ ID NO: 3645080 - RNA, 13 nt, Salmonella enterica enterica serovar Typhi
cugugcgagacca

SEQ ID NO: 3645081 - RNA, 13 nt, Salmonella enterica enterica serovar Typhi
cugugcgccugcu

SEQ ID NO: 3645082 - RNA, 15 nt, Salmonella enterica enterica serovar Typhi
cugugcggaauagcc

SEQ ID NO: 3645083 - RNA, 16 nt, Salmonella enterica enterica serovar Typhi
cugugcgugacccaca

SEQ ID NO: 3645084 - RNA, 15 nt, Salmonella enterica enterica serovar Typhi
cugugcgugaugggc

SEQ ID NO: 3645085 - RNA, 17 nt, Salmonella enterica enterica serovar Typhi
cugugcuaucaggccua

SEQ ID NO: 3645086 - RNA, 18 nt, Salmonella enterica enterica serovar Typhi
cugugcucgauauauuuu

SEQ ID NO: 3645087 - RNA, 19 nt, Salmonella enterica enterica serovar Typhi
cugugcucgauauauuuuc

SEQ ID NO: 3645088 - RNA, 20 nt, Salmonella enterica enterica serovar Typhi
cugugcucgauauauuuucc

SEQ ID NO: 3645089 - RNA, 19 nt, Salmonella enterica enterica serovar Typhi
cuguggaaacuccagcggc

SEQ ID NO: 3645090 - RNA, 14 nt, Salmonella enterica enterica serovar Typhi
cuguggaaacugug

SEQ ID NO: 3645091 - RNA, 17 nt, Salmonella enterica enterica serovar Typhi
cuguggaggguaagaaa

SEQ ID NO: 3645092 - RNA, 18 nt, Salmonella enterica enterica serovar Typhi
cuguggcaauuuucaguu

SEQ ID NO: 3645093 - RNA, 13 nt, Salmonella enterica enterica serovar Typhi
cuguggugugccu

SEQ ID NO: 3645094 - RNA, 14 nt, Salmonella enterica enterica serovar Typhi
cuguggugugccug

SEQ ID NO: 3645095 - RNA, 18 nt, Salmonella enterica enterica serovar Typhi
cuguggugugccugcguu

SEQ ID NO: 3645096 - RNA, 17 nt, Salmonella enterica enterica serovar Typhi
cugugguugcccgcagg

SEQ ID NO: 3645097 - RNA, 18 nt, Salmonella enterica enterica serovar Typhi
cuguguaccucuacauaa

SEQ ID NO: 3645098 - RNA, 24 nt, Salmonella enterica enterica serovar Typhi
cuguguauucugcgccagccagcu

SEQ ID NO: 3645099 - RNA, 19 nt, Salmonella enterica enterica serovar Typhi
cugugugagcgcccgccgc

SEQ ID NO: 3645100 - RNA, 16 nt, Salmonella enterica enterica serovar Typhi
cugugugggcacucga

SEQ ID NO: 3645101 - RNA, 17 nt, Salmonella enterica enterica serovar Typhi
cugugugggcacucgaa

SEQ ID NO: 3645102 - RNA, 17 nt, Salmonella enterica enterica serovar Typhi
cuguguugcucaaaaaa

SEQ ID NO: 3645103 - RNA, 13 nt, Salmonella enterica enterica serovar Typhi
cuguguuuuuucg

SEQ ID NO: 3645104 - RNA, 12 nt, Salmonella enterica enterica serovar Typhi
cuguuaaaaaau

SEQ ID NO: 3645105 - RNA, 22 nt, Salmonella enterica enterica serovar Typhi
cuguuaccaaugccaaaaaaac

SEQ ID NO: 3645106 - RNA, 17 nt, Salmonella enterica enterica serovar Typhi
cuguuacgcugguuugu

SEQ ID NO: 3645107 - RNA, 19 nt, Salmonella enterica enterica serovar Typhi
cuguuagggcgcggcuggu

SEQ ID NO: 3645108 - RNA, 22 nt, Salmonella enterica enterica serovar Typhi
cuguuauauauuuuucagcuuc

SEQ ID NO: 3645109 - RNA, 19 nt, Salmonella enterica enterica serovar Typhi
cuguuaucuggauguaaau

SEQ ID NO: 3645110 - RNA, 15 nt, Salmonella enterica enterica serovar Typhi
cuguuaugaaacccg

SEQ ID NO: 3645111 - RNA, 20 nt, Salmonella enterica enterica serovar Typhi
cuguuaugcacgcgcggcgc

SEQ ID NO: 3645112 - RNA, 19 nt, Salmonella enterica enterica serovar Typhi
cuguuauucagggcuuuau

SEQ ID NO: 3645113 - RNA, 16 nt, Salmonella enterica enterica serovar Typhi
cuguucaagcaauaau

SEQ ID NO: 3645114 - RNA, 11 nt, Salmonella enterica enterica serovar Typhi
cuguuccagcg

SEQ ID NO: 3645115 - RNA, 15 nt, Salmonella enterica enterica serovar Typhi
cuguuccagcugcga

SEQ ID NO: 3645116 - RNA, 14 nt, Salmonella enterica enterica serovar Typhi
cuguuccaggcgaa

SEQ ID NO: 3645117 - RNA, 21 nt, Salmonella enterica enterica serovar Typhi
cuguuccugcgggaacagaua

SEQ ID NO: 3645118 - RNA, 12 nt, Salmonella enterica enterica serovar Typhi
cuguucuggcuc

SEQ ID NO: 3645119 - RNA, 20 nt, Salmonella enterica enterica serovar Typhi
cuguucuggcucggccuguc

SEQ ID NO: 3645120 - RNA, 11 nt, Salmonella enterica enterica serovar Typhi
cuguucugucc

SEQ ID NO: 3645121 - RNA, 21 nt, Salmonella enterica enterica serovar Typhi
cuguugaauaucgcuuuuucu

SEQ ID NO: 3645122 - RNA, 18 nt, Salmonella enterica enterica serovar Typhi
cuguugaggaaauucuga

SEQ ID NO: 3645123 - RNA, 21 nt, Salmonella enterica enterica serovar Typhi
cuguugaguucccuucuccuc

SEQ ID NO: 3645124 - RNA, 20 nt, Salmonella enterica enterica serovar Typhi
cuguugauacaguaccuuua

SEQ ID NO: 3645125 - RNA, 21 nt, Salmonella enterica enterica serovar Typhi
cuguugaugauaaccgccgcc

SEQ ID NO: 3645126 - RNA, 18 nt, Salmonella enterica enterica serovar Typhi
cuguugcgggccagcagc

SEQ ID NO: 3645127 - RNA, 18 nt, Salmonella enterica enterica serovar Typhi
cuguugcugugcauaucu

SEQ ID NO: 3645128 - RNA, 13 nt, Salmonella enterica enterica serovar Typhi
cuguuggcauccu

SEQ ID NO: 3645129 - RNA, 17 nt, Salmonella enterica enterica serovar Typhi
cuguuuaagcgccucca

SEQ ID NO: 3645130 - RNA, 15 nt, Salmonella enterica enterica serovar Typhi
cuguuuagccgucuc

SEQ ID NO: 3645131 - RNA, 13 nt, Salmonella enterica enterica serovar Typhi
cuguuuaucugau

SEQ ID NO: 3645132 - RNA, 23 nt, Salmonella enterica enterica serovar Typhi
cuguuuauucuucgucagaugcg

SEQ ID NO: 3645133 - RNA, 17 nt, Salmonella enterica enterica serovar Typhi
cuguuucgccaggccgc

SEQ ID NO: 3645134 - RNA, 20 nt, Salmonella enterica enterica serovar Typhi
cuguuucgcccgcucgcgau

SEQ ID NO: 3645135 - RNA, 22 nt, Salmonella enterica enterica serovar Typhi
cuguuucuccguuguugcacca

SEQ ID NO: 3645136 - RNA, 14 nt, Salmonella enterica enterica serovar Typhi
cuguuucugcgccg

SEQ ID NO: 3645137 - RNA, 16 nt, Salmonella enterica enterica serovar Typhi
cuguuucugcuggccu

SEQ ID NO: 3645138 - RNA, 15 nt, Salmonella enterica enterica serovar Typhi
cuguuugugguccaa

SEQ ID NO: 3645139 - RNA, 15 nt, Salmonella enterica enterica serovar Typhi
cuguuugugguuggu

SEQ ID NO: 3645140 - RNA, 22 nt, Salmonella enterica enterica serovar Typhi
cuguuuguucgcaaaauagcgg

SEQ ID NO: 3645141 - RNA, 21 nt, Salmonella enterica enterica serovar Typhi
cuguuuguuuauugugcacag

SEQ ID NO: 3645142 - RNA, 14 nt, Salmonella enterica enterica serovar Typhi
cuguuuuauuuccu

SEQ ID NO: 3645143 - RNA, 18 nt, Salmonella enterica enterica serovar Typhi
cuguuuuauuuccucaga

SEQ ID NO: 3645144 - RNA, 12 nt, Salmonella enterica enterica serovar Typhi
cuguuuuccgcu

SEQ ID NO: 3645145 - RNA, 14 nt, Salmonella enterica enterica serovar Typhi
cuguuuuccgcuuu

SEQ ID NO: 3645146 - RNA, 16 nt, Salmonella enterica enterica serovar Typhi
cuguuuuugcuuuaau

SEQ ID NO: 3645147 - RNA, 23 nt, Salmonella enterica enterica serovar Typhi
cuguuuuuggaaacuaugcaaaa

SEQ ID NO: 3645148 - RNA, 15 nt, Salmonella enterica enterica serovar Typhi
cuguuuuuugccaca

SEQ ID NO: 3645149 - RNA, 19 nt, Salmonella enterica enterica serovar Typhi
cuguuuuuuguugauuuua

SEQ ID NO: 3645150 - RNA, 14 nt, Salmonella enterica enterica serovar Typhi
cuuaaaaaauccug

SEQ ID NO: 3645151 - RNA, 21 nt, Salmonella enterica enterica serovar Typhi
cuuaaaacgauuuggucggcg

SEQ ID NO: 3645152 - RNA, 21 nt, Salmonella enterica enterica serovar Typhi
cuuaaaagggaguauuuaccu

SEQ ID NO: 3645153 - RNA, 23 nt, Salmonella enterica enterica serovar Typhi
cuuaaaccaccauacccaguagc

SEQ ID NO: 3645154 - RNA, 15 nt, Salmonella enterica enterica serovar Typhi
cuuaaaccugcgccg

SEQ ID NO: 3645155 - RNA, 20 nt, Salmonella enterica enterica serovar Typhi
cuuaaacgccggauuccaga

SEQ ID NO: 3645156 - RNA, 19 nt, Salmonella enterica enterica serovar Typhi
cuuaaauaugaaagagaaa

SEQ ID NO: 3645157 - RNA, 14 nt, Salmonella enterica enterica serovar Typhi
cuuaaaugccgccg

SEQ ID NO: 3645158 - RNA, 22 nt, Salmonella enterica enterica serovar Typhi
cuuaaauuaaugauuaaaauaa

SEQ ID NO: 3645159 - RNA, 15 nt, Salmonella enterica enterica serovar Typhi
cuuaacagaauugcg

SEQ ID NO: 3645160 - RNA, 19 nt, Salmonella enterica enterica serovar Typhi
cuuaacagaauugcgccac

SEQ ID NO: 3645161 - RNA, 22 nt, Salmonella enterica enterica serovar Typhi
cuuaacccugccguuugcgcca

SEQ ID NO: 3645162 - RNA, 16 nt, Salmonella enterica enterica serovar Typhi
cuuaacgcccgcgucu

SEQ ID NO: 3645163 - RNA, 22 nt, Salmonella enterica enterica serovar Typhi
cuuaacgcccgcgucuucaucg

SEQ ID NO: 3645164 - RNA, 21 nt, Salmonella enterica enterica serovar Typhi
cuuaagaauguccaucucuuu

SEQ ID NO: 3645165 - RNA, 22 nt, Salmonella enterica enterica serovar Typhi
cuuaauauccaguugcgccagc

SEQ ID NO: 3645166 - RNA, 23 nt, Salmonella enterica enterica serovar Typhi
cuuaauaugcugccuacugcccu

SEQ ID NO: 3645167 - RNA, 20 nt, Salmonella enterica enterica serovar Typhi
cuuaaucaguucggcaucca

SEQ ID NO: 3645168 - RNA, 22 nt, Salmonella enterica enterica serovar Typhi
cuuaaugcauggcagauaaacc

SEQ ID NO: 3645169 - RNA, 17 nt, Salmonella enterica enterica serovar Typhi
cuuaauuaacgccgcga

SEQ ID NO: 3645170 - RNA, 16 nt, Salmonella enterica enterica serovar Typhi
cuuacaaaaaauacau

SEQ ID NO: 3645171 - RNA, 20 nt, Salmonella enterica enterica serovar Typhi
cuuacaacauuguuauguuu

SEQ ID NO: 3645172 - RNA, 13 nt, Salmonella enterica enterica serovar Typhi
cuuacaauuuauc

SEQ ID NO: 3645173 - RNA, 17 nt, Salmonella enterica enterica serovar Typhi
cuuacacacccggccua

SEQ ID NO: 3645174 - RNA, 13 nt, Salmonella enterica enterica serovar Typhi
cuuacaggcgcau

SEQ ID NO: 3645175 - RNA, 23 nt, Salmonella enterica enterica serovar Typhi
cuuacagggcgaugccucacccc

SEQ ID NO: 3645176 - RNA, 18 nt, Salmonella enterica enterica serovar Typhi
cuuaccaggucuuaccua

SEQ ID NO: 3645177 - RNA, 16 nt, Salmonella enterica enterica serovar Typhi
cuuacccacuguaucg

SEQ ID NO: 3645178 - RNA, 13 nt, Salmonella enterica enterica serovar Typhi
cuuaccgcaucgc

SEQ ID NO: 3645179 - RNA, 16 nt, Salmonella enterica enterica serovar Typhi
cuuaccgcuaaaauac

SEQ ID NO: 3645180 - RNA, 14 nt, Salmonella enterica enterica serovar Typhi
cuuaccgggcagga

SEQ ID NO: 3645181 - RNA, 23 nt, Salmonella enterica enterica serovar Typhi
cuuaccggugcgauucagcgcag

SEQ ID NO: 3645182 - RNA, 19 nt, Salmonella enterica enterica serovar Typhi
cuuaccuuguucuuccauu

SEQ ID NO: 3645183 - RNA, 16 nt, Salmonella enterica enterica serovar Typhi
cuuacgagaggcuuua

SEQ ID NO: 3645184 - RNA, 22 nt, Salmonella enterica enterica serovar Typhi
cuuacgcggcgcgcucuuuuuc

SEQ ID NO: 3645185 - RNA, 16 nt, Salmonella enterica enterica serovar Typhi
cuuacgcucgcugaug

SEQ ID NO: 3645186 - RNA, 19 nt, Salmonella enterica enterica serovar Typhi
cuuacgcuuacccggccua

SEQ ID NO: 3645187 - RNA, 24 nt, Salmonella enterica enterica serovar Typhi
cuuacgguaaagcguaucgcccag

SEQ ID NO: 3645188 - RNA, 18 nt, Salmonella enterica enterica serovar Typhi
cuuacguugcauuuauca

SEQ ID NO: 3645189 - RNA, 22 nt, Salmonella enterica enterica serovar Typhi
cuuacguuucucacuaauuuga

SEQ ID NO: 3645190 - RNA, 13 nt, Salmonella enterica enterica serovar Typhi
cuuacuaauaaau

SEQ ID NO: 3645191 - RNA, 13 nt, Salmonella enterica enterica serovar Typhi
cuuacugcugucc

SEQ ID NO: 3645192 - RNA, 15 nt, Salmonella enterica enterica serovar Typhi
cuuacugugccgccg

SEQ ID NO: 3645193 - RNA, 22 nt, Salmonella enterica enterica serovar Typhi
cuuacuuuccaaaauccaggga

SEQ ID NO: 3645194 - RNA, 14 nt, Salmonella enterica enterica serovar Typhi
cuuacuuugcgccc

SEQ ID NO: 3645195 - RNA, 19 nt, Salmonella enterica enterica serovar Typhi
cuuagcaacugccggcuua

SEQ ID NO: 3645196 - RNA, 23 nt, Salmonella enterica enterica serovar Typhi
cuuagcacccaccaucacuucca

SEQ ID NO: 3645197 - RNA, 17 nt, Salmonella enterica enterica serovar Typhi
cuuagcagcauaaacau

SEQ ID NO: 3645198 - RNA, 16 nt, Salmonella enterica enterica serovar Typhi
cuuaggauaauucccc

SEQ ID NO: 3645199 - RNA, 18 nt, Salmonella enterica enterica serovar Typhi
cuuaggauaauuccccca

SEQ ID NO: 3645200 - RNA, 14 nt, Salmonella enterica enterica serovar Typhi
cuuaggcagccagg

SEQ ID NO: 3645201 - RNA, 23 nt, Salmonella enterica enterica serovar Typhi
cuuaggcagccaggcaaagcccc

SEQ ID NO: 3645202 - RNA, 17 nt, Salmonella enterica enterica serovar Typhi
cuuaguuuucguagggc

SEQ ID NO: 3645203 - RNA, 23 nt, Salmonella enterica enterica serovar Typhi
cuuauaaaucagcuuugcggcca

SEQ ID NO: 3645204 - RNA, 16 nt, Salmonella enterica enterica serovar Typhi
cuuauacugauaaacu

SEQ ID NO: 3645205 - RNA, 14 nt, Salmonella enterica enterica serovar Typhi
cuuauaucauggga

SEQ ID NO: 3645206 - RNA, 12 nt, Salmonella enterica enterica serovar Typhi
cuuauauuuauu

SEQ ID NO: 3645207 - RNA, 20 nt, Salmonella enterica enterica serovar Typhi
cuuauauuuauuuauugucu

SEQ ID NO: 3645208 - RNA, 14 nt, Salmonella enterica enterica serovar Typhi
cuuaucaagcgaua

SEQ ID NO: 3645209 - RNA, 15 nt, Salmonella enterica enterica serovar Typhi
cuuaucaagcgauac

SEQ ID NO: 3645210 - RNA, 11 nt, Salmonella enterica enterica serovar Typhi
cuuaucagaac

SEQ ID NO: 3645211 - RNA, 13 nt, Salmonella enterica enterica serovar Typhi
cuuaucaggccua

SEQ ID NO: 3645212 - RNA, 23 nt, Salmonella enterica enterica serovar Typhi
cuuaucaggccuacauccggcuc

SEQ ID NO: 3645213 - RNA, 23 nt, Salmonella enterica enterica serovar Typhi
cuuaucaggccuguaaaccgccu

SEQ ID NO: 3645214 - RNA, 20 nt, Salmonella enterica enterica serovar Typhi
cuuauccaaauccuuaauca

SEQ ID NO: 3645215 - RNA, 19 nt, Salmonella enterica enterica serovar Typhi
cuuaucccacaacuguucu

SEQ ID NO: 3645216 - RNA, 14 nt, Salmonella enterica enterica serovar Typhi
cuuaucccauugcg

SEQ ID NO: 3645217 - RNA, 19 nt, Salmonella enterica enterica serovar Typhi
cuuauccgcuuuuaaacgg

SEQ ID NO: 3645218 - RNA, 20 nt, Salmonella enterica enterica serovar Typhi
cuuauccggccuaccgucuc

SEQ ID NO: 3645219 - RNA, 15 nt, Salmonella enterica enterica serovar Typhi
cuuauccggcugccg

SEQ ID NO: 3645220 - RNA, 12 nt, Salmonella enterica enterica serovar Typhi
cuuauccggcuu

SEQ ID NO: 3645221 - RNA, 23 nt, Salmonella enterica enterica serovar Typhi
cuuauccggcuuauccggccugc

SEQ ID NO: 3645222 - RNA, 19 nt, Salmonella enterica enterica serovar Typhi
cuuaucgagugucaauaag

SEQ ID NO: 3645223 - RNA, 15 nt, Salmonella enterica enterica serovar Typhi
cuuaucgccaaagau

SEQ ID NO: 3645224 - RNA, 15 nt, Salmonella enterica enterica serovar Typhi
cuuaucgccccagcc

SEQ ID NO: 3645225 - RNA, 22 nt, Salmonella enterica enterica serovar Typhi
cuuaucggcguguuucaucuca

SEQ ID NO: 3645226 - RNA, 22 nt, Salmonella enterica enterica serovar Typhi
cuuaucguuaaggccugcgcga

SEQ ID NO: 3645227 - RNA, 19 nt, Salmonella enterica enterica serovar Typhi
cuuaucucuacuuuccuga

SEQ ID NO: 3645228 - RNA, 15 nt, Salmonella enterica enterica serovar Typhi
cuuaucugcaauaaa

SEQ ID NO: 3645229 - RNA, 14 nt, Salmonella enterica enterica serovar Typhi
cuuaucugcugcug

SEQ ID NO: 3645230 - RNA, 13 nt, Salmonella enterica enterica serovar Typhi
cuuaucuugcgca

SEQ ID NO: 3645231 - RNA, 23 nt, Salmonella enterica enterica serovar Typhi
cuuaugaccgagucuacaucaag

SEQ ID NO: 3645232 - RNA, 12 nt, Salmonella enterica enterica serovar Typhi
cuuaugcccggc

SEQ ID NO: 3645233 - RNA, 16 nt, Salmonella enterica enterica serovar Typhi
cuuauuaaagccccuu

SEQ ID NO: 3645234 - RNA, 12 nt, Salmonella enterica enterica serovar Typhi
cuuauuacgcaa

SEQ ID NO: 3645235 - RNA, 20 nt, Salmonella enterica enterica serovar Typhi
cuuauuagaggcguaaguaa

SEQ ID NO: 3645236 - RNA, 12 nt, Salmonella enterica enterica serovar Typhi
cuuauucaggcg

SEQ ID NO: 3645237 - RNA, 16 nt, Salmonella enterica enterica serovar Typhi
cuuauugucgccgccg

SEQ ID NO: 3645238 - RNA, 15 nt, Salmonella enterica enterica serovar Typhi
cuuauuucuccugcg

SEQ ID NO: 3645239 - RNA, 13 nt, Salmonella enterica enterica serovar Typhi
cuuauuuguauug

SEQ ID NO: 3645240 - RNA, 20 nt, Salmonella enterica enterica serovar Typhi
cuuauuuuauuuuuauauuc

SEQ ID NO: 3645241 - RNA, 22 nt, Salmonella enterica enterica serovar Typhi
cuuauuuuauuuuuauauuccg

SEQ ID NO: 3645242 - RNA, 19 nt, Salmonella enterica enterica serovar Typhi
cuuauuuuccguuagccaa

SEQ ID NO: 3645243 - RNA, 14 nt, Salmonella enterica enterica serovar Typhi
cuucaacagcggcg

SEQ ID NO: 3645244 - RNA, 19 nt, Salmonella enterica enterica serovar Typhi
cuucaacagcggcggcagu

SEQ ID NO: 3645245 - RNA, 18 nt, Salmonella enterica enterica serovar Typhi
cuucaacccagcagcaga

SEQ ID NO: 3645246 - RNA, 21 nt, Salmonella enterica enterica serovar Typhi
cuucaaccguuucuuuuucga

SEQ ID NO: 3645247 - RNA, 19 nt, Salmonella enterica enterica serovar Typhi
cuucaaccuuuaucuguug

SEQ ID NO: 3645248 - RNA, 15 nt, Salmonella enterica enterica serovar Typhi
cuucaacgccgcgcu

SEQ ID NO: 3645249 - RNA, 13 nt, Salmonella enterica enterica serovar Typhi
cuucaacgcgccg

SEQ ID NO: 3645250 - RNA, 22 nt, Salmonella enterica enterica serovar Typhi
cuucaacgcgccgcucacaacc

SEQ ID NO: 3645251 - RNA, 15 nt, Salmonella enterica enterica serovar Typhi
cuucaagaaguucca

SEQ ID NO: 3645252 - RNA, 14 nt, Salmonella enterica enterica serovar Typhi
cuucaagaaucaau

SEQ ID NO: 3645253 - RNA, 14 nt, Salmonella enterica enterica serovar Typhi
cuucaagccaggcu

SEQ ID NO: 3645254 - RNA, 17 nt, Salmonella enterica enterica serovar Typhi
cuucaagcguuuccaga

SEQ ID NO: 3645255 - RNA, 20 nt, Salmonella enterica enterica serovar Typhi
cuucaagcuggugcuuuaug

SEQ ID NO: 3645256 - RNA, 23 nt, Salmonella enterica enterica serovar Typhi
cuucaaggcucaauacgcauaau

SEQ ID NO: 3645257 - RNA, 21 nt, Salmonella enterica enterica serovar Typhi
cuucaagguucgacucgagca

SEQ ID NO: 3645258 - RNA, 20 nt, Salmonella enterica enterica serovar Typhi
cuucaaucgucguuccgcca

SEQ ID NO: 3645259 - RNA, 21 nt, Salmonella enterica enterica serovar Typhi
cuucaaucgucguuccgccag

SEQ ID NO: 3645260 - RNA, 23 nt, Salmonella enterica enterica serovar Typhi
cuucaaugcgccccgucuguguu

SEQ ID NO: 3645261 - RNA, 22 nt, Salmonella enterica enterica serovar Typhi
cuucaauguuagcauuauuuuu

SEQ ID NO: 3645262 - RNA, 16 nt, Salmonella enterica enterica serovar Typhi
cuucaauuugccggaa

SEQ ID NO: 3645263 - RNA, 23 nt, Salmonella enterica enterica serovar Typhi
cuucaauuugccggaacucagcu

SEQ ID NO: 3645264 - RNA, 19 nt, Salmonella enterica enterica serovar Typhi
cuucaauuuuccagauagc

SEQ ID NO: 3645265 - RNA, 18 nt, Salmonella enterica enterica serovar Typhi
cuucacaaccaucgucug

SEQ ID NO: 3645266 - RNA, 19 nt, Salmonella enterica enterica serovar Typhi
cuucacacgaacuuuaucu

SEQ ID NO: 3645267 - RNA, 13 nt, Salmonella enterica enterica serovar Typhi
cuucaccacgcca

SEQ ID NO: 3645268 - RNA, 19 nt, Salmonella enterica enterica serovar Typhi
cuucacccagacugugaug

SEQ ID NO: 3645269 - RNA, 22 nt, Salmonella enterica enterica serovar Typhi
cuucacccagacugugauggcg

SEQ ID NO: 3645270 - RNA, 23 nt, Salmonella enterica enterica serovar Typhi
cuucacccgcgggcggcguuuca

SEQ ID NO: 3645271 - RNA, 14 nt, Salmonella enterica enterica serovar Typhi
cuucaccggcgugc

SEQ ID NO: 3645272 - RNA, 15 nt, Salmonella enterica enterica serovar Typhi
cuucaccggcgugcg

SEQ ID NO: 3645273 - RNA, 15 nt, Salmonella enterica enterica serovar Typhi
cuucaccucagccaa

SEQ ID NO: 3645274 - RNA, 17 nt, Salmonella enterica enterica serovar Typhi
cuucaccucagucgcuu

SEQ ID NO: 3645275 - RNA, 22 nt, Salmonella enterica enterica serovar Typhi
cuucaccuucggugaaaucacg

SEQ ID NO: 3645276 - RNA, 19 nt, Salmonella enterica enterica serovar Typhi
cuucacgcagugcgcgacc

SEQ ID NO: 3645277 - RNA, 21 nt, Salmonella enterica enterica serovar Typhi
cuucacgccgugaauuucugc

SEQ ID NO: 3645278 - RNA, 16 nt, Salmonella enterica enterica serovar Typhi
cuucacggaaggggcc

SEQ ID NO: 3645279 - RNA, 18 nt, Salmonella enterica enterica serovar Typhi
cuucacguugacgcaaac

SEQ ID NO: 3645280 - RNA, 21 nt, Salmonella enterica enterica serovar Typhi
cuucacguugacgcaaacugc

SEQ ID NO: 3645281 - RNA, 16 nt, Salmonella enterica enterica serovar Typhi
cuucacguuuuccagg

SEQ ID NO: 3645282 - RNA, 15 nt, Salmonella enterica enterica serovar Typhi
cuucacuaaaaacag

SEQ ID NO: 3645283 - RNA, 21 nt, Salmonella enterica enterica serovar Typhi
cuucacucugggauuugcgaa

SEQ ID NO: 3645284 - RNA, 12 nt, Salmonella enterica enterica serovar Typhi
cuucagagcagg

SEQ ID NO: 3645285 - RNA, 18 nt, Salmonella enterica enterica serovar Typhi
cuucagcauacaggucuu

SEQ ID NO: 3645286 - RNA, 14 nt, Salmonella enterica enterica serovar Typhi
cuucagcaucaucu

SEQ ID NO: 3645287 - RNA, 19 nt, Salmonella enterica enterica serovar Typhi
cuucagcaucaucucccag

SEQ ID NO: 3645288 - RNA, 14 nt, Salmonella enterica enterica serovar Typhi
cuucagccacuggc

SEQ ID NO: 3645289 - RNA, 15 nt, Salmonella enterica enterica serovar Typhi
cuucagccagacgcu

SEQ ID NO: 3645290 - RNA, 17 nt, Salmonella enterica enterica serovar Typhi
cuucagccagacguaaa

SEQ ID NO: 3645291 - RNA, 21 nt, Salmonella enterica enterica serovar Typhi
cuucagccugugcaaccagcu

SEQ ID NO: 3645292 - RNA, 23 nt, Salmonella enterica enterica serovar Typhi
cuucagcguccggaaaauccuca

SEQ ID NO: 3645293 - RNA, 13 nt, Salmonella enterica enterica serovar Typhi
cuucaggagaccu

SEQ ID NO: 3645294 - RNA, 20 nt, Salmonella enterica enterica serovar Typhi
cuucaggagaccuaaagucu

SEQ ID NO: 3645295 - RNA, 13 nt, Salmonella enterica enterica serovar Typhi
cuucaggcuguug

SEQ ID NO: 3645296 - RNA, 22 nt, Salmonella enterica enterica serovar Typhi
cuucagguuuuuaagcugccca

SEQ ID NO: 3645297 - RNA, 19 nt, Salmonella enterica enterica serovar Typhi
cuucaguaaccagggagga

SEQ ID NO: 3645298 - RNA, 19 nt, Salmonella enterica enterica serovar Typhi
cuucaguaauuucgaugau

SEQ ID NO: 3645299 - RNA, 19 nt, Salmonella enterica enterica serovar Typhi
cuucagucuacuacacacu

SEQ ID NO: 3645300 - RNA, 23 nt, Salmonella enterica enterica serovar Typhi
cuucauaaauagccagcaucaug

SEQ ID NO: 3645301 - RNA, 18 nt, Salmonella enterica enterica serovar Typhi
cuucauaggugaacauga

SEQ ID NO: 3645302 - RNA, 19 nt, Salmonella enterica enterica serovar Typhi
cuucaucaaagaaauaccc

SEQ ID NO: 3645303 - RNA, 14 nt, Salmonella enterica enterica serovar Typhi
cuucaucagccagc

SEQ ID NO: 3645304 - RNA, 17 nt, Salmonella enterica enterica serovar Typhi
cuucaucaguaacugac

SEQ ID NO: 3645305 - RNA, 12 nt, Salmonella enterica enterica serovar Typhi
cuucaucaucau

SEQ ID NO: 3645306 - RNA, 15 nt, Salmonella enterica enterica serovar Typhi
cuucauccagauagg

SEQ ID NO: 3645307 - RNA, 15 nt, Salmonella enterica enterica serovar Typhi
cuucaucccacucaa

SEQ ID NO: 3645308 - RNA, 16 nt, Salmonella enterica enterica serovar Typhi
cuucaucccauccggg

SEQ ID NO: 3645309 - RNA, 15 nt, Salmonella enterica enterica serovar Typhi
cuucauccggcguug

SEQ ID NO: 3645310 - RNA, 17 nt, Salmonella enterica enterica serovar Typhi
cuucaucggauagauga

SEQ ID NO: 3645311 - RNA, 16 nt, Salmonella enterica enterica serovar Typhi
cuucaucguuacgcag

SEQ ID NO: 3645312 - RNA, 12 nt, Salmonella enterica enterica serovar Typhi
cuucaucuucca

SEQ ID NO: 3645313 - RNA, 21 nt, Salmonella enterica enterica serovar Typhi
cuucaugaguaaaugaacguu

SEQ ID NO: 3645314 - RNA, 13 nt, Salmonella enterica enterica serovar Typhi
cuucaugcacaaa

SEQ ID NO: 3645315 - RNA, 14 nt, Salmonella enterica enterica serovar Typhi
cuucaugcagcccg

SEQ ID NO: 3645316 - RNA, 20 nt, Salmonella enterica enterica serovar Typhi
cuucaugccgaacagguuau

SEQ ID NO: 3645317 - RNA, 19 nt, Salmonella enterica enterica serovar Typhi
cuucauggucggacgggcc

SEQ ID NO: 3645318 - RNA, 19 nt, Salmonella enterica enterica serovar Typhi
cuucaugugguaggcuuca

SEQ ID NO: 3645319 - RNA, 18 nt, Salmonella enterica enterica serovar Typhi
cuuccacacggcauucac

SEQ ID NO: 3645320 - RNA, 18 nt, Salmonella enterica enterica serovar Typhi
cuuccaccaccuccugcu

SEQ ID NO: 3645321 - RNA, 16 nt, Salmonella enterica enterica serovar Typhi
cuuccacccgcgcgcu

SEQ ID NO: 3645322 - RNA, 16 nt, Salmonella enterica enterica serovar Typhi
cuuccaccucuucugc

SEQ ID NO: 3645323 - RNA, 15 nt, Salmonella enterica enterica serovar Typhi
cuuccacgcacgccg

SEQ ID NO: 3645324 - RNA, 17 nt, Salmonella enterica enterica serovar Typhi
cuuccacgcacgccggc

SEQ ID NO: 3645325 - RNA, 21 nt, Salmonella enterica enterica serovar Typhi
cuuccagauacauggcuauuc

SEQ ID NO: 3645326 - RNA, 23 nt, Salmonella enterica enterica serovar Typhi
cuuccagcaaaccuuccgccagg

SEQ ID NO: 3645327 - RNA, 14 nt, Salmonella enterica enterica serovar Typhi
cuuccagcaccgcg

SEQ ID NO: 3645328 - RNA, 22 nt, Salmonella enterica enterica serovar Typhi
cuuccagcacgauauccagcac

SEQ ID NO: 3645329 - RNA, 13 nt, Salmonella enterica enterica serovar Typhi
cuuccagcagcca

SEQ ID NO: 3645330 - RNA, 17 nt, Salmonella enterica enterica serovar Typhi
cuuccagcagccagccg

SEQ ID NO: 3645331 - RNA, 19 nt, Salmonella enterica enterica serovar Typhi
cuuccagcauucuauuguu

SEQ ID NO: 3645332 - RNA, 13 nt, Salmonella enterica enterica serovar Typhi
cuuccagcgccaa

SEQ ID NO: 3645333 - RNA, 14 nt, Salmonella enterica enterica serovar Typhi
cuuccagcgcgccg

SEQ ID NO: 3645334 - RNA, 22 nt, Salmonella enterica enterica serovar Typhi
cuuccagcgcgccgucaucgcu

SEQ ID NO: 3645335 - RNA, 13 nt, Salmonella enterica enterica serovar Typhi
cuuccagcggcag

SEQ ID NO: 3645336 - RNA, 15 nt, Salmonella enterica enterica serovar Typhi
cuuccagcgucucca

SEQ ID NO: 3645337 - RNA, 15 nt, Salmonella enterica enterica serovar Typhi
cuuccagcuccaucc

SEQ ID NO: 3645338 - RNA, 15 nt, Salmonella enterica enterica serovar Typhi
cuuccaguagccuau

SEQ ID NO: 3645339 - RNA, 21 nt, Salmonella enterica enterica serovar Typhi
cuuccaguaguaaaccgguug

SEQ ID NO: 3645340 - RNA, 16 nt, Salmonella enterica enterica serovar Typhi
cuuccaguugaaaacc

SEQ ID NO: 3645341 - RNA, 13 nt, Salmonella enterica enterica serovar Typhi
cuuccaguugcuu

SEQ ID NO: 3645342 - RNA, 15 nt, Salmonella enterica enterica serovar Typhi
cuuccaucagccagg

SEQ ID NO: 3645343 - RNA, 15 nt, Salmonella enterica enterica serovar Typhi
cuuccauccauguga

SEQ ID NO: 3645344 - RNA, 17 nt, Salmonella enterica enterica serovar Typhi
cuuccaugccuucauaa

SEQ ID NO: 3645345 - RNA, 16 nt, Salmonella enterica enterica serovar Typhi
cuucccacagucggcg

SEQ ID NO: 3645346 - RNA, 16 nt, Salmonella enterica enterica serovar Typhi
cuucccagguuucaau

SEQ ID NO: 3645347 - RNA, 19 nt, Salmonella enterica enterica serovar Typhi
cuucccagguuucaaugcc

SEQ ID NO: 3645348 - RNA, 23 nt, Salmonella enterica enterica serovar Typhi
cuucccccuggcuaucaauguuu

SEQ ID NO: 3645349 - RNA, 16 nt, Salmonella enterica enterica serovar Typhi
cuuccccgaucagaaa

SEQ ID NO: 3645350 - RNA, 22 nt, Salmonella enterica enterica serovar Typhi
cuuccccggucagucccagcgu

SEQ ID NO: 3645351 - RNA, 14 nt, Salmonella enterica enterica serovar Typhi
cuuccccugccaga

SEQ ID NO: 3645352 - RNA, 23 nt, Salmonella enterica enterica serovar Typhi
cuucccgcaccgcgaugcugcuc

SEQ ID NO: 3645353 - RNA, 16 nt, Salmonella enterica enterica serovar Typhi
cuucccgcgcagugca

SEQ ID NO: 3645354 - RNA, 14 nt, Salmonella enterica enterica serovar Typhi
cuucccgcucauua

SEQ ID NO: 3645355 - RNA, 16 nt, Salmonella enterica enterica serovar Typhi
cuucccggcaggcauu

SEQ ID NO: 3645356 - RNA, 12 nt, Salmonella enterica enterica serovar Typhi
cuucccggcgga

SEQ ID NO: 3645357 - RNA, 19 nt, Salmonella enterica enterica serovar Typhi
cuucccggcggaagcgaau

SEQ ID NO: 3645358 - RNA, 17 nt, Salmonella enterica enterica serovar Typhi
cuucccggggaacagaa

SEQ ID NO: 3645359 - RNA, 19 nt, Salmonella enterica enterica serovar Typhi
cuucccggggaacagaagc

SEQ ID NO: 3645360 - RNA, 18 nt, Salmonella enterica enterica serovar Typhi
cuucccugaccagcgacg

SEQ ID NO: 3645361 - RNA, 22 nt, Salmonella enterica enterica serovar Typhi
cuuccgcaauacagcccgccag

SEQ ID NO: 3645362 - RNA, 20 nt, Salmonella enterica enterica serovar Typhi
cuuccgcacgcgcgcccugc

SEQ ID NO: 3645363 - RNA, 18 nt, Salmonella enterica enterica serovar Typhi
cuuccgccacggcuuuca

SEQ ID NO: 3645364 - RNA, 18 nt, Salmonella enterica enterica serovar Typhi
cuuccggcacucuucuuc

SEQ ID NO: 3645365 - RNA, 20 nt, Salmonella enterica enterica serovar Typhi
cuuccggcaucacaucgccg

SEQ ID NO: 3645366 - RNA, 14 nt, Salmonella enterica enterica serovar Typhi
cuuccggcgcaaua

SEQ ID NO: 3645367 - RNA, 22 nt, Salmonella enterica enterica serovar Typhi
cuuccgggcgacgauacaacuc

SEQ ID NO: 3645368 - RNA, 15 nt, Salmonella enterica enterica serovar Typhi
cuuccggugugacca

SEQ ID NO: 3645369 - RNA, 20 nt, Salmonella enterica enterica serovar Typhi
cuuccgguugaccgcauaau

SEQ ID NO: 3645370 - RNA, 14 nt, Salmonella enterica enterica serovar Typhi
cuuccgucagcgaa

SEQ ID NO: 3645371 - RNA, 15 nt, Salmonella enterica enterica serovar Typhi
cuuccgucagcgaau

SEQ ID NO: 3645372 - RNA, 14 nt, Salmonella enterica enterica serovar Typhi
cuuccguccccagc

SEQ ID NO: 3645373 - RNA, 18 nt, Salmonella enterica enterica serovar Typhi
cuuccguccccagcccau

SEQ ID NO: 3645374 - RNA, 14 nt, Salmonella enterica enterica serovar Typhi
cuuccucacagccu

SEQ ID NO: 3645375 - RNA, 18 nt, Salmonella enterica enterica serovar Typhi
cuuccucauuuuugccca

SEQ ID NO: 3645376 - RNA, 22 nt, Salmonella enterica enterica serovar Typhi
cuuccuccagcaucagguggaa

SEQ ID NO: 3645377 - RNA, 16 nt, Salmonella enterica enterica serovar Typhi
cuuccugagcagacau

SEQ ID NO: 3645378 - RNA, 14 nt, Salmonella enterica enterica serovar Typhi
cuuccugcacgccu

SEQ ID NO: 3645379 - RNA, 19 nt, Salmonella enterica enterica serovar Typhi
cuuccugcacgccugcuuc

SEQ ID NO: 3645380 - RNA, 21 nt, Salmonella enterica enterica serovar Typhi
cuuccugcgcgccaaaccguu

SEQ ID NO: 3645381 - RNA, 12 nt, Salmonella enterica enterica serovar Typhi
cuuccugcugcg

SEQ ID NO: 3645382 - RNA, 15 nt, Salmonella enterica enterica serovar Typhi
cuuccugcugcgcca

SEQ ID NO: 3645383 - RNA, 15 nt, Salmonella enterica enterica serovar Typhi
cuuccugcugcgcuu

SEQ ID NO: 3645384 - RNA, 20 nt, Salmonella enterica enterica serovar Typhi
cuuccugcugcgcuuugucg

SEQ ID NO: 3645385 - RNA, 21 nt, Salmonella enterica enterica serovar Typhi
cuuccuguacaaaaucaucau

SEQ ID NO: 3645386 - RNA, 23 nt, Salmonella enterica enterica serovar Typhi
cuuccuguacaaaaucaucauca

SEQ ID NO: 3645387 - RNA, 17 nt, Salmonella enterica enterica serovar Typhi
cuuccuuugccuuucuu

SEQ ID NO: 3645388 - RNA, 18 nt, Salmonella enterica enterica serovar Typhi
cuucgacaaucagcacca

SEQ ID NO: 3645389 - RNA, 16 nt, Salmonella enterica enterica serovar Typhi
cuucgaccgccauaau

SEQ ID NO: 3645390 - RNA, 12 nt, Salmonella enterica enterica serovar Typhi
cuucgauaaacg

SEQ ID NO: 3645391 - RNA, 13 nt, Salmonella enterica enterica serovar Typhi
cuucgcaaccggu

SEQ ID NO: 3645392 - RNA, 13 nt, Salmonella enterica enterica serovar Typhi
cuucgcaaucucc

SEQ ID NO: 3645393 - RNA, 16 nt, Salmonella enterica enterica serovar Typhi
cuucgcagaucgccug

SEQ ID NO: 3645394 - RNA, 15 nt, Salmonella enterica enterica serovar Typhi
cuucgccaaucgccg

SEQ ID NO: 3645395 - RNA, 17 nt, Salmonella enterica enterica serovar Typhi
cuucgccaaucgccgcc

SEQ ID NO: 3645396 - RNA, 14 nt, Salmonella enterica enterica serovar Typhi
cuucgccaucucca

SEQ ID NO: 3645397 - RNA, 14 nt, Salmonella enterica enterica serovar Typhi
cuucgcccggcgua

SEQ ID NO: 3645398 - RNA, 17 nt, Salmonella enterica enterica serovar Typhi
cuucgccguuaucggcc

SEQ ID NO: 3645399 - RNA, 21 nt, Salmonella enterica enterica serovar Typhi
cuucgccuaaaucaagcagug

SEQ ID NO: 3645400 - RNA, 21 nt, Salmonella enterica enterica serovar Typhi
cuucgccuucgcccauaucca

SEQ ID NO: 3645401 - RNA, 16 nt, Salmonella enterica enterica serovar Typhi
cuucgcggaauuucag

SEQ ID NO: 3645402 - RNA, 13 nt, Salmonella enterica enterica serovar Typhi
cuucgcggccgcu

SEQ ID NO: 3645403 - RNA, 15 nt, Salmonella enterica enterica serovar Typhi
cuucgcgggaccaaa

SEQ ID NO: 3645404 - RNA, 15 nt, Salmonella enterica enterica serovar Typhi
cuucgcgguuagaaa

SEQ ID NO: 3645405 - RNA, 14 nt, Salmonella enterica enterica serovar Typhi
cuucgcucugaauc

SEQ ID NO: 3645406 - RNA, 15 nt, Salmonella enterica enterica serovar Typhi
cuucgcuuagcuucc

SEQ ID NO: 3645407 - RNA, 22 nt, Salmonella enterica enterica serovar Typhi
cuucggaaugacaaacgccacc

SEQ ID NO: 3645408 - RNA, 18 nt, Salmonella enterica enterica serovar Typhi
cuucggccugaaucagca

SEQ ID NO: 3645409 - RNA, 11 nt, Salmonella enterica enterica serovar Typhi
cuucggcgaua

SEQ ID NO: 3645410 - RNA, 21 nt, Salmonella enterica enterica serovar Typhi
cuucggcgggaucuccagaag

SEQ ID NO: 3645411 - RNA, 19 nt, Salmonella enterica enterica serovar Typhi
cuucggcgucgugcugggc

SEQ ID NO: 3645412 - RNA, 23 nt, Salmonella enterica enterica serovar Typhi
cuucgggcgauuuuugcagcaac

SEQ ID NO: 3645413 - RNA, 21 nt, Salmonella enterica enterica serovar Typhi
cuucgguuucguuaaucggca

SEQ ID NO: 3645414 - RNA, 16 nt, Salmonella enterica enterica serovar Typhi
cuucguaccaaacgaa

SEQ ID NO: 3645415 - RNA, 17 nt, Salmonella enterica enterica serovar Typhi
cuucgucaaugcugcuu

SEQ ID NO: 3645416 - RNA, 20 nt, Salmonella enterica enterica serovar Typhi
cuucgucaggcggcugcgca

SEQ ID NO: 3645417 - RNA, 17 nt, Salmonella enterica enterica serovar Typhi
cuucgugacccgccagc

SEQ ID NO: 3645418 - RNA, 23 nt, Salmonella enterica enterica serovar Typhi
cuucguggaacugcagcgcgucg

SEQ ID NO: 3645419 - RNA, 17 nt, Salmonella enterica enterica serovar Typhi
cuucguuagcggcguug

SEQ ID NO: 3645420 - RNA, 15 nt, Salmonella enterica enterica serovar Typhi
cuucguuauaaggcc

SEQ ID NO: 3645421 - RNA, 18 nt, Salmonella enterica enterica serovar Typhi
cuucguuauaaggccugc

SEQ ID NO: 3645422 - RNA, 19 nt, Salmonella enterica enterica serovar Typhi
cuucguuauuuuccugaaa

SEQ ID NO: 3645423 - RNA, 16 nt, Salmonella enterica enterica serovar Typhi
cuucguucaguuccag

SEQ ID NO: 3645424 - RNA, 19 nt, Salmonella enterica enterica serovar Typhi
cuucuaacgcaacggaagg

SEQ ID NO: 3645425 - RNA, 16 nt, Salmonella enterica enterica serovar Typhi
cuucuaauuccaggau

SEQ ID NO: 3645426 - RNA, 13 nt, Salmonella enterica enterica serovar Typhi
cuucuaauuuuuc

SEQ ID NO: 3645427 - RNA, 18 nt, Salmonella enterica enterica serovar Typhi
cuucuaauuuuuccagca

SEQ ID NO: 3645428 - RNA, 21 nt, Salmonella enterica enterica serovar Typhi
cuucuacacgacgcauugcca

SEQ ID NO: 3645429 - RNA, 14 nt, Salmonella enterica enterica serovar Typhi
cuucuaccgcuucg

SEQ ID NO: 3645430 - RNA, 13 nt, Salmonella enterica enterica serovar Typhi
cuucuaccuggaa

SEQ ID NO: 3645431 - RNA, 15 nt, Salmonella enterica enterica serovar Typhi
cuucuaccuggaacc

SEQ ID NO: 3645432 - RNA, 12 nt, Salmonella enterica enterica serovar Typhi
cuucuauccacu

SEQ ID NO: 3645433 - RNA, 19 nt, Salmonella enterica enterica serovar Typhi
cuucuauuaccgcagcgcg

SEQ ID NO: 3645434 - RNA, 19 nt, Salmonella enterica enterica serovar Typhi
cuucucaaaaucgccgccg

SEQ ID NO: 3645435 - RNA, 18 nt, Salmonella enterica enterica serovar Typhi
cuucucaauuucuuaucu

SEQ ID NO: 3645436 - RNA, 21 nt, Salmonella enterica enterica serovar Typhi
cuucucccaacagacgaucua

SEQ ID NO: 3645437 - RNA, 13 nt, Salmonella enterica enterica serovar Typhi
cuucuccccuuca

SEQ ID NO: 3645438 - RNA, 21 nt, Salmonella enterica enterica serovar Typhi
cuucuccccuucaucaguaac

SEQ ID NO: 3645439 - RNA, 13 nt, Salmonella enterica enterica serovar Typhi
cuucuccgccauc

SEQ ID NO: 3645440 - RNA, 16 nt, Salmonella enterica enterica serovar Typhi
cuucuccucaacagac

SEQ ID NO: 3645441 - RNA, 23 nt, Salmonella enterica enterica serovar Typhi
cuucuccuucaaucacaaaaugg

SEQ ID NO: 3645442 - RNA, 18 nt, Salmonella enterica enterica serovar Typhi
cuucucgaaguucucaau

SEQ ID NO: 3645443 - RNA, 14 nt, Salmonella enterica enterica serovar Typhi
cuucucgcaagagc

SEQ ID NO: 3645444 - RNA, 17 nt, Salmonella enterica enterica serovar Typhi
cuucucuaucagcgccu

SEQ ID NO: 3645445 - RNA, 21 nt, Salmonella enterica enterica serovar Typhi
cuucucugucgagcaucucca

SEQ ID NO: 3645446 - RNA, 12 nt, Salmonella enterica enterica serovar Typhi
cuucugaaaacc

SEQ ID NO: 3645447 - RNA, 23 nt, Salmonella enterica enterica serovar Typhi
cuucugacccaaucagacgccgg

SEQ ID NO: 3645448 - RNA, 16 nt, Salmonella enterica enterica serovar Typhi
cuucugacucgcugau

SEQ ID NO: 3645449 - RNA, 15 nt, Salmonella enterica enterica serovar Typhi
cuucugauggcuuug

SEQ ID NO: 3645450 - RNA, 20 nt, Salmonella enterica enterica serovar Typhi
cuucugauuauugacauuca

SEQ ID NO: 3645451 - RNA, 15 nt, Salmonella enterica enterica serovar Typhi
cuucugccgcgcggu

SEQ ID NO: 3645452 - RNA, 16 nt, Salmonella enterica enterica serovar Typhi
cuucuggcgcaucaac

SEQ ID NO: 3645453 - RNA, 13 nt, Salmonella enterica enterica serovar Typhi
cuucuggcucaga

SEQ ID NO: 3645454 - RNA, 16 nt, Salmonella enterica enterica serovar Typhi
cuucuguaauacgcug

SEQ ID NO: 3645455 - RNA, 22 nt, Salmonella enterica enterica serovar Typhi
cuucugucagccuugcaucuca

SEQ ID NO: 3645456 - RNA, 23 nt, Salmonella enterica enterica serovar Typhi
cuucugucagccuugcaucucau

SEQ ID NO: 3645457 - RNA, 12 nt, Salmonella enterica enterica serovar Typhi
cuucuuaccgug

SEQ ID NO: 3645458 - RNA, 18 nt, Salmonella enterica enterica serovar Typhi
cuucuucaguuccgccag

SEQ ID NO: 3645459 - RNA, 13 nt, Salmonella enterica enterica serovar Typhi
cuucuucaucuuc

SEQ ID NO: 3645460 - RNA, 14 nt, Salmonella enterica enterica serovar Typhi
cuucuucaucuuca

SEQ ID NO: 3645461 - RNA, 15 nt, Salmonella enterica enterica serovar Typhi
cuucuucgcggccgc

SEQ ID NO: 3645462 - RNA, 15 nt, Salmonella enterica enterica serovar Typhi
cuucuucuaccaccu

SEQ ID NO: 3645463 - RNA, 18 nt, Salmonella enterica enterica serovar Typhi
cuucuucuaccaccuuau

SEQ ID NO: 3645464 - RNA, 17 nt, Salmonella enterica enterica serovar Typhi
cuucuuuauagauauca

SEQ ID NO: 3645465 - RNA, 19 nt, Salmonella enterica enterica serovar Typhi
cuucuuuauccugaagaug

SEQ ID NO: 3645466 - RNA, 17 nt, Salmonella enterica enterica serovar Typhi
cuucuuuaucuucugcu

SEQ ID NO: 3645467 - RNA, 21 nt, Salmonella enterica enterica serovar Typhi
cuucuuuaucuucugcugcuc

SEQ ID NO: 3645468 - RNA, 23 nt, Salmonella enterica enterica serovar Typhi
cuucuuugaccagcgacgaugaa

SEQ ID NO: 3645469 - RNA, 13 nt, Salmonella enterica enterica serovar Typhi
cuucuuugcgcgu

SEQ ID NO: 3645470 - RNA, 17 nt, Salmonella enterica enterica serovar Typhi
cuucuuuggcuuaauca

SEQ ID NO: 3645471 - RNA, 19 nt, Salmonella enterica enterica serovar Typhi
cuucuuuggugcgacgcca

SEQ ID NO: 3645472 - RNA, 15 nt, Salmonella enterica enterica serovar Typhi
cuugaaagcaguccc

SEQ ID NO: 3645473 - RNA, 20 nt, Salmonella enterica enterica serovar Typhi
cuugaaguuauccagcgccc

SEQ ID NO: 3645474 - RNA, 15 nt, Salmonella enterica enterica serovar Typhi
cuugaauaacauaaa

SEQ ID NO: 3645475 - RNA, 15 nt, Salmonella enterica enterica serovar Typhi
cuugaccgccugauc

SEQ ID NO: 3645476 - RNA, 18 nt, Salmonella enterica enterica serovar Typhi
cuugacgcuuugcauuau

SEQ ID NO: 3645477 - RNA, 17 nt, Salmonella enterica enterica serovar Typhi
cuugaguuuuccgccau

SEQ ID NO: 3645478 - RNA, 22 nt, Salmonella enterica enterica serovar Typhi
cuugaguuuuccgccauuggcg

SEQ ID NO: 3645479 - RNA, 11 nt, Salmonella enterica enterica serovar Typhi
cuugauaaaua

SEQ ID NO: 3645480 - RNA, 13 nt, Salmonella enterica enterica serovar Typhi
cuugauacgccau

SEQ ID NO: 3645481 - RNA, 17 nt, Salmonella enterica enterica serovar Typhi
cuugauccuguaacgca

SEQ ID NO: 3645482 - RNA, 12 nt, Salmonella enterica enterica serovar Typhi
cuugaucgcgca

SEQ ID NO: 3645483 - RNA, 16 nt, Salmonella enterica enterica serovar Typhi
cuugaucgcgcagcaa

SEQ ID NO: 3645484 - RNA, 19 nt, Salmonella enterica enterica serovar Typhi
cuugaucggguuuuccuga

SEQ ID NO: 3645485 - RNA, 15 nt, Salmonella enterica enterica serovar Typhi
cuugaucucucccug

SEQ ID NO: 3645486 - RNA, 23 nt, Salmonella enterica enterica serovar Typhi
cuugaugauucacccucgucuuu

SEQ ID NO: 3645487 - RNA, 21 nt, Salmonella enterica enterica serovar Typhi
cuugauggaaaacgcaucugg

SEQ ID NO: 3645488 - RNA, 21 nt, Salmonella enterica enterica serovar Typhi
cuugauggcgaucagcgccac

SEQ ID NO: 3645489 - RNA, 13 nt, Salmonella enterica enterica serovar Typhi
cuugaugugucua

SEQ ID NO: 3645490 - RNA, 19 nt, Salmonella enterica enterica serovar Typhi
cuugaugugucuauuuauu

SEQ ID NO: 3645491 - RNA, 12 nt, Salmonella enterica enterica serovar Typhi
cuugauuccugg

SEQ ID NO: 3645492 - RNA, 20 nt, Salmonella enterica enterica serovar Typhi
cuugauugcaagaauaugag

SEQ ID NO: 3645493 - RNA, 18 nt, Salmonella enterica enterica serovar Typhi
cuugcaacccauacagcc

SEQ ID NO: 3645494 - RNA, 23 nt, Salmonella enterica enterica serovar Typhi
cuugcaaugaaaaauccccgcaa

SEQ ID NO: 3645495 - RNA, 18 nt, Salmonella enterica enterica serovar Typhi
cuugcacaauacuuuuug

SEQ ID NO: 3645496 - RNA, 24 nt, Salmonella enterica enterica serovar Typhi
cuugcaucucauaaaacauuccug

SEQ ID NO: 3645497 - RNA, 14 nt, Salmonella enterica enterica serovar Typhi
cuugcaugaccauc

SEQ ID NO: 3645498 - RNA, 13 nt, Salmonella enterica enterica serovar Typhi
cuugccacuggcc

SEQ ID NO: 3645499 - RNA, 13 nt, Salmonella enterica enterica serovar Typhi
cuugccagcgcau

SEQ ID NO: 3645500 - RNA, 18 nt, Salmonella enterica enterica serovar Typhi
cuugccaugugccgcgaa

SEQ ID NO: 3645501 - RNA, 21 nt, Salmonella enterica enterica serovar Typhi
cuugcccagcauauuaacagu

SEQ ID NO: 3645502 - RNA, 14 nt, Salmonella enterica enterica serovar Typhi
cuugcccagcgccu

SEQ ID NO: 3645503 - RNA, 18 nt, Salmonella enterica enterica serovar Typhi
cuugcccgcgccagaggc

SEQ ID NO: 3645504 - RNA, 21 nt, Salmonella enterica enterica serovar Typhi
cuugcccuguuucgcaggccg

SEQ ID NO: 3645505 - RNA, 18 nt, Salmonella enterica enterica serovar Typhi
cuugccgaguggaaucag

SEQ ID NO: 3645506 - RNA, 23 nt, Salmonella enterica enterica serovar Typhi
cuugccgcaucuucgcccggcgu

SEQ ID NO: 3645507 - RNA, 13 nt, Salmonella enterica enterica serovar Typhi
cuugccgcgccag

SEQ ID NO: 3645508 - RNA, 18 nt, Salmonella enterica enterica serovar Typhi
cuugccgcuuccagucca

SEQ ID NO: 3645509 - RNA, 17 nt, Salmonella enterica enterica serovar Typhi
cuugccgugaaaacgaa

SEQ ID NO: 3645510 - RNA, 15 nt, Salmonella enterica enterica serovar Typhi
cuugccguuuuucuc

SEQ ID NO: 3645511 - RNA, 19 nt, Salmonella enterica enterica serovar Typhi
cuugccguuuuucucauca

SEQ ID NO: 3645512 - RNA, 19 nt, Salmonella enterica enterica serovar Typhi
cuugccugcuuuuucauca

SEQ ID NO: 3645513 - RNA, 20 nt, Salmonella enterica enterica serovar Typhi
cuugcgaccacuccggcaua

SEQ ID NO: 3645514 - RNA, 19 nt, Salmonella enterica enterica serovar Typhi
cuugcgcagcauaucgccg

SEQ ID NO: 3645515 - RNA, 21 nt, Salmonella enterica enterica serovar Typhi
cuugcgccaucauccggcaac

SEQ ID NO: 3645516 - RNA, 21 nt, Salmonella enterica enterica serovar Typhi
cuugcgcguccgccuuugacg

SEQ ID NO: 3645517 - RNA, 21 nt, Salmonella enterica enterica serovar Typhi
cuugcggaaagaagaauaagc

SEQ ID NO: 3645518 - RNA, 15 nt, Salmonella enterica enterica serovar Typhi
cuugcggcgccagga

SEQ ID NO: 3645519 - RNA, 17 nt, Salmonella enterica enterica serovar Typhi
cuugcggggagaaugcg

SEQ ID NO: 3645520 - RNA, 22 nt, Salmonella enterica enterica serovar Typhi
cuugcucaaaaagcucaagcgc

SEQ ID NO: 3645521 - RNA, 19 nt, Salmonella enterica enterica serovar Typhi
cuugcugcggcacgaaaaa

SEQ ID NO: 3645522 - RNA, 23 nt, Salmonella enterica enterica serovar Typhi
cuugcuggguuaacgcgccaucu

SEQ ID NO: 3645523 - RNA, 17 nt, Salmonella enterica enterica serovar Typhi
cuugcuuuucaucacca

SEQ ID NO: 3645524 - RNA, 21 nt, Salmonella enterica enterica serovar Typhi
cuuggagagcaucaucugcca

SEQ ID NO: 3645525 - RNA, 17 nt, Salmonella enterica enterica serovar Typhi
cuuggcguuaaagacgc

SEQ ID NO: 3645526 - RNA, 19 nt, Salmonella enterica enterica serovar Typhi
cuuggcguuaaagacgcca

SEQ ID NO: 3645527 - RNA, 21 nt, Salmonella enterica enterica serovar Typhi
cuuggcguuaaagacgccagu

SEQ ID NO: 3645528 - RNA, 22 nt, Salmonella enterica enterica serovar Typhi
cuugguauggcgcuaacaccgc

SEQ ID NO: 3645529 - RNA, 12 nt, Salmonella enterica enterica serovar Typhi
cuuggucauaau

SEQ ID NO: 3645530 - RNA, 17 nt, Salmonella enterica enterica serovar Typhi
cuuguaaaaaugccugu

SEQ ID NO: 3645531 - RNA, 17 nt, Salmonella enterica enterica serovar Typhi
cuuguagaaaagaaggg

SEQ ID NO: 3645532 - RNA, 23 nt, Salmonella enterica enterica serovar Typhi
cuuguauuacguguaguuauaaa

SEQ ID NO: 3645533 - RNA, 23 nt, Salmonella enterica enterica serovar Typhi
cuuguccggcguuuuagcgccau

SEQ ID NO: 3645534 - RNA, 22 nt, Salmonella enterica enterica serovar Typhi
cuugugauaucugacuuauucg

SEQ ID NO: 3645535 - RNA, 15 nt, Salmonella enterica enterica serovar Typhi
cuugugaugagcuca

SEQ ID NO: 3645536 - RNA, 19 nt, Salmonella enterica enterica serovar Typhi
cuugugcaguggccagaau

SEQ ID NO: 3645537 - RNA, 15 nt, Salmonella enterica enterica serovar Typhi
cuugugcuuccagcu

SEQ ID NO: 3645538 - RNA, 16 nt, Salmonella enterica enterica serovar Typhi
cuugugcuuccagcuc

SEQ ID NO: 3645539 - RNA, 18 nt, Salmonella enterica enterica serovar Typhi
cuugugcuuccagcucca

SEQ ID NO: 3645540 - RNA, 22 nt, Salmonella enterica enterica serovar Typhi
cuugugcuuccagcuccaucca

SEQ ID NO: 3645541 - RNA, 24 nt, Salmonella enterica enterica serovar Typhi
cuugugcuuccagcuccauccacc

SEQ ID NO: 3645542 - RNA, 23 nt, Salmonella enterica enterica serovar Typhi
cuuguguggagguuucuucauca

SEQ ID NO: 3645543 - RNA, 24 nt, Salmonella enterica enterica serovar Typhi
cuuguuauccuaaaucugccauca

SEQ ID NO: 3645544 - RNA, 14 nt, Salmonella enterica enterica serovar Typhi
cuuguucgcagguc

SEQ ID NO: 3645545 - RNA, 15 nt, Salmonella enterica enterica serovar Typhi
cuuguucuuccauug

SEQ ID NO: 3645546 - RNA, 13 nt, Salmonella enterica enterica serovar Typhi
cuuguucuuuuca

SEQ ID NO: 3645547 - RNA, 14 nt, Salmonella enterica enterica serovar Typhi
cuuguugcggauga

SEQ ID NO: 3645548 - RNA, 15 nt, Salmonella enterica enterica serovar Typhi
cuuguuguaaagaaa

SEQ ID NO: 3645549 - RNA, 22 nt, Salmonella enterica enterica serovar Typhi
cuuguuuuaacggaaucagauu

SEQ ID NO: 3645550 - RNA, 22 nt, Salmonella enterica enterica serovar Typhi
cuuuaaacgccagccugugauc

SEQ ID NO: 3645551 - RNA, 16 nt, Salmonella enterica enterica serovar Typhi
cuuuaaaugccuguuu

SEQ ID NO: 3645552 - RNA, 19 nt, Salmonella enterica enterica serovar Typhi
cuuuaaaugccuguuuaua

SEQ ID NO: 3645553 - RNA, 14 nt, Salmonella enterica enterica serovar Typhi
cuuuaaccacagcc

SEQ ID NO: 3645554 - RNA, 16 nt, Salmonella enterica enterica serovar Typhi
cuuuaaccacagccuu

SEQ ID NO: 3645555 - RNA, 14 nt, Salmonella enterica enterica serovar Typhi
cuuuaaccgccugc

SEQ ID NO: 3645556 - RNA, 15 nt, Salmonella enterica enterica serovar Typhi
cuuuaaccgccugcu

SEQ ID NO: 3645557 - RNA, 23 nt, Salmonella enterica enterica serovar Typhi
cuuuaacgccuucauauuaaauu

SEQ ID NO: 3645558 - RNA, 20 nt, Salmonella enterica enterica serovar Typhi
cuuuaacuaauggcaauaau

SEQ ID NO: 3645559 - RNA, 14 nt, Salmonella enterica enterica serovar Typhi
cuuuaagaacgguu

SEQ ID NO: 3645560 - RNA, 16 nt, Salmonella enterica enterica serovar Typhi
cuuuaagcaccgcuuu

SEQ ID NO: 3645561 - RNA, 20 nt, Salmonella enterica enterica serovar Typhi
cuuuaagccgauugaauaau

SEQ ID NO: 3645562 - RNA, 13 nt, Salmonella enterica enterica serovar Typhi
cuuuaauauucau

SEQ ID NO: 3645563 - RNA, 18 nt, Salmonella enterica enterica serovar Typhi
cuuuaaugauguccagaa

SEQ ID NO: 3645564 - RNA, 20 nt, Salmonella enterica enterica serovar Typhi
cuuuaaugcccgguauuuuu

SEQ ID NO: 3645565 - RNA, 14 nt, Salmonella enterica enterica serovar Typhi
cuuuaauuaaucca

SEQ ID NO: 3645566 - RNA, 13 nt, Salmonella enterica enterica serovar Typhi
cuuuacaccccac

SEQ ID NO: 3645567 - RNA, 14 nt, Salmonella enterica enterica serovar Typhi
cuuuacaccccacu

SEQ ID NO: 3645568 - RNA, 14 nt, Salmonella enterica enterica serovar Typhi
cuuuacccagcggg

SEQ ID NO: 3645569 - RNA, 19 nt, Salmonella enterica enterica serovar Typhi
cuuuacccgggccaucuuu

SEQ ID NO: 3645570 - RNA, 17 nt, Salmonella enterica enterica serovar Typhi
cuuuacccuuacggcca

SEQ ID NO: 3645571 - RNA, 14 nt, Salmonella enterica enterica serovar Typhi
cuuuaccgugaaug

SEQ ID NO: 3645572 - RNA, 18 nt, Salmonella enterica enterica serovar Typhi
cuuuacgcuuguuguaaa

SEQ ID NO: 3645573 - RNA, 19 nt, Salmonella enterica enterica serovar Typhi
cuuuacuaauaccuggaau

SEQ ID NO: 3645574 - RNA, 13 nt, Salmonella enterica enterica serovar Typhi
cuuuacugcgcca

SEQ ID NO: 3645575 - RNA, 20 nt, Salmonella enterica enterica serovar Typhi
cuuuacugcgccagccugcu

SEQ ID NO: 3645576 - RNA, 17 nt, Salmonella enterica enterica serovar Typhi
cuuuacuucuuugcgau

SEQ ID NO: 3645577 - RNA, 20 nt, Salmonella enterica enterica serovar Typhi
cuuuaggcggcgccgcgccg

SEQ ID NO: 3645578 - RNA, 12 nt, Salmonella enterica enterica serovar Typhi
cuuuagggcgcu

SEQ ID NO: 3645579 - RNA, 18 nt, Salmonella enterica enterica serovar Typhi
cuuuaggguaucauuucc

SEQ ID NO: 3645580 - RNA, 21 nt, Salmonella enterica enterica serovar Typhi
cuuuaggguaucauuuccaca

SEQ ID NO: 3645581 - RNA, 23 nt, Salmonella enterica enterica serovar Typhi
cuuuauaaaaagcacaucagcaa

SEQ ID NO: 3645582 - RNA, 20 nt, Salmonella enterica enterica serovar Typhi
cuuuauaaaucaggaaaaag

SEQ ID NO: 3645583 - RNA, 14 nt, Salmonella enterica enterica serovar Typhi
cuuuauacaguaag

SEQ ID NO: 3645584 - RNA, 17 nt, Salmonella enterica enterica serovar Typhi
cuuuauauaaaaaaugg

SEQ ID NO: 3645585 - RNA, 12 nt, Salmonella enterica enterica serovar Typhi
cuuuauauuuuu

SEQ ID NO: 3645586 - RNA, 20 nt, Salmonella enterica enterica serovar Typhi
cuuuaucaaacaaaccaaac

SEQ ID NO: 3645587 - RNA, 21 nt, Salmonella enterica enterica serovar Typhi
cuuuauccagcggcgcgcggu

SEQ ID NO: 3645588 - RNA, 15 nt, Salmonella enterica enterica serovar Typhi
cuuuauccggucugc

SEQ ID NO: 3645589 - RNA, 23 nt, Salmonella enterica enterica serovar Typhi
cuuuaucgcgcagcagauuaaca

SEQ ID NO: 3645590 - RNA, 14 nt, Salmonella enterica enterica serovar Typhi
cuuuaucguaaccg

SEQ ID NO: 3645591 - RNA, 22 nt, Salmonella enterica enterica serovar Typhi
cuuuaucuucugcugcucccuc

SEQ ID NO: 3645592 - RNA, 24 nt, Salmonella enterica enterica serovar Typhi
cuuuaugcccuucgacaaucagca

SEQ ID NO: 3645593 - RNA, 13 nt, Salmonella enterica enterica serovar Typhi
cuuuauucauuuc

SEQ ID NO: 3645594 - RNA, 14 nt, Salmonella enterica enterica serovar Typhi
cuuuauucgcuugu

SEQ ID NO: 3645595 - RNA, 11 nt, Salmonella enterica enterica serovar Typhi
cuuuauugaug

SEQ ID NO: 3645596 - RNA, 15 nt, Salmonella enterica enterica serovar Typhi
cuuucaccagcgcca

SEQ ID NO: 3645597 - RNA, 21 nt, Salmonella enterica enterica serovar Typhi
cuuucaccuccgcuuuuaucg

SEQ ID NO: 3645598 - RNA, 20 nt, Salmonella enterica enterica serovar Typhi
cuuucacgaaaccggcgaug

SEQ ID NO: 3645599 - RNA, 22 nt, Salmonella enterica enterica serovar Typhi
cuuucacugucaugguuauuuu

SEQ ID NO: 3645600 - RNA, 20 nt, Salmonella enterica enterica serovar Typhi
cuuucagaccaaauucagcg

SEQ ID NO: 3645601 - RNA, 18 nt, Salmonella enterica enterica serovar Typhi
cuuucagagcccgggaga

SEQ ID NO: 3645602 - RNA, 16 nt, Salmonella enterica enterica serovar Typhi
cuuucagaugcagcgg

SEQ ID NO: 3645603 - RNA, 20 nt, Salmonella enterica enterica serovar Typhi
cuuucagccgacuaucuucu

SEQ ID NO: 3645604 - RNA, 22 nt, Salmonella enterica enterica serovar Typhi
cuuucagccgacuaucuucuuc

SEQ ID NO: 3645605 - RNA, 12 nt, Salmonella enterica enterica serovar Typhi
cuuucagcucuu

SEQ ID NO: 3645606 - RNA, 17 nt, Salmonella enterica enterica serovar Typhi
cuuucaggaauuuauca

SEQ ID NO: 3645607 - RNA, 20 nt, Salmonella enterica enterica serovar Typhi
cuuucaguuucggccccccc

SEQ ID NO: 3645608 - RNA, 21 nt, Salmonella enterica enterica serovar Typhi
cuuucauaauguucgguauau

SEQ ID NO: 3645609 - RNA, 12 nt, Salmonella enterica enterica serovar Typhi
cuuucaucuuua

SEQ ID NO: 3645610 - RNA, 21 nt, Salmonella enterica enterica serovar Typhi
cuuucaugaacguuggcgaua

SEQ ID NO: 3645611 - RNA, 17 nt, Salmonella enterica enterica serovar Typhi
cuuucauuccuuuagcu

SEQ ID NO: 3645612 - RNA, 17 nt, Salmonella enterica enterica serovar Typhi
cuuucauucgucaaauu

SEQ ID NO: 3645613 - RNA, 21 nt, Salmonella enterica enterica serovar Typhi
cuuucauuggauaaaguuuuc

SEQ ID NO: 3645614 - RNA, 13 nt, Salmonella enterica enterica serovar Typhi
cuuucauuucacu

SEQ ID NO: 3645615 - RNA, 16 nt, Salmonella enterica enterica serovar Typhi
cuuucauuucuuuaau

SEQ ID NO: 3645616 - RNA, 13 nt, Salmonella enterica enterica serovar Typhi
cuuuccaaccugu

SEQ ID NO: 3645617 - RNA, 14 nt, Salmonella enterica enterica serovar Typhi
cuuuccacaaucaa

SEQ ID NO: 3645618 - RNA, 23 nt, Salmonella enterica enterica serovar Typhi
cuuuccacaaucccggcaacugc

SEQ ID NO: 3645619 - RNA, 13 nt, Salmonella enterica enterica serovar Typhi
cuuuccagaccaa

SEQ ID NO: 3645620 - RNA, 20 nt, Salmonella enterica enterica serovar Typhi
cuuuccagcaacugacgcgc

SEQ ID NO: 3645621 - RNA, 13 nt, Salmonella enterica enterica serovar Typhi
cuuuccagcagcc

SEQ ID NO: 3645622 - RNA, 14 nt, Salmonella enterica enterica serovar Typhi
cuuuccagcagcca

SEQ ID NO: 3645623 - RNA, 17 nt, Salmonella enterica enterica serovar Typhi
cuuuccagcucaaccgc

SEQ ID NO: 3645624 - RNA, 14 nt, Salmonella enterica enterica serovar Typhi
cuuuccagcuccag

SEQ ID NO: 3645625 - RNA, 15 nt, Salmonella enterica enterica serovar Typhi
cuuuccagcuccagc

SEQ ID NO: 3645626 - RNA, 19 nt, Salmonella enterica enterica serovar Typhi
cuuuccagcuccagccgcu

SEQ ID NO: 3645627 - RNA, 15 nt, Salmonella enterica enterica serovar Typhi
cuuuccagucaacga

SEQ ID NO: 3645628 - RNA, 21 nt, Salmonella enterica enterica serovar Typhi
cuuuccaguucuggcugcgcu

SEQ ID NO: 3645629 - RNA, 17 nt, Salmonella enterica enterica serovar Typhi
cuuucccguuucagccc

SEQ ID NO: 3645630 - RNA, 19 nt, Salmonella enterica enterica serovar Typhi
cuuuccgacccuuauguca

SEQ ID NO: 3645631 - RNA, 15 nt, Salmonella enterica enterica serovar Typhi
cuuuccgcaccgcuu

SEQ ID NO: 3645632 - RNA, 17 nt, Salmonella enterica enterica serovar Typhi
cuuuccggcgcuuccug

SEQ ID NO: 3645633 - RNA, 18 nt, Salmonella enterica enterica serovar Typhi
cuuuccuuauuaaagccc

SEQ ID NO: 3645634 - RNA, 23 nt, Salmonella enterica enterica serovar Typhi
cuuuccuuauuaaagccccuucc

SEQ ID NO: 3645635 - RNA, 18 nt, Salmonella enterica enterica serovar Typhi
cuuuccuuuuucaggcac

SEQ ID NO: 3645636 - RNA, 21 nt, Salmonella enterica enterica serovar Typhi
cuuucgaagccgaccaccauc

SEQ ID NO: 3645637 - RNA, 18 nt, Salmonella enterica enterica serovar Typhi
cuuucgacagucgguaac

SEQ ID NO: 3645638 - RNA, 21 nt, Salmonella enterica enterica serovar Typhi
cuuucgcaacauccgaaagcu

SEQ ID NO: 3645639 - RNA, 15 nt, Salmonella enterica enterica serovar Typhi
cuuucgccagcggcg

SEQ ID NO: 3645640 - RNA, 14 nt, Salmonella enterica enterica serovar Typhi
cuuucgccaguuca

SEQ ID NO: 3645641 - RNA, 22 nt, Salmonella enterica enterica serovar Typhi
cuuucggcaaagcacugcugcu

SEQ ID NO: 3645642 - RNA, 23 nt, Salmonella enterica enterica serovar Typhi
cuuucggcaaagcacugcugcug

SEQ ID NO: 3645643 - RNA, 22 nt, Salmonella enterica enterica serovar Typhi
cuuucggucguuugccgugcau

SEQ ID NO: 3645644 - RNA, 21 nt, Salmonella enterica enterica serovar Typhi
cuuucgucguccacucuuccg

SEQ ID NO: 3645645 - RNA, 22 nt, Salmonella enterica enterica serovar Typhi
cuuucgucguccacucuuccgg

SEQ ID NO: 3645646 - RNA, 19 nt, Salmonella enterica enterica serovar Typhi
cuuucucggcuuuccagcu

SEQ ID NO: 3645647 - RNA, 18 nt, Salmonella enterica enterica serovar Typhi
cuuucucgggccuguucc

SEQ ID NO: 3645648 - RNA, 23 nt, Salmonella enterica enterica serovar Typhi
cuuucugagccgcccggcgcgcu

SEQ ID NO: 3645649 - RNA, 14 nt, Salmonella enterica enterica serovar Typhi
cuuucuucaauggc

SEQ ID NO: 3645650 - RNA, 12 nt, Salmonella enterica enterica serovar Typhi
cuuucuugccac

SEQ ID NO: 3645651 - RNA, 18 nt, Salmonella enterica enterica serovar Typhi
cuuucuugccacuggccu

SEQ ID NO: 3645652 - RNA, 16 nt, Salmonella enterica enterica serovar Typhi
cuuucuuuacaugacc

SEQ ID NO: 3645653 - RNA, 11 nt, Salmonella enterica enterica serovar Typhi
cuuucuuucuc

SEQ ID NO: 3645654 - RNA, 20 nt, Salmonella enterica enterica serovar Typhi
cuuucuuuuuauauuccccu

SEQ ID NO: 3645655 - RNA, 14 nt, Salmonella enterica enterica serovar Typhi
cuuugaaaaucaca

SEQ ID NO: 3645656 - RNA, 18 nt, Salmonella enterica enterica serovar Typhi
cuuugaaaaucacaucgc

SEQ ID NO: 3645657 - RNA, 20 nt, Salmonella enterica enterica serovar Typhi
cuuugacaaccucgcuucgc

SEQ ID NO: 3645658 - RNA, 18 nt, Salmonella enterica enterica serovar Typhi
cuuugaccagcaucgccg

SEQ ID NO: 3645659 - RNA, 22 nt, Salmonella enterica enterica serovar Typhi
cuuugaccagcaucgccgguag

SEQ ID NO: 3645660 - RNA, 15 nt, Salmonella enterica enterica serovar Typhi
cuuugaccagcgacg

SEQ ID NO: 3645661 - RNA, 21 nt, Salmonella enterica enterica serovar Typhi
cuuugacccacgccagcagcu

SEQ ID NO: 3645662 - RNA, 20 nt, Salmonella enterica enterica serovar Typhi
cuuugacgccgggaaauuuu

SEQ ID NO: 3645663 - RNA, 22 nt, Salmonella enterica enterica serovar Typhi
cuuugagcaucaaacuuuuaaa

SEQ ID NO: 3645664 - RNA, 13 nt, Salmonella enterica enterica serovar Typhi
cuuugcaaucgac

SEQ ID NO: 3645665 - RNA, 17 nt, Salmonella enterica enterica serovar Typhi
cuuugcccgucgccgau

SEQ ID NO: 3645666 - RNA, 23 nt, Salmonella enterica enterica serovar Typhi
cuuugccgcaaacgccgaagcca

SEQ ID NO: 3645667 - RNA, 19 nt, Salmonella enterica enterica serovar Typhi
cuuugccuucuguuuuuug

SEQ ID NO: 3645668 - RNA, 13 nt, Salmonella enterica enterica serovar Typhi
cuuugccuuucuu

SEQ ID NO: 3645669 - RNA, 18 nt, Salmonella enterica enterica serovar Typhi
cuuugcgauagcccggca

SEQ ID NO: 3645670 - RNA, 19 nt, Salmonella enterica enterica serovar Typhi
cuuugcgauagcccggcau

SEQ ID NO: 3645671 - RNA, 17 nt, Salmonella enterica enterica serovar Typhi
cuuugcgauuuguccgc

SEQ ID NO: 3645672 - RNA, 20 nt, Salmonella enterica enterica serovar Typhi
cuuugcgccauuucaauaau

SEQ ID NO: 3645673 - RNA, 16 nt, Salmonella enterica enterica serovar Typhi
cuuugcgcuccugcuc

SEQ ID NO: 3645674 - RNA, 12 nt, Salmonella enterica enterica serovar Typhi
cuuugcucuccu

SEQ ID NO: 3645675 - RNA, 11 nt, Salmonella enterica enterica serovar Typhi
cuuugcugcug

SEQ ID NO: 3645676 - RNA, 16 nt, Salmonella enterica enterica serovar Typhi
cuuugcuuauccggcc

SEQ ID NO: 3645677 - RNA, 18 nt, Salmonella enterica enterica serovar Typhi
cuuugcuuauccggccua

SEQ ID NO: 3645678 - RNA, 20 nt, Salmonella enterica enterica serovar Typhi
cuuugcuuuguaaagcgcca

SEQ ID NO: 3645679 - RNA, 14 nt, Salmonella enterica enterica serovar Typhi
cuuugcuuuguagc

SEQ ID NO: 3645680 - RNA, 18 nt, Salmonella enterica enterica serovar Typhi
cuuuggcaaacggcgcca

SEQ ID NO: 3645681 - RNA, 14 nt, Salmonella enterica enterica serovar Typhi
cuuuggcgcccauu

SEQ ID NO: 3645682 - RNA, 22 nt, Salmonella enterica enterica serovar Typhi
cuuuggcgcccauuucguuaau

SEQ ID NO: 3645683 - RNA, 21 nt, Salmonella enterica enterica serovar Typhi
cuuuggcgcgcgguuuauccc

SEQ ID NO: 3645684 - RNA, 18 nt, Salmonella enterica enterica serovar Typhi
cuuuggcuguccagccgc

SEQ ID NO: 3645685 - RNA, 17 nt, Salmonella enterica enterica serovar Typhi
cuuuggugcgacgccag

SEQ ID NO: 3645686 - RNA, 22 nt, Salmonella enterica enterica serovar Typhi
cuuugucaccggaguuaccauc

SEQ ID NO: 3645687 - RNA, 18 nt, Salmonella enterica enterica serovar Typhi
cuuugucauccaccagaa

SEQ ID NO: 3645688 - RNA, 21 nt, Salmonella enterica enterica serovar Typhi
cuuugucgaaauugccgcccg

SEQ ID NO: 3645689 - RNA, 19 nt, Salmonella enterica enterica serovar Typhi
cuuugugggacugcuucaa

SEQ ID NO: 3645690 - RNA, 17 nt, Salmonella enterica enterica serovar Typhi
cuuuguugaucucauug

SEQ ID NO: 3645691 - RNA, 15 nt, Salmonella enterica enterica serovar Typhi
cuuuuaaaaaucagu

SEQ ID NO: 3645692 - RNA, 18 nt, Salmonella enterica enterica serovar Typhi
cuuuuaaagacuuugaug

SEQ ID NO: 3645693 - RNA, 22 nt, Salmonella enterica enterica serovar Typhi
cuuuuaaauuguuauaccgcuu

SEQ ID NO: 3645694 - RNA, 22 nt, Salmonella enterica enterica serovar Typhi
cuuuuaacaaaucgacagccag

SEQ ID NO: 3645695 - RNA, 23 nt, Salmonella enterica enterica serovar Typhi
cuuuuaacaaaucgacagccagc

SEQ ID NO: 3645696 - RNA, 23 nt, Salmonella enterica enterica serovar Typhi
cuuuuaacauaagugauacaugc

SEQ ID NO: 3645697 - RNA, 15 nt, Salmonella enterica enterica serovar Typhi
cuuuuaauuuuuaug

SEQ ID NO: 3645698 - RNA, 23 nt, Salmonella enterica enterica serovar Typhi
cuuuuacaggccggacaggcgac

SEQ ID NO: 3645699 - RNA, 21 nt, Salmonella enterica enterica serovar Typhi
cuuuuacucuuccugcugcgc

SEQ ID NO: 3645700 - RNA, 19 nt, Salmonella enterica enterica serovar Typhi
cuuuuagaauuaucugaaa

SEQ ID NO: 3645701 - RNA, 14 nt, Salmonella enterica enterica serovar Typhi
cuuuuagcaccaga

SEQ ID NO: 3645702 - RNA, 21 nt, Salmonella enterica enterica serovar Typhi
cuuuucacccaacauuuuuag

SEQ ID NO: 3645703 - RNA, 17 nt, Salmonella enterica enterica serovar Typhi
cuuuucaggucuggauu

SEQ ID NO: 3645704 - RNA, 22 nt, Salmonella enterica enterica serovar Typhi
cuuuucaucaccaucugaccgu

SEQ ID NO: 3645705 - RNA, 22 nt, Salmonella enterica enterica serovar Typhi
cuuuucauccacagcgccagaa

SEQ ID NO: 3645706 - RNA, 18 nt, Salmonella enterica enterica serovar Typhi
cuuuucccgccagcugcg

SEQ ID NO: 3645707 - RNA, 22 nt, Salmonella enterica enterica serovar Typhi
cuuuucccguaaugcccaggcg

SEQ ID NO: 3645708 - RNA, 19 nt, Salmonella enterica enterica serovar Typhi
cuuuuccucgucauaucug

SEQ ID NO: 3645709 - RNA, 14 nt, Salmonella enterica enterica serovar Typhi
cuuuuccugcugcc

SEQ ID NO: 3645710 - RNA, 22 nt, Salmonella enterica enterica serovar Typhi
cuuuucgcaauagggggugaca

SEQ ID NO: 3645711 - RNA, 14 nt, Salmonella enterica enterica serovar Typhi
cuuuucgggcacug

SEQ ID NO: 3645712 - RNA, 16 nt, Salmonella enterica enterica serovar Typhi
cuuuucgggcacuggc

SEQ ID NO: 3645713 - RNA, 16 nt, Salmonella enterica enterica serovar Typhi
cuuuucggguaaauca

SEQ ID NO: 3645714 - RNA, 17 nt, Salmonella enterica enterica serovar Typhi
cuuuucggguguccacu

SEQ ID NO: 3645715 - RNA, 18 nt, Salmonella enterica enterica serovar Typhi
cuuuucggguguccacuc

SEQ ID NO: 3645716 - RNA, 22 nt, Salmonella enterica enterica serovar Typhi
cuuuucugucguguccuugcca

SEQ ID NO: 3645717 - RNA, 14 nt, Salmonella enterica enterica serovar Typhi
cuuuucuuucagcu

SEQ ID NO: 3645718 - RNA, 12 nt, Salmonella enterica enterica serovar Typhi
cuuuugagcagc

SEQ ID NO: 3645719 - RNA, 19 nt, Salmonella enterica enterica serovar Typhi
cuuuugagucgcauccagu

SEQ ID NO: 3645720 - RNA, 18 nt, Salmonella enterica enterica serovar Typhi
cuuuugauacucugcuuu

SEQ ID NO: 3645721 - RNA, 21 nt, Salmonella enterica enterica serovar Typhi
cuuuugauacucugcuuuuuc

SEQ ID NO: 3645722 - RNA, 16 nt, Salmonella enterica enterica serovar Typhi
cuuuugcgccuuccag

SEQ ID NO: 3645723 - RNA, 16 nt, Salmonella enterica enterica serovar Typhi
cuuuugcuacgucgcc

SEQ ID NO: 3645724 - RNA, 20 nt, Salmonella enterica enterica serovar Typhi
cuuuugcuuccaguuucuca

SEQ ID NO: 3645725 - RNA, 18 nt, Salmonella enterica enterica serovar Typhi
cuuuuggcgacaggcgcu

SEQ ID NO: 3645726 - RNA, 20 nt, Salmonella enterica enterica serovar Typhi
cuuuuggcguaauggcggga

SEQ ID NO: 3645727 - RNA, 17 nt, Salmonella enterica enterica serovar Typhi
cuuuugguggcaacaga

SEQ ID NO: 3645728 - RNA, 13 nt, Salmonella enterica enterica serovar Typhi
cuuuuuaaaauga

SEQ ID NO: 3645729 - RNA, 22 nt, Salmonella enterica enterica serovar Typhi
cuuuuuaaccauaaugucuucc

SEQ ID NO: 3645730 - RNA, 18 nt, Salmonella enterica enterica serovar Typhi
cuuuuuaggcuauaaaaa

SEQ ID NO: 3645731 - RNA, 19 nt, Salmonella enterica enterica serovar Typhi
cuuuuuauggcccgccagc

SEQ ID NO: 3645732 - RNA, 19 nt, Salmonella enterica enterica serovar Typhi
cuuuuuauggcggggcgcu

SEQ ID NO: 3645733 - RNA, 16 nt, Salmonella enterica enterica serovar Typhi
cuuuuuauuacuuucu

SEQ ID NO: 3645734 - RNA, 17 nt, Salmonella enterica enterica serovar Typhi
cuuuuuauuuacugccg

SEQ ID NO: 3645735 - RNA, 15 nt, Salmonella enterica enterica serovar Typhi
cuuuuuauuuuucug

SEQ ID NO: 3645736 - RNA, 16 nt, Salmonella enterica enterica serovar Typhi
cuuuuucaauuuccag

SEQ ID NO: 3645737 - RNA, 13 nt, Salmonella enterica enterica serovar Typhi
cuuuuucagaucu

SEQ ID NO: 3645738 - RNA, 20 nt, Salmonella enterica enterica serovar Typhi
cuuuuucauagaaccacuua

SEQ ID NO: 3645739 - RNA, 16 nt, Salmonella enterica enterica serovar Typhi
cuuuuucccggugcgu

SEQ ID NO: 3645740 - RNA, 21 nt, Salmonella enterica enterica serovar Typhi
cuuuuuccgccugaucuuucu

SEQ ID NO: 3645741 - RNA, 24 nt, Salmonella enterica enterica serovar Typhi
cuuuuuccuccugcggagagagca

SEQ ID NO: 3645742 - RNA, 16 nt, Salmonella enterica enterica serovar Typhi
cuuuuuccugccauug

SEQ ID NO: 3645743 - RNA, 13 nt, Salmonella enterica enterica serovar Typhi
cuuuuugagcggc

SEQ ID NO: 3645744 - RNA, 17 nt, Salmonella enterica enterica serovar Typhi
cuuuuugcgacacgcug

SEQ ID NO: 3645745 - RNA, 20 nt, Salmonella enterica enterica serovar Typhi
cuuuuugcgacacgcugcau

SEQ ID NO: 3645746 - RNA, 19 nt, Salmonella enterica enterica serovar Typhi
cuuuuugcgccacuuuucc

SEQ ID NO: 3645747 - RNA, 13 nt, Salmonella enterica enterica serovar Typhi
cuuuuuuaacgau

SEQ ID NO: 3645748 - RNA, 13 nt, Salmonella enterica enterica serovar Typhi
cuuuuuuaccgga

SEQ ID NO: 3645749 - RNA, 19 nt, Salmonella enterica enterica serovar Typhi
cuuuuuuagucuccugcca

SEQ ID NO: 3645750 - RNA, 14 nt, Salmonella enterica enterica serovar Typhi
cuuuuuuaugcugu

SEQ ID NO: 3645751 - RNA, 22 nt, Salmonella enterica enterica serovar Typhi
gaaaaaacgggcccgcggcgac

SEQ ID NO: 3645752 - RNA, 14 nt, Salmonella enterica enterica serovar Typhi
gaaaaaagcagcau

SEQ ID NO: 3645753 - RNA, 23 nt, Salmonella enterica enterica serovar Typhi
gaaaaaagugaucccccagaauc

SEQ ID NO: 3645754 - RNA, 19 nt, Salmonella enterica enterica serovar Typhi
gaaaaaauacugauaaaaa

SEQ ID NO: 3645755 - RNA, 23 nt, Salmonella enterica enterica serovar Typhi
gaaaaaauacugauaaaaaacag

SEQ ID NO: 3645756 - RNA, 14 nt, Salmonella enterica enterica serovar Typhi
gaaaaaauuaaaaa

SEQ ID NO: 3645757 - RNA, 21 nt, Salmonella enterica enterica serovar Typhi
gaaaaaauucccggcaugcca

SEQ ID NO: 3645758 - RNA, 15 nt, Salmonella enterica enterica serovar Typhi
gaaaaacaucauggc

SEQ ID NO: 3645759 - RNA, 17 nt, Salmonella enterica enterica serovar Typhi
gaaaaaccaaaaaauau

SEQ ID NO: 3645760 - RNA, 21 nt, Salmonella enterica enterica serovar Typhi
gaaaaacgcuaccgucgccga

SEQ ID NO: 3645761 - RNA, 20 nt, Salmonella enterica enterica serovar Typhi
gaaaaacucaccgcuaugaa

SEQ ID NO: 3645762 - RNA, 18 nt, Salmonella enterica enterica serovar Typhi
gaaaaagaaaccuccgca

SEQ ID NO: 3645763 - RNA, 20 nt, Salmonella enterica enterica serovar Typhi
gaaaaagaaguuagauauua

SEQ ID NO: 3645764 - RNA, 22 nt, Salmonella enterica enterica serovar Typhi
gaaaaagcgcacuuuccauaau

SEQ ID NO: 3645765 - RNA, 21 nt, Salmonella enterica enterica serovar Typhi
gaaaaagcggcuguagccagc

SEQ ID NO: 3645766 - RNA, 22 nt, Salmonella enterica enterica serovar Typhi
gaaaaauaagagggcgccaugc

SEQ ID NO: 3645767 - RNA, 13 nt, Salmonella enterica enterica serovar Typhi
gaaaaauguucag

SEQ ID NO: 3645768 - RNA, 23 nt, Salmonella enterica enterica serovar Typhi
gaaaaauuuaagccagauguaau

SEQ ID NO: 3645769 - RNA, 14 nt, Salmonella enterica enterica serovar Typhi
gaaaacaaauugca

SEQ ID NO: 3645770 - RNA, 21 nt, Salmonella enterica enterica serovar Typhi
gaaaacaccagggauuuugcu

SEQ ID NO: 3645771 - RNA, 15 nt, Salmonella enterica enterica serovar Typhi
gaaaacagcgccggc

SEQ ID NO: 3645772 - RNA, 19 nt, Salmonella enterica enterica serovar Typhi
gaaaacagcgccggcagca

SEQ ID NO: 3645773 - RNA, 20 nt, Salmonella enterica enterica serovar Typhi
gaaaacaucgcuccggcauc

SEQ ID NO: 3645774 - RNA, 13 nt, Salmonella enterica enterica serovar Typhi
gaaaaccagcgcc

SEQ ID NO: 3645775 - RNA, 20 nt, Salmonella enterica enterica serovar Typhi
gaaaaccccaucccggcaac

SEQ ID NO: 3645776 - RNA, 16 nt, Salmonella enterica enterica serovar Typhi
gaaaaccgagcauccg

SEQ ID NO: 3645777 - RNA, 15 nt, Salmonella enterica enterica serovar Typhi
gaaaacgaaucucgc

SEQ ID NO: 3645778 - RNA, 22 nt, Salmonella enterica enterica serovar Typhi
gaaaacggccagugaaauaaau

SEQ ID NO: 3645779 - RNA, 13 nt, Salmonella enterica enterica serovar Typhi
gaaaacuccagca

SEQ ID NO: 3645780 - RNA, 12 nt, Salmonella enterica enterica serovar Typhi
gaaaacugcgcc

SEQ ID NO: 3645781 - RNA, 14 nt, Salmonella enterica enterica serovar Typhi
gaaaacuuuccaac

SEQ ID NO: 3645782 - RNA, 12 nt, Salmonella enterica enterica serovar Typhi
gaaaagaaccga

SEQ ID NO: 3645783 - RNA, 16 nt, Salmonella enterica enterica serovar Typhi
gaaaagaccaguggac

SEQ ID NO: 3645784 - RNA, 12 nt, Salmonella enterica enterica serovar Typhi
gaaaagcagagg

SEQ ID NO: 3645785 - RNA, 16 nt, Salmonella enterica enterica serovar Typhi
gaaaagcagccagacc

SEQ ID NO: 3645786 - RNA, 14 nt, Salmonella enterica enterica serovar Typhi
gaaaagccggaaua

SEQ ID NO: 3645787 - RNA, 21 nt, Salmonella enterica enterica serovar Typhi
gaaaagccggaugugagcgca

SEQ ID NO: 3645788 - RNA, 20 nt, Salmonella enterica enterica serovar Typhi
gaaaagcgcgucgaaugacg

SEQ ID NO: 3645789 - RNA, 21 nt, Salmonella enterica enterica serovar Typhi
gaaaagcgggggcgacagccc

SEQ ID NO: 3645790 - RNA, 16 nt, Salmonella enterica enterica serovar Typhi
gaaaagcgucuucuua

SEQ ID NO: 3645791 - RNA, 11 nt, Salmonella enterica enterica serovar Typhi
gaaaagcuggu

SEQ ID NO: 3645792 - RNA, 21 nt, Salmonella enterica enterica serovar Typhi
gaaaaggccuggcugagaaaa

SEQ ID NO: 3645793 - RNA, 17 nt, Salmonella enterica enterica serovar Typhi
gaaaaggucgucaggcc

SEQ ID NO: 3645794 - RNA, 18 nt, Salmonella enterica enterica serovar Typhi
gaaaagguuucggcgauc

SEQ ID NO: 3645795 - RNA, 22 nt, Salmonella enterica enterica serovar Typhi
gaaaagguuucggcgaucacca

SEQ ID NO: 3645796 - RNA, 16 nt, Salmonella enterica enterica serovar Typhi
gaaaagucauuuucau

SEQ ID NO: 3645797 - RNA, 17 nt, Salmonella enterica enterica serovar Typhi
gaaaagucauuuucaug

SEQ ID NO: 3645798 - RNA, 12 nt, Salmonella enterica enterica serovar Typhi
gaaaagugaacg

SEQ ID NO: 3645799 - RNA, 18 nt, Salmonella enterica enterica serovar Typhi
gaaaaguguguaccagca

SEQ ID NO: 3645800 - RNA, 23 nt, Salmonella enterica enterica serovar Typhi
gaaaauaaacgcuugacucugaa

SEQ ID NO: 3645801 - RNA, 14 nt, Salmonella enterica enterica serovar Typhi
gaaaauaacaauau

SEQ ID NO: 3645802 - RNA, 19 nt, Salmonella enterica enterica serovar Typhi
gaaaauaacaauauuaaau

SEQ ID NO: 3645803 - RNA, 13 nt, Salmonella enterica enterica serovar Typhi
gaaaauacucccg

SEQ ID NO: 3645804 - RNA, 14 nt, Salmonella enterica enterica serovar Typhi
gaaaauagaggaaa

SEQ ID NO: 3645805 - RNA, 15 nt, Salmonella enterica enterica serovar Typhi
gaaaauauacaccug

SEQ ID NO: 3645806 - RNA, 16 nt, Salmonella enterica enterica serovar Typhi
gaaaauauaugacaac

SEQ ID NO: 3645807 - RNA, 13 nt, Salmonella enterica enterica serovar Typhi
gaaaauaucggcc

SEQ ID NO: 3645808 - RNA, 22 nt, Salmonella enterica enterica serovar Typhi
gaaaauaugagguugucuuugc

SEQ ID NO: 3645809 - RNA, 18 nt, Salmonella enterica enterica serovar Typhi
gaaaauauuagcggcggc

SEQ ID NO: 3645810 - RNA, 19 nt, Salmonella enterica enterica serovar Typhi
gaaaauauuagcggcggca

SEQ ID NO: 3645811 - RNA, 18 nt, Salmonella enterica enterica serovar Typhi
gaaaaucacaucgccgga

SEQ ID NO: 3645812 - RNA, 20 nt, Salmonella enterica enterica serovar Typhi
gaaaaucagugaacacccug

SEQ ID NO: 3645813 - RNA, 22 nt, Salmonella enterica enterica serovar Typhi
gaaaaucagugaacacccugcc

SEQ ID NO: 3645814 - RNA, 18 nt, Salmonella enterica enterica serovar Typhi
gaaaaucgcugcgcccga

SEQ ID NO: 3645815 - RNA, 13 nt, Salmonella enterica enterica serovar Typhi
gaaaaucggcggc

SEQ ID NO: 3645816 - RNA, 14 nt, Salmonella enterica enterica serovar Typhi
gaaaaucgucucuc

SEQ ID NO: 3645817 - RNA, 18 nt, Salmonella enterica enterica serovar Typhi
gaaaaucuggcgagagca

SEQ ID NO: 3645818 - RNA, 20 nt, Salmonella enterica enterica serovar Typhi
gaaaaugagagacggagaaa

SEQ ID NO: 3645819 - RNA, 23 nt, Salmonella enterica enterica serovar Typhi
gaaaaugccagcgauuauuucau

SEQ ID NO: 3645820 - RNA, 19 nt, Salmonella enterica enterica serovar Typhi
gaaaaugcccgacgcgccg

SEQ ID NO: 3645821 - RNA, 23 nt, Salmonella enterica enterica serovar Typhi
gaaaaugcccgacgcgccgccag

SEQ ID NO: 3645822 - RNA, 14 nt, Salmonella enterica enterica serovar Typhi
gaaaaugcgcuggg

SEQ ID NO: 3645823 - RNA, 19 nt, Salmonella enterica enterica serovar Typhi
gaaaaugcguccagaggau

SEQ ID NO: 3645824 - RNA, 17 nt, Salmonella enterica enterica serovar Typhi
gaaaaugguuuugccca

SEQ ID NO: 3645825 - RNA, 16 nt, Salmonella enterica enterica serovar Typhi
gaaaaugugcaaagag

SEQ ID NO: 3645826 - RNA, 19 nt, Salmonella enterica enterica serovar Typhi
gaaaauuauuuucacgcuc

SEQ ID NO: 3645827 - RNA, 15 nt, Salmonella enterica enterica serovar Typhi
gaaaauuccuggauu

SEQ ID NO: 3645828 - RNA, 17 nt, Salmonella enterica enterica serovar Typhi
gaaaauuccuggauuaa

SEQ ID NO: 3645829 - RNA, 19 nt, Salmonella enterica enterica serovar Typhi
gaaacaacacaaaucgggc

SEQ ID NO: 3645830 - RNA, 15 nt, Salmonella enterica enterica serovar Typhi
gaaacaagcggcggc

SEQ ID NO: 3645831 - RNA, 16 nt, Salmonella enterica enterica serovar Typhi
gaaacaggaaaaacau

SEQ ID NO: 3645832 - RNA, 16 nt, Salmonella enterica enterica serovar Typhi
gaaacaggcugacaaa

SEQ ID NO: 3645833 - RNA, 23 nt, Salmonella enterica enterica serovar Typhi
gaaacaguuggcggacucgcugg

SEQ ID NO: 3645834 - RNA, 13 nt, Salmonella enterica enterica serovar Typhi
gaaacauacuguc

SEQ ID NO: 3645835 - RNA, 14 nt, Salmonella enterica enterica serovar Typhi
gaaacauauauauc

SEQ ID NO: 3645836 - RNA, 19 nt, Salmonella enterica enterica serovar Typhi
gaaaccagauacccuuuau

SEQ ID NO: 3645837 - RNA, 22 nt, Salmonella enterica enterica serovar Typhi
gaaaccagauaucccgccaaac

SEQ ID NO: 3645838 - RNA, 11 nt, Salmonella enterica enterica serovar Typhi
gaaaccagcau

SEQ ID NO: 3645839 - RNA, 22 nt, Salmonella enterica enterica serovar Typhi
gaaaccccaaaucagcaaaaac

SEQ ID NO: 3645840 - RNA, 17 nt, Salmonella enterica enterica serovar Typhi
gaaacccgcucgcccgc

SEQ ID NO: 3645841 - RNA, 19 nt, Salmonella enterica enterica serovar Typhi
gaaaccgagguucaccagc

SEQ ID NO: 3645842 - RNA, 15 nt, Salmonella enterica enterica serovar Typhi
gaaaccgcagaaaaa

SEQ ID NO: 3645843 - RNA, 21 nt, Salmonella enterica enterica serovar Typhi
gaaaccggcgcgccuuccagc

SEQ ID NO: 3645844 - RNA, 21 nt, Salmonella enterica enterica serovar Typhi
gaaaccggcgucuuuugcugc

SEQ ID NO: 3645845 - RNA, 12 nt, Salmonella enterica enterica serovar Typhi
gaaaccuccgca

SEQ ID NO: 3645846 - RNA, 18 nt, Salmonella enterica enterica serovar Typhi
gaaacgacugguaauguc

SEQ ID NO: 3645847 - RNA, 18 nt, Salmonella enterica enterica serovar Typhi
gaaacgcacccgcgcagg

SEQ ID NO: 3645848 - RNA, 20 nt, Salmonella enterica enterica serovar Typhi
gaaacgcauacgcaggacuu

SEQ ID NO: 3645849 - RNA, 19 nt, Salmonella enterica enterica serovar Typhi
gaaacgccgaccacuucaa

SEQ ID NO: 3645850 - RNA, 22 nt, Salmonella enterica enterica serovar Typhi
gaaacgccugaauaaucggcgu

SEQ ID NO: 3645851 - RNA, 17 nt, Salmonella enterica enterica serovar Typhi
gaaacgcggcguagccg

SEQ ID NO: 3645852 - RNA, 18 nt, Salmonella enterica enterica serovar Typhi
gaaacgcuuguggauagu

SEQ ID NO: 3645853 - RNA, 21 nt, Salmonella enterica enterica serovar Typhi
gaaacgguuaaaaacagccag

SEQ ID NO: 3645854 - RNA, 20 nt, Salmonella enterica enterica serovar Typhi
gaaacguucggugaagaaaa

SEQ ID NO: 3645855 - RNA, 18 nt, Salmonella enterica enterica serovar Typhi
gaaacuccagcggcagga

SEQ ID NO: 3645856 - RNA, 22 nt, Salmonella enterica enterica serovar Typhi
gaaacuccuccgggaaaacauc

SEQ ID NO: 3645857 - RNA, 21 nt, Salmonella enterica enterica serovar Typhi
gaaacucgacgggaaucuccg

SEQ ID NO: 3645858 - RNA, 21 nt, Salmonella enterica enterica serovar Typhi
gaaacugaaccaacagcuggg

SEQ ID NO: 3645859 - RNA, 12 nt, Salmonella enterica enterica serovar Typhi
gaaacugauauu

SEQ ID NO: 3645860 - RNA, 15 nt, Salmonella enterica enterica serovar Typhi
gaaacugcugccgca

SEQ ID NO: 3645861 - RNA, 18 nt, Salmonella enterica enterica serovar Typhi
gaaacugcugccgcagca

SEQ ID NO: 3645862 - RNA, 11 nt, Salmonella enterica enterica serovar Typhi
gaaagaaaauu

SEQ ID NO: 3645863 - RNA, 15 nt, Salmonella enterica enterica serovar Typhi
gaaagaaaucaccgu

SEQ ID NO: 3645864 - RNA, 19 nt, Salmonella enterica enterica serovar Typhi
gaaagaaggaugacgacag

SEQ ID NO: 3645865 - RNA, 20 nt, Salmonella enterica enterica serovar Typhi
gaaagagauuagaacgcgua

SEQ ID NO: 3645866 - RNA, 13 nt, Salmonella enterica enterica serovar Typhi
gaaagauaaaaua

SEQ ID NO: 3645867 - RNA, 16 nt, Salmonella enterica enterica serovar Typhi
gaaagauagcaggccc

SEQ ID NO: 3645868 - RNA, 21 nt, Salmonella enterica enterica serovar Typhi
gaaagauuacuucaggcugcc

SEQ ID NO: 3645869 - RNA, 13 nt, Salmonella enterica enterica serovar Typhi
gaaagcacuucuc

SEQ ID NO: 3645870 - RNA, 19 nt, Salmonella enterica enterica serovar Typhi
gaaagccugauggcgcuuc

SEQ ID NO: 3645871 - RNA, 20 nt, Salmonella enterica enterica serovar Typhi
gaaagcgaccuucuccccgu

SEQ ID NO: 3645872 - RNA, 21 nt, Salmonella enterica enterica serovar Typhi
gaaagcuguacuuugccgggg

SEQ ID NO: 3645873 - RNA, 14 nt, Salmonella enterica enterica serovar Typhi
gaaaggaagcgggc

SEQ ID NO: 3645874 - RNA, 15 nt, Salmonella enterica enterica serovar Typhi
gaaaggcuugcagga

SEQ ID NO: 3645875 - RNA, 19 nt, Salmonella enterica enterica serovar Typhi
gaaaggcuugcaggauguc

SEQ ID NO: 3645876 - RNA, 15 nt, Salmonella enterica enterica serovar Typhi
gaaagggacgaugau

SEQ ID NO: 3645877 - RNA, 15 nt, Salmonella enterica enterica serovar Typhi
gaaagguauguacug

SEQ ID NO: 3645878 - RNA, 18 nt, Salmonella enterica enterica serovar Typhi
gaaagguccggcccgcua

SEQ ID NO: 3645879 - RNA, 20 nt, Salmonella enterica enterica serovar Typhi
gaaagucaaaauaaaauuau

SEQ ID NO: 3645880 - RNA, 21 nt, Salmonella enterica enterica serovar Typhi
gaaagucuucccgcaaacugg

SEQ ID NO: 3645881 - RNA, 22 nt, Salmonella enterica enterica serovar Typhi
gaaagugaauccccaggagcau

SEQ ID NO: 3645882 - RNA, 19 nt, Salmonella enterica enterica serovar Typhi
gaaagugggcgcuuuguua

SEQ ID NO: 3645883 - RNA, 23 nt, Salmonella enterica enterica serovar Typhi
gaaaguuacuuuccauauacucu

SEQ ID NO: 3645884 - RNA, 24 nt, Salmonella enterica enterica serovar Typhi
gaaaguuacuuuccauauacucuu

SEQ ID NO: 3645885 - RNA, 14 nt, Salmonella enterica enterica serovar Typhi
gaaaguuucaggau

SEQ ID NO: 3645886 - RNA, 14 nt, Salmonella enterica enterica serovar Typhi
gaaaguuugaagug

SEQ ID NO: 3645887 - RNA, 17 nt, Salmonella enterica enterica serovar Typhi
gaaaguuuucgccacgu

SEQ ID NO: 3645888 - RNA, 21 nt, Salmonella enterica enterica serovar Typhi
gaaauaaaucgauagcgauuu

SEQ ID NO: 3645889 - RNA, 17 nt, Salmonella enterica enterica serovar Typhi
gaaauaacgcacuacca

SEQ ID NO: 3645890 - RNA, 23 nt, Salmonella enterica enterica serovar Typhi
gaaauaacguuacauuuuccaug

SEQ ID NO: 3645891 - RNA, 14 nt, Salmonella enterica enterica serovar Typhi
gaaauaaucuguag

SEQ ID NO: 3645892 - RNA, 23 nt, Salmonella enterica enterica serovar Typhi
gaaauaccaggcggcuuuuucau

SEQ ID NO: 3645893 - RNA, 21 nt, Salmonella enterica enterica serovar Typhi
gaaauaccgguaaucaagccu

SEQ ID NO: 3645894 - RNA, 21 nt, Salmonella enterica enterica serovar Typhi
gaaauaccuaacucuuccgca

SEQ ID NO: 3645895 - RNA, 14 nt, Salmonella enterica enterica serovar Typhi
gaaauacugugccc

SEQ ID NO: 3645896 - RNA, 19 nt, Salmonella enterica enterica serovar Typhi
gaaauagacgagcgaaaaa

SEQ ID NO: 3645897 - RNA, 17 nt, Salmonella enterica enterica serovar Typhi
gaaauagccccgucaug

SEQ ID NO: 3645898 - RNA, 20 nt, Salmonella enterica enterica serovar Typhi
gaaauagcggaacugcguuu

SEQ ID NO: 3645899 - RNA, 18 nt, Salmonella enterica enterica serovar Typhi
gaaauauuauuccgguuc

SEQ ID NO: 3645900 - RNA, 15 nt, Salmonella enterica enterica serovar Typhi
gaaauauucucagcc

SEQ ID NO: 3645901 - RNA, 15 nt, Salmonella enterica enterica serovar Typhi
gaaauauuucacguu

SEQ ID NO: 3645902 - RNA, 13 nt, Salmonella enterica enterica serovar Typhi
gaaauauuugauc

SEQ ID NO: 3645903 - RNA, 19 nt, Salmonella enterica enterica serovar Typhi
gaaaucaaaaggcgacaca

SEQ ID NO: 3645904 - RNA, 23 nt, Salmonella enterica enterica serovar Typhi
gaaaucacaaacaccaccaguaa

SEQ ID NO: 3645905 - RNA, 22 nt, Salmonella enterica enterica serovar Typhi
gaaaucacgcucaucggcggca

SEQ ID NO: 3645906 - RNA, 19 nt, Salmonella enterica enterica serovar Typhi
gaaaucagagacaaauaca

SEQ ID NO: 3645907 - RNA, 13 nt, Salmonella enterica enterica serovar Typhi
gaaaucagcaggu

SEQ ID NO: 3645908 - RNA, 16 nt, Salmonella enterica enterica serovar Typhi
gaaaucaucaaucgcu

SEQ ID NO: 3645909 - RNA, 20 nt, Salmonella enterica enterica serovar Typhi
gaaaucaucaauggcgauuu

SEQ ID NO: 3645910 - RNA, 23 nt, Salmonella enterica enterica serovar Typhi
gaaauccaccagcggacggcuaa

SEQ ID NO: 3645911 - RNA, 14 nt, Salmonella enterica enterica serovar Typhi
gaaauccagcagaa

SEQ ID NO: 3645912 - RNA, 23 nt, Salmonella enterica enterica serovar Typhi
gaaauccgcgaauaccuucccgc

SEQ ID NO: 3645913 - RNA, 17 nt, Salmonella enterica enterica serovar Typhi
gaaauccgcgucccagc

SEQ ID NO: 3645914 - RNA, 17 nt, Salmonella enterica enterica serovar Typhi
gaaauccucuauuuuuu

SEQ ID NO: 3645915 - RNA, 23 nt, Salmonella enterica enterica serovar Typhi
gaaauccuggauacguuccagca

SEQ ID NO: 3645916 - RNA, 21 nt, Salmonella enterica enterica serovar Typhi
gaaaucgccgggcuauccggc

SEQ ID NO: 3645917 - RNA, 19 nt, Salmonella enterica enterica serovar Typhi
gaaaucgccucauucgggc

SEQ ID NO: 3645918 - RNA, 18 nt, Salmonella enterica enterica serovar Typhi
gaaaucgguacgcgucug

SEQ ID NO: 3645919 - RNA, 22 nt, Salmonella enterica enterica serovar Typhi
gaaaucgucagacggcuccagc

SEQ ID NO: 3645920 - RNA, 18 nt, Salmonella enterica enterica serovar Typhi
gaaaucgugcgccccagg

SEQ ID NO: 3645921 - RNA, 17 nt, Salmonella enterica enterica serovar Typhi
gaaaucucccuggcagu

SEQ ID NO: 3645922 - RNA, 17 nt, Salmonella enterica enterica serovar Typhi
gaaaucugaaugguucc

SEQ ID NO: 3645923 - RNA, 23 nt, Salmonella enterica enterica serovar Typhi
gaaaucugcacguaccugcucca

SEQ ID NO: 3645924 - RNA, 20 nt, Salmonella enterica enterica serovar Typhi
gaaaucuguuccagcgagca

SEQ ID NO: 3645925 - RNA, 19 nt, Salmonella enterica enterica serovar Typhi
gaaaucuuucuccugguuu

SEQ ID NO: 3645926 - RNA, 14 nt, Salmonella enterica enterica serovar Typhi
gaaaugaaaacucg

SEQ ID NO: 3645927 - RNA, 15 nt, Salmonella enterica enterica serovar Typhi
gaaaugagaaaagga

SEQ ID NO: 3645928 - RNA, 20 nt, Salmonella enterica enterica serovar Typhi
gaaaugcaggcguuuuauug

SEQ ID NO: 3645929 - RNA, 19 nt, Salmonella enterica enterica serovar Typhi
gaaaugcagggauccugua

SEQ ID NO: 3645930 - RNA, 20 nt, Salmonella enterica enterica serovar Typhi
gaaaugcccauaaagaaaua

SEQ ID NO: 3645931 - RNA, 24 nt, Salmonella enterica enterica serovar Typhi
gaaaugcccgauagugcaagcuca

SEQ ID NO: 3645932 - RNA, 17 nt, Salmonella enterica enterica serovar Typhi
gaaaugccuuauccggc

SEQ ID NO: 3645933 - RNA, 18 nt, Salmonella enterica enterica serovar Typhi
gaaaugccuuauccggcc

SEQ ID NO: 3645934 - RNA, 12 nt, Salmonella enterica enterica serovar Typhi
gaaaugcgaauc

SEQ ID NO: 3645935 - RNA, 17 nt, Salmonella enterica enterica serovar Typhi
gaaaugcgaauccggcg

SEQ ID NO: 3645936 - RNA, 19 nt, Salmonella enterica enterica serovar Typhi
gaaaugcgaauccggcggc

SEQ ID NO: 3645937 - RNA, 17 nt, Salmonella enterica enterica serovar Typhi
gaaaugcgacaucucag

SEQ ID NO: 3645938 - RNA, 15 nt, Salmonella enterica enterica serovar Typhi
gaaauguauucuccc

SEQ ID NO: 3645939 - RNA, 17 nt, Salmonella enterica enterica serovar Typhi
gaaaugucuggcgcuaa

SEQ ID NO: 3645940 - RNA, 12 nt, Salmonella enterica enterica serovar Typhi
gaaauuauccac

SEQ ID NO: 3645941 - RNA, 17 nt, Salmonella enterica enterica serovar Typhi
gaaauuauccacaaacu

SEQ ID NO: 3645942 - RNA, 16 nt, Salmonella enterica enterica serovar Typhi
gaaauuccuuccggcg

SEQ ID NO: 3645943 - RNA, 14 nt, Salmonella enterica enterica serovar Typhi
gaaauucucagaaa

SEQ ID NO: 3645944 - RNA, 17 nt, Salmonella enterica enterica serovar Typhi
gaaauucucagaaacaa

SEQ ID NO: 3645945 - RNA, 16 nt, Salmonella enterica enterica serovar Typhi
gaaauugaauuauaau

SEQ ID NO: 3645946 - RNA, 13 nt, Salmonella enterica enterica serovar Typhi
gaaauugcagggu

SEQ ID NO: 3645947 - RNA, 18 nt, Salmonella enterica enterica serovar Typhi
gaaauugcagggugcagc

SEQ ID NO: 3645948 - RNA, 21 nt, Salmonella enterica enterica serovar Typhi
gaaauuuaaagauagcugcuu

SEQ ID NO: 3645949 - RNA, 22 nt, Salmonella enterica enterica serovar Typhi
gaaauuuaggucaaaaaagcga

SEQ ID NO: 3645950 - RNA, 13 nt, Salmonella enterica enterica serovar Typhi
gaaauuugcagcg

SEQ ID NO: 3645951 - RNA, 20 nt, Salmonella enterica enterica serovar Typhi
gaacaaaagaaagcaauagc

SEQ ID NO: 3645952 - RNA, 21 nt, Salmonella enterica enterica serovar Typhi
gaacaaagccccgggcgcugg

SEQ ID NO: 3645953 - RNA, 20 nt, Salmonella enterica enterica serovar Typhi
gaacaacgagauucaauaau

SEQ ID NO: 3645954 - RNA, 19 nt, Salmonella enterica enterica serovar Typhi
gaacaauagacgcuacugu

SEQ ID NO: 3645955 - RNA, 18 nt, Salmonella enterica enterica serovar Typhi
gaacacagcaugaauaac

SEQ ID NO: 3645956 - RNA, 14 nt, Salmonella enterica enterica serovar Typhi
gaacaccagcgccg

SEQ ID NO: 3645957 - RNA, 16 nt, Salmonella enterica enterica serovar Typhi
gaacaccucauauuug

SEQ ID NO: 3645958 - RNA, 14 nt, Salmonella enterica enterica serovar Typhi
gaacacuaaaacac

SEQ ID NO: 3645959 - RNA, 16 nt, Salmonella enterica enterica serovar Typhi
gaacacucuaaaucua

SEQ ID NO: 3645960 - RNA, 17 nt, Salmonella enterica enterica serovar Typhi
gaacacucuaaaucuac

SEQ ID NO: 3645961 - RNA, 16 nt, Salmonella enterica enterica serovar Typhi
gaacagaaaaaaugca

SEQ ID NO: 3645962 - RNA, 21 nt, Salmonella enterica enterica serovar Typhi
gaacagaaaaaaugcaccgcc

SEQ ID NO: 3645963 - RNA, 15 nt, Salmonella enterica enterica serovar Typhi
gaacagacggcggcu

SEQ ID NO: 3645964 - RNA, 19 nt, Salmonella enterica enterica serovar Typhi
gaacagcacguuaccggcg

SEQ ID NO: 3645965 - RNA, 18 nt, Salmonella enterica enterica serovar Typhi
gaacagccccaccgccag

SEQ ID NO: 3645966 - RNA, 17 nt, Salmonella enterica enterica serovar Typhi
gaacagcgucauccagu

SEQ ID NO: 3645967 - RNA, 17 nt, Salmonella enterica enterica serovar Typhi
gaacagcgucgccaaua

SEQ ID NO: 3645968 - RNA, 13 nt, Salmonella enterica enterica serovar Typhi
gaacaggcagcgu

SEQ ID NO: 3645969 - RNA, 18 nt, Salmonella enterica enterica serovar Typhi
gaacaggccaaacccugc

SEQ ID NO: 3645970 - RNA, 19 nt, Salmonella enterica enterica serovar Typhi
gaacaggccaaacccugcg

SEQ ID NO: 3645971 - RNA, 17 nt, Salmonella enterica enterica serovar Typhi
gaacaggcucagcgcca

SEQ ID NO: 3645972 - RNA, 15 nt, Salmonella enterica enterica serovar Typhi
gaacaggcuggcgac

SEQ ID NO: 3645973 - RNA, 18 nt, Salmonella enterica enterica serovar Typhi
gaacaggcuucccaauac

SEQ ID NO: 3645974 - RNA, 18 nt, Salmonella enterica enterica serovar Typhi
gaacaggcuuuucaggcu

SEQ ID NO: 3645975 - RNA, 15 nt, Salmonella enterica enterica serovar Typhi
gaacagggcgggcga

SEQ ID NO: 3645976 - RNA, 21 nt, Salmonella enterica enterica serovar Typhi
gaacagggcgggcgauagaga

SEQ ID NO: 3645977 - RNA, 22 nt, Salmonella enterica enterica serovar Typhi
gaacagucccaccagcgcggca

SEQ ID NO: 3645978 - RNA, 13 nt, Salmonella enterica enterica serovar Typhi
gaacaguuucgcc

SEQ ID NO: 3645979 - RNA, 14 nt, Salmonella enterica enterica serovar Typhi
gaacaguuucucgc

SEQ ID NO: 3645980 - RNA, 17 nt, Salmonella enterica enterica serovar Typhi
gaacauaaaaacgcgcu

SEQ ID NO: 3645981 - RNA, 17 nt, Salmonella enterica enterica serovar Typhi
gaacauaacgggaauaa

SEQ ID NO: 3645982 - RNA, 22 nt, Salmonella enterica enterica serovar Typhi
gaacauaccggagccugggauu

SEQ ID NO: 3645983 - RNA, 20 nt, Salmonella enterica enterica serovar Typhi
gaacauacguuuaaagcgcu

SEQ ID NO: 3645984 - RNA, 18 nt, Salmonella enterica enterica serovar Typhi
gaacaucaagcgguagcg

SEQ ID NO: 3645985 - RNA, 17 nt, Salmonella enterica enterica serovar Typhi
gaacaucacgaugaaag

SEQ ID NO: 3645986 - RNA, 13 nt, Salmonella enterica enterica serovar Typhi
gaacaucagccag

SEQ ID NO: 3645987 - RNA, 15 nt, Salmonella enterica enterica serovar Typhi
gaacaucagccagca

SEQ ID NO: 3645988 - RNA, 18 nt, Salmonella enterica enterica serovar Typhi
gaacaucagccagcagcu

SEQ ID NO: 3645989 - RNA, 20 nt, Salmonella enterica enterica serovar Typhi
gaacaucagccagcagcuca

SEQ ID NO: 3645990 - RNA, 23 nt, Salmonella enterica enterica serovar Typhi
gaacaucgacauucgauguuacu

SEQ ID NO: 3645991 - RNA, 16 nt, Salmonella enterica enterica serovar Typhi
gaacaucgacccccac

SEQ ID NO: 3645992 - RNA, 19 nt, Salmonella enterica enterica serovar Typhi
gaacaucgguuuguucaua

SEQ ID NO: 3645993 - RNA, 18 nt, Salmonella enterica enterica serovar Typhi
gaacaucguguccugggu

SEQ ID NO: 3645994 - RNA, 21 nt, Salmonella enterica enterica serovar Typhi
gaacaugacgccgaaauaaau

SEQ ID NO: 3645995 - RNA, 17 nt, Salmonella enterica enterica serovar Typhi
gaacaugccgacggaga

SEQ ID NO: 3645996 - RNA, 14 nt, Salmonella enterica enterica serovar Typhi
gaacauuacauccu

SEQ ID NO: 3645997 - RNA, 19 nt, Salmonella enterica enterica serovar Typhi
gaacauugccccucccuga

SEQ ID NO: 3645998 - RNA, 22 nt, Salmonella enterica enterica serovar Typhi
gaacauugccccucccugaauc

SEQ ID NO: 3645999 - RNA, 18 nt, Salmonella enterica enterica serovar Typhi
gaacauuggaauauccgc

SEQ ID NO: 3646000 - RNA, 14 nt, Salmonella enterica enterica serovar Typhi
gaacauuuaagauu

SEQ ID NO: 3646001 - RNA, 16 nt, Salmonella enterica enterica serovar Typhi
gaacauuucaucuauc

SEQ ID NO: 3646002 - RNA, 15 nt, Salmonella enterica enterica serovar Typhi
gaaccaacagcuggg

SEQ ID NO: 3646003 - RNA, 21 nt, Salmonella enterica enterica serovar Typhi
gaaccaacgcauaaaaacgug

SEQ ID NO: 3646004 - RNA, 18 nt, Salmonella enterica enterica serovar Typhi
gaaccaacugccaaacca

SEQ ID NO: 3646005 - RNA, 21 nt, Salmonella enterica enterica serovar Typhi
gaaccaauaguauggagcagg

SEQ ID NO: 3646006 - RNA, 15 nt, Salmonella enterica enterica serovar Typhi
gaaccagcaucccac

SEQ ID NO: 3646007 - RNA, 13 nt, Salmonella enterica enterica serovar Typhi
gaaccauaauaaa

SEQ ID NO: 3646008 - RNA, 16 nt, Salmonella enterica enterica serovar Typhi
gaaccaucauuaauau

SEQ ID NO: 3646009 - RNA, 22 nt, Salmonella enterica enterica serovar Typhi
gaaccaucauuaauauaauccu

SEQ ID NO: 3646010 - RNA, 12 nt, Salmonella enterica enterica serovar Typhi
gaaccaucggca

SEQ ID NO: 3646011 - RNA, 23 nt, Salmonella enterica enterica serovar Typhi
gaaccauuuccucugcggacggc

SEQ ID NO: 3646012 - RNA, 16 nt, Salmonella enterica enterica serovar Typhi
gaaccauuuuccccag

SEQ ID NO: 3646013 - RNA, 20 nt, Salmonella enterica enterica serovar Typhi
gaacccaaagccgucggcgc

SEQ ID NO: 3646014 - RNA, 20 nt, Salmonella enterica enterica serovar Typhi
gaacccaucagggaaaaaug

SEQ ID NO: 3646015 - RNA, 17 nt, Salmonella enterica enterica serovar Typhi
gaaccgaauaacgccag

SEQ ID NO: 3646016 - RNA, 19 nt, Salmonella enterica enterica serovar Typhi
gaaccgaauaacgccaggu

SEQ ID NO: 3646017 - RNA, 20 nt, Salmonella enterica enterica serovar Typhi
gaaccgcccaucaacaccag

SEQ ID NO: 3646018 - RNA, 12 nt, Salmonella enterica enterica serovar Typhi
gaaccggaccag

SEQ ID NO: 3646019 - RNA, 15 nt, Salmonella enterica enterica serovar Typhi
gaaccggcaucggca

SEQ ID NO: 3646020 - RNA, 18 nt, Salmonella enterica enterica serovar Typhi
gaaccguaaacgccugca

SEQ ID NO: 3646021 - RNA, 20 nt, Salmonella enterica enterica serovar Typhi
gaaccguaaacgccugcacc

SEQ ID NO: 3646022 - RNA, 15 nt, Salmonella enterica enterica serovar Typhi
gaaccguggccuccg

SEQ ID NO: 3646023 - RNA, 18 nt, Salmonella enterica enterica serovar Typhi
gaaccguggccuccggca

SEQ ID NO: 3646024 - RNA, 19 nt, Salmonella enterica enterica serovar Typhi
gaaccguucgaguguaucu

SEQ ID NO: 3646025 - RNA, 17 nt, Salmonella enterica enterica serovar Typhi
gaaccguucucaauccg

SEQ ID NO: 3646026 - RNA, 22 nt, Salmonella enterica enterica serovar Typhi
gaaccguugcgcccaucaucau

SEQ ID NO: 3646027 - RNA, 22 nt, Salmonella enterica enterica serovar Typhi
gaaccucaccguccgccaggcc

SEQ ID NO: 3646028 - RNA, 22 nt, Salmonella enterica enterica serovar Typhi
gaaccuggcagaaaggugaaaa

SEQ ID NO: 3646029 - RNA, 19 nt, Salmonella enterica enterica serovar Typhi
gaaccuggcgguaaauacg

SEQ ID NO: 3646030 - RNA, 16 nt, Salmonella enterica enterica serovar Typhi
gaaccuguccugagcg

SEQ ID NO: 3646031 - RNA, 13 nt, Salmonella enterica enterica serovar Typhi
gaaccuuaagcgc

SEQ ID NO: 3646032 - RNA, 15 nt, Salmonella enterica enterica serovar Typhi
gaaccuuacggcuca

SEQ ID NO: 3646033 - RNA, 13 nt, Salmonella enterica enterica serovar Typhi
gaacgacgcugau

SEQ ID NO: 3646034 - RNA, 20 nt, Salmonella enterica enterica serovar Typhi
gaacgcacgcagccaacgcc

SEQ ID NO: 3646035 - RNA, 12 nt, Salmonella enterica enterica serovar Typhi
gaacgccaggcc

SEQ ID NO: 3646036 - RNA, 17 nt, Salmonella enterica enterica serovar Typhi
gaacgccgcuagcggcg

SEQ ID NO: 3646037 - RNA, 20 nt, Salmonella enterica enterica serovar Typhi
gaacgccgcuagcggcggcc

SEQ ID NO: 3646038 - RNA, 20 nt, Salmonella enterica enterica serovar Typhi
gaacgcggcgccgaagcagg

SEQ ID NO: 3646039 - RNA, 18 nt, Salmonella enterica enterica serovar Typhi
gaacgcuggcacuuuccg

SEQ ID NO: 3646040 - RNA, 18 nt, Salmonella enterica enterica serovar Typhi
gaacgcugguuucggcau

SEQ ID NO: 3646041 - RNA, 15 nt, Salmonella enterica enterica serovar Typhi
gaacgcuuccgggcu

SEQ ID NO: 3646042 - RNA, 19 nt, Salmonella enterica enterica serovar Typhi
gaacggaucaugguugaaa

SEQ ID NO: 3646043 - RNA, 15 nt, Salmonella enterica enterica serovar Typhi
gaacggcauaaucug

SEQ ID NO: 3646044 - RNA, 18 nt, Salmonella enterica enterica serovar Typhi
gaacggcuaggguggcgc

SEQ ID NO: 3646045 - RNA, 21 nt, Salmonella enterica enterica serovar Typhi
gaacggcuuuccagcagccag

SEQ ID NO: 3646046 - RNA, 23 nt, Salmonella enterica enterica serovar Typhi
gaacggcuuuccagcagccagaa

SEQ ID NO: 3646047 - RNA, 21 nt, Salmonella enterica enterica serovar Typhi
gaacggggaccaugauaucgc

SEQ ID NO: 3646048 - RNA, 22 nt, Salmonella enterica enterica serovar Typhi
gaacggguaaaugcgcgcggcu

SEQ ID NO: 3646049 - RNA, 20 nt, Salmonella enterica enterica serovar Typhi
gaacgguucauccagcagca

SEQ ID NO: 3646050 - RNA, 22 nt, Salmonella enterica enterica serovar Typhi
gaacguccagcggccaguguac

SEQ ID NO: 3646051 - RNA, 17 nt, Salmonella enterica enterica serovar Typhi
gaacguucaaaaucaaa

SEQ ID NO: 3646052 - RNA, 22 nt, Salmonella enterica enterica serovar Typhi
gaacucagcuaaaaacagcgca

SEQ ID NO: 3646053 - RNA, 13 nt, Salmonella enterica enterica serovar Typhi
gaacuccagcgcg

SEQ ID NO: 3646054 - RNA, 20 nt, Salmonella enterica enterica serovar Typhi
gaacucggucaggguaauag

SEQ ID NO: 3646055 - RNA, 17 nt, Salmonella enterica enterica serovar Typhi
gaacucgucuuauccga

SEQ ID NO: 3646056 - RNA, 13 nt, Salmonella enterica enterica serovar Typhi
gaacucuuucaga

SEQ ID NO: 3646057 - RNA, 15 nt, Salmonella enterica enterica serovar Typhi
gaacucuuucagacc

SEQ ID NO: 3646058 - RNA, 22 nt, Salmonella enterica enterica serovar Typhi
gaacugauggcgcuaagccagc

SEQ ID NO: 3646059 - RNA, 17 nt, Salmonella enterica enterica serovar Typhi
gaacugauguuccggca

SEQ ID NO: 3646060 - RNA, 18 nt, Salmonella enterica enterica serovar Typhi
gaacugauguuccggcac

SEQ ID NO: 3646061 - RNA, 20 nt, Salmonella enterica enterica serovar Typhi
gaacugauguugggcaugga

SEQ ID NO: 3646062 - RNA, 22 nt, Salmonella enterica enterica serovar Typhi
gaacugauuuguaggccugaua

SEQ ID NO: 3646063 - RNA, 11 nt, Salmonella enterica enterica serovar Typhi
gaacugcagcg

SEQ ID NO: 3646064 - RNA, 19 nt, Salmonella enterica enterica serovar Typhi
gaacugcagcgcgucgacc

SEQ ID NO: 3646065 - RNA, 22 nt, Salmonella enterica enterica serovar Typhi
gaacugcgaaaucaccgacagg

SEQ ID NO: 3646066 - RNA, 14 nt, Salmonella enterica enterica serovar Typhi
gaacuggugaaaca

SEQ ID NO: 3646067 - RNA, 14 nt, Salmonella enterica enterica serovar Typhi
gaacuguucagcca

SEQ ID NO: 3646068 - RNA, 16 nt, Salmonella enterica enterica serovar Typhi
gaacuguucagccagc

SEQ ID NO: 3646069 - RNA, 17 nt, Salmonella enterica enterica serovar Typhi
gaacuguucagccagca

SEQ ID NO: 3646070 - RNA, 14 nt, Salmonella enterica enterica serovar Typhi
gaacuuaaauuaau

SEQ ID NO: 3646071 - RNA, 17 nt, Salmonella enterica enterica serovar Typhi
gaacuuaggauaauucc

SEQ ID NO: 3646072 - RNA, 17 nt, Salmonella enterica enterica serovar Typhi
gaacuuccgccaccacc

SEQ ID NO: 3646073 - RNA, 17 nt, Salmonella enterica enterica serovar Typhi
gaacuuguaaaaaugcc

SEQ ID NO: 3646074 - RNA, 18 nt, Salmonella enterica enterica serovar Typhi
gaagaacacgccgccuau

SEQ ID NO: 3646075 - RNA, 14 nt, Salmonella enterica enterica serovar Typhi
gaagaacagcgucg

SEQ ID NO: 3646076 - RNA, 22 nt, Salmonella enterica enterica serovar Typhi
gaagaauccagggaugaacagc

SEQ ID NO: 3646077 - RNA, 16 nt, Salmonella enterica enterica serovar Typhi
gaagaccguuuaaacg

SEQ ID NO: 3646078 - RNA, 14 nt, Salmonella enterica enterica serovar Typhi
gaagaccuuauccc

SEQ ID NO: 3646079 - RNA, 19 nt, Salmonella enterica enterica serovar Typhi
gaagacguuuacaccgcca

SEQ ID NO: 3646080 - RNA, 15 nt, Salmonella enterica enterica serovar Typhi
gaagagacacgcuga

SEQ ID NO: 3646081 - RNA, 18 nt, Salmonella enterica enterica serovar Typhi
gaagagcucgaccaacau

SEQ ID NO: 3646082 - RNA, 19 nt, Salmonella enterica enterica serovar Typhi
gaagagcucgaccaacaua

SEQ ID NO: 3646083 - RNA, 16 nt, Salmonella enterica enterica serovar Typhi
gaagagugaauaacaa

SEQ ID NO: 3646084 - RNA, 21 nt, Salmonella enterica enterica serovar Typhi
gaagaguuaacuucuccgcca

SEQ ID NO: 3646085 - RNA, 14 nt, Salmonella enterica enterica serovar Typhi
gaagauaagaaaaa

SEQ ID NO: 3646086 - RNA, 20 nt, Salmonella enterica enterica serovar Typhi
gaagauagcgggcaaugcca

SEQ ID NO: 3646087 - RNA, 17 nt, Salmonella enterica enterica serovar Typhi
gaagaucgggagaaggc

SEQ ID NO: 3646088 - RNA, 20 nt, Salmonella enterica enterica serovar Typhi
gaagaucguuauccagcagc

SEQ ID NO: 3646089 - RNA, 14 nt, Salmonella enterica enterica serovar Typhi
gaagauuagcagag

SEQ ID NO: 3646090 - RNA, 17 nt, Salmonella enterica enterica serovar Typhi
gaagauuuuuauucccg

SEQ ID NO: 3646091 - RNA, 20 nt, Salmonella enterica enterica serovar Typhi
gaagccacaaucugauaauc

SEQ ID NO: 3646092 - RNA, 21 nt, Salmonella enterica enterica serovar Typhi
gaagccaccggauugccuucu

SEQ ID NO: 3646093 - RNA, 13 nt, Salmonella enterica enterica serovar Typhi
gaagccagugccc

SEQ ID NO: 3646094 - RNA, 21 nt, Salmonella enterica enterica serovar Typhi
gaagccauccucacgcaacca

SEQ ID NO: 3646095 - RNA, 12 nt, Salmonella enterica enterica serovar Typhi
gaagcccaacua

SEQ ID NO: 3646096 - RNA, 18 nt, Salmonella enterica enterica serovar Typhi
gaagcccaugauggugaa

SEQ ID NO: 3646097 - RNA, 22 nt, Salmonella enterica enterica serovar Typhi
gaagcccaugauggugaacaga

SEQ ID NO: 3646098 - RNA, 20 nt, Salmonella enterica enterica serovar Typhi
gaagcccggccacagcgcca

SEQ ID NO: 3646099 - RNA, 14 nt, Salmonella enterica enterica serovar Typhi
gaagccuuucuguu

SEQ ID NO: 3646100 - RNA, 19 nt, Salmonella enterica enterica serovar Typhi
gaagcgaccggcgucauca

SEQ ID NO: 3646101 - RNA, 21 nt, Salmonella enterica enterica serovar Typhi
gaagcgauuuauccaccgcca

SEQ ID NO: 3646102 - RNA, 14 nt, Salmonella enterica enterica serovar Typhi
gaagcgcaguguua

SEQ ID NO: 3646103 - RNA, 14 nt, Salmonella enterica enterica serovar Typhi
gaagcgcguguauu

SEQ ID NO: 3646104 - RNA, 18 nt, Salmonella enterica enterica serovar Typhi
gaagcgcguucgucccac

SEQ ID NO: 3646105 - RNA, 14 nt, Salmonella enterica enterica serovar Typhi
gaagcggacgggcg

SEQ ID NO: 3646106 - RNA, 16 nt, Salmonella enterica enterica serovar Typhi
gaagcgguaaaaccgg

SEQ ID NO: 3646107 - RNA, 18 nt, Salmonella enterica enterica serovar Typhi
gaagcguuucucuugugc

SEQ ID NO: 3646108 - RNA, 14 nt, Salmonella enterica enterica serovar Typhi
gaagcugaccaggg

SEQ ID NO: 3646109 - RNA, 21 nt, Salmonella enterica enterica serovar Typhi
gaagcugaccagggcaaauua

SEQ ID NO: 3646110 - RNA, 20 nt, Salmonella enterica enterica serovar Typhi
gaagcugcagggauaugcug

SEQ ID NO: 3646111 - RNA, 22 nt, Salmonella enterica enterica serovar Typhi
gaagcugcagggauaugcugau

SEQ ID NO: 3646112 - RNA, 17 nt, Salmonella enterica enterica serovar Typhi
gaagcugccgucccagc

SEQ ID NO: 3646113 - RNA, 16 nt, Salmonella enterica enterica serovar Typhi
gaaggaagggcgcugc

SEQ ID NO: 3646114 - RNA, 14 nt, Salmonella enterica enterica serovar Typhi
gaaggagaaaacgg

SEQ ID NO: 3646115 - RNA, 20 nt, Salmonella enterica enterica serovar Typhi
gaaggagcaaugagauccac

SEQ ID NO: 3646116 - RNA, 21 nt, Salmonella enterica enterica serovar Typhi
gaaggagcaaugagauccacu

SEQ ID NO: 3646117 - RNA, 16 nt, Salmonella enterica enterica serovar Typhi
gaaggcaacugauccu

SEQ ID NO: 3646118 - RNA, 17 nt, Salmonella enterica enterica serovar Typhi
gaaggcaggcuggguuu

SEQ ID NO: 3646119 - RNA, 13 nt, Salmonella enterica enterica serovar Typhi
gaaggcaucuuca

SEQ ID NO: 3646120 - RNA, 14 nt, Salmonella enterica enterica serovar Typhi
gaaggcgugcagcg

SEQ ID NO: 3646121 - RNA, 15 nt, Salmonella enterica enterica serovar Typhi
gaaggcgugcagcgu

SEQ ID NO: 3646122 - RNA, 16 nt, Salmonella enterica enterica serovar Typhi
gaaggcuaacagcugg

SEQ ID NO: 3646123 - RNA, 14 nt, Salmonella enterica enterica serovar Typhi
gaaggcuccggcac

SEQ ID NO: 3646124 - RNA, 16 nt, Salmonella enterica enterica serovar Typhi
gaaggcuuugccauac

SEQ ID NO: 3646125 - RNA, 17 nt, Salmonella enterica enterica serovar Typhi
gaagggcaauaucauga

SEQ ID NO: 3646126 - RNA, 14 nt, Salmonella enterica enterica serovar Typhi
gaagggcaggggaa

SEQ ID NO: 3646127 - RNA, 19 nt, Salmonella enterica enterica serovar Typhi
gaaggggcgggcagcagca

SEQ ID NO: 3646128 - RNA, 20 nt, Salmonella enterica enterica serovar Typhi
gaaggucaggccacugcccu

SEQ ID NO: 3646129 - RNA, 21 nt, Salmonella enterica enterica serovar Typhi
gaaggucaggccacugcccug

SEQ ID NO: 3646130 - RNA, 15 nt, Salmonella enterica enterica serovar Typhi
gaaggucugacaacu

SEQ ID NO: 3646131 - RNA, 22 nt, Salmonella enterica enterica serovar Typhi
gaagguucgauucgagcgcagc

SEQ ID NO: 3646132 - RNA, 20 nt, Salmonella enterica enterica serovar Typhi
gaagguuucgauagcaggca

SEQ ID NO: 3646133 - RNA, 12 nt, Salmonella enterica enterica serovar Typhi
gaaguaaaaaaa

SEQ ID NO: 3646134 - RNA, 12 nt, Salmonella enterica enterica serovar Typhi
gaaguaaggcau

SEQ ID NO: 3646135 - RNA, 21 nt, Salmonella enterica enterica serovar Typhi
gaaguagcagagaaaagguug

SEQ ID NO: 3646136 - RNA, 15 nt, Salmonella enterica enterica serovar Typhi
gaagucauucgcagc

SEQ ID NO: 3646137 - RNA, 17 nt, Salmonella enterica enterica serovar Typhi
gaagucgaaauuuucuu

SEQ ID NO: 3646138 - RNA, 18 nt, Salmonella enterica enterica serovar Typhi
gaagugauccuucaacgu

SEQ ID NO: 3646139 - RNA, 20 nt, Salmonella enterica enterica serovar Typhi
gaagugauccuucaacgucu

SEQ ID NO: 3646140 - RNA, 19 nt, Salmonella enterica enterica serovar Typhi
gaagugcagcguuuccagc

SEQ ID NO: 3646141 - RNA, 14 nt, Salmonella enterica enterica serovar Typhi
gaagugccagguuu

SEQ ID NO: 3646142 - RNA, 15 nt, Salmonella enterica enterica serovar Typhi
gaagugccaguaacu

SEQ ID NO: 3646143 - RNA, 23 nt, Salmonella enterica enterica serovar Typhi
gaagugccaguaacucaucgcca

SEQ ID NO: 3646144 - RNA, 20 nt, Salmonella enterica enterica serovar Typhi
gaaguggugggugaugacgg

SEQ ID NO: 3646145 - RNA, 19 nt, Salmonella enterica enterica serovar Typhi
gaaguuuaauucuuugagc

SEQ ID NO: 3646146 - RNA, 11 nt, Salmonella enterica enterica serovar Typhi
gaauaaacaca

SEQ ID NO: 3646147 - RNA, 13 nt, Salmonella enterica enterica serovar Typhi
gaauaaacucccg

SEQ ID NO: 3646148 - RNA, 17 nt, Salmonella enterica enterica serovar Typhi
gaauaaaggauuguacu

SEQ ID NO: 3646149 - RNA, 22 nt, Salmonella enterica enterica serovar Typhi
gaauaaaggauuguacuuauua

SEQ ID NO: 3646150 - RNA, 16 nt, Salmonella enterica enterica serovar Typhi
gaauaaagguggugcg

SEQ ID NO: 3646151 - RNA, 16 nt, Salmonella enterica enterica serovar Typhi
gaauaacaucuuccau

SEQ ID NO: 3646152 - RNA, 16 nt, Salmonella enterica enterica serovar Typhi
gaauaaccacugaugg

SEQ ID NO: 3646153 - RNA, 20 nt, Salmonella enterica enterica serovar Typhi
gaauaaccacugauggcugg

SEQ ID NO: 3646154 - RNA, 14 nt, Salmonella enterica enterica serovar Typhi
gaauaaccaucgga

SEQ ID NO: 3646155 - RNA, 15 nt, Salmonella enterica enterica serovar Typhi
gaauaacccgcagcc

SEQ ID NO: 3646156 - RNA, 13 nt, Salmonella enterica enterica serovar Typhi
gaauaaccucccg

SEQ ID NO: 3646157 - RNA, 19 nt, Salmonella enterica enterica serovar Typhi
gaauaagggugagagggga

SEQ ID NO: 3646158 - RNA, 19 nt, Salmonella enterica enterica serovar Typhi
gaauaauaauacaccgcca

SEQ ID NO: 3646159 - RNA, 17 nt, Salmonella enterica enterica serovar Typhi
gaauaaugaccagcgcc

SEQ ID NO: 3646160 - RNA, 21 nt, Salmonella enterica enterica serovar Typhi
gaauaauguugguauauucga

SEQ ID NO: 3646161 - RNA, 18 nt, Salmonella enterica enterica serovar Typhi
gaauacaccgccuagcgu

SEQ ID NO: 3646162 - RNA, 12 nt, Salmonella enterica enterica serovar Typhi
gaauaccacauc

SEQ ID NO: 3646163 - RNA, 23 nt, Salmonella enterica enterica serovar Typhi
gaauaccacuucggcagaaaaag

SEQ ID NO: 3646164 - RNA, 20 nt, Salmonella enterica enterica serovar Typhi
gaauaccagaaucaccgaca

SEQ ID NO: 3646165 - RNA, 23 nt, Salmonella enterica enterica serovar Typhi
gaauaccagaaucaccgacagca

SEQ ID NO: 3646166 - RNA, 15 nt, Salmonella enterica enterica serovar Typhi
gaauacccaacugua

SEQ ID NO: 3646167 - RNA, 15 nt, Salmonella enterica enterica serovar Typhi
gaauaccugaaagag

SEQ ID NO: 3646168 - RNA, 21 nt, Salmonella enterica enterica serovar Typhi
gaauacgcuccagcuggcugg

SEQ ID NO: 3646169 - RNA, 22 nt, Salmonella enterica enterica serovar Typhi
gaauacgcuccagcuggcuggc

SEQ ID NO: 3646170 - RNA, 19 nt, Salmonella enterica enterica serovar Typhi
gaauacgguccguuuucgc

SEQ ID NO: 3646171 - RNA, 22 nt, Salmonella enterica enterica serovar Typhi
gaauagacggccugcaaacgaa

SEQ ID NO: 3646172 - RNA, 15 nt, Salmonella enterica enterica serovar Typhi
gaauagacuggcgcc

SEQ ID NO: 3646173 - RNA, 16 nt, Salmonella enterica enterica serovar Typhi
gaauagaggcgcuggc

SEQ ID NO: 3646174 - RNA, 19 nt, Salmonella enterica enterica serovar Typhi
gaauagaguaauacaucca

SEQ ID NO: 3646175 - RNA, 20 nt, Salmonella enterica enterica serovar Typhi
gaauagccagcccccugcca

SEQ ID NO: 3646176 - RNA, 19 nt, Salmonella enterica enterica serovar Typhi
gaauagccugggcaaggcu

SEQ ID NO: 3646177 - RNA, 17 nt, Salmonella enterica enterica serovar Typhi
gaauagcgaacagucca

SEQ ID NO: 3646178 - RNA, 15 nt, Salmonella enterica enterica serovar Typhi
gaauagcgccagggu

SEQ ID NO: 3646179 - RNA, 22 nt, Salmonella enterica enterica serovar Typhi
gaauagcguauuuuuguacuuu

SEQ ID NO: 3646180 - RNA, 19 nt, Salmonella enterica enterica serovar Typhi
gaauaggccgccaaugaca

SEQ ID NO: 3646181 - RNA, 20 nt, Salmonella enterica enterica serovar Typhi
gaauaguggcgcgccagcga

SEQ ID NO: 3646182 - RNA, 15 nt, Salmonella enterica enterica serovar Typhi
gaauaguuuugccca

SEQ ID NO: 3646183 - RNA, 17 nt, Salmonella enterica enterica serovar Typhi
gaauauaacgacagccu

SEQ ID NO: 3646184 - RNA, 13 nt, Salmonella enterica enterica serovar Typhi
gaauauaccauca

SEQ ID NO: 3646185 - RNA, 18 nt, Salmonella enterica enterica serovar Typhi
gaauaucggcgucaacgu

SEQ ID NO: 3646186 - RNA, 15 nt, Salmonella enterica enterica serovar Typhi
gaauaugauuuaaaa

SEQ ID NO: 3646187 - RNA, 21 nt, Salmonella enterica enterica serovar Typhi
gaauauugacaguaauaaugu

SEQ ID NO: 3646188 - RNA, 19 nt, Salmonella enterica enterica serovar Typhi
gaauauugcgccacgcugu

SEQ ID NO: 3646189 - RNA, 15 nt, Salmonella enterica enterica serovar Typhi
gaaucaccgacagca

SEQ ID NO: 3646190 - RNA, 17 nt, Salmonella enterica enterica serovar Typhi
gaaucacuuacuaaggu

SEQ ID NO: 3646191 - RNA, 14 nt, Salmonella enterica enterica serovar Typhi
gaaucagaugcuca

SEQ ID NO: 3646192 - RNA, 21 nt, Salmonella enterica enterica serovar Typhi
gaaucagaugcucaucaacga

SEQ ID NO: 3646193 - RNA, 22 nt, Salmonella enterica enterica serovar Typhi
gaaucagaugcucaucaacgau

SEQ ID NO: 3646194 - RNA, 16 nt, Salmonella enterica enterica serovar Typhi
gaaucagauuacccuc

SEQ ID NO: 3646195 - RNA, 22 nt, Salmonella enterica enterica serovar Typhi
gaaucaguaacacaaucaggcg

SEQ ID NO: 3646196 - RNA, 12 nt, Salmonella enterica enterica serovar Typhi
gaaucaucagaa

SEQ ID NO: 3646197 - RNA, 16 nt, Salmonella enterica enterica serovar Typhi
gaauccagguacccca

SEQ ID NO: 3646198 - RNA, 16 nt, Salmonella enterica enterica serovar Typhi
gaauccccaucuccag

SEQ ID NO: 3646199 - RNA, 21 nt, Salmonella enterica enterica serovar Typhi
gaauccccggcuuccagcggc

SEQ ID NO: 3646200 - RNA, 20 nt, Salmonella enterica enterica serovar Typhi
gaaucccgccaucguccagc

SEQ ID NO: 3646201 - RNA, 20 nt, Salmonella enterica enterica serovar Typhi
gaauccggcgcucaucagac

SEQ ID NO: 3646202 - RNA, 14 nt, Salmonella enterica enterica serovar Typhi
gaauccggcggcuu

SEQ ID NO: 3646203 - RNA, 19 nt, Salmonella enterica enterica serovar Typhi
gaaucgcagagcguaauuc

SEQ ID NO: 3646204 - RNA, 12 nt, Salmonella enterica enterica serovar Typhi
gaaucgccagca

SEQ ID NO: 3646205 - RNA, 13 nt, Salmonella enterica enterica serovar Typhi
gaaucgccagcau

SEQ ID NO: 3646206 - RNA, 23 nt, Salmonella enterica enterica serovar Typhi
gaaucgccagcaucggcagcgcc

SEQ ID NO: 3646207 - RNA, 18 nt, Salmonella enterica enterica serovar Typhi
gaaucgccagucgcagca

SEQ ID NO: 3646208 - RNA, 21 nt, Salmonella enterica enterica serovar Typhi
gaaucgccuggcuugccggca

SEQ ID NO: 3646209 - RNA, 18 nt, Salmonella enterica enterica serovar Typhi
gaaucgcuuccuggguua

SEQ ID NO: 3646210 - RNA, 23 nt, Salmonella enterica enterica serovar Typhi
gaaucggacacuugcaacucgca

SEQ ID NO: 3646211 - RNA, 14 nt, Salmonella enterica enterica serovar Typhi
gaaucguccagauu

SEQ ID NO: 3646212 - RNA, 24 nt, Salmonella enterica enterica serovar Typhi
gaaucguccagauugagacaaaua

SEQ ID NO: 3646213 - RNA, 14 nt, Salmonella enterica enterica serovar Typhi
gaaucguucgccag

SEQ ID NO: 3646214 - RNA, 16 nt, Salmonella enterica enterica serovar Typhi
gaaucucaucagacug

SEQ ID NO: 3646215 - RNA, 22 nt, Salmonella enterica enterica serovar Typhi
gaaucucgaaacaauagcugug

SEQ ID NO: 3646216 - RNA, 20 nt, Salmonella enterica enterica serovar Typhi
gaaucucgugaucgccaaag

SEQ ID NO: 3646217 - RNA, 23 nt, Salmonella enterica enterica serovar Typhi
gaaucugcggcugcgugauuuug

SEQ ID NO: 3646218 - RNA, 21 nt, Salmonella enterica enterica serovar Typhi
gaaucuggauagucaggcgau

SEQ ID NO: 3646219 - RNA, 23 nt, Salmonella enterica enterica serovar Typhi
gaaucuggucggugauauauuca

SEQ ID NO: 3646220 - RNA, 16 nt, Salmonella enterica enterica serovar Typhi
gaaucugguuguuucg

SEQ ID NO: 3646221 - RNA, 16 nt, Salmonella enterica enterica serovar Typhi
gaaucuguauaaaaua

SEQ ID NO: 3646222 - RNA, 18 nt, Salmonella enterica enterica serovar Typhi
gaaugaaaaaaaaauuac

SEQ ID NO: 3646223 - RNA, 18 nt, Salmonella enterica enterica serovar Typhi
gaaugaccgaggaaauca

SEQ ID NO: 3646224 - RNA, 14 nt, Salmonella enterica enterica serovar Typhi
gaaugagcaucuac

SEQ ID NO: 3646225 - RNA, 15 nt, Salmonella enterica enterica serovar Typhi
gaaugaugugcuauu

SEQ ID NO: 3646226 - RNA, 23 nt, Salmonella enterica enterica serovar Typhi
gaaugauugccggauggcggcgu

SEQ ID NO: 3646227 - RNA, 21 nt, Salmonella enterica enterica serovar Typhi
gaaugcaaagaagggcagggg

SEQ ID NO: 3646228 - RNA, 13 nt, Salmonella enterica enterica serovar Typhi
gaaugcaagcagc

SEQ ID NO: 3646229 - RNA, 22 nt, Salmonella enterica enterica serovar Typhi
gaaugcaagcagcauaaugaau

SEQ ID NO: 3646230 - RNA, 17 nt, Salmonella enterica enterica serovar Typhi
gaaugcagaccucugcu

SEQ ID NO: 3646231 - RNA, 15 nt, Salmonella enterica enterica serovar Typhi
gaaugccaagcgcau

SEQ ID NO: 3646232 - RNA, 13 nt, Salmonella enterica enterica serovar Typhi
gaaugccagcgcc

SEQ ID NO: 3646233 - RNA, 14 nt, Salmonella enterica enterica serovar Typhi
gaaugccagcgccg

SEQ ID NO: 3646234 - RNA, 16 nt, Salmonella enterica enterica serovar Typhi
gaaugcccuuuuccag

SEQ ID NO: 3646235 - RNA, 18 nt, Salmonella enterica enterica serovar Typhi
gaaugccgaauggcgggc

SEQ ID NO: 3646236 - RNA, 22 nt, Salmonella enterica enterica serovar Typhi
gaaugccgcccauccagagcag

SEQ ID NO: 3646237 - RNA, 23 nt, Salmonella enterica enterica serovar Typhi
gaaugccgcccauccagagcagu

SEQ ID NO: 3646238 - RNA, 17 nt, Salmonella enterica enterica serovar Typhi
gaaugccuuuuacaaua

SEQ ID NO: 3646239 - RNA, 19 nt, Salmonella enterica enterica serovar Typhi
gaaugccuuuuacaauaac

SEQ ID NO: 3646240 - RNA, 21 nt, Salmonella enterica enterica serovar Typhi
gaaugcucucauauuccagcc

SEQ ID NO: 3646241 - RNA, 20 nt, Salmonella enterica enterica serovar Typhi
gaaugcugacgcguuuuuuc

SEQ ID NO: 3646242 - RNA, 23 nt, Salmonella enterica enterica serovar Typhi
gaaugcugacggauucuuccucu

SEQ ID NO: 3646243 - RNA, 19 nt, Salmonella enterica enterica serovar Typhi
gaauggggaaauaaauaug

SEQ ID NO: 3646244 - RNA, 18 nt, Salmonella enterica enterica serovar Typhi
gaaugguauuaccucgcg

SEQ ID NO: 3646245 - RNA, 15 nt, Salmonella enterica enterica serovar Typhi
gaauguagcgcccuu

SEQ ID NO: 3646246 - RNA, 19 nt, Salmonella enterica enterica serovar Typhi
gaauguccccauaucccgc

SEQ ID NO: 3646247 - RNA, 19 nt, Salmonella enterica enterica serovar Typhi
gaaugugaaauacagccag

SEQ ID NO: 3646248 - RNA, 13 nt, Salmonella enterica enterica serovar Typhi
gaauguguucuuu

SEQ ID NO: 3646249 - RNA, 20 nt, Salmonella enterica enterica serovar Typhi
gaauguuccccguugagaau

SEQ ID NO: 3646250 - RNA, 19 nt, Salmonella enterica enterica serovar Typhi
gaauguuccugcaauauau

SEQ ID NO: 3646251 - RNA, 14 nt, Salmonella enterica enterica serovar Typhi
gaauuaacagcgcg

SEQ ID NO: 3646252 - RNA, 22 nt, Salmonella enterica enterica serovar Typhi
gaauuaacucaucacagccaca

SEQ ID NO: 3646253 - RNA, 12 nt, Salmonella enterica enterica serovar Typhi
gaauuacgggcg

SEQ ID NO: 3646254 - RNA, 23 nt, Salmonella enterica enterica serovar Typhi
gaauuacgggcgauacaccuuca

SEQ ID NO: 3646255 - RNA, 15 nt, Salmonella enterica enterica serovar Typhi
gaauuaucaggguua

SEQ ID NO: 3646256 - RNA, 20 nt, Salmonella enterica enterica serovar Typhi
gaauuauuuaggguuaagag

SEQ ID NO: 3646257 - RNA, 14 nt, Salmonella enterica enterica serovar Typhi
gaauuauuucagga

SEQ ID NO: 3646258 - RNA, 22 nt, Salmonella enterica enterica serovar Typhi
gaauucaaagaacagggggcgc

SEQ ID NO: 3646259 - RNA, 18 nt, Salmonella enterica enterica serovar Typhi
gaauucaccgcaugacaa

SEQ ID NO: 3646260 - RNA, 19 nt, Salmonella enterica enterica serovar Typhi
gaauucaccgcaugacaau

SEQ ID NO: 3646261 - RNA, 16 nt, Salmonella enterica enterica serovar Typhi
gaauuccaguccuuuc

SEQ ID NO: 3646262 - RNA, 23 nt, Salmonella enterica enterica serovar Typhi
gaauuccugcggcgguaacgccu

SEQ ID NO: 3646263 - RNA, 15 nt, Salmonella enterica enterica serovar Typhi
gaauucguacguuuu

SEQ ID NO: 3646264 - RNA, 12 nt, Salmonella enterica enterica serovar Typhi
gaauucuucugu

SEQ ID NO: 3646265 - RNA, 15 nt, Salmonella enterica enterica serovar Typhi
gaauugaacuaaaaa

SEQ ID NO: 3646266 - RNA, 14 nt, Salmonella enterica enterica serovar Typhi
gaauugauuagcuu

SEQ ID NO: 3646267 - RNA, 19 nt, Salmonella enterica enterica serovar Typhi
gaauuuaucccgugguggg

SEQ ID NO: 3646268 - RNA, 17 nt, Salmonella enterica enterica serovar Typhi
gaauuucaaucaucaua

SEQ ID NO: 3646269 - RNA, 22 nt, Salmonella enterica enterica serovar Typhi
gaauuucaggguagcauugccg

SEQ ID NO: 3646270 - RNA, 19 nt, Salmonella enterica enterica serovar Typhi
gaauuucugcugccagcgc

SEQ ID NO: 3646271 - RNA, 20 nt, Salmonella enterica enterica serovar Typhi
gaauuucugcugccagcgcc

SEQ ID NO: 3646272 - RNA, 20 nt, Salmonella enterica enterica serovar Typhi
gaauuugucgucaugcgcca

SEQ ID NO: 3646273 - RNA, 13 nt, Salmonella enterica enterica serovar Typhi
gacaaaaauacca

SEQ ID NO: 3646274 - RNA, 14 nt, Salmonella enterica enterica serovar Typhi
gacaaaaauaccac

SEQ ID NO: 3646275 - RNA, 14 nt, Salmonella enterica enterica serovar Typhi
gacaaaaauggaua

SEQ ID NO: 3646276 - RNA, 19 nt, Salmonella enterica enterica serovar Typhi
gacaaaagauuuaucaauu

SEQ ID NO: 3646277 - RNA, 21 nt, Salmonella enterica enterica serovar Typhi
gacaaaaucuuuccagcucca

SEQ ID NO: 3646278 - RNA, 17 nt, Salmonella enterica enterica serovar Typhi
gacaaacagcuauccau

SEQ ID NO: 3646279 - RNA, 16 nt, Salmonella enterica enterica serovar Typhi
gacaaagagcucccca

SEQ ID NO: 3646280 - RNA, 21 nt, Salmonella enterica enterica serovar Typhi
gacaaagccggauaucgcuau

SEQ ID NO: 3646281 - RNA, 16 nt, Salmonella enterica enterica serovar Typhi
gacaaagcguggggaa

SEQ ID NO: 3646282 - RNA, 16 nt, Salmonella enterica enterica serovar Typhi
gacaaauuguuuaaaa

SEQ ID NO: 3646283 - RNA, 17 nt, Salmonella enterica enterica serovar Typhi
gacaacaucccagaaaa

SEQ ID NO: 3646284 - RNA, 20 nt, Salmonella enterica enterica serovar Typhi
gacaacaucccagaaaauga

SEQ ID NO: 3646285 - RNA, 11 nt, Salmonella enterica enterica serovar Typhi
gacaaccagcg

SEQ ID NO: 3646286 - RNA, 14 nt, Salmonella enterica enterica serovar Typhi
gacaaccugcccuu

SEQ ID NO: 3646287 - RNA, 23 nt, Salmonella enterica enterica serovar Typhi
gacaaccugccguuuuccagccg

SEQ ID NO: 3646288 - RNA, 17 nt, Salmonella enterica enterica serovar Typhi
gacaacgccgccuggca

SEQ ID NO: 3646289 - RNA, 21 nt, Salmonella enterica enterica serovar Typhi
gacaacgcguuuauuauaaac

SEQ ID NO: 3646290 - RNA, 16 nt, Salmonella enterica enterica serovar Typhi
gacaacguaaacggca

SEQ ID NO: 3646291 - RNA, 18 nt, Salmonella enterica enterica serovar Typhi
gacaacguuuucagcagu

SEQ ID NO: 3646292 - RNA, 15 nt, Salmonella enterica enterica serovar Typhi
gacaacuauugcugc

SEQ ID NO: 3646293 - RNA, 21 nt, Salmonella enterica enterica serovar Typhi
gacaacuucuaauuuuuccag

SEQ ID NO: 3646294 - RNA, 17 nt, Salmonella enterica enterica serovar Typhi
gacaagaaucacguaau

SEQ ID NO: 3646295 - RNA, 18 nt, Salmonella enterica enterica serovar Typhi
gacaagcugauuuuucgc

SEQ ID NO: 3646296 - RNA, 21 nt, Salmonella enterica enterica serovar Typhi
gacaaggccgauaaagcguuu

SEQ ID NO: 3646297 - RNA, 19 nt, Salmonella enterica enterica serovar Typhi
gacaaggcgguacgccgcc

SEQ ID NO: 3646298 - RNA, 19 nt, Salmonella enterica enterica serovar Typhi
gacaauaacggccucaauu

SEQ ID NO: 3646299 - RNA, 11 nt, Salmonella enterica enterica serovar Typhi
gacaauagcgg

SEQ ID NO: 3646300 - RNA, 16 nt, Salmonella enterica enterica serovar Typhi
gacaauagcggacggc

SEQ ID NO: 3646301 - RNA, 18 nt, Salmonella enterica enterica serovar Typhi
gacaaucaccaucccaug

SEQ ID NO: 3646302 - RNA, 18 nt, Salmonella enterica enterica serovar Typhi
gacaaucacucucuugua

SEQ ID NO: 3646303 - RNA, 16 nt, Salmonella enterica enterica serovar Typhi
gacaaucagcaccauu

SEQ ID NO: 3646304 - RNA, 20 nt, Salmonella enterica enterica serovar Typhi
gacaauccgcgaaugguuca

SEQ ID NO: 3646305 - RNA, 23 nt, Salmonella enterica enterica serovar Typhi
gacaaucuccuccggcuucagca

SEQ ID NO: 3646306 - RNA, 14 nt, Salmonella enterica enterica serovar Typhi
gacaaugaaccagc

SEQ ID NO: 3646307 - RNA, 17 nt, Salmonella enterica enterica serovar Typhi
gacaauguccgccagac

SEQ ID NO: 3646308 - RNA, 22 nt, Salmonella enterica enterica serovar Typhi
gacaauuuugauaagagaaaau

SEQ ID NO: 3646309 - RNA, 19 nt, Salmonella enterica enterica serovar Typhi
gacacagcguacaauggca

SEQ ID NO: 3646310 - RNA, 15 nt, Salmonella enterica enterica serovar Typhi
gacacaguaaaaaaa

SEQ ID NO: 3646311 - RNA, 17 nt, Salmonella enterica enterica serovar Typhi
gacacaugaccugaaua

SEQ ID NO: 3646312 - RNA, 15 nt, Salmonella enterica enterica serovar Typhi
gacacauuugauacu

SEQ ID NO: 3646313 - RNA, 13 nt, Salmonella enterica enterica serovar Typhi
gacaccagccguu

SEQ ID NO: 3646314 - RNA, 18 nt, Salmonella enterica enterica serovar Typhi
gacaccagcgucgcaugg

SEQ ID NO: 3646315 - RNA, 16 nt, Salmonella enterica enterica serovar Typhi
gacacccaauccggcu

SEQ ID NO: 3646316 - RNA, 16 nt, Salmonella enterica enterica serovar Typhi
gacacccgcagccaga

SEQ ID NO: 3646317 - RNA, 20 nt, Salmonella enterica enterica serovar Typhi
gacacgcgcgcugcgccugg

SEQ ID NO: 3646318 - RNA, 21 nt, Salmonella enterica enterica serovar Typhi
gacacgcuaccuugagguggu

SEQ ID NO: 3646319 - RNA, 23 nt, Salmonella enterica enterica serovar Typhi
gacacggugugccgccaucagcg

SEQ ID NO: 3646320 - RNA, 20 nt, Salmonella enterica enterica serovar Typhi
gacacugaaacuccgcagcc

SEQ ID NO: 3646321 - RNA, 20 nt, Salmonella enterica enterica serovar Typhi
gacacuuuccgacguuuuuc

SEQ ID NO: 3646322 - RNA, 14 nt, Salmonella enterica enterica serovar Typhi
gacagaacugauuu

SEQ ID NO: 3646323 - RNA, 18 nt, Salmonella enterica enterica serovar Typhi
gacagaacugauuuccgg

SEQ ID NO: 3646324 - RNA, 16 nt, Salmonella enterica enterica serovar Typhi
gacagaauaugcauau

SEQ ID NO: 3646325 - RNA, 14 nt, Salmonella enterica enterica serovar Typhi
gacagacgcaucuu

SEQ ID NO: 3646326 - RNA, 16 nt, Salmonella enterica enterica serovar Typhi
gacagagaaccugaac

SEQ ID NO: 3646327 - RNA, 19 nt, Salmonella enterica enterica serovar Typhi
gacagagcucgucaaaaau

SEQ ID NO: 3646328 - RNA, 16 nt, Salmonella enterica enterica serovar Typhi
gacagauaacaccagc

SEQ ID NO: 3646329 - RNA, 19 nt, Salmonella enterica enterica serovar Typhi
gacagauuggucagcagcc

SEQ ID NO: 3646330 - RNA, 16 nt, Salmonella enterica enterica serovar Typhi
gacagauuuggucagu

SEQ ID NO: 3646331 - RNA, 16 nt, Salmonella enterica enterica serovar Typhi
gacagauuuugcacuu

SEQ ID NO: 3646332 - RNA, 23 nt, Salmonella enterica enterica serovar Typhi
gacagauuuugcacuuuugccag

SEQ ID NO: 3646333 - RNA, 15 nt, Salmonella enterica enterica serovar Typhi
gacagcaaaacggcu

SEQ ID NO: 3646334 - RNA, 11 nt, Salmonella enterica enterica serovar Typhi
gacagcaagau

SEQ ID NO: 3646335 - RNA, 22 nt, Salmonella enterica enterica serovar Typhi
gacagcaaguugcgccacugcc

SEQ ID NO: 3646336 - RNA, 23 nt, Salmonella enterica enterica serovar Typhi
gacagcaaguugcgccacugcca

SEQ ID NO: 3646337 - RNA, 23 nt, Salmonella enterica enterica serovar Typhi
gacagcaauguuaaauucagcau

SEQ ID NO: 3646338 - RNA, 19 nt, Salmonella enterica enterica serovar Typhi
gacagcaggaacggcagga

SEQ ID NO: 3646339 - RNA, 18 nt, Salmonella enterica enterica serovar Typhi
gacagccagcauuuccag

SEQ ID NO: 3646340 - RNA, 19 nt, Salmonella enterica enterica serovar Typhi
gacagccagcauuuccagc

SEQ ID NO: 3646341 - RNA, 16 nt, Salmonella enterica enterica serovar Typhi
gacagccgacggcaaa

SEQ ID NO: 3646342 - RNA, 17 nt, Salmonella enterica enterica serovar Typhi
gacagccuauuaaucac

SEQ ID NO: 3646343 - RNA, 23 nt, Salmonella enterica enterica serovar Typhi
gacagcgaacaguguaaacgcca

SEQ ID NO: 3646344 - RNA, 23 nt, Salmonella enterica enterica serovar Typhi
gacagcgacacuccgcgcaugua

SEQ ID NO: 3646345 - RNA, 12 nt, Salmonella enterica enterica serovar Typhi
gacagcgacauc

SEQ ID NO: 3646346 - RNA, 13 nt, Salmonella enterica enterica serovar Typhi
gacagcgccauau

SEQ ID NO: 3646347 - RNA, 22 nt, Salmonella enterica enterica serovar Typhi
gacagcgcgcaaaaaccggagc

SEQ ID NO: 3646348 - RNA, 22 nt, Salmonella enterica enterica serovar Typhi
gacagcggauuacgcgccugcc

SEQ ID NO: 3646349 - RNA, 17 nt, Salmonella enterica enterica serovar Typhi
gacagcguaaugcgcca

SEQ ID NO: 3646350 - RNA, 12 nt, Salmonella enterica enterica serovar Typhi
gacaggacgcca

SEQ ID NO: 3646351 - RNA, 14 nt, Salmonella enterica enterica serovar Typhi
gacaggaguauagc

SEQ ID NO: 3646352 - RNA, 18 nt, Salmonella enterica enterica serovar Typhi
gacaggggggaacagcaa

SEQ ID NO: 3646353 - RNA, 18 nt, Salmonella enterica enterica serovar Typhi
gacaguauagaaauagcc

SEQ ID NO: 3646354 - RNA, 23 nt, Salmonella enterica enterica serovar Typhi
gacagucgcagagcccagcgcga

SEQ ID NO: 3646355 - RNA, 17 nt, Salmonella enterica enterica serovar Typhi
gacagugaacggcauaa

SEQ ID NO: 3646356 - RNA, 23 nt, Salmonella enterica enterica serovar Typhi
gacagugauuuacuccaaaaaua

SEQ ID NO: 3646357 - RNA, 11 nt, Salmonella enterica enterica serovar Typhi
gacagugcuau

SEQ ID NO: 3646358 - RNA, 12 nt, Salmonella enterica enterica serovar Typhi
gacagugcuaua

SEQ ID NO: 3646359 - RNA, 18 nt, Salmonella enterica enterica serovar Typhi
gacaguguucccugcgcu

SEQ ID NO: 3646360 - RNA, 22 nt, Salmonella enterica enterica serovar Typhi
gacauaaaacaguacgccgagg

SEQ ID NO: 3646361 - RNA, 16 nt, Salmonella enterica enterica serovar Typhi
gacauaagugcaggcu

SEQ ID NO: 3646362 - RNA, 15 nt, Salmonella enterica enterica serovar Typhi
gacauaguacccucu

SEQ ID NO: 3646363 - RNA, 19 nt, Salmonella enterica enterica serovar Typhi
gacauaguacccucugcac

SEQ ID NO: 3646364 - RNA, 21 nt, Salmonella enterica enterica serovar Typhi
gacauaguacccucugcacca

SEQ ID NO: 3646365 - RNA, 17 nt, Salmonella enterica enterica serovar Typhi
gacaucacguucgcgca

SEQ ID NO: 3646366 - RNA, 22 nt, Salmonella enterica enterica serovar Typhi
gacaucacguucgcgcauaccu

SEQ ID NO: 3646367 - RNA, 20 nt, Salmonella enterica enterica serovar Typhi
gacaucagccagccgccaaa

SEQ ID NO: 3646368 - RNA, 18 nt, Salmonella enterica enterica serovar Typhi
gacauccagcauuucgac

SEQ ID NO: 3646369 - RNA, 21 nt, Salmonella enterica enterica serovar Typhi
gacauccaugauaaucagcac

SEQ ID NO: 3646370 - RNA, 16 nt, Salmonella enterica enterica serovar Typhi
gacaucccagacaaaa

SEQ ID NO: 3646371 - RNA, 16 nt, Salmonella enterica enterica serovar Typhi
gacauccccgccgaga

SEQ ID NO: 3646372 - RNA, 16 nt, Salmonella enterica enterica serovar Typhi
gacaucgcaaugccac

SEQ ID NO: 3646373 - RNA, 17 nt, Salmonella enterica enterica serovar Typhi
gacaucgcucccggcac

SEQ ID NO: 3646374 - RNA, 20 nt, Salmonella enterica enterica serovar Typhi
gacaucggagauuucauccu

SEQ ID NO: 3646375 - RNA, 23 nt, Salmonella enterica enterica serovar Typhi
gacaucgucacaauaugguuauc

SEQ ID NO: 3646376 - RNA, 15 nt, Salmonella enterica enterica serovar Typhi
gacaucucaggcaag

SEQ ID NO: 3646377 - RNA, 14 nt, Salmonella enterica enterica serovar Typhi
gacaugaaaauaug

SEQ ID NO: 3646378 - RNA, 17 nt, Salmonella enterica enterica serovar Typhi
gacaugcuguugaaacg

SEQ ID NO: 3646379 - RNA, 15 nt, Salmonella enterica enterica serovar Typhi
gacauggaguuccag

SEQ ID NO: 3646380 - RNA, 15 nt, Salmonella enterica enterica serovar Typhi
gacauggcgaccggg

SEQ ID NO: 3646381 - RNA, 21 nt, Salmonella enterica enterica serovar Typhi
gacauggcggucgccauaugu

SEQ ID NO: 3646382 - RNA, 19 nt, Salmonella enterica enterica serovar Typhi
gacauggucgaacaucugc

SEQ ID NO: 3646383 - RNA, 14 nt, Salmonella enterica enterica serovar Typhi
gacauguuccgccc

SEQ ID NO: 3646384 - RNA, 23 nt, Salmonella enterica enterica serovar Typhi
gacauguuuauguagccagccau

SEQ ID NO: 3646385 - RNA, 15 nt, Salmonella enterica enterica serovar Typhi
gacauuaaagucgcg

SEQ ID NO: 3646386 - RNA, 23 nt, Salmonella enterica enterica serovar Typhi
gacauuacccggccaggcgugau

SEQ ID NO: 3646387 - RNA, 17 nt, Salmonella enterica enterica serovar Typhi
gacauuauucaccugga

SEQ ID NO: 3646388 - RNA, 14 nt, Salmonella enterica enterica serovar Typhi
gacauugcgcggcg

SEQ ID NO: 3646389 - RNA, 17 nt, Salmonella enterica enterica serovar Typhi
gacauugguuucaugca

SEQ ID NO: 3646390 - RNA, 14 nt, Salmonella enterica enterica serovar Typhi
gacauuguucuaaa

SEQ ID NO: 3646391 - RNA, 17 nt, Salmonella enterica enterica serovar Typhi
gacauuugcaucaaacu

SEQ ID NO: 3646392 - RNA, 19 nt, Salmonella enterica enterica serovar Typhi
gaccaaagcgaauacucac

SEQ ID NO: 3646393 - RNA, 14 nt, Salmonella enterica enterica serovar Typhi
gaccaaagcuauuc

SEQ ID NO: 3646394 - RNA, 18 nt, Salmonella enterica enterica serovar Typhi
gaccaaagucaaacugau

SEQ ID NO: 3646395 - RNA, 14 nt, Salmonella enterica enterica serovar Typhi
gaccaacaccagcc

SEQ ID NO: 3646396 - RNA, 17 nt, Salmonella enterica enterica serovar Typhi
gaccaacaccuacgaua

SEQ ID NO: 3646397 - RNA, 22 nt, Salmonella enterica enterica serovar Typhi
gaccaacgguuggauuucggcg

SEQ ID NO: 3646398 - RNA, 17 nt, Salmonella enterica enterica serovar Typhi
gaccaagcgucagcaug

SEQ ID NO: 3646399 - RNA, 21 nt, Salmonella enterica enterica serovar Typhi
gaccaauaaaggucggcugcc

SEQ ID NO: 3646400 - RNA, 21 nt, Salmonella enterica enterica serovar Typhi
gaccaauagagagcgacagcc

SEQ ID NO: 3646401 - RNA, 15 nt, Salmonella enterica enterica serovar Typhi
gaccaaugacgcuau

SEQ ID NO: 3646402 - RNA, 17 nt, Salmonella enterica enterica serovar Typhi
gaccaauugcaggcagc

SEQ ID NO: 3646403 - RNA, 16 nt, Salmonella enterica enterica serovar Typhi
gaccaccauccggcaa

SEQ ID NO: 3646404 - RNA, 14 nt, Salmonella enterica enterica serovar Typhi
gaccaccgccauau

SEQ ID NO: 3646405 - RNA, 22 nt, Salmonella enterica enterica serovar Typhi
gaccaccgcgcuagugccgcca

SEQ ID NO: 3646406 - RNA, 15 nt, Salmonella enterica enterica serovar Typhi
gaccacgccaccgcc

SEQ ID NO: 3646407 - RNA, 23 nt, Salmonella enterica enterica serovar Typhi
gaccacgccaucaacagcggaga

SEQ ID NO: 3646408 - RNA, 14 nt, Salmonella enterica enterica serovar Typhi
gaccacgccgccgc

SEQ ID NO: 3646409 - RNA, 18 nt, Salmonella enterica enterica serovar Typhi
gaccacggccacagccau

SEQ ID NO: 3646410 - RNA, 22 nt, Salmonella enterica enterica serovar Typhi
gaccacggccacagccauccga

SEQ ID NO: 3646411 - RNA, 18 nt, Salmonella enterica enterica serovar Typhi
gaccagacacggugugcc

SEQ ID NO: 3646412 - RNA, 23 nt, Salmonella enterica enterica serovar Typhi
gaccagcaccaucuuuuccggca

SEQ ID NO: 3646413 - RNA, 11 nt, Salmonella enterica enterica serovar Typhi
gaccagcaccu

SEQ ID NO: 3646414 - RNA, 13 nt, Salmonella enterica enterica serovar Typhi
gaccagcaccugc

SEQ ID NO: 3646415 - RNA, 11 nt, Salmonella enterica enterica serovar Typhi
gaccagcagca

SEQ ID NO: 3646416 - RNA, 15 nt, Salmonella enterica enterica serovar Typhi
gaccagcagcaucac

SEQ ID NO: 3646417 - RNA, 12 nt, Salmonella enterica enterica serovar Typhi
gaccagcaucag

SEQ ID NO: 3646418 - RNA, 18 nt, Salmonella enterica enterica serovar Typhi
gaccagcaucagaauaau

SEQ ID NO: 3646419 - RNA, 15 nt, Salmonella enterica enterica serovar Typhi
gaccagcaucgccgg

SEQ ID NO: 3646420 - RNA, 16 nt, Salmonella enterica enterica serovar Typhi
gaccagcaugugccgg

SEQ ID NO: 3646421 - RNA, 15 nt, Salmonella enterica enterica serovar Typhi
gaccagccaggcgau

SEQ ID NO: 3646422 - RNA, 14 nt, Salmonella enterica enterica serovar Typhi
gaccagcgacagua

SEQ ID NO: 3646423 - RNA, 18 nt, Salmonella enterica enterica serovar Typhi
gaccagcgacgaugaaau

SEQ ID NO: 3646424 - RNA, 15 nt, Salmonella enterica enterica serovar Typhi
gaccagcgacggcca

SEQ ID NO: 3646425 - RNA, 21 nt, Salmonella enterica enterica serovar Typhi
gaccagcgcaaacaacccggc

SEQ ID NO: 3646426 - RNA, 11 nt, Salmonella enterica enterica serovar Typhi
gaccagcgccc

SEQ ID NO: 3646427 - RNA, 15 nt, Salmonella enterica enterica serovar Typhi
gaccagcgcgccaaa

SEQ ID NO: 3646428 - RNA, 22 nt, Salmonella enterica enterica serovar Typhi
gaccagcguaccgucucggccu

SEQ ID NO: 3646429 - RNA, 18 nt, Salmonella enterica enterica serovar Typhi
gaccagcgugaccgguaa

SEQ ID NO: 3646430 - RNA, 19 nt, Salmonella enterica enterica serovar Typhi
gaccagcugacgacgccag

SEQ ID NO: 3646431 - RNA, 21 nt, Salmonella enterica enterica serovar Typhi
gaccagcugacgacgccagcc

SEQ ID NO: 3646432 - RNA, 22 nt, Salmonella enterica enterica serovar Typhi
gaccagcugacgacgccagccc

SEQ ID NO: 3646433 - RNA, 21 nt, Salmonella enterica enterica serovar Typhi
gaccaggaauuuaccggugcg

SEQ ID NO: 3646434 - RNA, 15 nt, Salmonella enterica enterica serovar Typhi
gaccaggaucagacc

SEQ ID NO: 3646435 - RNA, 14 nt, Salmonella enterica enterica serovar Typhi
gaccaggauggcca

SEQ ID NO: 3646436 - RNA, 15 nt, Salmonella enterica enterica serovar Typhi
gaccaggauggccag

SEQ ID NO: 3646437 - RNA, 17 nt, Salmonella enterica enterica serovar Typhi
gaccaggauggccagca

SEQ ID NO: 3646438 - RNA, 21 nt, Salmonella enterica enterica serovar Typhi
gaccaggauggccagcaccag

SEQ ID NO: 3646439 - RNA, 18 nt, Salmonella enterica enterica serovar Typhi
gaccagucggacagcgac

SEQ ID NO: 3646440 - RNA, 18 nt, Salmonella enterica enterica serovar Typhi
gaccagugaacgucugca

SEQ ID NO: 3646441 - RNA, 14 nt, Salmonella enterica enterica serovar Typhi
gaccaguuaagcaa

SEQ ID NO: 3646442 - RNA, 18 nt, Salmonella enterica enterica serovar Typhi
gaccaguucaccggcggc

SEQ ID NO: 3646443 - RNA, 22 nt, Salmonella enterica enterica serovar Typhi
gaccaguuuuugcgccagcgca

SEQ ID NO: 3646444 - RNA, 19 nt, Salmonella enterica enterica serovar Typhi
gaccauaaauagccgaccg

SEQ ID NO: 3646445 - RNA, 16 nt, Salmonella enterica enterica serovar Typhi
gaccauaaaugaaaug

SEQ ID NO: 3646446 - RNA, 17 nt, Salmonella enterica enterica serovar Typhi
gaccauaauuuccggcg

SEQ ID NO: 3646447 - RNA, 19 nt, Salmonella enterica enterica serovar Typhi
gaccauacgcagcauuucg

SEQ ID NO: 3646448 - RNA, 19 nt, Salmonella enterica enterica serovar Typhi
gaccauaguccaugcccaa

SEQ ID NO: 3646449 - RNA, 16 nt, Salmonella enterica enterica serovar Typhi
gaccauauaugaaauc

SEQ ID NO: 3646450 - RNA, 14 nt, Salmonella enterica enterica serovar Typhi
gaccauaugcggca

SEQ ID NO: 3646451 - RNA, 14 nt, Salmonella enterica enterica serovar Typhi
gaccauauucacgc

SEQ ID NO: 3646452 - RNA, 19 nt, Salmonella enterica enterica serovar Typhi
gaccauauucacgcagcuu

SEQ ID NO: 3646453 - RNA, 15 nt, Salmonella enterica enterica serovar Typhi
gaccaucucuuccgc

SEQ ID NO: 3646454 - RNA, 12 nt, Salmonella enterica enterica serovar Typhi
gaccaugauauc

SEQ ID NO: 3646455 - RNA, 22 nt, Salmonella enterica enterica serovar Typhi
gaccaugcauauaagagacgcc

SEQ ID NO: 3646456 - RNA, 20 nt, Salmonella enterica enterica serovar Typhi
gaccauuaccauuccucacg

SEQ ID NO: 3646457 - RNA, 16 nt, Salmonella enterica enterica serovar Typhi
gaccauugauuuccgc

SEQ ID NO: 3646458 - RNA, 20 nt, Salmonella enterica enterica serovar Typhi
gaccauuggcaccaccagga

SEQ ID NO: 3646459 - RNA, 15 nt, Salmonella enterica enterica serovar Typhi
gacccacagccgguu

SEQ ID NO: 3646460 - RNA, 16 nt, Salmonella enterica enterica serovar Typhi
gacccacagccgguua

SEQ ID NO: 3646461 - RNA, 14 nt, Salmonella enterica enterica serovar Typhi
gacccacgccagca

SEQ ID NO: 3646462 - RNA, 16 nt, Salmonella enterica enterica serovar Typhi
gacccacuaacugccg

SEQ ID NO: 3646463 - RNA, 12 nt, Salmonella enterica enterica serovar Typhi
gacccagacaaa

SEQ ID NO: 3646464 - RNA, 16 nt, Salmonella enterica enterica serovar Typhi
gacccaguacaaacaa

SEQ ID NO: 3646465 - RNA, 20 nt, Salmonella enterica enterica serovar Typhi
gacccauacucuuucccggc

SEQ ID NO: 3646466 - RNA, 14 nt, Salmonella enterica enterica serovar Typhi
gaccccaauagcga

SEQ ID NO: 3646467 - RNA, 18 nt, Salmonella enterica enterica serovar Typhi
gaccccaguaauccggca

SEQ ID NO: 3646468 - RNA, 12 nt, Salmonella enterica enterica serovar Typhi
gacccccuccuu

SEQ ID NO: 3646469 - RNA, 14 nt, Salmonella enterica enterica serovar Typhi
gacccgaaguggug

SEQ ID NO: 3646470 - RNA, 18 nt, Salmonella enterica enterica serovar Typhi
gacccgcaucgccgcggc

SEQ ID NO: 3646471 - RNA, 17 nt, Salmonella enterica enterica serovar Typhi
gacccgccgccagcacc

SEQ ID NO: 3646472 - RNA, 11 nt, Salmonella enterica enterica serovar Typhi
gacccggcauu

SEQ ID NO: 3646473 - RNA, 19 nt, Salmonella enterica enterica serovar Typhi
gacccgggacuucaggcau

SEQ ID NO: 3646474 - RNA, 22 nt, Salmonella enterica enterica serovar Typhi
gacccgggacuucaggcaucca

SEQ ID NO: 3646475 - RNA, 14 nt, Salmonella enterica enterica serovar Typhi
gaccgacaucgcca

SEQ ID NO: 3646476 - RNA, 18 nt, Salmonella enterica enterica serovar Typhi
gaccgagacccagcgcga

SEQ ID NO: 3646477 - RNA, 13 nt, Salmonella enterica enterica serovar Typhi
gaccgagaucagg

SEQ ID NO: 3646478 - RNA, 22 nt, Salmonella enterica enterica serovar Typhi
gaccgauagagacugccgccgu

SEQ ID NO: 3646479 - RNA, 16 nt, Salmonella enterica enterica serovar Typhi
gaccgauauagccacu

SEQ ID NO: 3646480 - RNA, 22 nt, Salmonella enterica enterica serovar Typhi
gaccgaucucaugcaacuggca

SEQ ID NO: 3646481 - RNA, 13 nt, Salmonella enterica enterica serovar Typhi
gaccgcaaaccga

SEQ ID NO: 3646482 - RNA, 15 nt, Salmonella enterica enterica serovar Typhi
gaccgcacagcagac

SEQ ID NO: 3646483 - RNA, 20 nt, Salmonella enterica enterica serovar Typhi
gaccgcagaccggaugaugg

SEQ ID NO: 3646484 - RNA, 14 nt, Salmonella enterica enterica serovar Typhi
gaccgcagcuuauu

SEQ ID NO: 3646485 - RNA, 14 nt, Salmonella enterica enterica serovar Typhi
gaccgccagcagag

SEQ ID NO: 3646486 - RNA, 23 nt, Salmonella enterica enterica serovar Typhi
gaccgcccaggauaucgcgggcg

SEQ ID NO: 3646487 - RNA, 21 nt, Salmonella enterica enterica serovar Typhi
gaccgccgaugcugaauagcc

SEQ ID NO: 3646488 - RNA, 22 nt, Salmonella enterica enterica serovar Typhi
gaccgccgucauagcaggagau

SEQ ID NO: 3646489 - RNA, 15 nt, Salmonella enterica enterica serovar Typhi
gaccgccuaacagcg

SEQ ID NO: 3646490 - RNA, 22 nt, Salmonella enterica enterica serovar Typhi
gaccgccugcaucaccucagaa

SEQ ID NO: 3646491 - RNA, 12 nt, Salmonella enterica enterica serovar Typhi
gaccgcugaugg

SEQ ID NO: 3646492 - RNA, 23 nt, Salmonella enterica enterica serovar Typhi
gaccgcuuuagccaguagcuggu

SEQ ID NO: 3646493 - RNA, 17 nt, Salmonella enterica enterica serovar Typhi
gaccgcuuucccggcau

SEQ ID NO: 3646494 - RNA, 16 nt, Salmonella enterica enterica serovar Typhi
gaccggacguugaaaa

SEQ ID NO: 3646495 - RNA, 17 nt, Salmonella enterica enterica serovar Typhi
gaccggacguugaaaaa

SEQ ID NO: 3646496 - RNA, 17 nt, Salmonella enterica enterica serovar Typhi
gaccggaugauggccug

SEQ ID NO: 3646497 - RNA, 23 nt, Salmonella enterica enterica serovar Typhi
gaccggcaaaaagaaucgccagu

SEQ ID NO: 3646498 - RNA, 18 nt, Salmonella enterica enterica serovar Typhi
gaccggcaucucaucuug

SEQ ID NO: 3646499 - RNA, 13 nt, Salmonella enterica enterica serovar Typhi
gaccggcccgcuu

SEQ ID NO: 3646500 - RNA, 16 nt, Salmonella enterica enterica serovar Typhi
gaccggcgcagcgccc

SEQ ID NO: 3646501 - RNA, 17 nt, Salmonella enterica enterica serovar Typhi
gaccgggcugcacgcca

SEQ ID NO: 3646502 - RNA, 19 nt, Salmonella enterica enterica serovar Typhi
gaccgguaagcccauggca

SEQ ID NO: 3646503 - RNA, 14 nt, Salmonella enterica enterica serovar Typhi
gaccggucagccgg

SEQ ID NO: 3646504 - RNA, 19 nt, Salmonella enterica enterica serovar Typhi
gaccgguccaccgggggcg

SEQ ID NO: 3646505 - RNA, 18 nt, Salmonella enterica enterica serovar Typhi
gaccgucaaacguccaua

SEQ ID NO: 3646506 - RNA, 18 nt, Salmonella enterica enterica serovar Typhi
gaccguccccagccagag

SEQ ID NO: 3646507 - RNA, 20 nt, Salmonella enterica enterica serovar Typhi
gaccgucgcgcccuccucca

SEQ ID NO: 3646508 - RNA, 17 nt, Salmonella enterica enterica serovar Typhi
gaccgucgugccugcgg

SEQ ID NO: 3646509 - RNA, 19 nt, Salmonella enterica enterica serovar Typhi
gaccgucuuugucaagcac

SEQ ID NO: 3646510 - RNA, 21 nt, Salmonella enterica enterica serovar Typhi
gaccgugauuuuuaccgccgg

SEQ ID NO: 3646511 - RNA, 15 nt, Salmonella enterica enterica serovar Typhi
gaccguuagcgacgg

SEQ ID NO: 3646512 - RNA, 17 nt, Salmonella enterica enterica serovar Typhi
gaccuaaaguaaaggaa

SEQ ID NO: 3646513 - RNA, 13 nt, Salmonella enterica enterica serovar Typhi
gaccuaaauaagc

SEQ ID NO: 3646514 - RNA, 15 nt, Salmonella enterica enterica serovar Typhi
gaccuaauagccagc

SEQ ID NO: 3646515 - RNA, 13 nt, Salmonella enterica enterica serovar Typhi
gaccucaauccgu

SEQ ID NO: 3646516 - RNA, 20 nt, Salmonella enterica enterica serovar Typhi
gaccucacgcuuaucgccaa

SEQ ID NO: 3646517 - RNA, 13 nt, Salmonella enterica enterica serovar Typhi
gaccuccgccauc

SEQ ID NO: 3646518 - RNA, 21 nt, Salmonella enterica enterica serovar Typhi
gaccucuucuuugagcucccg

SEQ ID NO: 3646519 - RNA, 22 nt, Salmonella enterica enterica serovar Typhi
gaccugaauauucggcuccagg

SEQ ID NO: 3646520 - RNA, 18 nt, Salmonella enterica enterica serovar Typhi
gaccugagcgugcaaugu

SEQ ID NO: 3646521 - RNA, 17 nt, Salmonella enterica enterica serovar Typhi
gaccugauugaccagca

SEQ ID NO: 3646522 - RNA, 16 nt, Salmonella enterica enterica serovar Typhi
gaccugcaacuccaca

SEQ ID NO: 3646523 - RNA, 23 nt, Salmonella enterica enterica serovar Typhi
gaccugcaacuccacaaauagca

SEQ ID NO: 3646524 - RNA, 21 nt, Salmonella enterica enterica serovar Typhi
gaccugccgcgccugauucau

SEQ ID NO: 3646525 - RNA, 22 nt, Salmonella enterica enterica serovar Typhi
gaccugccuuucccauccgccg

SEQ ID NO: 3646526 - RNA, 17 nt, Salmonella enterica enterica serovar Typhi
gaccugcuccaugacgu

SEQ ID NO: 3646527 - RNA, 11 nt, Salmonella enterica enterica serovar Typhi
gaccuggcgcu

SEQ ID NO: 3646528 - RNA, 18 nt, Salmonella enterica enterica serovar Typhi
gaccuggcgcucaaucag

SEQ ID NO: 3646529 - RNA, 22 nt, Salmonella enterica enterica serovar Typhi
gaccuguucuguaggcugugca

SEQ ID NO: 3646530 - RNA, 14 nt, Salmonella enterica enterica serovar Typhi
gaccuuaauccagc

SEQ ID NO: 3646531 - RNA, 17 nt, Salmonella enterica enterica serovar Typhi
gaccuuaucccgcugac

SEQ ID NO: 3646532 - RNA, 22 nt, Salmonella enterica enterica serovar Typhi
gaccuuauucccauuccugcaa

SEQ ID NO: 3646533 - RNA, 10 nt, Salmonella enterica enterica serovar Typhi
aaaaaacagg

SEQ ID NO: 3646534 - RNA, 21 nt, Salmonella enterica enterica serovar Typhi
aaaaaacauauaauuaacauu

SEQ ID NO: 3646535 - RNA, 12 nt, Salmonella enterica enterica serovar Typhi
aaaaaaccguau

SEQ ID NO: 3646536 - RNA, 20 nt, Salmonella enterica enterica serovar Typhi
aaaaaacgcccagaucgacc

SEQ ID NO: 3646537 - RNA, 17 nt, Salmonella enterica enterica serovar Typhi
aaaaaacggaaccaaaa

SEQ ID NO: 3646538 - RNA, 11 nt, Salmonella enterica enterica serovar Typhi
aaaaaagagaa

SEQ ID NO: 3646539 - RNA, 11 nt, Salmonella enterica enterica serovar Typhi
aaaaaagccau

SEQ ID NO: 3646540 - RNA, 21 nt, Salmonella enterica enterica serovar Typhi
aaaaaagucacuuacuuucuu

SEQ ID NO: 3646541 - RNA, 13 nt, Salmonella enterica enterica serovar Typhi
aaaaaauaucucu

SEQ ID NO: 3646542 - RNA, 12 nt, Salmonella enterica enterica serovar Typhi
aaaaaaucagca

SEQ ID NO: 3646543 - RNA, 12 nt, Salmonella enterica enterica serovar Typhi
aaaaaauccuca

SEQ ID NO: 3646544 - RNA, 11 nt, Salmonella enterica enterica serovar Typhi
aaaaaauuccc

SEQ ID NO: 3646545 - RNA, 16 nt, Salmonella enterica enterica serovar Typhi
aaaaacagccagcagc

SEQ ID NO: 3646546 - RNA, 19 nt, Salmonella enterica enterica serovar Typhi
aaaaacagcgcaauaugca

SEQ ID NO: 3646547 - RNA, 19 nt, Salmonella enterica enterica serovar Typhi
aaaaacagguugcguaacg

SEQ ID NO: 3646548 - RNA, 11 nt, Salmonella enterica enterica serovar Typhi
aaaaacaucau

SEQ ID NO: 3646549 - RNA, 15 nt, Salmonella enterica enterica serovar Typhi
aaaaaccaaaaaaua

SEQ ID NO: 3646550 - RNA, 16 nt, Salmonella enterica enterica serovar Typhi
aaaaaccaaaaaauau

SEQ ID NO: 3646551 - RNA, 15 nt, Salmonella enterica enterica serovar Typhi
aaaaacccaccaacu

SEQ ID NO: 3646552 - RNA, 14 nt, Salmonella enterica enterica serovar Typhi
aaaaacccaccagc

SEQ ID NO: 3646553 - RNA, 16 nt, Salmonella enterica enterica serovar Typhi
aaaaaccgccucaauu

SEQ ID NO: 3646554 - RNA, 20 nt, Salmonella enterica enterica serovar Typhi
aaaaacgcgcucgccagcgc

SEQ ID NO: 3646555 - RNA, 13 nt, Salmonella enterica enterica serovar Typhi
aaaaacggcuuua

SEQ ID NO: 3646556 - RNA, 15 nt, Salmonella enterica enterica serovar Typhi
aaaaacucaggaaau

SEQ ID NO: 3646557 - RNA, 18 nt, Salmonella enterica enterica serovar Typhi
aaaaacugcuaaaagaag

SEQ ID NO: 3646558 - RNA, 12 nt, Salmonella enterica enterica serovar Typhi
aaaaagaaaaaa

SEQ ID NO: 3646559 - RNA, 20 nt, Salmonella enterica enterica serovar Typhi
aaaaagaacggcaaauugag

SEQ ID NO: 3646560 - RNA, 22 nt, Salmonella enterica enterica serovar Typhi
aaaaagccagggaaauggcgaa

SEQ ID NO: 3646561 - RNA, 22 nt, Salmonella enterica enterica serovar Typhi
aaaaagcccgacccgcugcgug

SEQ ID NO: 3646562 - RNA, 19 nt, Salmonella enterica enterica serovar Typhi
aaaaagccggcggaaaaaa

SEQ ID NO: 3646563 - RNA, 16 nt, Salmonella enterica enterica serovar Typhi
aaaaagccucugauuu

SEQ ID NO: 3646564 - RNA, 17 nt, Salmonella enterica enterica serovar Typhi
aaaaagccucugauuuc

SEQ ID NO: 3646565 - RNA, 19 nt, Salmonella enterica enterica serovar Typhi
aaaaagccucugauuucga

SEQ ID NO: 3646566 - RNA, 17 nt, Salmonella enterica enterica serovar Typhi
aaaaagcguacaaaaaa

SEQ ID NO: 3646567 - RNA, 19 nt, Salmonella enterica enterica serovar Typhi
aaaaagcgucaguaaaagc

SEQ ID NO: 3646568 - RNA, 11 nt, Salmonella enterica enterica serovar Typhi
aaaaagcugcg

SEQ ID NO: 3646569 - RNA, 17 nt, Salmonella enterica enterica serovar Typhi
aaaaagcugcgaucaag

SEQ ID NO: 3646570 - RNA, 10 nt, Salmonella enterica enterica serovar Typhi
aaaaaggaca

SEQ ID NO: 3646571 - RNA, 15 nt, Salmonella enterica enterica serovar Typhi
aaaaaggcagaagaa

SEQ ID NO: 3646572 - RNA, 20 nt, Salmonella enterica enterica serovar Typhi
aaaaaggcgaacuccagcgc

SEQ ID NO: 3646573 - RNA, 15 nt, Salmonella enterica enterica serovar Typhi
aaaaagguaacuauu

SEQ ID NO: 3646574 - RNA, 13 nt, Salmonella enterica enterica serovar Typhi
aaaaauaaaaaaa

SEQ ID NO: 3646575 - RNA, 14 nt, Salmonella enterica enterica serovar Typhi
aaaaauaaaaaaac

SEQ ID NO: 3646576 - RNA, 13 nt, Salmonella enterica enterica serovar Typhi
aaaaauaaaaacc

SEQ ID NO: 3646577 - RNA, 21 nt, Salmonella enterica enterica serovar Typhi
aaaaauaauuacuaucuucaa

SEQ ID NO: 3646578 - RNA, 11 nt, Salmonella enterica enterica serovar Typhi
aaaaauacuga

SEQ ID NO: 3646579 - RNA, 14 nt, Salmonella enterica enterica serovar Typhi
aaaaauagcauuaa

SEQ ID NO: 3646580 - RNA, 13 nt, Salmonella enterica enterica serovar Typhi
aaaauaacgcgau

SEQ ID NO: 3646581 - RNA, 23 nt, Salmonella enterica enterica serovar Typhi
aaaauaagagggcgccaugcuga

SEQ ID NO: 3646582 - RNA, 17 nt, Salmonella enterica enterica serovar Typhi
aaaauaauaaucguuuu

SEQ ID NO: 3646583 - RNA, 13 nt, Salmonella enterica enterica serovar Typhi
aaaauaauaggua

SEQ ID NO: 3646584 - RNA, 16 nt, Salmonella enterica enterica serovar Typhi
aaaauaccgcacauca

SEQ ID NO: 3646585 - RNA, 22 nt, Salmonella enterica enterica serovar Typhi
aaaauacugcuagaacauuucc

SEQ ID NO: 3646586 - RNA, 17 nt, Salmonella enterica enterica serovar Typhi
aaaauacuuccauuccc

SEQ ID NO: 3646587 - RNA, 22 nt, Salmonella enterica enterica serovar Typhi
aaaauagccagaaugccagcgc

SEQ ID NO: 3646588 - RNA, 14 nt, Salmonella enterica enterica serovar Typhi
aaaauagcccggcu

SEQ ID NO: 3646589 - RNA, 15 nt, Salmonella enterica enterica serovar Typhi
aaaauagcuggcugu

SEQ ID NO: 3646590 - RNA, 19 nt, Salmonella enterica enterica serovar Typhi
aaaauauccgccaucgaca

SEQ ID NO: 3646591 - RNA, 13 nt, Salmonella enterica enterica serovar Typhi
aaaaucaccacac

SEQ ID NO: 3646592 - RNA, 23 nt, Salmonella enterica enterica serovar Typhi
aaaaucacgcuggauaagacgac

SEQ ID NO: 3646593 - RNA, 21 nt, Salmonella enterica enterica serovar Typhi
aaaaucacuaagaccagcauc

SEQ ID NO: 3646594 - RNA, 22 nt, Salmonella enterica enterica serovar Typhi
aaaaucagcccggacaucaucc

SEQ ID NO: 3646595 - RNA, 18 nt, Salmonella enterica enterica serovar Typhi
aaaaucccggcuggguuc

SEQ ID NO: 3646596 - RNA, 23 nt, Salmonella enterica enterica serovar Typhi
aaaauccucuaccggaaaacagc

SEQ ID NO: 3646597 - RNA, 16 nt, Salmonella enterica enterica serovar Typhi
aaaaucgucaucagau

SEQ ID NO: 3646598 - RNA, 19 nt, Salmonella enterica enterica serovar Typhi
aaaaucguuaaccagcggc

SEQ ID NO: 3646599 - RNA, 21 nt, Salmonella enterica enterica serovar Typhi
aaaaucugcgccaaucgcgau

SEQ ID NO: 3646600 - RNA, 23 nt, Salmonella enterica enterica serovar Typhi
aaaaugaugacucauuaaaaaaa

SEQ ID NO: 3646601 - RNA, 16 nt, Salmonella enterica enterica serovar Typhi
aaaaugaugcaacaug

SEQ ID NO: 3646602 - RNA, 20 nt, Salmonella enterica enterica serovar Typhi
aaaaugaugccccagaacaa

SEQ ID NO: 3646603 - RNA, 13 nt, Salmonella enterica enterica serovar Typhi
aaaaugcacauua

SEQ ID NO: 3646604 - RNA, 14 nt, Salmonella enterica enterica serovar Typhi
aaaaugccccacga

SEQ ID NO: 3646605 - RNA, 14 nt, Salmonella enterica enterica serovar Typhi
aaaaugcgcaugau

SEQ ID NO: 3646606 - RNA, 19 nt, Salmonella enterica enterica serovar Typhi
aaaaugcgccaggaaacuc

SEQ ID NO: 3646607 - RNA, 17 nt, Salmonella enterica enterica serovar Typhi
aaaauggcaaguaaaau

SEQ ID NO: 3646608 - RNA, 21 nt, Salmonella enterica enterica serovar Typhi
aaaauggcugauaaauccggu

SEQ ID NO: 3646609 - RNA, 16 nt, Salmonella enterica enterica serovar Typhi
aaaaugggcuggaaau

SEQ ID NO: 3646610 - RNA, 20 nt, Salmonella enterica enterica serovar Typhi
aaaauggucggucacgcgau

SEQ ID NO: 3646611 - RNA, 21 nt, Salmonella enterica enterica serovar Typhi
aaaaugugagccauaacaacu

SEQ ID NO: 3646612 - RNA, 13 nt, Salmonella enterica enterica serovar Typhi
aaaauguucaugu

SEQ ID NO: 3646613 - RNA, 13 nt, Salmonella enterica enterica serovar Typhi
aaaauuaccaggc

SEQ ID NO: 3646614 - RNA, 23 nt, Salmonella enterica enterica serovar Typhi
aaaauuacuucguagacucaggc

SEQ ID NO: 3646615 - RNA, 23 nt, Salmonella enterica enterica serovar Typhi
aaaauuagacaagcaguucugaa

SEQ ID NO: 3646616 - RNA, 15 nt, Salmonella enterica enterica serovar Typhi
aaaauuauauucuaa

SEQ ID NO: 3646617 - RNA, 19 nt, Salmonella enterica enterica serovar Typhi
aaaauuaugaauaaccauc

SEQ ID NO: 3646618 - RNA, 15 nt, Salmonella enterica enterica serovar Typhi
aaaauuauuuuuacu

SEQ ID NO: 3646619 - RNA, 15 nt, Salmonella enterica enterica serovar Typhi
aaaauucagacucaa

SEQ ID NO: 3646620 - RNA, 13 nt, Salmonella enterica enterica serovar Typhi
aaaauugaauuaa

SEQ ID NO: 3646621 - RNA, 14 nt, Salmonella enterica enterica serovar Typhi
aaaauuucugccga

SEQ ID NO: 3646622 - RNA, 20 nt, Salmonella enterica enterica serovar Typhi
aaaauuuuuuaucagguugu

SEQ ID NO: 3646623 - RNA, 16 nt, Salmonella enterica enterica serovar Typhi
aaacaaauaaauccau

SEQ ID NO: 3646624 - RNA, 13 nt, Salmonella enterica enterica serovar Typhi
aaacaacauaucg

SEQ ID NO: 3646625 - RNA, 22 nt, Salmonella enterica enterica serovar Typhi
aaacaagccgccaacgccagca

SEQ ID NO: 3646626 - RNA, 14 nt, Salmonella enterica enterica serovar Typhi
aaacaaugcaggua

SEQ ID NO: 3646627 - RNA, 17 nt, Salmonella enterica enterica serovar Typhi
aaacaauuuacgcagcc

SEQ ID NO: 3646628 - RNA, 22 nt, Salmonella enterica enterica serovar Typhi
aaacacaaucacaacgucaucc

SEQ ID NO: 3646629 - RNA, 22 nt, Salmonella enterica enterica serovar Typhi
aaacaccaccgguuugucgcuu

SEQ ID NO: 3646630 - RNA, 11 nt, Salmonella enterica enterica serovar Typhi
aaacaccagaa

SEQ ID NO: 3646631 - RNA, 13 nt, Salmonella enterica enterica serovar Typhi
aaacaccagaaug

SEQ ID NO: 3646632 - RNA, 14 nt, Salmonella enterica enterica serovar Typhi
aaacaccagaaugc

SEQ ID NO: 3646633 - RNA, 19 nt, Salmonella enterica enterica serovar Typhi
aaacaccgcucaauaucau

SEQ ID NO: 3646634 - RNA, 17 nt, Salmonella enterica enterica serovar Typhi
aaacaccggggcauuuc

SEQ ID NO: 3646635 - RNA, 19 nt, Salmonella enterica enterica serovar Typhi
aaacaccggggcauuucca

SEQ ID NO: 3646636 - RNA, 14 nt, Salmonella enterica enterica serovar Typhi
aaacaccucagcca

SEQ ID NO: 3646637 - RNA, 23 nt, Salmonella enterica enterica serovar Typhi
aaacaccugucugucaaaaccca

SEQ ID NO: 3646638 - RNA, 16 nt, Salmonella enterica enterica serovar Typhi
aaacacgccgcgcugg

SEQ ID NO: 3646639 - RNA, 17 nt, Salmonella enterica enterica serovar Typhi
aaacacgccuccauaca

SEQ ID NO: 3646640 - RNA, 15 nt, Salmonella enterica enterica serovar Typhi
aaacacgucuggaaa

SEQ ID NO: 3646641 - RNA, 14 nt, Salmonella enterica enterica serovar Typhi
aaacacuaaaucau

SEQ ID NO: 3646642 - RNA, 13 nt, Salmonella enterica enterica serovar Typhi
aaacacucaggca

SEQ ID NO: 3646643 - RNA, 15 nt, Salmonella enterica enterica serovar Typhi
aaacacucuccacca

SEQ ID NO: 3646644 - RNA, 18 nt, Salmonella enterica enterica serovar Typhi
aaacacucuccaccaaau

SEQ ID NO: 3646645 - RNA, 18 nt, Salmonella enterica enterica serovar Typhi
aaacacuuccccugccag

SEQ ID NO: 3646646 - RNA, 14 nt, Salmonella enterica enterica serovar Typhi
aaacagacaauuag

SEQ ID NO: 3646647 - RNA, 20 nt, Salmonella enterica enterica serovar Typhi
aaacagauaagcgucugcaa

SEQ ID NO: 3646648 - RNA, 14 nt, Salmonella enterica enterica serovar Typhi
aaacagcaaaucgg

SEQ ID NO: 3646649 - RNA, 17 nt, Salmonella enterica enterica serovar Typhi
aaacagcacgcucaaau

SEQ ID NO: 3646650 - RNA, 17 nt, Salmonella enterica enterica serovar Typhi
aaacagccaaucauaaa

SEQ ID NO: 3646651 - RNA, 18 nt, Salmonella enterica enterica serovar Typhi
aaacagcgccaguuuuuc

SEQ ID NO: 3646652 - RNA, 20 nt, Salmonella enterica enterica serovar Typhi
aaacagcggcacuucgauaa

SEQ ID NO: 3646653 - RNA, 16 nt, Salmonella enterica enterica serovar Typhi
aaacagcuguaaaucg

SEQ ID NO: 3646654 - RNA, 15 nt, Salmonella enterica enterica serovar Typhi
aaacaggcugcccgg

SEQ ID NO: 3646655 - RNA, 19 nt, Salmonella enterica enterica serovar Typhi
aaacagguaaaacaaaaaa

SEQ ID NO: 3646656 - RNA, 19 nt, Salmonella enterica enterica serovar Typhi
aaacaguccggcgaaaaaa

SEQ ID NO: 3646657 - RNA, 16 nt, Salmonella enterica enterica serovar Typhi
aaacagugauuacaaa

SEQ ID NO: 3646658 - RNA, 16 nt, Salmonella enterica enterica serovar Typhi
aaacauaagcaaaucc

SEQ ID NO: 3646659 - RNA, 14 nt, Salmonella enterica enterica serovar Typhi
aaacauauaucucu

SEQ ID NO: 3646660 - RNA, 15 nt, Salmonella enterica enterica serovar Typhi
aaacauauccauaca

SEQ ID NO: 3646661 - RNA, 13 nt, Salmonella enterica enterica serovar Typhi
aaacaucagcgca

SEQ ID NO: 3646662 - RNA, 14 nt, Salmonella enterica enterica serovar Typhi
aaacaucagcgcau

SEQ ID NO: 3646663 - RNA, 16 nt, Salmonella enterica enterica serovar Typhi
aaacaucauaauaauu

SEQ ID NO: 3646664 - RNA, 14 nt, Salmonella enterica enterica serovar Typhi
aaaccaaacaccag

SEQ ID NO: 3646665 - RNA, 23 nt, Salmonella enterica enterica serovar Typhi
aaaccaaacagcgacacauccug

SEQ ID NO: 3646666 - RNA, 15 nt, Salmonella enterica enterica serovar Typhi
aaacuccgcgcuggc

SEQ ID NO: 3646667 - RNA, 19 nt, Salmonella enterica enterica serovar Typhi
aaacuccuccgggaaaaca

SEQ ID NO: 3646668 - RNA, 19 nt, Salmonella enterica enterica serovar Typhi
aaacucgacacacucaucu

SEQ ID NO: 3646669 - RNA, 19 nt, Salmonella enterica enterica serovar Typhi
aaacucuguguuaugaaug

SEQ ID NO: 3646670 - RNA, 22 nt, Salmonella enterica enterica serovar Typhi
aaacugacaucccccucuugcc

SEQ ID NO: 3646671 - RNA, 15 nt, Salmonella enterica enterica serovar Typhi
aaacugacugaugcu

SEQ ID NO: 3646672 - RNA, 21 nt, Salmonella enterica enterica serovar Typhi
aaacugauaguuuaaauccag

SEQ ID NO: 3646673 - RNA, 19 nt, Salmonella enterica enterica serovar Typhi
aaacugcauccccugcagg

SEQ ID NO: 3646674 - RNA, 11 nt, Salmonella enterica enterica serovar Typhi
aaacugccuuc

SEQ ID NO: 3646675 - RNA, 14 nt, Salmonella enterica enterica serovar Typhi
aaacugcgaugcgc

SEQ ID NO: 3646676 - RNA, 17 nt, Salmonella enterica enterica serovar Typhi
aaacuggagcacgcggu

SEQ ID NO: 3646677 - RNA, 17 nt, Salmonella enterica enterica serovar Typhi
aaacuggcggaacgcau

SEQ ID NO: 3646678 - RNA, 12 nt, Salmonella enterica enterica serovar Typhi
aaacuggugcag

SEQ ID NO: 3646679 - RNA, 21 nt, Salmonella enterica enterica serovar Typhi
aaacuuaucaguaacagaaca

SEQ ID NO: 3646680 - RNA, 13 nt, Salmonella enterica enterica serovar Typhi
aaacuuaucucuu

SEQ ID NO: 3646681 - RNA, 21 nt, Salmonella enterica enterica serovar Typhi
aaacuucaauucagaaaguua

SEQ ID NO: 3646682 - RNA, 14 nt, Salmonella enterica enterica serovar Typhi
aaacuucacgucgc

SEQ ID NO: 3646683 - RNA, 12 nt, Salmonella enterica enterica serovar Typhi
aaacuuuuaaau

SEQ ID NO: 3646684 - RNA, 13 nt, Salmonella enterica enterica serovar Typhi
aaacuuuuaaauu

SEQ ID NO: 3646685 - RNA, 14 nt, Salmonella enterica enterica serovar Typhi
aaagaaaacaucag

SEQ ID NO: 3646686 - RNA, 18 nt, Salmonella enterica enterica serovar Typhi
aaagaaaguagaucacca

SEQ ID NO: 3646687 - RNA, 16 nt, Salmonella enterica enterica serovar Typhi
aaagaacaauaaucau

SEQ ID NO: 3646688 - RNA, 21 nt, Salmonella enterica enterica serovar Typhi
aaagaaccgacugucgaaacc

SEQ ID NO: 3646689 - RNA, 22 nt, Salmonella enterica enterica serovar Typhi
aaagaacgacgaauaagcugaa

SEQ ID NO: 3646690 - RNA, 23 nt, Salmonella enterica enterica serovar Typhi
aaagaacguguuuuuccagcaac

SEQ ID NO: 3646691 - RNA, 23 nt, Salmonella enterica enterica serovar Typhi
aaagaagaaaccgcagaaaaagc

SEQ ID NO: 3646692 - RNA, 16 nt, Salmonella enterica enterica serovar Typhi
aaagaaucgccagucg

SEQ ID NO: 3646693 - RNA, 17 nt, Salmonella enterica enterica serovar Typhi
aaagacauaggccggcg

SEQ ID NO: 3646694 - RNA, 18 nt, Salmonella enterica enterica serovar Typhi
aaagacaugaucuuaccu

SEQ ID NO: 3646695 - RNA, 15 nt, Salmonella enterica enterica serovar Typhi
aaagaccaauacuga

SEQ ID NO: 3646696 - RNA, 19 nt, Salmonella enterica enterica serovar Typhi
aaagaccauccgguuuuaa

SEQ ID NO: 3646697 - RNA, 13 nt, Salmonella enterica enterica serovar Typhi
aaagacgccaugg

SEQ ID NO: 3646698 - RNA, 20 nt, Salmonella enterica enterica serovar Typhi
aaagacuacuuuaucgaaug

SEQ ID NO: 3646699 - RNA, 23 nt, Salmonella enterica enterica serovar Typhi
aaagacuuugaugcggaagagaa

SEQ ID NO: 3646700 - RNA, 20 nt, Salmonella enterica enterica serovar Typhi
aaagagacagaaucaggcca

SEQ ID NO: 3646701 - RNA, 17 nt, Salmonella enterica enterica serovar Typhi
aaagagagcgccaaaaa

SEQ ID NO: 3646702 - RNA, 15 nt, Salmonella enterica enterica serovar Typhi
aaagagcgucguuau

SEQ ID NO: 3646703 - RNA, 16 nt, Salmonella enterica enterica serovar Typhi
aaagaggaauguccag

SEQ ID NO: 3646704 - RNA, 22 nt, Salmonella enterica enterica serovar Typhi
aaagauaaccauuucaaacguu

SEQ ID NO: 3646705 - RNA, 13 nt, Salmonella enterica enterica serovar Typhi
aaagauaaucuga

SEQ ID NO: 3646706 - RNA, 14 nt, Salmonella enterica enterica serovar Typhi
aaagauaaucugaa

SEQ ID NO: 3646707 - RNA, 15 nt, Salmonella enterica enterica serovar Typhi
aaagauaaucugaau

SEQ ID NO: 3646708 - RNA, 15 nt, Salmonella enterica enterica serovar Typhi
aaagaucauuccuga

SEQ ID NO: 3646709 - RNA, 15 nt, Salmonella enterica enterica serovar Typhi
aaagaucgcugcaau

SEQ ID NO: 3646710 - RNA, 16 nt, Salmonella enterica enterica serovar Typhi
aaagauuagccccagc

SEQ ID NO: 3646711 - RNA, 18 nt, Salmonella enterica enterica serovar Typhi
aaagauuagccccagcgc

SEQ ID NO: 3646712 - RNA, 22 nt, Salmonella enterica enterica serovar Typhi
aaagauuauuuuaucaucagca

SEQ ID NO: 3646713 - RNA, 16 nt, Salmonella enterica enterica serovar Typhi
aaagcaauaauccgcu

SEQ ID NO: 3646714 - RNA, 16 nt, Salmonella enterica enterica serovar Typhi
aaagcaaucgccagcg

SEQ ID NO: 3646715 - RNA, 18 nt, Salmonella enterica enterica serovar Typhi
aaagcaaucgccagcgcc

SEQ ID NO: 3646716 - RNA, 16 nt, Salmonella enterica enterica serovar Typhi
aaagcacuccccggcu

SEQ ID NO: 3646717 - RNA, 17 nt, Salmonella enterica enterica serovar Typhi
aaagcacugcugcugaa

SEQ ID NO: 3646718 - RNA, 22 nt, Salmonella enterica enterica serovar Typhi
aaagcacugcugcugaaagaag

SEQ ID NO: 3646719 - RNA, 13 nt, Salmonella enterica enterica serovar Typhi
aaagcagcugcug

SEQ ID NO: 3646720 - RNA, 14 nt, Salmonella enterica enterica serovar Typhi
aaagcagcugcugg

SEQ ID NO: 3646721 - RNA, 23 nt, Salmonella enterica enterica serovar Typhi
aaagcagugaauccccagaauuu

SEQ ID NO: 3646722 - RNA, 14 nt, Salmonella enterica enterica serovar Typhi
aaagcauaaccaaa

SEQ ID NO: 3646723 - RNA, 23 nt, Salmonella enterica enterica serovar Typhi
aaagcauggcuggcgguuuuugu

SEQ ID NO: 3646724 - RNA, 18 nt, Salmonella enterica enterica serovar Typhi
aaagcauucgcagcagac

SEQ ID NO: 3646725 - RNA, 18 nt, Salmonella enterica enterica serovar Typhi
aaagccaauccagaauac

SEQ ID NO: 3646726 - RNA, 17 nt, Salmonella enterica enterica serovar Typhi
aaagccacgcaagcagc

SEQ ID NO: 3646727 - RNA, 17 nt, Salmonella enterica enterica serovar Typhi
aaagccagauaaagcag

SEQ ID NO: 3646728 - RNA, 14 nt, Salmonella enterica enterica serovar Typhi
aaagccaggccgcc

SEQ ID NO: 3646729 - RNA, 15 nt, Salmonella enterica enterica serovar Typhi
aaagccaggccgcca

SEQ ID NO: 3646730 - RNA, 16 nt, Salmonella enterica enterica serovar Typhi
aaagccaggccgccag

SEQ ID NO: 3646731 - RNA, 19 nt, Salmonella enterica enterica serovar Typhi
aaagccaguuucucuucuu

SEQ ID NO: 3646732 - RNA, 20 nt, Salmonella enterica enterica serovar Typhi
aaagccaguuucucuucuuu

SEQ ID NO: 3646733 - RNA, 16 nt, Salmonella enterica enterica serovar Typhi
aaagccaucaauccau

SEQ ID NO: 3646734 - RNA, 23 nt, Salmonella enterica enterica serovar Typhi
aaagccaucuucgguaauacaau

SEQ ID NO: 3646735 - RNA, 13 nt, Salmonella enterica enterica serovar Typhi
aaagcccaucagc

SEQ ID NO: 3646736 - RNA, 16 nt, Salmonella enterica enterica serovar Typhi
aaagcccaucagcgcc

SEQ ID NO: 3646737 - RNA, 12 nt, Salmonella enterica enterica serovar Typhi
aaagccccggcu

SEQ ID NO: 3646738 - RNA, 14 nt, Salmonella enterica enterica serovar Typhi
aaagccccggcuca

SEQ ID NO: 3646739 - RNA, 14 nt, Salmonella enterica enterica serovar Typhi
aaagcccgcccagc

SEQ ID NO: 3646740 - RNA, 16 nt, Salmonella enterica enterica serovar Typhi
aaagcccgcccagcau

SEQ ID NO: 3646741 - RNA, 22 nt, Salmonella enterica enterica serovar Typhi
aaagccgcccugcggacaggcg

SEQ ID NO: 3646742 - RNA, 19 nt, Salmonella enterica enterica serovar Typhi
aaagccggaugugagcgca

SEQ ID NO: 3646743 - RNA, 23 nt, Salmonella enterica enterica serovar Typhi
aaagccggaugugagcgcauccg

SEQ ID NO: 3646744 - RNA, 21 nt, Salmonella enterica enterica serovar Typhi
aaagccggcggaaaaaagcag

SEQ ID NO: 3646745 - RNA, 20 nt, Salmonella enterica enterica serovar Typhi
aaagccguauuuuauuuuuc

SEQ ID NO: 3646746 - RNA, 19 nt, Salmonella enterica enterica serovar Typhi
aaagccuguuuaccaagca

SEQ ID NO: 3646747 - RNA, 12 nt, Salmonella enterica enterica serovar Typhi
aaagcgaauacu

SEQ ID NO: 3646748 - RNA, 18 nt, Salmonella enterica enterica serovar Typhi
aaagcgaauacuccugca

SEQ ID NO: 3646749 - RNA, 23 nt, Salmonella enterica enterica serovar Typhi
aaagcgaccggcacucaccucuu

SEQ ID NO: 3646750 - RNA, 22 nt, Salmonella enterica enterica serovar Typhi
aaagcgcgagggauuaucuuua

SEQ ID NO: 3646751 - RNA, 21 nt, Salmonella enterica enterica serovar Typhi
aaagcgcgccgaaaauauaca

SEQ ID NO: 3646752 - RNA, 19 nt, Salmonella enterica enterica serovar Typhi
aaauacccgaccccgccgu

SEQ ID NO: 3646753 - RNA, 15 nt, Salmonella enterica enterica serovar Typhi
aaauaccgcacauca

SEQ ID NO: 3646754 - RNA, 23 nt, Salmonella enterica enterica serovar Typhi
aaauaccggcagcggucaucaau

SEQ ID NO: 3646755 - RNA, 12 nt, Salmonella enterica enterica serovar Typhi
aaauaccuaacu

SEQ ID NO: 3646756 - RNA, 19 nt, Salmonella enterica enterica serovar Typhi
aaauacgccgccagcaaua

SEQ ID NO: 3646757 - RNA, 20 nt, Salmonella enterica enterica serovar Typhi
aaauacgcgauaaaaaccca

SEQ ID NO: 3646758 - RNA, 23 nt, Salmonella enterica enterica serovar Typhi
aaauacgcggcacguuuuccagg

SEQ ID NO: 3646759 - RNA, 16 nt, Salmonella enterica enterica serovar Typhi
aaauacgcucaauaua

SEQ ID NO: 3646760 - RNA, 20 nt, Salmonella enterica enterica serovar Typhi
aaauacgcucaauauacuua

SEQ ID NO: 3646761 - RNA, 14 nt, Salmonella enterica enterica serovar Typhi
aaauacugauuaau

SEQ ID NO: 3646762 - RNA, 22 nt, Salmonella enterica enterica serovar Typhi
aaauacuggccgguuuuaaaaa

SEQ ID NO: 3646763 - RNA, 13 nt, Salmonella enterica enterica serovar Typhi
aaauagaaaauaa

SEQ ID NO: 3646764 - RNA, 14 nt, Salmonella enterica enterica serovar Typhi
aaauagaaaauaau

SEQ ID NO: 3646765 - RNA, 17 nt, Salmonella enterica enterica serovar Typhi
aaauagaaauugcaggg

SEQ ID NO: 3646766 - RNA, 15 nt, Salmonella enterica enterica serovar Typhi
aaauagagaaaauaa

SEQ ID NO: 3646767 - RNA, 16 nt, Salmonella enterica enterica serovar Typhi
aaauagagaaaauaac

SEQ ID NO: 3646768 - RNA, 23 nt, Salmonella enterica enterica serovar Typhi
aaauagaucaucuauaauaccuc

SEQ ID NO: 3646769 - RNA, 15 nt, Salmonella enterica enterica serovar Typhi
aaauagcaauuauau

SEQ ID NO: 3646770 - RNA, 17 nt, Salmonella enterica enterica serovar Typhi
aaauagccagaaugcca

SEQ ID NO: 3646771 - RNA, 14 nt, Salmonella enterica enterica serovar Typhi
aaauagccagcauc

SEQ ID NO: 3646772 - RNA, 18 nt, Salmonella enterica enterica serovar Typhi
aaauagcccuaauaggau

SEQ ID NO: 3646773 - RNA, 18 nt, Salmonella enterica enterica serovar Typhi
aaauagccguuaccgccg

SEQ ID NO: 3646774 - RNA, 19 nt, Salmonella enterica enterica serovar Typhi
aaauagcgccagacagaua

SEQ ID NO: 3646775 - RNA, 17 nt, Salmonella enterica enterica serovar Typhi
aaauagcgguucaauca

SEQ ID NO: 3646776 - RNA, 22 nt, Salmonella enterica enterica serovar Typhi
aaauagcgguucaaucacgcgu

SEQ ID NO: 3646777 - RNA, 20 nt, Salmonella enterica enterica serovar Typhi
aaauaggcgaggaaaacauu

SEQ ID NO: 3646778 - RNA, 18 nt, Salmonella enterica enterica serovar Typhi
aaauaguaaauagaaaau

SEQ ID NO: 3646779 - RNA, 19 nt, Salmonella enterica enterica serovar Typhi
aaauaguaaauagaaaaua

SEQ ID NO: 3646780 - RNA, 21 nt, Salmonella enterica enterica serovar Typhi
aaauaguauaacgaugauuau

SEQ ID NO: 3646781 - RNA, 20 nt, Salmonella enterica enterica serovar Typhi
aaauaguccagcauccaugc

SEQ ID NO: 3646782 - RNA, 17 nt, Salmonella enterica enterica serovar Typhi
aaauagugacuucugcu

SEQ ID NO: 3646783 - RNA, 22 nt, Salmonella enterica enterica serovar Typhi
aaauaguuacuguuucacgccu

SEQ ID NO: 3646784 - RNA, 16 nt, Salmonella enterica enterica serovar Typhi
aaauauagcuuuucau

SEQ ID NO: 3646785 - RNA, 23 nt, Salmonella enterica enterica serovar Typhi
aaauauccgccaucgacagcgcc

SEQ ID NO: 3646786 - RNA, 19 nt, Salmonella enterica enterica serovar Typhi
aaauauccuccgccgauaa

SEQ ID NO: 3646787 - RNA, 17 nt, Salmonella enterica enterica serovar Typhi
aaauaucgcugcccaga

SEQ ID NO: 3646788 - RNA, 17 nt, Salmonella enterica enterica serovar Typhi
aaauaucucucccuccc

SEQ ID NO: 3646789 - RNA, 19 nt, Salmonella enterica enterica serovar Typhi
aaauaugagguugucuuug

SEQ ID NO: 3646790 - RNA, 20 nt, Salmonella enterica enterica serovar Typhi
aaauauuaaugaauaaauga

SEQ ID NO: 3646791 - RNA, 14 nt, Salmonella enterica enterica serovar Typhi
aaauauuaauuaag

SEQ ID NO: 3646792 - RNA, 19 nt, Salmonella enterica enterica serovar Typhi
aaauauuacaacauguccu

SEQ ID NO: 3646793 - RNA, 19 nt, Salmonella enterica enterica serovar Typhi
aaauauuucuuugucgcca

SEQ ID NO: 3646794 - RNA, 12 nt, Salmonella enterica enterica serovar Typhi
aaaucaaaaagu

SEQ ID NO: 3646795 - RNA, 18 nt, Salmonella enterica enterica serovar Typhi
aaaucaaagaccuccgcc

SEQ ID NO: 3646796 - RNA, 16 nt, Salmonella enterica enterica serovar Typhi
aaaucaacauacugau

SEQ ID NO: 3646797 - RNA, 19 nt, Salmonella enterica enterica serovar Typhi
aaaucaacauuauuaaaau

SEQ ID NO: 3646798 - RNA, 22 nt, Salmonella enterica enterica serovar Typhi
aaaucaacgaaaucagagacaa

SEQ ID NO: 3646799 - RNA, 22 nt, Salmonella enterica enterica serovar Typhi
aaaucaacgcucagaccgaucu

SEQ ID NO: 3646800 - RNA, 22 nt, Salmonella enterica enterica serovar Typhi
aaaucacagggggaacauuuaa

SEQ ID NO: 3646801 - RNA, 16 nt, Salmonella enterica enterica serovar Typhi
aaaucacaucgccgga

SEQ ID NO: 3646802 - RNA, 18 nt, Salmonella enterica enterica serovar Typhi
aaaucacccaacguucau

SEQ ID NO: 3646803 - RNA, 18 nt, Salmonella enterica enterica serovar Typhi
aaaucacguuuacuaaaa

SEQ ID NO: 3646804 - RNA, 18 nt, Salmonella enterica enterica serovar Typhi
aaaucacuaagaccagca

SEQ ID NO: 3646805 - RNA, 20 nt, Salmonella enterica enterica serovar Typhi
aaaucacuaagaccagcauc

SEQ ID NO: 3646806 - RNA, 22 nt, Salmonella enterica enterica serovar Typhi
aaaucacuggagcgcauuuuac

SEQ ID NO: 3646807 - RNA, 12 nt, Salmonella enterica enterica serovar Typhi
aaaucagacuaa

SEQ ID NO: 3646808 - RNA, 12 nt, Salmonella enterica enterica serovar Typhi
aaaucagauaac

SEQ ID NO: 3646809 - RNA, 20 nt, Salmonella enterica enterica serovar Typhi
aaaucagcaaaaacauuacc

SEQ ID NO: 3646810 - RNA, 14 nt, Salmonella enterica enterica serovar Typhi
aaaucagcauuacc

SEQ ID NO: 3646811 - RNA, 14 nt, Salmonella enterica enterica serovar Typhi
aaaucaggaaaaag

SEQ ID NO: 3646812 - RNA, 20 nt, Salmonella enterica enterica serovar Typhi
aaaucaggccaagcaacauu

SEQ ID NO: 3646813 - RNA, 13 nt, Salmonella enterica enterica serovar Typhi
aaaucauaccagc

SEQ ID NO: 3646814 - RNA, 13 nt, Salmonella enterica enterica serovar Typhi
aaaucaucaucag

SEQ ID NO: 3646815 - RNA, 16 nt, Salmonella enterica enterica serovar Typhi
aaaucaucgccacgau

SEQ ID NO: 3646816 - RNA, 21 nt, Salmonella enterica enterica serovar Typhi
aaaucaugaaggagagcauuu

SEQ ID NO: 3646817 - RNA, 15 nt, Salmonella enterica enterica serovar Typhi
aaaucaugccagaau

SEQ ID NO: 3646818 - RNA, 20 nt, Salmonella enterica enterica serovar Typhi
aaaucauuuguacaaaaaau

SEQ ID NO: 3646819 - RNA, 17 nt, Salmonella enterica enterica serovar Typhi
aaauccacaaccggcug

SEQ ID NO: 3646820 - RNA, 15 nt, Salmonella enterica enterica serovar Typhi
aaauccagcucaguu

SEQ ID NO: 3646821 - RNA, 20 nt, Salmonella enterica enterica serovar Typhi
aaauccccaccugacuauac

SEQ ID NO: 3646822 - RNA, 22 nt, Salmonella enterica enterica serovar Typhi
aaaucccggcgauuaauaaaau

SEQ ID NO: 3646823 - RNA, 14 nt, Salmonella enterica enterica serovar Typhi
aaaucccggcuggg

SEQ ID NO: 3646824 - RNA, 16 nt, Salmonella enterica enterica serovar Typhi
aaaucccgguuuuuuu

SEQ ID NO: 3646825 - RNA, 18 nt, Salmonella enterica enterica serovar Typhi
aaauccgccggaaacugg

SEQ ID NO: 3646826 - RNA, 21 nt, Salmonella enterica enterica serovar Typhi
aaauccggcaggcagccggau

SEQ ID NO: 3646827 - RNA, 16 nt, Salmonella enterica enterica serovar Typhi
aaauccucuauuuuuu

SEQ ID NO: 3646828 - RNA, 16 nt, Salmonella enterica enterica serovar Typhi
aaauccugcacuucca

SEQ ID NO: 3646829 - RNA, 23 nt, Salmonella enterica enterica serovar Typhi
aaauccuggauacguuccagcag

SEQ ID NO: 3646830 - RNA, 14 nt, Salmonella enterica enterica serovar Typhi
aaaucgacagccag

SEQ ID NO: 3646831 - RNA, 23 nt, Salmonella enterica enterica serovar Typhi
aaaucgaugaucgaggcgugcga

SEQ ID NO: 3646832 - RNA, 16 nt, Salmonella enterica enterica serovar Typhi
aaaucgcaaacgccag

SEQ ID NO: 3646833 - RNA, 23 nt, Salmonella enterica enterica serovar Typhi
aaaucgccaaagaaacgcugauc

SEQ ID NO: 3646834 - RNA, 19 nt, Salmonella enterica enterica serovar Typhi
aaaucgccucauucgggca

SEQ ID NO: 3646835 - RNA, 16 nt, Salmonella enterica enterica serovar Typhi
aaaucgcuaagcagaa

SEQ ID NO: 3646836 - RNA, 16 nt, Salmonella enterica enterica serovar Typhi
aaaucggaccuccgcg

SEQ ID NO: 3646837 - RNA, 20 nt, Salmonella enterica enterica serovar Typhi
aaaucgguaacaucaaguac

SEQ ID NO: 3646838 - RNA, 22 nt, Salmonella enterica enterica serovar Typhi
aaaucggucauuaauccccggc

SEQ ID NO: 3646839 - RNA, 22 nt, Salmonella enterica enterica serovar Typhi
aaaucguauuggggaucgggca

SEQ ID NO: 3646840 - RNA, 13 nt, Salmonella enterica enterica serovar Typhi
aaaucgucgccaa

SEQ ID NO: 3646841 - RNA, 14 nt, Salmonella enterica enterica serovar Typhi
aaaucguucgcgga

SEQ ID NO: 3646842 - RNA, 21 nt, Salmonella enterica enterica serovar Typhi
aaaucuggugauaaagcagac

SEQ ID NO: 3646843 - RNA, 22 nt, Salmonella enterica enterica serovar Typhi
aaaucuguuaucuggauguaaa

SEQ ID NO: 3646844 - RNA, 13 nt, Salmonella enterica enterica serovar Typhi
aaaucuucauuuc

SEQ ID NO: 3646845 - RNA, 13 nt, Salmonella enterica enterica serovar Typhi
aaaucuuccaguu

SEQ ID NO: 3646846 - RNA, 21 nt, Salmonella enterica enterica serovar Typhi
aaaucuucggcaaaauauuca

SEQ ID NO: 3646847 - RNA, 23 nt, Salmonella enterica enterica serovar Typhi
aaaucuucuacuucaauuuucca

SEQ ID NO: 3646848 - RNA, 21 nt, Salmonella enterica enterica serovar Typhi
aaaugaaaaacgguauuucca

SEQ ID NO: 3646849 - RNA, 14 nt, Salmonella enterica enterica serovar Typhi
aaaugaaaaagaua

SEQ ID NO: 3646850 - RNA, 22 nt, Salmonella enterica enterica serovar Typhi
aaaugaaaugcccauaaagaaa

SEQ ID NO: 3646851 - RNA, 23 nt, Salmonella enterica enterica serovar Typhi
aaaugacgcccugcgccagcaug

SEQ ID NO: 3646852 - RNA, 16 nt, Salmonella enterica enterica serovar Typhi
aaaugacgccggguaa

SEQ ID NO: 3646853 - RNA, 12 nt, Salmonella enterica enterica serovar Typhi
aaaugacgcgcg

SEQ ID NO: 3646854 - RNA, 19 nt, Salmonella enterica enterica serovar Typhi
aaaugacgggcgaucgacu

SEQ ID NO: 3646855 - RNA, 21 nt, Salmonella enterica enterica serovar Typhi
aaaugagaaaaggaagaauaa

SEQ ID NO: 3646856 - RNA, 10 nt, Salmonella enterica enterica serovar Typhi
aaaugauaag

SEQ ID NO: 3646857 - RNA, 12 nt, Salmonella enterica enterica serovar Typhi
aaaugauauuua

SEQ ID NO: 3646858 - RNA, 15 nt, Salmonella enterica enterica serovar Typhi
aaaugaucacuuccg

SEQ ID NO: 3646859 - RNA, 12 nt, Salmonella enterica enterica serovar Typhi
aaaugaucguuu

SEQ ID NO: 3646860 - RNA, 23 nt, Salmonella enterica enterica serovar Typhi
aaaugaugacucauuaaaaaaac

SEQ ID NO: 3646861 - RNA, 23 nt, Salmonella enterica enterica serovar Typhi
aaaugcaccggcguuacuccgcg

SEQ ID NO: 3646862 - RNA, 19 nt, Salmonella enterica enterica serovar Typhi
aaaugcauugauaggcugc

SEQ ID NO: 3646863 - RNA, 19 nt, Salmonella enterica enterica serovar Typhi
aaaugcccauaaagaaaua

SEQ ID NO: 3646864 - RNA, 18 nt, Salmonella enterica enterica serovar Typhi
aaaugcccgucucauuuc

SEQ ID NO: 3646865 - RNA, 14 nt, Salmonella enterica enterica serovar Typhi
aaaugccugugcca

SEQ ID NO: 3646866 - RNA, 21 nt, Salmonella enterica enterica serovar Typhi
aaaugccuguuuauauucugg

SEQ ID NO: 3646867 - RNA, 15 nt, Salmonella enterica enterica serovar Typhi
aaaugcgaaaaaaag

SEQ ID NO: 3646868 - RNA, 18 nt, Salmonella enterica enterica serovar Typhi
aaaugcgacaucucaggc

SEQ ID NO: 3646869 - RNA, 17 nt, Salmonella enterica enterica serovar Typhi
aaaugcgcaaagcauaa

SEQ ID NO: 3646870 - RNA, 11 nt, Salmonella enterica enterica serovar Typhi
aaaugcgcaug

SEQ ID NO: 3646871 - RNA, 15 nt, Salmonella enterica enterica serovar Typhi
aaaugcgguuuucuu

SEQ ID NO: 3646872 - RNA, 13 nt, Salmonella enterica enterica serovar Typhi
aaaugcugggcuu

SEQ ID NO: 3646873 - RNA, 17 nt, Salmonella enterica enterica serovar Typhi
aaauggagcgagcuggu

SEQ ID NO: 3646874 - RNA, 14 nt, Salmonella enterica enterica serovar Typhi
aaauggauacuggu

SEQ ID NO: 3646875 - RNA, 17 nt, Salmonella enterica enterica serovar Typhi
aaaugggcuggaaauau

SEQ ID NO: 3646876 - RNA, 16 nt, Salmonella enterica enterica serovar Typhi
aaauggguaucgccuu

SEQ ID NO: 3646877 - RNA, 16 nt, Salmonella enterica enterica serovar Typhi
aaauggucggucacgc

SEQ ID NO: 3646878 - RNA, 18 nt, Salmonella enterica enterica serovar Typhi
aaauggucggucacgcga

SEQ ID NO: 3646879 - RNA, 15 nt, Salmonella enterica enterica serovar Typhi
aaauggucugccagu

SEQ ID NO: 3646880 - RNA, 14 nt, Salmonella enterica enterica serovar Typhi
aaaugguuuugccc

SEQ ID NO: 3646881 - RNA, 17 nt, Salmonella enterica enterica serovar Typhi
aaaugguuuugcccauu

SEQ ID NO: 3646882 - RNA, 17 nt, Salmonella enterica enterica serovar Typhi
aaaugucaggaucagau

SEQ ID NO: 3646883 - RNA, 16 nt, Salmonella enterica enterica serovar Typhi
aaaugucuguuuguuc

SEQ ID NO: 3646884 - RNA, 21 nt, Salmonella enterica enterica serovar Typhi
aaauguuguuugaaaagugaa

SEQ ID NO: 3646885 - RNA, 14 nt, Salmonella enterica enterica serovar Typhi
aaauuaaaaauacc

SEQ ID NO: 3646886 - RNA, 18 nt, Salmonella enterica enterica serovar Typhi
aaauuaaagauuagcguu

SEQ ID NO: 3646887 - RNA, 15 nt, Salmonella enterica enterica serovar Typhi
aaauuaaauccugaa

SEQ ID NO: 3646888 - RNA, 14 nt, Salmonella enterica enterica serovar Typhi
aaauuaagaaagua

SEQ ID NO: 3646889 - RNA, 13 nt, Salmonella enterica enterica serovar Typhi
aaauuaaucaggc

SEQ ID NO: 3646890 - RNA, 20 nt, Salmonella enterica enterica serovar Typhi
aaauuaaugauuaaaauaaa

SEQ ID NO: 3646891 - RNA, 22 nt, Salmonella enterica enterica serovar Typhi
aaauuagcucccgcgauagguu

SEQ ID NO: 3646892 - RNA, 23 nt, Salmonella enterica enterica serovar Typhi
aaauuauuccuugaucaggaaau

SEQ ID NO: 3646893 - RNA, 18 nt, Salmonella enterica enterica serovar Typhi
aaauuauuggcuuuguaa

SEQ ID NO: 3646894 - RNA, 12 nt, Salmonella enterica enterica serovar Typhi
aaauuauuuuca

SEQ ID NO: 3646895 - RNA, 19 nt, Salmonella enterica enterica serovar Typhi
aaauuauuuuuacuuaaaa

SEQ ID NO: 3646896 - RNA, 16 nt, Salmonella enterica enterica serovar Typhi
aaauucacaccaaugu

SEQ ID NO: 3646897 - RNA, 20 nt, Salmonella enterica enterica serovar Typhi
aaauucacccguuauucauu

SEQ ID NO: 3646898 - RNA, 19 nt, Salmonella enterica enterica serovar Typhi
aaauucacgcuucucuggc

SEQ ID NO: 3646899 - RNA, 23 nt, Salmonella enterica enterica serovar Typhi
aaauuccagcaaugagccgucgc

SEQ ID NO: 3646900 - RNA, 19 nt, Salmonella enterica enterica serovar Typhi
aaauuccccauaaucgacc

SEQ ID NO: 3646901 - RNA, 21 nt, Salmonella enterica enterica serovar Typhi
aaauuccuuccggcgcaauaa

SEQ ID NO: 3646902 - RNA, 12 nt, Salmonella enterica enterica serovar Typhi
aaauucgaaaua

SEQ ID NO: 3646903 - RNA, 16 nt, Salmonella enterica enterica serovar Typhi
aaauucgaaauaaaga

SEQ ID NO: 3646904 - RNA, 19 nt, Salmonella enterica enterica serovar Typhi
aaauucgcuaauccccccu

SEQ ID NO: 3646905 - RNA, 19 nt, Salmonella enterica enterica serovar Typhi
aaauucggcguuacccguc

SEQ ID NO: 3646906 - RNA, 17 nt, Salmonella enterica enterica serovar Typhi
aaauucuaugccaggcg

SEQ ID NO: 3646907 - RNA, 22 nt, Salmonella enterica enterica serovar Typhi
aaauucugucucaauaaaaugu

SEQ ID NO: 3646908 - RNA, 12 nt, Salmonella enterica enterica serovar Typhi
aaauucuuuuca

SEQ ID NO: 3646909 - RNA, 23 nt, Salmonella enterica enterica serovar Typhi
aaauugaauuaagcaauccauuu

SEQ ID NO: 3646910 - RNA, 14 nt, Salmonella enterica enterica serovar Typhi
aaauugaauuauaa

SEQ ID NO: 3646911 - RNA, 19 nt, Salmonella enterica enterica serovar Typhi
aaauugaauuauaauaaag

SEQ ID NO: 3646912 - RNA, 22 nt, Salmonella enterica enterica serovar Typhi
aaauugaccucacgcuuaucgc

SEQ ID NO: 3646913 - RNA, 18 nt, Salmonella enterica enterica serovar Typhi
aaauugagaauuauucgu

SEQ ID NO: 3646914 - RNA, 12 nt, Salmonella enterica enterica serovar Typhi
aaauugcagggu

SEQ ID NO: 3646915 - RNA, 24 nt, Salmonella enterica enterica serovar Typhi
aaauugccacgaacgauauaaaaa

SEQ ID NO: 3646916 - RNA, 16 nt, Salmonella enterica enterica serovar Typhi
aaauugccugauggcg

SEQ ID NO: 3646917 - RNA, 23 nt, Salmonella enterica enterica serovar Typhi
aaauugccugauggcgcugcgcu

SEQ ID NO: 3646918 - RNA, 17 nt, Salmonella enterica enterica serovar Typhi
aaauuggaguuaucauu

SEQ ID NO: 3646919 - RNA, 17 nt, Salmonella enterica enterica serovar Typhi
aaauuggcucagaauuu

SEQ ID NO: 3646920 - RNA, 16 nt, Salmonella enterica enterica serovar Typhi
aaauuuaauauaugaa

SEQ ID NO: 3646921 - RNA, 19 nt, Salmonella enterica enterica serovar Typhi
aaauuuagcuauuccaaaa

SEQ ID NO: 3646922 - RNA, 21 nt, Salmonella enterica enterica serovar Typhi
aacaggccugcggaaaaaguc

SEQ ID NO: 3646923 - RNA, 13 nt, Salmonella enterica enterica serovar Typhi
aacaggcgaaaac

SEQ ID NO: 3646924 - RNA, 19 nt, Salmonella enterica enterica serovar Typhi
aacaggcuuuauacaguaa

SEQ ID NO: 3646925 - RNA, 19 nt, Salmonella enterica enterica serovar Typhi
aacaggcuuuucaggcugu

SEQ ID NO: 3646926 - RNA, 20 nt, Salmonella enterica enterica serovar Typhi
aacagggcggccuccuggcu

SEQ ID NO: 3646927 - RNA, 23 nt, Salmonella enterica enterica serovar Typhi
aacagggugauggugucaaucgc

SEQ ID NO: 3646928 - RNA, 13 nt, Salmonella enterica enterica serovar Typhi
aacaggucacaug

SEQ ID NO: 3646929 - RNA, 15 nt, Salmonella enterica enterica serovar Typhi
aacaguaccugauaa

SEQ ID NO: 3646930 - RNA, 18 nt, Salmonella enterica enterica serovar Typhi
aacaguaccugauaaaau

SEQ ID NO: 3646931 - RNA, 19 nt, Salmonella enterica enterica serovar Typhi
aacaguaccugauaaaauu

SEQ ID NO: 3646932 - RNA, 23 nt, Salmonella enterica enterica serovar Typhi
aacagucccaccagcgcggcaca

SEQ ID NO: 3646933 - RNA, 23 nt, Salmonella enterica enterica serovar Typhi
aacagugauuacaaaaugugcaa

SEQ ID NO: 3646934 - RNA, 22 nt, Salmonella enterica enterica serovar Typhi
aacagugggcuaugaagagaaa

SEQ ID NO: 3646935 - RNA, 17 nt, Salmonella enterica enterica serovar Typhi
aacaguguaaacgccag

SEQ ID NO: 3646936 - RNA, 21 nt, Salmonella enterica enterica serovar Typhi
aacaguguaaacgccagauaa

SEQ ID NO: 3646937 - RNA, 19 nt, Salmonella enterica enterica serovar Typhi
aacaguucaaacggcccgg

SEQ ID NO: 3646938 - RNA, 13 nt, Salmonella enterica enterica serovar Typhi
aacaguucagaca

SEQ ID NO: 3646939 - RNA, 22 nt, Salmonella enterica enterica serovar Typhi
aacaguucauuucaggcaaagg

SEQ ID NO: 3646940 - RNA, 16 nt, Salmonella enterica enterica serovar Typhi
aacaguuuuuccuuuc

SEQ ID NO: 3646941 - RNA, 23 nt, Salmonella enterica enterica serovar Typhi
aacauacgggcaugaagaaaaua

SEQ ID NO: 3646942 - RNA, 18 nt, Salmonella enterica enterica serovar Typhi
aacauagcggcaaggaaa

SEQ ID NO: 3646943 - RNA, 23 nt, Salmonella enterica enterica serovar Typhi
aacauagcggcaaggaaaaccag

SEQ ID NO: 3646944 - RNA, 17 nt, Salmonella enterica enterica serovar Typhi
aacauagcuaaauaaaa

SEQ ID NO: 3646945 - RNA, 20 nt, Salmonella enterica enterica serovar Typhi
aacauauagcaguuuucacu

SEQ ID NO: 3646946 - RNA, 12 nt, Salmonella enterica enterica serovar Typhi
aacauauuuuua

SEQ ID NO: 3646947 - RNA, 13 nt, Salmonella enterica enterica serovar Typhi
aacauauuuuuau

SEQ ID NO: 3646948 - RNA, 19 nt, Salmonella enterica enterica serovar Typhi
aacauauuuuucacacaua

SEQ ID NO: 3646949 - RNA, 16 nt, Salmonella enterica enterica serovar Typhi
aacaucaccuuucauu

SEQ ID NO: 3646950 - RNA, 18 nt, Salmonella enterica enterica serovar Typhi
aacaucagccagcagcuc

SEQ ID NO: 3646951 - RNA, 14 nt, Salmonella enterica enterica serovar Typhi
aacaucagcgcuac

SEQ ID NO: 3646952 - RNA, 15 nt, Salmonella enterica enterica serovar Typhi
aacaucagcgcuacc

SEQ ID NO: 3646953 - RNA, 20 nt, Salmonella enterica enterica serovar Typhi
aacaucagcgcuaccagcgc

SEQ ID NO: 3646954 - RNA, 19 nt, Salmonella enterica enterica serovar Typhi
aacaucaucaggccugacu

SEQ ID NO: 3646955 - RNA, 22 nt, Salmonella enterica enterica serovar Typhi
aacaucauucccguaucuucau

SEQ ID NO: 3646956 - RNA, 20 nt, Salmonella enterica enterica serovar Typhi
aacauccccgcuugcagcgu

SEQ ID NO: 3646957 - RNA, 14 nt, Salmonella enterica enterica serovar Typhi
aacauccucuccug

SEQ ID NO: 3646958 - RNA, 18 nt, Salmonella enterica enterica serovar Typhi
aacauccucuccugaagc

SEQ ID NO: 3646959 - RNA, 17 nt, Salmonella enterica enterica serovar Typhi
aacaucgcaaaauuccg

SEQ ID NO: 3646960 - RNA, 15 nt, Salmonella enterica enterica serovar Typhi
aacaucguaaaucaa

SEQ ID NO: 3646961 - RNA, 16 nt, Salmonella enterica enterica serovar Typhi
aacaucguaaaucaaa

SEQ ID NO: 3646962 - RNA, 22 nt, Salmonella enterica enterica serovar Typhi
aacaucugcguugcgcgcguca

SEQ ID NO: 3646963 - RNA, 18 nt, Salmonella enterica enterica serovar Typhi
aacaucuuccaugccuuc

SEQ ID NO: 3646964 - RNA, 14 nt, Salmonella enterica enterica serovar Typhi
aacaugaccagcgc

SEQ ID NO: 3646965 - RNA, 16 nt, Salmonella enterica enterica serovar Typhi
aacaugaccagcgcaa

SEQ ID NO: 3646966 - RNA, 14 nt, Salmonella enterica enterica serovar Typhi
aacaugcccaguuu

SEQ ID NO: 3646967 - RNA, 17 nt, Salmonella enterica enterica serovar Typhi
aacauggauucgcugga

SEQ ID NO: 3646968 - RNA, 14 nt, Salmonella enterica enterica serovar Typhi
aacauggggagcag

SEQ ID NO: 3646969 - RNA, 16 nt, Salmonella enterica enterica serovar Typhi
aacauggggagcagca

SEQ ID NO: 3646970 - RNA, 19 nt, Salmonella enterica enterica serovar Typhi
aacauuacaauguacagaa

SEQ ID NO: 3646971 - RNA, 13 nt, Salmonella enterica enterica serovar Typhi
aacauuacugacc

SEQ ID NO: 3646972 - RNA, 18 nt, Salmonella enterica enterica serovar Typhi
aacauuauuaaaaugucu

SEQ ID NO: 3646973 - RNA, 12 nt, Salmonella enterica enterica serovar Typhi
aacauuccgcuu

SEQ ID NO: 3646974 - RNA, 21 nt, Salmonella enterica enterica serovar Typhi
aacauuggaaaacuccagcag

SEQ ID NO: 3646975 - RNA, 14 nt, Salmonella enterica enterica serovar Typhi
aaccaaaaaauaug

SEQ ID NO: 3646976 - RNA, 16 nt, Salmonella enterica enterica serovar Typhi
aaccaacgcauaaaaa

SEQ ID NO: 3646977 - RNA, 12 nt, Salmonella enterica enterica serovar Typhi
aaccaaugcagc

SEQ ID NO: 3646978 - RNA, 15 nt, Salmonella enterica enterica serovar Typhi
aaccacaaguuuauc

SEQ ID NO: 3646979 - RNA, 15 nt, Salmonella enterica enterica serovar Typhi
aaccacagugaugac

SEQ ID NO: 3646980 - RNA, 13 nt, Salmonella enterica enterica serovar Typhi
aaccaccagcagu

SEQ ID NO: 3646981 - RNA, 19 nt, Salmonella enterica enterica serovar Typhi
aaccaccagcggaaucccc

SEQ ID NO: 3646982 - RNA, 10 nt, Salmonella enterica enterica serovar Typhi
aaccacgcca

SEQ ID NO: 3646983 - RNA, 20 nt, Salmonella enterica enterica serovar Typhi
aaccacgccauggccgcagc

SEQ ID NO: 3646984 - RNA, 20 nt, Salmonella enterica enterica serovar Typhi
aaccacggagagacaguuca

SEQ ID NO: 3646985 - RNA, 19 nt, Salmonella enterica enterica serovar Typhi
aaccacggauaagccagcc

SEQ ID NO: 3646986 - RNA, 22 nt, Salmonella enterica enterica serovar Typhi
aaccacuuugggccgaaggaag

SEQ ID NO: 3646987 - RNA, 23 nt, Salmonella enterica enterica serovar Typhi
aaccagaguccggcgccugaaua

SEQ ID NO: 3646988 - RNA, 17 nt, Salmonella enterica enterica serovar Typhi
aaccagcaaugagacaa

SEQ ID NO: 3646989 - RNA, 18 nt, Salmonella enterica enterica serovar Typhi
aaccagcccaugaaggag

SEQ ID NO: 3646990 - RNA, 12 nt, Salmonella enterica enterica serovar Typhi
aaccagccgauc

SEQ ID NO: 3646991 - RNA, 16 nt, Salmonella enterica enterica serovar Typhi
aaccagcgaaaugacg

SEQ ID NO: 3646992 - RNA, 20 nt, Salmonella enterica enterica serovar Typhi
aaccagcgcgccgccaacgc

SEQ ID NO: 3646993 - RNA, 17 nt, Salmonella enterica enterica serovar Typhi
aaccagcgcggccagaa

SEQ ID NO: 3646994 - RNA, 15 nt, Salmonella enterica enterica serovar Typhi
aaccagcuauccagu

SEQ ID NO: 3646995 - RNA, 14 nt, Salmonella enterica enterica serovar Typhi
aaccagcuuuucau

SEQ ID NO: 3646996 - RNA, 15 nt, Salmonella enterica enterica serovar Typhi
aaccagcuuuucauu

SEQ ID NO: 3646997 - RNA, 11 nt, Salmonella enterica enterica serovar Typhi
aaccaggcaaa

SEQ ID NO: 3646998 - RNA, 10 nt, Salmonella enterica enterica serovar Typhi
aaccagggag

SEQ ID NO: 3646999 - RNA, 22 nt, Salmonella enterica enterica serovar Typhi
aaccagggucaauacgccguca

SEQ ID NO: 3647000 - RNA, 13 nt, Salmonella enterica enterica serovar Typhi
aaccagguaaucc

SEQ ID NO: 3647001 - RNA, 16 nt, Salmonella enterica enterica serovar Typhi
aaccaguaacggcagu

SEQ ID NO: 3647002 - RNA, 20 nt, Salmonella enterica enterica serovar Typhi
aaccagucguuaucugacau

SEQ ID NO: 3647003 - RNA, 18 nt, Salmonella enterica enterica serovar Typhi
aaccagugaauacugcgc

SEQ ID NO: 3647004 - RNA, 18 nt, Salmonella enterica enterica serovar Typhi
aaccaguugccaggguuc

SEQ ID NO: 3647005 - RNA, 17 nt, Salmonella enterica enterica serovar Typhi
aaccauacauccugauu

SEQ ID NO: 3647006 - RNA, 15 nt, Salmonella enterica enterica serovar Typhi
aaccaucaaaaaaaa

SEQ ID NO: 3647007 - RNA, 18 nt, Salmonella enterica enterica serovar Typhi
aaccaugcgagaucggca

SEQ ID NO: 3647008 - RNA, 18 nt, Salmonella enterica enterica serovar Typhi
aaccuguaggccggauaa

SEQ ID NO: 3647009 - RNA, 15 nt, Salmonella enterica enterica serovar Typhi
aaccuguaucugcug

SEQ ID NO: 3647010 - RNA, 13 nt, Salmonella enterica enterica serovar Typhi
aaccugucaguac

SEQ ID NO: 3647011 - RNA, 22 nt, Salmonella enterica enterica serovar Typhi
aaccuguuaugaaacccgccac

SEQ ID NO: 3647012 - RNA, 20 nt, Salmonella enterica enterica serovar Typhi
aaccuucaagaaucaauaua

SEQ ID NO: 3647013 - RNA, 17 nt, Salmonella enterica enterica serovar Typhi
aaccuucauaaauacgu

SEQ ID NO: 3647014 - RNA, 18 nt, Salmonella enterica enterica serovar Typhi
aaccuuccgccaggcggg

SEQ ID NO: 3647015 - RNA, 15 nt, Salmonella enterica enterica serovar Typhi
aaccuucgcuuuuaa

SEQ ID NO: 3647016 - RNA, 19 nt, Salmonella enterica enterica serovar Typhi
aaccuucgcuuuuaaaacu

SEQ ID NO: 3647017 - RNA, 14 nt, Salmonella enterica enterica serovar Typhi
aaccuuugcugacg

SEQ ID NO: 3647018 - RNA, 22 nt, Salmonella enterica enterica serovar Typhi
aaccuuuuuauggcccgccagc

SEQ ID NO: 3647019 - RNA, 18 nt, Salmonella enterica enterica serovar Typhi
aacgaaacucagcggccc

SEQ ID NO: 3647020 - RNA, 19 nt, Salmonella enterica enterica serovar Typhi
aacgaacugauguuccggc

SEQ ID NO: 3647021 - RNA, 19 nt, Salmonella enterica enterica serovar Typhi
aacgaaucaccucgcuucc

SEQ ID NO: 3647022 - RNA, 13 nt, Salmonella enterica enterica serovar Typhi
aacgaauuuaaau

SEQ ID NO: 3647023 - RNA, 17 nt, Salmonella enterica enterica serovar Typhi
aacgacaaaaauaccac

SEQ ID NO: 3647024 - RNA, 15 nt, Salmonella enterica enterica serovar Typhi
aacgacaaaucugcc

SEQ ID NO: 3647025 - RNA, 17 nt, Salmonella enterica enterica serovar Typhi
aacgacgcauaaaaaau

SEQ ID NO: 3647026 - RNA, 21 nt, Salmonella enterica enterica serovar Typhi
aacgacuacguucaucaggca

SEQ ID NO: 3647027 - RNA, 14 nt, Salmonella enterica enterica serovar Typhi
aacgacucacgcgc

SEQ ID NO: 3647028 - RNA, 22 nt, Salmonella enterica enterica serovar Typhi
aacgagaauggaugugaauaaa

SEQ ID NO: 3647029 - RNA, 13 nt, Salmonella enterica enterica serovar Typhi
aacgagauucaau

SEQ ID NO: 3647030 - RNA, 17 nt, Salmonella enterica enterica serovar Typhi
aacgaggccaccaucac

SEQ ID NO: 3647031 - RNA, 21 nt, Salmonella enterica enterica serovar Typhi
aacgaguugcggcaacgugaa

SEQ ID NO: 3647032 - RNA, 20 nt, Salmonella enterica enterica serovar Typhi
aacgauaauaucgucaccag

SEQ ID NO: 3647033 - RNA, 19 nt, Salmonella enterica enterica serovar Typhi
aacgauacagcacggcagu

SEQ ID NO: 3647034 - RNA, 16 nt, Salmonella enterica enterica serovar Typhi
aacgaucccuaauaaa

SEQ ID NO: 3647035 - RNA, 18 nt, Salmonella enterica enterica serovar Typhi
aacgaucccuaauaaaau

SEQ ID NO: 3647036 - RNA, 17 nt, Salmonella enterica enterica serovar Typhi
aacgaucuggucgccaa

SEQ ID NO: 3647037 - RNA, 15 nt, Salmonella enterica enterica serovar Typhi
aacgaugaccauaaa

SEQ ID NO: 3647038 - RNA, 22 nt, Salmonella enterica enterica serovar Typhi
aacgauguaaaaccuggcacuu

SEQ ID NO: 3647039 - RNA, 15 nt, Salmonella enterica enterica serovar Typhi
aacgcaaagacaccc

SEQ ID NO: 3647040 - RNA, 18 nt, Salmonella enterica enterica serovar Typhi
aacgcacccgcgcaggcg

SEQ ID NO: 3647041 - RNA, 19 nt, Salmonella enterica enterica serovar Typhi
aacgcacguacggaaggua

SEQ ID NO: 3647042 - RNA, 15 nt, Salmonella enterica enterica serovar Typhi
aacgcaggcgauagc

SEQ ID NO: 3647043 - RNA, 13 nt, Salmonella enterica enterica serovar Typhi
aacgcaucacaug

SEQ ID NO: 3647044 - RNA, 18 nt, Salmonella enterica enterica serovar Typhi
aacgcaucacaugcggga

SEQ ID NO: 3647045 - RNA, 14 nt, Salmonella enterica enterica serovar Typhi
aacgcauccagcgc

SEQ ID NO: 3647046 - RNA, 14 nt, Salmonella enterica enterica serovar Typhi
aacgcauccagcgu

SEQ ID NO: 3647047 - RNA, 21 nt, Salmonella enterica enterica serovar Typhi
aacgcaucgcggauggcggca

SEQ ID NO: 3647048 - RNA, 20 nt, Salmonella enterica enterica serovar Typhi
aacgcaucgcugcgcuuaca

SEQ ID NO: 3647049 - RNA, 22 nt, Salmonella enterica enterica serovar Typhi
aacgcaucgcugcgcuuacaca

SEQ ID NO: 3647050 - RNA, 16 nt, Salmonella enterica enterica serovar Typhi
aacgccaagcgcggca

SEQ ID NO: 3647051 - RNA, 23 nt, Salmonella enterica enterica serovar Typhi
aacgccaagcgcggcagcagcuu

SEQ ID NO: 3647052 - RNA, 18 nt, Salmonella enterica enterica serovar Typhi
aacgccaaucacuuuacu

SEQ ID NO: 3647053 - RNA, 22 nt, Salmonella enterica enterica serovar Typhi
aacgccaggccguugugucccu

SEQ ID NO: 3647054 - RNA, 15 nt, Salmonella enterica enterica serovar Typhi
aacgccagugccugg

SEQ ID NO: 3647055 - RNA, 17 nt, Salmonella enterica enterica serovar Typhi
aacgccaucagcaaaau

SEQ ID NO: 3647056 - RNA, 22 nt, Salmonella enterica enterica serovar Typhi
aacgccaugcucauccaacugc

SEQ ID NO: 3647057 - RNA, 17 nt, Salmonella enterica enterica serovar Typhi
aacgccauugcgaacau

SEQ ID NO: 3647058 - RNA, 18 nt, Salmonella enterica enterica serovar Typhi
aacgcccccugccagcgc

SEQ ID NO: 3647059 - RNA, 20 nt, Salmonella enterica enterica serovar Typhi
aacgcccgauagcguaaaga

SEQ ID NO: 3647060 - RNA, 20 nt, Salmonella enterica enterica serovar Typhi
aacgcccucaaguaaaaugc

SEQ ID NO: 3647061 - RNA, 14 nt, Salmonella enterica enterica serovar Typhi
aacgccgaagccag

SEQ ID NO: 3647062 - RNA, 15 nt, Salmonella enterica enterica serovar Typhi
aacgccgaagccagc

SEQ ID NO: 3647063 - RNA, 16 nt, Salmonella enterica enterica serovar Typhi
aacgccgaagccagcg

SEQ ID NO: 3647064 - RNA, 20 nt, Salmonella enterica enterica serovar Typhi
aacgccgaccacuucaacgc

SEQ ID NO: 3647065 - RNA, 23 nt, Salmonella enterica enterica serovar Typhi
aacgccgcgcaaagcaauaccac

SEQ ID NO: 3647066 - RNA, 16 nt, Salmonella enterica enterica serovar Typhi
aacgccgcgcguaaau

SEQ ID NO: 3647067 - RNA, 14 nt, Salmonella enterica enterica serovar Typhi
aacgccgcguucgc

SEQ ID NO: 3647068 - RNA, 20 nt, Salmonella enterica enterica serovar Typhi
aacgccgcuuuaccgccuuc

SEQ ID NO: 3647069 - RNA, 17 nt, Salmonella enterica enterica serovar Typhi
aacgccggauuccagaa

SEQ ID NO: 3647070 - RNA, 15 nt, Salmonella enterica enterica serovar Typhi
aacgccgggccugcc

SEQ ID NO: 3647071 - RNA, 18 nt, Salmonella enterica enterica serovar Typhi
aacgccgguuccaacagc

SEQ ID NO: 3647072 - RNA, 19 nt, Salmonella enterica enterica serovar Typhi
aacgccguacuccagccca

SEQ ID NO: 3647073 - RNA, 22 nt, Salmonella enterica enterica serovar Typhi
aacgccgucacaaagcccaccg

SEQ ID NO: 3647074 - RNA, 17 nt, Salmonella enterica enterica serovar Typhi
aacgccguuaccagcau

SEQ ID NO: 3647075 - RNA, 18 nt, Salmonella enterica enterica serovar Typhi
aacgccguuaccagcauc

SEQ ID NO: 3647076 - RNA, 14 nt, Salmonella enterica enterica serovar Typhi
aacgccugauccgg

SEQ ID NO: 3647077 - RNA, 16 nt, Salmonella enterica enterica serovar Typhi
aacgccugauccggcc

SEQ ID NO: 3647078 - RNA, 18 nt, Salmonella enterica enterica serovar Typhi
aacgccugaugcugcgca

SEQ ID NO: 3647079 - RNA, 20 nt, Salmonella enterica enterica serovar Typhi
aacgccugcuccguccacgc

SEQ ID NO: 3647080 - RNA, 12 nt, Salmonella enterica enterica serovar Typhi
aacgccuggcgc

SEQ ID NO: 3647081 - RNA, 20 nt, Salmonella enterica enterica serovar Typhi
aacgccuuauccggccuaca

SEQ ID NO: 3647082 - RNA, 14 nt, Salmonella enterica enterica serovar Typhi
aacgccuucguccg

SEQ ID NO: 3647083 - RNA, 13 nt, Salmonella enterica enterica serovar Typhi
aacgcgaaaauac

SEQ ID NO: 3647084 - RNA, 21 nt, Salmonella enterica enterica serovar Typhi
aacgcgaaaauaccccagcgc

SEQ ID NO: 3647085 - RNA, 17 nt, Salmonella enterica enterica serovar Typhi
aacgcgaauccgccaua

SEQ ID NO: 3647086 - RNA, 13 nt, Salmonella enterica enterica serovar Typhi
aacgcgacaacgc

SEQ ID NO: 3647087 - RNA, 18 nt, Salmonella enterica enterica serovar Typhi
aacgcgaccagcgcgcca

SEQ ID NO: 3647088 - RNA, 19 nt, Salmonella enterica enterica serovar Typhi
aacgcgagaagaagaauua

SEQ ID NO: 3647089 - RNA, 14 nt, Salmonella enterica enterica serovar Typhi
aacgcgagaagccc

SEQ ID NO: 3647090 - RNA, 22 nt, Salmonella enterica enterica serovar Typhi
aacgcgagugucauccugcgca

SEQ ID NO: 3647091 - RNA, 14 nt, Salmonella enterica enterica serovar Typhi
aacgcgaugccugg

SEQ ID NO: 3647092 - RNA, 14 nt, Salmonella enterica enterica serovar Typhi
aacgcgcaaaacuc

SEQ ID NO: 3647093 - RNA, 18 nt, Salmonella enterica enterica serovar Typhi
aacgcgcaucaacgccag

SEQ ID NO: 3647094 - RNA, 16 nt, Salmonella enterica enterica serovar Typhi
aagaacguucaugcgu

SEQ ID NO: 3647095 - RNA, 22 nt, Salmonella enterica enterica serovar Typhi
aagaacugcaaauaccacauca

SEQ ID NO: 3647096 - RNA, 19 nt, Salmonella enterica enterica serovar Typhi
aagaacuggaugacgaaua

SEQ ID NO: 3647097 - RNA, 19 nt, Salmonella enterica enterica serovar Typhi
aagaacuuccccaucagga

SEQ ID NO: 3647098 - RNA, 12 nt, Salmonella enterica enterica serovar Typhi
aagaagaauuau

SEQ ID NO: 3647099 - RNA, 19 nt, Salmonella enterica enterica serovar Typhi
aagaagaauuauuaucaau

SEQ ID NO: 3647100 - RNA, 15 nt, Salmonella enterica enterica serovar Typhi
aagaagcgcuggaga

SEQ ID NO: 3647101 - RNA, 19 nt, Salmonella enterica enterica serovar Typhi
aagaaguaaacagaaucaa

SEQ ID NO: 3647102 - RNA, 15 nt, Salmonella enterica enterica serovar Typhi
aagaagucugugaga

SEQ ID NO: 3647103 - RNA, 20 nt, Salmonella enterica enterica serovar Typhi
aagaagucugugagaaaagc

SEQ ID NO: 3647104 - RNA, 17 nt, Salmonella enterica enterica serovar Typhi
aagaauacccuuuacac

SEQ ID NO: 3647105 - RNA, 22 nt, Salmonella enterica enterica serovar Typhi
aagaauagccggauaaaauuau

SEQ ID NO: 3647106 - RNA, 22 nt, Salmonella enterica enterica serovar Typhi
aagaauaucggcgucaacguuu

SEQ ID NO: 3647107 - RNA, 12 nt, Salmonella enterica enterica serovar Typhi
aagaauaugaga

SEQ ID NO: 3647108 - RNA, 14 nt, Salmonella enterica enterica serovar Typhi
aagaaucacgccga

SEQ ID NO: 3647109 - RNA, 17 nt, Salmonella enterica enterica serovar Typhi
aagaaucacgccgauga

SEQ ID NO: 3647110 - RNA, 19 nt, Salmonella enterica enterica serovar Typhi
aagaaucuguauaaaauau

SEQ ID NO: 3647111 - RNA, 16 nt, Salmonella enterica enterica serovar Typhi
aagaaugcgcgucagg

SEQ ID NO: 3647112 - RNA, 14 nt, Salmonella enterica enterica serovar Typhi
aagaauuaacaccg

SEQ ID NO: 3647113 - RNA, 22 nt, Salmonella enterica enterica serovar Typhi
aagaauuauuaucaauuucaua

SEQ ID NO: 3647114 - RNA, 22 nt, Salmonella enterica enterica serovar Typhi
aagaauuccgaugaaaaacugg

SEQ ID NO: 3647115 - RNA, 14 nt, Salmonella enterica enterica serovar Typhi
aagaauucgcaaug

SEQ ID NO: 3647116 - RNA, 18 nt, Salmonella enterica enterica serovar Typhi
aagaauuucaaucaucau

SEQ ID NO: 3647117 - RNA, 19 nt, Salmonella enterica enterica serovar Typhi
aagaauuucgcgaauaauc

SEQ ID NO: 3647118 - RNA, 16 nt, Salmonella enterica enterica serovar Typhi
aagaauuugaacucuu

SEQ ID NO: 3647119 - RNA, 17 nt, Salmonella enterica enterica serovar Typhi
aagacaaaagcugguga

SEQ ID NO: 3647120 - RNA, 19 nt, Salmonella enterica enterica serovar Typhi
aagacagaagcugagaaaa

SEQ ID NO: 3647121 - RNA, 12 nt, Salmonella enterica enterica serovar Typhi
aagacagcaggc

SEQ ID NO: 3647122 - RNA, 23 nt, Salmonella enterica enterica serovar Typhi
aagacaugaucuuaccucuccug

SEQ ID NO: 3647123 - RNA, 16 nt, Salmonella enterica enterica serovar Typhi
aagacauggaguucca

SEQ ID NO: 3647124 - RNA, 14 nt, Salmonella enterica enterica serovar Typhi
aagacauucacaua

SEQ ID NO: 3647125 - RNA, 22 nt, Salmonella enterica enterica serovar Typhi
aagaccagauuaaucagcagau

SEQ ID NO: 3647126 - RNA, 11 nt, Salmonella enterica enterica serovar Typhi
aagaccagcau

SEQ ID NO: 3647127 - RNA, 15 nt, Salmonella enterica enterica serovar Typhi
aagaccuccgcccgg

SEQ ID NO: 3647128 - RNA, 22 nt, Salmonella enterica enterica serovar Typhi
aagaccugcuucagguuaagug

SEQ ID NO: 3647129 - RNA, 21 nt, Salmonella enterica enterica serovar Typhi
aagacgaaaaaugaauaccaa

SEQ ID NO: 3647130 - RNA, 19 nt, Salmonella enterica enterica serovar Typhi
aagacgcucgacguccagc

SEQ ID NO: 3647131 - RNA, 22 nt, Salmonella enterica enterica serovar Typhi
aagacggcagcgccauccggca

SEQ ID NO: 3647132 - RNA, 16 nt, Salmonella enterica enterica serovar Typhi
aagacgguaaucagac

SEQ ID NO: 3647133 - RNA, 17 nt, Salmonella enterica enterica serovar Typhi
aagacgguuauuuuuca

SEQ ID NO: 3647134 - RNA, 20 nt, Salmonella enterica enterica serovar Typhi
aagacgguuauuuuucagau

SEQ ID NO: 3647135 - RNA, 20 nt, Salmonella enterica enterica serovar Typhi
aagacgguuucagugauaaa

SEQ ID NO: 3647136 - RNA, 15 nt, Salmonella enterica enterica serovar Typhi
aagacgugccggaag

SEQ ID NO: 3647137 - RNA, 19 nt, Salmonella enterica enterica serovar Typhi
aagacgugccggaagcgau

SEQ ID NO: 3647138 - RNA, 20 nt, Salmonella enterica enterica serovar Typhi
aagacguuuacaccgccauc

SEQ ID NO: 3647139 - RNA, 16 nt, Salmonella enterica enterica serovar Typhi
aagacuccggcagcau

SEQ ID NO: 3647140 - RNA, 13 nt, Salmonella enterica enterica serovar Typhi
aagacuggcaacc

SEQ ID NO: 3647141 - RNA, 15 nt, Salmonella enterica enterica serovar Typhi
aagacuuagcccugg

SEQ ID NO: 3647142 - RNA, 11 nt, Salmonella enterica enterica serovar Typhi
aagagaaaacc

SEQ ID NO: 3647143 - RNA, 16 nt, Salmonella enterica enterica serovar Typhi
aagagaaacauacugu

SEQ ID NO: 3647144 - RNA, 16 nt, Salmonella enterica enterica serovar Typhi
aagagacacgcugacc

SEQ ID NO: 3647145 - RNA, 12 nt, Salmonella enterica enterica serovar Typhi
aagagagcaaca

SEQ ID NO: 3647146 - RNA, 21 nt, Salmonella enterica enterica serovar Typhi
aagagagcaacauaccgcaga

SEQ ID NO: 3647147 - RNA, 23 nt, Salmonella enterica enterica serovar Typhi
aagagagccuuacaggcgcauca

SEQ ID NO: 3647148 - RNA, 14 nt, Salmonella enterica enterica serovar Typhi
aagagagugagaaa

SEQ ID NO: 3647149 - RNA, 19 nt, Salmonella enterica enterica serovar Typhi
aagagcgagucuuuguccg

SEQ ID NO: 3647150 - RNA, 23 nt, Salmonella enterica enterica serovar Typhi
aagagcggcgaguuguuucaaca

SEQ ID NO: 3647151 - RNA, 21 nt, Salmonella enterica enterica serovar Typhi
aagagcguccaguccuguccc

SEQ ID NO: 3647152 - RNA, 15 nt, Salmonella enterica enterica serovar Typhi
aagagcguuacccag

SEQ ID NO: 3647153 - RNA, 12 nt, Salmonella enterica enterica serovar Typhi
aagaggcagcaa

SEQ ID NO: 3647154 - RNA, 15 nt, Salmonella enterica enterica serovar Typhi
aagagguauccugaa

SEQ ID NO: 3647155 - RNA, 20 nt, Salmonella enterica enterica serovar Typhi
aagaguccauucggccugcg

SEQ ID NO: 3647156 - RNA, 15 nt, Salmonella enterica enterica serovar Typhi
aagauaaaaagacag

SEQ ID NO: 3647157 - RNA, 17 nt, Salmonella enterica enterica serovar Typhi
aagauaaaaagacagau

SEQ ID NO: 3647158 - RNA, 18 nt, Salmonella enterica enterica serovar Typhi
aagauaaaaagacagaua

SEQ ID NO: 3647159 - RNA, 12 nt, Salmonella enterica enterica serovar Typhi
aagauaaaaaua

SEQ ID NO: 3647160 - RNA, 12 nt, Salmonella enterica enterica serovar Typhi
aagauaaaauac

SEQ ID NO: 3647161 - RNA, 16 nt, Salmonella enterica enterica serovar Typhi
aagauaaacagcagcg

SEQ ID NO: 3647162 - RNA, 14 nt, Salmonella enterica enterica serovar Typhi
aagauaaagauauu

SEQ ID NO: 3647163 - RNA, 18 nt, Salmonella enterica enterica serovar Typhi
aagauaagcacaugacgg

SEQ ID NO: 3647164 - RNA, 22 nt, Salmonella enterica enterica serovar Typhi
aagauauugucgcccugcaauu

SEQ ID NO: 3647165 - RNA, 12 nt, Salmonella enterica enterica serovar Typhi
aagaucccaggg

SEQ ID NO: 3647166 - RNA, 21 nt, Salmonella enterica enterica serovar Typhi
aagaucgcauuuaaucgccug

SEQ ID NO: 3647167 - RNA, 18 nt, Salmonella enterica enterica serovar Typhi
aagaucgccaagcuguga

SEQ ID NO: 3647168 - RNA, 19 nt, Salmonella enterica enterica serovar Typhi
aagaucgcggggcaacaga

SEQ ID NO: 3647169 - RNA, 17 nt, Salmonella enterica enterica serovar Typhi
aagaucgcguacagcgc

SEQ ID NO: 3647170 - RNA, 20 nt, Salmonella enterica enterica serovar Typhi
aagaucggguggccuaacgc

SEQ ID NO: 3647171 - RNA, 22 nt, Salmonella enterica enterica serovar Typhi
aagaucguuauccagcagccac

SEQ ID NO: 3647172 - RNA, 16 nt, Salmonella enterica enterica serovar Typhi
aagaugaggagcugga

SEQ ID NO: 3647173 - RNA, 22 nt, Salmonella enterica enterica serovar Typhi
aagaugcguaccgcuaucgcca

SEQ ID NO: 3647174 - RNA, 23 nt, Salmonella enterica enterica serovar Typhi
aagaugggucagugcauguacaa

SEQ ID NO: 3647175 - RNA, 11 nt, Salmonella enterica enterica serovar Typhi
aagauguagac

SEQ ID NO: 3647176 - RNA, 15 nt, Salmonella enterica enterica serovar Typhi
aagauguagucgccu

SEQ ID NO: 3647177 - RNA, 16 nt, Salmonella enterica enterica serovar Typhi
aagauuaaccagcagu

SEQ ID NO: 3647178 - RNA, 20 nt, Salmonella enterica enterica serovar Typhi
aagauuaauugauuacaaag

SEQ ID NO: 3647179 - RNA, 22 nt, Salmonella enterica enterica serovar Typhi
aagauuacucucuugccagcgc

SEQ ID NO: 3647180 - RNA, 19 nt, Salmonella enterica enterica serovar Typhi
aagauuagccccagcgcca

SEQ ID NO: 3647181 - RNA, 12 nt, Salmonella enterica enterica serovar Typhi
aagauuccagau

SEQ ID NO: 3647182 - RNA, 18 nt, Salmonella enterica enterica serovar Typhi
aagauuggccgucacuuu

SEQ ID NO: 3647183 - RNA, 13 nt, Salmonella enterica enterica serovar Typhi
aagauuuuucacc

SEQ ID NO: 3647184 - RNA, 23 nt, Salmonella enterica enterica serovar Typhi
aagcaacugggcuugcauugcuu

SEQ ID NO: 3647185 - RNA, 20 nt, Salmonella enterica enterica serovar Typhi
aagcaacuguagaaugcuau

SEQ ID NO: 3647186 - RNA, 20 nt, Salmonella enterica enterica serovar Typhi
aagcaagaggugacucacau

SEQ ID NO: 3647187 - RNA, 19 nt, Salmonella enterica enterica serovar Typhi
aagcaauauggcugcgaua

SEQ ID NO: 3647188 - RNA, 15 nt, Salmonella enterica enterica serovar Typhi
aagcaaucgccagcg

SEQ ID NO: 3647189 - RNA, 16 nt, Salmonella enterica enterica serovar Typhi
aagcaauuaauauuua

SEQ ID NO: 3647190 - RNA, 18 nt, Salmonella enterica enterica serovar Typhi
aagcacauaacugagacu

SEQ ID NO: 3647191 - RNA, 17 nt, Salmonella enterica enterica serovar Typhi
aagcaccgccagcgccg

SEQ ID NO: 3647192 - RNA, 18 nt, Salmonella enterica enterica serovar Typhi
aagcacgccgcuuucugu

SEQ ID NO: 3647193 - RNA, 21 nt, Salmonella enterica enterica serovar Typhi
aagcacgggcuugaauaacau

SEQ ID NO: 3647194 - RNA, 19 nt, Salmonella enterica enterica serovar Typhi
aagcacucguaagaggcgu

SEQ ID NO: 3647195 - RNA, 13 nt, Salmonella enterica enterica serovar Typhi
aagcacugcugcu

SEQ ID NO: 3647196 - RNA, 22 nt, Salmonella enterica enterica serovar Typhi
aagcacugcugcugaaagaaga

SEQ ID NO: 3647197 - RNA, 14 nt, Salmonella enterica enterica serovar Typhi
aagcacuucuccac

SEQ ID NO: 3647198 - RNA, 19 nt, Salmonella enterica enterica serovar Typhi
aagcacuucuccacgcgau

SEQ ID NO: 3647199 - RNA, 19 nt, Salmonella enterica enterica serovar Typhi
aagcagaacguagcccauu

SEQ ID NO: 3647200 - RNA, 20 nt, Salmonella enterica enterica serovar Typhi
aagcagaccaccccacagua

SEQ ID NO: 3647201 - RNA, 15 nt, Salmonella enterica enterica serovar Typhi
aagcagauaccagcc

SEQ ID NO: 3647202 - RNA, 16 nt, Salmonella enterica enterica serovar Typhi
aagcagcauaaugaau

SEQ ID NO: 3647203 - RNA, 15 nt, Salmonella enterica enterica serovar Typhi
aagcagcgacaauau

SEQ ID NO: 3647204 - RNA, 12 nt, Salmonella enterica enterica serovar Typhi
aagcagcugcug

SEQ ID NO: 3647205 - RNA, 20 nt, Salmonella enterica enterica serovar Typhi
aagcagcugcugguaccuuu

SEQ ID NO: 3647206 - RNA, 23 nt, Salmonella enterica enterica serovar Typhi
aagcagcuuaucuuuacgcuugu

SEQ ID NO: 3647207 - RNA, 12 nt, Salmonella enterica enterica serovar Typhi
aagcagcuugcu

SEQ ID NO: 3647208 - RNA, 16 nt, Salmonella enterica enterica serovar Typhi
aagcagcuugcugcuu

SEQ ID NO: 3647209 - RNA, 23 nt, Salmonella enterica enterica serovar Typhi
aagcagguagcgccuuuacuggu

SEQ ID NO: 3647210 - RNA, 13 nt, Salmonella enterica enterica serovar Typhi
aagcagucccgcc

SEQ ID NO: 3647211 - RNA, 15 nt, Salmonella enterica enterica serovar Typhi
aagcagugaaucccc

SEQ ID NO: 3647212 - RNA, 15 nt, Salmonella enterica enterica serovar Typhi
aagcaguuccagcau

SEQ ID NO: 3647213 - RNA, 16 nt, Salmonella enterica enterica serovar Typhi
aagcaguuccagcauc

SEQ ID NO: 3647214 - RNA, 15 nt, Salmonella enterica enterica serovar Typhi
aagcauaaaaagacg

SEQ ID NO: 3647215 - RNA, 15 nt, Salmonella enterica enterica serovar Typhi
aagcaucugauauau

SEQ ID NO: 3647216 - RNA, 20 nt, Salmonella enterica enterica serovar Typhi
aagcauggcguuaaugcgcg

SEQ ID NO: 3647217 - RNA, 18 nt, Salmonella enterica enterica serovar Typhi
aagcauugccguuuucaa

SEQ ID NO: 3647218 - RNA, 15 nt, Salmonella enterica enterica serovar Typhi
aagccaaaauuuuca

SEQ ID NO: 3647219 - RNA, 15 nt, Salmonella enterica enterica serovar Typhi
aagccacaaucugau

SEQ ID NO: 3647220 - RNA, 17 nt, Salmonella enterica enterica serovar Typhi
aagccagacucgcuccc

SEQ ID NO: 3647221 - RNA, 22 nt, Salmonella enterica enterica serovar Typhi
aagccagccaaauagcgccaga

SEQ ID NO: 3647222 - RNA, 17 nt, Salmonella enterica enterica serovar Typhi
aagccaggccgccagca

SEQ ID NO: 3647223 - RNA, 14 nt, Salmonella enterica enterica serovar Typhi
aagccagggaaaug

SEQ ID NO: 3647224 - RNA, 13 nt, Salmonella enterica enterica serovar Typhi
aagccagguuuuc

SEQ ID NO: 3647225 - RNA, 18 nt, Salmonella enterica enterica serovar Typhi
aagcccaacuacacucuu

SEQ ID NO: 3647226 - RNA, 17 nt, Salmonella enterica enterica serovar Typhi
aagccccaugugccuug

SEQ ID NO: 3647227 - RNA, 15 nt, Salmonella enterica enterica serovar Typhi
aagccccccgcacag

SEQ ID NO: 3647228 - RNA, 16 nt, Salmonella enterica enterica serovar Typhi
aagcccggccacagcg

SEQ ID NO: 3647229 - RNA, 19 nt, Salmonella enterica enterica serovar Typhi
aagcccggccacagcgcca

SEQ ID NO: 3647230 - RNA, 19 nt, Salmonella enterica enterica serovar Typhi
aagcccuuucuuuuuuugu

SEQ ID NO: 3647231 - RNA, 18 nt, Salmonella enterica enterica serovar Typhi
aagccgaaaccacagcgg

SEQ ID NO: 3647232 - RNA, 22 nt, Salmonella enterica enterica serovar Typhi
aagccgacccgcaucagaccuc

SEQ ID NO: 3647233 - RNA, 18 nt, Salmonella enterica enterica serovar Typhi
aagccgccaacgccagca

SEQ ID NO: 3647234 - RNA, 19 nt, Salmonella enterica enterica serovar Typhi
aagccgccauccggcauuu

SEQ ID NO: 3647235 - RNA, 20 nt, Salmonella enterica enterica serovar Typhi
aagccgcccugcggacaggc

SEQ ID NO: 3647236 - RNA, 19 nt, Salmonella enterica enterica serovar Typhi
aagccgcguucugucgaua

SEQ ID NO: 3647237 - RNA, 22 nt, Salmonella enterica enterica serovar Typhi
aagccggcggaaaaaagcagca

SEQ ID NO: 3647238 - RNA, 20 nt, Salmonella enterica enterica serovar Typhi
aagccguauuuuauuuuuca

SEQ ID NO: 3647239 - RNA, 22 nt, Salmonella enterica enterica serovar Typhi
aagccguauuuuauuuuucaau

SEQ ID NO: 3647240 - RNA, 20 nt, Salmonella enterica enterica serovar Typhi
aagccguuuuggcagcgccc

SEQ ID NO: 3647241 - RNA, 22 nt, Salmonella enterica enterica serovar Typhi
aagccucuuccgccugauaaaa

SEQ ID NO: 3647242 - RNA, 18 nt, Salmonella enterica enterica serovar Typhi
aagccugagcgcgaggca

SEQ ID NO: 3647243 - RNA, 22 nt, Salmonella enterica enterica serovar Typhi
aagccugauggcgcuucgcuua

SEQ ID NO: 3647244 - RNA, 20 nt, Salmonella enterica enterica serovar Typhi
aagccugcuucaccgcgcca

SEQ ID NO: 3647245 - RNA, 18 nt, Salmonella enterica enterica serovar Typhi
aagccugggucguugacg

SEQ ID NO: 3647246 - RNA, 12 nt, Salmonella enterica enterica serovar Typhi
aagccuuucugu

SEQ ID NO: 3647247 - RNA, 12 nt, Salmonella enterica enterica serovar Typhi
aagcgaaaauaa

SEQ ID NO: 3647248 - RNA, 23 nt, Salmonella enterica enterica serovar Typhi
aagcgaauacuccugcaacagaa

SEQ ID NO: 3647249 - RNA, 14 nt, Salmonella enterica enterica serovar Typhi
aagcgaaugcuguc

SEQ ID NO: 3647250 - RNA, 17 nt, Salmonella enterica enterica serovar Typhi
aagcgaccagcgcgcca

SEQ ID NO: 3647251 - RNA, 13 nt, Salmonella enterica enterica serovar Typhi
aagcgaccuucuc

SEQ ID NO: 3647252 - RNA, 20 nt, Salmonella enterica enterica serovar Typhi
aagcgacgcgcgguugcggc

SEQ ID NO: 3647253 - RNA, 17 nt, Salmonella enterica enterica serovar Typhi
aagcgagguaaaaagcg

SEQ ID NO: 3647254 - RNA, 18 nt, Salmonella enterica enterica serovar Typhi
aagcgauacgucagcggu

SEQ ID NO: 3647255 - RNA, 21 nt, Salmonella enterica enterica serovar Typhi
aagcgauauucaacagcccga

SEQ ID NO: 3647256 - RNA, 18 nt, Salmonella enterica enterica serovar Typhi
aagcgaucaagacaaaag

SEQ ID NO: 3647257 - RNA, 13 nt, Salmonella enterica enterica serovar Typhi
aagcgauccggca

SEQ ID NO: 3647258 - RNA, 18 nt, Salmonella enterica enterica serovar Typhi
aagcgauuuauccaccgc

SEQ ID NO: 3647259 - RNA, 20 nt, Salmonella enterica enterica serovar Typhi
aagcgauuuauccaccgcca

SEQ ID NO: 3647260 - RNA, 21 nt, Salmonella enterica enterica serovar Typhi
aagcgcaaacggaucuuccac

SEQ ID NO: 3647261 - RNA, 17 nt, Salmonella enterica enterica serovar Typhi
aagcgcaaacuuccaca

SEQ ID NO: 3647262 - RNA, 13 nt, Salmonella enterica enterica serovar Typhi
aagcgcagcguca

SEQ ID NO: 3647263 - RNA, 22 nt, Salmonella enterica enterica serovar Typhi
aagcgcaggugcgauacggcuu

SEQ ID NO: 3647264 - RNA, 14 nt, Salmonella enterica enterica serovar Typhi
aagcgcaguguuaa

SEQ ID NO: 3647265 - RNA, 22 nt, Salmonella enterica enterica serovar Typhi
aaggcaaauaugcugucuauug

SEQ ID NO: 3647266 - RNA, 17 nt, Salmonella enterica enterica serovar Typhi
aaggcaccgguuuuuga

SEQ ID NO: 3647267 - RNA, 17 nt, Salmonella enterica enterica serovar Typhi
aaggcacgcuccugcuc

SEQ ID NO: 3647268 - RNA, 18 nt, Salmonella enterica enterica serovar Typhi
aaggcagcgaaagcugcc

SEQ ID NO: 3647269 - RNA, 13 nt, Salmonella enterica enterica serovar Typhi
aaggcaucugcgc

SEQ ID NO: 3647270 - RNA, 14 nt, Salmonella enterica enterica serovar Typhi
aaggcaucugcgca

SEQ ID NO: 3647271 - RNA, 22 nt, Salmonella enterica enterica serovar Typhi
aaggcauuaagucauaccuguu

SEQ ID NO: 3647272 - RNA, 23 nt, Salmonella enterica enterica serovar Typhi
aaggcauuauguuuugaacauau

SEQ ID NO: 3647273 - RNA, 15 nt, Salmonella enterica enterica serovar Typhi
aaggcauucacgcca

SEQ ID NO: 3647274 - RNA, 11 nt, Salmonella enterica enterica serovar Typhi
aaggccagacu

SEQ ID NO: 3647275 - RNA, 22 nt, Salmonella enterica enterica serovar Typhi
aaggccagacucaucgccgcaa

SEQ ID NO: 3647276 - RNA, 14 nt, Salmonella enterica enterica serovar Typhi
aaggccgagcgaag

SEQ ID NO: 3647277 - RNA, 18 nt, Salmonella enterica enterica serovar Typhi
aaggccgauaaagcguuu

SEQ ID NO: 3647278 - RNA, 23 nt, Salmonella enterica enterica serovar Typhi
aaggcgaaaccgcuacccggcac

SEQ ID NO: 3647279 - RNA, 23 nt, Salmonella enterica enterica serovar Typhi
aaggcgacgaugugcauaaccgc

SEQ ID NO: 3647280 - RNA, 12 nt, Salmonella enterica enterica serovar Typhi
aaggcgcagccg

SEQ ID NO: 3647281 - RNA, 16 nt, Salmonella enterica enterica serovar Typhi
aaggcgcagccgccau

SEQ ID NO: 3647282 - RNA, 17 nt, Salmonella enterica enterica serovar Typhi
aaggcgcgauccgccca

SEQ ID NO: 3647283 - RNA, 20 nt, Salmonella enterica enterica serovar Typhi
aaggcgcuugcgccgccauc

SEQ ID NO: 3647284 - RNA, 22 nt, Salmonella enterica enterica serovar Typhi
aaggcgcuugugauaucugacu

SEQ ID NO: 3647285 - RNA, 22 nt, Salmonella enterica enterica serovar Typhi
aaggcgcuuuuggcgucguuaa

SEQ ID NO: 3647286 - RNA, 20 nt, Salmonella enterica enterica serovar Typhi
aaggcggcaaagauaaucug

SEQ ID NO: 3647287 - RNA, 22 nt, Salmonella enterica enterica serovar Typhi
aaggcguaagucguaccggcgc

SEQ ID NO: 3647288 - RNA, 22 nt, Salmonella enterica enterica serovar Typhi
aaggcguucacaccgccgccag

SEQ ID NO: 3647289 - RNA, 20 nt, Salmonella enterica enterica serovar Typhi
aaggcguuuacgccgccauc

SEQ ID NO: 3647290 - RNA, 20 nt, Salmonella enterica enterica serovar Typhi
aaggcguuugcgccgccauc

SEQ ID NO: 3647291 - RNA, 20 nt, Salmonella enterica enterica serovar Typhi
aaggcuaccgggcaaacauu

SEQ ID NO: 3647292 - RNA, 20 nt, Salmonella enterica enterica serovar Typhi
aaggcuaccgguugcguagc

SEQ ID NO: 3647293 - RNA, 18 nt, Salmonella enterica enterica serovar Typhi
aaggcugcgcguuuucau

SEQ ID NO: 3647294 - RNA, 17 nt, Salmonella enterica enterica serovar Typhi
aaggcuggcacguucuc

SEQ ID NO: 3647295 - RNA, 21 nt, Salmonella enterica enterica serovar Typhi
aagggaaaagccauugccgcg

SEQ ID NO: 3647296 - RNA, 22 nt, Salmonella enterica enterica serovar Typhi
aagggaaaagccauugccgcga

SEQ ID NO: 3647297 - RNA, 14 nt, Salmonella enterica enterica serovar Typhi
aagggaccgcgaag

SEQ ID NO: 3647298 - RNA, 17 nt, Salmonella enterica enterica serovar Typhi
aagggaggugcucuccc

SEQ ID NO: 3647299 - RNA, 18 nt, Salmonella enterica enterica serovar Typhi
aagggaggugcucuccca

SEQ ID NO: 3647300 - RNA, 20 nt, Salmonella enterica enterica serovar Typhi
aagggaggugcucucccagc

SEQ ID NO: 3647301 - RNA, 21 nt, Salmonella enterica enterica serovar Typhi
aagggaucgauaauugcucac

SEQ ID NO: 3647302 - RNA, 14 nt, Salmonella enterica enterica serovar Typhi
aagggcaccugggc

SEQ ID NO: 3647303 - RNA, 18 nt, Salmonella enterica enterica serovar Typhi
aaggggauaacaaccagg

SEQ ID NO: 3647304 - RNA, 14 nt, Salmonella enterica enterica serovar Typhi
aagguaauuuucac

SEQ ID NO: 3647305 - RNA, 15 nt, Salmonella enterica enterica serovar Typhi
aagguauccgccaua

SEQ ID NO: 3647306 - RNA, 21 nt, Salmonella enterica enterica serovar Typhi
aaggucacgccggguacauau

SEQ ID NO: 3647307 - RNA, 13 nt, Salmonella enterica enterica serovar Typhi
aagguccagggaa

SEQ ID NO: 3647308 - RNA, 18 nt, Salmonella enterica enterica serovar Typhi
aaggucgacauuuaauga

SEQ ID NO: 3647309 - RNA, 17 nt, Salmonella enterica enterica serovar Typhi
aaggucgcuauccagca

SEQ ID NO: 3647310 - RNA, 23 nt, Salmonella enterica enterica serovar Typhi
aaggucugacaacuauugcugcc

SEQ ID NO: 3647311 - RNA, 15 nt, Salmonella enterica enterica serovar Typhi
aagguuauccgccgg

SEQ ID NO: 3647312 - RNA, 18 nt, Salmonella enterica enterica serovar Typhi
aagguuauccgccggagg

SEQ ID NO: 3647313 - RNA, 14 nt, Salmonella enterica enterica serovar Typhi
aagguugaucagga

SEQ ID NO: 3647314 - RNA, 15 nt, Salmonella enterica enterica serovar Typhi
aagguugaucaggaa

SEQ ID NO: 3647315 - RNA, 17 nt, Salmonella enterica enterica serovar Typhi
aagguuugcugcgucac

SEQ ID NO: 3647316 - RNA, 13 nt, Salmonella enterica enterica serovar Typhi
aaguaaaagccgu

SEQ ID NO: 3647317 - RNA, 18 nt, Salmonella enterica enterica serovar Typhi
aaguaaggaggaaucgcu

SEQ ID NO: 3647318 - RNA, 13 nt, Salmonella enterica enterica serovar Typhi
aaguaaggcauga

SEQ ID NO: 3647319 - RNA, 14 nt, Salmonella enterica enterica serovar Typhi
aaguaauaaaauaa

SEQ ID NO: 3647320 - RNA, 15 nt, Salmonella enterica enterica serovar Typhi
aaguaauaaaauaau

SEQ ID NO: 3647321 - RNA, 21 nt, Salmonella enterica enterica serovar Typhi
aaguaauucuucgaaugucuc

SEQ ID NO: 3647322 - RNA, 19 nt, Salmonella enterica enterica serovar Typhi
aaguaauuuccauauuuau

SEQ ID NO: 3647323 - RNA, 18 nt, Salmonella enterica enterica serovar Typhi
aaguaccaaaacagaaaa

SEQ ID NO: 3647324 - RNA, 22 nt, Salmonella enterica enterica serovar Typhi
aaguaccgugaagaaacggaaa

SEQ ID NO: 3647325 - RNA, 14 nt, Salmonella enterica enterica serovar Typhi
aaguagaucaccag

SEQ ID NO: 3647326 - RNA, 15 nt, Salmonella enterica enterica serovar Typhi
aaguagcguucgccg

SEQ ID NO: 3647327 - RNA, 15 nt, Salmonella enterica enterica serovar Typhi
aaguagcugaaaauc

SEQ ID NO: 3647328 - RNA, 22 nt, Salmonella enterica enterica serovar Typhi
aaguagcugaaaaucaaaucgg

SEQ ID NO: 3647329 - RNA, 12 nt, Salmonella enterica enterica serovar Typhi
aaguauaaagcu

SEQ ID NO: 3647330 - RNA, 16 nt, Salmonella enterica enterica serovar Typhi
aaguauaaucauaccg

SEQ ID NO: 3647331 - RNA, 16 nt, Salmonella enterica enterica serovar Typhi
aagucaaaauaaaauu

SEQ ID NO: 3647332 - RNA, 12 nt, Salmonella enterica enterica serovar Typhi
aagucaaacuga

SEQ ID NO: 3647333 - RNA, 14 nt, Salmonella enterica enterica serovar Typhi
aagucaccaucagu

SEQ ID NO: 3647334 - RNA, 16 nt, Salmonella enterica enterica serovar Typhi
aagucacuuacuuucu

SEQ ID NO: 3647335 - RNA, 12 nt, Salmonella enterica enterica serovar Typhi
aagucagacaag

SEQ ID NO: 3647336 - RNA, 16 nt, Salmonella enterica enterica serovar Typhi
aagucauaccuguucc

SEQ ID NO: 3647337 - RNA, 18 nt, Salmonella enterica enterica serovar Typhi
aagucauaccuguuccuc

SEQ ID NO: 3647338 - RNA, 15 nt, Salmonella enterica enterica serovar Typhi
aagucaucaauugcu

SEQ ID NO: 3647339 - RNA, 18 nt, Salmonella enterica enterica serovar Typhi
aaguccaaguauguuaac

SEQ ID NO: 3647340 - RNA, 16 nt, Salmonella enterica enterica serovar Typhi
aagucccuggcgcgcc

SEQ ID NO: 3647341 - RNA, 18 nt, Salmonella enterica enterica serovar Typhi
aagucccuggcgcgccag

SEQ ID NO: 3647342 - RNA, 17 nt, Salmonella enterica enterica serovar Typhi
aaguccguauuauccac

SEQ ID NO: 3647343 - RNA, 17 nt, Salmonella enterica enterica serovar Typhi
aaguccuaacaccugcc

SEQ ID NO: 3647344 - RNA, 15 nt, Salmonella enterica enterica serovar Typhi
aaguccuucuucccc

SEQ ID NO: 3647345 - RNA, 18 nt, Salmonella enterica enterica serovar Typhi
aagucgaugaaugacgag

SEQ ID NO: 3647346 - RNA, 13 nt, Salmonella enterica enterica serovar Typhi
aagucgcgcauaa

SEQ ID NO: 3647347 - RNA, 18 nt, Salmonella enterica enterica serovar Typhi
aagucggggcguaaaaau

SEQ ID NO: 3647348 - RNA, 18 nt, Salmonella enterica enterica serovar Typhi
aagucucaggagugaaca

SEQ ID NO: 3647349 - RNA, 22 nt, Salmonella enterica enterica serovar Typhi
aagucucagggagaacucaucu

SEQ ID NO: 3647350 - RNA, 18 nt, Salmonella enterica enterica serovar Typhi
aagucugagcgcaaacau

SEQ ID NO: 3647351 - RNA, 17 nt, Salmonella enterica enterica serovar Typhi
aauaauguaaaaaaaua

SEQ ID NO: 3647352 - RNA, 15 nt, Salmonella enterica enterica serovar Typhi
aauaauuaauccaaa

SEQ ID NO: 3647353 - RNA, 23 nt, Salmonella enterica enterica serovar Typhi
aauaauucuuaacccacaagaaa

SEQ ID NO: 3647354 - RNA, 23 nt, Salmonella enterica enterica serovar Typhi
aauaauugcgguggcgcaaaucg

SEQ ID NO: 3647355 - RNA, 15 nt, Salmonella enterica enterica serovar Typhi
aauaauuucuucuuu

SEQ ID NO: 3647356 - RNA, 16 nt, Salmonella enterica enterica serovar Typhi
aauaauuuuagaaaua

SEQ ID NO: 3647357 - RNA, 17 nt, Salmonella enterica enterica serovar Typhi
aauaauuuuagaaauag

SEQ ID NO: 3647358 - RNA, 19 nt, Salmonella enterica enterica serovar Typhi
aauacaauucaacucacua

SEQ ID NO: 3647359 - RNA, 15 nt, Salmonella enterica enterica serovar Typhi
aauacacaaugcuuc

SEQ ID NO: 3647360 - RNA, 17 nt, Salmonella enterica enterica serovar Typhi
aauacaccgccauauau

SEQ ID NO: 3647361 - RNA, 20 nt, Salmonella enterica enterica serovar Typhi
aauacaccgccauauauuua

SEQ ID NO: 3647362 - RNA, 21 nt, Salmonella enterica enterica serovar Typhi
aauacagccagguugccagaa

SEQ ID NO: 3647363 - RNA, 23 nt, Salmonella enterica enterica serovar Typhi
aauacaggguuugucagcauaaa

SEQ ID NO: 3647364 - RNA, 20 nt, Salmonella enterica enterica serovar Typhi
aauacaucgccaccaccagc

SEQ ID NO: 3647365 - RNA, 22 nt, Salmonella enterica enterica serovar Typhi
aauaccaaagugguuccaggcg

SEQ ID NO: 3647366 - RNA, 17 nt, Salmonella enterica enterica serovar Typhi
aauaccaaauauuucuu

SEQ ID NO: 3647367 - RNA, 13 nt, Salmonella enterica enterica serovar Typhi
aauaccaauaaga

SEQ ID NO: 3647368 - RNA, 20 nt, Salmonella enterica enterica serovar Typhi
aauaccaccugccaaagcug

SEQ ID NO: 3647369 - RNA, 19 nt, Salmonella enterica enterica serovar Typhi
aauacccaggccaucagaa

SEQ ID NO: 3647370 - RNA, 18 nt, Salmonella enterica enterica serovar Typhi
aauacccauuucuucuuc

SEQ ID NO: 3647371 - RNA, 22 nt, Salmonella enterica enterica serovar Typhi
aauaccccaggggcauauauua

SEQ ID NO: 3647372 - RNA, 22 nt, Salmonella enterica enterica serovar Typhi
aauacccgacucuuuuuucaga

SEQ ID NO: 3647373 - RNA, 16 nt, Salmonella enterica enterica serovar Typhi
aauaccgcaauaaaca

SEQ ID NO: 3647374 - RNA, 21 nt, Salmonella enterica enterica serovar Typhi
aauaccguggucuccgccugg

SEQ ID NO: 3647375 - RNA, 19 nt, Salmonella enterica enterica serovar Typhi
aauaccuaacucuuccgca

SEQ ID NO: 3647376 - RNA, 22 nt, Salmonella enterica enterica serovar Typhi
aauaccuaacucuuccgcaauc

SEQ ID NO: 3647377 - RNA, 18 nt, Salmonella enterica enterica serovar Typhi
aauaccuuauucagccca

SEQ ID NO: 3647378 - RNA, 20 nt, Salmonella enterica enterica serovar Typhi
aauaccuuauucagcccacg

SEQ ID NO: 3647379 - RNA, 18 nt, Salmonella enterica enterica serovar Typhi
aauacgagugacauuauu

SEQ ID NO: 3647380 - RNA, 19 nt, Salmonella enterica enterica serovar Typhi
aauacgauguacauaggca

SEQ ID NO: 3647381 - RNA, 20 nt, Salmonella enterica enterica serovar Typhi
aauacgccagccgucaugau

SEQ ID NO: 3647382 - RNA, 23 nt, Salmonella enterica enterica serovar Typhi
aauacgcggcacguuuuccaggu

SEQ ID NO: 3647383 - RNA, 18 nt, Salmonella enterica enterica serovar Typhi
aauacgcgucuguagcgc

SEQ ID NO: 3647384 - RNA, 18 nt, Salmonella enterica enterica serovar Typhi
aauacgcuccagcuggcu

SEQ ID NO: 3647385 - RNA, 14 nt, Salmonella enterica enterica serovar Typhi
aauacgcugaacuu

SEQ ID NO: 3647386 - RNA, 17 nt, Salmonella enterica enterica serovar Typhi
aauacggagcaaaaaau

SEQ ID NO: 3647387 - RNA, 23 nt, Salmonella enterica enterica serovar Typhi
aauacgggagagcguauccagca

SEQ ID NO: 3647388 - RNA, 19 nt, Salmonella enterica enterica serovar Typhi
aauacgguaaacagauaag

SEQ ID NO: 3647389 - RNA, 12 nt, Salmonella enterica enterica serovar Typhi
aauacguaaacc

SEQ ID NO: 3647390 - RNA, 20 nt, Salmonella enterica enterica serovar Typhi
aauacgucgugacccacaca

SEQ ID NO: 3647391 - RNA, 18 nt, Salmonella enterica enterica serovar Typhi
aauacgugagcgaaguuc

SEQ ID NO: 3647392 - RNA, 17 nt, Salmonella enterica enterica serovar Typhi
aauacguuuauucuuuu

SEQ ID NO: 3647393 - RNA, 22 nt, Salmonella enterica enterica serovar Typhi
aauacuacugguggaauaaaua

SEQ ID NO: 3647394 - RNA, 15 nt, Salmonella enterica enterica serovar Typhi
aauacucuucacgca

SEQ ID NO: 3647395 - RNA, 14 nt, Salmonella enterica enterica serovar Typhi
aauacugaucaauu

SEQ ID NO: 3647396 - RNA, 18 nt, Salmonella enterica enterica serovar Typhi
aauacugcuuuuccggca

SEQ ID NO: 3647397 - RNA, 15 nt, Salmonella enterica enterica serovar Typhi
aauacuguaagccuc

SEQ ID NO: 3647398 - RNA, 14 nt, Salmonella enterica enterica serovar Typhi
aauacuuaaaccug

SEQ ID NO: 3647399 - RNA, 13 nt, Salmonella enterica enterica serovar Typhi
aauacuuccugcu

SEQ ID NO: 3647400 - RNA, 14 nt, Salmonella enterica enterica serovar Typhi
aauacuuccugcuc

SEQ ID NO: 3647401 - RNA, 18 nt, Salmonella enterica enterica serovar Typhi
aauacuucgcucucuuuu

SEQ ID NO: 3647402 - RNA, 15 nt, Salmonella enterica enterica serovar Typhi
aauacuuuccagcug

SEQ ID NO: 3647403 - RNA, 13 nt, Salmonella enterica enterica serovar Typhi
aauacuuuuuuag

SEQ ID NO: 3647404 - RNA, 12 nt, Salmonella enterica enterica serovar Typhi
aauagaaaauaa

SEQ ID NO: 3647405 - RNA, 21 nt, Salmonella enterica enterica serovar Typhi
aauagacaacaucccagaaaa

SEQ ID NO: 3647406 - RNA, 14 nt, Salmonella enterica enterica serovar Typhi
aauagacagugauu

SEQ ID NO: 3647407 - RNA, 21 nt, Salmonella enterica enterica serovar Typhi
aauagacuucacuuucccgga

SEQ ID NO: 3647408 - RNA, 19 nt, Salmonella enterica enterica serovar Typhi
aauagagaaaauaacaaua

SEQ ID NO: 3647409 - RNA, 17 nt, Salmonella enterica enterica serovar Typhi
aauagagaaaucaacga

SEQ ID NO: 3647410 - RNA, 23 nt, Salmonella enterica enterica serovar Typhi
aauagagagcgacagcccggcgu

SEQ ID NO: 3647411 - RNA, 20 nt, Salmonella enterica enterica serovar Typhi
aauagagcaguuaauaauga

SEQ ID NO: 3647412 - RNA, 22 nt, Salmonella enterica enterica serovar Typhi
aauagagcaguuaauaaugaac

SEQ ID NO: 3647413 - RNA, 16 nt, Salmonella enterica enterica serovar Typhi
aauagaggaaauaaca

SEQ ID NO: 3647414 - RNA, 17 nt, Salmonella enterica enterica serovar Typhi
aauagaggaaauaacau

SEQ ID NO: 3647415 - RNA, 20 nt, Salmonella enterica enterica serovar Typhi
aauagaugcgucgcauccuu

SEQ ID NO: 3647416 - RNA, 15 nt, Salmonella enterica enterica serovar Typhi
aauagcagcguuuug

SEQ ID NO: 3647417 - RNA, 15 nt, Salmonella enterica enterica serovar Typhi
aauagcauuaagcug

SEQ ID NO: 3647418 - RNA, 21 nt, Salmonella enterica enterica serovar Typhi
aauagccagaaugccagcgcc

SEQ ID NO: 3647419 - RNA, 12 nt, Salmonella enterica enterica serovar Typhi
aauagccagaca

SEQ ID NO: 3647420 - RNA, 16 nt, Salmonella enterica enterica serovar Typhi
aauagccagccccaga

SEQ ID NO: 3647421 - RNA, 19 nt, Salmonella enterica enterica serovar Typhi
aauagccagccccagaaaa

SEQ ID NO: 3647422 - RNA, 18 nt, Salmonella enterica enterica serovar Typhi
aauagccccggucaacgc

SEQ ID NO: 3647423 - RNA, 14 nt, Salmonella enterica enterica serovar Typhi
aauagccggauaaa

SEQ ID NO: 3647424 - RNA, 22 nt, Salmonella enterica enterica serovar Typhi
aauagcgaacaguccaugauga

SEQ ID NO: 3647425 - RNA, 15 nt, Salmonella enterica enterica serovar Typhi
aauagcgccauccug

SEQ ID NO: 3647426 - RNA, 11 nt, Salmonella enterica enterica serovar Typhi
aauagcgcugc

SEQ ID NO: 3647427 - RNA, 20 nt, Salmonella enterica enterica serovar Typhi
aauagcgcuggcgccgcaaa

SEQ ID NO: 3647428 - RNA, 13 nt, Salmonella enterica enterica serovar Typhi
aauagcggcacag

SEQ ID NO: 3647429 - RNA, 14 nt, Salmonella enterica enterica serovar Typhi
aauagcggcacaga

SEQ ID NO: 3647430 - RNA, 17 nt, Salmonella enterica enterica serovar Typhi
aauagcggcacagauac

SEQ ID NO: 3647431 - RNA, 15 nt, Salmonella enterica enterica serovar Typhi
aauagcggcuaauca

SEQ ID NO: 3647432 - RNA, 12 nt, Salmonella enterica enterica serovar Typhi
aauagcugaaaa

SEQ ID NO: 3647433 - RNA, 17 nt, Salmonella enterica enterica serovar Typhi
aauagcuggcugucuuc

SEQ ID NO: 3647434 - RNA, 20 nt, Salmonella enterica enterica serovar Typhi
aauagcuuuuuacucagggc

SEQ ID NO: 3647435 - RNA, 13 nt, Salmonella enterica enterica serovar Typhi
aauaggauggcgc

SEQ ID NO: 3647436 - RNA, 16 nt, Salmonella enterica enterica serovar Typhi
aaucacaaagccgucg

SEQ ID NO: 3647437 - RNA, 17 nt, Salmonella enterica enterica serovar Typhi
aaucacaacguaaucau

SEQ ID NO: 3647438 - RNA, 18 nt, Salmonella enterica enterica serovar Typhi
aaucacagggggaacauu

SEQ ID NO: 3647439 - RNA, 15 nt, Salmonella enterica enterica serovar Typhi
aaucacaucauuaaa

SEQ ID NO: 3647440 - RNA, 13 nt, Salmonella enterica enterica serovar Typhi
aaucacauccgcc

SEQ ID NO: 3647441 - RNA, 20 nt, Salmonella enterica enterica serovar Typhi
aaucaccacguaacucggca

SEQ ID NO: 3647442 - RNA, 13 nt, Salmonella enterica enterica serovar Typhi
aaucaccagcgca

SEQ ID NO: 3647443 - RNA, 22 nt, Salmonella enterica enterica serovar Typhi
aaucacccagaugcgaaucuuc

SEQ ID NO: 3647444 - RNA, 15 nt, Salmonella enterica enterica serovar Typhi
aaucaccccaagcaa

SEQ ID NO: 3647445 - RNA, 17 nt, Salmonella enterica enterica serovar Typhi
aaucaccgacagcaccg

SEQ ID NO: 3647446 - RNA, 12 nt, Salmonella enterica enterica serovar Typhi
aaucaccgccag

SEQ ID NO: 3647447 - RNA, 21 nt, Salmonella enterica enterica serovar Typhi
aaucaccguuguggcgaccag

SEQ ID NO: 3647448 - RNA, 22 nt, Salmonella enterica enterica serovar Typhi
aaucaccuuacgcucgcugaug

SEQ ID NO: 3647449 - RNA, 23 nt, Salmonella enterica enterica serovar Typhi
aaucaccuuuacuuaauucugcu

SEQ ID NO: 3647450 - RNA, 21 nt, Salmonella enterica enterica serovar Typhi
aaucacgcccgcagcaauaga

SEQ ID NO: 3647451 - RNA, 15 nt, Salmonella enterica enterica serovar Typhi
aaucacgccgaugac

SEQ ID NO: 3647452 - RNA, 20 nt, Salmonella enterica enterica serovar Typhi
aaucacguuuacuaaaacgg

SEQ ID NO: 3647453 - RNA, 20 nt, Salmonella enterica enterica serovar Typhi
aaucacguuuugcagcgcca

SEQ ID NO: 3647454 - RNA, 15 nt, Salmonella enterica enterica serovar Typhi
aaucacuacggguuu

SEQ ID NO: 3647455 - RNA, 16 nt, Salmonella enterica enterica serovar Typhi
aaucacuuaucaaacc

SEQ ID NO: 3647456 - RNA, 13 nt, Salmonella enterica enterica serovar Typhi
aaucacuuccgcc

SEQ ID NO: 3647457 - RNA, 14 nt, Salmonella enterica enterica serovar Typhi
aaucagaauaccgc

SEQ ID NO: 3647458 - RNA, 21 nt, Salmonella enterica enterica serovar Typhi
aaucagacuaucuucgauaaa

SEQ ID NO: 3647459 - RNA, 18 nt, Salmonella enterica enterica serovar Typhi
aaucagagacaaauacau

SEQ ID NO: 3647460 - RNA, 13 nt, Salmonella enterica enterica serovar Typhi
aaucagaugcuca

SEQ ID NO: 3647461 - RNA, 21 nt, Salmonella enterica enterica serovar Typhi
aaucagauugccacaggacca

SEQ ID NO: 3647462 - RNA, 18 nt, Salmonella enterica enterica serovar Typhi
aaucagcaauuuuguuaa

SEQ ID NO: 3647463 - RNA, 21 nt, Salmonella enterica enterica serovar Typhi
aaucagcagccgggccagacg

SEQ ID NO: 3647464 - RNA, 11 nt, Salmonella enterica enterica serovar Typhi
aaucagcagcg

SEQ ID NO: 3647465 - RNA, 18 nt, Salmonella enterica enterica serovar Typhi
aaucagccacggcaacgc

SEQ ID NO: 3647466 - RNA, 15 nt, Salmonella enterica enterica serovar Typhi
aaucagccgacggcg

SEQ ID NO: 3647467 - RNA, 17 nt, Salmonella enterica enterica serovar Typhi
aaucagccgacggcgau

SEQ ID NO: 3647468 - RNA, 15 nt, Salmonella enterica enterica serovar Typhi
aaucagcgcaauaaa

SEQ ID NO: 3647469 - RNA, 20 nt, Salmonella enterica enterica serovar Typhi
aaucagcgcggcaaggauaa

SEQ ID NO: 3647470 - RNA, 21 nt, Salmonella enterica enterica serovar Typhi
aaucagcgcggcgugaucaaa

SEQ ID NO: 3647471 - RNA, 15 nt, Salmonella enterica enterica serovar Typhi
aaucagcuuugcggc

SEQ ID NO: 3647472 - RNA, 15 nt, Salmonella enterica enterica serovar Typhi
aaucaggacaucaaa

SEQ ID NO: 3647473 - RNA, 17 nt, Salmonella enterica enterica serovar Typhi
aaucaggcauccugccc

SEQ ID NO: 3647474 - RNA, 18 nt, Salmonella enterica enterica serovar Typhi
aaucaguacugcgcccgc

SEQ ID NO: 3647475 - RNA, 14 nt, Salmonella enterica enterica serovar Typhi
aaucagugcugaaa

SEQ ID NO: 3647476 - RNA, 18 nt, Salmonella enterica enterica serovar Typhi
aaucaguggcggcaaaaa

SEQ ID NO: 3647477 - RNA, 22 nt, Salmonella enterica enterica serovar Typhi
aaucaguggcggcaaaaaauau

SEQ ID NO: 3647478 - RNA, 13 nt, Salmonella enterica enterica serovar Typhi
aaucauaccagcg

SEQ ID NO: 3647479 - RNA, 22 nt, Salmonella enterica enterica serovar Typhi
aaucauagcccugauuaaagau

SEQ ID NO: 3647480 - RNA, 14 nt, Salmonella enterica enterica serovar Typhi
aaucaucaaucgcu

SEQ ID NO: 3647481 - RNA, 14 nt, Salmonella enterica enterica serovar Typhi
aaucaucauauccc

SEQ ID NO: 3647482 - RNA, 13 nt, Salmonella enterica enterica serovar Typhi
aaucaucaucagg

SEQ ID NO: 3647483 - RNA, 14 nt, Salmonella enterica enterica serovar Typhi
aaucaucaucaucc

SEQ ID NO: 3647484 - RNA, 23 nt, Salmonella enterica enterica serovar Typhi
aaucaucgaggccaccaaaaauu

SEQ ID NO: 3647485 - RNA, 23 nt, Salmonella enterica enterica serovar Typhi
aaucaucgcgcugauauuuuuac

SEQ ID NO: 3647486 - RNA, 22 nt, Salmonella enterica enterica serovar Typhi
aaucaugaacguuaucggcaua

SEQ ID NO: 3647487 - RNA, 14 nt, Salmonella enterica enterica serovar Typhi
aaucauuaauacac

SEQ ID NO: 3647488 - RNA, 13 nt, Salmonella enterica enterica serovar Typhi
aaucauuaucacu

SEQ ID NO: 3647489 - RNA, 18 nt, Salmonella enterica enterica serovar Typhi
aaucauucgggaugcaua

SEQ ID NO: 3647490 - RNA, 19 nt, Salmonella enterica enterica serovar Typhi
aaucauucgggaugcauaa

SEQ ID NO: 3647491 - RNA, 20 nt, Salmonella enterica enterica serovar Typhi
aaucauucgggaugcauaaa

SEQ ID NO: 3647492 - RNA, 22 nt, Salmonella enterica enterica serovar Typhi
aaucauucuacaaguucaguag

SEQ ID NO: 3647493 - RNA, 18 nt, Salmonella enterica enterica serovar Typhi
aaucauugugguuucccu

SEQ ID NO: 3647494 - RNA, 18 nt, Salmonella enterica enterica serovar Typhi
aaucauuuagucgauggu

SEQ ID NO: 3647495 - RNA, 15 nt, Salmonella enterica enterica serovar Typhi
aaucauuuguacaaa

SEQ ID NO: 3647496 - RNA, 19 nt, Salmonella enterica enterica serovar Typhi
aaucauuuguacaaaaaau

SEQ ID NO: 3647497 - RNA, 16 nt, Salmonella enterica enterica serovar Typhi
aauccacauuccagac

SEQ ID NO: 3647498 - RNA, 12 nt, Salmonella enterica enterica serovar Typhi
aauccaccagcg

SEQ ID NO: 3647499 - RNA, 21 nt, Salmonella enterica enterica serovar Typhi
aauccacggguuacaacugcg

SEQ ID NO: 3647500 - RNA, 20 nt, Salmonella enterica enterica serovar Typhi
aauccagaggguaauuucuu

SEQ ID NO: 3647501 - RNA, 16 nt, Salmonella enterica enterica serovar Typhi
aauccagcgcgcugag

SEQ ID NO: 3647502 - RNA, 15 nt, Salmonella enterica enterica serovar Typhi
aauccagcuacuggc

SEQ ID NO: 3647503 - RNA, 17 nt, Salmonella enterica enterica serovar Typhi
aauccagcuacuggcca

SEQ ID NO: 3647504 - RNA, 16 nt, Salmonella enterica enterica serovar Typhi
aauccaggaauuuucc

SEQ ID NO: 3647505 - RNA, 13 nt, Salmonella enterica enterica serovar Typhi
aauccagguggau

SEQ ID NO: 3647506 - RNA, 23 nt, Salmonella enterica enterica serovar Typhi
aauccaguaaugccauaauuuau

SEQ ID NO: 3647507 - RNA, 12 nt, Salmonella enterica enterica serovar Typhi
aauccaucucag

SEQ ID NO: 3647508 - RNA, 17 nt, Salmonella enterica enterica serovar Typhi
aauccaucucaggccga

SEQ ID NO: 3647509 - RNA, 17 nt, Salmonella enterica enterica serovar Typhi
aauccaugagaagaaaa

SEQ ID NO: 3647510 - RNA, 17 nt, Salmonella enterica enterica serovar Typhi
aaucccaccaauugcca

SEQ ID NO: 3647511 - RNA, 19 nt, Salmonella enterica enterica serovar Typhi
aauccccagcgcuccacca

SEQ ID NO: 3647512 - RNA, 19 nt, Salmonella enterica enterica serovar Typhi
aauccccccuuuuuugcug

SEQ ID NO: 3647513 - RNA, 23 nt, Salmonella enterica enterica serovar Typhi
aaucccccggaucaccggcauuu

SEQ ID NO: 3647514 - RNA, 16 nt, Salmonella enterica enterica serovar Typhi
aauccccgccgccauc

SEQ ID NO: 3647515 - RNA, 17 nt, Salmonella enterica enterica serovar Typhi
aaucccgcguucgcgca

SEQ ID NO: 3647516 - RNA, 19 nt, Salmonella enterica enterica serovar Typhi
aaucccuggcgaauaaaau

SEQ ID NO: 3647517 - RNA, 13 nt, Salmonella enterica enterica serovar Typhi
aaucccuucuuuu

SEQ ID NO: 3647518 - RNA, 20 nt, Salmonella enterica enterica serovar Typhi
aaucccuucuuuuacugccc

SEQ ID NO: 3647519 - RNA, 21 nt, Salmonella enterica enterica serovar Typhi
aauccgagacgguaagaauaa

SEQ ID NO: 3647520 - RNA, 18 nt, Salmonella enterica enterica serovar Typhi
aauccgccggaaacuggc

SEQ ID NO: 3647521 - RNA, 18 nt, Salmonella enterica enterica serovar Typhi
aauccgcuccacauccug

SEQ ID NO: 3647522 - RNA, 20 nt, Salmonella enterica enterica serovar Typhi
aaucuuuuugugcaaucaca

SEQ ID NO: 3647523 - RNA, 14 nt, Salmonella enterica enterica serovar Typhi
aaugaaaaaaaaau

SEQ ID NO: 3647524 - RNA, 22 nt, Salmonella enterica enterica serovar Typhi
aaugaaaugcccauaaagaaau

SEQ ID NO: 3647525 - RNA, 23 nt, Salmonella enterica enterica serovar Typhi
aaugaacaugacgccgaaauaaa

SEQ ID NO: 3647526 - RNA, 16 nt, Salmonella enterica enterica serovar Typhi
aaugaagcauaaaaag

SEQ ID NO: 3647527 - RNA, 22 nt, Salmonella enterica enterica serovar Typhi
aaugaaucaucgguaaaugcuu

SEQ ID NO: 3647528 - RNA, 13 nt, Salmonella enterica enterica serovar Typhi
aaugaaucccccc

SEQ ID NO: 3647529 - RNA, 15 nt, Salmonella enterica enterica serovar Typhi
aaugaauguaggccg

SEQ ID NO: 3647530 - RNA, 22 nt, Salmonella enterica enterica serovar Typhi
aaugaauuauuuuuucaugacu

SEQ ID NO: 3647531 - RNA, 17 nt, Salmonella enterica enterica serovar Typhi
aaugaauugaacuaaaa

SEQ ID NO: 3647532 - RNA, 13 nt, Salmonella enterica enterica serovar Typhi
aaugaccucaaga

SEQ ID NO: 3647533 - RNA, 18 nt, Salmonella enterica enterica serovar Typhi
aaugacgagcagguuacu

SEQ ID NO: 3647534 - RNA, 23 nt, Salmonella enterica enterica serovar Typhi
aaugacgcgcgagaacugcugca

SEQ ID NO: 3647535 - RNA, 20 nt, Salmonella enterica enterica serovar Typhi
aaugacggaccaacaaccca

SEQ ID NO: 3647536 - RNA, 12 nt, Salmonella enterica enterica serovar Typhi
aaugagaccaau

SEQ ID NO: 3647537 - RNA, 13 nt, Salmonella enterica enterica serovar Typhi
aaugagaugcacg

SEQ ID NO: 3647538 - RNA, 15 nt, Salmonella enterica enterica serovar Typhi
aaugagcaucuaccc

SEQ ID NO: 3647539 - RNA, 21 nt, Salmonella enterica enterica serovar Typhi
aaugagugaaaugguugcguu

SEQ ID NO: 3647540 - RNA, 12 nt, Salmonella enterica enterica serovar Typhi
aaugaucagaac

SEQ ID NO: 3647541 - RNA, 19 nt, Salmonella enterica enterica serovar Typhi
aaugaucagaacucacaua

SEQ ID NO: 3647542 - RNA, 20 nt, Salmonella enterica enterica serovar Typhi
aaugaucagaacucacauau

SEQ ID NO: 3647543 - RNA, 19 nt, Salmonella enterica enterica serovar Typhi
aaugaucagcaaaauagug

SEQ ID NO: 3647544 - RNA, 22 nt, Salmonella enterica enterica serovar Typhi
aaugaucgauaucgauaaucaa

SEQ ID NO: 3647545 - RNA, 21 nt, Salmonella enterica enterica serovar Typhi
aaugaucguaugcagccaggc

SEQ ID NO: 3647546 - RNA, 14 nt, Salmonella enterica enterica serovar Typhi
aaugaugacucauu

SEQ ID NO: 3647547 - RNA, 21 nt, Salmonella enterica enterica serovar Typhi
aaugaugacucauuaaaaaaa

SEQ ID NO: 3647548 - RNA, 12 nt, Salmonella enterica enterica serovar Typhi
aaugaugggguc

SEQ ID NO: 3647549 - RNA, 19 nt, Salmonella enterica enterica serovar Typhi
aaugauggggucacagguu

SEQ ID NO: 3647550 - RNA, 22 nt, Salmonella enterica enterica serovar Typhi
aaugaugguagacaggcuggcu

SEQ ID NO: 3647551 - RNA, 12 nt, Salmonella enterica enterica serovar Typhi
aaugauuaaaau

SEQ ID NO: 3647552 - RNA, 18 nt, Salmonella enterica enterica serovar Typhi
aaugauuacggaacaaaa

SEQ ID NO: 3647553 - RNA, 14 nt, Salmonella enterica enterica serovar Typhi
aaugauuaucuuuu

SEQ ID NO: 3647554 - RNA, 23 nt, Salmonella enterica enterica serovar Typhi
aaugauuuuguguauauauugca

SEQ ID NO: 3647555 - RNA, 22 nt, Salmonella enterica enterica serovar Typhi
aaugcacauuagcaauugccau

SEQ ID NO: 3647556 - RNA, 21 nt, Salmonella enterica enterica serovar Typhi
aaugcagcggaauucccacau

SEQ ID NO: 3647557 - RNA, 19 nt, Salmonella enterica enterica serovar Typhi
aaugcagggguguccagau

SEQ ID NO: 3647558 - RNA, 19 nt, Salmonella enterica enterica serovar Typhi
aaugcauggcagauaaacc

SEQ ID NO: 3647559 - RNA, 21 nt, Salmonella enterica enterica serovar Typhi
aaugcauggcagauaaaccac

SEQ ID NO: 3647560 - RNA, 14 nt, Salmonella enterica enterica serovar Typhi
aaugccaaaaaaac

SEQ ID NO: 3647561 - RNA, 16 nt, Salmonella enterica enterica serovar Typhi
aaugccaaaaaaacua

SEQ ID NO: 3647562 - RNA, 16 nt, Salmonella enterica enterica serovar Typhi
aaugccaccagcgcca

SEQ ID NO: 3647563 - RNA, 17 nt, Salmonella enterica enterica serovar Typhi
aaugccacuauagauga

SEQ ID NO: 3647564 - RNA, 19 nt, Salmonella enterica enterica serovar Typhi
aaugccauaauuuauccuc

SEQ ID NO: 3647565 - RNA, 23 nt, Salmonella enterica enterica serovar Typhi
aaugccauauuuuuccagcgccu

SEQ ID NO: 3647566 - RNA, 23 nt, Salmonella enterica enterica serovar Typhi
aaugccaucaucaguaacacccg

SEQ ID NO: 3647567 - RNA, 12 nt, Salmonella enterica enterica serovar Typhi
aaugcccaaaau

SEQ ID NO: 3647568 - RNA, 14 nt, Salmonella enterica enterica serovar Typhi
aaugcccagcgccg

SEQ ID NO: 3647569 - RNA, 16 nt, Salmonella enterica enterica serovar Typhi
aaugcccaggcggcgg

SEQ ID NO: 3647570 - RNA, 15 nt, Salmonella enterica enterica serovar Typhi
aaugcccccucggca

SEQ ID NO: 3647571 - RNA, 21 nt, Salmonella enterica enterica serovar Typhi
aaugcccgucucauuucugga

SEQ ID NO: 3647572 - RNA, 18 nt, Salmonella enterica enterica serovar Typhi
aaugcccucaacgcccug

SEQ ID NO: 3647573 - RNA, 15 nt, Salmonella enterica enterica serovar Typhi
aaugccgacccaccu

SEQ ID NO: 3647574 - RNA, 18 nt, Salmonella enterica enterica serovar Typhi
aaugccgacccaccugac

SEQ ID NO: 3647575 - RNA, 19 nt, Salmonella enterica enterica serovar Typhi
aaugccgcgcuuucaguaa

SEQ ID NO: 3647576 - RNA, 20 nt, Salmonella enterica enterica serovar Typhi
aaugccgcgggaaauaccaa

SEQ ID NO: 3647577 - RNA, 22 nt, Salmonella enterica enterica serovar Typhi
aaugccggacgccaccacgccg

SEQ ID NO: 3647578 - RNA, 15 nt, Salmonella enterica enterica serovar Typhi
aaugccgggcaaaaa

SEQ ID NO: 3647579 - RNA, 13 nt, Salmonella enterica enterica serovar Typhi
aaugccuguuuau

SEQ ID NO: 3647580 - RNA, 16 nt, Salmonella enterica enterica serovar Typhi
aaugccuguuuauauu

SEQ ID NO: 3647581 - RNA, 15 nt, Salmonella enterica enterica serovar Typhi
aaugccuuaccuggc

SEQ ID NO: 3647582 - RNA, 16 nt, Salmonella enterica enterica serovar Typhi
aaugccuuaugcccgg

SEQ ID NO: 3647583 - RNA, 17 nt, Salmonella enterica enterica serovar Typhi
aaugccuuccuguggaa

SEQ ID NO: 3647584 - RNA, 14 nt, Salmonella enterica enterica serovar Typhi
aaugcgaaaaaaag

SEQ ID NO: 3647585 - RNA, 15 nt, Salmonella enterica enterica serovar Typhi
aaugcgacagcgaca

SEQ ID NO: 3647586 - RNA, 13 nt, Salmonella enterica enterica serovar Typhi
aaugcgagcaaaa

SEQ ID NO: 3647587 - RNA, 13 nt, Salmonella enterica enterica serovar Typhi
aaugcgcacgcca

SEQ ID NO: 3647588 - RNA, 15 nt, Salmonella enterica enterica serovar Typhi
aaugcgccccggcgg

SEQ ID NO: 3647589 - RNA, 18 nt, Salmonella enterica enterica serovar Typhi
aaugcgccccggcggcgu

SEQ ID NO: 3647590 - RNA, 17 nt, Salmonella enterica enterica serovar Typhi
aaugcgcgaauaucuuu

SEQ ID NO: 3647591 - RNA, 22 nt, Salmonella enterica enterica serovar Typhi
aaugcgcgcggcuaccggacug

SEQ ID NO: 3647592 - RNA, 15 nt, Salmonella enterica enterica serovar Typhi
aaugcgcgucaggcc

SEQ ID NO: 3647593 - RNA, 21 nt, Salmonella enterica enterica serovar Typhi
aaugcgcgugcgguuuuccug

SEQ ID NO: 3647594 - RNA, 17 nt, Salmonella enterica enterica serovar Typhi
aaugcgcuuuuuuugcc

SEQ ID NO: 3647595 - RNA, 16 nt, Salmonella enterica enterica serovar Typhi
aaugcggccauccugc

SEQ ID NO: 3647596 - RNA, 18 nt, Salmonella enterica enterica serovar Typhi
aaugcggcguguggcugu

SEQ ID NO: 3647597 - RNA, 16 nt, Salmonella enterica enterica serovar Typhi
aaugcgucggcaccau

SEQ ID NO: 3647598 - RNA, 20 nt, Salmonella enterica enterica serovar Typhi
aaugcguuugauuugcgcgu

SEQ ID NO: 3647599 - RNA, 18 nt, Salmonella enterica enterica serovar Typhi
aaugcuccaauaaauauu

SEQ ID NO: 3647600 - RNA, 20 nt, Salmonella enterica enterica serovar Typhi
aaugcugcuuugaugcggca

SEQ ID NO: 3647601 - RNA, 16 nt, Salmonella enterica enterica serovar Typhi
aaugcuggugcaucug

SEQ ID NO: 3647602 - RNA, 18 nt, Salmonella enterica enterica serovar Typhi
aaugcuuagucagccuua

SEQ ID NO: 3647603 - RNA, 14 nt, Salmonella enterica enterica serovar Typhi
aaugcuuuaaaugc

SEQ ID NO: 3647604 - RNA, 14 nt, Salmonella enterica enterica serovar Typhi
aauggaaaauaaua

SEQ ID NO: 3647605 - RNA, 19 nt, Salmonella enterica enterica serovar Typhi
aauggaccagccaggcgau

SEQ ID NO: 3647606 - RNA, 11 nt, Salmonella enterica enterica serovar Typhi
aauggagauga

SEQ ID NO: 3647607 - RNA, 17 nt, Salmonella enterica enterica serovar Typhi
aauggauagagucgaua

SEQ ID NO: 3647608 - RNA, 22 nt, Salmonella enterica enterica serovar Typhi
aauucacguuccauuucagcga

SEQ ID NO: 3647609 - RNA, 23 nt, Salmonella enterica enterica serovar Typhi
aauucacuuccgucauguagcaa

SEQ ID NO: 3647610 - RNA, 21 nt, Salmonella enterica enterica serovar Typhi
aauucagaaaguuacuuucca

SEQ ID NO: 3647611 - RNA, 22 nt, Salmonella enterica enterica serovar Typhi
aauucagcauuaggcguaaaau

SEQ ID NO: 3647612 - RNA, 19 nt, Salmonella enterica enterica serovar Typhi
aauucagcgucgagcaccu

SEQ ID NO: 3647613 - RNA, 15 nt, Salmonella enterica enterica serovar Typhi
aauucauaacaccaa

SEQ ID NO: 3647614 - RNA, 20 nt, Salmonella enterica enterica serovar Typhi
aauucauuacgaaguuuaau

SEQ ID NO: 3647615 - RNA, 14 nt, Salmonella enterica enterica serovar Typhi
aauuccaauauuua

SEQ ID NO: 3647616 - RNA, 15 nt, Salmonella enterica enterica serovar Typhi
aauuccaccaccucg

SEQ ID NO: 3647617 - RNA, 14 nt, Salmonella enterica enterica serovar Typhi
aauuccaggaugac

SEQ ID NO: 3647618 - RNA, 19 nt, Salmonella enterica enterica serovar Typhi
aauuccauuagcauucccu

SEQ ID NO: 3647619 - RNA, 20 nt, Salmonella enterica enterica serovar Typhi
aauucccgcagccagcaaua

SEQ ID NO: 3647620 - RNA, 21 nt, Salmonella enterica enterica serovar Typhi
aauucccgccucggucaguau

SEQ ID NO: 3647621 - RNA, 21 nt, Salmonella enterica enterica serovar Typhi
aauuccgcaggagagccagaa

SEQ ID NO: 3647622 - RNA, 16 nt, Salmonella enterica enterica serovar Typhi
aauuccggagccugug

SEQ ID NO: 3647623 - RNA, 17 nt, Salmonella enterica enterica serovar Typhi
aauuccggcgaaaaacc

SEQ ID NO: 3647624 - RNA, 16 nt, Salmonella enterica enterica serovar Typhi
aauuccugacugcgcg

SEQ ID NO: 3647625 - RNA, 18 nt, Salmonella enterica enterica serovar Typhi
aauuccuucaauuuuacu

SEQ ID NO: 3647626 - RNA, 17 nt, Salmonella enterica enterica serovar Typhi
aauuccuuguuuuaacg

SEQ ID NO: 3647627 - RNA, 21 nt, Salmonella enterica enterica serovar Typhi
aauucgaaauaaagaaaguag

SEQ ID NO: 3647628 - RNA, 22 nt, Salmonella enterica enterica serovar Typhi
aauucguacguuuuuccauuca

SEQ ID NO: 3647629 - RNA, 22 nt, Salmonella enterica enterica serovar Typhi
aauucgucaauaccuaaguuca

SEQ ID NO: 3647630 - RNA, 14 nt, Salmonella enterica enterica serovar Typhi
aauucguccacacg

SEQ ID NO: 3647631 - RNA, 14 nt, Salmonella enterica enterica serovar Typhi
aauucgugugauuu

SEQ ID NO: 3647632 - RNA, 17 nt, Salmonella enterica enterica serovar Typhi
aauucguuaccugcgca

SEQ ID NO: 3647633 - RNA, 21 nt, Salmonella enterica enterica serovar Typhi
aauucucccaaauuuuuuuag

SEQ ID NO: 3647634 - RNA, 19 nt, Salmonella enterica enterica serovar Typhi
aauucugcgcgucaucgcu

SEQ ID NO: 3647635 - RNA, 21 nt, Salmonella enterica enterica serovar Typhi
aauucuguaccaggacgcacc

SEQ ID NO: 3647636 - RNA, 19 nt, Salmonella enterica enterica serovar Typhi
aauucuuaacccacaagaa

SEQ ID NO: 3647637 - RNA, 18 nt, Salmonella enterica enterica serovar Typhi
aauucuucugugauuauc

SEQ ID NO: 3647638 - RNA, 20 nt, Salmonella enterica enterica serovar Typhi
aauucuugcccgcugagugg

SEQ ID NO: 3647639 - RNA, 23 nt, Salmonella enterica enterica serovar Typhi
aauucuuuaauuugugccagcgu

SEQ ID NO: 3647640 - RNA, 23 nt, Salmonella enterica enterica serovar Typhi
aauugaaauacucuuugaacagc

SEQ ID NO: 3647641 - RNA, 20 nt, Salmonella enterica enterica serovar Typhi
aauugacuggauuuuugacu

SEQ ID NO: 3647642 - RNA, 18 nt, Salmonella enterica enterica serovar Typhi
aauugauaauaaccgucu

SEQ ID NO: 3647643 - RNA, 18 nt, Salmonella enterica enterica serovar Typhi
aauugaucacaaaaucau

SEQ ID NO: 3647644 - RNA, 21 nt, Salmonella enterica enterica serovar Typhi
aauugauuagcuuuaauccgu

SEQ ID NO: 3647645 - RNA, 13 nt, Salmonella enterica enterica serovar Typhi
aauugauucugug

SEQ ID NO: 3647646 - RNA, 14 nt, Salmonella enterica enterica serovar Typhi
aauugccagcaggu

SEQ ID NO: 3647647 - RNA, 20 nt, Salmonella enterica enterica serovar Typhi
aauugccugauggcgcugcg

SEQ ID NO: 3647648 - RNA, 17 nt, Salmonella enterica enterica serovar Typhi
aauugcgccaggcccag

SEQ ID NO: 3647649 - RNA, 24 nt, Salmonella enterica enterica serovar Typhi
aauugcgccaggcccagccgcucc

SEQ ID NO: 3647650 - RNA, 20 nt, Salmonella enterica enterica serovar Typhi
aauugcgguagaugaaaauu

SEQ ID NO: 3647651 - RNA, 17 nt, Salmonella enterica enterica serovar Typhi
aauugcgguucugcaua

SEQ ID NO: 3647652 - RNA, 14 nt, Salmonella enterica enterica serovar Typhi
aauugcucugccag

SEQ ID NO: 3647653 - RNA, 13 nt, Salmonella enterica enterica serovar Typhi
aauugguagacgc

SEQ ID NO: 3647654 - RNA, 14 nt, Salmonella enterica enterica serovar Typhi
aauugguuauauua

SEQ ID NO: 3647655 - RNA, 16 nt, Salmonella enterica enterica serovar Typhi
aauuguagcugcgcca

SEQ ID NO: 3647656 - RNA, 18 nt, Salmonella enterica enterica serovar Typhi
aauuguaggcaggaauuc

SEQ ID NO: 3647657 - RNA, 18 nt, Salmonella enterica enterica serovar Typhi
aauugucuuuuuaaccau

SEQ ID NO: 3647658 - RNA, 12 nt, Salmonella enterica enterica serovar Typhi
aauuuaaacgga

SEQ ID NO: 3647659 - RNA, 19 nt, Salmonella enterica enterica serovar Typhi
aauuuaauauaugaaccaa

SEQ ID NO: 3647660 - RNA, 22 nt, Salmonella enterica enterica serovar Typhi
aauuuagcuauuccaaaauaau

SEQ ID NO: 3647661 - RNA, 22 nt, Salmonella enterica enterica serovar Typhi
aauuuaucaacaaauuccggca

SEQ ID NO: 3647662 - RNA, 13 nt, Salmonella enterica enterica serovar Typhi
aauuuaucugcgu

SEQ ID NO: 3647663 - RNA, 12 nt, Salmonella enterica enterica serovar Typhi
aauuuaugauuu

SEQ ID NO: 3647664 - RNA, 20 nt, Salmonella enterica enterica serovar Typhi
aauuuaugguuccugaaaua

SEQ ID NO: 3647665 - RNA, 16 nt, Salmonella enterica enterica serovar Typhi
aauuuauuaacccuuc

SEQ ID NO: 3647666 - RNA, 18 nt, Salmonella enterica enterica serovar Typhi
aauuucagggcuuauuca

SEQ ID NO: 3647667 - RNA, 19 nt, Salmonella enterica enterica serovar Typhi
aauuuccagaaggugaguu

SEQ ID NO: 3647668 - RNA, 19 nt, Salmonella enterica enterica serovar Typhi
aauuucccccacuucugac

SEQ ID NO: 3647669 - RNA, 20 nt, Salmonella enterica enterica serovar Typhi
aauuucccccacuucugaca

SEQ ID NO: 3647670 - RNA, 13 nt, Salmonella enterica enterica serovar Typhi
aauuucgcauaau

SEQ ID NO: 3647671 - RNA, 11 nt, Salmonella enterica enterica serovar Typhi
aauuugacgac

SEQ ID NO: 3647672 - RNA, 9 nt, Salmonella enterica enterica serovar Typhi
aauuugauu

SEQ ID NO: 3647673 - RNA, 21 nt, Salmonella enterica enterica serovar Typhi
aauuugcuuucucgggccugu

SEQ ID NO: 3647674 - RNA, 21 nt, Salmonella enterica enterica serovar Typhi
aauuuguacuucagagcugaa

SEQ ID NO: 3647675 - RNA, 14 nt, Salmonella enterica enterica serovar Typhi
aauuugugagauaa

SEQ ID NO: 3647676 - RNA, 21 nt, Salmonella enterica enterica serovar Typhi
aauuuuacuuucauuccuuua

SEQ ID NO: 3647677 - RNA, 11 nt, Salmonella enterica enterica serovar Typhi
aauuuugauaa

SEQ ID NO: 3647678 - RNA, 20 nt, Salmonella enterica enterica serovar Typhi
aauuuugauaagagaaaaua

SEQ ID NO: 3647679 - RNA, 19 nt, Salmonella enterica enterica serovar Typhi
aauuuugcaccaucaacgc

SEQ ID NO: 3647680 - RNA, 15 nt, Salmonella enterica enterica serovar Typhi
aauuuuugaucugcu

SEQ ID NO: 3647681 - RNA, 14 nt, Salmonella enterica enterica serovar Typhi
acaaaaccgcuaau

SEQ ID NO: 3647682 - RNA, 18 nt, Salmonella enterica enterica serovar Typhi
acaaaagaaagcaauagc

SEQ ID NO: 3647683 - RNA, 17 nt, Salmonella enterica enterica serovar Typhi
acaaaagcgguuaagau

SEQ ID NO: 3647684 - RNA, 17 nt, Salmonella enterica enterica serovar Typhi
acaaaaggauacagcgc

SEQ ID NO: 3647685 - RNA, 16 nt, Salmonella enterica enterica serovar Typhi
acaaaauaaagugaaa

SEQ ID NO: 3647686 - RNA, 14 nt, Salmonella enterica enterica serovar Typhi
acaaaaucauugcg

SEQ ID NO: 3647687 - RNA, 17 nt, Salmonella enterica enterica serovar Typhi
acaaaauggcugauaaa

SEQ ID NO: 3647688 - RNA, 16 nt, Salmonella enterica enterica serovar Typhi
acaaaauucagacuca

SEQ ID NO: 3647689 - RNA, 16 nt, Salmonella enterica enterica serovar Typhi
acaaaauuuugcauaa

SEQ ID NO: 3647690 - RNA, 12 nt, Salmonella enterica enterica serovar Typhi
acaaaauuuuuu

SEQ ID NO: 3647691 - RNA, 19 nt, Salmonella enterica enterica serovar Typhi
acaaacaaauaaauccaug

SEQ ID NO: 3647692 - RNA, 19 nt, Salmonella enterica enterica serovar Typhi
acaaacaccaccaguaacc

SEQ ID NO: 3647693 - RNA, 17 nt, Salmonella enterica enterica serovar Typhi
acaaucauaauaaacug

SEQ ID NO: 3647694 - RNA, 16 nt, Salmonella enterica enterica serovar Typhi
acaauccgccacgcuc

SEQ ID NO: 3647695 - RNA, 18 nt, Salmonella enterica enterica serovar Typhi
acaauccgccacgcucgc

SEQ ID NO: 3647696 - RNA, 19 nt, Salmonella enterica enterica serovar Typhi
acaaucgccgugaucccaa

SEQ ID NO: 3647697 - RNA, 21 nt, Salmonella enterica enterica serovar Typhi
acaaucgccgugaucccaaug

SEQ ID NO: 3647698 - RNA, 21 nt, Salmonella enterica enterica serovar Typhi
acaaucgcguuuuccagcauc

SEQ ID NO: 3647699 - RNA, 15 nt, Salmonella enterica enterica serovar Typhi
acaaucucaauacca

SEQ ID NO: 3647700 - RNA, 20 nt, Salmonella enterica enterica serovar Typhi
acaaucucaauaccacgccg

SEQ ID NO: 3647701 - RNA, 20 nt, Salmonella enterica enterica serovar Typhi
acaaucuccagaccgcugcg

SEQ ID NO: 3647702 - RNA, 21 nt, Salmonella enterica enterica serovar Typhi
acaaucugugugggcacucga

SEQ ID NO: 3647703 - RNA, 15 nt, Salmonella enterica enterica serovar Typhi
acaaugaauccucgg

SEQ ID NO: 3647704 - RNA, 18 nt, Salmonella enterica enterica serovar Typhi
acaaugaucagacgcaca

SEQ ID NO: 3647705 - RNA, 22 nt, Salmonella enterica enterica serovar Typhi
acaaugccauuauugcaucaau

SEQ ID NO: 3647706 - RNA, 21 nt, Salmonella enterica enterica serovar Typhi
acaaugcgguaaccguauugc

SEQ ID NO: 3647707 - RNA, 15 nt, Salmonella enterica enterica serovar Typhi
acaauggcccgauac

SEQ ID NO: 3647708 - RNA, 14 nt, Salmonella enterica enterica serovar Typhi
acaauguacagaau

SEQ ID NO: 3647709 - RNA, 21 nt, Salmonella enterica enterica serovar Typhi
acaauuacgcaagagagcaac

SEQ ID NO: 3647710 - RNA, 15 nt, Salmonella enterica enterica serovar Typhi
acaauucaacucacu

SEQ ID NO: 3647711 - RNA, 17 nt, Salmonella enterica enterica serovar Typhi
acaauuccggcccaggc

SEQ ID NO: 3647712 - RNA, 15 nt, Salmonella enterica enterica serovar Typhi
acaauugccagcagg

SEQ ID NO: 3647713 - RNA, 15 nt, Salmonella enterica enterica serovar Typhi
acaauuuaucagaca

SEQ ID NO: 3647714 - RNA, 15 nt, Salmonella enterica enterica serovar Typhi
acaauuugcccagcg

SEQ ID NO: 3647715 - RNA, 18 nt, Salmonella enterica enterica serovar Typhi
acaauuuugauaagagaa

SEQ ID NO: 3647716 - RNA, 20 nt, Salmonella enterica enterica serovar Typhi
acaauuuugauaagagaaaa

SEQ ID NO: 3647717 - RNA, 22 nt, Salmonella enterica enterica serovar Typhi
acacaaaagcaucguaccuuca

SEQ ID NO: 3647718 - RNA, 15 nt, Salmonella enterica enterica serovar Typhi
acacaauagcaaucu

SEQ ID NO: 3647719 - RNA, 20 nt, Salmonella enterica enterica serovar Typhi
acacaauaucgccaucguag

SEQ ID NO: 3647720 - RNA, 13 nt, Salmonella enterica enterica serovar Typhi
acacaauuuucuu

SEQ ID NO: 3647721 - RNA, 22 nt, Salmonella enterica enterica serovar Typhi
acacacaguugccuucgauuaa

SEQ ID NO: 3647722 - RNA, 13 nt, Salmonella enterica enterica serovar Typhi
acacacgcgcuga

SEQ ID NO: 3647723 - RNA, 20 nt, Salmonella enterica enterica serovar Typhi
acacagaaaaaccaaaaaau

SEQ ID NO: 3647724 - RNA, 12 nt, Salmonella enterica enterica serovar Typhi
acacagaauuac

SEQ ID NO: 3647725 - RNA, 22 nt, Salmonella enterica enterica serovar Typhi
acacagacuuugcacagucugc

SEQ ID NO: 3647726 - RNA, 13 nt, Salmonella enterica enterica serovar Typhi
acacagcagaaag

SEQ ID NO: 3647727 - RNA, 15 nt, Salmonella enterica enterica serovar Typhi
acacagcgucgcgcg

SEQ ID NO: 3647728 - RNA, 15 nt, Salmonella enterica enterica serovar Typhi
acacaggccugcauu

SEQ ID NO: 3647729 - RNA, 19 nt, Salmonella enterica enterica serovar Typhi
acacaggcgugguggauau

SEQ ID NO: 3647730 - RNA, 22 nt, Salmonella enterica enterica serovar Typhi
acacaggcgugguggauaucca

SEQ ID NO: 3647731 - RNA, 22 nt, Salmonella enterica enterica serovar Typhi
acacagggucgucaaacuuuua

SEQ ID NO: 3647732 - RNA, 14 nt, Salmonella enterica enterica serovar Typhi
acacaguaaaaaaa

SEQ ID NO: 3647733 - RNA, 15 nt, Salmonella enterica enterica serovar Typhi
acacaucacaaucuc

SEQ ID NO: 3647734 - RNA, 17 nt, Salmonella enterica enterica serovar Typhi
acacaucacaaucucca

SEQ ID NO: 3647735 - RNA, 16 nt, Salmonella enterica enterica serovar Typhi
acacauuucuuuugau

SEQ ID NO: 3647736 - RNA, 13 nt, Salmonella enterica enterica serovar Typhi
acaccaacaaagu

SEQ ID NO: 3647737 - RNA, 17 nt, Salmonella enterica enterica serovar Typhi
acaccaacgcuggcccg

SEQ ID NO: 3647738 - RNA, 18 nt, Salmonella enterica enterica serovar Typhi
acaccaaugucauauuug

SEQ ID NO: 3647739 - RNA, 16 nt, Salmonella enterica enterica serovar Typhi
acaccacgccggaauc

SEQ ID NO: 3647740 - RNA, 23 nt, Salmonella enterica enterica serovar Typhi
acaccagaucauuaccugucgcc

SEQ ID NO: 3647741 - RNA, 21 nt, Salmonella enterica enterica serovar Typhi
acaccagcccuggcuguccuu

SEQ ID NO: 3647742 - RNA, 14 nt, Salmonella enterica enterica serovar Typhi
acaccagccguuca

SEQ ID NO: 3647743 - RNA, 13 nt, Salmonella enterica enterica serovar Typhi
acaccauuucaca

SEQ ID NO: 3647744 - RNA, 22 nt, Salmonella enterica enterica serovar Typhi
acaccauuucacaaauuaaaaa

SEQ ID NO: 3647745 - RNA, 12 nt, Salmonella enterica enterica serovar Typhi
acacccaauaua

SEQ ID NO: 3647746 - RNA, 14 nt, Salmonella enterica enterica serovar Typhi
acacccgcacgccu

SEQ ID NO: 3647747 - RNA, 15 nt, Salmonella enterica enterica serovar Typhi
acacccgcagccaga

SEQ ID NO: 3647748 - RNA, 15 nt, Salmonella enterica enterica serovar Typhi
acacccgcagccgca

SEQ ID NO: 3647749 - RNA, 22 nt, Salmonella enterica enterica serovar Typhi
acacccggcuuuugcuuucugg

SEQ ID NO: 3647750 - RNA, 13 nt, Salmonella enterica enterica serovar Typhi
acaccgccagcgu

SEQ ID NO: 3647751 - RNA, 21 nt, Salmonella enterica enterica serovar Typhi
acaccgccuagcgucccggca

SEQ ID NO: 3647752 - RNA, 14 nt, Salmonella enterica enterica serovar Typhi
acaccgcuugccgg

SEQ ID NO: 3647753 - RNA, 14 nt, Salmonella enterica enterica serovar Typhi
acaccggaagugaa

SEQ ID NO: 3647754 - RNA, 18 nt, Salmonella enterica enterica serovar Typhi
acaccggccauugccgcg

SEQ ID NO: 3647755 - RNA, 14 nt, Salmonella enterica enterica serovar Typhi
acaccggccugccu

SEQ ID NO: 3647756 - RNA, 20 nt, Salmonella enterica enterica serovar Typhi
acaccgguugcgcaaccucc

SEQ ID NO: 3647757 - RNA, 21 nt, Salmonella enterica enterica serovar Typhi
acaccguauccggccugcagg

SEQ ID NO: 3647758 - RNA, 21 nt, Salmonella enterica enterica serovar Typhi
acaccugggcuugcuuuucuc

SEQ ID NO: 3647759 - RNA, 20 nt, Salmonella enterica enterica serovar Typhi
acaccuguaacgucacauuc

SEQ ID NO: 3647760 - RNA, 12 nt, Salmonella enterica enterica serovar Typhi
acaccuuugggg

SEQ ID NO: 3647761 - RNA, 20 nt, Salmonella enterica enterica serovar Typhi
acaccuuuggggaaagguaa

SEQ ID NO: 3647762 - RNA, 14 nt, Salmonella enterica enterica serovar Typhi
acacgaacacagaa

SEQ ID NO: 3647763 - RNA, 14 nt, Salmonella enterica enterica serovar Typhi
acacgaccagcgac

SEQ ID NO: 3647764 - RNA, 16 nt, Salmonella enterica enterica serovar Typhi
acacgauaaaccucac

SEQ ID NO: 3647765 - RNA, 18 nt, Salmonella enterica enterica serovar Typhi
acacgauagugaucgccc

SEQ ID NO: 3647766 - RNA, 17 nt, Salmonella enterica enterica serovar Typhi
acacgauccccaucgau

SEQ ID NO: 3647767 - RNA, 14 nt, Salmonella enterica enterica serovar Typhi
acacgauggcaaau

SEQ ID NO: 3647768 - RNA, 14 nt, Salmonella enterica enterica serovar Typhi
acacgccuuccucc

SEQ ID NO: 3647769 - RNA, 14 nt, Salmonella enterica enterica serovar Typhi
acacgcgaauagcc

SEQ ID NO: 3647770 - RNA, 21 nt, Salmonella enterica enterica serovar Typhi
acacgcgcaccaguucacucc

SEQ ID NO: 3647771 - RNA, 17 nt, Salmonella enterica enterica serovar Typhi
acacgcgcgcugcgccu

SEQ ID NO: 3647772 - RNA, 16 nt, Salmonella enterica enterica serovar Typhi
acacgcguaaacuucc

SEQ ID NO: 3647773 - RNA, 16 nt, Salmonella enterica enterica serovar Typhi
acacgcuuagcuugcc

SEQ ID NO: 3647774 - RNA, 16 nt, Salmonella enterica enterica serovar Typhi
acacgcuuauccugcc

SEQ ID NO: 3647775 - RNA, 21 nt, Salmonella enterica enterica serovar Typhi
acacgcuuccagaugaagcgc

SEQ ID NO: 3647776 - RNA, 19 nt, Salmonella enterica enterica serovar Typhi
acacgcuuuucagcgccag

SEQ ID NO: 3647777 - RNA, 17 nt, Salmonella enterica enterica serovar Typhi
acacggcgcucaggauc

SEQ ID NO: 3647778 - RNA, 16 nt, Salmonella enterica enterica serovar Typhi
acacggggcgguaccg

SEQ ID NO: 3647779 - RNA, 17 nt, Salmonella enterica enterica serovar Typhi
acagcuuagcuguaauu

SEQ ID NO: 3647780 - RNA, 22 nt, Salmonella enterica enterica serovar Typhi
acagcuucaugcgccgcgacaa

SEQ ID NO: 3647781 - RNA, 19 nt, Salmonella enterica enterica serovar Typhi
acagcuucgguccggcgcu

SEQ ID NO: 3647782 - RNA, 16 nt, Salmonella enterica enterica serovar Typhi
acagcuugaucaucag

SEQ ID NO: 3647783 - RNA, 14 nt, Salmonella enterica enterica serovar Typhi
acagcuuuuacaac

SEQ ID NO: 3647784 - RNA, 19 nt, Salmonella enterica enterica serovar Typhi
acaggaacaucguguccug

SEQ ID NO: 3647785 - RNA, 17 nt, Salmonella enterica enterica serovar Typhi
acaggaagcagcuugcu

SEQ ID NO: 3647786 - RNA, 15 nt, Salmonella enterica enterica serovar Typhi
acaggacaagcagug

SEQ ID NO: 3647787 - RNA, 17 nt, Salmonella enterica enterica serovar Typhi
acaggacaagcagugcu

SEQ ID NO: 3647788 - RNA, 14 nt, Salmonella enterica enterica serovar Typhi
acaggacagauguc

SEQ ID NO: 3647789 - RNA, 15 nt, Salmonella enterica enterica serovar Typhi
acaggcacaacaaua

SEQ ID NO: 3647790 - RNA, 20 nt, Salmonella enterica enterica serovar Typhi
acaggcaccagcguauaauu

SEQ ID NO: 3647791 - RNA, 13 nt, Salmonella enterica enterica serovar Typhi
acaggcauggccu

SEQ ID NO: 3647792 - RNA, 16 nt, Salmonella enterica enterica serovar Typhi
acaggcauggccuuca

SEQ ID NO: 3647793 - RNA, 12 nt, Salmonella enterica enterica serovar Typhi
acaggcauuguc

SEQ ID NO: 3647794 - RNA, 19 nt, Salmonella enterica enterica serovar Typhi
acaggccaaacccugcgcc

SEQ ID NO: 3647795 - RNA, 15 nt, Salmonella enterica enterica serovar Typhi
acaggccggacaggc

SEQ ID NO: 3647796 - RNA, 16 nt, Salmonella enterica enterica serovar Typhi
acaggccuuccggcgu

SEQ ID NO: 3647797 - RNA, 19 nt, Salmonella enterica enterica serovar Typhi
acaggcgacgccgccaucc

SEQ ID NO: 3647798 - RNA, 23 nt, Salmonella enterica enterica serovar Typhi
acaggcgcaggcauuaaaaaaac

SEQ ID NO: 3647799 - RNA, 19 nt, Salmonella enterica enterica serovar Typhi
acaggcgcagggcauuauu

SEQ ID NO: 3647800 - RNA, 14 nt, Salmonella enterica enterica serovar Typhi
acaggcgcaucaga

SEQ ID NO: 3647801 - RNA, 15 nt, Salmonella enterica enterica serovar Typhi
acaggcgcaucagaa

SEQ ID NO: 3647802 - RNA, 17 nt, Salmonella enterica enterica serovar Typhi
acaggcgcaucagaaaa

SEQ ID NO: 3647803 - RNA, 22 nt, Salmonella enterica enterica serovar Typhi
acaggcgcaucagaaaaaccuc

SEQ ID NO: 3647804 - RNA, 18 nt, Salmonella enterica enterica serovar Typhi
acaggcgcggagacguga

SEQ ID NO: 3647805 - RNA, 21 nt, Salmonella enterica enterica serovar Typhi
acaggcggaaaucaacaaucc

SEQ ID NO: 3647806 - RNA, 12 nt, Salmonella enterica enterica serovar Typhi
acaggcggauga

SEQ ID NO: 3647807 - RNA, 16 nt, Salmonella enterica enterica serovar Typhi
acaggcggaugaaaca

SEQ ID NO: 3647808 - RNA, 16 nt, Salmonella enterica enterica serovar Typhi
acaggcugucugccau

SEQ ID NO: 3647809 - RNA, 22 nt, Salmonella enterica enterica serovar Typhi
acaggcuuuucaggcuguggcu

SEQ ID NO: 3647810 - RNA, 17 nt, Salmonella enterica enterica serovar Typhi
acagggcgaugccucac

SEQ ID NO: 3647811 - RNA, 15 nt, Salmonella enterica enterica serovar Typhi
acagggcggccuccu

SEQ ID NO: 3647812 - RNA, 18 nt, Salmonella enterica enterica serovar Typhi
acagggcggcgcgcugcc

SEQ ID NO: 3647813 - RNA, 18 nt, Salmonella enterica enterica serovar Typhi
acaggggccacaggcggc

SEQ ID NO: 3647814 - RNA, 21 nt, Salmonella enterica enterica serovar Typhi
acaggggccacaggcggcaug

SEQ ID NO: 3647815 - RNA, 17 nt, Salmonella enterica enterica serovar Typhi
acaggggggaacagcaa

SEQ ID NO: 3647816 - RNA, 14 nt, Salmonella enterica enterica serovar Typhi
acagggguaagaau

SEQ ID NO: 3647817 - RNA, 23 nt, Salmonella enterica enterica serovar Typhi
acaggguuugccagcaccagcag

SEQ ID NO: 3647818 - RNA, 14 nt, Salmonella enterica enterica serovar Typhi
acagguaaaacaaa

SEQ ID NO: 3647819 - RNA, 15 nt, Salmonella enterica enterica serovar Typhi
acagguacaggccgc

SEQ ID NO: 3647820 - RNA, 19 nt, Salmonella enterica enterica serovar Typhi
acaggucgaugauuuucaa

SEQ ID NO: 3647821 - RNA, 15 nt, Salmonella enterica enterica serovar Typhi
acaggucggccaacc

SEQ ID NO: 3647822 - RNA, 19 nt, Salmonella enterica enterica serovar Typhi
acaggugaaauaggggaga

SEQ ID NO: 3647823 - RNA, 16 nt, Salmonella enterica enterica serovar Typhi
acaggugaacauuaca

SEQ ID NO: 3647824 - RNA, 14 nt, Salmonella enterica enterica serovar Typhi
acaggugaccaggc

SEQ ID NO: 3647825 - RNA, 17 nt, Salmonella enterica enterica serovar Typhi
acaggugaccaggcuuc

SEQ ID NO: 3647826 - RNA, 22 nt, Salmonella enterica enterica serovar Typhi
acagguuaacgaagguaaacgc

SEQ ID NO: 3647827 - RNA, 18 nt, Salmonella enterica enterica serovar Typhi
acagguugcguaacgcca

SEQ ID NO: 3647828 - RNA, 20 nt, Salmonella enterica enterica serovar Typhi
acagguugcguaacgccaca

SEQ ID NO: 3647829 - RNA, 17 nt, Salmonella enterica enterica serovar Typhi
acaguaaaaaaacgccu

SEQ ID NO: 3647830 - RNA, 16 nt, Salmonella enterica enterica serovar Typhi
acaguaaccccauaca

SEQ ID NO: 3647831 - RNA, 17 nt, Salmonella enterica enterica serovar Typhi
acaguacaccugcaggu

SEQ ID NO: 3647832 - RNA, 14 nt, Salmonella enterica enterica serovar Typhi
acaguaccuuuacc

SEQ ID NO: 3647833 - RNA, 18 nt, Salmonella enterica enterica serovar Typhi
acaguacggucaggcuca

SEQ ID NO: 3647834 - RNA, 16 nt, Salmonella enterica enterica serovar Typhi
acaguagagggggacc

SEQ ID NO: 3647835 - RNA, 14 nt, Salmonella enterica enterica serovar Typhi
acaguagcaggggc

SEQ ID NO: 3647836 - RNA, 19 nt, Salmonella enterica enterica serovar Typhi
acaguauuuguucagacac

SEQ ID NO: 3647837 - RNA, 14 nt, Salmonella enterica enterica serovar Typhi
acagucgcagagcc

SEQ ID NO: 3647838 - RNA, 21 nt, Salmonella enterica enterica serovar Typhi
acagucgcgccgugcccagca

SEQ ID NO: 3647839 - RNA, 17 nt, Salmonella enterica enterica serovar Typhi
acagugacccgccgcca

SEQ ID NO: 3647840 - RNA, 20 nt, Salmonella enterica enterica serovar Typhi
acagugacccgccgccagca

SEQ ID NO: 3647841 - RNA, 21 nt, Salmonella enterica enterica serovar Typhi
acagugacccgccgccagcac

SEQ ID NO: 3647842 - RNA, 13 nt, Salmonella enterica enterica serovar Typhi
acagugcgccaua

SEQ ID NO: 3647843 - RNA, 18 nt, Salmonella enterica enterica serovar Typhi
acagugcuauacaguaaa

SEQ ID NO: 3647844 - RNA, 16 nt, Salmonella enterica enterica serovar Typhi
acagugggcuaugaag

SEQ ID NO: 3647845 - RNA, 18 nt, Salmonella enterica enterica serovar Typhi
acagugugccgucaucca

SEQ ID NO: 3647846 - RNA, 23 nt, Salmonella enterica enterica serovar Typhi
acaguguugauugaaacucgcca

SEQ ID NO: 3647847 - RNA, 14 nt, Salmonella enterica enterica serovar Typhi
acaguuaccacaca

SEQ ID NO: 3647848 - RNA, 18 nt, Salmonella enterica enterica serovar Typhi
acaguucagacaccacgc

SEQ ID NO: 3647849 - RNA, 19 nt, Salmonella enterica enterica serovar Typhi
acaguucauuucaggcaaa

SEQ ID NO: 3647850 - RNA, 15 nt, Salmonella enterica enterica serovar Typhi
acaguuucauauccg

SEQ ID NO: 3647851 - RNA, 17 nt, Salmonella enterica enterica serovar Typhi
acaguuugugccgccac

SEQ ID NO: 3647852 - RNA, 21 nt, Salmonella enterica enterica serovar Typhi
acaguuuugucaucagaucau

SEQ ID NO: 3647853 - RNA, 21 nt, Salmonella enterica enterica serovar Typhi
acaguuuuuccuuucugcgcc

SEQ ID NO: 3647854 - RNA, 20 nt, Salmonella enterica enterica serovar Typhi
acaguuuuuucguuccagag

SEQ ID NO: 3647855 - RNA, 22 nt, Salmonella enterica enterica serovar Typhi
acauaaaauaguugguggguga

SEQ ID NO: 3647856 - RNA, 22 nt, Salmonella enterica enterica serovar Typhi
acauaaacagcgugaacacgcc

SEQ ID NO: 3647857 - RNA, 15 nt, Salmonella enterica enterica serovar Typhi
acauaaauaaacagc

SEQ ID NO: 3647858 - RNA, 17 nt, Salmonella enterica enterica serovar Typhi
acauaacagcagcagac

SEQ ID NO: 3647859 - RNA, 16 nt, Salmonella enterica enterica serovar Typhi
acauaacugagacuca

SEQ ID NO: 3647860 - RNA, 13 nt, Salmonella enterica enterica serovar Typhi
acauaaguaaaua

SEQ ID NO: 3647861 - RNA, 16 nt, Salmonella enterica enterica serovar Typhi
acauaagugcaggcug

SEQ ID NO: 3647862 - RNA, 20 nt, Salmonella enterica enterica serovar Typhi
acauaauguaaaggugagcu

SEQ ID NO: 3647863 - RNA, 21 nt, Salmonella enterica enterica serovar Typhi
acauaauuuccggccaguagc

SEQ ID NO: 3647864 - RNA, 19 nt, Salmonella enterica enterica serovar Typhi
acauacguuuaaagcgcuc

SEQ ID NO: 3647865 - RNA, 13 nt, Salmonella enterica enterica serovar Typhi
accacgguauuaa

SEQ ID NO: 3647866 - RNA, 21 nt, Salmonella enterica enterica serovar Typhi
accacgguauuaacaggcgcc

SEQ ID NO: 3647867 - RNA, 19 nt, Salmonella enterica enterica serovar Typhi
accacgguguaccccgccu

SEQ ID NO: 3647868 - RNA, 15 nt, Salmonella enterica enterica serovar Typhi
accacguaaugcgcc

SEQ ID NO: 3647869 - RNA, 16 nt, Salmonella enterica enterica serovar Typhi
accacgucauccggca

SEQ ID NO: 3647870 - RNA, 23 nt, Salmonella enterica enterica serovar Typhi
accacuccccaacguaauaacca

SEQ ID NO: 3647871 - RNA, 22 nt, Salmonella enterica enterica serovar Typhi
accacuguccgguuacaaccgu

SEQ ID NO: 3647872 - RNA, 16 nt, Salmonella enterica enterica serovar Typhi
accacuuuguuuuugu

SEQ ID NO: 3647873 - RNA, 22 nt, Salmonella enterica enterica serovar Typhi
accagaaaaccgacagcaauau

SEQ ID NO: 3647874 - RNA, 17 nt, Salmonella enterica enterica serovar Typhi
accagaaacaacacgau

SEQ ID NO: 3647875 - RNA, 17 nt, Salmonella enterica enterica serovar Typhi
accagaauacacuucuc

SEQ ID NO: 3647876 - RNA, 17 nt, Salmonella enterica enterica serovar Typhi
accagaaucaccgacag

SEQ ID NO: 3647877 - RNA, 17 nt, Salmonella enterica enterica serovar Typhi
accagaaucauuaauaa

SEQ ID NO: 3647878 - RNA, 22 nt, Salmonella enterica enterica serovar Typhi
accagaaucccacggagaaaag

SEQ ID NO: 3647879 - RNA, 14 nt, Salmonella enterica enterica serovar Typhi
accagaaucgccag

SEQ ID NO: 3647880 - RNA, 18 nt, Salmonella enterica enterica serovar Typhi
accagaaucgccagcauc

SEQ ID NO: 3647881 - RNA, 11 nt, Salmonella enterica enterica serovar Typhi
accagacccgu

SEQ ID NO: 3647882 - RNA, 16 nt, Salmonella enterica enterica serovar Typhi
accagaccgacaagcc

SEQ ID NO: 3647883 - RNA, 14 nt, Salmonella enterica enterica serovar Typhi
accagaccggcauc

SEQ ID NO: 3647884 - RNA, 22 nt, Salmonella enterica enterica serovar Typhi
accagacgcuggcacuggcagc

SEQ ID NO: 3647885 - RNA, 23 nt, Salmonella enterica enterica serovar Typhi
accagacugaugaugaagaacag

SEQ ID NO: 3647886 - RNA, 18 nt, Salmonella enterica enterica serovar Typhi
accagaucaacauggugu

SEQ ID NO: 3647887 - RNA, 16 nt, Salmonella enterica enterica serovar Typhi
accagcaaugagacaa

SEQ ID NO: 3647888 - RNA, 22 nt, Salmonella enterica enterica serovar Typhi
accagcaauuggccaucuucgu

SEQ ID NO: 3647889 - RNA, 15 nt, Salmonella enterica enterica serovar Typhi
accagcagaugcagu

SEQ ID NO: 3647890 - RNA, 13 nt, Salmonella enterica enterica serovar Typhi
accagcagcgcca

SEQ ID NO: 3647891 - RNA, 14 nt, Salmonella enterica enterica serovar Typhi
accagcagcgccag

SEQ ID NO: 3647892 - RNA, 21 nt, Salmonella enterica enterica serovar Typhi
accagcagcgccagcgaagua

SEQ ID NO: 3647893 - RNA, 22 nt, Salmonella enterica enterica serovar Typhi
accagcagcgcggcguacacuu

SEQ ID NO: 3647894 - RNA, 15 nt, Salmonella enterica enterica serovar Typhi
accagcagcgggcug

SEQ ID NO: 3647895 - RNA, 17 nt, Salmonella enterica enterica serovar Typhi
accagcagcgggcuguc

SEQ ID NO: 3647896 - RNA, 22 nt, Salmonella enterica enterica serovar Typhi
accagcaguguaucguugucgc

SEQ ID NO: 3647897 - RNA, 13 nt, Salmonella enterica enterica serovar Typhi
accagcaguuccg

SEQ ID NO: 3647898 - RNA, 16 nt, Salmonella enterica enterica serovar Typhi
accagcauaauauuca

SEQ ID NO: 3647899 - RNA, 22 nt, Salmonella enterica enterica serovar Typhi
accagcaucaauagcagcuuca

SEQ ID NO: 3647900 - RNA, 23 nt, Salmonella enterica enterica serovar Typhi
accagcaucccacgaaugccgau

SEQ ID NO: 3647901 - RNA, 13 nt, Salmonella enterica enterica serovar Typhi
accagcaugugcc

SEQ ID NO: 3647902 - RNA, 16 nt, Salmonella enterica enterica serovar Typhi
accagccacugcgcca

SEQ ID NO: 3647903 - RNA, 18 nt, Salmonella enterica enterica serovar Typhi
accagccaggaaccgccg

SEQ ID NO: 3647904 - RNA, 22 nt, Salmonella enterica enterica serovar Typhi
accagcccaacggucuuugccg

SEQ ID NO: 3647905 - RNA, 12 nt, Salmonella enterica enterica serovar Typhi
accagcccauga

SEQ ID NO: 3647906 - RNA, 15 nt, Salmonella enterica enterica serovar Typhi
accagccccaaaauu

SEQ ID NO: 3647907 - RNA, 15 nt, Salmonella enterica enterica serovar Typhi
accagccgaucauca

SEQ ID NO: 3647908 - RNA, 18 nt, Salmonella enterica enterica serovar Typhi
accagccgaucaucacga

SEQ ID NO: 3647909 - RNA, 24 nt, Salmonella enterica enterica serovar Typhi
accagccgcgcccuaacaggcgca

SEQ ID NO: 3647910 - RNA, 17 nt, Salmonella enterica enterica serovar Typhi
accagcgaaaugacggc

SEQ ID NO: 3647911 - RNA, 15 nt, Salmonella enterica enterica serovar Typhi
accagcgacggcgua

SEQ ID NO: 3647912 - RNA, 17 nt, Salmonella enterica enterica serovar Typhi
accagcgagauaaccgg

SEQ ID NO: 3647913 - RNA, 22 nt, Salmonella enterica enterica serovar Typhi
accagcgcaagcagcgccccgc

SEQ ID NO: 3647914 - RNA, 19 nt, Salmonella enterica enterica serovar Typhi
accagcgcaguaaacuccu

SEQ ID NO: 3647915 - RNA, 12 nt, Salmonella enterica enterica serovar Typhi
accagcgcaucu

SEQ ID NO: 3647916 - RNA, 16 nt, Salmonella enterica enterica serovar Typhi
accagcgcaugacggu

SEQ ID NO: 3647917 - RNA, 15 nt, Salmonella enterica enterica serovar Typhi
accagcgccaggcca

SEQ ID NO: 3647918 - RNA, 14 nt, Salmonella enterica enterica serovar Typhi
accagcgccgccag

SEQ ID NO: 3647919 - RNA, 22 nt, Salmonella enterica enterica serovar Typhi
accagcgccgccagauaaagcg

SEQ ID NO: 3647920 - RNA, 14 nt, Salmonella enterica enterica serovar Typhi
accagcgcgccaaa

SEQ ID NO: 3647921 - RNA, 20 nt, Salmonella enterica enterica serovar Typhi
accagcgcgccgccaacgcc

SEQ ID NO: 3647922 - RNA, 13 nt, Salmonella enterica enterica serovar Typhi
accagcgcggcac

SEQ ID NO: 3647923 - RNA, 16 nt, Salmonella enterica enterica serovar Typhi
accagcgcggcgccag

SEQ ID NO: 3647924 - RNA, 16 nt, Salmonella enterica enterica serovar Typhi
accagcgcuauccagg

SEQ ID NO: 3647925 - RNA, 17 nt, Salmonella enterica enterica serovar Typhi
accagcgcuucgccugc

SEQ ID NO: 3647926 - RNA, 22 nt, Salmonella enterica enterica serovar Typhi
accagcgcuucuguuaaaaaau

SEQ ID NO: 3647927 - RNA, 22 nt, Salmonella enterica enterica serovar Typhi
accagcggaauccccgccgcca

SEQ ID NO: 3647928 - RNA, 17 nt, Salmonella enterica enterica serovar Typhi
accagcggcagcuucag

SEQ ID NO: 3647929 - RNA, 20 nt, Salmonella enterica enterica serovar Typhi
accagcgggccgcugauguu

SEQ ID NO: 3647930 - RNA, 19 nt, Salmonella enterica enterica serovar Typhi
accagcgguaugcaccucu

SEQ ID NO: 3647931 - RNA, 21 nt, Salmonella enterica enterica serovar Typhi
accagcgucagccagaacgaa

SEQ ID NO: 3647932 - RNA, 19 nt, Salmonella enterica enterica serovar Typhi
accagcguggcuauccaua

SEQ ID NO: 3647933 - RNA, 19 nt, Salmonella enterica enterica serovar Typhi
accagcugacgacgccagc

SEQ ID NO: 3647934 - RNA, 22 nt, Salmonella enterica enterica serovar Typhi
accagcugacgacgccagcccu

SEQ ID NO: 3647935 - RNA, 16 nt, Salmonella enterica enterica serovar Typhi
accagcuucaugcugg

SEQ ID NO: 3647936 - RNA, 21 nt, Salmonella enterica enterica serovar Typhi
accagcuucaugcuggauacc

SEQ ID NO: 3647937 - RNA, 17 nt, Salmonella enterica enterica serovar Typhi
accaggcaaaccagcac

SEQ ID NO: 3647938 - RNA, 13 nt, Salmonella enterica enterica serovar Typhi
accaggcacugca

SEQ ID NO: 3647939 - RNA, 14 nt, Salmonella enterica enterica serovar Typhi
accaggcacuugag

SEQ ID NO: 3647940 - RNA, 13 nt, Salmonella enterica enterica serovar Typhi
accaggccagcgu

SEQ ID NO: 3647941 - RNA, 20 nt, Salmonella enterica enterica serovar Typhi
accaggcggcuuuuucauca

SEQ ID NO: 3647942 - RNA, 20 nt, Salmonella enterica enterica serovar Typhi
accagggaggacgcaagagc

SEQ ID NO: 3647943 - RNA, 19 nt, Salmonella enterica enterica serovar Typhi
accagggauuuugcuuuuu

SEQ ID NO: 3647944 - RNA, 18 nt, Salmonella enterica enterica serovar Typhi
accaggguucgcuggcca

SEQ ID NO: 3647945 - RNA, 13 nt, Salmonella enterica enterica serovar Typhi
accagguaauccg

SEQ ID NO: 3647946 - RNA, 18 nt, Salmonella enterica enterica serovar Typhi
accagguacagcuuagcu

SEQ ID NO: 3647947 - RNA, 15 nt, Salmonella enterica enterica serovar Typhi
accaguaacggcagu

SEQ ID NO: 3647948 - RNA, 21 nt, Salmonella enterica enterica serovar Typhi
accaguacaauuucuggcccc

SEQ ID NO: 3647949 - RNA, 16 nt, Salmonella enterica enterica serovar Typhi
accaguacaucuucac

SEQ ID NO: 3647950 - RNA, 22 nt, Salmonella enterica enterica serovar Typhi
acccaguuuuaagcgcaggugc

SEQ ID NO: 3647951 - RNA, 18 nt, Salmonella enterica enterica serovar Typhi
acccauacaguacagacu

SEQ ID NO: 3647952 - RNA, 14 nt, Salmonella enterica enterica serovar Typhi
acccauagcagcuc

SEQ ID NO: 3647953 - RNA, 19 nt, Salmonella enterica enterica serovar Typhi
acccauaguagcuaaugau

SEQ ID NO: 3647954 - RNA, 21 nt, Salmonella enterica enterica serovar Typhi
acccauauuccugcggcccca

SEQ ID NO: 3647955 - RNA, 18 nt, Salmonella enterica enterica serovar Typhi
acccauauucgucuucau

SEQ ID NO: 3647956 - RNA, 19 nt, Salmonella enterica enterica serovar Typhi
acccaucagggaaaaaugu

SEQ ID NO: 3647957 - RNA, 19 nt, Salmonella enterica enterica serovar Typhi
accccaaacaccaacaaag

SEQ ID NO: 3647958 - RNA, 18 nt, Salmonella enterica enterica serovar Typhi
accccaaaucagcaaaaa

SEQ ID NO: 3647959 - RNA, 16 nt, Salmonella enterica enterica serovar Typhi
accccaaucuugcgua

SEQ ID NO: 3647960 - RNA, 20 nt, Salmonella enterica enterica serovar Typhi
accccacgcuuuuuuauuuu

SEQ ID NO: 3647961 - RNA, 12 nt, Salmonella enterica enterica serovar Typhi
accccagcugcg

SEQ ID NO: 3647962 - RNA, 22 nt, Salmonella enterica enterica serovar Typhi
accccagggagacggccaccca

SEQ ID NO: 3647963 - RNA, 16 nt, Salmonella enterica enterica serovar Typhi
accccaggucagcagu

SEQ ID NO: 3647964 - RNA, 17 nt, Salmonella enterica enterica serovar Typhi
accccaguaauccggca

SEQ ID NO: 3647965 - RNA, 18 nt, Salmonella enterica enterica serovar Typhi
accccaguaauccggcaa

SEQ ID NO: 3647966 - RNA, 15 nt, Salmonella enterica enterica serovar Typhi
accccaguagcccug

SEQ ID NO: 3647967 - RNA, 11 nt, Salmonella enterica enterica serovar Typhi
accccaucccg

SEQ ID NO: 3647968 - RNA, 15 nt, Salmonella enterica enterica serovar Typhi
accccauggcgucuu

SEQ ID NO: 3647969 - RNA, 20 nt, Salmonella enterica enterica serovar Typhi
accccauuaugugcgacgua

SEQ ID NO: 3647970 - RNA, 18 nt, Salmonella enterica enterica serovar Typhi
acccccaccucaaucacc

SEQ ID NO: 3647971 - RNA, 12 nt, Salmonella enterica enterica serovar Typhi
acccccagccau

SEQ ID NO: 3647972 - RNA, 14 nt, Salmonella enterica enterica serovar Typhi
acccccgcaacggc

SEQ ID NO: 3647973 - RNA, 22 nt, Salmonella enterica enterica serovar Typhi
acccccuccuuguaagggaggu

SEQ ID NO: 3647974 - RNA, 13 nt, Salmonella enterica enterica serovar Typhi
acccccuggccgg

SEQ ID NO: 3647975 - RNA, 20 nt, Salmonella enterica enterica serovar Typhi
accccgauaaaccaggcagc

SEQ ID NO: 3647976 - RNA, 23 nt, Salmonella enterica enterica serovar Typhi
accccgccagcagguuaaacaga

SEQ ID NO: 3647977 - RNA, 13 nt, Salmonella enterica enterica serovar Typhi
accccgccugacg

SEQ ID NO: 3647978 - RNA, 19 nt, Salmonella enterica enterica serovar Typhi
accccggucacaucguuau

SEQ ID NO: 3647979 - RNA, 13 nt, Salmonella enterica enterica serovar Typhi
accccugcggcug

SEQ ID NO: 3647980 - RNA, 14 nt, Salmonella enterica enterica serovar Typhi
accccuuaguuuuc

SEQ ID NO: 3647981 - RNA, 13 nt, Salmonella enterica enterica serovar Typhi
accccuuccugca

SEQ ID NO: 3647982 - RNA, 17 nt, Salmonella enterica enterica serovar Typhi
accccuucgcccucgcc

SEQ ID NO: 3647983 - RNA, 19 nt, Salmonella enterica enterica serovar Typhi
accccuucgcccucgccag

SEQ ID NO: 3647984 - RNA, 20 nt, Salmonella enterica enterica serovar Typhi
accccuugcgcguuucugaa

SEQ ID NO: 3647985 - RNA, 14 nt, Salmonella enterica enterica serovar Typhi
acccgacacggcuc

SEQ ID NO: 3647986 - RNA, 15 nt, Salmonella enterica enterica serovar Typhi
acccgauaccgccag

SEQ ID NO: 3647987 - RNA, 19 nt, Salmonella enterica enterica serovar Typhi
acccgauaccgccagcccc

SEQ ID NO: 3647988 - RNA, 20 nt, Salmonella enterica enterica serovar Typhi
acccgaucgccauccugcac

SEQ ID NO: 3647989 - RNA, 15 nt, Salmonella enterica enterica serovar Typhi
acccgauucugccag

SEQ ID NO: 3647990 - RNA, 20 nt, Salmonella enterica enterica serovar Typhi
acccgauucugccaguucac

SEQ ID NO: 3647991 - RNA, 19 nt, Salmonella enterica enterica serovar Typhi
acccgcaaacuaauggcgc

SEQ ID NO: 3647992 - RNA, 14 nt, Salmonella enterica enterica serovar Typhi
acccgcaauaccaa

SEQ ID NO: 3647993 - RNA, 15 nt, Salmonella enterica enterica serovar Typhi
acccgcaaugugcag

SEQ ID NO: 3647994 - RNA, 17 nt, Salmonella enterica enterica serovar Typhi
acccgcacuaccagcuc

SEQ ID NO: 3647995 - RNA, 15 nt, Salmonella enterica enterica serovar Typhi
acccgcagccagaac

SEQ ID NO: 3647996 - RNA, 20 nt, Salmonella enterica enterica serovar Typhi
acccgcagccagaacagaag

SEQ ID NO: 3647997 - RNA, 15 nt, Salmonella enterica enterica serovar Typhi
acccgcagcggaaga

SEQ ID NO: 3647998 - RNA, 13 nt, Salmonella enterica enterica serovar Typhi
acccgcaggccug

SEQ ID NO: 3647999 - RNA, 15 nt, Salmonella enterica enterica serovar Typhi
acccgcccagaucag

SEQ ID NO: 3648000 - RNA, 16 nt, Salmonella enterica enterica serovar Typhi
acccgccgccagcacc

SEQ ID NO: 3648001 - RNA, 17 nt, Salmonella enterica enterica serovar Typhi
acccgccggcagcagcu

SEQ ID NO: 3648002 - RNA, 15 nt, Salmonella enterica enterica serovar Typhi
acccgcgccagcagg

SEQ ID NO: 3648003 - RNA, 18 nt, Salmonella enterica enterica serovar Typhi
acccgcgcucuccggcac

SEQ ID NO: 3648004 - RNA, 16 nt, Salmonella enterica enterica serovar Typhi
acccgcgggcggcguu

SEQ ID NO: 3648005 - RNA, 17 nt, Salmonella enterica enterica serovar Typhi
acccgcgugcggacgua

SEQ ID NO: 3648006 - RNA, 13 nt, Salmonella enterica enterica serovar Typhi
acccgcuaugaag

SEQ ID NO: 3648007 - RNA, 15 nt, Salmonella enterica enterica serovar Typhi
acccgcuaugaagac

SEQ ID NO: 3648008 - RNA, 16 nt, Salmonella enterica enterica serovar Typhi
acccgcugcuucacgg

SEQ ID NO: 3648009 - RNA, 22 nt, Salmonella enterica enterica serovar Typhi
acccgcuuacaauuuaucugcg

SEQ ID NO: 3648010 - RNA, 20 nt, Salmonella enterica enterica serovar Typhi
acccgcuucacgaagcgggu

SEQ ID NO: 3648011 - RNA, 13 nt, Salmonella enterica enterica serovar Typhi
acccggauauccg

SEQ ID NO: 3648012 - RNA, 23 nt, Salmonella enterica enterica serovar Typhi
acccggcaaaggaauuacgggcg

SEQ ID NO: 3648013 - RNA, 16 nt, Salmonella enterica enterica serovar Typhi
acccggcaauucaucc

SEQ ID NO: 3648014 - RNA, 19 nt, Salmonella enterica enterica serovar Typhi
acccggcuaaaugacgcgc

SEQ ID NO: 3648015 - RNA, 22 nt, Salmonella enterica enterica serovar Typhi
acccggcugccauuaucaccau

SEQ ID NO: 3648016 - RNA, 16 nt, Salmonella enterica enterica serovar Typhi
acccggcuuuugcuuu

SEQ ID NO: 3648017 - RNA, 21 nt, Salmonella enterica enterica serovar Typhi
acccggcuuuuuuauugccua

SEQ ID NO: 3648018 - RNA, 18 nt, Salmonella enterica enterica serovar Typhi
acccgggaaaaaugacgc

SEQ ID NO: 3648019 - RNA, 20 nt, Salmonella enterica enterica serovar Typhi
acccggugcggcaagcgcgc

SEQ ID NO: 3648020 - RNA, 16 nt, Salmonella enterica enterica serovar Typhi
acccgugcgcgucgcc

SEQ ID NO: 3648021 - RNA, 20 nt, Salmonella enterica enterica serovar Typhi
acccguuaaauaccagcacc

SEQ ID NO: 3648022 - RNA, 12 nt, Salmonella enterica enterica serovar Typhi
acccguuuucau

SEQ ID NO: 3648023 - RNA, 22 nt, Salmonella enterica enterica serovar Typhi
acccguuuucuccuucauccag

SEQ ID NO: 3648024 - RNA, 14 nt, Salmonella enterica enterica serovar Typhi
acccuauccgccag

SEQ ID NO: 3648025 - RNA, 16 nt, Salmonella enterica enterica serovar Typhi
acccugaaaaguuaca

SEQ ID NO: 3648026 - RNA, 16 nt, Salmonella enterica enterica serovar Typhi
acccugaaauccggcu

SEQ ID NO: 3648027 - RNA, 16 nt, Salmonella enterica enterica serovar Typhi
acccugagcgccgcca

SEQ ID NO: 3648028 - RNA, 22 nt, Salmonella enterica enterica serovar Typhi
acccuggcauauggauauucau

SEQ ID NO: 3648029 - RNA, 15 nt, Salmonella enterica enterica serovar Typhi
acccugguuugcugg

SEQ ID NO: 3648030 - RNA, 18 nt, Salmonella enterica enterica serovar Typhi
acccuuccccggcagccu

SEQ ID NO: 3648031 - RNA, 20 nt, Salmonella enterica enterica serovar Typhi
acccuucuucuggcucagac

SEQ ID NO: 3648032 - RNA, 12 nt, Salmonella enterica enterica serovar Typhi
acccuugcggcu

SEQ ID NO: 3648033 - RNA, 14 nt, Salmonella enterica enterica serovar Typhi
acccuuuggccacc

SEQ ID NO: 3648034 - RNA, 22 nt, Salmonella enterica enterica serovar Typhi
accgaaacgcauacgcaggacu

SEQ ID NO: 3648035 - RNA, 13 nt, Salmonella enterica enterica serovar Typhi
accgaaaucauca

SEQ ID NO: 3648036 - RNA, 15 nt, Salmonella enterica enterica serovar Typhi
accgcucgccgccuc

SEQ ID NO: 3648037 - RNA, 14 nt, Salmonella enterica enterica serovar Typhi
accgcugacugaac

SEQ ID NO: 3648038 - RNA, 17 nt, Salmonella enterica enterica serovar Typhi
accgcugcggaacacca

SEQ ID NO: 3648039 - RNA, 17 nt, Salmonella enterica enterica serovar Typhi
accgcugggaugaccug

SEQ ID NO: 3648040 - RNA, 18 nt, Salmonella enterica enterica serovar Typhi
accgcuuaacagcguaca

SEQ ID NO: 3648041 - RNA, 13 nt, Salmonella enterica enterica serovar Typhi
accgcuuaacucc

SEQ ID NO: 3648042 - RNA, 22 nt, Salmonella enterica enterica serovar Typhi
accgcuucgaaguuuugaguuu

SEQ ID NO: 3648043 - RNA, 17 nt, Salmonella enterica enterica serovar Typhi
accgcuucgccuucgcc

SEQ ID NO: 3648044 - RNA, 16 nt, Salmonella enterica enterica serovar Typhi
accgcuucgcgcgcca

SEQ ID NO: 3648045 - RNA, 17 nt, Salmonella enterica enterica serovar Typhi
accgcuuuaugcgcuuc

SEQ ID NO: 3648046 - RNA, 17 nt, Salmonella enterica enterica serovar Typhi
accgcuuucccggcaug

SEQ ID NO: 3648047 - RNA, 22 nt, Salmonella enterica enterica serovar Typhi
accgcuuuggcgcccauuucgu

SEQ ID NO: 3648048 - RNA, 23 nt, Salmonella enterica enterica serovar Typhi
accgcuuuucgguuacguucggc

SEQ ID NO: 3648049 - RNA, 16 nt, Salmonella enterica enterica serovar Typhi
accggauggaucaucg

SEQ ID NO: 3648050 - RNA, 21 nt, Salmonella enterica enterica serovar Typhi
accggaugggcagauagaaug

SEQ ID NO: 3648051 - RNA, 21 nt, Salmonella enterica enterica serovar Typhi
accggauuugacguuauccag

SEQ ID NO: 3648052 - RNA, 22 nt, Salmonella enterica enterica serovar Typhi
accggcaaauaccgucauaauc

SEQ ID NO: 3648053 - RNA, 16 nt, Salmonella enterica enterica serovar Typhi
accggcaaccgguacu

SEQ ID NO: 3648054 - RNA, 22 nt, Salmonella enterica enterica serovar Typhi
accggcagcggucaucaaugau

SEQ ID NO: 3648055 - RNA, 13 nt, Salmonella enterica enterica serovar Typhi
accggcagcguca

SEQ ID NO: 3648056 - RNA, 15 nt, Salmonella enterica enterica serovar Typhi
accggcagcgucagc

SEQ ID NO: 3648057 - RNA, 20 nt, Salmonella enterica enterica serovar Typhi
accggcagcgucagcccaag

SEQ ID NO: 3648058 - RNA, 16 nt, Salmonella enterica enterica serovar Typhi
accggcaucucaucuu

SEQ ID NO: 3648059 - RNA, 13 nt, Salmonella enterica enterica serovar Typhi
accggcauuucac

SEQ ID NO: 3648060 - RNA, 20 nt, Salmonella enterica enterica serovar Typhi
accggccacaauugccagca

SEQ ID NO: 3648061 - RNA, 23 nt, Salmonella enterica enterica serovar Typhi
accggccacaauugccagcaggu

SEQ ID NO: 3648062 - RNA, 17 nt, Salmonella enterica enterica serovar Typhi
accggccacgagcuguc

SEQ ID NO: 3648063 - RNA, 17 nt, Salmonella enterica enterica serovar Typhi
accggccagcgucauca

SEQ ID NO: 3648064 - RNA, 18 nt, Salmonella enterica enterica serovar Typhi
accggccauugccgcgcc

SEQ ID NO: 3648065 - RNA, 15 nt, Salmonella enterica enterica serovar Typhi
accggcccacgcagu

SEQ ID NO: 3648066 - RNA, 14 nt, Salmonella enterica enterica serovar Typhi
accggccugccuau

SEQ ID NO: 3648067 - RNA, 19 nt, Salmonella enterica enterica serovar Typhi
accggcgacgugacgcgcc

SEQ ID NO: 3648068 - RNA, 15 nt, Salmonella enterica enterica serovar Typhi
accggcgccagcucu

SEQ ID NO: 3648069 - RNA, 19 nt, Salmonella enterica enterica serovar Typhi
accggcgcgaacggcgggu

SEQ ID NO: 3648070 - RNA, 12 nt, Salmonella enterica enterica serovar Typhi
accggcgcgccu

SEQ ID NO: 3648071 - RNA, 20 nt, Salmonella enterica enterica serovar Typhi
accggcgcgccuuccagcaa

SEQ ID NO: 3648072 - RNA, 15 nt, Salmonella enterica enterica serovar Typhi
accggcggaauagcu

SEQ ID NO: 3648073 - RNA, 19 nt, Salmonella enterica enterica serovar Typhi
accggcggccuaccaguug

SEQ ID NO: 3648074 - RNA, 19 nt, Salmonella enterica enterica serovar Typhi
accggcguaauugcgccug

SEQ ID NO: 3648075 - RNA, 20 nt, Salmonella enterica enterica serovar Typhi
accggcguccccguucugac

SEQ ID NO: 3648076 - RNA, 13 nt, Salmonella enterica enterica serovar Typhi
accggcuccggca

SEQ ID NO: 3648077 - RNA, 17 nt, Salmonella enterica enterica serovar Typhi
accggcucgucguugaa

SEQ ID NO: 3648078 - RNA, 20 nt, Salmonella enterica enterica serovar Typhi
accggcuguauuuucgauaa

SEQ ID NO: 3648079 - RNA, 18 nt, Salmonella enterica enterica serovar Typhi
accggcugugggcguguc

SEQ ID NO: 3648080 - RNA, 23 nt, Salmonella enterica enterica serovar Typhi
accggcuguucacguaccaggca

SEQ ID NO: 3648081 - RNA, 20 nt, Salmonella enterica enterica serovar Typhi
accgggagaaaacgcggccu

SEQ ID NO: 3648082 - RNA, 14 nt, Salmonella enterica enterica serovar Typhi
accgggcaaacauu

SEQ ID NO: 3648083 - RNA, 14 nt, Salmonella enterica enterica serovar Typhi
accgggcaggauac

SEQ ID NO: 3648084 - RNA, 18 nt, Salmonella enterica enterica serovar Typhi
accgggcaggauacggcg

SEQ ID NO: 3648085 - RNA, 12 nt, Salmonella enterica enterica serovar Typhi
accgggcuaaac

SEQ ID NO: 3648086 - RNA, 20 nt, Salmonella enterica enterica serovar Typhi
accgggcucacgcuggugcu

SEQ ID NO: 3648087 - RNA, 21 nt, Salmonella enterica enterica serovar Typhi
accgggcucacgcuggugcuu

SEQ ID NO: 3648088 - RNA, 15 nt, Salmonella enterica enterica serovar Typhi
accgggcugcagccc

SEQ ID NO: 3648089 - RNA, 19 nt, Salmonella enterica enterica serovar Typhi
accggggcgcucgccugau

SEQ ID NO: 3648090 - RNA, 18 nt, Salmonella enterica enterica serovar Typhi
accgggucgauaaacagc

SEQ ID NO: 3648091 - RNA, 17 nt, Salmonella enterica enterica serovar Typhi
accgggucgcagaacau

SEQ ID NO: 3648092 - RNA, 15 nt, Salmonella enterica enterica serovar Typhi
accggguuaaagccc

SEQ ID NO: 3648093 - RNA, 19 nt, Salmonella enterica enterica serovar Typhi
accgguaacugucagauca

SEQ ID NO: 3648094 - RNA, 15 nt, Salmonella enterica enterica serovar Typhi
accgguacucuucca

SEQ ID NO: 3648095 - RNA, 18 nt, Salmonella enterica enterica serovar Typhi
accgguagccaggcgcga

SEQ ID NO: 3648096 - RNA, 15 nt, Salmonella enterica enterica serovar Typhi
accggucagaaaucc

SEQ ID NO: 3648097 - RNA, 18 nt, Salmonella enterica enterica serovar Typhi
accggucuggcucacuga

SEQ ID NO: 3648098 - RNA, 19 nt, Salmonella enterica enterica serovar Typhi
accggugcgauucagcgca

SEQ ID NO: 3648099 - RNA, 13 nt, Salmonella enterica enterica serovar Typhi
accggugcgcccc

SEQ ID NO: 3648100 - RNA, 19 nt, Salmonella enterica enterica serovar Typhi
accggugcgccccagcaug

SEQ ID NO: 3648101 - RNA, 13 nt, Salmonella enterica enterica serovar Typhi
accgguuuuuccg

SEQ ID NO: 3648102 - RNA, 17 nt, Salmonella enterica enterica serovar Typhi
accguaaacgccugcac

SEQ ID NO: 3648103 - RNA, 22 nt, Salmonella enterica enterica serovar Typhi
accguaaucaucgcgaucgcca

SEQ ID NO: 3648104 - RNA, 14 nt, Salmonella enterica enterica serovar Typhi
accguagaucgcca

SEQ ID NO: 3648105 - RNA, 22 nt, Salmonella enterica enterica serovar Typhi
accguaguagguauccagcaga

SEQ ID NO: 3648106 - RNA, 18 nt, Salmonella enterica enterica serovar Typhi
accguagugacacgguca

SEQ ID NO: 3648107 - RNA, 19 nt, Salmonella enterica enterica serovar Typhi
accguauccagacccccgg

SEQ ID NO: 3648108 - RNA, 14 nt, Salmonella enterica enterica serovar Typhi
accguauccgccac

SEQ ID NO: 3648109 - RNA, 18 nt, Salmonella enterica enterica serovar Typhi
accguauccuuccagccc

SEQ ID NO: 3648110 - RNA, 21 nt, Salmonella enterica enterica serovar Typhi
accguaucgcccagcuuaugc

SEQ ID NO: 3648111 - RNA, 22 nt, Salmonella enterica enterica serovar Typhi
accgucaauaacgggcacgguc

SEQ ID NO: 3648112 - RNA, 14 nt, Salmonella enterica enterica serovar Typhi
accgucagcagcac

SEQ ID NO: 3648113 - RNA, 16 nt, Salmonella enterica enterica serovar Typhi
accgucagcuccggua

SEQ ID NO: 3648114 - RNA, 16 nt, Salmonella enterica enterica serovar Typhi
accgucaguaccagcg

SEQ ID NO: 3648115 - RNA, 13 nt, Salmonella enterica enterica serovar Typhi
accgucaugacgu

SEQ ID NO: 3648116 - RNA, 21 nt, Salmonella enterica enterica serovar Typhi
accgucauuuccggcgcgguc

SEQ ID NO: 3648117 - RNA, 18 nt, Salmonella enterica enterica serovar Typhi
accgucgagaaaccgcuc

SEQ ID NO: 3648118 - RNA, 18 nt, Salmonella enterica enterica serovar Typhi
accgucgcgcccuccucc

SEQ ID NO: 3648119 - RNA, 21 nt, Salmonella enterica enterica serovar Typhi
accgucgcgcccuccuccagc

SEQ ID NO: 3648120 - RNA, 14 nt, Salmonella enterica enterica serovar Typhi
accgucggcacgca

SEQ ID NO: 3648121 - RNA, 17 nt, Salmonella enterica enterica serovar Typhi
accgucggcgcaaccau

SEQ ID NO: 3648122 - RNA, 18 nt, Salmonella enterica enterica serovar Typhi
accugauugauacgcgcc

SEQ ID NO: 3648123 - RNA, 23 nt, Salmonella enterica enterica serovar Typhi
accugauugauacgcgcccgauc

SEQ ID NO: 3648124 - RNA, 20 nt, Salmonella enterica enterica serovar Typhi
accugcaaacguagcgcguc

SEQ ID NO: 3648125 - RNA, 22 nt, Salmonella enterica enterica serovar Typhi
accugcacaucgccauuaaaag

SEQ ID NO: 3648126 - RNA, 23 nt, Salmonella enterica enterica serovar Typhi
accugcagggugaagauggcgcc

SEQ ID NO: 3648127 - RNA, 24 nt, Salmonella enterica enterica serovar Typhi
accugcagguuuaaaaccggccag

SEQ ID NO: 3648128 - RNA, 14 nt, Salmonella enterica enterica serovar Typhi
accugcaucacgcc

SEQ ID NO: 3648129 - RNA, 20 nt, Salmonella enterica enterica serovar Typhi
accugccacaggccaacaua

SEQ ID NO: 3648130 - RNA, 19 nt, Salmonella enterica enterica serovar Typhi
accugccaguccgcccgcc

SEQ ID NO: 3648131 - RNA, 19 nt, Salmonella enterica enterica serovar Typhi
accugcccuuucagagcgu

SEQ ID NO: 3648132 - RNA, 20 nt, Salmonella enterica enterica serovar Typhi
accugcccuuucuucaaugg

SEQ ID NO: 3648133 - RNA, 13 nt, Salmonella enterica enterica serovar Typhi
accugccgaugaa

SEQ ID NO: 3648134 - RNA, 18 nt, Salmonella enterica enterica serovar Typhi
accugccgaugaaagagc

SEQ ID NO: 3648135 - RNA, 19 nt, Salmonella enterica enterica serovar Typhi
accugccguuuuccagccg

SEQ ID NO: 3648136 - RNA, 22 nt, Salmonella enterica enterica serovar Typhi
accugccugucacgcagggggu

SEQ ID NO: 3648137 - RNA, 20 nt, Salmonella enterica enterica serovar Typhi
accugcgcgacggcggcguc

SEQ ID NO: 3648138 - RNA, 15 nt, Salmonella enterica enterica serovar Typhi
accugcgcugacggc

SEQ ID NO: 3648139 - RNA, 21 nt, Salmonella enterica enterica serovar Typhi
accugcgcugacggcggcaga

SEQ ID NO: 3648140 - RNA, 20 nt, Salmonella enterica enterica serovar Typhi
accugcuccagauuacuaug

SEQ ID NO: 3648141 - RNA, 19 nt, Salmonella enterica enterica serovar Typhi
accugcuguaccucuugcu

SEQ ID NO: 3648142 - RNA, 18 nt, Salmonella enterica enterica serovar Typhi
accuggaaguuuugcugg

SEQ ID NO: 3648143 - RNA, 19 nt, Salmonella enterica enterica serovar Typhi
accuggccguugauaaagu

SEQ ID NO: 3648144 - RNA, 15 nt, Salmonella enterica enterica serovar Typhi
accuggcggagcugc

SEQ ID NO: 3648145 - RNA, 23 nt, Salmonella enterica enterica serovar Typhi
accuggcgggcagccuucaaguu

SEQ ID NO: 3648146 - RNA, 18 nt, Salmonella enterica enterica serovar Typhi
accuggcguaguacgcgc

SEQ ID NO: 3648147 - RNA, 17 nt, Salmonella enterica enterica serovar Typhi
accugggaaucgugcaa

SEQ ID NO: 3648148 - RNA, 20 nt, Salmonella enterica enterica serovar Typhi
accugguauuacaacguucg

SEQ ID NO: 3648149 - RNA, 23 nt, Salmonella enterica enterica serovar Typhi
accuguaucugcugacacccucu

SEQ ID NO: 3648150 - RNA, 12 nt, Salmonella enterica enterica serovar Typhi
accuguuuguuu

SEQ ID NO: 3648151 - RNA, 20 nt, Salmonella enterica enterica serovar Typhi
accuuaaaaggcgcucgccu

SEQ ID NO: 3648152 - RNA, 18 nt, Salmonella enterica enterica serovar Typhi
accuuaagcgcgaaauuu

SEQ ID NO: 3648153 - RNA, 11 nt, Salmonella enterica enterica serovar Typhi
accuuaaugau

SEQ ID NO: 3648154 - RNA, 21 nt, Salmonella enterica enterica serovar Typhi
accuuaauuugugauugcaga

SEQ ID NO: 3648155 - RNA, 23 nt, Salmonella enterica enterica serovar Typhi
accuuacgcacaugaucuucguu

SEQ ID NO: 3648156 - RNA, 20 nt, Salmonella enterica enterica serovar Typhi
accuuacgcucgcugauggc

SEQ ID NO: 3648157 - RNA, 21 nt, Salmonella enterica enterica serovar Typhi
accuuacuuguaggccuggua

SEQ ID NO: 3648158 - RNA, 17 nt, Salmonella enterica enterica serovar Typhi
accuuaucgagaauacu

SEQ ID NO: 3648159 - RNA, 20 nt, Salmonella enterica enterica serovar Typhi
accuucaacccagcagcaga

SEQ ID NO: 3648160 - RNA, 19 nt, Salmonella enterica enterica serovar Typhi
accuucaagaaucaauaua

SEQ ID NO: 3648161 - RNA, 17 nt, Salmonella enterica enterica serovar Typhi
accuucacccccaucgc

SEQ ID NO: 3648162 - RNA, 19 nt, Salmonella enterica enterica serovar Typhi
accuucacccccaucgccc

SEQ ID NO: 3648163 - RNA, 18 nt, Salmonella enterica enterica serovar Typhi
accuucacgcagugcgcg

SEQ ID NO: 3648164 - RNA, 18 nt, Salmonella enterica enterica serovar Typhi
accuucacgccgccaaag

SEQ ID NO: 3648165 - RNA, 19 nt, Salmonella enterica enterica serovar Typhi
accuucgcuuuuaaaacuu

SEQ ID NO: 3648166 - RNA, 13 nt, Salmonella enterica enterica serovar Typhi
accuucggccucc

SEQ ID NO: 3648167 - RNA, 22 nt, Salmonella enterica enterica serovar Typhi
accuucggccuccgcuuccugc

SEQ ID NO: 3648168 - RNA, 19 nt, Salmonella enterica enterica serovar Typhi
accuucggucccaucgcgc

SEQ ID NO: 3648169 - RNA, 15 nt, Salmonella enterica enterica serovar Typhi
accuucucuuuaugc

SEQ ID NO: 3648170 - RNA, 22 nt, Salmonella enterica enterica serovar Typhi
accuucugugaaaguuucagga

SEQ ID NO: 3648171 - RNA, 15 nt, Salmonella enterica enterica serovar Typhi
accuucuuuuggaaa

SEQ ID NO: 3648172 - RNA, 18 nt, Salmonella enterica enterica serovar Typhi
accuugauucccuuuugc

SEQ ID NO: 3648173 - RNA, 14 nt, Salmonella enterica enterica serovar Typhi
accuugcccuggaa

SEQ ID NO: 3648174 - RNA, 20 nt, Salmonella enterica enterica serovar Typhi
accuuuaaccucuuuuucau

SEQ ID NO: 3648175 - RNA, 13 nt, Salmonella enterica enterica serovar Typhi
accuuucugccag

SEQ ID NO: 3648176 - RNA, 19 nt, Salmonella enterica enterica serovar Typhi
accuuucuucucuucuuca

SEQ ID NO: 3648177 - RNA, 22 nt, Salmonella enterica enterica serovar Typhi
accuuugcccgagcgcuggcau

SEQ ID NO: 3648178 - RNA, 19 nt, Salmonella enterica enterica serovar Typhi
accuuugggcagauaucgg

SEQ ID NO: 3648179 - RNA, 15 nt, Salmonella enterica enterica serovar Typhi
accuuuuacuucacg

SEQ ID NO: 3648180 - RNA, 14 nt, Salmonella enterica enterica serovar Typhi
accuuuugccgccc

SEQ ID NO: 3648181 - RNA, 13 nt, Salmonella enterica enterica serovar Typhi
acgaaaaauaaaa

SEQ ID NO: 3648182 - RNA, 21 nt, Salmonella enterica enterica serovar Typhi
acgaaaaaugaauaccaaguc

SEQ ID NO: 3648183 - RNA, 17 nt, Salmonella enterica enterica serovar Typhi
acgaaaaccguccacau

SEQ ID NO: 3648184 - RNA, 22 nt, Salmonella enterica enterica serovar Typhi
acgaaaauuauuuucgaugccc

SEQ ID NO: 3648185 - RNA, 14 nt, Salmonella enterica enterica serovar Typhi
acgaaacgcaucgu

SEQ ID NO: 3648186 - RNA, 12 nt, Salmonella enterica enterica serovar Typhi
acgaaacucagc

SEQ ID NO: 3648187 - RNA, 13 nt, Salmonella enterica enterica serovar Typhi
acgaaacucagcg

SEQ ID NO: 3648188 - RNA, 17 nt, Salmonella enterica enterica serovar Typhi
acgaaagucuguucgua

SEQ ID NO: 3648189 - RNA, 15 nt, Salmonella enterica enterica serovar Typhi
acgaaauagcgcagc

SEQ ID NO: 3648190 - RNA, 21 nt, Salmonella enterica enterica serovar Typhi
acgaaaucagagacaaauaca

SEQ ID NO: 3648191 - RNA, 18 nt, Salmonella enterica enterica serovar Typhi
acgaacaacaucagacag

SEQ ID NO: 3648192 - RNA, 19 nt, Salmonella enterica enterica serovar Typhi
acgaaccugauuguuuuac

SEQ ID NO: 3648193 - RNA, 20 nt, Salmonella enterica enterica serovar Typhi
acgaacgcuggcacuuuccg

SEQ ID NO: 3648194 - RNA, 17 nt, Salmonella enterica enterica serovar Typhi
acgaagagaccugugua

SEQ ID NO: 3648195 - RNA, 17 nt, Salmonella enterica enterica serovar Typhi
acgaagaucgucgauca

SEQ ID NO: 3648196 - RNA, 12 nt, Salmonella enterica enterica serovar Typhi
acgaagcgcaaa

SEQ ID NO: 3648197 - RNA, 23 nt, Salmonella enterica enterica serovar Typhi
acgaagcgggcaauuccggucau

SEQ ID NO: 3648198 - RNA, 11 nt, Salmonella enterica enterica serovar Typhi
acgaaggucag

SEQ ID NO: 3648199 - RNA, 12 nt, Salmonella enterica enterica serovar Typhi
acgaaguuuaau

SEQ ID NO: 3648200 - RNA, 17 nt, Salmonella enterica enterica serovar Typhi
acgaaguuuaauucuuu

SEQ ID NO: 3648201 - RNA, 17 nt, Salmonella enterica enterica serovar Typhi
acgaauaagaaucagau

SEQ ID NO: 3648202 - RNA, 17 nt, Salmonella enterica enterica serovar Typhi
acgaauaccugaaagag

SEQ ID NO: 3648203 - RNA, 13 nt, Salmonella enterica enterica serovar Typhi
acgaauagcgcgc

SEQ ID NO: 3648204 - RNA, 12 nt, Salmonella enterica enterica serovar Typhi
acgaaucaggau

SEQ ID NO: 3648205 - RNA, 17 nt, Salmonella enterica enterica serovar Typhi
acgaaucaggauauucg

SEQ ID NO: 3648206 - RNA, 20 nt, Salmonella enterica enterica serovar Typhi
acgaaucuggucguaagaau

SEQ ID NO: 3648207 - RNA, 17 nt, Salmonella enterica enterica serovar Typhi
acgcagaucguauccag

SEQ ID NO: 3648208 - RNA, 14 nt, Salmonella enterica enterica serovar Typhi
acgcagcaagaaca

SEQ ID NO: 3648209 - RNA, 15 nt, Salmonella enterica enterica serovar Typhi
acgcagcaagaacag

SEQ ID NO: 3648210 - RNA, 17 nt, Salmonella enterica enterica serovar Typhi
acgcagcaagaacagag

SEQ ID NO: 3648211 - RNA, 19 nt, Salmonella enterica enterica serovar Typhi
acgcagcacguccagauac

SEQ ID NO: 3648212 - RNA, 14 nt, Salmonella enterica enterica serovar Typhi
acgcagcauuucgu

SEQ ID NO: 3648213 - RNA, 12 nt, Salmonella enterica enterica serovar Typhi
acgcagccaugu

SEQ ID NO: 3648214 - RNA, 17 nt, Salmonella enterica enterica serovar Typhi
acgcagcgcauccacca

SEQ ID NO: 3648215 - RNA, 20 nt, Salmonella enterica enterica serovar Typhi
acgcagcgccuucgcuucga

SEQ ID NO: 3648216 - RNA, 14 nt, Salmonella enterica enterica serovar Typhi
acgcagcuccagcu

SEQ ID NO: 3648217 - RNA, 13 nt, Salmonella enterica enterica serovar Typhi
acgcagcuuaaag

SEQ ID NO: 3648218 - RNA, 22 nt, Salmonella enterica enterica serovar Typhi
acgcagcuuaaagccaauccag

SEQ ID NO: 3648219 - RNA, 16 nt, Salmonella enterica enterica serovar Typhi
acgcaggcuaacgcgc

SEQ ID NO: 3648220 - RNA, 22 nt, Salmonella enterica enterica serovar Typhi
acgcaggcuugcccauucgccg

SEQ ID NO: 3648221 - RNA, 20 nt, Salmonella enterica enterica serovar Typhi
acgcauaaugcgccccgcaa

SEQ ID NO: 3648222 - RNA, 23 nt, Salmonella enterica enterica serovar Typhi
acgcauaguccugccgacaggca

SEQ ID NO: 3648223 - RNA, 16 nt, Salmonella enterica enterica serovar Typhi
acgcauauccagcaga

SEQ ID NO: 3648224 - RNA, 17 nt, Salmonella enterica enterica serovar Typhi
acgcauauccagcagau

SEQ ID NO: 3648225 - RNA, 20 nt, Salmonella enterica enterica serovar Typhi
acgcauaucccacugcacgc

SEQ ID NO: 3648226 - RNA, 20 nt, Salmonella enterica enterica serovar Typhi
acgcaucaaagccacccacg

SEQ ID NO: 3648227 - RNA, 12 nt, Salmonella enterica enterica serovar Typhi
acgcaucaaaua

SEQ ID NO: 3648228 - RNA, 23 nt, Salmonella enterica enterica serovar Typhi
acgcaucaaauaccuuuucauug

SEQ ID NO: 3648229 - RNA, 22 nt, Salmonella enterica enterica serovar Typhi
acgcaucauauucgcagcucug

SEQ ID NO: 3648230 - RNA, 13 nt, Salmonella enterica enterica serovar Typhi
acgcauccagcgu

SEQ ID NO: 3648231 - RNA, 13 nt, Salmonella enterica enterica serovar Typhi
acgcaucccgcca

SEQ ID NO: 3648232 - RNA, 18 nt, Salmonella enterica enterica serovar Typhi
acgcaucccgccaaccag

SEQ ID NO: 3648233 - RNA, 14 nt, Salmonella enterica enterica serovar Typhi
acgcauccugcacu

SEQ ID NO: 3648234 - RNA, 23 nt, Salmonella enterica enterica serovar Typhi
acgcaucgcugcgcuuacacacc

SEQ ID NO: 3648235 - RNA, 17 nt, Salmonella enterica enterica serovar Typhi
acgcaucguggccgaua

SEQ ID NO: 3648236 - RNA, 15 nt, Salmonella enterica enterica serovar Typhi
acgcaucuuuuuccc

SEQ ID NO: 3648237 - RNA, 13 nt, Salmonella enterica enterica serovar Typhi
acgcaugaagcgu

SEQ ID NO: 3648238 - RNA, 18 nt, Salmonella enterica enterica serovar Typhi
acgcaugacccaggcauc

SEQ ID NO: 3648239 - RNA, 18 nt, Salmonella enterica enterica serovar Typhi
acgcauggcguugcugca

SEQ ID NO: 3648240 - RNA, 18 nt, Salmonella enterica enterica serovar Typhi
acgcauugagacaugccg

SEQ ID NO: 3648241 - RNA, 20 nt, Salmonella enterica enterica serovar Typhi
acgcauugagacaugccgcc

SEQ ID NO: 3648242 - RNA, 23 nt, Salmonella enterica enterica serovar Typhi
acgcauugccauguuaauaccag

SEQ ID NO: 3648243 - RNA, 19 nt, Salmonella enterica enterica serovar Typhi
acgcauuucaagcaggcga

SEQ ID NO: 3648244 - RNA, 15 nt, Salmonella enterica enterica serovar Typhi
acgccaaaaagugaa

SEQ ID NO: 3648245 - RNA, 16 nt, Salmonella enterica enterica serovar Typhi
acgccaaaccugccac

SEQ ID NO: 3648246 - RNA, 19 nt, Salmonella enterica enterica serovar Typhi
acgccaacguccgccguca

SEQ ID NO: 3648247 - RNA, 13 nt, Salmonella enterica enterica serovar Typhi
acgccaagcagcg

SEQ ID NO: 3648248 - RNA, 23 nt, Salmonella enterica enterica serovar Typhi
acgccaagcagcggcguaucuuc

SEQ ID NO: 3648249 - RNA, 21 nt, Salmonella enterica enterica serovar Typhi
acgccaagcgcggcagcagcu

SEQ ID NO: 3648250 - RNA, 15 nt, Salmonella enterica enterica serovar Typhi
acgccaagcugcaau

SEQ ID NO: 3648251 - RNA, 20 nt, Salmonella enterica enterica serovar Typhi
acgccacaaacugcgcuagc

SEQ ID NO: 3648252 - RNA, 15 nt, Salmonella enterica enterica serovar Typhi
acgccacaguugguu

SEQ ID NO: 3648253 - RNA, 17 nt, Salmonella enterica enterica serovar Typhi
acgccaccgccgccacc

SEQ ID NO: 3648254 - RNA, 22 nt, Salmonella enterica enterica serovar Typhi
acgccaccgccgccaccaaaaa

SEQ ID NO: 3648255 - RNA, 22 nt, Salmonella enterica enterica serovar Typhi
acgccaccggguuaaagcccug

SEQ ID NO: 3648256 - RNA, 19 nt, Salmonella enterica enterica serovar Typhi
acgccaccuuugaaaauca

SEQ ID NO: 3648257 - RNA, 19 nt, Salmonella enterica enterica serovar Typhi
acgccagauaaaucagccc

SEQ ID NO: 3648258 - RNA, 16 nt, Salmonella enterica enterica serovar Typhi
acgccagauaaucgcc

SEQ ID NO: 3648259 - RNA, 17 nt, Salmonella enterica enterica serovar Typhi
acgccagauuaucggcc

SEQ ID NO: 3648260 - RNA, 11 nt, Salmonella enterica enterica serovar Typhi
acgccagcaga

SEQ ID NO: 3648261 - RNA, 23 nt, Salmonella enterica enterica serovar Typhi
acgccagcagcgcgauacgcgac

SEQ ID NO: 3648262 - RNA, 14 nt, Salmonella enterica enterica serovar Typhi
acgccagcagcucg

SEQ ID NO: 3648263 - RNA, 16 nt, Salmonella enterica enterica serovar Typhi
acgccagccacugacu

SEQ ID NO: 3648264 - RNA, 11 nt, Salmonella enterica enterica serovar Typhi
acgccagccag

SEQ ID NO: 3648265 - RNA, 17 nt, Salmonella enterica enterica serovar Typhi
acgccagcgggugaucg

SEQ ID NO: 3648266 - RNA, 16 nt, Salmonella enterica enterica serovar Typhi
acgccaggcagaacgc

SEQ ID NO: 3648267 - RNA, 19 nt, Salmonella enterica enterica serovar Typhi
acgccagucuuugcaggag

SEQ ID NO: 3648268 - RNA, 19 nt, Salmonella enterica enterica serovar Typhi
acgccauagcaucgacccu

SEQ ID NO: 3648269 - RNA, 14 nt, Salmonella enterica enterica serovar Typhi
acgccaucaacagc

SEQ ID NO: 3648270 - RNA, 22 nt, Salmonella enterica enterica serovar Typhi
acgccaucagcaaaauaccggc

SEQ ID NO: 3648271 - RNA, 14 nt, Salmonella enterica enterica serovar Typhi
acgccaucgacaaa

SEQ ID NO: 3648272 - RNA, 15 nt, Salmonella enterica enterica serovar Typhi
acgccaucggcuaag

SEQ ID NO: 3648273 - RNA, 14 nt, Salmonella enterica enterica serovar Typhi
acgccaucuuccuc

SEQ ID NO: 3648274 - RNA, 18 nt, Salmonella enterica enterica serovar Typhi
acgccaucuuucuuuucg

SEQ ID NO: 3648275 - RNA, 21 nt, Salmonella enterica enterica serovar Typhi
acgccaugacgccaagcugca

SEQ ID NO: 3648276 - RNA, 15 nt, Salmonella enterica enterica serovar Typhi
acgccaugcaaaaaa

SEQ ID NO: 3648277 - RNA, 20 nt, Salmonella enterica enterica serovar Typhi
acgccaugcucauccaacug

SEQ ID NO: 3648278 - RNA, 18 nt, Salmonella enterica enterica serovar Typhi
acgccauggccgcagccc

SEQ ID NO: 3648279 - RNA, 20 nt, Salmonella enterica enterica serovar Typhi
acgccauggggugaggcauc

SEQ ID NO: 3648280 - RNA, 20 nt, Salmonella enterica enterica serovar Typhi
acgccauuccuuuaaauauc

SEQ ID NO: 3648281 - RNA, 21 nt, Salmonella enterica enterica serovar Typhi
acgccauugcgaacaucacga

SEQ ID NO: 3648282 - RNA, 16 nt, Salmonella enterica enterica serovar Typhi
acgcccacgcggcgug

SEQ ID NO: 3648283 - RNA, 21 nt, Salmonella enterica enterica serovar Typhi
acgcccacgcggcgugcgcug

SEQ ID NO: 3648284 - RNA, 15 nt, Salmonella enterica enterica serovar Typhi
acgcccagccgugaa

SEQ ID NO: 3648285 - RNA, 17 nt, Salmonella enterica enterica serovar Typhi
acgcccaucagcauccc

SEQ ID NO: 3648286 - RNA, 21 nt, Salmonella enterica enterica serovar Typhi
acgcccaucagcaucccaccg

SEQ ID NO: 3648287 - RNA, 23 nt, Salmonella enterica enterica serovar Typhi
acgcccaucagcaucccaccgga

SEQ ID NO: 3648288 - RNA, 17 nt, Salmonella enterica enterica serovar Typhi
acgcccaugcaaccagu

SEQ ID NO: 3648289 - RNA, 22 nt, Salmonella enterica enterica serovar Typhi
acgccccgguggcgguaccggc

SEQ ID NO: 3648290 - RNA, 16 nt, Salmonella enterica enterica serovar Typhi
acgccccuaaggcagc

SEQ ID NO: 3648291 - RNA, 15 nt, Salmonella enterica enterica serovar Typhi
acgcccgcauucaua

SEQ ID NO: 3648292 - RNA, 15 nt, Salmonella enterica enterica serovar Typhi
acgcgaugccaguag

SEQ ID NO: 3648293 - RNA, 21 nt, Salmonella enterica enterica serovar Typhi
acgcgcaaaacucucaccgac

SEQ ID NO: 3648294 - RNA, 20 nt, Salmonella enterica enterica serovar Typhi
acgcgcagagauagccagcg

SEQ ID NO: 3648295 - RNA, 20 nt, Salmonella enterica enterica serovar Typhi
acgcgcaucaacgccaggca

SEQ ID NO: 3648296 - RNA, 22 nt, Salmonella enterica enterica serovar Typhi
acgcgcauccugcauaauccaa

SEQ ID NO: 3648297 - RNA, 15 nt, Salmonella enterica enterica serovar Typhi
acgcgcaucuucacu

SEQ ID NO: 3648298 - RNA, 19 nt, Salmonella enterica enterica serovar Typhi
acgcgcauuaauaugcgca

SEQ ID NO: 3648299 - RNA, 20 nt, Salmonella enterica enterica serovar Typhi
acgcgcauuaauaugcgcaa

SEQ ID NO: 3648300 - RNA, 23 nt, Salmonella enterica enterica serovar Typhi
acgcgcauuaauaugcgcaauca

SEQ ID NO: 3648301 - RNA, 15 nt, Salmonella enterica enterica serovar Typhi
acgcgccacgcgcca

SEQ ID NO: 3648302 - RNA, 15 nt, Salmonella enterica enterica serovar Typhi
acgcgccagcaaaau

SEQ ID NO: 3648303 - RNA, 21 nt, Salmonella enterica enterica serovar Typhi
acgcgccagcagugggaaaau

SEQ ID NO: 3648304 - RNA, 17 nt, Salmonella enterica enterica serovar Typhi
acgcgccaucagacucu

SEQ ID NO: 3648305 - RNA, 15 nt, Salmonella enterica enterica serovar Typhi
acgcgccauccggca

SEQ ID NO: 3648306 - RNA, 18 nt, Salmonella enterica enterica serovar Typhi
acgcgccgccagcgacuu

SEQ ID NO: 3648307 - RNA, 23 nt, Salmonella enterica enterica serovar Typhi
acgcgccugcucccgcugcggcg

SEQ ID NO: 3648308 - RNA, 18 nt, Salmonella enterica enterica serovar Typhi
acgcgcgagaacugcugc

SEQ ID NO: 3648309 - RNA, 20 nt, Salmonella enterica enterica serovar Typhi
acgcgcgccugccgccagca

SEQ ID NO: 3648310 - RNA, 15 nt, Salmonella enterica enterica serovar Typhi
acgcgcuagcuucag

SEQ ID NO: 3648311 - RNA, 19 nt, Salmonella enterica enterica serovar Typhi
acgcgcucaccuccgccac

SEQ ID NO: 3648312 - RNA, 15 nt, Salmonella enterica enterica serovar Typhi
acgcgcuccagcaac

SEQ ID NO: 3648313 - RNA, 15 nt, Salmonella enterica enterica serovar Typhi
acgcgcucgccagcg

SEQ ID NO: 3648314 - RNA, 13 nt, Salmonella enterica enterica serovar Typhi
acgcgcuggcgga

SEQ ID NO: 3648315 - RNA, 20 nt, Salmonella enterica enterica serovar Typhi
acgcgcuuuuucuuccguca

SEQ ID NO: 3648316 - RNA, 17 nt, Salmonella enterica enterica serovar Typhi
acgcggaacuggugaaa

SEQ ID NO: 3648317 - RNA, 14 nt, Salmonella enterica enterica serovar Typhi
acgcggaagaaaua

SEQ ID NO: 3648318 - RNA, 12 nt, Salmonella enterica enterica serovar Typhi
acgcggaaguau

SEQ ID NO: 3648319 - RNA, 23 nt, Salmonella enterica enterica serovar Typhi
acgcggaaucgucacagaccccg

SEQ ID NO: 3648320 - RNA, 19 nt, Salmonella enterica enterica serovar Typhi
acgcggacgccaccacagu

SEQ ID NO: 3648321 - RNA, 16 nt, Salmonella enterica enterica serovar Typhi
acgcggauguugcugu

SEQ ID NO: 3648322 - RNA, 16 nt, Salmonella enterica enterica serovar Typhi
acgcggauugccgccc

SEQ ID NO: 3648323 - RNA, 21 nt, Salmonella enterica enterica serovar Typhi
acgcggcacaaaguccgccgu

SEQ ID NO: 3648324 - RNA, 22 nt, Salmonella enterica enterica serovar Typhi
acgcggccaaaacccaccagca

SEQ ID NO: 3648325 - RNA, 14 nt, Salmonella enterica enterica serovar Typhi
acgcggcguaccgc

SEQ ID NO: 3648326 - RNA, 13 nt, Salmonella enterica enterica serovar Typhi
acgcggcgugcgc

SEQ ID NO: 3648327 - RNA, 18 nt, Salmonella enterica enterica serovar Typhi
acgcggcuaaucagggua

SEQ ID NO: 3648328 - RNA, 16 nt, Salmonella enterica enterica serovar Typhi
acgcggguacgggacg

SEQ ID NO: 3648329 - RNA, 19 nt, Salmonella enterica enterica serovar Typhi
acgcgguaaauuccgcagg

SEQ ID NO: 3648330 - RNA, 15 nt, Salmonella enterica enterica serovar Typhi
acgcggucaggguga

SEQ ID NO: 3648331 - RNA, 20 nt, Salmonella enterica enterica serovar Typhi
acgcgucaaauagagaaaau

SEQ ID NO: 3648332 - RNA, 19 nt, Salmonella enterica enterica serovar Typhi
acgcgucaauuaccguuua

SEQ ID NO: 3648333 - RNA, 19 nt, Salmonella enterica enterica serovar Typhi
acgcgucagggcgauaaua

SEQ ID NO: 3648334 - RNA, 22 nt, Salmonella enterica enterica serovar Typhi
acgcgucagugaauauccccug

SEQ ID NO: 3648335 - RNA, 18 nt, Salmonella enterica enterica serovar Typhi
acgcguuucacaucgcca

SEQ ID NO: 3648336 - RNA, 22 nt, Salmonella enterica enterica serovar Typhi
acgcguuucacaucgccaguua

SEQ ID NO: 3648337 - RNA, 16 nt, Salmonella enterica enterica serovar Typhi
acgcuaaaaaaggcag

SEQ ID NO: 3648338 - RNA, 16 nt, Salmonella enterica enterica serovar Typhi
acgcuaaaccacauga

SEQ ID NO: 3648339 - RNA, 23 nt, Salmonella enterica enterica serovar Typhi
acgcuaaucccgcucgccaggug

SEQ ID NO: 3648340 - RNA, 18 nt, Salmonella enterica enterica serovar Typhi
acgcuaccgucgacgucu

SEQ ID NO: 3648341 - RNA, 22 nt, Salmonella enterica enterica serovar Typhi
acgcuaccgucgccgacaacgc

SEQ ID NO: 3648342 - RNA, 15 nt, Salmonella enterica enterica serovar Typhi
acgcuauuuaaaaac

SEQ ID NO: 3648343 - RNA, 17 nt, Salmonella enterica enterica serovar Typhi
acgcucaaccgguuugu

SEQ ID NO: 3648344 - RNA, 15 nt, Salmonella enterica enterica serovar Typhi
acgcucacgcagaua

SEQ ID NO: 3648345 - RNA, 12 nt, Salmonella enterica enterica serovar Typhi
acgcucacuuuu

SEQ ID NO: 3648346 - RNA, 22 nt, Salmonella enterica enterica serovar Typhi
acgcucauuaacgacaacuucu

SEQ ID NO: 3648347 - RNA, 18 nt, Salmonella enterica enterica serovar Typhi
acgcuccagcuggcuggc

SEQ ID NO: 3648348 - RNA, 11 nt, Salmonella enterica enterica serovar Typhi
acgcuccugga

SEQ ID NO: 3648349 - RNA, 14 nt, Salmonella enterica enterica serovar Typhi
acgcucgcugaugg

SEQ ID NO: 3648350 - RNA, 13 nt, Salmonella enterica enterica serovar Typhi
acgcucuucgcca

SEQ ID NO: 3648351 - RNA, 18 nt, Salmonella enterica enterica serovar Typhi
acgcucuucgccaaucgc

SEQ ID NO: 3648352 - RNA, 19 nt, Salmonella enterica enterica serovar Typhi
acgcucuuuuccacggcgc

SEQ ID NO: 3648353 - RNA, 20 nt, Salmonella enterica enterica serovar Typhi
acgcugacaggauacccggc

SEQ ID NO: 3648354 - RNA, 15 nt, Salmonella enterica enterica serovar Typhi
acgcugaccacgccg

SEQ ID NO: 3648355 - RNA, 16 nt, Salmonella enterica enterica serovar Typhi
acgcugacgcgaucgc

SEQ ID NO: 3648356 - RNA, 16 nt, Salmonella enterica enterica serovar Typhi
acgcugagucagaaac

SEQ ID NO: 3648357 - RNA, 13 nt, Salmonella enterica enterica serovar Typhi
acgcugauagcca

SEQ ID NO: 3648358 - RNA, 14 nt, Salmonella enterica enterica serovar Typhi
acgcugcaucguuu

SEQ ID NO: 3648359 - RNA, 20 nt, Salmonella enterica enterica serovar Typhi
acgcugccauccucauuuug

SEQ ID NO: 3648360 - RNA, 15 nt, Salmonella enterica enterica serovar Typhi
acgcugcgcaacagc

SEQ ID NO: 3648361 - RNA, 15 nt, Salmonella enterica enterica serovar Typhi
acgcugcggccugcc

SEQ ID NO: 3648362 - RNA, 21 nt, Salmonella enterica enterica serovar Typhi
acgcugcuauccggcaacacg

SEQ ID NO: 3648363 - RNA, 22 nt, Salmonella enterica enterica serovar Typhi
acgcugcuauccggcaacacgu

SEQ ID NO: 3648364 - RNA, 20 nt, Salmonella enterica enterica serovar Typhi
acgcugcuauuuugcgcuuu

SEQ ID NO: 3648365 - RNA, 13 nt, Salmonella enterica enterica serovar Typhi
acgcuggcacagg

SEQ ID NO: 3648366 - RNA, 17 nt, Salmonella enterica enterica serovar Typhi
acgcuggcacuggcagc

SEQ ID NO: 3648367 - RNA, 19 nt, Salmonella enterica enterica serovar Typhi
acgcuggcacuuuccgguu

SEQ ID NO: 3648368 - RNA, 13 nt, Salmonella enterica enterica serovar Typhi
acgcuggccgcaa

SEQ ID NO: 3648369 - RNA, 20 nt, Salmonella enterica enterica serovar Typhi
acgcuggcgcaaagaaggca

SEQ ID NO: 3648370 - RNA, 18 nt, Salmonella enterica enterica serovar Typhi
acgcuggugcugugccug

SEQ ID NO: 3648371 - RNA, 17 nt, Salmonella enterica enterica serovar Typhi
acgcugguuucggcauc

SEQ ID NO: 3648372 - RNA, 19 nt, Salmonella enterica enterica serovar Typhi
acgcugguuugugugcagg

SEQ ID NO: 3648373 - RNA, 13 nt, Salmonella enterica enterica serovar Typhi
acgcuguaccggc

SEQ ID NO: 3648374 - RNA, 23 nt, Salmonella enterica enterica serovar Typhi
acgcuguaguuccuguagcguga

SEQ ID NO: 3648375 - RNA, 12 nt, Salmonella enterica enterica serovar Typhi
acgcuguugccg

SEQ ID NO: 3648376 - RNA, 21 nt, Salmonella enterica enterica serovar Typhi
acgcuuaaucaguugcaggaa

SEQ ID NO: 3648377 - RNA, 22 nt, Salmonella enterica enterica serovar Typhi
acggcgcgacuuuaaucaccug

SEQ ID NO: 3648378 - RNA, 15 nt, Salmonella enterica enterica serovar Typhi
acggcgcuaagcgcc

SEQ ID NO: 3648379 - RNA, 22 nt, Salmonella enterica enterica serovar Typhi
acggcgcuccugucaggcgagc

SEQ ID NO: 3648380 - RNA, 14 nt, Salmonella enterica enterica serovar Typhi
acggcgcuggcgua

SEQ ID NO: 3648381 - RNA, 20 nt, Salmonella enterica enterica serovar Typhi
acggcggcauuaaagccgcc

SEQ ID NO: 3648382 - RNA, 23 nt, Salmonella enterica enterica serovar Typhi
acggcgguaccauaccugcggcc

SEQ ID NO: 3648383 - RNA, 15 nt, Salmonella enterica enterica serovar Typhi
acggcggucgccgca

SEQ ID NO: 3648384 - RNA, 16 nt, Salmonella enterica enterica serovar Typhi
acggcguaagcgcuau

SEQ ID NO: 3648385 - RNA, 16 nt, Salmonella enterica enterica serovar Typhi
acggcguaagucgcgc

SEQ ID NO: 3648386 - RNA, 17 nt, Salmonella enterica enterica serovar Typhi
acggcguaagucgcgca

SEQ ID NO: 3648387 - RNA, 18 nt, Salmonella enterica enterica serovar Typhi
acggcguaccagaaugcc

SEQ ID NO: 3648388 - RNA, 12 nt, Salmonella enterica enterica serovar Typhi
acggcguagcga

SEQ ID NO: 3648389 - RNA, 14 nt, Salmonella enterica enterica serovar Typhi
acggcgucagccac

SEQ ID NO: 3648390 - RNA, 16 nt, Salmonella enterica enterica serovar Typhi
acggcuaauaugccag

SEQ ID NO: 3648391 - RNA, 19 nt, Salmonella enterica enterica serovar Typhi
acggcuaauaugccaggcu

SEQ ID NO: 3648392 - RNA, 14 nt, Salmonella enterica enterica serovar Typhi
acggcuacccauga

SEQ ID NO: 3648393 - RNA, 16 nt, Salmonella enterica enterica serovar Typhi
acggcuccagcgccag

SEQ ID NO: 3648394 - RNA, 19 nt, Salmonella enterica enterica serovar Typhi
acggcugcacaaaauacug

SEQ ID NO: 3648395 - RNA, 22 nt, Salmonella enterica enterica serovar Typhi
acggcugccuuuguacagcuug

SEQ ID NO: 3648396 - RNA, 20 nt, Salmonella enterica enterica serovar Typhi
acggcuggugaucuggccaa

SEQ ID NO: 3648397 - RNA, 20 nt, Salmonella enterica enterica serovar Typhi
acggcugucaggagccaccg

SEQ ID NO: 3648398 - RNA, 22 nt, Salmonella enterica enterica serovar Typhi
acggcuuuaauaccccuguuca

SEQ ID NO: 3648399 - RNA, 19 nt, Salmonella enterica enterica serovar Typhi
acggcuuuccagcagccag

SEQ ID NO: 3648400 - RNA, 20 nt, Salmonella enterica enterica serovar Typhi
acggcuuucuuucuccagcg

SEQ ID NO: 3648401 - RNA, 16 nt, Salmonella enterica enterica serovar Typhi
acgggaaggaaauuca

SEQ ID NO: 3648402 - RNA, 15 nt, Salmonella enterica enterica serovar Typhi
acgggaaguaaggca

SEQ ID NO: 3648403 - RNA, 18 nt, Salmonella enterica enterica serovar Typhi
acgggacgaauuuccagc

SEQ ID NO: 3648404 - RNA, 20 nt, Salmonella enterica enterica serovar Typhi
acgggagagcguauccagca

SEQ ID NO: 3648405 - RNA, 11 nt, Salmonella enterica enterica serovar Typhi
acgggcaaagc

SEQ ID NO: 3648406 - RNA, 18 nt, Salmonella enterica enterica serovar Typhi
acgggcaagguuaugcag

SEQ ID NO: 3648407 - RNA, 19 nt, Salmonella enterica enterica serovar Typhi
acgggcacggucugcugac

SEQ ID NO: 3648408 - RNA, 15 nt, Salmonella enterica enterica serovar Typhi
acgggcagagucgau

SEQ ID NO: 3648409 - RNA, 22 nt, Salmonella enterica enterica serovar Typhi
acgggcagucuggcggcagccg

SEQ ID NO: 3648410 - RNA, 19 nt, Salmonella enterica enterica serovar Typhi
acgggcauuguuaauccag

SEQ ID NO: 3648411 - RNA, 22 nt, Salmonella enterica enterica serovar Typhi
acgggcauuguuaauccagagc

SEQ ID NO: 3648412 - RNA, 16 nt, Salmonella enterica enterica serovar Typhi
acgggcccuggccgca

SEQ ID NO: 3648413 - RNA, 17 nt, Salmonella enterica enterica serovar Typhi
acgggcccuggccgcaa

SEQ ID NO: 3648414 - RNA, 22 nt, Salmonella enterica enterica serovar Typhi
acgggcgauggcucgcccggua

SEQ ID NO: 3648415 - RNA, 22 nt, Salmonella enterica enterica serovar Typhi
acgggcggcgacagagaaugcg

SEQ ID NO: 3648416 - RNA, 16 nt, Salmonella enterica enterica serovar Typhi
acgggcuaucaauaug

SEQ ID NO: 3648417 - RNA, 23 nt, Salmonella enterica enterica serovar Typhi
acgggcuuaaucaguucggcauc

SEQ ID NO: 3648418 - RNA, 15 nt, Salmonella enterica enterica serovar Typhi
acgggcuuccaguac

SEQ ID NO: 3648419 - RNA, 18 nt, Salmonella enterica enterica serovar Typhi
acgggcuuuuagccgcgc

SEQ ID NO: 3648420 - RNA, 13 nt, Salmonella enterica enterica serovar Typhi
acggggcgcagaa

SEQ ID NO: 3648421 - RNA, 15 nt, Salmonella enterica enterica serovar Typhi
acggguuaauggcag

SEQ ID NO: 3648422 - RNA, 14 nt, Salmonella enterica enterica serovar Typhi
acgguaaaccucuu

SEQ ID NO: 3648423 - RNA, 20 nt, Salmonella enterica enterica serovar Typhi
acgguaaccauuuccggauc

SEQ ID NO: 3648424 - RNA, 14 nt, Salmonella enterica enterica serovar Typhi
acgguaaguugaaa

SEQ ID NO: 3648425 - RNA, 16 nt, Salmonella enterica enterica serovar Typhi
acgguaauugacgcgu

SEQ ID NO: 3648426 - RNA, 20 nt, Salmonella enterica enterica serovar Typhi
acgguaauugccgggaaaac

SEQ ID NO: 3648427 - RNA, 23 nt, Salmonella enterica enterica serovar Typhi
acgguacaaaccccacccacuga

SEQ ID NO: 3648428 - RNA, 20 nt, Salmonella enterica enterica serovar Typhi
acgguaggccggguaggaca

SEQ ID NO: 3648429 - RNA, 22 nt, Salmonella enterica enterica serovar Typhi
acgguaucagcgcguuuuccau

SEQ ID NO: 3648430 - RNA, 13 nt, Salmonella enterica enterica serovar Typhi
acgguaugaaaca

SEQ ID NO: 3648431 - RNA, 19 nt, Salmonella enterica enterica serovar Typhi
acgguaugaaacauauaua

SEQ ID NO: 3648432 - RNA, 21 nt, Salmonella enterica enterica serovar Typhi
acgguauucguuaccagcauc

SEQ ID NO: 3648433 - RNA, 14 nt, Salmonella enterica enterica serovar Typhi
acggucaaucauca

SEQ ID NO: 3648434 - RNA, 15 nt, Salmonella enterica enterica serovar Typhi
acggucagcggcgga

SEQ ID NO: 3648435 - RNA, 20 nt, Salmonella enterica enterica serovar Typhi
acggucauaucgucaucggu

SEQ ID NO: 3648436 - RNA, 18 nt, Salmonella enterica enterica serovar Typhi
acggugagcugaaagccg

SEQ ID NO: 3648437 - RNA, 23 nt, Salmonella enterica enterica serovar Typhi
acggugguaaaucagaauaccgc

SEQ ID NO: 3648438 - RNA, 20 nt, Salmonella enterica enterica serovar Typhi
acggugugccgccaucagcg

SEQ ID NO: 3648439 - RNA, 22 nt, Salmonella enterica enterica serovar Typhi
acgguguuuagacacauugaug

SEQ ID NO: 3648440 - RNA, 22 nt, Salmonella enterica enterica serovar Typhi
acgguuaaaaacagccagcagc

SEQ ID NO: 3648441 - RNA, 13 nt, Salmonella enterica enterica serovar Typhi
acgguuaaaaagu

SEQ ID NO: 3648442 - RNA, 17 nt, Salmonella enterica enterica serovar Typhi
acgguuaagccgguaau

SEQ ID NO: 3648443 - RNA, 17 nt, Salmonella enterica enterica serovar Typhi
acgguucauccagcagc

SEQ ID NO: 3648444 - RNA, 22 nt, Salmonella enterica enterica serovar Typhi
acgguucauccagcagcagcac

SEQ ID NO: 3648445 - RNA, 13 nt, Salmonella enterica enterica serovar Typhi
acgguugaagcga

SEQ ID NO: 3648446 - RNA, 18 nt, Salmonella enterica enterica serovar Typhi
acgguuucgaccagcagc

SEQ ID NO: 3648447 - RNA, 15 nt, Salmonella enterica enterica serovar Typhi
acguaaagacgacgu

SEQ ID NO: 3648448 - RNA, 17 nt, Salmonella enterica enterica serovar Typhi
acguaaauacccaggcc

SEQ ID NO: 3648449 - RNA, 20 nt, Salmonella enterica enterica serovar Typhi
acguaaauuacuuaugauau

SEQ ID NO: 3648450 - RNA, 21 nt, Salmonella enterica enterica serovar Typhi
acguaaauuacuuaugauaua

SEQ ID NO: 3648451 - RNA, 16 nt, Salmonella enterica enterica serovar Typhi
acguaacaugaccugc

SEQ ID NO: 3648452 - RNA, 20 nt, Salmonella enterica enterica serovar Typhi
acguaacggaaaagcauugc

SEQ ID NO: 3648453 - RNA, 19 nt, Salmonella enterica enterica serovar Typhi
acguaacugacaauuucca

SEQ ID NO: 3648454 - RNA, 21 nt, Salmonella enterica enterica serovar Typhi
acguaacugcgguaaauaaug

SEQ ID NO: 3648455 - RNA, 15 nt, Salmonella enterica enterica serovar Typhi
acguaacuuauccac

SEQ ID NO: 3648456 - RNA, 12 nt, Salmonella enterica enterica serovar Typhi
acguaauaccug

SEQ ID NO: 3648457 - RNA, 13 nt, Salmonella enterica enterica serovar Typhi
acguaauaccuga

SEQ ID NO: 3648458 - RNA, 22 nt, Salmonella enterica enterica serovar Typhi
acguacagguugugcaucuccu

SEQ ID NO: 3648459 - RNA, 18 nt, Salmonella enterica enterica serovar Typhi
acguacccgcucggcaua

SEQ ID NO: 3648460 - RNA, 14 nt, Salmonella enterica enterica serovar Typhi
acguagauucugau

SEQ ID NO: 3648461 - RNA, 22 nt, Salmonella enterica enterica serovar Typhi
acguagcaaagcguacaugaau

SEQ ID NO: 3648462 - RNA, 14 nt, Salmonella enterica enterica serovar Typhi
acguuuucugagcg

SEQ ID NO: 3648463 - RNA, 16 nt, Salmonella enterica enterica serovar Typhi
acuaaaaauucaaaaa

SEQ ID NO: 3648464 - RNA, 23 nt, Salmonella enterica enterica serovar Typhi
acuaaaaauucaaaaaagcagua

SEQ ID NO: 3648465 - RNA, 14 nt, Salmonella enterica enterica serovar Typhi
acuaaaacaccggu

SEQ ID NO: 3648466 - RNA, 15 nt, Salmonella enterica enterica serovar Typhi
acuaaaguuuauuua

SEQ ID NO: 3648467 - RNA, 15 nt, Salmonella enterica enterica serovar Typhi
acuaacgaggccacc

SEQ ID NO: 3648468 - RNA, 22 nt, Salmonella enterica enterica serovar Typhi
acuaacgauguaaaaccuggca

SEQ ID NO: 3648469 - RNA, 22 nt, Salmonella enterica enterica serovar Typhi
acuaacugaccauauaugaaau

SEQ ID NO: 3648470 - RNA, 12 nt, Salmonella enterica enterica serovar Typhi
acuaacuggcaa

SEQ ID NO: 3648471 - RNA, 17 nt, Salmonella enterica enterica serovar Typhi
acuaagaccagcaucag

SEQ ID NO: 3648472 - RNA, 18 nt, Salmonella enterica enterica serovar Typhi
acuaagccaguucucaau

SEQ ID NO: 3648473 - RNA, 16 nt, Salmonella enterica enterica serovar Typhi
acuaaguaaggaggaa

SEQ ID NO: 3648474 - RNA, 22 nt, Salmonella enterica enterica serovar Typhi
acuaauccaguccucgcccacu

SEQ ID NO: 3648475 - RNA, 17 nt, Salmonella enterica enterica serovar Typhi
acuaauccccauuuuuu

SEQ ID NO: 3648476 - RNA, 15 nt, Salmonella enterica enterica serovar Typhi
acuaauuauuuuuca

SEQ ID NO: 3648477 - RNA, 17 nt, Salmonella enterica enterica serovar Typhi
acuaauuauuuuucaaa

SEQ ID NO: 3648478 - RNA, 18 nt, Salmonella enterica enterica serovar Typhi
acuaauuauuuuucaaau

SEQ ID NO: 3648479 - RNA, 22 nt, Salmonella enterica enterica serovar Typhi
acuacaauacucacuaucacac

SEQ ID NO: 3648480 - RNA, 12 nt, Salmonella enterica enterica serovar Typhi
acuacagaaagc

SEQ ID NO: 3648481 - RNA, 11 nt, Salmonella enterica enterica serovar Typhi
acuacagcccu

SEQ ID NO: 3648482 - RNA, 18 nt, Salmonella enterica enterica serovar Typhi
acuacauaucuauauuuu

SEQ ID NO: 3648483 - RNA, 15 nt, Salmonella enterica enterica serovar Typhi
acuaccacuuucuug

SEQ ID NO: 3648484 - RNA, 18 nt, Salmonella enterica enterica serovar Typhi
acuaccagaaacaacacg

SEQ ID NO: 3648485 - RNA, 22 nt, Salmonella enterica enterica serovar Typhi
acuaccagcucgcgcaguucca

SEQ ID NO: 3648486 - RNA, 21 nt, Salmonella enterica enterica serovar Typhi
acuacccaucacgcccuguaa

SEQ ID NO: 3648487 - RNA, 17 nt, Salmonella enterica enterica serovar Typhi
acuaccgcaaugggggc

SEQ ID NO: 3648488 - RNA, 12 nt, Salmonella enterica enterica serovar Typhi
acuaccgccauc

SEQ ID NO: 3648489 - RNA, 17 nt, Salmonella enterica enterica serovar Typhi
acuaccggcaccagcaa

SEQ ID NO: 3648490 - RNA, 17 nt, Salmonella enterica enterica serovar Typhi
acuacgccaaugaacuc

SEQ ID NO: 3648491 - RNA, 23 nt, Salmonella enterica enterica serovar Typhi
acuacggcaaacacaaucacgcc

SEQ ID NO: 3648492 - RNA, 21 nt, Salmonella enterica enterica serovar Typhi
acuacggcaaacgcuggugcu

SEQ ID NO: 3648493 - RNA, 22 nt, Salmonella enterica enterica serovar Typhi
acuacggguuuuuguguugaaa

SEQ ID NO: 3648494 - RNA, 21 nt, Salmonella enterica enterica serovar Typhi
acuacgguugccuuucgccag

SEQ ID NO: 3648495 - RNA, 15 nt, Salmonella enterica enterica serovar Typhi
acuacuacaccaccc

SEQ ID NO: 3648496 - RNA, 17 nt, Salmonella enterica enterica serovar Typhi
acuacucguaaucuaaa

SEQ ID NO: 3648497 - RNA, 19 nt, Salmonella enterica enterica serovar Typhi
acuacucguaaucuaaaau

SEQ ID NO: 3648498 - RNA, 18 nt, Salmonella enterica enterica serovar Typhi
acuacugguggaauaaau

SEQ ID NO: 3648499 - RNA, 22 nt, Salmonella enterica enterica serovar Typhi
acuacugguggaauaaauauaa

SEQ ID NO: 3648500 - RNA, 22 nt, Salmonella enterica enterica serovar Typhi
acuacuuuuacccuucagauau

SEQ ID NO: 3648501 - RNA, 14 nt, Salmonella enterica enterica serovar Typhi
acuagaauuuucac

SEQ ID NO: 3648502 - RNA, 15 nt, Salmonella enterica enterica serovar Typhi
acuagacagccucuc

SEQ ID NO: 3648503 - RNA, 20 nt, Salmonella enterica enterica serovar Typhi
acuauaaaaauaccggcauc

SEQ ID NO: 3648504 - RNA, 20 nt, Salmonella enterica enterica serovar Typhi
acuauaauugcuuuuuucca

SEQ ID NO: 3648505 - RNA, 21 nt, Salmonella enterica enterica serovar Typhi
acuaucaauauuggugucgua

SEQ ID NO: 3648506 - RNA, 16 nt, Salmonella enterica enterica serovar Typhi
acuaucaugauuucuu

SEQ ID NO: 3648507 - RNA, 16 nt, Salmonella enterica enterica serovar Typhi
acuauccacagcgaau

SEQ ID NO: 3648508 - RNA, 20 nt, Salmonella enterica enterica serovar Typhi
acuaucccauugauucccgg

SEQ ID NO: 3648509 - RNA, 18 nt, Salmonella enterica enterica serovar Typhi
acuaucgaaagagcaaau

SEQ ID NO: 3648510 - RNA, 17 nt, Salmonella enterica enterica serovar Typhi
acuauggucugaaagag

SEQ ID NO: 3648511 - RNA, 20 nt, Salmonella enterica enterica serovar Typhi
acuauguugaugcuaaccuc

SEQ ID NO: 3648512 - RNA, 13 nt, Salmonella enterica enterica serovar Typhi
acuauuaaagcac

SEQ ID NO: 3648513 - RNA, 18 nt, Salmonella enterica enterica serovar Typhi
acuauuucggcacugacu

SEQ ID NO: 3648514 - RNA, 18 nt, Salmonella enterica enterica serovar Typhi
acuauuuuccccuucugu

SEQ ID NO: 3648515 - RNA, 23 nt, Salmonella enterica enterica serovar Typhi
acuauuuuuccggcgucaaaaau

SEQ ID NO: 3648516 - RNA, 21 nt, Salmonella enterica enterica serovar Typhi
acuauuuuuuaugugacaauc

SEQ ID NO: 3648517 - RNA, 21 nt, Salmonella enterica enterica serovar Typhi
acucaaaauaacgcuucaccu

SEQ ID NO: 3648518 - RNA, 12 nt, Salmonella enterica enterica serovar Typhi
acucaaagaaaa

SEQ ID NO: 3648519 - RNA, 14 nt, Salmonella enterica enterica serovar Typhi
acucaaagaaaaca

SEQ ID NO: 3648520 - RNA, 21 nt, Salmonella enterica enterica serovar Typhi
acucaaccaucaaaaaaaaua

SEQ ID NO: 3648521 - RNA, 20 nt, Salmonella enterica enterica serovar Typhi
acucaaggcuauuagccaaa

SEQ ID NO: 3648522 - RNA, 22 nt, Salmonella enterica enterica serovar Typhi
acucaaggcuauuagccaaagc

SEQ ID NO: 3648523 - RNA, 14 nt, Salmonella enterica enterica serovar Typhi
acucaauaaaaguu

SEQ ID NO: 3648524 - RNA, 15 nt, Salmonella enterica enterica serovar Typhi
acucaauauccugcg

SEQ ID NO: 3648525 - RNA, 15 nt, Salmonella enterica enterica serovar Typhi
acucaauaucgacag

SEQ ID NO: 3648526 - RNA, 14 nt, Salmonella enterica enterica serovar Typhi
acucaaucaggcua

SEQ ID NO: 3648527 - RNA, 19 nt, Salmonella enterica enterica serovar Typhi
acucaaugaauugaacuaa

SEQ ID NO: 3648528 - RNA, 24 nt, Salmonella enterica enterica serovar Typhi
acucacauaacaaaaccagcauca

SEQ ID NO: 3648529 - RNA, 17 nt, Salmonella enterica enterica serovar Typhi
acucaccgcuaauccca

SEQ ID NO: 3648530 - RNA, 17 nt, Salmonella enterica enterica serovar Typhi
acucaccguuacaaaua

SEQ ID NO: 3648531 - RNA, 19 nt, Salmonella enterica enterica serovar Typhi
acucaccugaugcgaugaa

SEQ ID NO: 3648532 - RNA, 18 nt, Salmonella enterica enterica serovar Typhi
acucacgacuuucaccag

SEQ ID NO: 3648533 - RNA, 21 nt, Salmonella enterica enterica serovar Typhi
acucacgcgcgcuuuucgcca

SEQ ID NO: 3648534 - RNA, 18 nt, Salmonella enterica enterica serovar Typhi
acucacguuccccagcac

SEQ ID NO: 3648535 - RNA, 22 nt, Salmonella enterica enterica serovar Typhi
acucagaaaauuauuuuaaauu

SEQ ID NO: 3648536 - RNA, 18 nt, Salmonella enterica enterica serovar Typhi
acucagaccgggcgaagu

SEQ ID NO: 3648537 - RNA, 13 nt, Salmonella enterica enterica serovar Typhi
acucagccagaua

SEQ ID NO: 3648538 - RNA, 13 nt, Salmonella enterica enterica serovar Typhi
acucagccagguc

SEQ ID NO: 3648539 - RNA, 16 nt, Salmonella enterica enterica serovar Typhi
acucagcgacguaauc

SEQ ID NO: 3648540 - RNA, 16 nt, Salmonella enterica enterica serovar Typhi
acucagcuaaaaacag

SEQ ID NO: 3648541 - RNA, 17 nt, Salmonella enterica enterica serovar Typhi
acucagcuaaaaacagc

SEQ ID NO: 3648542 - RNA, 23 nt, Salmonella enterica enterica serovar Typhi
acucaggccuuuuuauugccaca

SEQ ID NO: 3648543 - RNA, 13 nt, Salmonella enterica enterica serovar Typhi
acucagggcaaaa

SEQ ID NO: 3648544 - RNA, 20 nt, Salmonella enterica enterica serovar Typhi
acucaucacagccacacugc

SEQ ID NO: 3648545 - RNA, 21 nt, Salmonella enterica enterica serovar Typhi
acucaucacagccacacugcu

SEQ ID NO: 3648546 - RNA, 23 nt, Salmonella enterica enterica serovar Typhi
acucaucauaauccuuauuuaau

SEQ ID NO: 3648547 - RNA, 17 nt, Salmonella enterica enterica serovar Typhi
acugacaauuuccagau

SEQ ID NO: 3648548 - RNA, 15 nt, Salmonella enterica enterica serovar Typhi
acugacacccaucgc

SEQ ID NO: 3648549 - RNA, 16 nt, Salmonella enterica enterica serovar Typhi
acugaccagacagccc

SEQ ID NO: 3648550 - RNA, 14 nt, Salmonella enterica enterica serovar Typhi
acugacgaaaaccg

SEQ ID NO: 3648551 - RNA, 15 nt, Salmonella enterica enterica serovar Typhi
acugacggcgcucuu

SEQ ID NO: 3648552 - RNA, 21 nt, Salmonella enterica enterica serovar Typhi
acugacggcgcucuuuacaua

SEQ ID NO: 3648553 - RNA, 18 nt, Salmonella enterica enterica serovar Typhi
acugacguugcgaaucag

SEQ ID NO: 3648554 - RNA, 23 nt, Salmonella enterica enterica serovar Typhi
acugacguugcgaaucagguaca

SEQ ID NO: 3648555 - RNA, 21 nt, Salmonella enterica enterica serovar Typhi
acugacuauccacagcgaauu

SEQ ID NO: 3648556 - RNA, 15 nt, Salmonella enterica enterica serovar Typhi
acugacugcugucau

SEQ ID NO: 3648557 - RNA, 23 nt, Salmonella enterica enterica serovar Typhi
acugagcgguuuuuuuguggccu

SEQ ID NO: 3648558 - RNA, 16 nt, Salmonella enterica enterica serovar Typhi
acugagcuaacgaccc

SEQ ID NO: 3648559 - RNA, 22 nt, Salmonella enterica enterica serovar Typhi
acugagcuucaccgccagagca

SEQ ID NO: 3648560 - RNA, 17 nt, Salmonella enterica enterica serovar Typhi
acugauagcgaggcagc

SEQ ID NO: 3648561 - RNA, 23 nt, Salmonella enterica enterica serovar Typhi
acugauaguccaucaccucuucg

SEQ ID NO: 3648562 - RNA, 15 nt, Salmonella enterica enterica serovar Typhi
acugauaguuuaaau

SEQ ID NO: 3648563 - RNA, 19 nt, Salmonella enterica enterica serovar Typhi
acugaucaauuugccuuua

SEQ ID NO: 3648564 - RNA, 23 nt, Salmonella enterica enterica serovar Typhi
acugaucccacuuaggcagccag

SEQ ID NO: 3648565 - RNA, 17 nt, Salmonella enterica enterica serovar Typhi
acugaucgccuaagauc

SEQ ID NO: 3648566 - RNA, 14 nt, Salmonella enterica enterica serovar Typhi
acugaugccagccg

SEQ ID NO: 3648567 - RNA, 21 nt, Salmonella enterica enterica serovar Typhi
acugauggaguuucaucagca

SEQ ID NO: 3648568 - RNA, 22 nt, Salmonella enterica enterica serovar Typhi
acugauggaguuucaucagcac

SEQ ID NO: 3648569 - RNA, 13 nt, Salmonella enterica enterica serovar Typhi
acugauggcuggc

SEQ ID NO: 3648570 - RNA, 17 nt, Salmonella enterica enterica serovar Typhi
acugauuaaucugccga

SEQ ID NO: 3648571 - RNA, 15 nt, Salmonella enterica enterica serovar Typhi
acugauuaauugcga

SEQ ID NO: 3648572 - RNA, 17 nt, Salmonella enterica enterica serovar Typhi
acugauucaaaagguga

SEQ ID NO: 3648573 - RNA, 21 nt, Salmonella enterica enterica serovar Typhi
acugauuucgccccacuggcc

SEQ ID NO: 3648574 - RNA, 13 nt, Salmonella enterica enterica serovar Typhi
acugcaaauacca

SEQ ID NO: 3648575 - RNA, 19 nt, Salmonella enterica enterica serovar Typhi
acugcaaauaccacaucag

SEQ ID NO: 3648576 - RNA, 14 nt, Salmonella enterica enterica serovar Typhi
acugcaaaucugcc

SEQ ID NO: 3648577 - RNA, 20 nt, Salmonella enterica enterica serovar Typhi
acugcaaaucugccgucauc

SEQ ID NO: 3648578 - RNA, 16 nt, Salmonella enterica enterica serovar Typhi
acugcaacgccagaug

SEQ ID NO: 3648579 - RNA, 13 nt, Salmonella enterica enterica serovar Typhi
acugcaacugcgc

SEQ ID NO: 3648580 - RNA, 13 nt, Salmonella enterica enterica serovar Typhi
acugcacuuccug

SEQ ID NO: 3648581 - RNA, 20 nt, Salmonella enterica enterica serovar Typhi
acugcacuuccugcgucagg

SEQ ID NO: 3648582 - RNA, 22 nt, Salmonella enterica enterica serovar Typhi
acugcacuuccugcgucaggcu

SEQ ID NO: 3648583 - RNA, 13 nt, Salmonella enterica enterica serovar Typhi
acugcagcgcguc

SEQ ID NO: 3648584 - RNA, 14 nt, Salmonella enterica enterica serovar Typhi
acugcaucugcggu

SEQ ID NO: 3648585 - RNA, 14 nt, Salmonella enterica enterica serovar Typhi
acugcccaaauaaa

SEQ ID NO: 3648586 - RNA, 23 nt, Salmonella enterica enterica serovar Typhi
acugcccaaauaaaagccgccgu

SEQ ID NO: 3648587 - RNA, 13 nt, Salmonella enterica enterica serovar Typhi
acugcccggcaua

SEQ ID NO: 3648588 - RNA, 15 nt, Salmonella enterica enterica serovar Typhi
acugcccguggcgga

SEQ ID NO: 3648589 - RNA, 14 nt, Salmonella enterica enterica serovar Typhi
acugcccuggaaga

SEQ ID NO: 3648590 - RNA, 22 nt, Salmonella enterica enterica serovar Typhi
acugcccuggaagaacuggaug

SEQ ID NO: 3648591 - RNA, 15 nt, Salmonella enterica enterica serovar Typhi
acugccgcagccgcu

SEQ ID NO: 3648592 - RNA, 21 nt, Salmonella enterica enterica serovar Typhi
acugccgcagccgcucagggu

SEQ ID NO: 3648593 - RNA, 14 nt, Salmonella enterica enterica serovar Typhi
acugccgcccaucg

SEQ ID NO: 3648594 - RNA, 15 nt, Salmonella enterica enterica serovar Typhi
acugccgcccaucgc

SEQ ID NO: 3648595 - RNA, 21 nt, Salmonella enterica enterica serovar Typhi
acugccgcccaucgccacagc

SEQ ID NO: 3648596 - RNA, 18 nt, Salmonella enterica enterica serovar Typhi
acugccgccgucaucugc

SEQ ID NO: 3648597 - RNA, 16 nt, Salmonella enterica enterica serovar Typhi
acugccguauccaggg

SEQ ID NO: 3648598 - RNA, 19 nt, Salmonella enterica enterica serovar Typhi
acugccugauggcgcuacg

SEQ ID NO: 3648599 - RNA, 22 nt, Salmonella enterica enterica serovar Typhi
acugcgaacgcaucaaagccac

SEQ ID NO: 3648600 - RNA, 23 nt, Salmonella enterica enterica serovar Typhi
acugcgaacgcaucaaagccacc

SEQ ID NO: 3648601 - RNA, 13 nt, Salmonella enterica enterica serovar Typhi
acugcgaauuucc

SEQ ID NO: 3648602 - RNA, 16 nt, Salmonella enterica enterica serovar Typhi
acugcgccauguucau

SEQ ID NO: 3648603 - RNA, 16 nt, Salmonella enterica enterica serovar Typhi
acugcgccauuaacgc

SEQ ID NO: 3648604 - RNA, 12 nt, Salmonella enterica enterica serovar Typhi
acugcgcccgca

SEQ ID NO: 3648605 - RNA, 20 nt, Salmonella enterica enterica serovar Typhi
acugcgcccgcucugcgcca

SEQ ID NO: 3648606 - RNA, 18 nt, Salmonella enterica enterica serovar Typhi
acugcgccgccagcgaca

SEQ ID NO: 3648607 - RNA, 12 nt, Salmonella enterica enterica serovar Typhi
acugcgccugcu

SEQ ID NO: 3648608 - RNA, 15 nt, Salmonella enterica enterica serovar Typhi
acugcgcgcccgccu

SEQ ID NO: 3648609 - RNA, 20 nt, Salmonella enterica enterica serovar Typhi
acugcgcggcaaugagcggc

SEQ ID NO: 3648610 - RNA, 18 nt, Salmonella enterica enterica serovar Typhi
acugcggcauuacgcgcc

SEQ ID NO: 3648611 - RNA, 16 nt, Salmonella enterica enterica serovar Typhi
acugcggcuuacccug

SEQ ID NO: 3648612 - RNA, 16 nt, Salmonella enterica enterica serovar Typhi
acugcguaaucuuuuc

SEQ ID NO: 3648613 - RNA, 14 nt, Salmonella enterica enterica serovar Typhi
acugcguagaucau

SEQ ID NO: 3648614 - RNA, 12 nt, Salmonella enterica enterica serovar Typhi
acugcuccggca

SEQ ID NO: 3648615 - RNA, 21 nt, Salmonella enterica enterica serovar Typhi
acugcucguaaagcaucagac

SEQ ID NO: 3648616 - RNA, 21 nt, Salmonella enterica enterica serovar Typhi
acugcucguuaaauccuccca

SEQ ID NO: 3648617 - RNA, 22 nt, Salmonella enterica enterica serovar Typhi
acugcucuaccaacugagcuaa

SEQ ID NO: 3648618 - RNA, 13 nt, Salmonella enterica enterica serovar Typhi
acugcugcgcgug

SEQ ID NO: 3648619 - RNA, 15 nt, Salmonella enterica enterica serovar Typhi
acugcugcugaaaga

SEQ ID NO: 3648620 - RNA, 23 nt, Salmonella enterica enterica serovar Typhi
acugcugcugaaagaagacgaaa

SEQ ID NO: 3648621 - RNA, 23 nt, Salmonella enterica enterica serovar Typhi
acugcuuaaauuuuuugccgcuc

SEQ ID NO: 3648622 - RNA, 18 nt, Salmonella enterica enterica serovar Typhi
acugcuuagcucaucagc

SEQ ID NO: 3648623 - RNA, 20 nt, Salmonella enterica enterica serovar Typhi
acugcuuagcucaucagccu

SEQ ID NO: 3648624 - RNA, 20 nt, Salmonella enterica enterica serovar Typhi
acugcuuuuccggcagcgca

SEQ ID NO: 3648625 - RNA, 21 nt, Salmonella enterica enterica serovar Typhi
acuggaagcgaucaagacaaa

SEQ ID NO: 3648626 - RNA, 20 nt, Salmonella enterica enterica serovar Typhi
acuggaauaguuacggacau

SEQ ID NO: 3648627 - RNA, 14 nt, Salmonella enterica enterica serovar Typhi
acuggagaccggcg

SEQ ID NO: 3648628 - RNA, 16 nt, Salmonella enterica enterica serovar Typhi
acuggaucgguugcag

SEQ ID NO: 3648629 - RNA, 12 nt, Salmonella enterica enterica serovar Typhi
acuggauuaucg

SEQ ID NO: 3648630 - RNA, 15 nt, Salmonella enterica enterica serovar Typhi
acuggcaaucaugcg

SEQ ID NO: 3648631 - RNA, 22 nt, Salmonella enterica enterica serovar Typhi
acuggcagccucguccugcaau

SEQ ID NO: 3648632 - RNA, 17 nt, Salmonella enterica enterica serovar Typhi
acuggcagcgccugacg

SEQ ID NO: 3648633 - RNA, 22 nt, Salmonella enterica enterica serovar Typhi
acuucuugguaccaaacagcag

SEQ ID NO: 3648634 - RNA, 13 nt, Salmonella enterica enterica serovar Typhi
acuugaucgugcc

SEQ ID NO: 3648635 - RNA, 20 nt, Salmonella enterica enterica serovar Typhi
acuugauuccuggcuugcca

SEQ ID NO: 3648636 - RNA, 23 nt, Salmonella enterica enterica serovar Typhi
acuuggaaaguugcgccgugccu

SEQ ID NO: 3648637 - RNA, 13 nt, Salmonella enterica enterica serovar Typhi
acuuguucuucug

SEQ ID NO: 3648638 - RNA, 15 nt, Salmonella enterica enterica serovar Typhi
acuuguucuucuguu

SEQ ID NO: 3648639 - RNA, 19 nt, Salmonella enterica enterica serovar Typhi
acuuuaaagcccagcacgg

SEQ ID NO: 3648640 - RNA, 14 nt, Salmonella enterica enterica serovar Typhi
acuuuaagcggcag

SEQ ID NO: 3648641 - RNA, 16 nt, Salmonella enterica enterica serovar Typhi
acuuuaaucaccugcc

SEQ ID NO: 3648642 - RNA, 20 nt, Salmonella enterica enterica serovar Typhi
acuuuacccacaucaaucac

SEQ ID NO: 3648643 - RNA, 14 nt, Salmonella enterica enterica serovar Typhi
acuuuaccgccguu

SEQ ID NO: 3648644 - RNA, 17 nt, Salmonella enterica enterica serovar Typhi
acuuuaccgccguuagc

SEQ ID NO: 3648645 - RNA, 13 nt, Salmonella enterica enterica serovar Typhi
acuuuauuuuucg

SEQ ID NO: 3648646 - RNA, 15 nt, Salmonella enterica enterica serovar Typhi
acuuucauuccuuua

SEQ ID NO: 3648647 - RNA, 20 nt, Salmonella enterica enterica serovar Typhi
acuuucauuucacuuguucu

SEQ ID NO: 3648648 - RNA, 16 nt, Salmonella enterica enterica serovar Typhi
acuuuccaaaauccag

SEQ ID NO: 3648649 - RNA, 17 nt, Salmonella enterica enterica serovar Typhi
acuuuccaaaauccagg

SEQ ID NO: 3648650 - RNA, 14 nt, Salmonella enterica enterica serovar Typhi
acuuuccagcacga

SEQ ID NO: 3648651 - RNA, 23 nt, Salmonella enterica enterica serovar Typhi
acuuuccauauacucuuuguggg

SEQ ID NO: 3648652 - RNA, 20 nt, Salmonella enterica enterica serovar Typhi
acuuuccauucgacaguucc

SEQ ID NO: 3648653 - RNA, 19 nt, Salmonella enterica enterica serovar Typhi
acuuuccuggcugucggca

SEQ ID NO: 3648654 - RNA, 18 nt, Salmonella enterica enterica serovar Typhi
acuuucuugccacuggcc

SEQ ID NO: 3648655 - RNA, 15 nt, Salmonella enterica enterica serovar Typhi
acuuugaccagcauc

SEQ ID NO: 3648656 - RNA, 19 nt, Salmonella enterica enterica serovar Typhi
acuuugcccuuuuugcauu

SEQ ID NO: 3648657 - RNA, 16 nt, Salmonella enterica enterica serovar Typhi
acuuugcgcuccugcu

SEQ ID NO: 3648658 - RNA, 20 nt, Salmonella enterica enterica serovar Typhi
acuuugcgcuccugcuccca

SEQ ID NO: 3648659 - RNA, 18 nt, Salmonella enterica enterica serovar Typhi
acuuugcucuccuuaaaa

SEQ ID NO: 3648660 - RNA, 22 nt, Salmonella enterica enterica serovar Typhi
acuuuggccuaacagucgcgcc

SEQ ID NO: 3648661 - RNA, 15 nt, Salmonella enterica enterica serovar Typhi
acuuuguugaucuca

SEQ ID NO: 3648662 - RNA, 17 nt, Salmonella enterica enterica serovar Typhi
acuuuuaaauugaagag

SEQ ID NO: 3648663 - RNA, 14 nt, Salmonella enterica enterica serovar Typhi
acuuuuacccuuca

SEQ ID NO: 3648664 - RNA, 18 nt, Salmonella enterica enterica serovar Typhi
acuuuuacccuucagaua

SEQ ID NO: 3648665 - RNA, 13 nt, Salmonella enterica enterica serovar Typhi
acuuuugaacaua

SEQ ID NO: 3648666 - RNA, 23 nt, Salmonella enterica enterica serovar Typhi
acuuuugaacauaaagucagaca

SEQ ID NO: 3648667 - RNA, 15 nt, Salmonella enterica enterica serovar Typhi
acuuuugcaaucgca

SEQ ID NO: 3648668 - RNA, 22 nt, Salmonella enterica enterica serovar Typhi
acuuuugccaggcggauaaaac

SEQ ID NO: 3648669 - RNA, 14 nt, Salmonella enterica enterica serovar Typhi
acuuuugccgucag

SEQ ID NO: 3648670 - RNA, 16 nt, Salmonella enterica enterica serovar Typhi
acuuuuuuaaauguuu

SEQ ID NO: 3648671 - RNA, 18 nt, Salmonella enterica enterica serovar Typhi
agaaaaaacucaggaaau

SEQ ID NO: 3648672 - RNA, 12 nt, Salmonella enterica enterica serovar Typhi
agaaaaaauuaa

SEQ ID NO: 3648673 - RNA, 15 nt, Salmonella enterica enterica serovar Typhi
agaaaaaauuaaaaa

SEQ ID NO: 3648674 - RNA, 18 nt, Salmonella enterica enterica serovar Typhi
agaaaaaccuccggcuau

SEQ ID NO: 3648675 - RNA, 18 nt, Salmonella enterica enterica serovar Typhi
agaaaaacgcgcaaaacu

SEQ ID NO: 3648676 - RNA, 13 nt, Salmonella enterica enterica serovar Typhi
agaaaaagaagcc

SEQ ID NO: 3648677 - RNA, 20 nt, Salmonella enterica enterica serovar Typhi
agaaaaagguaacuauuucu

SEQ ID NO: 3648678 - RNA, 13 nt, Salmonella enterica enterica serovar Typhi
agaaaaaguagaa

SEQ ID NO: 3648679 - RNA, 23 nt, Salmonella enterica enterica serovar Typhi
agaaaaaucagucauuugcaggu

SEQ ID NO: 3648680 - RNA, 23 nt, Salmonella enterica enterica serovar Typhi
agaaaacagcaugguguuaguuu

SEQ ID NO: 3648681 - RNA, 18 nt, Salmonella enterica enterica serovar Typhi
agaaaaccgacagcaaua

SEQ ID NO: 3648682 - RNA, 19 nt, Salmonella enterica enterica serovar Typhi
agaaaacuuucauuucacu

SEQ ID NO: 3648683 - RNA, 12 nt, Salmonella enterica enterica serovar Typhi
agaaaagcagag

SEQ ID NO: 3648684 - RNA, 19 nt, Salmonella enterica enterica serovar Typhi
agaaaaggaagaauaaaua

SEQ ID NO: 3648685 - RNA, 15 nt, Salmonella enterica enterica serovar Typhi
agaaaauaacaauau

SEQ ID NO: 3648686 - RNA, 18 nt, Salmonella enterica enterica serovar Typhi
agaaaauaacaauauuaa

SEQ ID NO: 3648687 - RNA, 13 nt, Salmonella enterica enterica serovar Typhi
agaaaauaauuca

SEQ ID NO: 3648688 - RNA, 20 nt, Salmonella enterica enterica serovar Typhi
agaaaauaauucuuaaccca

SEQ ID NO: 3648689 - RNA, 19 nt, Salmonella enterica enterica serovar Typhi
agaaaauagaggaaauaac

SEQ ID NO: 3648690 - RNA, 22 nt, Salmonella enterica enterica serovar Typhi
agaaaauauauuggccuuaugc

SEQ ID NO: 3648691 - RNA, 17 nt, Salmonella enterica enterica serovar Typhi
agaaaaucccgaacaug

SEQ ID NO: 3648692 - RNA, 23 nt, Salmonella enterica enterica serovar Typhi
agaaaaugcgcugggaaucgcga

SEQ ID NO: 3648693 - RNA, 17 nt, Salmonella enterica enterica serovar Typhi
agaaaauggucugccag

SEQ ID NO: 3648694 - RNA, 20 nt, Salmonella enterica enterica serovar Typhi
agaaaauuaacgacaaaaau

SEQ ID NO: 3648695 - RNA, 17 nt, Salmonella enterica enterica serovar Typhi
agaaaauuauuuuaaau

SEQ ID NO: 3648696 - RNA, 19 nt, Salmonella enterica enterica serovar Typhi
agaaacaacaccguaaaag

SEQ ID NO: 3648697 - RNA, 14 nt, Salmonella enterica enterica serovar Typhi
agaaacaccagaau

SEQ ID NO: 3648698 - RNA, 15 nt, Salmonella enterica enterica serovar Typhi
agaaacaccagaaug

SEQ ID NO: 3648699 - RNA, 11 nt, Salmonella enterica enterica serovar Typhi
agaaacaucau

SEQ ID NO: 3648700 - RNA, 23 nt, Salmonella enterica enterica serovar Typhi
agaaacaucaucguuugcgcgca

SEQ ID NO: 3648701 - RNA, 16 nt, Salmonella enterica enterica serovar Typhi
agaaaccgcagaaaaa

SEQ ID NO: 3648702 - RNA, 17 nt, Salmonella enterica enterica serovar Typhi
agaaaccgcagaaaaag

SEQ ID NO: 3648703 - RNA, 14 nt, Salmonella enterica enterica serovar Typhi
agaaacgcugaucu

SEQ ID NO: 3648704 - RNA, 23 nt, Salmonella enterica enterica serovar Typhi
agaaagcauuaaaucaucauaau

SEQ ID NO: 3648705 - RNA, 16 nt, Salmonella enterica enterica serovar Typhi
agaaagcgaauggcgu

SEQ ID NO: 3648706 - RNA, 23 nt, Salmonella enterica enterica serovar Typhi
agaaagcuacguuugaacagcag

SEQ ID NO: 3648707 - RNA, 18 nt, Salmonella enterica enterica serovar Typhi
agaaaggggagggcaaca

SEQ ID NO: 3648708 - RNA, 23 nt, Salmonella enterica enterica serovar Typhi
agaaaguaggcgguuucaucgag

SEQ ID NO: 3648709 - RNA, 21 nt, Salmonella enterica enterica serovar Typhi
agaaaguaguauccccggcaa

SEQ ID NO: 3648710 - RNA, 17 nt, Salmonella enterica enterica serovar Typhi
agaaaguggcauaucau

SEQ ID NO: 3648711 - RNA, 14 nt, Salmonella enterica enterica serovar Typhi
agaaauaaaaccag

SEQ ID NO: 3648712 - RNA, 14 nt, Salmonella enterica enterica serovar Typhi
agaaauaaaauacg

SEQ ID NO: 3648713 - RNA, 14 nt, Salmonella enterica enterica serovar Typhi
agaaauaacucccu

SEQ ID NO: 3648714 - RNA, 20 nt, Salmonella enterica enterica serovar Typhi
agaaauacugugcccagagc

SEQ ID NO: 3648715 - RNA, 20 nt, Salmonella enterica enterica serovar Typhi
agaaauagaacagcuggugc

SEQ ID NO: 3648716 - RNA, 22 nt, Salmonella enterica enterica serovar Typhi
agaaauagacgagcgaaaaacu

SEQ ID NO: 3648717 - RNA, 19 nt, Salmonella enterica enterica serovar Typhi
agaaauagccgguaacuuu

SEQ ID NO: 3648718 - RNA, 15 nt, Salmonella enterica enterica serovar Typhi
agacaaaauucagac

SEQ ID NO: 3648719 - RNA, 18 nt, Salmonella enterica enterica serovar Typhi
agacaaaauucagacuca

SEQ ID NO: 3648720 - RNA, 11 nt, Salmonella enterica enterica serovar Typhi
agacaaacagc

SEQ ID NO: 3648721 - RNA, 10 nt, Salmonella enterica enterica serovar Typhi
agacaacauc

SEQ ID NO: 3648722 - RNA, 22 nt, Salmonella enterica enterica serovar Typhi
agacaauaccagggcgauuccc

SEQ ID NO: 3648723 - RNA, 22 nt, Salmonella enterica enterica serovar Typhi
agacaaucugugugggcacucg

SEQ ID NO: 3648724 - RNA, 21 nt, Salmonella enterica enterica serovar Typhi
agacaaugcugacacugauau

SEQ ID NO: 3648725 - RNA, 22 nt, Salmonella enterica enterica serovar Typhi
agacaauugcugcguaacugcc

SEQ ID NO: 3648726 - RNA, 14 nt, Salmonella enterica enterica serovar Typhi
agacaauuuucuuc

SEQ ID NO: 3648727 - RNA, 16 nt, Salmonella enterica enterica serovar Typhi
agacacaauauugcug

SEQ ID NO: 3648728 - RNA, 15 nt, Salmonella enterica enterica serovar Typhi
agacaccccagccua

SEQ ID NO: 3648729 - RNA, 12 nt, Salmonella enterica enterica serovar Typhi
agacacuuuccg

SEQ ID NO: 3648730 - RNA, 18 nt, Salmonella enterica enterica serovar Typhi
agacagaacaggaugcuu

SEQ ID NO: 3648731 - RNA, 24 nt, Salmonella enterica enterica serovar Typhi
agacagaaucaggccauuaccgcc

SEQ ID NO: 3648732 - RNA, 16 nt, Salmonella enterica enterica serovar Typhi
agacagauaacaccag

SEQ ID NO: 3648733 - RNA, 14 nt, Salmonella enterica enterica serovar Typhi
agacagaucgguuu

SEQ ID NO: 3648734 - RNA, 16 nt, Salmonella enterica enterica serovar Typhi
agacagauuuggucag

SEQ ID NO: 3648735 - RNA, 20 nt, Salmonella enterica enterica serovar Typhi
agacagcuuagauucaacca

SEQ ID NO: 3648736 - RNA, 15 nt, Salmonella enterica enterica serovar Typhi
agacaguacggauga

SEQ ID NO: 3648737 - RNA, 15 nt, Salmonella enterica enterica serovar Typhi
agacauauuuucucu

SEQ ID NO: 3648738 - RNA, 14 nt, Salmonella enterica enterica serovar Typhi
agacauccagcauu

SEQ ID NO: 3648739 - RNA, 12 nt, Salmonella enterica enterica serovar Typhi
agacaugaccgc

SEQ ID NO: 3648740 - RNA, 19 nt, Salmonella enterica enterica serovar Typhi
agacaugaccgcacagcag

SEQ ID NO: 3648741 - RNA, 16 nt, Salmonella enterica enterica serovar Typhi
agacaugaucuuaccu

SEQ ID NO: 3648742 - RNA, 15 nt, Salmonella enterica enterica serovar Typhi
agacauuauugucuu

SEQ ID NO: 3648743 - RNA, 21 nt, Salmonella enterica enterica serovar Typhi
agacauuccauuggccagaua

SEQ ID NO: 3648744 - RNA, 15 nt, Salmonella enterica enterica serovar Typhi
agacauucgcgcacg

SEQ ID NO: 3648745 - RNA, 16 nt, Salmonella enterica enterica serovar Typhi
agacauuuugaguugc

SEQ ID NO: 3648746 - RNA, 23 nt, Salmonella enterica enterica serovar Typhi
agaccaauaagucccaucgagcc

SEQ ID NO: 3648747 - RNA, 17 nt, Salmonella enterica enterica serovar Typhi
agaccacgaaucaggau

SEQ ID NO: 3648748 - RNA, 12 nt, Salmonella enterica enterica serovar Typhi
agaccacuauag

SEQ ID NO: 3648749 - RNA, 23 nt, Salmonella enterica enterica serovar Typhi
agaccagaaucccacggagaaaa

SEQ ID NO: 3648750 - RNA, 16 nt, Salmonella enterica enterica serovar Typhi
agaccauccaugaaau

SEQ ID NO: 3648751 - RNA, 19 nt, Salmonella enterica enterica serovar Typhi
agaccauucaaccagccga

SEQ ID NO: 3648752 - RNA, 14 nt, Salmonella enterica enterica serovar Typhi
agacccaggcgcgu

SEQ ID NO: 3648753 - RNA, 19 nt, Salmonella enterica enterica serovar Typhi
agacccaguacaaacaaau

SEQ ID NO: 3648754 - RNA, 15 nt, Salmonella enterica enterica serovar Typhi
agaccccgcaucgcc

SEQ ID NO: 3648755 - RNA, 21 nt, Salmonella enterica enterica serovar Typhi
agacccgcaauaacgccgaua

SEQ ID NO: 3648756 - RNA, 18 nt, Salmonella enterica enterica serovar Typhi
agacccgggacuucaggc

SEQ ID NO: 3648757 - RNA, 17 nt, Salmonella enterica enterica serovar Typhi
agaccgacaucgccagu

SEQ ID NO: 3648758 - RNA, 14 nt, Salmonella enterica enterica serovar Typhi
agaccgacgccaac

SEQ ID NO: 3648759 - RNA, 23 nt, Salmonella enterica enterica serovar Typhi
agaccgccgcuuucaaaaccgac

SEQ ID NO: 3648760 - RNA, 16 nt, Salmonella enterica enterica serovar Typhi
agaccgccuaacagcg

SEQ ID NO: 3648761 - RNA, 18 nt, Salmonella enterica enterica serovar Typhi
agaccgccuaacagcgcc

SEQ ID NO: 3648762 - RNA, 15 nt, Salmonella enterica enterica serovar Typhi
agaccggcagccugc

SEQ ID NO: 3648763 - RNA, 19 nt, Salmonella enterica enterica serovar Typhi
agaccggcagccugccgca

SEQ ID NO: 3648764 - RNA, 15 nt, Salmonella enterica enterica serovar Typhi
agaccggcaucucau

SEQ ID NO: 3648765 - RNA, 17 nt, Salmonella enterica enterica serovar Typhi
agaccggcaucucaucu

SEQ ID NO: 3648766 - RNA, 18 nt, Salmonella enterica enterica serovar Typhi
agaccggcaucucaucuu

SEQ ID NO: 3648767 - RNA, 17 nt, Salmonella enterica enterica serovar Typhi
agaccuguaaaaaaacc

SEQ ID NO: 3648768 - RNA, 14 nt, Salmonella enterica enterica serovar Typhi
agaccuucaaccca

SEQ ID NO: 3648769 - RNA, 22 nt, Salmonella enterica enterica serovar Typhi
agacgaccauccaccagaaccu

SEQ ID NO: 3648770 - RNA, 15 nt, Salmonella enterica enterica serovar Typhi
agacgauauagcugc

SEQ ID NO: 3648771 - RNA, 22 nt, Salmonella enterica enterica serovar Typhi
agacgaugaauuccugcggcgg

SEQ ID NO: 3648772 - RNA, 19 nt, Salmonella enterica enterica serovar Typhi
agacgcaucaggaaccaca

SEQ ID NO: 3648773 - RNA, 20 nt, Salmonella enterica enterica serovar Typhi
agacgcaucuuuuucccggu

SEQ ID NO: 3648774 - RNA, 16 nt, Salmonella enterica enterica serovar Typhi
agacgcccgcaaaagc

SEQ ID NO: 3648775 - RNA, 17 nt, Salmonella enterica enterica serovar Typhi
agacgccugggcauuug

SEQ ID NO: 3648776 - RNA, 19 nt, Salmonella enterica enterica serovar Typhi
agacgcuccgcaguaauca

SEQ ID NO: 3648777 - RNA, 18 nt, Salmonella enterica enterica serovar Typhi
agacgcucgacguccagc

SEQ ID NO: 3648778 - RNA, 20 nt, Salmonella enterica enterica serovar Typhi
agacgcucguauccgagcgu

SEQ ID NO: 3648779 - RNA, 13 nt, Salmonella enterica enterica serovar Typhi
agacgcugguugu

SEQ ID NO: 3648780 - RNA, 22 nt, Salmonella enterica enterica serovar Typhi
agacggcggcuuaccgaaucuu

SEQ ID NO: 3648781 - RNA, 15 nt, Salmonella enterica enterica serovar Typhi
agacgguaagaauaa

SEQ ID NO: 3648782 - RNA, 23 nt, Salmonella enterica enterica serovar Typhi
agacggugaaucagauaacugag

SEQ ID NO: 3648783 - RNA, 19 nt, Salmonella enterica enterica serovar Typhi
agacgguuauuuuucagau

SEQ ID NO: 3648784 - RNA, 13 nt, Salmonella enterica enterica serovar Typhi
agacgucauaccu

SEQ ID NO: 3648785 - RNA, 15 nt, Salmonella enterica enterica serovar Typhi
agacgucauaccugg

SEQ ID NO: 3648786 - RNA, 17 nt, Salmonella enterica enterica serovar Typhi
agacgucggcaccgaau

SEQ ID NO: 3648787 - RNA, 13 nt, Salmonella enterica enterica serovar Typhi
agacguuuaagca

SEQ ID NO: 3648788 - RNA, 20 nt, Salmonella enterica enterica serovar Typhi
agacguuuacaccgccaucc

SEQ ID NO: 3648789 - RNA, 19 nt, Salmonella enterica enterica serovar Typhi
agacguuuauaccccacca

SEQ ID NO: 3648790 - RNA, 16 nt, Salmonella enterica enterica serovar Typhi
agacguuuaugccgcc

SEQ ID NO: 3648791 - RNA, 20 nt, Salmonella enterica enterica serovar Typhi
agacguuuaugccgccaucc

SEQ ID NO: 3648792 - RNA, 17 nt, Salmonella enterica enterica serovar Typhi
agacuaaaacgugcuga

SEQ ID NO: 3648793 - RNA, 19 nt, Salmonella enterica enterica serovar Typhi
agacuacccaucacgcccu

SEQ ID NO: 3648794 - RNA, 19 nt, Salmonella enterica enterica serovar Typhi
agacuacgcaaaaaaagcc

SEQ ID NO: 3648795 - RNA, 16 nt, Salmonella enterica enterica serovar Typhi
agacuacggaaacugu

SEQ ID NO: 3648796 - RNA, 21 nt, Salmonella enterica enterica serovar Typhi
agacuacuuuuacccuucaga

SEQ ID NO: 3648797 - RNA, 21 nt, Salmonella enterica enterica serovar Typhi
agacucaaagaaaacaucagc

SEQ ID NO: 3648798 - RNA, 18 nt, Salmonella enterica enterica serovar Typhi
agacucaccccuucuuua

SEQ ID NO: 3648799 - RNA, 13 nt, Salmonella enterica enterica serovar Typhi
agacucagcagcg

SEQ ID NO: 3648800 - RNA, 18 nt, Salmonella enterica enterica serovar Typhi
agacucaucgccgcaaug

SEQ ID NO: 3648801 - RNA, 17 nt, Salmonella enterica enterica serovar Typhi
agacuccgucaaagaaa

SEQ ID NO: 3648802 - RNA, 16 nt, Salmonella enterica enterica serovar Typhi
agacucgcggguuuca

SEQ ID NO: 3648803 - RNA, 22 nt, Salmonella enterica enterica serovar Typhi
agacucgcuucacgcggauugc

SEQ ID NO: 3648804 - RNA, 22 nt, Salmonella enterica enterica serovar Typhi
agauaaaacugcugacaaucag

SEQ ID NO: 3648805 - RNA, 19 nt, Salmonella enterica enterica serovar Typhi
agauaaacagguaaaacaa

SEQ ID NO: 3648806 - RNA, 13 nt, Salmonella enterica enterica serovar Typhi
agauaaaucagcc

SEQ ID NO: 3648807 - RNA, 15 nt, Salmonella enterica enterica serovar Typhi
agauaacgcaucaga

SEQ ID NO: 3648808 - RNA, 19 nt, Salmonella enterica enterica serovar Typhi
agauaacuauaugcccggg

SEQ ID NO: 3648809 - RNA, 23 nt, Salmonella enterica enterica serovar Typhi
agauaacuuccuuugccuuucuu

SEQ ID NO: 3648810 - RNA, 12 nt, Salmonella enterica enterica serovar Typhi
agauaagaucuu

SEQ ID NO: 3648811 - RNA, 22 nt, Salmonella enterica enterica serovar Typhi
agauaagccgucauaaaaucaa

SEQ ID NO: 3648812 - RNA, 12 nt, Salmonella enterica enterica serovar Typhi
agauaagcgcca

SEQ ID NO: 3648813 - RNA, 17 nt, Salmonella enterica enterica serovar Typhi
agauaagcgucugcaau

SEQ ID NO: 3648814 - RNA, 14 nt, Salmonella enterica enterica serovar Typhi
agauaaguguugga

SEQ ID NO: 3648815 - RNA, 18 nt, Salmonella enterica enterica serovar Typhi
agauaauagcugaaaaga

SEQ ID NO: 3648816 - RNA, 20 nt, Salmonella enterica enterica serovar Typhi
agauaauccagcgucgccag

SEQ ID NO: 3648817 - RNA, 20 nt, Salmonella enterica enterica serovar Typhi
agauaccuacuuuauuuuuc

SEQ ID NO: 3648818 - RNA, 22 nt, Salmonella enterica enterica serovar Typhi
agauacuggaagugauccuuca

SEQ ID NO: 3648819 - RNA, 22 nt, Salmonella enterica enterica serovar Typhi
agauagcugcuuaccauacuga

SEQ ID NO: 3648820 - RNA, 17 nt, Salmonella enterica enterica serovar Typhi
agauagcuuccaugccg

SEQ ID NO: 3648821 - RNA, 20 nt, Salmonella enterica enterica serovar Typhi
agauaggcgcgaaauguccc

SEQ ID NO: 3648822 - RNA, 20 nt, Salmonella enterica enterica serovar Typhi
agauagucacgauaguuugc

SEQ ID NO: 3648823 - RNA, 13 nt, Salmonella enterica enterica serovar Typhi
agauaguggcuga

SEQ ID NO: 3648824 - RNA, 11 nt, Salmonella enterica enterica serovar Typhi
agauaguuuuu

SEQ ID NO: 3648825 - RNA, 18 nt, Salmonella enterica enterica serovar Typhi
agauaucaaacacaaauu

SEQ ID NO: 3648826 - RNA, 16 nt, Salmonella enterica enterica serovar Typhi
agauaucagucugcaa

SEQ ID NO: 3648827 - RNA, 16 nt, Salmonella enterica enterica serovar Typhi
agauauuauaaaauaa

SEQ ID NO: 3648828 - RNA, 22 nt, Salmonella enterica enterica serovar Typhi
agauauuccagcgacaucgcau

SEQ ID NO: 3648829 - RNA, 21 nt, Salmonella enterica enterica serovar Typhi
agauauuuuguuuuaaauuca

SEQ ID NO: 3648830 - RNA, 22 nt, Salmonella enterica enterica serovar Typhi
agauauuuuguuuuaaauucaa

SEQ ID NO: 3648831 - RNA, 20 nt, Salmonella enterica enterica serovar Typhi
agaucagcagaacaaaggcu

SEQ ID NO: 3648832 - RNA, 14 nt, Salmonella enterica enterica serovar Typhi
agaucagcauggua

SEQ ID NO: 3648833 - RNA, 24 nt, Salmonella enterica enterica serovar Typhi
agaucaggaguaaauaacaaaagc

SEQ ID NO: 3648834 - RNA, 20 nt, Salmonella enterica enterica serovar Typhi
agaucauuaccugucgccca

SEQ ID NO: 3648835 - RNA, 23 nt, Salmonella enterica enterica serovar Typhi
agaucauuuacggcgauuugccc

SEQ ID NO: 3648836 - RNA, 19 nt, Salmonella enterica enterica serovar Typhi
agauccauaagaugaaaga

SEQ ID NO: 3648837 - RNA, 20 nt, Salmonella enterica enterica serovar Typhi
agauccauaagaugaaagau

SEQ ID NO: 3648838 - RNA, 21 nt, Salmonella enterica enterica serovar Typhi
agauccauuaaaugcgccagc

SEQ ID NO: 3648839 - RNA, 17 nt, Salmonella enterica enterica serovar Typhi
agaucccagggcggcgu

SEQ ID NO: 3648840 - RNA, 13 nt, Salmonella enterica enterica serovar Typhi
agaucccucaccu

SEQ ID NO: 3648841 - RNA, 19 nt, Salmonella enterica enterica serovar Typhi
agauccggacugauaguca

SEQ ID NO: 3648842 - RNA, 18 nt, Salmonella enterica enterica serovar Typhi
agauccuggcgaaagcga

SEQ ID NO: 3648843 - RNA, 17 nt, Salmonella enterica enterica serovar Typhi
agauccuuaacgucaaa

SEQ ID NO: 3648844 - RNA, 19 nt, Salmonella enterica enterica serovar Typhi
agaucgcagucgauuuaau

SEQ ID NO: 3648845 - RNA, 20 nt, Salmonella enterica enterica serovar Typhi
agaucgcauaaaauuauaaa

SEQ ID NO: 3648846 - RNA, 18 nt, Salmonella enterica enterica serovar Typhi
agaucgccaccguaacua

SEQ ID NO: 3648847 - RNA, 20 nt, Salmonella enterica enterica serovar Typhi
agaucgccgccgguaacgau

SEQ ID NO: 3648848 - RNA, 17 nt, Salmonella enterica enterica serovar Typhi
agaucgcgggcaaucaa

SEQ ID NO: 3648849 - RNA, 17 nt, Salmonella enterica enterica serovar Typhi
agaucgguaauuuccac

SEQ ID NO: 3648850 - RNA, 18 nt, Salmonella enterica enterica serovar Typhi
agaucguaugcgccuguu

SEQ ID NO: 3648851 - RNA, 20 nt, Salmonella enterica enterica serovar Typhi
agaucguaugcgccuguuag

SEQ ID NO: 3648852 - RNA, 22 nt, Salmonella enterica enterica serovar Typhi
agaucgugcauccggacgccag

SEQ ID NO: 3648853 - RNA, 19 nt, Salmonella enterica enterica serovar Typhi
agaucguuauccagcagcc

SEQ ID NO: 3648854 - RNA, 15 nt, Salmonella enterica enterica serovar Typhi
agaucucuaucggca

SEQ ID NO: 3648855 - RNA, 17 nt, Salmonella enterica enterica serovar Typhi
agaucugucgccaugac

SEQ ID NO: 3648856 - RNA, 22 nt, Salmonella enterica enterica serovar Typhi
agaucuuuugcgccuuccaguu

SEQ ID NO: 3648857 - RNA, 14 nt, Salmonella enterica enterica serovar Typhi
agaucuuuuugcuc

SEQ ID NO: 3648858 - RNA, 17 nt, Salmonella enterica enterica serovar Typhi
agaugaacguaacguga

SEQ ID NO: 3648859 - RNA, 17 nt, Salmonella enterica enterica serovar Typhi
agaugaucguuuccagc

SEQ ID NO: 3648860 - RNA, 14 nt, Salmonella enterica enterica serovar Typhi
agaugaugauuuau

SEQ ID NO: 3648861 - RNA, 17 nt, Salmonella enterica enterica serovar Typhi
agaugauggaugucagc

SEQ ID NO: 3648862 - RNA, 16 nt, Salmonella enterica enterica serovar Typhi
agaugccggagcgaug

SEQ ID NO: 3648863 - RNA, 13 nt, Salmonella enterica enterica serovar Typhi
agaugcgaaucuu

SEQ ID NO: 3648864 - RNA, 22 nt, Salmonella enterica enterica serovar Typhi
agaugcggcgccaacgcgcuac

SEQ ID NO: 3648865 - RNA, 23 nt, Salmonella enterica enterica serovar Typhi
agaugcggcgccaacgcgcuacc

SEQ ID NO: 3648866 - RNA, 20 nt, Salmonella enterica enterica serovar Typhi
agaugcugggcgugucccug

SEQ ID NO: 3648867 - RNA, 16 nt, Salmonella enterica enterica serovar Typhi
agaugcugucggaaaa

SEQ ID NO: 3648868 - RNA, 14 nt, Salmonella enterica enterica serovar Typhi
agauggaaaaaaag

SEQ ID NO: 3648869 - RNA, 16 nt, Salmonella enterica enterica serovar Typhi
agauggaaaaaaagaa

SEQ ID NO: 3648870 - RNA, 21 nt, Salmonella enterica enterica serovar Typhi
agauggcauugcccggcggca

SEQ ID NO: 3648871 - RNA, 23 nt, Salmonella enterica enterica serovar Typhi
agauggcgccauuggcucggcgu

SEQ ID NO: 3648872 - RNA, 15 nt, Salmonella enterica enterica serovar Typhi
agauggcguggccaa

SEQ ID NO: 3648873 - RNA, 21 nt, Salmonella enterica enterica serovar Typhi
agaugguauaaaucacgcuga

SEQ ID NO: 3648874 - RNA, 20 nt, Salmonella enterica enterica serovar Typhi
agaugucagauccuucauuc

SEQ ID NO: 3648875 - RNA, 21 nt, Salmonella enterica enterica serovar Typhi
agauguuuuaaucucuucuau

SEQ ID NO: 3648876 - RNA, 22 nt, Salmonella enterica enterica serovar Typhi
agauuaacagcgcgaccagcgu

SEQ ID NO: 3648877 - RNA, 16 nt, Salmonella enterica enterica serovar Typhi
agauuaacagcuucau

SEQ ID NO: 3648878 - RNA, 17 nt, Salmonella enterica enterica serovar Typhi
agauuaagaccguauaa

SEQ ID NO: 3648879 - RNA, 20 nt, Salmonella enterica enterica serovar Typhi
agauuaauaauugagcgcaa

SEQ ID NO: 3648880 - RNA, 17 nt, Salmonella enterica enterica serovar Typhi
agauuagccaggugacu

SEQ ID NO: 3648881 - RNA, 19 nt, Salmonella enterica enterica serovar Typhi
agauuaucggccagcgcca

SEQ ID NO: 3648882 - RNA, 19 nt, Salmonella enterica enterica serovar Typhi
agauucaccaccacccgau

SEQ ID NO: 3648883 - RNA, 14 nt, Salmonella enterica enterica serovar Typhi
agauucuaacauaa

SEQ ID NO: 3648884 - RNA, 23 nt, Salmonella enterica enterica serovar Typhi
agauucugcgguaaucugccagc

SEQ ID NO: 3648885 - RNA, 18 nt, Salmonella enterica enterica serovar Typhi
agauugaaacgaaaacug

SEQ ID NO: 3648886 - RNA, 14 nt, Salmonella enterica enterica serovar Typhi
agauugauuuauuc

SEQ ID NO: 3648887 - RNA, 21 nt, Salmonella enterica enterica serovar Typhi
agauugauuuauucacuggca

SEQ ID NO: 3648888 - RNA, 13 nt, Salmonella enterica enterica serovar Typhi
agauuggcaucug

SEQ ID NO: 3648889 - RNA, 13 nt, Salmonella enterica enterica serovar Typhi
agcacgcccgguc

SEQ ID NO: 3648890 - RNA, 15 nt, Salmonella enterica enterica serovar Typhi
agcacgcccugccau

SEQ ID NO: 3648891 - RNA, 17 nt, Salmonella enterica enterica serovar Typhi
agcacgcuuacccagca

SEQ ID NO: 3648892 - RNA, 18 nt, Salmonella enterica enterica serovar Typhi
agcacgguaacuucgcgg

SEQ ID NO: 3648893 - RNA, 15 nt, Salmonella enterica enterica serovar Typhi
agcacgugcauggga

SEQ ID NO: 3648894 - RNA, 14 nt, Salmonella enterica enterica serovar Typhi
agcacuaacagcag

SEQ ID NO: 3648895 - RNA, 21 nt, Salmonella enterica enterica serovar Typhi
agcacuaacagcagcagcaaa

SEQ ID NO: 3648896 - RNA, 18 nt, Salmonella enterica enterica serovar Typhi
agcacuacggcaaacaca

SEQ ID NO: 3648897 - RNA, 15 nt, Salmonella enterica enterica serovar Typhi
agcacucggcgccuu

SEQ ID NO: 3648898 - RNA, 15 nt, Salmonella enterica enterica serovar Typhi
agcacugcccaggac

SEQ ID NO: 3648899 - RNA, 13 nt, Salmonella enterica enterica serovar Typhi
agcacugcugcug

SEQ ID NO: 3648900 - RNA, 19 nt, Salmonella enterica enterica serovar Typhi
agcacugcuuaaauuuuuu

SEQ ID NO: 3648901 - RNA, 18 nt, Salmonella enterica enterica serovar Typhi
agcacuucacccaucgcc

SEQ ID NO: 3648902 - RNA, 22 nt, Salmonella enterica enterica serovar Typhi
agcacuuccggaucgcuaucuu

SEQ ID NO: 3648903 - RNA, 14 nt, Salmonella enterica enterica serovar Typhi
agcagaaagcaaca

SEQ ID NO: 3648904 - RNA, 19 nt, Salmonella enterica enterica serovar Typhi
agcagaaagcaacagcaag

SEQ ID NO: 3648905 - RNA, 23 nt, Salmonella enterica enterica serovar Typhi
agcagaacguagcccauugucau

SEQ ID NO: 3648906 - RNA, 21 nt, Salmonella enterica enterica serovar Typhi
agcagaacuggcgcgaugacu

SEQ ID NO: 3648907 - RNA, 20 nt, Salmonella enterica enterica serovar Typhi
agcagaagacggaaaccaga

SEQ ID NO: 3648908 - RNA, 22 nt, Salmonella enterica enterica serovar Typhi
agcagaauauugcugauaauca

SEQ ID NO: 3648909 - RNA, 14 nt, Salmonella enterica enterica serovar Typhi
agcagacaggugaa

SEQ ID NO: 3648910 - RNA, 13 nt, Salmonella enterica enterica serovar Typhi
agcagacguuggu

SEQ ID NO: 3648911 - RNA, 22 nt, Salmonella enterica enterica serovar Typhi
agcagacguuuaagcaugguga

SEQ ID NO: 3648912 - RNA, 15 nt, Salmonella enterica enterica serovar Typhi
agcagagaucaggag

SEQ ID NO: 3648913 - RNA, 15 nt, Salmonella enterica enterica serovar Typhi
agcagagccggaacc

SEQ ID NO: 3648914 - RNA, 22 nt, Salmonella enterica enterica serovar Typhi
agcagauaagcgacucuguauu

SEQ ID NO: 3648915 - RNA, 20 nt, Salmonella enterica enterica serovar Typhi
agcagauuuuucgccaggua

SEQ ID NO: 3648916 - RNA, 14 nt, Salmonella enterica enterica serovar Typhi
agcagcaccggcug

SEQ ID NO: 3648917 - RNA, 15 nt, Salmonella enterica enterica serovar Typhi
agcagcagagccgga

SEQ ID NO: 3648918 - RNA, 16 nt, Salmonella enterica enterica serovar Typhi
agcagcagagccggaa

SEQ ID NO: 3648919 - RNA, 15 nt, Salmonella enterica enterica serovar Typhi
agcagcagauaagcg

SEQ ID NO: 3648920 - RNA, 13 nt, Salmonella enterica enterica serovar Typhi
agcagcagccggu

SEQ ID NO: 3648921 - RNA, 13 nt, Salmonella enterica enterica serovar Typhi
agcagcagcgcaa

SEQ ID NO: 3648922 - RNA, 14 nt, Salmonella enterica enterica serovar Typhi
agcagcaggcugga

SEQ ID NO: 3648923 - RNA, 17 nt, Salmonella enterica enterica serovar Typhi
agcagcagugaggauaa

SEQ ID NO: 3648924 - RNA, 20 nt, Salmonella enterica enterica serovar Typhi
agcagcauacgacaucgcca

SEQ ID NO: 3648925 - RNA, 16 nt, Salmonella enterica enterica serovar Typhi
agcagcaucccggcaa

SEQ ID NO: 3648926 - RNA, 15 nt, Salmonella enterica enterica serovar Typhi
agcagccagaaaaag

SEQ ID NO: 3648927 - RNA, 16 nt, Salmonella enterica enterica serovar Typhi
agcagccagacccgcg

SEQ ID NO: 3648928 - RNA, 21 nt, Salmonella enterica enterica serovar Typhi
agcagccaguuauuaaucaag

SEQ ID NO: 3648929 - RNA, 19 nt, Salmonella enterica enterica serovar Typhi
agcagcgaugacagcagga

SEQ ID NO: 3648930 - RNA, 17 nt, Salmonella enterica enterica serovar Typhi
agcagcggcguaucuuc

SEQ ID NO: 3648931 - RNA, 13 nt, Salmonella enterica enterica serovar Typhi
agcagcugcugua

SEQ ID NO: 3648932 - RNA, 20 nt, Salmonella enterica enterica serovar Typhi
agcagcuuaucuuuacgcuu

SEQ ID NO: 3648933 - RNA, 13 nt, Salmonella enterica enterica serovar Typhi
agcagcuucagca

SEQ ID NO: 3648934 - RNA, 15 nt, Salmonella enterica enterica serovar Typhi
agcagcuuggcggcu

SEQ ID NO: 3648935 - RNA, 15 nt, Salmonella enterica enterica serovar Typhi
agcaggaacggcagg

SEQ ID NO: 3648936 - RNA, 22 nt, Salmonella enterica enterica serovar Typhi
agcaggaucuccagaucgccac

SEQ ID NO: 3648937 - RNA, 15 nt, Salmonella enterica enterica serovar Typhi
agcaggcacuguggu

SEQ ID NO: 3648938 - RNA, 21 nt, Salmonella enterica enterica serovar Typhi
agcaggcacuguggugugccu

SEQ ID NO: 3648939 - RNA, 24 nt, Salmonella enterica enterica serovar Typhi
agcaggcgggacgccauagcguuu

SEQ ID NO: 3648940 - RNA, 13 nt, Salmonella enterica enterica serovar Typhi
agcaggcgggcuu

SEQ ID NO: 3648941 - RNA, 14 nt, Salmonella enterica enterica serovar Typhi
agcaggcuuugcug

SEQ ID NO: 3648942 - RNA, 20 nt, Salmonella enterica enterica serovar Typhi
agcagggcaugauuacagau

SEQ ID NO: 3648943 - RNA, 14 nt, Salmonella enterica enterica serovar Typhi
agcagggucaggaa

SEQ ID NO: 3648944 - RNA, 15 nt, Salmonella enterica enterica serovar Typhi
agcagggucaggaac

SEQ ID NO: 3648945 - RNA, 15 nt, Salmonella enterica enterica serovar Typhi
agcaggguuaugccg

SEQ ID NO: 3648946 - RNA, 18 nt, Salmonella enterica enterica serovar Typhi
agcaggucaaagacgaaa

SEQ ID NO: 3648947 - RNA, 21 nt, Salmonella enterica enterica serovar Typhi
agcaggugcggacugggcuga

SEQ ID NO: 3648948 - RNA, 13 nt, Salmonella enterica enterica serovar Typhi
agcaggugcggcu

SEQ ID NO: 3648949 - RNA, 17 nt, Salmonella enterica enterica serovar Typhi
agcagguuaaacagaca

SEQ ID NO: 3648950 - RNA, 15 nt, Salmonella enterica enterica serovar Typhi
agcaguaacgcacuu

SEQ ID NO: 3648951 - RNA, 19 nt, Salmonella enterica enterica serovar Typhi
agcaguaucguguuauuuu

SEQ ID NO: 3648952 - RNA, 18 nt, Salmonella enterica enterica serovar Typhi
agcaguccugcgggaaca

SEQ ID NO: 3648953 - RNA, 14 nt, Salmonella enterica enterica serovar Typhi
agcaguucagcagc

SEQ ID NO: 3648954 - RNA, 16 nt, Salmonella enterica enterica serovar Typhi
agcaguucagcagcac

SEQ ID NO: 3648955 - RNA, 20 nt, Salmonella enterica enterica serovar Typhi
agcaguuccccgccgcggcg

SEQ ID NO: 3648956 - RNA, 21 nt, Salmonella enterica enterica serovar Typhi
agcaguuuuaucuaugugugg

SEQ ID NO: 3648957 - RNA, 13 nt, Salmonella enterica enterica serovar Typhi
agcauaaaaagac

SEQ ID NO: 3648958 - RNA, 21 nt, Salmonella enterica enterica serovar Typhi
agcauaaaaccgccgcccauu

SEQ ID NO: 3648959 - RNA, 16 nt, Salmonella enterica enterica serovar Typhi
agcauaauauccugca

SEQ ID NO: 3648960 - RNA, 21 nt, Salmonella enterica enterica serovar Typhi
agcauaccgugugcagugaca

SEQ ID NO: 3648961 - RNA, 17 nt, Salmonella enterica enterica serovar Typhi
agcauacgacaucgcca

SEQ ID NO: 3648962 - RNA, 14 nt, Salmonella enterica enterica serovar Typhi
agcauacgcugcac

SEQ ID NO: 3648963 - RNA, 17 nt, Salmonella enterica enterica serovar Typhi
agcauagcgccaucagg

SEQ ID NO: 3648964 - RNA, 15 nt, Salmonella enterica enterica serovar Typhi
agcauagcguuaucu

SEQ ID NO: 3648965 - RNA, 23 nt, Salmonella enterica enterica serovar Typhi
agcauagucgcuccccauaaaga

SEQ ID NO: 3648966 - RNA, 16 nt, Salmonella enterica enterica serovar Typhi
agcauaucaaacugaa

SEQ ID NO: 3648967 - RNA, 14 nt, Salmonella enterica enterica serovar Typhi
agcauauccagcgc

SEQ ID NO: 3648968 - RNA, 19 nt, Salmonella enterica enterica serovar Typhi
agcaucaacccguuuucau

SEQ ID NO: 3648969 - RNA, 22 nt, Salmonella enterica enterica serovar Typhi
agcaucaauaucugcuaccgcc

SEQ ID NO: 3648970 - RNA, 13 nt, Salmonella enterica enterica serovar Typhi
agcaucagcgccg

SEQ ID NO: 3648971 - RNA, 13 nt, Salmonella enterica enterica serovar Typhi
agcaucaggugga

SEQ ID NO: 3648972 - RNA, 23 nt, Salmonella enterica enterica serovar Typhi
agcaucagguggaagaaacgcuu

SEQ ID NO: 3648973 - RNA, 15 nt, Salmonella enterica enterica serovar Typhi
agcaucaucugccau

SEQ ID NO: 3648974 - RNA, 16 nt, Salmonella enterica enterica serovar Typhi
agcaucaucugccauu

SEQ ID NO: 3648975 - RNA, 15 nt, Salmonella enterica enterica serovar Typhi
agccagcgcagucaa

SEQ ID NO: 3648976 - RNA, 15 nt, Salmonella enterica enterica serovar Typhi
agccaggccagcgcu

SEQ ID NO: 3648977 - RNA, 20 nt, Salmonella enterica enterica serovar Typhi
agccaggcccgguggcgcca

SEQ ID NO: 3648978 - RNA, 14 nt, Salmonella enterica enterica serovar Typhi
agccaggccgccag

SEQ ID NO: 3648979 - RNA, 17 nt, Salmonella enterica enterica serovar Typhi
agccaggcgauugucac

SEQ ID NO: 3648980 - RNA, 22 nt, Salmonella enterica enterica serovar Typhi
agccagguauuuagccacgccg

SEQ ID NO: 3648981 - RNA, 19 nt, Salmonella enterica enterica serovar Typhi
agccagguggcaauauccu

SEQ ID NO: 3648982 - RNA, 16 nt, Salmonella enterica enterica serovar Typhi
agccagguugccagaa

SEQ ID NO: 3648983 - RNA, 20 nt, Salmonella enterica enterica serovar Typhi
agccagguugccagaaacaa

SEQ ID NO: 3648984 - RNA, 13 nt, Salmonella enterica enterica serovar Typhi
agccagguugcgc

SEQ ID NO: 3648985 - RNA, 20 nt, Salmonella enterica enterica serovar Typhi
agccagguugcgcccggcgc

SEQ ID NO: 3648986 - RNA, 15 nt, Salmonella enterica enterica serovar Typhi
agccagguuuugcuc

SEQ ID NO: 3648987 - RNA, 17 nt, Salmonella enterica enterica serovar Typhi
agccaguaagaacgaga

SEQ ID NO: 3648988 - RNA, 17 nt, Salmonella enterica enterica serovar Typhi
agccaguccugccacca

SEQ ID NO: 3648989 - RNA, 14 nt, Salmonella enterica enterica serovar Typhi
agccagucgccagg

SEQ ID NO: 3648990 - RNA, 17 nt, Salmonella enterica enterica serovar Typhi
agccagucgccaggcaa

SEQ ID NO: 3648991 - RNA, 22 nt, Salmonella enterica enterica serovar Typhi
agccaguucgccuucuucaucu

SEQ ID NO: 3648992 - RNA, 13 nt, Salmonella enterica enterica serovar Typhi
agccaguucucaa

SEQ ID NO: 3648993 - RNA, 22 nt, Salmonella enterica enterica serovar Typhi
agccaguuguucgauaaccugu

SEQ ID NO: 3648994 - RNA, 15 nt, Salmonella enterica enterica serovar Typhi
agccauagcagcaaa

SEQ ID NO: 3648995 - RNA, 15 nt, Salmonella enterica enterica serovar Typhi
agccauauggcauuc

SEQ ID NO: 3648996 - RNA, 14 nt, Salmonella enterica enterica serovar Typhi
agccaucccggcga

SEQ ID NO: 3648997 - RNA, 17 nt, Salmonella enterica enterica serovar Typhi
agccaucuucugcguca

SEQ ID NO: 3648998 - RNA, 15 nt, Salmonella enterica enterica serovar Typhi
agccaugccagcagu

SEQ ID NO: 3648999 - RNA, 15 nt, Salmonella enterica enterica serovar Typhi
agccaugccauugcu

SEQ ID NO: 3649000 - RNA, 22 nt, Salmonella enterica enterica serovar Typhi
agccaugcuauucagcaguuca

SEQ ID NO: 3649001 - RNA, 19 nt, Salmonella enterica enterica serovar Typhi
agccauguagaauagcgcc

SEQ ID NO: 3649002 - RNA, 14 nt, Salmonella enterica enterica serovar Typhi
agccauuaaccaga

SEQ ID NO: 3649003 - RNA, 17 nt, Salmonella enterica enterica serovar Typhi
agccauuaaugcaggca

SEQ ID NO: 3649004 - RNA, 18 nt, Salmonella enterica enterica serovar Typhi
agccauucauuaaaauug

SEQ ID NO: 3649005 - RNA, 23 nt, Salmonella enterica enterica serovar Typhi
agccauugcugcuauauaacaua

SEQ ID NO: 3649006 - RNA, 15 nt, Salmonella enterica enterica serovar Typhi
agccauuuuaaaaau

SEQ ID NO: 3649007 - RNA, 15 nt, Salmonella enterica enterica serovar Typhi
agcccaauacgccag

SEQ ID NO: 3649008 - RNA, 14 nt, Salmonella enterica enterica serovar Typhi
agcccacacaucac

SEQ ID NO: 3649009 - RNA, 12 nt, Salmonella enterica enterica serovar Typhi
agcccagcgccg

SEQ ID NO: 3649010 - RNA, 12 nt, Salmonella enterica enterica serovar Typhi
agcccagcucag

SEQ ID NO: 3649011 - RNA, 21 nt, Salmonella enterica enterica serovar Typhi
agcccauaaagcacuggugga

SEQ ID NO: 3649012 - RNA, 17 nt, Salmonella enterica enterica serovar Typhi
agcccaucagcgccagc

SEQ ID NO: 3649013 - RNA, 17 nt, Salmonella enterica enterica serovar Typhi
agcccaucaguccccag

SEQ ID NO: 3649014 - RNA, 14 nt, Salmonella enterica enterica serovar Typhi
agcccauccgucag

SEQ ID NO: 3649015 - RNA, 20 nt, Salmonella enterica enterica serovar Typhi
agcccaugauggugaacaga

SEQ ID NO: 3649016 - RNA, 23 nt, Salmonella enterica enterica serovar Typhi
agcccaugauggugaacagaauc

SEQ ID NO: 3649017 - RNA, 14 nt, Salmonella enterica enterica serovar Typhi
agcccauggcaggc

SEQ ID NO: 3649018 - RNA, 17 nt, Salmonella enterica enterica serovar Typhi
agcccauggcaggcagc

SEQ ID NO: 3649019 - RNA, 14 nt, Salmonella enterica enterica serovar Typhi
agccccacgguacg

SEQ ID NO: 3649020 - RNA, 15 nt, Salmonella enterica enterica serovar Typhi
agccccagcgccagc

SEQ ID NO: 3649021 - RNA, 13 nt, Salmonella enterica enterica serovar Typhi
agccccaggccgg

SEQ ID NO: 3649022 - RNA, 17 nt, Salmonella enterica enterica serovar Typhi
agccccaggccgguugu

SEQ ID NO: 3649023 - RNA, 21 nt, Salmonella enterica enterica serovar Typhi
agccccauaaccgaugcacau

SEQ ID NO: 3649024 - RNA, 23 nt, Salmonella enterica enterica serovar Typhi
agccccccgcacagcacauagaa

SEQ ID NO: 3649025 - RNA, 22 nt, Salmonella enterica enterica serovar Typhi
agccccgaaagucaucugccag

SEQ ID NO: 3649026 - RNA, 18 nt, Salmonella enterica enterica serovar Typhi
agccccuucgcuguccau

SEQ ID NO: 3649027 - RNA, 16 nt, Salmonella enterica enterica serovar Typhi
agcccgcccacaggcu

SEQ ID NO: 3649028 - RNA, 15 nt, Salmonella enterica enterica serovar Typhi
agcccgcccagcauu

SEQ ID NO: 3649029 - RNA, 16 nt, Salmonella enterica enterica serovar Typhi
agcccgcccagcauua

SEQ ID NO: 3649030 - RNA, 17 nt, Salmonella enterica enterica serovar Typhi
agcccgcccagcauuac

SEQ ID NO: 3649031 - RNA, 21 nt, Salmonella enterica enterica serovar Typhi
agcccgucuuuuuccugcaug

SEQ ID NO: 3649032 - RNA, 14 nt, Salmonella enterica enterica serovar Typhi
agcccuaccgccac

SEQ ID NO: 3649033 - RNA, 17 nt, Salmonella enterica enterica serovar Typhi
agcccuauaacagcgcu

SEQ ID NO: 3649034 - RNA, 20 nt, Salmonella enterica enterica serovar Typhi
agcccuauuaggcacuacca

SEQ ID NO: 3649035 - RNA, 21 nt, Salmonella enterica enterica serovar Typhi
agcccuauuaggcacuaccac

SEQ ID NO: 3649036 - RNA, 22 nt, Salmonella enterica enterica serovar Typhi
agcccucaacauugccggcauc

SEQ ID NO: 3649037 - RNA, 13 nt, Salmonella enterica enterica serovar Typhi
agcccugacagaa

SEQ ID NO: 3649038 - RNA, 12 nt, Salmonella enterica enterica serovar Typhi
agcccuggccaa

SEQ ID NO: 3649039 - RNA, 17 nt, Salmonella enterica enterica serovar Typhi
agcccugugccgcuggu

SEQ ID NO: 3649040 - RNA, 19 nt, Salmonella enterica enterica serovar Typhi
agcccuuaucgccccagcc

SEQ ID NO: 3649041 - RNA, 21 nt, Salmonella enterica enterica serovar Typhi
agccgaaacuuauacugauaa

SEQ ID NO: 3649042 - RNA, 15 nt, Salmonella enterica enterica serovar Typhi
agccgaacucuucca

SEQ ID NO: 3649043 - RNA, 20 nt, Salmonella enterica enterica serovar Typhi
agccgaaguuccccguggcc

SEQ ID NO: 3649044 - RNA, 19 nt, Salmonella enterica enterica serovar Typhi
agccgaccaucgcgccgcu

SEQ ID NO: 3649045 - RNA, 13 nt, Salmonella enterica enterica serovar Typhi
agccgaccgccga

SEQ ID NO: 3649046 - RNA, 13 nt, Salmonella enterica enterica serovar Typhi
agccgacgcucuu

SEQ ID NO: 3649047 - RNA, 15 nt, Salmonella enterica enterica serovar Typhi
agccgacuauuccgc

SEQ ID NO: 3649048 - RNA, 14 nt, Salmonella enterica enterica serovar Typhi
agccgagcgguaag

SEQ ID NO: 3649049 - RNA, 19 nt, Salmonella enterica enterica serovar Typhi
agccgauaagaacuccaaa

SEQ ID NO: 3649050 - RNA, 18 nt, Salmonella enterica enterica serovar Typhi
agccgauggaaguacugg

SEQ ID NO: 3649051 - RNA, 23 nt, Salmonella enterica enterica serovar Typhi
agccgcaaucagcguuucgccgu

SEQ ID NO: 3649052 - RNA, 13 nt, Salmonella enterica enterica serovar Typhi
agccgcagaacca

SEQ ID NO: 3649053 - RNA, 23 nt, Salmonella enterica enterica serovar Typhi
agccgcagaaccauuuccucugc

SEQ ID NO: 3649054 - RNA, 15 nt, Salmonella enterica enterica serovar Typhi
agccgccaccacaaa

SEQ ID NO: 3649055 - RNA, 17 nt, Salmonella enterica enterica serovar Typhi
agccgccacccggcuuu

SEQ ID NO: 3649056 - RNA, 12 nt, Salmonella enterica enterica serovar Typhi
agccgccaggca

SEQ ID NO: 3649057 - RNA, 22 nt, Salmonella enterica enterica serovar Typhi
agccgccaggcaaucagcagcc

SEQ ID NO: 3649058 - RNA, 15 nt, Salmonella enterica enterica serovar Typhi
agccgccauccggca

SEQ ID NO: 3649059 - RNA, 16 nt, Salmonella enterica enterica serovar Typhi
agccgccauccggcac

SEQ ID NO: 3649060 - RNA, 21 nt, Salmonella enterica enterica serovar Typhi
agccgccauccggcacaguau

SEQ ID NO: 3649061 - RNA, 13 nt, Salmonella enterica enterica serovar Typhi
agcgaacagucca

SEQ ID NO: 3649062 - RNA, 17 nt, Salmonella enterica enterica serovar Typhi
agcgaacguccagcggc

SEQ ID NO: 3649063 - RNA, 20 nt, Salmonella enterica enterica serovar Typhi
agcgaagaagucagugcuga

SEQ ID NO: 3649064 - RNA, 23 nt, Salmonella enterica enterica serovar Typhi
agcgaagcgucauccggcaauca

SEQ ID NO: 3649065 - RNA, 15 nt, Salmonella enterica enterica serovar Typhi
agcgaauaacauaau

SEQ ID NO: 3649066 - RNA, 20 nt, Salmonella enterica enterica serovar Typhi
agcgaauaaucccggcgcca

SEQ ID NO: 3649067 - RNA, 17 nt, Salmonella enterica enterica serovar Typhi
agcgaauacuccugcaa

SEQ ID NO: 3649068 - RNA, 14 nt, Salmonella enterica enterica serovar Typhi
agcgaauagcggca

SEQ ID NO: 3649069 - RNA, 18 nt, Salmonella enterica enterica serovar Typhi
agcgaaucgaucuggcgc

SEQ ID NO: 3649070 - RNA, 15 nt, Salmonella enterica enterica serovar Typhi
agcgaaugcgcgcca

SEQ ID NO: 3649071 - RNA, 13 nt, Salmonella enterica enterica serovar Typhi
agcgaaugcugca

SEQ ID NO: 3649072 - RNA, 22 nt, Salmonella enterica enterica serovar Typhi
agcgaauggcgugaagccauca

SEQ ID NO: 3649073 - RNA, 21 nt, Salmonella enterica enterica serovar Typhi
agcgaauuaugacggaugcca

SEQ ID NO: 3649074 - RNA, 22 nt, Salmonella enterica enterica serovar Typhi
agcgaauugccgucgccggaau

SEQ ID NO: 3649075 - RNA, 13 nt, Salmonella enterica enterica serovar Typhi
agcgacaaaugaa

SEQ ID NO: 3649076 - RNA, 17 nt, Salmonella enterica enterica serovar Typhi
agcgacacuccgcgcau

SEQ ID NO: 3649077 - RNA, 15 nt, Salmonella enterica enterica serovar Typhi
agcgacagcccggcg

SEQ ID NO: 3649078 - RNA, 20 nt, Salmonella enterica enterica serovar Typhi
agcgaccuguagaugaaacu

SEQ ID NO: 3649079 - RNA, 17 nt, Salmonella enterica enterica serovar Typhi
agcgaccuuaccggcga

SEQ ID NO: 3649080 - RNA, 15 nt, Salmonella enterica enterica serovar Typhi
agcgacggcgcgcca

SEQ ID NO: 3649081 - RNA, 14 nt, Salmonella enterica enterica serovar Typhi
agcgacggcgcugg

SEQ ID NO: 3649082 - RNA, 21 nt, Salmonella enterica enterica serovar Typhi
agcgacgguccuggccaggcu

SEQ ID NO: 3649083 - RNA, 21 nt, Salmonella enterica enterica serovar Typhi
agcgacgucccgucagggcga

SEQ ID NO: 3649084 - RNA, 21 nt, Salmonella enterica enterica serovar Typhi
agcgacguugucuucaucuau

SEQ ID NO: 3649085 - RNA, 19 nt, Salmonella enterica enterica serovar Typhi
agcgacucauucagcaacu

SEQ ID NO: 3649086 - RNA, 23 nt, Salmonella enterica enterica serovar Typhi
agcgacucuguauuuaauaccug

SEQ ID NO: 3649087 - RNA, 15 nt, Salmonella enterica enterica serovar Typhi
agcgagacuuuugcc

SEQ ID NO: 3649088 - RNA, 17 nt, Salmonella enterica enterica serovar Typhi
agcgagauaaccgggaa

SEQ ID NO: 3649089 - RNA, 18 nt, Salmonella enterica enterica serovar Typhi
agcgagauaaccgggaau

SEQ ID NO: 3649090 - RNA, 13 nt, Salmonella enterica enterica serovar Typhi
agcgagaugaaaa

SEQ ID NO: 3649091 - RNA, 22 nt, Salmonella enterica enterica serovar Typhi
agcgagcgauagagaguuccuc

SEQ ID NO: 3649092 - RNA, 13 nt, Salmonella enterica enterica serovar Typhi
agcgagcgccuga

SEQ ID NO: 3649093 - RNA, 18 nt, Salmonella enterica enterica serovar Typhi
agcgagcugguuucaaua

SEQ ID NO: 3649094 - RNA, 12 nt, Salmonella enterica enterica serovar Typhi
agcgagguaaaa

SEQ ID NO: 3649095 - RNA, 15 nt, Salmonella enterica enterica serovar Typhi
agcgagguaaaaagc

SEQ ID NO: 3649096 - RNA, 19 nt, Salmonella enterica enterica serovar Typhi
agcgagguucccgccgcca

SEQ ID NO: 3649097 - RNA, 21 nt, Salmonella enterica enterica serovar Typhi
agcgaguacguaaugugaaaa

SEQ ID NO: 3649098 - RNA, 22 nt, Salmonella enterica enterica serovar Typhi
agcgauauagcgcauagcggcc

SEQ ID NO: 3649099 - RNA, 15 nt, Salmonella enterica enterica serovar Typhi
agcgaucgagauaag

SEQ ID NO: 3649100 - RNA, 17 nt, Salmonella enterica enterica serovar Typhi
agcgaucgagauaagau

SEQ ID NO: 3649101 - RNA, 18 nt, Salmonella enterica enterica serovar Typhi
agcgaucgagauaagauc

SEQ ID NO: 3649102 - RNA, 22 nt, Salmonella enterica enterica serovar Typhi
agcgaugagcgccagcaacagc

SEQ ID NO: 3649103 - RNA, 13 nt, Salmonella enterica enterica serovar Typhi
agcgaugcgcgcg

SEQ ID NO: 3649104 - RNA, 17 nt, Salmonella enterica enterica serovar Typhi
agcgauugcgccagacc

SEQ ID NO: 3649105 - RNA, 21 nt, Salmonella enterica enterica serovar Typhi
agcgauuucgacaucuuggcg

SEQ ID NO: 3649106 - RNA, 19 nt, Salmonella enterica enterica serovar Typhi
agcgauuuuugaucucuuu

SEQ ID NO: 3649107 - RNA, 15 nt, Salmonella enterica enterica serovar Typhi
agcgcaaacaacccg

SEQ ID NO: 3649108 - RNA, 16 nt, Salmonella enterica enterica serovar Typhi
agcgcaacgcgcauca

SEQ ID NO: 3649109 - RNA, 11 nt, Salmonella enterica enterica serovar Typhi
agcgcaaugcu

SEQ ID NO: 3649110 - RNA, 23 nt, Salmonella enterica enterica serovar Typhi
agcgcagaccgagcgcauguucu

SEQ ID NO: 3649111 - RNA, 18 nt, Salmonella enterica enterica serovar Typhi
agcgcagagugaccagcg

SEQ ID NO: 3649112 - RNA, 12 nt, Salmonella enterica enterica serovar Typhi
agcgcagcacgu

SEQ ID NO: 3649113 - RNA, 18 nt, Salmonella enterica enterica serovar Typhi
agcgcagcgccaucaggc

SEQ ID NO: 3649114 - RNA, 15 nt, Salmonella enterica enterica serovar Typhi
agcgcagcggaaagu

SEQ ID NO: 3649115 - RNA, 18 nt, Salmonella enterica enterica serovar Typhi
agcgcagugaccagcauc

SEQ ID NO: 3649116 - RNA, 22 nt, Salmonella enterica enterica serovar Typhi
agcgcauacgcuguccagucaa

SEQ ID NO: 3649117 - RNA, 16 nt, Salmonella enterica enterica serovar Typhi
agcgcauccagcucuu

SEQ ID NO: 3649118 - RNA, 14 nt, Salmonella enterica enterica serovar Typhi
agcgcauccggcca

SEQ ID NO: 3649119 - RNA, 17 nt, Salmonella enterica enterica serovar Typhi
agcgcauccggccagcg

SEQ ID NO: 3649120 - RNA, 16 nt, Salmonella enterica enterica serovar Typhi
agcgcaucgcucccca

SEQ ID NO: 3649121 - RNA, 18 nt, Salmonella enterica enterica serovar Typhi
agcgcauugacgauaucg

SEQ ID NO: 3649122 - RNA, 14 nt, Salmonella enterica enterica serovar Typhi
agcgccaaucacua

SEQ ID NO: 3649123 - RNA, 22 nt, Salmonella enterica enterica serovar Typhi
agcgccaccaaagccaggccgc

SEQ ID NO: 3649124 - RNA, 23 nt, Salmonella enterica enterica serovar Typhi
agcgccaccaaagccaggccgcc

SEQ ID NO: 3649125 - RNA, 14 nt, Salmonella enterica enterica serovar Typhi
agcgccaccacaaa

SEQ ID NO: 3649126 - RNA, 17 nt, Salmonella enterica enterica serovar Typhi
agcgccacccauuuucc

SEQ ID NO: 3649127 - RNA, 14 nt, Salmonella enterica enterica serovar Typhi
agcgccacgcccaa

SEQ ID NO: 3649128 - RNA, 16 nt, Salmonella enterica enterica serovar Typhi
agcgccagacacugga

SEQ ID NO: 3649129 - RNA, 12 nt, Salmonella enterica enterica serovar Typhi
agcgccagcagc

SEQ ID NO: 3649130 - RNA, 12 nt, Salmonella enterica enterica serovar Typhi
agcgccagcaug

SEQ ID NO: 3649131 - RNA, 15 nt, Salmonella enterica enterica serovar Typhi
agcgccagcgacaga

SEQ ID NO: 3649132 - RNA, 17 nt, Salmonella enterica enterica serovar Typhi
agcgccagcgccaccug

SEQ ID NO: 3649133 - RNA, 15 nt, Salmonella enterica enterica serovar Typhi
agcgccagcuccaua

SEQ ID NO: 3649134 - RNA, 12 nt, Salmonella enterica enterica serovar Typhi
agcgccaggcca

SEQ ID NO: 3649135 - RNA, 13 nt, Salmonella enterica enterica serovar Typhi
agcgccagugacg

SEQ ID NO: 3649136 - RNA, 14 nt, Salmonella enterica enterica serovar Typhi
agcgccagugacgc

SEQ ID NO: 3649137 - RNA, 14 nt, Salmonella enterica enterica serovar Typhi
agcgccaguuuuuc

SEQ ID NO: 3649138 - RNA, 20 nt, Salmonella enterica enterica serovar Typhi
agcgccaguuuuuccuguuc

SEQ ID NO: 3649139 - RNA, 14 nt, Salmonella enterica enterica serovar Typhi
agcgccauauugcu

SEQ ID NO: 3649140 - RNA, 17 nt, Salmonella enterica enterica serovar Typhi
agcgccaucaggcaaug

SEQ ID NO: 3649141 - RNA, 20 nt, Salmonella enterica enterica serovar Typhi
agcgccaucaggcacggcgu

SEQ ID NO: 3649142 - RNA, 23 nt, Salmonella enterica enterica serovar Typhi
agcgccaucaggcacggcguaca

SEQ ID NO: 3649143 - RNA, 21 nt, Salmonella enterica enterica serovar Typhi
agcgccaucaggcaugccaaa

SEQ ID NO: 3649144 - RNA, 15 nt, Salmonella enterica enterica serovar Typhi
agcgccauccggcaa

SEQ ID NO: 3649145 - RNA, 20 nt, Salmonella enterica enterica serovar Typhi
agcgccauccggcacacaga

SEQ ID NO: 3649146 - RNA, 18 nt, Salmonella enterica enterica serovar Typhi
agcgccaucgggcauuua

SEQ ID NO: 3649147 - RNA, 22 nt, Salmonella enterica enterica serovar Typhi
agcgcuucuaacgaaacagauu

SEQ ID NO: 3649148 - RNA, 18 nt, Salmonella enterica enterica serovar Typhi
agcgcuugauaaugucaa

SEQ ID NO: 3649149 - RNA, 14 nt, Salmonella enterica enterica serovar Typhi
agcgcuugauccag

SEQ ID NO: 3649150 - RNA, 21 nt, Salmonella enterica enterica serovar Typhi
agcgcuuggcguauagccgcc

SEQ ID NO: 3649151 - RNA, 14 nt, Salmonella enterica enterica serovar Typhi
agcgcuugugccug

SEQ ID NO: 3649152 - RNA, 19 nt, Salmonella enterica enterica serovar Typhi
agcgcuuguuaucuggcau

SEQ ID NO: 3649153 - RNA, 22 nt, Salmonella enterica enterica serovar Typhi
agcgcuuuccugcguauauuua

SEQ ID NO: 3649154 - RNA, 21 nt, Salmonella enterica enterica serovar Typhi
agcgcuuuggaggucauuauu

SEQ ID NO: 3649155 - RNA, 13 nt, Salmonella enterica enterica serovar Typhi
agcgcuuuugccg

SEQ ID NO: 3649156 - RNA, 16 nt, Salmonella enterica enterica serovar Typhi
agcgcuuuuuuuaugc

SEQ ID NO: 3649157 - RNA, 23 nt, Salmonella enterica enterica serovar Typhi
agcggaaaauauucagcacauca

SEQ ID NO: 3649158 - RNA, 20 nt, Salmonella enterica enterica serovar Typhi
agcggaaucgcuuccugggu

SEQ ID NO: 3649159 - RNA, 21 nt, Salmonella enterica enterica serovar Typhi
agcggacggcuaauaugccag

SEQ ID NO: 3649160 - RNA, 23 nt, Salmonella enterica enterica serovar Typhi
agcggacgggcggugccgguaau

SEQ ID NO: 3649161 - RNA, 21 nt, Salmonella enterica enterica serovar Typhi
agcggauaagauagcaggcga

SEQ ID NO: 3649162 - RNA, 14 nt, Salmonella enterica enterica serovar Typhi
agcggcaagacaga

SEQ ID NO: 3649163 - RNA, 22 nt, Salmonella enterica enterica serovar Typhi
agcggcaagccgaucagcgugu

SEQ ID NO: 3649164 - RNA, 22 nt, Salmonella enterica enterica serovar Typhi
agcggcaaggaaaaccaguaac

SEQ ID NO: 3649165 - RNA, 15 nt, Salmonella enterica enterica serovar Typhi
agcggcaaucgccuc

SEQ ID NO: 3649166 - RNA, 15 nt, Salmonella enterica enterica serovar Typhi
agcggcaccagcacg

SEQ ID NO: 3649167 - RNA, 21 nt, Salmonella enterica enterica serovar Typhi
agcggcagaucguuuacgacc

SEQ ID NO: 3649168 - RNA, 14 nt, Salmonella enterica enterica serovar Typhi
agcggcaguaaauu

SEQ ID NO: 3649169 - RNA, 20 nt, Salmonella enterica enterica serovar Typhi
agcggcaguacgagcaucca

SEQ ID NO: 3649170 - RNA, 15 nt, Salmonella enterica enterica serovar Typhi
agcggcccgcgcuga

SEQ ID NO: 3649171 - RNA, 13 nt, Salmonella enterica enterica serovar Typhi
agcggccugucag

SEQ ID NO: 3649172 - RNA, 16 nt, Salmonella enterica enterica serovar Typhi
agcggcgaaccaggac

SEQ ID NO: 3649173 - RNA, 21 nt, Salmonella enterica enterica serovar Typhi
agcggcgaucccgggcgauaa

SEQ ID NO: 3649174 - RNA, 23 nt, Salmonella enterica enterica serovar Typhi
agcggcgauuuauagagcagcac

SEQ ID NO: 3649175 - RNA, 19 nt, Salmonella enterica enterica serovar Typhi
agcggcgcagacacugcca

SEQ ID NO: 3649176 - RNA, 16 nt, Salmonella enterica enterica serovar Typhi
agcggcgcaggggcau

SEQ ID NO: 3649177 - RNA, 17 nt, Salmonella enterica enterica serovar Typhi
agcggcgccaucaccau

SEQ ID NO: 3649178 - RNA, 18 nt, Salmonella enterica enterica serovar Typhi
agcggcgccaucaccauc

SEQ ID NO: 3649179 - RNA, 20 nt, Salmonella enterica enterica serovar Typhi
agcggcggucugcgccugcu

SEQ ID NO: 3649180 - RNA, 15 nt, Salmonella enterica enterica serovar Typhi
agcggcguucaaaac

SEQ ID NO: 3649181 - RNA, 17 nt, Salmonella enterica enterica serovar Typhi
agcggcuaaucaccacc

SEQ ID NO: 3649182 - RNA, 16 nt, Salmonella enterica enterica serovar Typhi
agcggcucauccagca

SEQ ID NO: 3649183 - RNA, 18 nt, Salmonella enterica enterica serovar Typhi
agcggcucauccagcaac

SEQ ID NO: 3649184 - RNA, 14 nt, Salmonella enterica enterica serovar Typhi
agcggcugcgccug

SEQ ID NO: 3649185 - RNA, 19 nt, Salmonella enterica enterica serovar Typhi
agcggcugcgccugcgggu

SEQ ID NO: 3649186 - RNA, 15 nt, Salmonella enterica enterica serovar Typhi
agcggcugcgccugu

SEQ ID NO: 3649187 - RNA, 20 nt, Salmonella enterica enterica serovar Typhi
agcgggcgucgaaaucgucc

SEQ ID NO: 3649188 - RNA, 16 nt, Salmonella enterica enterica serovar Typhi
agcggguagagcuuuu

SEQ ID NO: 3649189 - RNA, 22 nt, Salmonella enterica enterica serovar Typhi
agcgggugcauuuucaccugga

SEQ ID NO: 3649190 - RNA, 19 nt, Salmonella enterica enterica serovar Typhi
agcgguaaaaccggucugg

SEQ ID NO: 3649191 - RNA, 18 nt, Salmonella enterica enterica serovar Typhi
agcgguaagagccagacg

SEQ ID NO: 3649192 - RNA, 18 nt, Salmonella enterica enterica serovar Typhi
agcgguaguuaagcguca

SEQ ID NO: 3649193 - RNA, 18 nt, Salmonella enterica enterica serovar Typhi
agcgguauaucuguaaca

SEQ ID NO: 3649194 - RNA, 16 nt, Salmonella enterica enterica serovar Typhi
agcggucaucaaugau

SEQ ID NO: 3649195 - RNA, 21 nt, Salmonella enterica enterica serovar Typhi
agcgguccaauaaacgccagg

SEQ ID NO: 3649196 - RNA, 20 nt, Salmonella enterica enterica serovar Typhi
agcggucggagguucgaauc

SEQ ID NO: 3649197 - RNA, 15 nt, Salmonella enterica enterica serovar Typhi
agcggucuuucaaca

SEQ ID NO: 3649198 - RNA, 22 nt, Salmonella enterica enterica serovar Typhi
agcgguguaaaagccagcaagg

SEQ ID NO: 3649199 - RNA, 18 nt, Salmonella enterica enterica serovar Typhi
agcgguuaagauacauau

SEQ ID NO: 3649200 - RNA, 21 nt, Salmonella enterica enterica serovar Typhi
agcguaauccucgacgcauca

SEQ ID NO: 3649201 - RNA, 18 nt, Salmonella enterica enterica serovar Typhi
agcguaaugcgccaggca

SEQ ID NO: 3649202 - RNA, 19 nt, Salmonella enterica enterica serovar Typhi
agcguaauuccgcaaucug

SEQ ID NO: 3649203 - RNA, 18 nt, Salmonella enterica enterica serovar Typhi
agcguacaggcggaugaa

SEQ ID NO: 3649204 - RNA, 12 nt, Salmonella enterica enterica serovar Typhi
agcguaccagcg

SEQ ID NO: 3649205 - RNA, 15 nt, Salmonella enterica enterica serovar Typhi
agcguaccagcguca

SEQ ID NO: 3649206 - RNA, 18 nt, Salmonella enterica enterica serovar Typhi
agcguauaauuaagcugc

SEQ ID NO: 3649207 - RNA, 15 nt, Salmonella enterica enterica serovar Typhi
agcguauugagcugg

SEQ ID NO: 3649208 - RNA, 18 nt, Salmonella enterica enterica serovar Typhi
agcguauugagcuggaua

SEQ ID NO: 3649209 - RNA, 23 nt, Salmonella enterica enterica serovar Typhi
agcgucaauaaucgcgcgcguau

SEQ ID NO: 3649210 - RNA, 13 nt, Salmonella enterica enterica serovar Typhi
agcgucacaggcu

SEQ ID NO: 3649211 - RNA, 19 nt, Salmonella enterica enterica serovar Typhi
agcgucaccucuuucgccg

SEQ ID NO: 3649212 - RNA, 19 nt, Salmonella enterica enterica serovar Typhi
agcgucagacacaauauug

SEQ ID NO: 3649213 - RNA, 12 nt, Salmonella enterica enterica serovar Typhi
agcgucagcaga

SEQ ID NO: 3649214 - RNA, 13 nt, Salmonella enterica enterica serovar Typhi
agcgucagcaugg

SEQ ID NO: 3649215 - RNA, 18 nt, Salmonella enterica enterica serovar Typhi
agcgucagccagaacgaa

SEQ ID NO: 3649216 - RNA, 12 nt, Salmonella enterica enterica serovar Typhi
agcgucaggcca

SEQ ID NO: 3649217 - RNA, 17 nt, Salmonella enterica enterica serovar Typhi
agcgucaggcuuaucgu

SEQ ID NO: 3649218 - RNA, 19 nt, Salmonella enterica enterica serovar Typhi
agcgucagguagcccggca

SEQ ID NO: 3649219 - RNA, 17 nt, Salmonella enterica enterica serovar Typhi
agcgucaguaaaagccc

SEQ ID NO: 3649220 - RNA, 15 nt, Salmonella enterica enterica serovar Typhi
agcgucauccggcaa

SEQ ID NO: 3649221 - RNA, 20 nt, Salmonella enterica enterica serovar Typhi
agcgucauccggcaaucaga

SEQ ID NO: 3649222 - RNA, 13 nt, Salmonella enterica enterica serovar Typhi
agcguccacgcca

SEQ ID NO: 3649223 - RNA, 12 nt, Salmonella enterica enterica serovar Typhi
agcguccagcag

SEQ ID NO: 3649224 - RNA, 22 nt, Salmonella enterica enterica serovar Typhi
agcguccagcagacucauggac

SEQ ID NO: 3649225 - RNA, 20 nt, Salmonella enterica enterica serovar Typhi
agcguccaguccugucccug

SEQ ID NO: 3649226 - RNA, 16 nt, Salmonella enterica enterica serovar Typhi
agcguccggagcagcu

SEQ ID NO: 3649227 - RNA, 21 nt, Salmonella enterica enterica serovar Typhi
agcguccgggcaagcccggua

SEQ ID NO: 3649228 - RNA, 22 nt, Salmonella enterica enterica serovar Typhi
agcgucgccagaaccccugcca

SEQ ID NO: 3649229 - RNA, 17 nt, Salmonella enterica enterica serovar Typhi
agcgucgccagaccgaa

SEQ ID NO: 3649230 - RNA, 17 nt, Salmonella enterica enterica serovar Typhi
agcgucgccagcgucuc

SEQ ID NO: 3649231 - RNA, 16 nt, Salmonella enterica enterica serovar Typhi
agcgucucagcaggcg

SEQ ID NO: 3649232 - RNA, 15 nt, Salmonella enterica enterica serovar Typhi
agcugauauuuuacu

SEQ ID NO: 3649233 - RNA, 16 nt, Salmonella enterica enterica serovar Typhi
agcugauauuuuacuu

SEQ ID NO: 3649234 - RNA, 14 nt, Salmonella enterica enterica serovar Typhi
agcugauugauuuu

SEQ ID NO: 3649235 - RNA, 15 nt, Salmonella enterica enterica serovar Typhi
agcugcaccaggagc

SEQ ID NO: 3649236 - RNA, 22 nt, Salmonella enterica enterica serovar Typhi
agcugcauccgggguucgaauc

SEQ ID NO: 3649237 - RNA, 17 nt, Salmonella enterica enterica serovar Typhi
agcugcgaucaaguuuu

SEQ ID NO: 3649238 - RNA, 20 nt, Salmonella enterica enterica serovar Typhi
agcugcgcaagaaacaucau

SEQ ID NO: 3649239 - RNA, 17 nt, Salmonella enterica enterica serovar Typhi
agcugcgccagcgugcu

SEQ ID NO: 3649240 - RNA, 17 nt, Salmonella enterica enterica serovar Typhi
agcugcgccauaccccg

SEQ ID NO: 3649241 - RNA, 14 nt, Salmonella enterica enterica serovar Typhi
agcugcgcgccgca

SEQ ID NO: 3649242 - RNA, 22 nt, Salmonella enterica enterica serovar Typhi
agcugcugacguagauucugau

SEQ ID NO: 3649243 - RNA, 17 nt, Salmonella enterica enterica serovar Typhi
agcugcuggcgagcagg

SEQ ID NO: 3649244 - RNA, 16 nt, Salmonella enterica enterica serovar Typhi
agcugcuuugccugga

SEQ ID NO: 3649245 - RNA, 15 nt, Salmonella enterica enterica serovar Typhi
agcuggagcaggaaa

SEQ ID NO: 3649246 - RNA, 13 nt, Salmonella enterica enterica serovar Typhi
agcuggauaagcu

SEQ ID NO: 3649247 - RNA, 21 nt, Salmonella enterica enterica serovar Typhi
agcuggcaagaccgauagaga

SEQ ID NO: 3649248 - RNA, 15 nt, Salmonella enterica enterica serovar Typhi
agcuggccaaucagc

SEQ ID NO: 3649249 - RNA, 16 nt, Salmonella enterica enterica serovar Typhi
agcuggccuucuccac

SEQ ID NO: 3649250 - RNA, 21 nt, Salmonella enterica enterica serovar Typhi
agcuggcgagaaagugguggg

SEQ ID NO: 3649251 - RNA, 23 nt, Salmonella enterica enterica serovar Typhi
agcuggcuuuauauaaaaaaugg

SEQ ID NO: 3649252 - RNA, 14 nt, Salmonella enterica enterica serovar Typhi
agcugggccugcuc

SEQ ID NO: 3649253 - RNA, 18 nt, Salmonella enterica enterica serovar Typhi
agcugggcguuacuggcg

SEQ ID NO: 3649254 - RNA, 19 nt, Salmonella enterica enterica serovar Typhi
agcugguauaggccaggcu

SEQ ID NO: 3649255 - RNA, 21 nt, Salmonella enterica enterica serovar Typhi
agcugguggcgaguccugccg

SEQ ID NO: 3649256 - RNA, 20 nt, Salmonella enterica enterica serovar Typhi
agcugguguaauugcgccag

SEQ ID NO: 3649257 - RNA, 12 nt, Salmonella enterica enterica serovar Typhi
agcugugagaau

SEQ ID NO: 3649258 - RNA, 17 nt, Salmonella enterica enterica serovar Typhi
agcugugcguugucuac

SEQ ID NO: 3649259 - RNA, 16 nt, Salmonella enterica enterica serovar Typhi
agcuguuaauuugcau

SEQ ID NO: 3649260 - RNA, 15 nt, Salmonella enterica enterica serovar Typhi
agcuuaaaaaauccu

SEQ ID NO: 3649261 - RNA, 14 nt, Salmonella enterica enterica serovar Typhi
agcuuaaucaccag

SEQ ID NO: 3649262 - RNA, 15 nt, Salmonella enterica enterica serovar Typhi
agcuuaaucaccagc

SEQ ID NO: 3649263 - RNA, 15 nt, Salmonella enterica enterica serovar Typhi
agcuuacuuugcgcc

SEQ ID NO: 3649264 - RNA, 20 nt, Salmonella enterica enterica serovar Typhi
agcuuaggauaagaauaggu

SEQ ID NO: 3649265 - RNA, 15 nt, Salmonella enterica enterica serovar Typhi
agcuuaggauucgcc

SEQ ID NO: 3649266 - RNA, 13 nt, Salmonella enterica enterica serovar Typhi
agcuuauccugcc

SEQ ID NO: 3649267 - RNA, 18 nt, Salmonella enterica enterica serovar Typhi
agcuuaucgccaaagaua

SEQ ID NO: 3649268 - RNA, 20 nt, Salmonella enterica enterica serovar Typhi
agcuuaucgccaaagauaua

SEQ ID NO: 3649269 - RNA, 18 nt, Salmonella enterica enterica serovar Typhi
agcuuaucgggccuacca

SEQ ID NO: 3649270 - RNA, 15 nt, Salmonella enterica enterica serovar Typhi
agcuuauuccaguca

SEQ ID NO: 3649271 - RNA, 14 nt, Salmonella enterica enterica serovar Typhi
agcuucaccgccag

SEQ ID NO: 3649272 - RNA, 20 nt, Salmonella enterica enterica serovar Typhi
agcuucagcuggauagagua

SEQ ID NO: 3649273 - RNA, 13 nt, Salmonella enterica enterica serovar Typhi
agcuucaugcgcc

SEQ ID NO: 3649274 - RNA, 13 nt, Salmonella enterica enterica serovar Typhi
agcuucaugcugg

SEQ ID NO: 3649275 - RNA, 12 nt, Salmonella enterica enterica serovar Typhi
agcuuccagcaa

SEQ ID NO: 3649276 - RNA, 14 nt, Salmonella enterica enterica serovar Typhi
agcuuccagcaaac

SEQ ID NO: 3649277 - RNA, 21 nt, Salmonella enterica enterica serovar Typhi
agcuucgccgcguaaucuucg

SEQ ID NO: 3649278 - RNA, 19 nt, Salmonella enterica enterica serovar Typhi
agcuucgguccggcgcuaa

SEQ ID NO: 3649279 - RNA, 20 nt, Salmonella enterica enterica serovar Typhi
agcuucugucugcgugaaga

SEQ ID NO: 3649280 - RNA, 14 nt, Salmonella enterica enterica serovar Typhi
agcuugaucaucag

SEQ ID NO: 3649281 - RNA, 12 nt, Salmonella enterica enterica serovar Typhi
agcuugccgcca

SEQ ID NO: 3649282 - RNA, 22 nt, Salmonella enterica enterica serovar Typhi
agcuugccgccaauaggggcgg

SEQ ID NO: 3649283 - RNA, 22 nt, Salmonella enterica enterica serovar Typhi
agcuugcgauccauauaaucaa

SEQ ID NO: 3649284 - RNA, 15 nt, Salmonella enterica enterica serovar Typhi
agcuugcgcagagua

SEQ ID NO: 3649285 - RNA, 15 nt, Salmonella enterica enterica serovar Typhi
agcuugcgcuggugu

SEQ ID NO: 3649286 - RNA, 17 nt, Salmonella enterica enterica serovar Typhi
agcuugcgcugguguuu

SEQ ID NO: 3649287 - RNA, 23 nt, Salmonella enterica enterica serovar Typhi
agcuuuacucaacggucaaaaua

SEQ ID NO: 3649288 - RNA, 16 nt, Salmonella enterica enterica serovar Typhi
agcuuuccaccagcca

SEQ ID NO: 3649289 - RNA, 18 nt, Salmonella enterica enterica serovar Typhi
agcuuucugaauuucacg

SEQ ID NO: 3649290 - RNA, 16 nt, Salmonella enterica enterica serovar Typhi
agcuuucuguuaucag

SEQ ID NO: 3649291 - RNA, 21 nt, Salmonella enterica enterica serovar Typhi
agcuuugcguaaaaaacauca

SEQ ID NO: 3649292 - RNA, 20 nt, Salmonella enterica enterica serovar Typhi
agcuuuucauauagucauaa

SEQ ID NO: 3649293 - RNA, 19 nt, Salmonella enterica enterica serovar Typhi
agcuuuugccugcgucguu

SEQ ID NO: 3649294 - RNA, 22 nt, Salmonella enterica enterica serovar Typhi
agcuuuugcgcguuccccaaca

SEQ ID NO: 3649295 - RNA, 20 nt, Salmonella enterica enterica serovar Typhi
agcuuuugcugcgccagcca

SEQ ID NO: 3649296 - RNA, 13 nt, Salmonella enterica enterica serovar Typhi
aggaaaacgcuuc

SEQ ID NO: 3649297 - RNA, 15 nt, Salmonella enterica enterica serovar Typhi
aggaaaagucauuuu

SEQ ID NO: 3649298 - RNA, 23 nt, Salmonella enterica enterica serovar Typhi
aggaaacauaaggguaagcaaua

SEQ ID NO: 3649299 - RNA, 20 nt, Salmonella enterica enterica serovar Typhi
aggaaagauuacuucaggcu

SEQ ID NO: 3649300 - RNA, 12 nt, Salmonella enterica enterica serovar Typhi
aggaaaggcaga

SEQ ID NO: 3649301 - RNA, 14 nt, Salmonella enterica enterica serovar Typhi
aggaaauaacgugc

SEQ ID NO: 3649302 - RNA, 14 nt, Salmonella enterica enterica serovar Typhi
aggaaauauuaauu

SEQ ID NO: 3649303 - RNA, 16 nt, Salmonella enterica enterica serovar Typhi
aggaaaucuuccaguu

SEQ ID NO: 3649304 - RNA, 12 nt, Salmonella enterica enterica serovar Typhi
aggaacagugac

SEQ ID NO: 3649305 - RNA, 13 nt, Salmonella enterica enterica serovar Typhi
aggaacagugaca

SEQ ID NO: 3649306 - RNA, 18 nt, Salmonella enterica enterica serovar Typhi
aggaacagugacaaacuc

SEQ ID NO: 3649307 - RNA, 17 nt, Salmonella enterica enterica serovar Typhi
aggaacaucagccagca

SEQ ID NO: 3649308 - RNA, 18 nt, Salmonella enterica enterica serovar Typhi
aggaacaucgacccccac

SEQ ID NO: 3649309 - RNA, 20 nt, Salmonella enterica enterica serovar Typhi
aggaacaucgacccccaccu

SEQ ID NO: 3649310 - RNA, 14 nt, Salmonella enterica enterica serovar Typhi
aggaaccacaucca

SEQ ID NO: 3649311 - RNA, 16 nt, Salmonella enterica enterica serovar Typhi
aggaacgccauaugcg

SEQ ID NO: 3649312 - RNA, 18 nt, Salmonella enterica enterica serovar Typhi
aggaacgcgcagaccguu

SEQ ID NO: 3649313 - RNA, 19 nt, Salmonella enterica enterica serovar Typhi
aggaacgcgcagaccguuu

SEQ ID NO: 3649314 - RNA, 18 nt, Salmonella enterica enterica serovar Typhi
aggaacugcggccagaca

SEQ ID NO: 3649315 - RNA, 22 nt, Salmonella enterica enterica serovar Typhi
aggaagcccucggcgaacaggc

SEQ ID NO: 3649316 - RNA, 13 nt, Salmonella enterica enterica serovar Typhi
aggaagcugcgca

SEQ ID NO: 3649317 - RNA, 20 nt, Salmonella enterica enterica serovar Typhi
aggaaggcgguaagagagug

SEQ ID NO: 3649318 - RNA, 15 nt, Salmonella enterica enterica serovar Typhi
aggcagauucuucug

SEQ ID NO: 3649319 - RNA, 17 nt, Salmonella enterica enterica serovar Typhi
aggcagcacaucaauau

SEQ ID NO: 3649320 - RNA, 18 nt, Salmonella enterica enterica serovar Typhi
aggcagccggauuuuaaa

SEQ ID NO: 3649321 - RNA, 19 nt, Salmonella enterica enterica serovar Typhi
aggcagccggauuuuaaau

SEQ ID NO: 3649322 - RNA, 21 nt, Salmonella enterica enterica serovar Typhi
aggcagccggauuuuaaauug

SEQ ID NO: 3649323 - RNA, 20 nt, Salmonella enterica enterica serovar Typhi
aggcagcguaauacaggcga

SEQ ID NO: 3649324 - RNA, 19 nt, Salmonella enterica enterica serovar Typhi
aggcauaauggaacugccu

SEQ ID NO: 3649325 - RNA, 14 nt, Salmonella enterica enterica serovar Typhi
aggcauacacaucu

SEQ ID NO: 3649326 - RNA, 17 nt, Salmonella enterica enterica serovar Typhi
aggcauaccgcccagaa

SEQ ID NO: 3649327 - RNA, 17 nt, Salmonella enterica enterica serovar Typhi
aggcauccagacccaca

SEQ ID NO: 3649328 - RNA, 23 nt, Salmonella enterica enterica serovar Typhi
aggcauccagacccacagccggu

SEQ ID NO: 3649329 - RNA, 19 nt, Salmonella enterica enterica serovar Typhi
aggcauccgugaccugcug

SEQ ID NO: 3649330 - RNA, 14 nt, Salmonella enterica enterica serovar Typhi
aggcaucgacgcca

SEQ ID NO: 3649331 - RNA, 16 nt, Salmonella enterica enterica serovar Typhi
aggcaucuuccagcgu

SEQ ID NO: 3649332 - RNA, 15 nt, Salmonella enterica enterica serovar Typhi
aggcaugcacuccaa

SEQ ID NO: 3649333 - RNA, 19 nt, Salmonella enterica enterica serovar Typhi
aggcauggccuucaaucag

SEQ ID NO: 3649334 - RNA, 16 nt, Salmonella enterica enterica serovar Typhi
aggcauguuaugaaua

SEQ ID NO: 3649335 - RNA, 16 nt, Salmonella enterica enterica serovar Typhi
aggcauuaaaaaaacg

SEQ ID NO: 3649336 - RNA, 15 nt, Salmonella enterica enterica serovar Typhi
aggcauucagcgggu

SEQ ID NO: 3649337 - RNA, 14 nt, Salmonella enterica enterica serovar Typhi
aggcauuggacgga

SEQ ID NO: 3649338 - RNA, 16 nt, Salmonella enterica enterica serovar Typhi
aggcauuuaugccgcc

SEQ ID NO: 3649339 - RNA, 19 nt, Salmonella enterica enterica serovar Typhi
aggcauuuaugccgccauc

SEQ ID NO: 3649340 - RNA, 18 nt, Salmonella enterica enterica serovar Typhi
aggcauuucgccgccauc

SEQ ID NO: 3649341 - RNA, 13 nt, Salmonella enterica enterica serovar Typhi
aggccaaaaccac

SEQ ID NO: 3649342 - RNA, 20 nt, Salmonella enterica enterica serovar Typhi
aggccaaaaccacagugacc

SEQ ID NO: 3649343 - RNA, 20 nt, Salmonella enterica enterica serovar Typhi
aggccaaacccugcgccgca

SEQ ID NO: 3649344 - RNA, 19 nt, Salmonella enterica enterica serovar Typhi
aggccaaguuuagaaaaua

SEQ ID NO: 3649345 - RNA, 20 nt, Salmonella enterica enterica serovar Typhi
aggccagaaggcgaacauaa

SEQ ID NO: 3649346 - RNA, 23 nt, Salmonella enterica enterica serovar Typhi
aggccagaugguaagcauagcgc

SEQ ID NO: 3649347 - RNA, 16 nt, Salmonella enterica enterica serovar Typhi
aggccagcgucaccuc

SEQ ID NO: 3649348 - RNA, 23 nt, Salmonella enterica enterica serovar Typhi
aggccagugccaagcaacacggc

SEQ ID NO: 3649349 - RNA, 16 nt, Salmonella enterica enterica serovar Typhi
aggccaucauaccgcc

SEQ ID NO: 3649350 - RNA, 20 nt, Salmonella enterica enterica serovar Typhi
aggccauuaagcuucgugag

SEQ ID NO: 3649351 - RNA, 21 nt, Salmonella enterica enterica serovar Typhi
aggcccauuuucggcaucagc

SEQ ID NO: 3649352 - RNA, 23 nt, Salmonella enterica enterica serovar Typhi
aggcccauuuucggcaucagcag

SEQ ID NO: 3649353 - RNA, 22 nt, Salmonella enterica enterica serovar Typhi
aggcccguucacguuuuuacuc

SEQ ID NO: 3649354 - RNA, 23 nt, Salmonella enterica enterica serovar Typhi
aggccgacaaaugacgucagcaa

SEQ ID NO: 3649355 - RNA, 14 nt, Salmonella enterica enterica serovar Typhi
aggccgccaaugac

SEQ ID NO: 3649356 - RNA, 16 nt, Salmonella enterica enterica serovar Typhi
aggccgccaccgccuc

SEQ ID NO: 3649357 - RNA, 15 nt, Salmonella enterica enterica serovar Typhi
aggccgccagcaaac

SEQ ID NO: 3649358 - RNA, 16 nt, Salmonella enterica enterica serovar Typhi
aggccgccgaggcuaa

SEQ ID NO: 3649359 - RNA, 22 nt, Salmonella enterica enterica serovar Typhi
aggccgccgaggcuaagccaga

SEQ ID NO: 3649360 - RNA, 10 nt, Salmonella enterica enterica serovar Typhi
aggccgccgc

SEQ ID NO: 3649361 - RNA, 16 nt, Salmonella enterica enterica serovar Typhi
aggccgcuuaauaaua

SEQ ID NO: 3649362 - RNA, 16 nt, Salmonella enterica enterica serovar Typhi
aggccgcuuucgcggc

SEQ ID NO: 3649363 - RNA, 15 nt, Salmonella enterica enterica serovar Typhi
aggccggacaggcga

SEQ ID NO: 3649364 - RNA, 23 nt, Salmonella enterica enterica serovar Typhi
aggccggauaagagaauccgaca

SEQ ID NO: 3649365 - RNA, 17 nt, Salmonella enterica enterica serovar Typhi
aggccggaugaggcgca

SEQ ID NO: 3649366 - RNA, 21 nt, Salmonella enterica enterica serovar Typhi
aggccggcgaagauccgcuca

SEQ ID NO: 3649367 - RNA, 14 nt, Salmonella enterica enterica serovar Typhi
aggccgggaaaucu

SEQ ID NO: 3649368 - RNA, 22 nt, Salmonella enterica enterica serovar Typhi
aggccgggaaaucuucuacuuc

SEQ ID NO: 3649369 - RNA, 20 nt, Salmonella enterica enterica serovar Typhi
aggccgggcaagcgaagcgc

SEQ ID NO: 3649370 - RNA, 21 nt, Salmonella enterica enterica serovar Typhi
aggccgguuguuuacacggca

SEQ ID NO: 3649371 - RNA, 20 nt, Salmonella enterica enterica serovar Typhi
aggccguucauucgccccag

SEQ ID NO: 3649372 - RNA, 19 nt, Salmonella enterica enterica serovar Typhi
aggccguugugucccugga

SEQ ID NO: 3649373 - RNA, 21 nt, Salmonella enterica enterica serovar Typhi
aggccuacaacgacuacguuc

SEQ ID NO: 3649374 - RNA, 14 nt, Salmonella enterica enterica serovar Typhi
aggccuacaagaau

SEQ ID NO: 3649375 - RNA, 16 nt, Salmonella enterica enterica serovar Typhi
aggccuacaaucgugu

SEQ ID NO: 3649376 - RNA, 21 nt, Salmonella enterica enterica serovar Typhi
aggccuacacucugcgcgcga

SEQ ID NO: 3649377 - RNA, 13 nt, Salmonella enterica enterica serovar Typhi
aggccuaccagcc

SEQ ID NO: 3649378 - RNA, 16 nt, Salmonella enterica enterica serovar Typhi
aggccuaccagccgag

SEQ ID NO: 3649379 - RNA, 21 nt, Salmonella enterica enterica serovar Typhi
aggccuaucagcgauccgccg

SEQ ID NO: 3649380 - RNA, 23 nt, Salmonella enterica enterica serovar Typhi
aggccuaucagcgauccgccguc

SEQ ID NO: 3649381 - RNA, 13 nt, Salmonella enterica enterica serovar Typhi
aggccucuaucuu

SEQ ID NO: 3649382 - RNA, 22 nt, Salmonella enterica enterica serovar Typhi
aggccucuaucuucucaggcga

SEQ ID NO: 3649383 - RNA, 22 nt, Salmonella enterica enterica serovar Typhi
aggccucuuucaugcggucuuc

SEQ ID NO: 3649384 - RNA, 23 nt, Salmonella enterica enterica serovar Typhi
aggccugauaagacgcaucgcgu

SEQ ID NO: 3649385 - RNA, 13 nt, Salmonella enterica enterica serovar Typhi
aggccugauaagc

SEQ ID NO: 3649386 - RNA, 14 nt, Salmonella enterica enterica serovar Typhi
aggccugauaagcg

SEQ ID NO: 3649387 - RNA, 18 nt, Salmonella enterica enterica serovar Typhi
aggccugcaaaccucucc

SEQ ID NO: 3649388 - RNA, 20 nt, Salmonella enterica enterica serovar Typhi
aggccugcaucaacaggcga

SEQ ID NO: 3649389 - RNA, 18 nt, Salmonella enterica enterica serovar Typhi
aggccugccggguuuaau

SEQ ID NO: 3649390 - RNA, 12 nt, Salmonella enterica enterica serovar Typhi
aggccuggcugg

SEQ ID NO: 3649391 - RNA, 21 nt, Salmonella enterica enterica serovar Typhi
aggccuggcuggaugaggcgc

SEQ ID NO: 3649392 - RNA, 16 nt, Salmonella enterica enterica serovar Typhi
aggccugguuaacaau

SEQ ID NO: 3649393 - RNA, 21 nt, Salmonella enterica enterica serovar Typhi
aggcgaaacggcggaaccauu

SEQ ID NO: 3649394 - RNA, 23 nt, Salmonella enterica enterica serovar Typhi
aggcgaaacggcggaaccauuuu

SEQ ID NO: 3649395 - RNA, 17 nt, Salmonella enterica enterica serovar Typhi
aggcgaacuacaggcga

SEQ ID NO: 3649396 - RNA, 22 nt, Salmonella enterica enterica serovar Typhi
aggcgaacuucauccacgccga

SEQ ID NO: 3649397 - RNA, 18 nt, Salmonella enterica enterica serovar Typhi
aggcgaccaauauccgca

SEQ ID NO: 3649398 - RNA, 17 nt, Salmonella enterica enterica serovar Typhi
aggcgacgaugugcaua

SEQ ID NO: 3649399 - RNA, 17 nt, Salmonella enterica enterica serovar Typhi
aggcgacucauuacgcc

SEQ ID NO: 3649400 - RNA, 19 nt, Salmonella enterica enterica serovar Typhi
aggcgacuggcguccgcaa

SEQ ID NO: 3649401 - RNA, 21 nt, Salmonella enterica enterica serovar Typhi
aggcgagcacaccauaucuuu

SEQ ID NO: 3649402 - RNA, 23 nt, Salmonella enterica enterica serovar Typhi
aggcgauaccuaaucccuggcga

SEQ ID NO: 3649403 - RNA, 13 nt, Salmonella enterica enterica serovar Typhi
agggaagauaucg

SEQ ID NO: 3649404 - RNA, 14 nt, Salmonella enterica enterica serovar Typhi
agggaauaagcgcc

SEQ ID NO: 3649405 - RNA, 16 nt, Salmonella enterica enterica serovar Typhi
agggacacucaaggcu

SEQ ID NO: 3649406 - RNA, 18 nt, Salmonella enterica enterica serovar Typhi
agggacgcauccugcacu

SEQ ID NO: 3649407 - RNA, 23 nt, Salmonella enterica enterica serovar Typhi
agggacuaucgaaagagcaaaua

SEQ ID NO: 3649408 - RNA, 17 nt, Salmonella enterica enterica serovar Typhi
agggacuuauuaaaaau

SEQ ID NO: 3649409 - RNA, 17 nt, Salmonella enterica enterica serovar Typhi
agggagcugacugcaaa

SEQ ID NO: 3649410 - RNA, 19 nt, Salmonella enterica enterica serovar Typhi
agggaggugcucucccagc

SEQ ID NO: 3649411 - RNA, 22 nt, Salmonella enterica enterica serovar Typhi
agggaggugcucucccagcuga

SEQ ID NO: 3649412 - RNA, 18 nt, Salmonella enterica enterica serovar Typhi
agggagguucgccucccu

SEQ ID NO: 3649413 - RNA, 23 nt, Salmonella enterica enterica serovar Typhi
agggauaacaguauuuguucaga

SEQ ID NO: 3649414 - RNA, 20 nt, Salmonella enterica enterica serovar Typhi
agggauaagaaagauaaaau

SEQ ID NO: 3649415 - RNA, 22 nt, Salmonella enterica enterica serovar Typhi
agggauaagguugucaaaaaau

SEQ ID NO: 3649416 - RNA, 16 nt, Salmonella enterica enterica serovar Typhi
agggaucaauguaaaa

SEQ ID NO: 3649417 - RNA, 22 nt, Salmonella enterica enterica serovar Typhi
agggaucgauaauugcucaccc

SEQ ID NO: 3649418 - RNA, 20 nt, Salmonella enterica enterica serovar Typhi
agggcaaaguuaucccugcu

SEQ ID NO: 3649419 - RNA, 18 nt, Salmonella enterica enterica serovar Typhi
agggcaccugggcaauaa

SEQ ID NO: 3649420 - RNA, 20 nt, Salmonella enterica enterica serovar Typhi
agggcaccugggcaauaacg

SEQ ID NO: 3649421 - RNA, 22 nt, Salmonella enterica enterica serovar Typhi
agggcauaaugauugcuggcag

SEQ ID NO: 3649422 - RNA, 19 nt, Salmonella enterica enterica serovar Typhi
agggcaucaauaaaaucac

SEQ ID NO: 3649423 - RNA, 17 nt, Salmonella enterica enterica serovar Typhi
agggcauucauuguccg

SEQ ID NO: 3649424 - RNA, 13 nt, Salmonella enterica enterica serovar Typhi
agggccaggcgcg

SEQ ID NO: 3649425 - RNA, 14 nt, Salmonella enterica enterica serovar Typhi
agggccaggcgcga

SEQ ID NO: 3649426 - RNA, 21 nt, Salmonella enterica enterica serovar Typhi
agggccgcguuaacgccguug

SEQ ID NO: 3649427 - RNA, 14 nt, Salmonella enterica enterica serovar Typhi
agggcgacgucaga

SEQ ID NO: 3649428 - RNA, 16 nt, Salmonella enterica enterica serovar Typhi
agggcgagcguagcga

SEQ ID NO: 3649429 - RNA, 21 nt, Salmonella enterica enterica serovar Typhi
agggcgauaauccgcuccaca

SEQ ID NO: 3649430 - RNA, 18 nt, Salmonella enterica enterica serovar Typhi
agggcgauucccgaucuu

SEQ ID NO: 3649431 - RNA, 18 nt, Salmonella enterica enterica serovar Typhi
agggcgcggcgcaacuuu

SEQ ID NO: 3649432 - RNA, 19 nt, Salmonella enterica enterica serovar Typhi
agggcgcggcgcaacuuuu

SEQ ID NO: 3649433 - RNA, 13 nt, Salmonella enterica enterica serovar Typhi
agggcgcggcugg

SEQ ID NO: 3649434 - RNA, 14 nt, Salmonella enterica enterica serovar Typhi
agggcgcggcuggu

SEQ ID NO: 3649435 - RNA, 21 nt, Salmonella enterica enterica serovar Typhi
agggcggcgcgcugccgcccu

SEQ ID NO: 3649436 - RNA, 17 nt, Salmonella enterica enterica serovar Typhi
agggcgggcgauagaga

SEQ ID NO: 3649437 - RNA, 22 nt, Salmonella enterica enterica serovar Typhi
agggcgucuuauccggccuacc

SEQ ID NO: 3649438 - RNA, 17 nt, Salmonella enterica enterica serovar Typhi
agggcgugacgcgccag

SEQ ID NO: 3649439 - RNA, 18 nt, Salmonella enterica enterica serovar Typhi
agggcgugccgugagcgc

SEQ ID NO: 3649440 - RNA, 16 nt, Salmonella enterica enterica serovar Typhi
agggcguuuuauaagc

SEQ ID NO: 3649441 - RNA, 14 nt, Salmonella enterica enterica serovar Typhi
agggcuuacucccu

SEQ ID NO: 3649442 - RNA, 15 nt, Salmonella enterica enterica serovar Typhi
aggggcauuuuccgg

SEQ ID NO: 3649443 - RNA, 18 nt, Salmonella enterica enterica serovar Typhi
aggggccacaggcggcau

SEQ ID NO: 3649444 - RNA, 20 nt, Salmonella enterica enterica serovar Typhi
aggggcuccugcgccggacg

SEQ ID NO: 3649445 - RNA, 18 nt, Salmonella enterica enterica serovar Typhi
aggggcucuaaaaaggaa

SEQ ID NO: 3649446 - RNA, 14 nt, Salmonella enterica enterica serovar Typhi
aggggggaaaugag

SEQ ID NO: 3649447 - RNA, 14 nt, Salmonella enterica enterica serovar Typhi
aggguagaaaaagg

SEQ ID NO: 3649448 - RNA, 16 nt, Salmonella enterica enterica serovar Typhi
aggguagggauagcau

SEQ ID NO: 3649449 - RNA, 13 nt, Salmonella enterica enterica serovar Typhi
aggguauaugagc

SEQ ID NO: 3649450 - RNA, 21 nt, Salmonella enterica enterica serovar Typhi
aggguauaugagcgcaggcga

SEQ ID NO: 3649451 - RNA, 13 nt, Salmonella enterica enterica serovar Typhi
agggucagcagga

SEQ ID NO: 3649452 - RNA, 14 nt, Salmonella enterica enterica serovar Typhi
agggugagagggga

SEQ ID NO: 3649453 - RNA, 23 nt, Salmonella enterica enterica serovar Typhi
agggugauuucgcccgcauucgc

SEQ ID NO: 3649454 - RNA, 15 nt, Salmonella enterica enterica serovar Typhi
agggugcaaagaaac

SEQ ID NO: 3649455 - RNA, 18 nt, Salmonella enterica enterica serovar Typhi
agggugcagcaaauaauc

SEQ ID NO: 3649456 - RNA, 23 nt, Salmonella enterica enterica serovar Typhi
agggugggcgcacaggccuucau

SEQ ID NO: 3649457 - RNA, 21 nt, Salmonella enterica enterica serovar Typhi
aggguuauuuccgcuggccgg

SEQ ID NO: 3649458 - RNA, 22 nt, Salmonella enterica enterica serovar Typhi
aggguuuucaauuccacaggcg

SEQ ID NO: 3649459 - RNA, 18 nt, Salmonella enterica enterica serovar Typhi
aggguuuucuaccgcagc

SEQ ID NO: 3649460 - RNA, 14 nt, Salmonella enterica enterica serovar Typhi
agguaaauccgcca

SEQ ID NO: 3649461 - RNA, 13 nt, Salmonella enterica enterica serovar Typhi
agguaacauacaa

SEQ ID NO: 3649462 - RNA, 19 nt, Salmonella enterica enterica serovar Typhi
agguaacgcgaaaaaagau

SEQ ID NO: 3649463 - RNA, 15 nt, Salmonella enterica enterica serovar Typhi
agguaauaucauccg

SEQ ID NO: 3649464 - RNA, 17 nt, Salmonella enterica enterica serovar Typhi
agguaauaucauccggu

SEQ ID NO: 3649465 - RNA, 16 nt, Salmonella enterica enterica serovar Typhi
agguacagcuuagcug

SEQ ID NO: 3649466 - RNA, 13 nt, Salmonella enterica enterica serovar Typhi
agguacauugcca

SEQ ID NO: 3649467 - RNA, 14 nt, Salmonella enterica enterica serovar Typhi
agguacauugccag

SEQ ID NO: 3649468 - RNA, 14 nt, Salmonella enterica enterica serovar Typhi
agguacgcguuuca

SEQ ID NO: 3649469 - RNA, 20 nt, Salmonella enterica enterica serovar Typhi
agguacgcguuucacaaccu

SEQ ID NO: 3649470 - RNA, 19 nt, Salmonella enterica enterica serovar Typhi
agguagcccggcaggcugg

SEQ ID NO: 3649471 - RNA, 17 nt, Salmonella enterica enterica serovar Typhi
agguaguaacgggcauc

SEQ ID NO: 3649472 - RNA, 17 nt, Salmonella enterica enterica serovar Typhi
agguaguccaaauaagg

SEQ ID NO: 3649473 - RNA, 14 nt, Salmonella enterica enterica serovar Typhi
agguauccagcaga

SEQ ID NO: 3649474 - RNA, 23 nt, Salmonella enterica enterica serovar Typhi
agguaucccgccagcggcgccau

SEQ ID NO: 3649475 - RNA, 20 nt, Salmonella enterica enterica serovar Typhi
agguauccugaaccagcggc

SEQ ID NO: 3649476 - RNA, 17 nt, Salmonella enterica enterica serovar Typhi
agguaugcuucagcguu

SEQ ID NO: 3649477 - RNA, 16 nt, Salmonella enterica enterica serovar Typhi
agguauguaguaaaua

SEQ ID NO: 3649478 - RNA, 14 nt, Salmonella enterica enterica serovar Typhi
agguauuaaauaca

SEQ ID NO: 3649479 - RNA, 18 nt, Salmonella enterica enterica serovar Typhi
agguauucuaacugauca

SEQ ID NO: 3649480 - RNA, 14 nt, Salmonella enterica enterica serovar Typhi
agguauuuagccac

SEQ ID NO: 3649481 - RNA, 23 nt, Salmonella enterica enterica serovar Typhi
agguauuucgaggggcaggaagg

SEQ ID NO: 3649482 - RNA, 21 nt, Salmonella enterica enterica serovar Typhi
aggucaaccacgagagcaccg

SEQ ID NO: 3649483 - RNA, 15 nt, Salmonella enterica enterica serovar Typhi
aggucaauaagauau

SEQ ID NO: 3649484 - RNA, 15 nt, Salmonella enterica enterica serovar Typhi
aggucacaucaucgc

SEQ ID NO: 3649485 - RNA, 19 nt, Salmonella enterica enterica serovar Typhi
aggucacgccggaaaucac

SEQ ID NO: 3649486 - RNA, 20 nt, Salmonella enterica enterica serovar Typhi
aggucagauccuuuuucugc

SEQ ID NO: 3649487 - RNA, 16 nt, Salmonella enterica enterica serovar Typhi
aggucagcaguuuuuc

SEQ ID NO: 3649488 - RNA, 16 nt, Salmonella enterica enterica serovar Typhi
aguaauggacagguaa

SEQ ID NO: 3649489 - RNA, 19 nt, Salmonella enterica enterica serovar Typhi
aguaauggacagguaaacc

SEQ ID NO: 3649490 - RNA, 16 nt, Salmonella enterica enterica serovar Typhi
aguaauguccagauua

SEQ ID NO: 3649491 - RNA, 15 nt, Salmonella enterica enterica serovar Typhi
aguaauucccggcag

SEQ ID NO: 3649492 - RNA, 14 nt, Salmonella enterica enterica serovar Typhi
aguaauuugaacau

SEQ ID NO: 3649493 - RNA, 13 nt, Salmonella enterica enterica serovar Typhi
aguaauuuuuccg

SEQ ID NO: 3649494 - RNA, 21 nt, Salmonella enterica enterica serovar Typhi
aguaauuuuucucccagcaga

SEQ ID NO: 3649495 - RNA, 21 nt, Salmonella enterica enterica serovar Typhi
aguacaaacaaauaaauccau

SEQ ID NO: 3649496 - RNA, 16 nt, Salmonella enterica enterica serovar Typhi
aguacagacuggaugg

SEQ ID NO: 3649497 - RNA, 23 nt, Salmonella enterica enterica serovar Typhi
aguacagcuuaaucaccagcgca

SEQ ID NO: 3649498 - RNA, 17 nt, Salmonella enterica enterica serovar Typhi
aguacaggcauugucac

SEQ ID NO: 3649499 - RNA, 12 nt, Salmonella enterica enterica serovar Typhi
aguaccagcacu

SEQ ID NO: 3649500 - RNA, 22 nt, Salmonella enterica enterica serovar Typhi
aguaccauugagcuuucuucca

SEQ ID NO: 3649501 - RNA, 15 nt, Salmonella enterica enterica serovar Typhi
aguacccucugcacc

SEQ ID NO: 3649502 - RNA, 18 nt, Salmonella enterica enterica serovar Typhi
aguaccgaacagccaggc

SEQ ID NO: 3649503 - RNA, 19 nt, Salmonella enterica enterica serovar Typhi
aguaccgaacagccaggcu

SEQ ID NO: 3649504 - RNA, 20 nt, Salmonella enterica enterica serovar Typhi
aguaccgaacagccaggcuu

SEQ ID NO: 3649505 - RNA, 23 nt, Salmonella enterica enterica serovar Typhi
aguaccggcaggacaaucauaau

SEQ ID NO: 3649506 - RNA, 21 nt, Salmonella enterica enterica serovar Typhi
aguaccgggcaggaaaagacu

SEQ ID NO: 3649507 - RNA, 18 nt, Salmonella enterica enterica serovar Typhi
aguaccgguuagcucaac

SEQ ID NO: 3649508 - RNA, 17 nt, Salmonella enterica enterica serovar Typhi
aguaccugacuuuucca

SEQ ID NO: 3649509 - RNA, 23 nt, Salmonella enterica enterica serovar Typhi
aguaccugcccggcaacgggcaa

SEQ ID NO: 3649510 - RNA, 18 nt, Salmonella enterica enterica serovar Typhi
aguacgagcauccagauc

SEQ ID NO: 3649511 - RNA, 15 nt, Salmonella enterica enterica serovar Typhi
aguacgcaaggaaau

SEQ ID NO: 3649512 - RNA, 18 nt, Salmonella enterica enterica serovar Typhi
aguacggcgcgaaucccg

SEQ ID NO: 3649513 - RNA, 20 nt, Salmonella enterica enterica serovar Typhi
aguacggcgcgaaucccgcg

SEQ ID NO: 3649514 - RNA, 15 nt, Salmonella enterica enterica serovar Typhi
aguacgggcagaugg

SEQ ID NO: 3649515 - RNA, 19 nt, Salmonella enterica enterica serovar Typhi
aguacgggcagauggucgc

SEQ ID NO: 3649516 - RNA, 23 nt, Salmonella enterica enterica serovar Typhi
aguacgguuugcggauuggauaa

SEQ ID NO: 3649517 - RNA, 15 nt, Salmonella enterica enterica serovar Typhi
aguacugaccagaca

SEQ ID NO: 3649518 - RNA, 16 nt, Salmonella enterica enterica serovar Typhi
aguagaccaacaauca

SEQ ID NO: 3649519 - RNA, 14 nt, Salmonella enterica enterica serovar Typhi
aguagaucaccagc

SEQ ID NO: 3649520 - RNA, 11 nt, Salmonella enterica enterica serovar Typhi
aguagauggcg

SEQ ID NO: 3649521 - RNA, 15 nt, Salmonella enterica enterica serovar Typhi
aguagcagacagccg

SEQ ID NO: 3649522 - RNA, 19 nt, Salmonella enterica enterica serovar Typhi
aguagcccugacgaacaga

SEQ ID NO: 3649523 - RNA, 16 nt, Salmonella enterica enterica serovar Typhi
aguagccugccagcaa

SEQ ID NO: 3649524 - RNA, 21 nt, Salmonella enterica enterica serovar Typhi
aguagcguucuuuccaguucu

SEQ ID NO: 3649525 - RNA, 17 nt, Salmonella enterica enterica serovar Typhi
aguagcugagcgucagg

SEQ ID NO: 3649526 - RNA, 20 nt, Salmonella enterica enterica serovar Typhi
aguagcugagcgucaggcgc

SEQ ID NO: 3649527 - RNA, 16 nt, Salmonella enterica enterica serovar Typhi
aguaggcaugcacucc

SEQ ID NO: 3649528 - RNA, 15 nt, Salmonella enterica enterica serovar Typhi
aguaguuccagcaua

SEQ ID NO: 3649529 - RNA, 18 nt, Salmonella enterica enterica serovar Typhi
aguaguugaauaaccuca

SEQ ID NO: 3649530 - RNA, 12 nt, Salmonella enterica enterica serovar Typhi
aguauaaagcug

SEQ ID NO: 3649531 - RNA, 21 nt, Salmonella enterica enterica serovar Typhi
aguauaaauaccuuauucagc

SEQ ID NO: 3649532 - RNA, 22 nt, Salmonella enterica enterica serovar Typhi
aguauaauucgucaauaccuaa

SEQ ID NO: 3649533 - RNA, 21 nt, Salmonella enterica enterica serovar Typhi
aguauaucggcgaguagcgca

SEQ ID NO: 3649534 - RNA, 21 nt, Salmonella enterica enterica serovar Typhi
aguaucccuuucaaaaaagag

SEQ ID NO: 3649535 - RNA, 20 nt, Salmonella enterica enterica serovar Typhi
aguaucgagauaaugcucau

SEQ ID NO: 3649536 - RNA, 15 nt, Salmonella enterica enterica serovar Typhi
aguaucgcgccgcca

SEQ ID NO: 3649537 - RNA, 21 nt, Salmonella enterica enterica serovar Typhi
aguaucgcucuauauccugcc

SEQ ID NO: 3649538 - RNA, 23 nt, Salmonella enterica enterica serovar Typhi
aguaucgcucuauauccugcccu

SEQ ID NO: 3649539 - RNA, 21 nt, Salmonella enterica enterica serovar Typhi
aguaucucgccaguaaagaca

SEQ ID NO: 3649540 - RNA, 18 nt, Salmonella enterica enterica serovar Typhi
aguaugaccccuccggcc

SEQ ID NO: 3649541 - RNA, 16 nt, Salmonella enterica enterica serovar Typhi
aguauguuaacgccga

SEQ ID NO: 3649542 - RNA, 14 nt, Salmonella enterica enterica serovar Typhi
aguauuauccauug

SEQ ID NO: 3649543 - RNA, 15 nt, Salmonella enterica enterica serovar Typhi
aguauuuacaaaaaa

SEQ ID NO: 3649544 - RNA, 20 nt, Salmonella enterica enterica serovar Typhi
aguauuucgacuuucuucgg

SEQ ID NO: 3649545 - RNA, 22 nt, Salmonella enterica enterica serovar Typhi
agucaaaagauugauuuauuca

SEQ ID NO: 3649546 - RNA, 15 nt, Salmonella enterica enterica serovar Typhi
agucaaagguaauau

SEQ ID NO: 3649547 - RNA, 12 nt, Salmonella enterica enterica serovar Typhi
agucaaauucca

SEQ ID NO: 3649548 - RNA, 16 nt, Salmonella enterica enterica serovar Typhi
agucaaauuccagcaa

SEQ ID NO: 3649549 - RNA, 18 nt, Salmonella enterica enterica serovar Typhi
agucaaauuccagcaaug

SEQ ID NO: 3649550 - RNA, 23 nt, Salmonella enterica enterica serovar Typhi
agucaacucaugccgcugcuggc

SEQ ID NO: 3649551 - RNA, 16 nt, Salmonella enterica enterica serovar Typhi
agucaagcuugccgcu

SEQ ID NO: 3649552 - RNA, 22 nt, Salmonella enterica enterica serovar Typhi
agucaagcuugccgcuaucgag

SEQ ID NO: 3649553 - RNA, 19 nt, Salmonella enterica enterica serovar Typhi
agucaauaaacuggagcac

SEQ ID NO: 3649554 - RNA, 17 nt, Salmonella enterica enterica serovar Typhi
agucacagauccagaca

SEQ ID NO: 3649555 - RNA, 23 nt, Salmonella enterica enterica serovar Typhi
agucacccugcaacauuccuugc

SEQ ID NO: 3649556 - RNA, 20 nt, Salmonella enterica enterica serovar Typhi
agucacggcucgaucccgac

SEQ ID NO: 3649557 - RNA, 20 nt, Salmonella enterica enterica serovar Typhi
agucacuagcacuacggcaa

SEQ ID NO: 3649558 - RNA, 16 nt, Salmonella enterica enterica serovar Typhi
agucacuuacuuucuu

SEQ ID NO: 3649559 - RNA, 19 nt, Salmonella enterica enterica serovar Typhi
agucacuuacuuucuugcc

SEQ ID NO: 3649560 - RNA, 15 nt, Salmonella enterica enterica serovar Typhi
agucagaggaauucu

SEQ ID NO: 3649561 - RNA, 15 nt, Salmonella enterica enterica serovar Typhi
agucagcaacaugga

SEQ ID NO: 3649562 - RNA, 14 nt, Salmonella enterica enterica serovar Typhi
agucagcaauuaac

SEQ ID NO: 3649563 - RNA, 13 nt, Salmonella enterica enterica serovar Typhi
agucagcguuacu

SEQ ID NO: 3649564 - RNA, 17 nt, Salmonella enterica enterica serovar Typhi
agucagcguuacuggcg

SEQ ID NO: 3649565 - RNA, 22 nt, Salmonella enterica enterica serovar Typhi
agucagggcgcggcgcaacuuu

SEQ ID NO: 3649566 - RNA, 14 nt, Salmonella enterica enterica serovar Typhi
agucauaauuaaaa

SEQ ID NO: 3649567 - RNA, 23 nt, Salmonella enterica enterica serovar Typhi
agucauaccuguuccucuuuccc

SEQ ID NO: 3649568 - RNA, 17 nt, Salmonella enterica enterica serovar Typhi
agucauauuaucgcgcu

SEQ ID NO: 3649569 - RNA, 21 nt, Salmonella enterica enterica serovar Typhi
agucauauuaucgcgcugaau

SEQ ID NO: 3649570 - RNA, 15 nt, Salmonella enterica enterica serovar Typhi
agucaucauaauuca

SEQ ID NO: 3649571 - RNA, 13 nt, Salmonella enterica enterica serovar Typhi
agucauccuuccc

SEQ ID NO: 3649572 - RNA, 19 nt, Salmonella enterica enterica serovar Typhi
agucaucgccuucauccgc

SEQ ID NO: 3649573 - RNA, 18 nt, Salmonella enterica enterica serovar Typhi
agucaucugccaguuauc

SEQ ID NO: 3649574 - RNA, 18 nt, Salmonella enterica enterica serovar Typhi
agucaucuguucaacuuu

SEQ ID NO: 3649575 - RNA, 18 nt, Salmonella enterica enterica serovar Typhi
agucaugaaaucuaucug

SEQ ID NO: 3649576 - RNA, 19 nt, Salmonella enterica enterica serovar Typhi
agucauuaauucccgcagc

SEQ ID NO: 3649577 - RNA, 15 nt, Salmonella enterica enterica serovar Typhi
agucauugacagcaa

SEQ ID NO: 3649578 - RNA, 19 nt, Salmonella enterica enterica serovar Typhi
aguccacguuuuacuuccu

SEQ ID NO: 3649579 - RNA, 15 nt, Salmonella enterica enterica serovar Typhi
aguccagccauaauc

SEQ ID NO: 3649580 - RNA, 17 nt, Salmonella enterica enterica serovar Typhi
aguccauaccguuucaa

SEQ ID NO: 3649581 - RNA, 13 nt, Salmonella enterica enterica serovar Typhi
aguccauauccgu

SEQ ID NO: 3649582 - RNA, 16 nt, Salmonella enterica enterica serovar Typhi
aguccaugaugaagau

SEQ ID NO: 3649583 - RNA, 14 nt, Salmonella enterica enterica serovar Typhi
aguccauuuuccua

SEQ ID NO: 3649584 - RNA, 18 nt, Salmonella enterica enterica serovar Typhi
aguccccuuuucacccaa

SEQ ID NO: 3649585 - RNA, 20 nt, Salmonella enterica enterica serovar Typhi
agucccgcgcuuuccagccc

SEQ ID NO: 3649586 - RNA, 17 nt, Salmonella enterica enterica serovar Typhi
agucccgggcuaaucgc

SEQ ID NO: 3649587 - RNA, 15 nt, Salmonella enterica enterica serovar Typhi
agucccuaauagcgc

SEQ ID NO: 3649588 - RNA, 16 nt, Salmonella enterica enterica serovar Typhi
aguccgcacgccugca

SEQ ID NO: 3649589 - RNA, 19 nt, Salmonella enterica enterica serovar Typhi
aguccgccgucgucaccgc

SEQ ID NO: 3649590 - RNA, 15 nt, Salmonella enterica enterica serovar Typhi
aguccgccguugaga

SEQ ID NO: 3649591 - RNA, 21 nt, Salmonella enterica enterica serovar Typhi
aguccgcuuuucguccccuau

SEQ ID NO: 3649592 - RNA, 22 nt, Salmonella enterica enterica serovar Typhi
aguccgcuuuucguccccuaua

SEQ ID NO: 3649593 - RNA, 14 nt, Salmonella enterica enterica serovar Typhi
aguccggauggcag

SEQ ID NO: 3649594 - RNA, 14 nt, Salmonella enterica enterica serovar Typhi
aguccggcgaaaaa

SEQ ID NO: 3649595 - RNA, 17 nt, Salmonella enterica enterica serovar Typhi
aguccgguggcgaaaac

SEQ ID NO: 3649596 - RNA, 21 nt, Salmonella enterica enterica serovar Typhi
aguccgucguuaaucagcgcg

SEQ ID NO: 3649597 - RNA, 21 nt, Salmonella enterica enterica serovar Typhi
aguccguggagaguuuugccg

SEQ ID NO: 3649598 - RNA, 21 nt, Salmonella enterica enterica serovar Typhi
aguccucuaucuuuucaauca

SEQ ID NO: 3649599 - RNA, 20 nt, Salmonella enterica enterica serovar Typhi
aguccugcgucgcuucgcca

SEQ ID NO: 3649600 - RNA, 14 nt, Salmonella enterica enterica serovar Typhi
aguccugcucaugc

SEQ ID NO: 3649601 - RNA, 17 nt, Salmonella enterica enterica serovar Typhi
aguccugucccugccag

SEQ ID NO: 3649602 - RNA, 18 nt, Salmonella enterica enterica serovar Typhi
agucgaaauuuucuucuu

SEQ ID NO: 3649603 - RNA, 19 nt, Salmonella enterica enterica serovar Typhi
agucgagggugauuuccgc

SEQ ID NO: 3649604 - RNA, 14 nt, Salmonella enterica enterica serovar Typhi
agucgauacgcuga

SEQ ID NO: 3649605 - RNA, 17 nt, Salmonella enterica enterica serovar Typhi
agucgauagaucgccac

SEQ ID NO: 3649606 - RNA, 19 nt, Salmonella enterica enterica serovar Typhi
agucgauguggccuuccuc

SEQ ID NO: 3649607 - RNA, 15 nt, Salmonella enterica enterica serovar Typhi
agucgcagcggcugc

SEQ ID NO: 3649608 - RNA, 19 nt, Salmonella enterica enterica serovar Typhi
agucgcauccaguggugaa

SEQ ID NO: 3649609 - RNA, 14 nt, Salmonella enterica enterica serovar Typhi
agucgccagaaggc

SEQ ID NO: 3649610 - RNA, 17 nt, Salmonella enterica enterica serovar Typhi
agucgccagaugucggc

SEQ ID NO: 3649611 - RNA, 14 nt, Salmonella enterica enterica serovar Typhi
agucgccaggcaag

SEQ ID NO: 3649612 - RNA, 20 nt, Salmonella enterica enterica serovar Typhi
agucgcuuaucugcugcugg

SEQ ID NO: 3649613 - RNA, 18 nt, Salmonella enterica enterica serovar Typhi
agucggcgaacuucgcgg

SEQ ID NO: 3649614 - RNA, 17 nt, Salmonella enterica enterica serovar Typhi
agucgggaaagggcggc

SEQ ID NO: 3649615 - RNA, 12 nt, Salmonella enterica enterica serovar Typhi
agucgggcgugc

SEQ ID NO: 3649616 - RNA, 23 nt, Salmonella enterica enterica serovar Typhi
agucgggcgugccguccugugcu

SEQ ID NO: 3649617 - RNA, 22 nt, Salmonella enterica enterica serovar Typhi
agucggggcguaaaaauuuucc

SEQ ID NO: 3649618 - RNA, 14 nt, Salmonella enterica enterica serovar Typhi
agucgguaagucug

SEQ ID NO: 3649619 - RNA, 21 nt, Salmonella enterica enterica serovar Typhi
agucgguuaugcauugcugau

SEQ ID NO: 3649620 - RNA, 21 nt, Salmonella enterica enterica serovar Typhi
agucguaauucagcucgcugc

SEQ ID NO: 3649621 - RNA, 20 nt, Salmonella enterica enterica serovar Typhi
agucgucauggcguaaaucg

SEQ ID NO: 3649622 - RNA, 23 nt, Salmonella enterica enterica serovar Typhi
agucguggcggauucuacugguu

SEQ ID NO: 3649623 - RNA, 15 nt, Salmonella enterica enterica serovar Typhi
agucguuauaauccu

SEQ ID NO: 3649624 - RNA, 16 nt, Salmonella enterica enterica serovar Typhi
agucguuauccagauc

SEQ ID NO: 3649625 - RNA, 20 nt, Salmonella enterica enterica serovar Typhi
agucguuucuauuauugauc

SEQ ID NO: 3649626 - RNA, 15 nt, Salmonella enterica enterica serovar Typhi
agucucaggagugaa

SEQ ID NO: 3649627 - RNA, 14 nt, Salmonella enterica enterica serovar Typhi
agucucccuccugc

SEQ ID NO: 3649628 - RNA, 15 nt, Salmonella enterica enterica serovar Typhi
agucucccuccugcu

SEQ ID NO: 3649629 - RNA, 20 nt, Salmonella enterica enterica serovar Typhi
agucuccgccaccugaauaa

SEQ ID NO: 3649630 - RNA, 20 nt, Salmonella enterica enterica serovar Typhi
agucuccugccaaugaaaua

SEQ ID NO: 3649631 - RNA, 13 nt, Salmonella enterica enterica serovar Typhi
agucugaaaauaa

SEQ ID NO: 3649632 - RNA, 17 nt, Salmonella enterica enterica serovar Typhi
agucugaccgucagccc

SEQ ID NO: 3649633 - RNA, 15 nt, Salmonella enterica enterica serovar Typhi
agucuggauauaaac

SEQ ID NO: 3649634 - RNA, 20 nt, Salmonella enterica enterica serovar Typhi
agucuggccaccgauaaaaa

SEQ ID NO: 3649635 - RNA, 14 nt, Salmonella enterica enterica serovar Typhi
agucugugagaaaa

SEQ ID NO: 3649636 - RNA, 22 nt, Salmonella enterica enterica serovar Typhi
agucuuaauuugcuguuuuuug

SEQ ID NO: 3649637 - RNA, 16 nt, Salmonella enterica enterica serovar Typhi
agucuucauggucgga

SEQ ID NO: 3649638 - RNA, 16 nt, Salmonella enterica enterica serovar Typhi
agucuuuuguuuuucu

SEQ ID NO: 3649639 - RNA, 14 nt, Salmonella enterica enterica serovar Typhi
agugaaaagcugga

SEQ ID NO: 3649640 - RNA, 12 nt, Salmonella enterica enterica serovar Typhi
agugaaauaaau

SEQ ID NO: 3649641 - RNA, 20 nt, Salmonella enterica enterica serovar Typhi
agugaaauuugucgauaaaa

SEQ ID NO: 3649642 - RNA, 15 nt, Salmonella enterica enterica serovar Typhi
agugaacacccugcc

SEQ ID NO: 3649643 - RNA, 22 nt, Salmonella enterica enterica serovar Typhi
agugaaggccaaguuuagaaaa

SEQ ID NO: 3649644 - RNA, 14 nt, Salmonella enterica enterica serovar Typhi
agugaauaacaacc

SEQ ID NO: 3649645 - RNA, 19 nt, Salmonella enterica enterica serovar Typhi
agugaauuaugaccaaugu

SEQ ID NO: 3649646 - RNA, 14 nt, Salmonella enterica enterica serovar Typhi
agugaauuuaaacg

SEQ ID NO: 3649647 - RNA, 16 nt, Salmonella enterica enterica serovar Typhi
agugacagaggaauga

SEQ ID NO: 3649648 - RNA, 22 nt, Salmonella enterica enterica serovar Typhi
agugacagaggaaugaaaacga

SEQ ID NO: 3649649 - RNA, 22 nt, Salmonella enterica enterica serovar Typhi
agugacauuauucaccuggauu

SEQ ID NO: 3649650 - RNA, 18 nt, Salmonella enterica enterica serovar Typhi
agugacguggcuucgccg

SEQ ID NO: 3649651 - RNA, 15 nt, Salmonella enterica enterica serovar Typhi
agugaguuaagacgc

SEQ ID NO: 3649652 - RNA, 18 nt, Salmonella enterica enterica serovar Typhi
agugauaaagcacagccc

SEQ ID NO: 3649653 - RNA, 21 nt, Salmonella enterica enterica serovar Typhi
agugauagcgccauggagaaa

SEQ ID NO: 3649654 - RNA, 19 nt, Salmonella enterica enterica serovar Typhi
agugaucccccagaaucgg

SEQ ID NO: 3649655 - RNA, 17 nt, Salmonella enterica enterica serovar Typhi
agugauucggguaaaca

SEQ ID NO: 3649656 - RNA, 23 nt, Salmonella enterica enterica serovar Typhi
agugauuuacuccaaaaauaaac

SEQ ID NO: 3649657 - RNA, 12 nt, Salmonella enterica enterica serovar Typhi
agugcagaaagu

SEQ ID NO: 3649658 - RNA, 21 nt, Salmonella enterica enterica serovar Typhi
agugcagcggaugcucuuuac

SEQ ID NO: 3649659 - RNA, 22 nt, Salmonella enterica enterica serovar Typhi
aguucggcgauuuccagcgccg

SEQ ID NO: 3649660 - RNA, 15 nt, Salmonella enterica enterica serovar Typhi
aguucuaacaggaag

SEQ ID NO: 3649661 - RNA, 13 nt, Salmonella enterica enterica serovar Typhi
aguucucaaugaa

SEQ ID NO: 3649662 - RNA, 17 nt, Salmonella enterica enterica serovar Typhi
aguucucgcgccgccug

SEQ ID NO: 3649663 - RNA, 18 nt, Salmonella enterica enterica serovar Typhi
aguucucgucugcugaaa

SEQ ID NO: 3649664 - RNA, 12 nt, Salmonella enterica enterica serovar Typhi
aguucucuucuu

SEQ ID NO: 3649665 - RNA, 19 nt, Salmonella enterica enterica serovar Typhi
aguucuggcuuugcgccgg

SEQ ID NO: 3649666 - RNA, 14 nt, Salmonella enterica enterica serovar Typhi
aguucuucauuuau

SEQ ID NO: 3649667 - RNA, 18 nt, Salmonella enterica enterica serovar Typhi
aguugaaaggaaaggucg

SEQ ID NO: 3649668 - RNA, 21 nt, Salmonella enterica enterica serovar Typhi
aguugacgccccauguggcca

SEQ ID NO: 3649669 - RNA, 18 nt, Salmonella enterica enterica serovar Typhi
aguugauucgcuaauaau

SEQ ID NO: 3649670 - RNA, 15 nt, Salmonella enterica enterica serovar Typhi
aguugcaagucacca

SEQ ID NO: 3649671 - RNA, 19 nt, Salmonella enterica enterica serovar Typhi
aguugcacccgaacaacaa

SEQ ID NO: 3649672 - RNA, 21 nt, Salmonella enterica enterica serovar Typhi
aguugcagauuacugagcagu

SEQ ID NO: 3649673 - RNA, 21 nt, Salmonella enterica enterica serovar Typhi
aguugcauauaaggcccauac

SEQ ID NO: 3649674 - RNA, 16 nt, Salmonella enterica enterica serovar Typhi
aguugcccauuuuccu

SEQ ID NO: 3649675 - RNA, 17 nt, Salmonella enterica enterica serovar Typhi
aguugcccgaugcgccc

SEQ ID NO: 3649676 - RNA, 13 nt, Salmonella enterica enterica serovar Typhi
aguugccuucgau

SEQ ID NO: 3649677 - RNA, 19 nt, Salmonella enterica enterica serovar Typhi
aguugcgacuguucaucaa

SEQ ID NO: 3649678 - RNA, 16 nt, Salmonella enterica enterica serovar Typhi
aguugcgcaggguauc

SEQ ID NO: 3649679 - RNA, 14 nt, Salmonella enterica enterica serovar Typhi
aguugcgccacugc

SEQ ID NO: 3649680 - RNA, 17 nt, Salmonella enterica enterica serovar Typhi
aguugcggcaacgugaa

SEQ ID NO: 3649681 - RNA, 14 nt, Salmonella enterica enterica serovar Typhi
aguugcuggagcag

SEQ ID NO: 3649682 - RNA, 16 nt, Salmonella enterica enterica serovar Typhi
aguugcuggauucucu

SEQ ID NO: 3649683 - RNA, 20 nt, Salmonella enterica enterica serovar Typhi
aguugcuucguuaccgguga

SEQ ID NO: 3649684 - RNA, 21 nt, Salmonella enterica enterica serovar Typhi
aguuggaaccaaacaccagau

SEQ ID NO: 3649685 - RNA, 15 nt, Salmonella enterica enterica serovar Typhi
aguuggcagggcuga

SEQ ID NO: 3649686 - RNA, 14 nt, Salmonella enterica enterica serovar Typhi
aguuggugggugau

SEQ ID NO: 3649687 - RNA, 15 nt, Salmonella enterica enterica serovar Typhi
aguuggugggugaug

SEQ ID NO: 3649688 - RNA, 16 nt, Salmonella enterica enterica serovar Typhi
aguugguucccagcac

SEQ ID NO: 3649689 - RNA, 17 nt, Salmonella enterica enterica serovar Typhi
aguugguuguagcacag

SEQ ID NO: 3649690 - RNA, 17 nt, Salmonella enterica enterica serovar Typhi
aguuguacaaacuguga

SEQ ID NO: 3649691 - RNA, 14 nt, Salmonella enterica enterica serovar Typhi
aguuguuccagcag

SEQ ID NO: 3649692 - RNA, 21 nt, Salmonella enterica enterica serovar Typhi
aguuguugucgagguuauaaa

SEQ ID NO: 3649693 - RNA, 22 nt, Salmonella enterica enterica serovar Typhi
aguuguuuauuccauucaucga

SEQ ID NO: 3649694 - RNA, 18 nt, Salmonella enterica enterica serovar Typhi
aguuuaaccguuccaacg

SEQ ID NO: 3649695 - RNA, 15 nt, Salmonella enterica enterica serovar Typhi
aguuuaauucuuuga

SEQ ID NO: 3649696 - RNA, 22 nt, Salmonella enterica enterica serovar Typhi
aguuuacgagugcguucuucca

SEQ ID NO: 3649697 - RNA, 15 nt, Salmonella enterica enterica serovar Typhi
aguuuagaaaauaua

SEQ ID NO: 3649698 - RNA, 22 nt, Salmonella enterica enterica serovar Typhi
aguuuagaaaauauauuggccu

SEQ ID NO: 3649699 - RNA, 11 nt, Salmonella enterica enterica serovar Typhi
aguuuauccgg

SEQ ID NO: 3649700 - RNA, 17 nt, Salmonella enterica enterica serovar Typhi
aguuuauucaucuccuc

SEQ ID NO: 3649701 - RNA, 22 nt, Salmonella enterica enterica serovar Typhi
aguuucagcccaaaagcgaccu

SEQ ID NO: 3649702 - RNA, 14 nt, Salmonella enterica enterica serovar Typhi
aguuucaugccaua

SEQ ID NO: 3649703 - RNA, 14 nt, Salmonella enterica enterica serovar Typhi
aguuuccgguaaau

SEQ ID NO: 3649704 - RNA, 22 nt, Salmonella enterica enterica serovar Typhi
aguuucgacuuucauuucuuua

SEQ ID NO: 3649705 - RNA, 15 nt, Salmonella enterica enterica serovar Typhi
aguuucguuaccccg

SEQ ID NO: 3649706 - RNA, 16 nt, Salmonella enterica enterica serovar Typhi
aguuucucuucguuau

SEQ ID NO: 3649707 - RNA, 21 nt, Salmonella enterica enterica serovar Typhi
aguuucuucggcuucaccgau

SEQ ID NO: 3649708 - RNA, 21 nt, Salmonella enterica enterica serovar Typhi
aguuucuuuuuccaaauaguu

SEQ ID NO: 3649709 - RNA, 18 nt, Salmonella enterica enterica serovar Typhi
aguuugaugcaaauguca

SEQ ID NO: 3649710 - RNA, 15 nt, Salmonella enterica enterica serovar Typhi
aguuugcaauccaga

SEQ ID NO: 3649711 - RNA, 20 nt, Salmonella enterica enterica serovar Typhi
aguuugcgcgauuuauagag

SEQ ID NO: 3649712 - RNA, 13 nt, Salmonella enterica enterica serovar Typhi
aguuugucaucca

SEQ ID NO: 3649713 - RNA, 19 nt, Salmonella enterica enterica serovar Typhi
aguuugucuucgaugcgcu

SEQ ID NO: 3649714 - RNA, 22 nt, Salmonella enterica enterica serovar Typhi
aguuugucuucgaugcgcucau

SEQ ID NO: 3649715 - RNA, 10 nt, Salmonella enterica enterica serovar Typhi
aguuuuaacg

SEQ ID NO: 3649716 - RNA, 17 nt, Salmonella enterica enterica serovar Typhi
aguuuuacugaugccag

SEQ ID NO: 3649717 - RNA, 16 nt, Salmonella enterica enterica serovar Typhi
aguuuugcuucaugca

SEQ ID NO: 3649718 - RNA, 16 nt, Salmonella enterica enterica serovar Typhi
aguuuuuaaacaacau

SEQ ID NO: 3649719 - RNA, 14 nt, Salmonella enterica enterica serovar Typhi
aguuuuucaaucuu

SEQ ID NO: 3649720 - RNA, 19 nt, Salmonella enterica enterica serovar Typhi
aguuuuuccuuucugcgcc

SEQ ID NO: 3649721 - RNA, 19 nt, Salmonella enterica enterica serovar Typhi
aguuuuugcgccagcgcaa

SEQ ID NO: 3649722 - RNA, 22 nt, Salmonella enterica enterica serovar Typhi
aguuuuuucuuacuaauaaaua

SEQ ID NO: 3649723 - RNA, 20 nt, Salmonella enterica enterica serovar Typhi
aguuuuuuuaagaaggucag

SEQ ID NO: 3649724 - RNA, 14 nt, Salmonella enterica enterica serovar Typhi
aguuuuuuucugcc

SEQ ID NO: 3649725 - RNA, 19 nt, Salmonella enterica enterica serovar Typhi
auaaaaaaaagccgaccug

SEQ ID NO: 3649726 - RNA, 14 nt, Salmonella enterica enterica serovar Typhi
auaaaaaacaucau

SEQ ID NO: 3649727 - RNA, 18 nt, Salmonella enterica enterica serovar Typhi
auaaaaaagccguauuuu

SEQ ID NO: 3649728 - RNA, 17 nt, Salmonella enterica enterica serovar Typhi
auaaaaacaauaaauaa

SEQ ID NO: 3649729 - RNA, 22 nt, Salmonella enterica enterica serovar Typhi
auaaaaacgcgcucgccagcgc

SEQ ID NO: 3649730 - RNA, 13 nt, Salmonella enterica enterica serovar Typhi
auaaaaagcacau

SEQ ID NO: 3649731 - RNA, 16 nt, Salmonella enterica enterica serovar Typhi
auaaaaagccagggaa

SEQ ID NO: 3649732 - RNA, 12 nt, Salmonella enterica enterica serovar Typhi
auaaaaauuccc

SEQ ID NO: 3649733 - RNA, 14 nt, Salmonella enterica enterica serovar Typhi
auaaaaccggcaua

SEQ ID NO: 3649734 - RNA, 18 nt, Salmonella enterica enterica serovar Typhi
auaaaacgcccccugcca

SEQ ID NO: 3649735 - RNA, 20 nt, Salmonella enterica enterica serovar Typhi
auaaaagagagcgccaaaaa

SEQ ID NO: 3649736 - RNA, 21 nt, Salmonella enterica enterica serovar Typhi
auaaaagagagcgccaaaaag

SEQ ID NO: 3649737 - RNA, 23 nt, Salmonella enterica enterica serovar Typhi
auaaaagcucuggaaaaauuguu

SEQ ID NO: 3649738 - RNA, 22 nt, Salmonella enterica enterica serovar Typhi
auaaaaguugcucggcaauuuc

SEQ ID NO: 3649739 - RNA, 11 nt, Salmonella enterica enterica serovar Typhi
auaaaauaaac

SEQ ID NO: 3649740 - RNA, 14 nt, Salmonella enterica enterica serovar Typhi
auaaaauaaacacu

SEQ ID NO: 3649741 - RNA, 15 nt, Salmonella enterica enterica serovar Typhi
auaaaauagccuaau

SEQ ID NO: 3649742 - RNA, 19 nt, Salmonella enterica enterica serovar Typhi
auaaaauagugaucaucau

SEQ ID NO: 3649743 - RNA, 23 nt, Salmonella enterica enterica serovar Typhi
auaaaaucaucgcgcugauauuu

SEQ ID NO: 3649744 - RNA, 14 nt, Salmonella enterica enterica serovar Typhi
auaaaauccucuac

SEQ ID NO: 3649745 - RNA, 19 nt, Salmonella enterica enterica serovar Typhi
auaacgccgcccccaugcc

SEQ ID NO: 3649746 - RNA, 17 nt, Salmonella enterica enterica serovar Typhi
auaacgccgguuccaac

SEQ ID NO: 3649747 - RNA, 19 nt, Salmonella enterica enterica serovar Typhi
auaacgcgagaagaagaau

SEQ ID NO: 3649748 - RNA, 19 nt, Salmonella enterica enterica serovar Typhi
auaacgcggcuaaucaggg

SEQ ID NO: 3649749 - RNA, 18 nt, Salmonella enterica enterica serovar Typhi
auaacgcguucuggcgau

SEQ ID NO: 3649750 - RNA, 21 nt, Salmonella enterica enterica serovar Typhi
auaacggguuugauugccauc

SEQ ID NO: 3649751 - RNA, 15 nt, Salmonella enterica enterica serovar Typhi
auaacguguuaugcg

SEQ ID NO: 3649752 - RNA, 17 nt, Salmonella enterica enterica serovar Typhi
auaacguuacauuuucc

SEQ ID NO: 3649753 - RNA, 22 nt, Salmonella enterica enterica serovar Typhi
auaacguuacauuuuccaugcc

SEQ ID NO: 3649754 - RNA, 15 nt, Salmonella enterica enterica serovar Typhi
auaacguuguggaau

SEQ ID NO: 3649755 - RNA, 15 nt, Salmonella enterica enterica serovar Typhi
auaacguuuccuuau

SEQ ID NO: 3649756 - RNA, 14 nt, Salmonella enterica enterica serovar Typhi
auaacuauaauugc

SEQ ID NO: 3649757 - RNA, 22 nt, Salmonella enterica enterica serovar Typhi
auaacuauaauugcuuuuuucc

SEQ ID NO: 3649758 - RNA, 18 nt, Salmonella enterica enterica serovar Typhi
auaacucaauagcggugc

SEQ ID NO: 3649759 - RNA, 17 nt, Salmonella enterica enterica serovar Typhi
auaacucuuaauuauaa

SEQ ID NO: 3649760 - RNA, 14 nt, Salmonella enterica enterica serovar Typhi
auaacuuuccugcc

SEQ ID NO: 3649761 - RNA, 16 nt, Salmonella enterica enterica serovar Typhi
auaagaaagauaaaau

SEQ ID NO: 3649762 - RNA, 16 nt, Salmonella enterica enterica serovar Typhi
auaagaaguaaacaga

SEQ ID NO: 3649763 - RNA, 13 nt, Salmonella enterica enterica serovar Typhi
auaagaaucagau

SEQ ID NO: 3649764 - RNA, 22 nt, Salmonella enterica enterica serovar Typhi
auaagacgcgaagcggcgcuau

SEQ ID NO: 3649765 - RNA, 15 nt, Salmonella enterica enterica serovar Typhi
auaagagaaaauacc

SEQ ID NO: 3649766 - RNA, 15 nt, Salmonella enterica enterica serovar Typhi
auaagaucuuccggc

SEQ ID NO: 3649767 - RNA, 18 nt, Salmonella enterica enterica serovar Typhi
auaagcacaccauuucac

SEQ ID NO: 3649768 - RNA, 21 nt, Salmonella enterica enterica serovar Typhi
auaagcacaccauuucacaaa

SEQ ID NO: 3649769 - RNA, 20 nt, Salmonella enterica enterica serovar Typhi
auaagccugagcgcgaggca

SEQ ID NO: 3649770 - RNA, 19 nt, Salmonella enterica enterica serovar Typhi
auaagcgccgaguagcuga

SEQ ID NO: 3649771 - RNA, 15 nt, Salmonella enterica enterica serovar Typhi
auaagcgucugcaau

SEQ ID NO: 3649772 - RNA, 19 nt, Salmonella enterica enterica serovar Typhi
auaagcugcgacaacaagu

SEQ ID NO: 3649773 - RNA, 12 nt, Salmonella enterica enterica serovar Typhi
auaagcuuuaac

SEQ ID NO: 3649774 - RNA, 15 nt, Salmonella enterica enterica serovar Typhi
auaaggcagcaaugu

SEQ ID NO: 3649775 - RNA, 23 nt, Salmonella enterica enterica serovar Typhi
auaaggcgcuugcgccaucaucc

SEQ ID NO: 3649776 - RNA, 23 nt, Salmonella enterica enterica serovar Typhi
auaaggcggacaacgcauauuau

SEQ ID NO: 3649777 - RNA, 14 nt, Salmonella enterica enterica serovar Typhi
auaagggcucagca

SEQ ID NO: 3649778 - RNA, 15 nt, Salmonella enterica enterica serovar Typhi
auaagggcucagcau

SEQ ID NO: 3649779 - RNA, 15 nt, Salmonella enterica enterica serovar Typhi
auaagggcuugucag

SEQ ID NO: 3649780 - RNA, 22 nt, Salmonella enterica enterica serovar Typhi
auaagguaacgcgaaaaaagau

SEQ ID NO: 3649781 - RNA, 23 nt, Salmonella enterica enterica serovar Typhi
auaagguguuuacgccgccaucc

SEQ ID NO: 3649782 - RNA, 18 nt, Salmonella enterica enterica serovar Typhi
auaagugcauguaaauaa

SEQ ID NO: 3649783 - RNA, 14 nt, Salmonella enterica enterica serovar Typhi
auaaguuuuuucuu

SEQ ID NO: 3649784 - RNA, 22 nt, Salmonella enterica enterica serovar Typhi
auaauaagcggccuauauuagu

SEQ ID NO: 3649785 - RNA, 15 nt, Salmonella enterica enterica serovar Typhi
auaauaaugaucgcu

SEQ ID NO: 3649786 - RNA, 20 nt, Salmonella enterica enterica serovar Typhi
auaauaauuaccacgcagcc

SEQ ID NO: 3649787 - RNA, 12 nt, Salmonella enterica enterica serovar Typhi
auaauaccucaa

SEQ ID NO: 3649788 - RNA, 23 nt, Salmonella enterica enterica serovar Typhi
auaauacgaaauugagaauuauu

SEQ ID NO: 3649789 - RNA, 17 nt, Salmonella enterica enterica serovar Typhi
auaauagcugaaaagau

SEQ ID NO: 3649790 - RNA, 17 nt, Salmonella enterica enterica serovar Typhi
auaauaugcaacacgcc

SEQ ID NO: 3649791 - RNA, 18 nt, Salmonella enterica enterica serovar Typhi
auaauauuaucauaaugu

SEQ ID NO: 3649792 - RNA, 19 nt, Salmonella enterica enterica serovar Typhi
auaaucacauuaugcuggg

SEQ ID NO: 3649793 - RNA, 12 nt, Salmonella enterica enterica serovar Typhi
auaaucaccacg

SEQ ID NO: 3649794 - RNA, 13 nt, Salmonella enterica enterica serovar Typhi
auaaucagcagcg

SEQ ID NO: 3649795 - RNA, 13 nt, Salmonella enterica enterica serovar Typhi
auaaucagcgcuc

SEQ ID NO: 3649796 - RNA, 23 nt, Salmonella enterica enterica serovar Typhi
auaaucauccgggcauaaaaaaa

SEQ ID NO: 3649797 - RNA, 15 nt, Salmonella enterica enterica serovar Typhi
auaauccagacaaau

SEQ ID NO: 3649798 - RNA, 12 nt, Salmonella enterica enterica serovar Typhi
auaauccuuccc

SEQ ID NO: 3649799 - RNA, 15 nt, Salmonella enterica enterica serovar Typhi
auaauccuucccgcu

SEQ ID NO: 3649800 - RNA, 18 nt, Salmonella enterica enterica serovar Typhi
auaaucgacaguggcuuu

SEQ ID NO: 3649801 - RNA, 16 nt, Salmonella enterica enterica serovar Typhi
auaaucgaccguaucc

SEQ ID NO: 3649802 - RNA, 17 nt, Salmonella enterica enterica serovar Typhi
auaaucgauuccuauuu

SEQ ID NO: 3649803 - RNA, 21 nt, Salmonella enterica enterica serovar Typhi
auaaucgccgacuaauuauuu

SEQ ID NO: 3649804 - RNA, 14 nt, Salmonella enterica enterica serovar Typhi
auaaucgccgccgg

SEQ ID NO: 3649805 - RNA, 16 nt, Salmonella enterica enterica serovar Typhi
auaaucgcgagaaaau

SEQ ID NO: 3649806 - RNA, 21 nt, Salmonella enterica enterica serovar Typhi
auaaucgcgauacugccgccc

SEQ ID NO: 3649807 - RNA, 14 nt, Salmonella enterica enterica serovar Typhi
auaaucggcgucau

SEQ ID NO: 3649808 - RNA, 18 nt, Salmonella enterica enterica serovar Typhi
auaaucggcgucauuuuc

SEQ ID NO: 3649809 - RNA, 22 nt, Salmonella enterica enterica serovar Typhi
auaaucgguagcacuuuaaaca

SEQ ID NO: 3649810 - RNA, 20 nt, Salmonella enterica enterica serovar Typhi
auaaucugugauugaauuca

SEQ ID NO: 3649811 - RNA, 17 nt, Salmonella enterica enterica serovar Typhi
auaaugaauacgcucca

SEQ ID NO: 3649812 - RNA, 20 nt, Salmonella enterica enterica serovar Typhi
auaaugacgcuauucaugcc

SEQ ID NO: 3649813 - RNA, 21 nt, Salmonella enterica enterica serovar Typhi
auaaugcaaucaguuccaauc

SEQ ID NO: 3649814 - RNA, 14 nt, Salmonella enterica enterica serovar Typhi
auaaugcgccacca

SEQ ID NO: 3649815 - RNA, 16 nt, Salmonella enterica enterica serovar Typhi
auaaugcgccaccacu

SEQ ID NO: 3649816 - RNA, 23 nt, Salmonella enterica enterica serovar Typhi
auaaugcgccccgcaacgccgau

SEQ ID NO: 3649817 - RNA, 19 nt, Salmonella enterica enterica serovar Typhi
auaauggcgacggccacgc

SEQ ID NO: 3649818 - RNA, 13 nt, Salmonella enterica enterica serovar Typhi
auaauggcgccga

SEQ ID NO: 3649819 - RNA, 19 nt, Salmonella enterica enterica serovar Typhi
auaauggcgcgaaaacagc

SEQ ID NO: 3649820 - RNA, 20 nt, Salmonella enterica enterica serovar Typhi
auaauggggauuaucaggau

SEQ ID NO: 3649821 - RNA, 19 nt, Salmonella enterica enterica serovar Typhi
auaaugguggaaugcccca

SEQ ID NO: 3649822 - RNA, 19 nt, Salmonella enterica enterica serovar Typhi
auaauguaaaaaaauaaaa

SEQ ID NO: 3649823 - RNA, 15 nt, Salmonella enterica enterica serovar Typhi
auaaugucauuacua

SEQ ID NO: 3649824 - RNA, 18 nt, Salmonella enterica enterica serovar Typhi
auaauguuugcgccaucg

SEQ ID NO: 3649825 - RNA, 23 nt, Salmonella enterica enterica serovar Typhi
auaauuaacauuuaagaaacaau

SEQ ID NO: 3649826 - RNA, 22 nt, Salmonella enterica enterica serovar Typhi
auaauuaagaccauacuuugca

SEQ ID NO: 3649827 - RNA, 15 nt, Salmonella enterica enterica serovar Typhi
auaauuaauaauggu

SEQ ID NO: 3649828 - RNA, 22 nt, Salmonella enterica enterica serovar Typhi
auaauuaugccugucaucauca

SEQ ID NO: 3649829 - RNA, 19 nt, Salmonella enterica enterica serovar Typhi
auaauucauaacaccaaua

SEQ ID NO: 3649830 - RNA, 17 nt, Salmonella enterica enterica serovar Typhi
auacgauguaaaaaugc

SEQ ID NO: 3649831 - RNA, 18 nt, Salmonella enterica enterica serovar Typhi
auacgauuucucgccauu

SEQ ID NO: 3649832 - RNA, 12 nt, Salmonella enterica enterica serovar Typhi
auacgcaccagc

SEQ ID NO: 3649833 - RNA, 22 nt, Salmonella enterica enterica serovar Typhi
auacgcagaucuuuuugcuccu

SEQ ID NO: 3649834 - RNA, 14 nt, Salmonella enterica enterica serovar Typhi
auacgccaucuuuc

SEQ ID NO: 3649835 - RNA, 16 nt, Salmonella enterica enterica serovar Typhi
auacgcccacgcggcg

SEQ ID NO: 3649836 - RNA, 18 nt, Salmonella enterica enterica serovar Typhi
auacgcgacggcguaagc

SEQ ID NO: 3649837 - RNA, 21 nt, Salmonella enterica enterica serovar Typhi
auacgcggcacaaaguccgcc

SEQ ID NO: 3649838 - RNA, 16 nt, Salmonella enterica enterica serovar Typhi
auacgcgucaaauaga

SEQ ID NO: 3649839 - RNA, 20 nt, Salmonella enterica enterica serovar Typhi
auacgcgucaaauagagaaa

SEQ ID NO: 3649840 - RNA, 16 nt, Salmonella enterica enterica serovar Typhi
auacgcgucagccuac

SEQ ID NO: 3649841 - RNA, 13 nt, Salmonella enterica enterica serovar Typhi
auacgcuccagcu

SEQ ID NO: 3649842 - RNA, 12 nt, Salmonella enterica enterica serovar Typhi
auacgcugaaga

SEQ ID NO: 3649843 - RNA, 13 nt, Salmonella enterica enterica serovar Typhi
auacgcugaagcu

SEQ ID NO: 3649844 - RNA, 15 nt, Salmonella enterica enterica serovar Typhi
auacgcugaagcuug

SEQ ID NO: 3649845 - RNA, 18 nt, Salmonella enterica enterica serovar Typhi
auacgcugcgucaggcga

SEQ ID NO: 3649846 - RNA, 17 nt, Salmonella enterica enterica serovar Typhi
auacggaaggauagccg

SEQ ID NO: 3649847 - RNA, 22 nt, Salmonella enterica enterica serovar Typhi
auacggagaacggcacaauagc

SEQ ID NO: 3649848 - RNA, 20 nt, Salmonella enterica enterica serovar Typhi
auacggcggcaaugccgccg

SEQ ID NO: 3649849 - RNA, 22 nt, Salmonella enterica enterica serovar Typhi
auacgggagagcguauccagca

SEQ ID NO: 3649850 - RNA, 23 nt, Salmonella enterica enterica serovar Typhi
auacgggagagcguauccagcac

SEQ ID NO: 3649851 - RNA, 13 nt, Salmonella enterica enterica serovar Typhi
auacggggacaga

SEQ ID NO: 3649852 - RNA, 15 nt, Salmonella enterica enterica serovar Typhi
auacggggucuaagg

SEQ ID NO: 3649853 - RNA, 15 nt, Salmonella enterica enterica serovar Typhi
auacgguaauaacuc

SEQ ID NO: 3649854 - RNA, 15 nt, Salmonella enterica enterica serovar Typhi
auacguaauaccuga

SEQ ID NO: 3649855 - RNA, 14 nt, Salmonella enterica enterica serovar Typhi
auacgucauaucau

SEQ ID NO: 3649856 - RNA, 20 nt, Salmonella enterica enterica serovar Typhi
auacgucauaucauccagcc

SEQ ID NO: 3649857 - RNA, 19 nt, Salmonella enterica enterica serovar Typhi
auacguccccauccgagcg

SEQ ID NO: 3649858 - RNA, 13 nt, Salmonella enterica enterica serovar Typhi
auacgucugcgcu

SEQ ID NO: 3649859 - RNA, 18 nt, Salmonella enterica enterica serovar Typhi
auacguguacggcgaauu

SEQ ID NO: 3649860 - RNA, 19 nt, Salmonella enterica enterica serovar Typhi
auacguuauaaauuuuuua

SEQ ID NO: 3649861 - RNA, 14 nt, Salmonella enterica enterica serovar Typhi
auacguuccagcag

SEQ ID NO: 3649862 - RNA, 23 nt, Salmonella enterica enterica serovar Typhi
auacguucgaacgacucggcgau

SEQ ID NO: 3649863 - RNA, 13 nt, Salmonella enterica enterica serovar Typhi
auacguucgcggg

SEQ ID NO: 3649864 - RNA, 15 nt, Salmonella enterica enterica serovar Typhi
auacuaaaacuuuaa

SEQ ID NO: 3649865 - RNA, 17 nt, Salmonella enterica enterica serovar Typhi
auacuaaagggaucuuc

SEQ ID NO: 3649866 - RNA, 23 nt, Salmonella enterica enterica serovar Typhi
auacuacugguggaauaaauaua

SEQ ID NO: 3649867 - RNA, 22 nt, Salmonella enterica enterica serovar Typhi
auacuauccaacagaaggcuuc

SEQ ID NO: 3649868 - RNA, 23 nt, Salmonella enterica enterica serovar Typhi
auacucagcgacguaaucuauuc

SEQ ID NO: 3649869 - RNA, 12 nt, Salmonella enterica enterica serovar Typhi
auacucaucaua

SEQ ID NO: 3649870 - RNA, 22 nt, Salmonella enterica enterica serovar Typhi
auacuccauugucggcagcgag

SEQ ID NO: 3649871 - RNA, 16 nt, Salmonella enterica enterica serovar Typhi
auacucccggcgcugg

SEQ ID NO: 3649872 - RNA, 20 nt, Salmonella enterica enterica serovar Typhi
auacucugcuuuuucacccu

SEQ ID NO: 3649873 - RNA, 21 nt, Salmonella enterica enterica serovar Typhi
auacugaagauaaacagcagc

SEQ ID NO: 3649874 - RNA, 22 nt, Salmonella enterica enterica serovar Typhi
auacugccaaccauuaacuccg

SEQ ID NO: 3649875 - RNA, 16 nt, Salmonella enterica enterica serovar Typhi
auacugccgcccaucg

SEQ ID NO: 3649876 - RNA, 21 nt, Salmonella enterica enterica serovar Typhi
auacugccgcccaucgccaca

SEQ ID NO: 3649877 - RNA, 13 nt, Salmonella enterica enterica serovar Typhi
auacugccgccgu

SEQ ID NO: 3649878 - RNA, 14 nt, Salmonella enterica enterica serovar Typhi
auacuggaaaaaac

SEQ ID NO: 3649879 - RNA, 18 nt, Salmonella enterica enterica serovar Typhi
auacuggaccccagauaa

SEQ ID NO: 3649880 - RNA, 22 nt, Salmonella enterica enterica serovar Typhi
auacugggcgcaugaggccugu

SEQ ID NO: 3649881 - RNA, 17 nt, Salmonella enterica enterica serovar Typhi
auacugucgcgcggcgu

SEQ ID NO: 3649882 - RNA, 13 nt, Salmonella enterica enterica serovar Typhi
auacugucuugug

SEQ ID NO: 3649883 - RNA, 18 nt, Salmonella enterica enterica serovar Typhi
auacugugggauuuuugg

SEQ ID NO: 3649884 - RNA, 17 nt, Salmonella enterica enterica serovar Typhi
auacuguuccaggcgaa

SEQ ID NO: 3649885 - RNA, 15 nt, Salmonella enterica enterica serovar Typhi
auacuguuuuugcuu

SEQ ID NO: 3649886 - RNA, 22 nt, Salmonella enterica enterica serovar Typhi
auacuguuuuugcuuuaauauu

SEQ ID NO: 3649887 - RNA, 12 nt, Salmonella enterica enterica serovar Typhi
auacuuaacccu

SEQ ID NO: 3649888 - RNA, 21 nt, Salmonella enterica enterica serovar Typhi
auacuuaacccugaaccggga

SEQ ID NO: 3649889 - RNA, 14 nt, Salmonella enterica enterica serovar Typhi
auacuuacugcugu

SEQ ID NO: 3649890 - RNA, 19 nt, Salmonella enterica enterica serovar Typhi
auacuuauugauccacgga

SEQ ID NO: 3649891 - RNA, 12 nt, Salmonella enterica enterica serovar Typhi
auacuuccgcug

SEQ ID NO: 3649892 - RNA, 16 nt, Salmonella enterica enterica serovar Typhi
auagaacgcuugucuu

SEQ ID NO: 3649893 - RNA, 23 nt, Salmonella enterica enterica serovar Typhi
auagaacgguuuugcgcugguac

SEQ ID NO: 3649894 - RNA, 16 nt, Salmonella enterica enterica serovar Typhi
auagaaguuaugcauc

SEQ ID NO: 3649895 - RNA, 21 nt, Salmonella enterica enterica serovar Typhi
auagacagcggcuaauuuauu

SEQ ID NO: 3649896 - RNA, 16 nt, Salmonella enterica enterica serovar Typhi
auagacagugauuuac

SEQ ID NO: 3649897 - RNA, 15 nt, Salmonella enterica enterica serovar Typhi
auagacauccagcau

SEQ ID NO: 3649898 - RNA, 16 nt, Salmonella enterica enterica serovar Typhi
auagaccacgccauca

SEQ ID NO: 3649899 - RNA, 19 nt, Salmonella enterica enterica serovar Typhi
auagaccaggcgacuauuc

SEQ ID NO: 3649900 - RNA, 18 nt, Salmonella enterica enterica serovar Typhi
auagacgacaucuuuucc

SEQ ID NO: 3649901 - RNA, 13 nt, Salmonella enterica enterica serovar Typhi
auagacgauauag

SEQ ID NO: 3649902 - RNA, 17 nt, Salmonella enterica enterica serovar Typhi
auagacgcccugcaaag

SEQ ID NO: 3649903 - RNA, 15 nt, Salmonella enterica enterica serovar Typhi
auagacgccgaaccu

SEQ ID NO: 3649904 - RNA, 15 nt, Salmonella enterica enterica serovar Typhi
auagacggccugcaa

SEQ ID NO: 3649905 - RNA, 12 nt, Salmonella enterica enterica serovar Typhi
auagacuccguc

SEQ ID NO: 3649906 - RNA, 17 nt, Salmonella enterica enterica serovar Typhi
auagacuucacuuuccc

SEQ ID NO: 3649907 - RNA, 21 nt, Salmonella enterica enterica serovar Typhi
auagacuucacuuucccggaa

SEQ ID NO: 3649908 - RNA, 17 nt, Salmonella enterica enterica serovar Typhi
auagagacugccgccgu

SEQ ID NO: 3649909 - RNA, 17 nt, Salmonella enterica enterica serovar Typhi
auagagagcgacagccc

SEQ ID NO: 3649910 - RNA, 20 nt, Salmonella enterica enterica serovar Typhi
auagagucgauagaucgcca

SEQ ID NO: 3649911 - RNA, 15 nt, Salmonella enterica enterica serovar Typhi
auagauaugaaagaa

SEQ ID NO: 3649912 - RNA, 23 nt, Salmonella enterica enterica serovar Typhi
auagaucagacgaccauccacca

SEQ ID NO: 3649913 - RNA, 15 nt, Salmonella enterica enterica serovar Typhi
auagaugauaaucau

SEQ ID NO: 3649914 - RNA, 18 nt, Salmonella enterica enterica serovar Typhi
auagcaacccacuuucgg

SEQ ID NO: 3649915 - RNA, 18 nt, Salmonella enterica enterica serovar Typhi
auagcaacguccgcagcc

SEQ ID NO: 3649916 - RNA, 15 nt, Salmonella enterica enterica serovar Typhi
auauaaauuuggcga

SEQ ID NO: 3649917 - RNA, 20 nt, Salmonella enterica enterica serovar Typhi
auauaagcgguauucagguu

SEQ ID NO: 3649918 - RNA, 18 nt, Salmonella enterica enterica serovar Typhi
auauaaggaucggaagac

SEQ ID NO: 3649919 - RNA, 15 nt, Salmonella enterica enterica serovar Typhi
auauaaggugucuau

SEQ ID NO: 3649920 - RNA, 17 nt, Salmonella enterica enterica serovar Typhi
auauacccccugcaauu

SEQ ID NO: 3649921 - RNA, 15 nt, Salmonella enterica enterica serovar Typhi
auauacuucaccaua

SEQ ID NO: 3649922 - RNA, 22 nt, Salmonella enterica enterica serovar Typhi
auauacuucaccauaaaucauu

SEQ ID NO: 3649923 - RNA, 23 nt, Salmonella enterica enterica serovar Typhi
auauagagcccucuguccacaca

SEQ ID NO: 3649924 - RNA, 16 nt, Salmonella enterica enterica serovar Typhi
auauagaguugugaaa

SEQ ID NO: 3649925 - RNA, 14 nt, Salmonella enterica enterica serovar Typhi
auauagcaaucaua

SEQ ID NO: 3649926 - RNA, 16 nt, Salmonella enterica enterica serovar Typhi
auauagcaguuuucac

SEQ ID NO: 3649927 - RNA, 14 nt, Salmonella enterica enterica serovar Typhi
auauagccguggcu

SEQ ID NO: 3649928 - RNA, 17 nt, Salmonella enterica enterica serovar Typhi
auauagccguggcuggc

SEQ ID NO: 3649929 - RNA, 23 nt, Salmonella enterica enterica serovar Typhi
auauagcuaaugcaauaaacuaa

SEQ ID NO: 3649930 - RNA, 16 nt, Salmonella enterica enterica serovar Typhi
auauaggggccaagcg

SEQ ID NO: 3649931 - RNA, 15 nt, Salmonella enterica enterica serovar Typhi
auauaggguuuuccg

SEQ ID NO: 3649932 - RNA, 22 nt, Salmonella enterica enterica serovar Typhi
auauaguugagccauuccagcg

SEQ ID NO: 3649933 - RNA, 20 nt, Salmonella enterica enterica serovar Typhi
auauauccgcuauuaccagu

SEQ ID NO: 3649934 - RNA, 21 nt, Salmonella enterica enterica serovar Typhi
auauauccgcuauuaccagua

SEQ ID NO: 3649935 - RNA, 21 nt, Salmonella enterica enterica serovar Typhi
auauaucgcaggaugcgcugc

SEQ ID NO: 3649936 - RNA, 18 nt, Salmonella enterica enterica serovar Typhi
auauaucgcgucaucaaa

SEQ ID NO: 3649937 - RNA, 19 nt, Salmonella enterica enterica serovar Typhi
auauaucgcgucaucaaac

SEQ ID NO: 3649938 - RNA, 11 nt, Salmonella enterica enterica serovar Typhi
auauaucucua

SEQ ID NO: 3649939 - RNA, 12 nt, Salmonella enterica enterica serovar Typhi
auauaugaaauc

SEQ ID NO: 3649940 - RNA, 20 nt, Salmonella enterica enterica serovar Typhi
auauaugaaccaagauaaga

SEQ ID NO: 3649941 - RNA, 21 nt, Salmonella enterica enterica serovar Typhi
auauaugacaacacucacaaa

SEQ ID NO: 3649942 - RNA, 15 nt, Salmonella enterica enterica serovar Typhi
auauaugcaaaacug

SEQ ID NO: 3649943 - RNA, 18 nt, Salmonella enterica enterica serovar Typhi
auauauuacgacugcacc

SEQ ID NO: 3649944 - RNA, 17 nt, Salmonella enterica enterica serovar Typhi
auauauuuacugaauaa

SEQ ID NO: 3649945 - RNA, 20 nt, Salmonella enterica enterica serovar Typhi
auaucaaacacaaauuucga

SEQ ID NO: 3649946 - RNA, 12 nt, Salmonella enterica enterica serovar Typhi
auaucaacgacc

SEQ ID NO: 3649947 - RNA, 13 nt, Salmonella enterica enterica serovar Typhi
auaucaaucaccu

SEQ ID NO: 3649948 - RNA, 14 nt, Salmonella enterica enterica serovar Typhi
auaucaaugcgaaa

SEQ ID NO: 3649949 - RNA, 14 nt, Salmonella enterica enterica serovar Typhi
auaucaauucaaca

SEQ ID NO: 3649950 - RNA, 21 nt, Salmonella enterica enterica serovar Typhi
auaucagccccacggcaaauu

SEQ ID NO: 3649951 - RNA, 19 nt, Salmonella enterica enterica serovar Typhi
auaucaggcaaaaaucguc

SEQ ID NO: 3649952 - RNA, 14 nt, Salmonella enterica enterica serovar Typhi
auaucagucugcaa

SEQ ID NO: 3649953 - RNA, 13 nt, Salmonella enterica enterica serovar Typhi
auauccagcacgc

SEQ ID NO: 3649954 - RNA, 17 nt, Salmonella enterica enterica serovar Typhi
auauccagccaguccuc

SEQ ID NO: 3649955 - RNA, 16 nt, Salmonella enterica enterica serovar Typhi
auauccaguugcgcca

SEQ ID NO: 3649956 - RNA, 16 nt, Salmonella enterica enterica serovar Typhi
auauccccaucccaga

SEQ ID NO: 3649957 - RNA, 15 nt, Salmonella enterica enterica serovar Typhi
auaucccgcauaccg

SEQ ID NO: 3649958 - RNA, 18 nt, Salmonella enterica enterica serovar Typhi
auaucccggcugacauaa

SEQ ID NO: 3649959 - RNA, 19 nt, Salmonella enterica enterica serovar Typhi
auaucccggcugacauaau

SEQ ID NO: 3649960 - RNA, 15 nt, Salmonella enterica enterica serovar Typhi
auaucccuauuagca

SEQ ID NO: 3649961 - RNA, 14 nt, Salmonella enterica enterica serovar Typhi
auauccgcugcggu

SEQ ID NO: 3649962 - RNA, 15 nt, Salmonella enterica enterica serovar Typhi
auauccgguacacca

SEQ ID NO: 3649963 - RNA, 21 nt, Salmonella enterica enterica serovar Typhi
auauccguacauaacagcagc

SEQ ID NO: 3649964 - RNA, 15 nt, Salmonella enterica enterica serovar Typhi
auauccguagcggau

SEQ ID NO: 3649965 - RNA, 23 nt, Salmonella enterica enterica serovar Typhi
auauccgugcgcaauuccagcaa

SEQ ID NO: 3649966 - RNA, 19 nt, Salmonella enterica enterica serovar Typhi
auauccucgcauccuccau

SEQ ID NO: 3649967 - RNA, 22 nt, Salmonella enterica enterica serovar Typhi
auauccugcaccgccugcggca

SEQ ID NO: 3649968 - RNA, 20 nt, Salmonella enterica enterica serovar Typhi
auaucgacauaaguaaauaa

SEQ ID NO: 3649969 - RNA, 18 nt, Salmonella enterica enterica serovar Typhi
auaucgacggucaggcug

SEQ ID NO: 3649970 - RNA, 13 nt, Salmonella enterica enterica serovar Typhi
auaucgauaaaga

SEQ ID NO: 3649971 - RNA, 17 nt, Salmonella enterica enterica serovar Typhi
auaucgauagcauuuuu

SEQ ID NO: 3649972 - RNA, 13 nt, Salmonella enterica enterica serovar Typhi
auaucgaugccag

SEQ ID NO: 3649973 - RNA, 17 nt, Salmonella enterica enterica serovar Typhi
auaucgccuggugugaa

SEQ ID NO: 3649974 - RNA, 19 nt, Salmonella enterica enterica serovar Typhi
auaucgccuugcugcggca

SEQ ID NO: 3649975 - RNA, 13 nt, Salmonella enterica enterica serovar Typhi
auaucgcgcggca

SEQ ID NO: 3649976 - RNA, 16 nt, Salmonella enterica enterica serovar Typhi
auaucgcggaaauuca

SEQ ID NO: 3649977 - RNA, 22 nt, Salmonella enterica enterica serovar Typhi
auaucgcggguaaacucaccca

SEQ ID NO: 3649978 - RNA, 18 nt, Salmonella enterica enterica serovar Typhi
auaucgcuaaaccaaacu

SEQ ID NO: 3649979 - RNA, 18 nt, Salmonella enterica enterica serovar Typhi
auaucgcuaaccaaacca

SEQ ID NO: 3649980 - RNA, 18 nt, Salmonella enterica enterica serovar Typhi
auaucggccggaugccag

SEQ ID NO: 3649981 - RNA, 14 nt, Salmonella enterica enterica serovar Typhi
auaucggcugcugu

SEQ ID NO: 3649982 - RNA, 19 nt, Salmonella enterica enterica serovar Typhi
auaucgguaagcgccugcu

SEQ ID NO: 3649983 - RNA, 22 nt, Salmonella enterica enterica serovar Typhi
auaucgguaagcgccugcugcg

SEQ ID NO: 3649984 - RNA, 14 nt, Salmonella enterica enterica serovar Typhi
auaucguugccgcc

SEQ ID NO: 3649985 - RNA, 15 nt, Salmonella enterica enterica serovar Typhi
auaucguugccgccg

SEQ ID NO: 3649986 - RNA, 21 nt, Salmonella enterica enterica serovar Typhi
auaucugagcugguuucuccg

SEQ ID NO: 3649987 - RNA, 15 nt, Salmonella enterica enterica serovar Typhi
auaucugcgccgcca

SEQ ID NO: 3649988 - RNA, 19 nt, Salmonella enterica enterica serovar Typhi
auaucuggacgggccgcca

SEQ ID NO: 3649989 - RNA, 20 nt, Salmonella enterica enterica serovar Typhi
auaucuguuucauggagauc

SEQ ID NO: 3649990 - RNA, 15 nt, Salmonella enterica enterica serovar Typhi
auaucuuuauucgcu

SEQ ID NO: 3649991 - RNA, 14 nt, Salmonella enterica enterica serovar Typhi
auaugaaagagaaa

SEQ ID NO: 3649992 - RNA, 16 nt, Salmonella enterica enterica serovar Typhi
auaugaaaucgccugu

SEQ ID NO: 3649993 - RNA, 14 nt, Salmonella enterica enterica serovar Typhi
auaugaauauacga

SEQ ID NO: 3649994 - RNA, 18 nt, Salmonella enterica enterica serovar Typhi
auaugaaucaucagaauc

SEQ ID NO: 3649995 - RNA, 18 nt, Salmonella enterica enterica serovar Typhi
auaugacaacacucacaa

SEQ ID NO: 3649996 - RNA, 18 nt, Salmonella enterica enterica serovar Typhi
auaugacguauugaaaau

SEQ ID NO: 3649997 - RNA, 18 nt, Salmonella enterica enterica serovar Typhi
auaugaguacuacugaua

SEQ ID NO: 3649998 - RNA, 19 nt, Salmonella enterica enterica serovar Typhi
auaugauagaaguuaugca

SEQ ID NO: 3649999 - RNA, 23 nt, Salmonella enterica enterica serovar Typhi
auaugauauguguaucuugcuuu

SEQ ID NO: 3650000 - RNA, 21 nt, Salmonella enterica enterica serovar Typhi
auaugaucgaaaaugcgcaug

SEQ ID NO: 3650001 - RNA, 19 nt, Salmonella enterica enterica serovar Typhi
auaugaucugcacaacauu

SEQ ID NO: 3650002 - RNA, 17 nt, Salmonella enterica enterica serovar Typhi
aucacugauauaacccu

SEQ ID NO: 3650003 - RNA, 23 nt, Salmonella enterica enterica serovar Typhi
aucacugcaccucagaccguuag

SEQ ID NO: 3650004 - RNA, 21 nt, Salmonella enterica enterica serovar Typhi
aucacuggagcgcauuuuacu

SEQ ID NO: 3650005 - RNA, 18 nt, Salmonella enterica enterica serovar Typhi
aucacuuaucaaaccagc

SEQ ID NO: 3650006 - RNA, 21 nt, Salmonella enterica enterica serovar Typhi
aucacuuaucaaaccagcuuu

SEQ ID NO: 3650007 - RNA, 16 nt, Salmonella enterica enterica serovar Typhi
aucacuuccgccacca

SEQ ID NO: 3650008 - RNA, 20 nt, Salmonella enterica enterica serovar Typhi
aucacuuccgccaccacgcc

SEQ ID NO: 3650009 - RNA, 12 nt, Salmonella enterica enterica serovar Typhi
aucacuuccugu

SEQ ID NO: 3650010 - RNA, 22 nt, Salmonella enterica enterica serovar Typhi
aucacuuuacugaauaacagca

SEQ ID NO: 3650011 - RNA, 13 nt, Salmonella enterica enterica serovar Typhi
aucacuuucaguu

SEQ ID NO: 3650012 - RNA, 14 nt, Salmonella enterica enterica serovar Typhi
aucacuuuugauaa

SEQ ID NO: 3650013 - RNA, 13 nt, Salmonella enterica enterica serovar Typhi
aucacuuuuggcg

SEQ ID NO: 3650014 - RNA, 19 nt, Salmonella enterica enterica serovar Typhi
aucagaaaaaagccaagca

SEQ ID NO: 3650015 - RNA, 14 nt, Salmonella enterica enterica serovar Typhi
aucagaaaaaauua

SEQ ID NO: 3650016 - RNA, 20 nt, Salmonella enterica enterica serovar Typhi
aucagaaaaaauuacagccg

SEQ ID NO: 3650017 - RNA, 13 nt, Salmonella enterica enterica serovar Typhi
aucagaaaaaccu

SEQ ID NO: 3650018 - RNA, 23 nt, Salmonella enterica enterica serovar Typhi
aucagaacaaacuuaucccacaa

SEQ ID NO: 3650019 - RNA, 15 nt, Salmonella enterica enterica serovar Typhi
aucagaagaaauauu

SEQ ID NO: 3650020 - RNA, 15 nt, Salmonella enterica enterica serovar Typhi
aucagaagaagacaa

SEQ ID NO: 3650021 - RNA, 23 nt, Salmonella enterica enterica serovar Typhi
aucagaauuucgcccuguauaca

SEQ ID NO: 3650022 - RNA, 13 nt, Salmonella enterica enterica serovar Typhi
aucagaccgacaa

SEQ ID NO: 3650023 - RNA, 18 nt, Salmonella enterica enterica serovar Typhi
aucagaccgagacccagc

SEQ ID NO: 3650024 - RNA, 20 nt, Salmonella enterica enterica serovar Typhi
aucagaccgagacccagcgc

SEQ ID NO: 3650025 - RNA, 16 nt, Salmonella enterica enterica serovar Typhi
aucagaccgauaaaua

SEQ ID NO: 3650026 - RNA, 16 nt, Salmonella enterica enterica serovar Typhi
aucagaccgugaauaa

SEQ ID NO: 3650027 - RNA, 16 nt, Salmonella enterica enterica serovar Typhi
aucagacgcacaaucg

SEQ ID NO: 3650028 - RNA, 12 nt, Salmonella enterica enterica serovar Typhi
aucagacgcauc

SEQ ID NO: 3650029 - RNA, 14 nt, Salmonella enterica enterica serovar Typhi
aucagacgcaucag

SEQ ID NO: 3650030 - RNA, 22 nt, Salmonella enterica enterica serovar Typhi
aucagacgccgggccugcgccu

SEQ ID NO: 3650031 - RNA, 13 nt, Salmonella enterica enterica serovar Typhi
aucagacgcuuca

SEQ ID NO: 3650032 - RNA, 23 nt, Salmonella enterica enterica serovar Typhi
aucagacguuuauaccccaccau

SEQ ID NO: 3650033 - RNA, 14 nt, Salmonella enterica enterica serovar Typhi
aucagacuaucuuc

SEQ ID NO: 3650034 - RNA, 15 nt, Salmonella enterica enterica serovar Typhi
aucagacuaucuucg

SEQ ID NO: 3650035 - RNA, 18 nt, Salmonella enterica enterica serovar Typhi
aucagagacaaauacaug

SEQ ID NO: 3650036 - RNA, 13 nt, Salmonella enterica enterica serovar Typhi
aucagauaaacag

SEQ ID NO: 3650037 - RNA, 15 nt, Salmonella enterica enterica serovar Typhi
aucagauuguugccg

SEQ ID NO: 3650038 - RNA, 14 nt, Salmonella enterica enterica serovar Typhi
aucagauuuaggau

SEQ ID NO: 3650039 - RNA, 12 nt, Salmonella enterica enterica serovar Typhi
aucagcaaaaua

SEQ ID NO: 3650040 - RNA, 20 nt, Salmonella enterica enterica serovar Typhi
aucagcaaaauaccggcagc

SEQ ID NO: 3650041 - RNA, 22 nt, Salmonella enterica enterica serovar Typhi
aucagcaaaauaccggcagcgg

SEQ ID NO: 3650042 - RNA, 17 nt, Salmonella enterica enterica serovar Typhi
aucagcacacuacacag

SEQ ID NO: 3650043 - RNA, 18 nt, Salmonella enterica enterica serovar Typhi
aucagcacauucagcagc

SEQ ID NO: 3650044 - RNA, 15 nt, Salmonella enterica enterica serovar Typhi
aucagcaccacgccc

SEQ ID NO: 3650045 - RNA, 18 nt, Salmonella enterica enterica serovar Typhi
aucagcagccgggccaga

SEQ ID NO: 3650046 - RNA, 16 nt, Salmonella enterica enterica serovar Typhi
aucagcaggauagcga

SEQ ID NO: 3650047 - RNA, 22 nt, Salmonella enterica enterica serovar Typhi
aucagcaucuuaugcgcaaaaa

SEQ ID NO: 3650048 - RNA, 18 nt, Salmonella enterica enterica serovar Typhi
aucagccagcaucgcuaa

SEQ ID NO: 3650049 - RNA, 15 nt, Salmonella enterica enterica serovar Typhi
aucagccagccgcca

SEQ ID NO: 3650050 - RNA, 16 nt, Salmonella enterica enterica serovar Typhi
aucagccagccgccaa

SEQ ID NO: 3650051 - RNA, 12 nt, Salmonella enterica enterica serovar Typhi
aucagccaggcg

SEQ ID NO: 3650052 - RNA, 22 nt, Salmonella enterica enterica serovar Typhi
aucagcccgauacccgcccaga

SEQ ID NO: 3650053 - RNA, 18 nt, Salmonella enterica enterica serovar Typhi
aucagcccgcaaaggacc

SEQ ID NO: 3650054 - RNA, 19 nt, Salmonella enterica enterica serovar Typhi
aucagcgaaggcaacugau

SEQ ID NO: 3650055 - RNA, 22 nt, Salmonella enterica enterica serovar Typhi
aucagcgauugcgccagaccca

SEQ ID NO: 3650056 - RNA, 16 nt, Salmonella enterica enterica serovar Typhi
aucagcgcaauaaauu

SEQ ID NO: 3650057 - RNA, 13 nt, Salmonella enterica enterica serovar Typhi
aucagcgccacca

SEQ ID NO: 3650058 - RNA, 15 nt, Salmonella enterica enterica serovar Typhi
aucagcgccaccaca

SEQ ID NO: 3650059 - RNA, 18 nt, Salmonella enterica enterica serovar Typhi
aucagcgccaccacaaac

SEQ ID NO: 3650060 - RNA, 13 nt, Salmonella enterica enterica serovar Typhi
aucagcgccuccg

SEQ ID NO: 3650061 - RNA, 14 nt, Salmonella enterica enterica serovar Typhi
aucagcgcgcucca

SEQ ID NO: 3650062 - RNA, 17 nt, Salmonella enterica enterica serovar Typhi
aucagcgcgcuccagac

SEQ ID NO: 3650063 - RNA, 20 nt, Salmonella enterica enterica serovar Typhi
aucagcgcgcuccagaccac

SEQ ID NO: 3650064 - RNA, 22 nt, Salmonella enterica enterica serovar Typhi
aucagcgcggcgugaucaaauu

SEQ ID NO: 3650065 - RNA, 14 nt, Salmonella enterica enterica serovar Typhi
aucagcgcgggaua

SEQ ID NO: 3650066 - RNA, 18 nt, Salmonella enterica enterica serovar Typhi
aucagcgcguuuuccauc

SEQ ID NO: 3650067 - RNA, 15 nt, Salmonella enterica enterica serovar Typhi
aucagcgcuccgaca

SEQ ID NO: 3650068 - RNA, 23 nt, Salmonella enterica enterica serovar Typhi
aucagcguuucgccguaaaacaa

SEQ ID NO: 3650069 - RNA, 22 nt, Salmonella enterica enterica serovar Typhi
aucagcuauuagcguuuuuacc

SEQ ID NO: 3650070 - RNA, 16 nt, Salmonella enterica enterica serovar Typhi
aucagcuuugcggcca

SEQ ID NO: 3650071 - RNA, 22 nt, Salmonella enterica enterica serovar Typhi
aucagcuuugcggccagcauau

SEQ ID NO: 3650072 - RNA, 13 nt, Salmonella enterica enterica serovar Typhi
aucaggaaguuga

SEQ ID NO: 3650073 - RNA, 16 nt, Salmonella enterica enterica serovar Typhi
aucaggacauggucac

SEQ ID NO: 3650074 - RNA, 23 nt, Salmonella enterica enterica serovar Typhi
aucaggcaagacccgaaccugcg

SEQ ID NO: 3650075 - RNA, 17 nt, Salmonella enterica enterica serovar Typhi
aucaggcacaacccaaa

SEQ ID NO: 3650076 - RNA, 17 nt, Salmonella enterica enterica serovar Typhi
aucaggcauguugcgca

SEQ ID NO: 3650077 - RNA, 19 nt, Salmonella enterica enterica serovar Typhi
aucaggcauucagcggguu

SEQ ID NO: 3650078 - RNA, 19 nt, Salmonella enterica enterica serovar Typhi
aucaggccgacaaaugacg

SEQ ID NO: 3650079 - RNA, 20 nt, Salmonella enterica enterica serovar Typhi
aucaggccgacaaaugacgu

SEQ ID NO: 3650080 - RNA, 20 nt, Salmonella enterica enterica serovar Typhi
aucaggccuacauccggcuc

SEQ ID NO: 3650081 - RNA, 17 nt, Salmonella enterica enterica serovar Typhi
aucaggccuaccaucgc

SEQ ID NO: 3650082 - RNA, 19 nt, Salmonella enterica enterica serovar Typhi
aucaggccugcaaaccucu

SEQ ID NO: 3650083 - RNA, 13 nt, Salmonella enterica enterica serovar Typhi
aucaggccugccu

SEQ ID NO: 3650084 - RNA, 14 nt, Salmonella enterica enterica serovar Typhi
aucaggccugccug

SEQ ID NO: 3650085 - RNA, 16 nt, Salmonella enterica enterica serovar Typhi
aucaggccugccugau

SEQ ID NO: 3650086 - RNA, 20 nt, Salmonella enterica enterica serovar Typhi
aucaggcgagagaagaauuc

SEQ ID NO: 3650087 - RNA, 12 nt, Salmonella enterica enterica serovar Typhi
aucaggcguaga

SEQ ID NO: 3650088 - RNA, 22 nt, Salmonella enterica enterica serovar Typhi
aucauucccguaucuucauguu

SEQ ID NO: 3650089 - RNA, 14 nt, Salmonella enterica enterica serovar Typhi
aucauucgcgucau

SEQ ID NO: 3650090 - RNA, 22 nt, Salmonella enterica enterica serovar Typhi
aucauucgggaugcauaaaaaa

SEQ ID NO: 3650091 - RNA, 23 nt, Salmonella enterica enterica serovar Typhi
aucauucgggaugcauaaaaaaa

SEQ ID NO: 3650092 - RNA, 15 nt, Salmonella enterica enterica serovar Typhi
aucauugauacugua

SEQ ID NO: 3650093 - RNA, 23 nt, Salmonella enterica enterica serovar Typhi
aucauugccuguaucgcuauccg

SEQ ID NO: 3650094 - RNA, 14 nt, Salmonella enterica enterica serovar Typhi
aucauugcgccaag

SEQ ID NO: 3650095 - RNA, 15 nt, Salmonella enterica enterica serovar Typhi
aucauugcgccaaga

SEQ ID NO: 3650096 - RNA, 19 nt, Salmonella enterica enterica serovar Typhi
aucauuggauuaacggcaa

SEQ ID NO: 3650097 - RNA, 11 nt, Salmonella enterica enterica serovar Typhi
aucauuuccac

SEQ ID NO: 3650098 - RNA, 21 nt, Salmonella enterica enterica serovar Typhi
aucauuuggaggccggauaag

SEQ ID NO: 3650099 - RNA, 12 nt, Salmonella enterica enterica serovar Typhi
aucauuuucuuu

SEQ ID NO: 3650100 - RNA, 19 nt, Salmonella enterica enterica serovar Typhi
aucauuuuuuuggcuucug

SEQ ID NO: 3650101 - RNA, 22 nt, Salmonella enterica enterica serovar Typhi
auccaaacggaccggcgacuau

SEQ ID NO: 3650102 - RNA, 18 nt, Salmonella enterica enterica serovar Typhi
auccaacgcggaaaugua

SEQ ID NO: 3650103 - RNA, 19 nt, Salmonella enterica enterica serovar Typhi
auccacaaccggcuggcua

SEQ ID NO: 3650104 - RNA, 13 nt, Salmonella enterica enterica serovar Typhi
auccacagcgcca

SEQ ID NO: 3650105 - RNA, 16 nt, Salmonella enterica enterica serovar Typhi
auccacagcgccagaa

SEQ ID NO: 3650106 - RNA, 17 nt, Salmonella enterica enterica serovar Typhi
auccacagguuaucgcc

SEQ ID NO: 3650107 - RNA, 19 nt, Salmonella enterica enterica serovar Typhi
auccacaguaaccccauac

SEQ ID NO: 3650108 - RNA, 17 nt, Salmonella enterica enterica serovar Typhi
auccaccaccagcauca

SEQ ID NO: 3650109 - RNA, 13 nt, Salmonella enterica enterica serovar Typhi
auccaccaccuga

SEQ ID NO: 3650110 - RNA, 20 nt, Salmonella enterica enterica serovar Typhi
auccaccaccugauucugca

SEQ ID NO: 3650111 - RNA, 17 nt, Salmonella enterica enterica serovar Typhi
auccaccacguaaugcg

SEQ ID NO: 3650112 - RNA, 15 nt, Salmonella enterica enterica serovar Typhi
auccaccagaauaaa

SEQ ID NO: 3650113 - RNA, 20 nt, Salmonella enterica enterica serovar Typhi
auccaccagcccaucuuucg

SEQ ID NO: 3650114 - RNA, 13 nt, Salmonella enterica enterica serovar Typhi
auccaccagcgcc

SEQ ID NO: 3650115 - RNA, 13 nt, Salmonella enterica enterica serovar Typhi
auccaccaggcau

SEQ ID NO: 3650116 - RNA, 23 nt, Salmonella enterica enterica serovar Typhi
auccaccccuugcgcguuucuga

SEQ ID NO: 3650117 - RNA, 17 nt, Salmonella enterica enterica serovar Typhi
auccacccgguuuacca

SEQ ID NO: 3650118 - RNA, 15 nt, Salmonella enterica enterica serovar Typhi
auccaccgcccgcgu

SEQ ID NO: 3650119 - RNA, 18 nt, Salmonella enterica enterica serovar Typhi
auccaccgguacgcucca

SEQ ID NO: 3650120 - RNA, 14 nt, Salmonella enterica enterica serovar Typhi
auccaccuuauccu

SEQ ID NO: 3650121 - RNA, 15 nt, Salmonella enterica enterica serovar Typhi
auccaccuuauccug

SEQ ID NO: 3650122 - RNA, 23 nt, Salmonella enterica enterica serovar Typhi
auccacgccgcuaucgaccagca

SEQ ID NO: 3650123 - RNA, 20 nt, Salmonella enterica enterica serovar Typhi
auccacgcggugcccugggu

SEQ ID NO: 3650124 - RNA, 19 nt, Salmonella enterica enterica serovar Typhi
auccacggguuacaacugc

SEQ ID NO: 3650125 - RNA, 22 nt, Salmonella enterica enterica serovar Typhi
auccacgucauaacgcgcauuc

SEQ ID NO: 3650126 - RNA, 19 nt, Salmonella enterica enterica serovar Typhi
auccacucccugcuuuuuc

SEQ ID NO: 3650127 - RNA, 23 nt, Salmonella enterica enterica serovar Typhi
auccacucggcgcugucguucca

SEQ ID NO: 3650128 - RNA, 18 nt, Salmonella enterica enterica serovar Typhi
auccacugagcgcgccau

SEQ ID NO: 3650129 - RNA, 20 nt, Salmonella enterica enterica serovar Typhi
auccacugagcgcgccauga

SEQ ID NO: 3650130 - RNA, 20 nt, Salmonella enterica enterica serovar Typhi
auccacuggucgucugaaag

SEQ ID NO: 3650131 - RNA, 23 nt, Salmonella enterica enterica serovar Typhi
auccagaaggcaaaaugccagcc

SEQ ID NO: 3650132 - RNA, 22 nt, Salmonella enterica enterica serovar Typhi
auccagacaaauaccuccuggc

SEQ ID NO: 3650133 - RNA, 17 nt, Salmonella enterica enterica serovar Typhi
auccagauauggcaaac

SEQ ID NO: 3650134 - RNA, 19 nt, Salmonella enterica enterica serovar Typhi
auccagcaaccagguaauc

SEQ ID NO: 3650135 - RNA, 20 nt, Salmonella enterica enterica serovar Typhi
auccagcaaucguccucaca

SEQ ID NO: 3650136 - RNA, 12 nt, Salmonella enterica enterica serovar Typhi
auccagcagcca

SEQ ID NO: 3650137 - RNA, 11 nt, Salmonella enterica enterica serovar Typhi
auccagccagg

SEQ ID NO: 3650138 - RNA, 11 nt, Salmonella enterica enterica serovar Typhi
auccagcccca

SEQ ID NO: 3650139 - RNA, 14 nt, Salmonella enterica enterica serovar Typhi
auccagccucuccc

SEQ ID NO: 3650140 - RNA, 17 nt, Salmonella enterica enterica serovar Typhi
auccagcgaaccuucca

SEQ ID NO: 3650141 - RNA, 20 nt, Salmonella enterica enterica serovar Typhi
auccagcgaaccuuccaucg

SEQ ID NO: 3650142 - RNA, 22 nt, Salmonella enterica enterica serovar Typhi
auccagcgauugacgguuuguc

SEQ ID NO: 3650143 - RNA, 22 nt, Salmonella enterica enterica serovar Typhi
auccagcgccugcuguaaaaua

SEQ ID NO: 3650144 - RNA, 19 nt, Salmonella enterica enterica serovar Typhi
auccagcgcguaaauaccu

SEQ ID NO: 3650145 - RNA, 21 nt, Salmonella enterica enterica serovar Typhi
auccagcgcguaaauaccuuc

SEQ ID NO: 3650146 - RNA, 17 nt, Salmonella enterica enterica serovar Typhi
auccagcgcucaaucag

SEQ ID NO: 3650147 - RNA, 17 nt, Salmonella enterica enterica serovar Typhi
auccagcgguuacuuuu

SEQ ID NO: 3650148 - RNA, 18 nt, Salmonella enterica enterica serovar Typhi
auccagcgguuacuuuug

SEQ ID NO: 3650149 - RNA, 18 nt, Salmonella enterica enterica serovar Typhi
auccagcguagcggugua

SEQ ID NO: 3650150 - RNA, 17 nt, Salmonella enterica enterica serovar Typhi
auccagcgucgccagca

SEQ ID NO: 3650151 - RNA, 17 nt, Salmonella enterica enterica serovar Typhi
auccagcucaguuucca

SEQ ID NO: 3650152 - RNA, 15 nt, Salmonella enterica enterica serovar Typhi
auccagcucuucuuc

SEQ ID NO: 3650153 - RNA, 18 nt, Salmonella enterica enterica serovar Typhi
auccagcucuuucaaucc

SEQ ID NO: 3650154 - RNA, 20 nt, Salmonella enterica enterica serovar Typhi
auccagcuugccgucacagg

SEQ ID NO: 3650155 - RNA, 16 nt, Salmonella enterica enterica serovar Typhi
auccaggaaguaaauu

SEQ ID NO: 3650156 - RNA, 15 nt, Salmonella enterica enterica serovar Typhi
auccaggacgucuug

SEQ ID NO: 3650157 - RNA, 18 nt, Salmonella enterica enterica serovar Typhi
auccaggacgucuugcaa

SEQ ID NO: 3650158 - RNA, 14 nt, Salmonella enterica enterica serovar Typhi
auccagguggaucg

SEQ ID NO: 3650159 - RNA, 9 nt, Salmonella enterica enterica serovar Typhi
auccaguaa

SEQ ID NO: 3650160 - RNA, 17 nt, Salmonella enterica enterica serovar Typhi
auccaguaauuuuuccg

SEQ ID NO: 3650161 - RNA, 15 nt, Salmonella enterica enterica serovar Typhi
auccagucagaggaa

SEQ ID NO: 3650162 - RNA, 23 nt, Salmonella enterica enterica serovar Typhi
auccaguggugaaaaagcggcug

SEQ ID NO: 3650163 - RNA, 14 nt, Salmonella enterica enterica serovar Typhi
auccaguuucuucg

SEQ ID NO: 3650164 - RNA, 24 nt, Salmonella enterica enterica serovar Typhi
auccaguuucuucggcuucaccga

SEQ ID NO: 3650165 - RNA, 20 nt, Salmonella enterica enterica serovar Typhi
auccaguuuuuuccagcgcg

SEQ ID NO: 3650166 - RNA, 17 nt, Salmonella enterica enterica serovar Typhi
auccauaauuuucccca

SEQ ID NO: 3650167 - RNA, 19 nt, Salmonella enterica enterica serovar Typhi
auccauacgguuguugauu

SEQ ID NO: 3650168 - RNA, 13 nt, Salmonella enterica enterica serovar Typhi
auccaucagccag

SEQ ID NO: 3650169 - RNA, 17 nt, Salmonella enterica enterica serovar Typhi
auccaucagccaggguu

SEQ ID NO: 3650170 - RNA, 13 nt, Salmonella enterica enterica serovar Typhi
auccaucaucuau

SEQ ID NO: 3650171 - RNA, 20 nt, Salmonella enterica enterica serovar Typhi
auccaucgguucucugccau

SEQ ID NO: 3650172 - RNA, 19 nt, Salmonella enterica enterica serovar Typhi
auccaugauggcguaaucc

SEQ ID NO: 3650173 - RNA, 16 nt, Salmonella enterica enterica serovar Typhi
auccaugcuuucaaua

SEQ ID NO: 3650174 - RNA, 19 nt, Salmonella enterica enterica serovar Typhi
auccaugcuuucaauaaau

SEQ ID NO: 3650175 - RNA, 18 nt, Salmonella enterica enterica serovar Typhi
auccauuaaaugcgccag

SEQ ID NO: 3650176 - RNA, 18 nt, Salmonella enterica enterica serovar Typhi
auccauucucaucagacc

SEQ ID NO: 3650177 - RNA, 19 nt, Salmonella enterica enterica serovar Typhi
auccauugcgccacggaug

SEQ ID NO: 3650178 - RNA, 12 nt, Salmonella enterica enterica serovar Typhi
aucccaaucagg

SEQ ID NO: 3650179 - RNA, 22 nt, Salmonella enterica enterica serovar Typhi
aucccaaucaggcuugagcgau

SEQ ID NO: 3650180 - RNA, 17 nt, Salmonella enterica enterica serovar Typhi
aucccacaacuguucuu

SEQ ID NO: 3650181 - RNA, 15 nt, Salmonella enterica enterica serovar Typhi
aucccacggagaaaa

SEQ ID NO: 3650182 - RNA, 21 nt, Salmonella enterica enterica serovar Typhi
aucccacggagaaaagcgaaa

SEQ ID NO: 3650183 - RNA, 20 nt, Salmonella enterica enterica serovar Typhi
aucccacuccaucgccugau

SEQ ID NO: 3650184 - RNA, 21 nt, Salmonella enterica enterica serovar Typhi
aucccacucuucaaccggcag

SEQ ID NO: 3650185 - RNA, 18 nt, Salmonella enterica enterica serovar Typhi
aucccacuuaggcagcca

SEQ ID NO: 3650186 - RNA, 20 nt, Salmonella enterica enterica serovar Typhi
aucccagggcggcgucgcca

SEQ ID NO: 3650187 - RNA, 19 nt, Salmonella enterica enterica serovar Typhi
aucccaguugaucggccag

SEQ ID NO: 3650188 - RNA, 23 nt, Salmonella enterica enterica serovar Typhi
aucccaguugaucggccagcaag

SEQ ID NO: 3650189 - RNA, 20 nt, Salmonella enterica enterica serovar Typhi
aucccauccgggccacucuc

SEQ ID NO: 3650190 - RNA, 17 nt, Salmonella enterica enterica serovar Typhi
aucccauugcguucuau

SEQ ID NO: 3650191 - RNA, 13 nt, Salmonella enterica enterica serovar Typhi
auccccaaacugc

SEQ ID NO: 3650192 - RNA, 17 nt, Salmonella enterica enterica serovar Typhi
auccccaaacugcucgu

SEQ ID NO: 3650193 - RNA, 15 nt, Salmonella enterica enterica serovar Typhi
auccccaccaccgcc

SEQ ID NO: 3650194 - RNA, 16 nt, Salmonella enterica enterica serovar Typhi
auccccaccgcugaug

SEQ ID NO: 3650195 - RNA, 17 nt, Salmonella enterica enterica serovar Typhi
auccccagucuuccugc

SEQ ID NO: 3650196 - RNA, 14 nt, Salmonella enterica enterica serovar Typhi
auccccauauucca

SEQ ID NO: 3650197 - RNA, 12 nt, Salmonella enterica enterica serovar Typhi
auccccauccca

SEQ ID NO: 3650198 - RNA, 16 nt, Salmonella enterica enterica serovar Typhi
aucccccaacgucacc

SEQ ID NO: 3650199 - RNA, 20 nt, Salmonella enterica enterica serovar Typhi
auccccccuuuuuugcuggc

SEQ ID NO: 3650200 - RNA, 18 nt, Salmonella enterica enterica serovar Typhi
auccccgccgagaaaaua

SEQ ID NO: 3650201 - RNA, 22 nt, Salmonella enterica enterica serovar Typhi
auccccgccgagaaaauaccgc

SEQ ID NO: 3650202 - RNA, 15 nt, Salmonella enterica enterica serovar Typhi
auccccgccgggcuu

SEQ ID NO: 3650203 - RNA, 16 nt, Salmonella enterica enterica serovar Typhi
auccccgccucaccgc

SEQ ID NO: 3650204 - RNA, 17 nt, Salmonella enterica enterica serovar Typhi
auccccggcaaccuuaa

SEQ ID NO: 3650205 - RNA, 17 nt, Salmonella enterica enterica serovar Typhi
auccccguuuucgccgg

SEQ ID NO: 3650206 - RNA, 21 nt, Salmonella enterica enterica serovar Typhi
auccccucuuccaucagccag

SEQ ID NO: 3650207 - RNA, 14 nt, Salmonella enterica enterica serovar Typhi
auccccugcuccug

SEQ ID NO: 3650208 - RNA, 18 nt, Salmonella enterica enterica serovar Typhi
aucccgaacaugccgccg

SEQ ID NO: 3650209 - RNA, 23 nt, Salmonella enterica enterica serovar Typhi
aucccgaccaguuuuugcgccag

SEQ ID NO: 3650210 - RNA, 14 nt, Salmonella enterica enterica serovar Typhi
aucccgcaggcggc

SEQ ID NO: 3650211 - RNA, 14 nt, Salmonella enterica enterica serovar Typhi
aucccgccgcaucc

SEQ ID NO: 3650212 - RNA, 17 nt, Salmonella enterica enterica serovar Typhi
aucccgcgccaauaacg

SEQ ID NO: 3650213 - RNA, 16 nt, Salmonella enterica enterica serovar Typhi
aucccgcgcgccucgc

SEQ ID NO: 3650214 - RNA, 20 nt, Salmonella enterica enterica serovar Typhi
aucccgcgcgccucgcauaa

SEQ ID NO: 3650215 - RNA, 23 nt, Salmonella enterica enterica serovar Typhi
aucccgcugugauccauguugcc

SEQ ID NO: 3650216 - RNA, 21 nt, Salmonella enterica enterica serovar Typhi
aucccggagagagcaacuggc

SEQ ID NO: 3650217 - RNA, 17 nt, Salmonella enterica enterica serovar Typhi
aucccggcgcgcguggc

SEQ ID NO: 3650218 - RNA, 15 nt, Salmonella enterica enterica serovar Typhi
aucccggcguagcgc

SEQ ID NO: 3650219 - RNA, 20 nt, Salmonella enterica enterica serovar Typhi
aucccgguauuccguuccuu

SEQ ID NO: 3650220 - RNA, 21 nt, Salmonella enterica enterica serovar Typhi
aucccgguauuccguuccuuc

SEQ ID NO: 3650221 - RNA, 15 nt, Salmonella enterica enterica serovar Typhi
aucccguagccgcuu

SEQ ID NO: 3650222 - RNA, 15 nt, Salmonella enterica enterica serovar Typhi
aucccgucccaccac

SEQ ID NO: 3650223 - RNA, 13 nt, Salmonella enterica enterica serovar Typhi
aucccgugguggg

SEQ ID NO: 3650224 - RNA, 13 nt, Salmonella enterica enterica serovar Typhi
aucccucaccucc

SEQ ID NO: 3650225 - RNA, 22 nt, Salmonella enterica enterica serovar Typhi
aucccuccaccagcuucaugcu

SEQ ID NO: 3650226 - RNA, 16 nt, Salmonella enterica enterica serovar Typhi
aucccugaucggccag

SEQ ID NO: 3650227 - RNA, 20 nt, Salmonella enterica enterica serovar Typhi
aucccuguucaaaagccugu

SEQ ID NO: 3650228 - RNA, 13 nt, Salmonella enterica enterica serovar Typhi
auccgaagaacca

SEQ ID NO: 3650229 - RNA, 17 nt, Salmonella enterica enterica serovar Typhi
auccgacgccuguucga

SEQ ID NO: 3650230 - RNA, 15 nt, Salmonella enterica enterica serovar Typhi
auccgacgccuuuac

SEQ ID NO: 3650231 - RNA, 20 nt, Salmonella enterica enterica serovar Typhi
auccgauuucaugcgcagca

SEQ ID NO: 3650232 - RNA, 23 nt, Salmonella enterica enterica serovar Typhi
auccgauuucaugcgcagcauga

SEQ ID NO: 3650233 - RNA, 22 nt, Salmonella enterica enterica serovar Typhi
auccgcagacuuuaaccauucc

SEQ ID NO: 3650234 - RNA, 16 nt, Salmonella enterica enterica serovar Typhi
auccgcagauccagca

SEQ ID NO: 3650235 - RNA, 15 nt, Salmonella enterica enterica serovar Typhi
auccgcagcaguugg

SEQ ID NO: 3650236 - RNA, 15 nt, Salmonella enterica enterica serovar Typhi
auccgcauacaccuu

SEQ ID NO: 3650237 - RNA, 14 nt, Salmonella enterica enterica serovar Typhi
auccgcauccguca

SEQ ID NO: 3650238 - RNA, 20 nt, Salmonella enterica enterica serovar Typhi
auccgccaguuuguaaccaa

SEQ ID NO: 3650239 - RNA, 11 nt, Salmonella enterica enterica serovar Typhi
auccgccaucg

SEQ ID NO: 3650240 - RNA, 19 nt, Salmonella enterica enterica serovar Typhi
auccgccgagggcauugau

SEQ ID NO: 3650241 - RNA, 16 nt, Salmonella enterica enterica serovar Typhi
auccgccgccagccau

SEQ ID NO: 3650242 - RNA, 13 nt, Salmonella enterica enterica serovar Typhi
auccgccgccgca

SEQ ID NO: 3650243 - RNA, 22 nt, Salmonella enterica enterica serovar Typhi
auccgcgcauacucuuccguca

SEQ ID NO: 3650244 - RNA, 18 nt, Salmonella enterica enterica serovar Typhi
auccgcgccggguuuggc

SEQ ID NO: 3650245 - RNA, 19 nt, Salmonella enterica enterica serovar Typhi
auccgcgccggguuuggcg

SEQ ID NO: 3650246 - RNA, 17 nt, Salmonella enterica enterica serovar Typhi
auccgcguaaucgcgaa

SEQ ID NO: 3650247 - RNA, 18 nt, Salmonella enterica enterica serovar Typhi
auccgcuccacauccugu

SEQ ID NO: 3650248 - RNA, 20 nt, Salmonella enterica enterica serovar Typhi
auccgcucccgcuucaaaac

SEQ ID NO: 3650249 - RNA, 15 nt, Salmonella enterica enterica serovar Typhi
auccggaauaagaau

SEQ ID NO: 3650250 - RNA, 23 nt, Salmonella enterica enterica serovar Typhi
auccggacgauaaccaugcucag

SEQ ID NO: 3650251 - RNA, 15 nt, Salmonella enterica enterica serovar Typhi
auccggauauucugc

SEQ ID NO: 3650252 - RNA, 14 nt, Salmonella enterica enterica serovar Typhi
auccggcaaaauua

SEQ ID NO: 3650253 - RNA, 15 nt, Salmonella enterica enterica serovar Typhi
auccggcaaacucag

SEQ ID NO: 3650254 - RNA, 20 nt, Salmonella enterica enterica serovar Typhi
auccggcaacaaaacuaccg

SEQ ID NO: 3650255 - RNA, 15 nt, Salmonella enterica enterica serovar Typhi
auccggcaacugccg

SEQ ID NO: 3650256 - RNA, 14 nt, Salmonella enterica enterica serovar Typhi
auccggcaagcgcu

SEQ ID NO: 3650257 - RNA, 22 nt, Salmonella enterica enterica serovar Typhi
auccggcacgccaucgccugau

SEQ ID NO: 3650258 - RNA, 14 nt, Salmonella enterica enterica serovar Typhi
auccggcacgguca

SEQ ID NO: 3650259 - RNA, 13 nt, Salmonella enterica enterica serovar Typhi
aucgcauauugcg

SEQ ID NO: 3650260 - RNA, 22 nt, Salmonella enterica enterica serovar Typhi
aucgcauuaacguccauaccgg

SEQ ID NO: 3650261 - RNA, 24 nt, Salmonella enterica enterica serovar Typhi
aucgccaaacgccaucacuucgcg

SEQ ID NO: 3650262 - RNA, 12 nt, Salmonella enterica enterica serovar Typhi
aucgccaaagcg

SEQ ID NO: 3650263 - RNA, 19 nt, Salmonella enterica enterica serovar Typhi
aucgccaaagcguaaacag

SEQ ID NO: 3650264 - RNA, 22 nt, Salmonella enterica enterica serovar Typhi
aucgccaaagucauugcugcca

SEQ ID NO: 3650265 - RNA, 22 nt, Salmonella enterica enterica serovar Typhi
aucgccaaaguuaaucagcgaa

SEQ ID NO: 3650266 - RNA, 17 nt, Salmonella enterica enterica serovar Typhi
aucgccaacgaccggcg

SEQ ID NO: 3650267 - RNA, 23 nt, Salmonella enterica enterica serovar Typhi
aucgccacgauagacagcaccau

SEQ ID NO: 3650268 - RNA, 14 nt, Salmonella enterica enterica serovar Typhi
aucgccagauaaau

SEQ ID NO: 3650269 - RNA, 15 nt, Salmonella enterica enterica serovar Typhi
aucgccagcacguuu

SEQ ID NO: 3650270 - RNA, 14 nt, Salmonella enterica enterica serovar Typhi
aucgccagcagcgc

SEQ ID NO: 3650271 - RNA, 17 nt, Salmonella enterica enterica serovar Typhi
aucgccagcagggucag

SEQ ID NO: 3650272 - RNA, 14 nt, Salmonella enterica enterica serovar Typhi
aucgccagcgccug

SEQ ID NO: 3650273 - RNA, 12 nt, Salmonella enterica enterica serovar Typhi
aucgccagcgcg

SEQ ID NO: 3650274 - RNA, 19 nt, Salmonella enterica enterica serovar Typhi
aucgccagcguuagcacau

SEQ ID NO: 3650275 - RNA, 17 nt, Salmonella enterica enterica serovar Typhi
aucgccauauacgccac

SEQ ID NO: 3650276 - RNA, 20 nt, Salmonella enterica enterica serovar Typhi
aucgccaucaacuccuccgg

SEQ ID NO: 3650277 - RNA, 15 nt, Salmonella enterica enterica serovar Typhi
aucgccaucagcgcg

SEQ ID NO: 3650278 - RNA, 17 nt, Salmonella enterica enterica serovar Typhi
aucgccaucagcgcgaa

SEQ ID NO: 3650279 - RNA, 14 nt, Salmonella enterica enterica serovar Typhi
aucgccaucgcgaa

SEQ ID NO: 3650280 - RNA, 22 nt, Salmonella enterica enterica serovar Typhi
aucgcccacgcaaaauggccug

SEQ ID NO: 3650281 - RNA, 22 nt, Salmonella enterica enterica serovar Typhi
aucgcccaggccugaugagcgc

SEQ ID NO: 3650282 - RNA, 22 nt, Salmonella enterica enterica serovar Typhi
aucgcccccaucgugauaaagg

SEQ ID NO: 3650283 - RNA, 16 nt, Salmonella enterica enterica serovar Typhi
aucgcccggccuccgg

SEQ ID NO: 3650284 - RNA, 24 nt, Salmonella enterica enterica serovar Typhi
aucgcccgguugcaauuccgccau

SEQ ID NO: 3650285 - RNA, 17 nt, Salmonella enterica enterica serovar Typhi
aucgccgaaagcgauca

SEQ ID NO: 3650286 - RNA, 18 nt, Salmonella enterica enterica serovar Typhi
aucgccgacuaauuauuu

SEQ ID NO: 3650287 - RNA, 13 nt, Salmonella enterica enterica serovar Typhi
aucgccgaucaca

SEQ ID NO: 3650288 - RNA, 15 nt, Salmonella enterica enterica serovar Typhi
aucgccgaucacaaa

SEQ ID NO: 3650289 - RNA, 19 nt, Salmonella enterica enterica serovar Typhi
aucgccgaucacaaaguca

SEQ ID NO: 3650290 - RNA, 20 nt, Salmonella enterica enterica serovar Typhi
aucgccgcaaugaccacaaa

SEQ ID NO: 3650291 - RNA, 20 nt, Salmonella enterica enterica serovar Typhi
aucgccgccacauugcgcgc

SEQ ID NO: 3650292 - RNA, 15 nt, Salmonella enterica enterica serovar Typhi
aucgccgccagcuca

SEQ ID NO: 3650293 - RNA, 23 nt, Salmonella enterica enterica serovar Typhi
aucgccgccagcucaugcgcggc

SEQ ID NO: 3650294 - RNA, 13 nt, Salmonella enterica enterica serovar Typhi
aucgccgccaucg

SEQ ID NO: 3650295 - RNA, 16 nt, Salmonella enterica enterica serovar Typhi
aucgccgcgacagucg

SEQ ID NO: 3650296 - RNA, 22 nt, Salmonella enterica enterica serovar Typhi
aucgccgguagcuucagcggcg

SEQ ID NO: 3650297 - RNA, 21 nt, Salmonella enterica enterica serovar Typhi
aucgccgguuuugguaucuuc

SEQ ID NO: 3650298 - RNA, 23 nt, Salmonella enterica enterica serovar Typhi
aucgccgucuucuucuucgcgca

SEQ ID NO: 3650299 - RNA, 22 nt, Salmonella enterica enterica serovar Typhi
aucgccguuaucgaggcgcugg

SEQ ID NO: 3650300 - RNA, 16 nt, Salmonella enterica enterica serovar Typhi
aucgccucccugccua

SEQ ID NO: 3650301 - RNA, 16 nt, Salmonella enterica enterica serovar Typhi
aucgccugaugaccgc

SEQ ID NO: 3650302 - RNA, 18 nt, Salmonella enterica enterica serovar Typhi
aucgccugcgcgccugac

SEQ ID NO: 3650303 - RNA, 15 nt, Salmonella enterica enterica serovar Typhi
aucgccugcggcgua

SEQ ID NO: 3650304 - RNA, 14 nt, Salmonella enterica enterica serovar Typhi
aucgccuggagcug

SEQ ID NO: 3650305 - RNA, 22 nt, Salmonella enterica enterica serovar Typhi
aucgccuggugugaacaucacg

SEQ ID NO: 3650306 - RNA, 23 nt, Salmonella enterica enterica serovar Typhi
aucgcgagcacuuuuuccuccug

SEQ ID NO: 3650307 - RNA, 21 nt, Salmonella enterica enterica serovar Typhi
aucgcgauuuuuuuccgcccg

SEQ ID NO: 3650308 - RNA, 16 nt, Salmonella enterica enterica serovar Typhi
aucgcgcacaugcugu

SEQ ID NO: 3650309 - RNA, 16 nt, Salmonella enterica enterica serovar Typhi
aucgcgcagacagugg

SEQ ID NO: 3650310 - RNA, 17 nt, Salmonella enterica enterica serovar Typhi
aucgcgcagcaaaucag

SEQ ID NO: 3650311 - RNA, 19 nt, Salmonella enterica enterica serovar Typhi
aucgcgcagcguaaagcgu

SEQ ID NO: 3650312 - RNA, 22 nt, Salmonella enterica enterica serovar Typhi
aucgcgccaugauucaucccgc

SEQ ID NO: 3650313 - RNA, 23 nt, Salmonella enterica enterica serovar Typhi
aucgcgcccgccaucaugcccac

SEQ ID NO: 3650314 - RNA, 21 nt, Salmonella enterica enterica serovar Typhi
aucgcgcgcagaguguaggcc

SEQ ID NO: 3650315 - RNA, 15 nt, Salmonella enterica enterica serovar Typhi
aucgcggccagcaug

SEQ ID NO: 3650316 - RNA, 21 nt, Salmonella enterica enterica serovar Typhi
aucgcggcgcugaguuucucc

SEQ ID NO: 3650317 - RNA, 15 nt, Salmonella enterica enterica serovar Typhi
aucgcggucagcggc

SEQ ID NO: 3650318 - RNA, 15 nt, Salmonella enterica enterica serovar Typhi
aucgcguacagcgcc

SEQ ID NO: 3650319 - RNA, 16 nt, Salmonella enterica enterica serovar Typhi
aucgcguacagcgcca

SEQ ID NO: 3650320 - RNA, 15 nt, Salmonella enterica enterica serovar Typhi
aucgcgucgccauca

SEQ ID NO: 3650321 - RNA, 22 nt, Salmonella enterica enterica serovar Typhi
aucgcgucguucacgucgcgaa

SEQ ID NO: 3650322 - RNA, 19 nt, Salmonella enterica enterica serovar Typhi
aucgcguuguaaucgccug

SEQ ID NO: 3650323 - RNA, 17 nt, Salmonella enterica enterica serovar Typhi
aucgcuaaacauauacc

SEQ ID NO: 3650324 - RNA, 13 nt, Salmonella enterica enterica serovar Typhi
aucgcuaaucagg

SEQ ID NO: 3650325 - RNA, 23 nt, Salmonella enterica enterica serovar Typhi
aucgcuaucugacagccaaacug

SEQ ID NO: 3650326 - RNA, 16 nt, Salmonella enterica enterica serovar Typhi
aucgcucaacuccugc

SEQ ID NO: 3650327 - RNA, 23 nt, Salmonella enterica enterica serovar Typhi
aucgcucaggagcgccugacagg

SEQ ID NO: 3650328 - RNA, 12 nt, Salmonella enterica enterica serovar Typhi
aucgcuccuccc

SEQ ID NO: 3650329 - RNA, 17 nt, Salmonella enterica enterica serovar Typhi
aucgcucuauauccugc

SEQ ID NO: 3650330 - RNA, 16 nt, Salmonella enterica enterica serovar Typhi
aucgcugacgaucaug

SEQ ID NO: 3650331 - RNA, 17 nt, Salmonella enterica enterica serovar Typhi
aucgcugauauuguuga

SEQ ID NO: 3650332 - RNA, 13 nt, Salmonella enterica enterica serovar Typhi
aucgcugcgcccg

SEQ ID NO: 3650333 - RNA, 14 nt, Salmonella enterica enterica serovar Typhi
aucgcuguggcauu

SEQ ID NO: 3650334 - RNA, 21 nt, Salmonella enterica enterica serovar Typhi
aucgcugugguuuauccgcag

SEQ ID NO: 3650335 - RNA, 17 nt, Salmonella enterica enterica serovar Typhi
aucgcuuaacggcccag

SEQ ID NO: 3650336 - RNA, 21 nt, Salmonella enterica enterica serovar Typhi
aucgcuuaacggcccaggcau

SEQ ID NO: 3650337 - RNA, 24 nt, Salmonella enterica enterica serovar Typhi
aucgcuuauuuucgucguuucuac

SEQ ID NO: 3650338 - RNA, 22 nt, Salmonella enterica enterica serovar Typhi
aucgcuucaaucagcguggcgu

SEQ ID NO: 3650339 - RNA, 15 nt, Salmonella enterica enterica serovar Typhi
aucgcuugcccagca

SEQ ID NO: 3650340 - RNA, 16 nt, Salmonella enterica enterica serovar Typhi
aucgcuugguauggcg

SEQ ID NO: 3650341 - RNA, 17 nt, Salmonella enterica enterica serovar Typhi
aucgcuuugcagaaaau

SEQ ID NO: 3650342 - RNA, 20 nt, Salmonella enterica enterica serovar Typhi
aucggaagacuggcgcagca

SEQ ID NO: 3650343 - RNA, 14 nt, Salmonella enterica enterica serovar Typhi
aucggaccuccgcg

SEQ ID NO: 3650344 - RNA, 19 nt, Salmonella enterica enterica serovar Typhi
aucuacgcuauuuccagaa

SEQ ID NO: 3650345 - RNA, 15 nt, Salmonella enterica enterica serovar Typhi
aucucaagccccaug

SEQ ID NO: 3650346 - RNA, 14 nt, Salmonella enterica enterica serovar Typhi
aucucaaggucugu

SEQ ID NO: 3650347 - RNA, 19 nt, Salmonella enterica enterica serovar Typhi
aucucaaggucugucagga

SEQ ID NO: 3650348 - RNA, 13 nt, Salmonella enterica enterica serovar Typhi
aucucauaaaccg

SEQ ID NO: 3650349 - RNA, 18 nt, Salmonella enterica enterica serovar Typhi
aucucauaaacgccugga

SEQ ID NO: 3650350 - RNA, 18 nt, Salmonella enterica enterica serovar Typhi
aucucauaaaugcugucg

SEQ ID NO: 3650351 - RNA, 17 nt, Salmonella enterica enterica serovar Typhi
aucucauaccaggugcc

SEQ ID NO: 3650352 - RNA, 19 nt, Salmonella enterica enterica serovar Typhi
aucucaucagacuguaugu

SEQ ID NO: 3650353 - RNA, 14 nt, Salmonella enterica enterica serovar Typhi
aucucauugauggu

SEQ ID NO: 3650354 - RNA, 19 nt, Salmonella enterica enterica serovar Typhi
aucuccagaccgcugcgga

SEQ ID NO: 3650355 - RNA, 20 nt, Salmonella enterica enterica serovar Typhi
aucuccagaccgcugcggaa

SEQ ID NO: 3650356 - RNA, 11 nt, Salmonella enterica enterica serovar Typhi
aucuccagcau

SEQ ID NO: 3650357 - RNA, 16 nt, Salmonella enterica enterica serovar Typhi
aucuccaguuguucac

SEQ ID NO: 3650358 - RNA, 16 nt, Salmonella enterica enterica serovar Typhi
aucuccaucauuuccg

SEQ ID NO: 3650359 - RNA, 13 nt, Salmonella enterica enterica serovar Typhi
aucuccaucucca

SEQ ID NO: 3650360 - RNA, 23 nt, Salmonella enterica enterica serovar Typhi
aucucccaggccgccaccgccuc

SEQ ID NO: 3650361 - RNA, 19 nt, Salmonella enterica enterica serovar Typhi
aucuccgccgcuuuaucgu

SEQ ID NO: 3650362 - RNA, 16 nt, Salmonella enterica enterica serovar Typhi
aucuccggcagcgaau

SEQ ID NO: 3650363 - RNA, 13 nt, Salmonella enterica enterica serovar Typhi
aucuccuccggcu

SEQ ID NO: 3650364 - RNA, 22 nt, Salmonella enterica enterica serovar Typhi
aucuccuccucauucagcggcu

SEQ ID NO: 3650365 - RNA, 12 nt, Salmonella enterica enterica serovar Typhi
aucuccugacau

SEQ ID NO: 3650366 - RNA, 19 nt, Salmonella enterica enterica serovar Typhi
aucuccugacauagcucac

SEQ ID NO: 3650367 - RNA, 16 nt, Salmonella enterica enterica serovar Typhi
aucuccuuuaaugaag

SEQ ID NO: 3650368 - RNA, 23 nt, Salmonella enterica enterica serovar Typhi
aucucgaccuggcgcucaaucag

SEQ ID NO: 3650369 - RNA, 22 nt, Salmonella enterica enterica serovar Typhi
aucucgcacaucaugaugaucu

SEQ ID NO: 3650370 - RNA, 12 nt, Salmonella enterica enterica serovar Typhi
aucucgccgucg

SEQ ID NO: 3650371 - RNA, 21 nt, Salmonella enterica enterica serovar Typhi
aucucgcgguugacgcugcuu

SEQ ID NO: 3650372 - RNA, 17 nt, Salmonella enterica enterica serovar Typhi
aucucgugaucgccaaa

SEQ ID NO: 3650373 - RNA, 15 nt, Salmonella enterica enterica serovar Typhi
aucucuacuuuccug

SEQ ID NO: 3650374 - RNA, 18 nt, Salmonella enterica enterica serovar Typhi
aucucuacuuuccugaag

SEQ ID NO: 3650375 - RNA, 18 nt, Salmonella enterica enterica serovar Typhi
aucucuaucggcaaacca

SEQ ID NO: 3650376 - RNA, 14 nt, Salmonella enterica enterica serovar Typhi
aucucuuaauguaa

SEQ ID NO: 3650377 - RNA, 17 nt, Salmonella enterica enterica serovar Typhi
aucucuugcauaauauc

SEQ ID NO: 3650378 - RNA, 22 nt, Salmonella enterica enterica serovar Typhi
aucucuugcauaauauccagga

SEQ ID NO: 3650379 - RNA, 14 nt, Salmonella enterica enterica serovar Typhi
aucucuuuauugcu

SEQ ID NO: 3650380 - RNA, 22 nt, Salmonella enterica enterica serovar Typhi
aucucuuuuaauuuucuguaau

SEQ ID NO: 3650381 - RNA, 15 nt, Salmonella enterica enterica serovar Typhi
aucucuuuugcuuca

SEQ ID NO: 3650382 - RNA, 12 nt, Salmonella enterica enterica serovar Typhi
aucucuuuuucu

SEQ ID NO: 3650383 - RNA, 21 nt, Salmonella enterica enterica serovar Typhi
aucugaacucuuccagauacg

SEQ ID NO: 3650384 - RNA, 13 nt, Salmonella enterica enterica serovar Typhi
aucugaauaccuu

SEQ ID NO: 3650385 - RNA, 15 nt, Salmonella enterica enterica serovar Typhi
aucugacagauaucu

SEQ ID NO: 3650386 - RNA, 14 nt, Salmonella enterica enterica serovar Typhi
aucugacagccaaa

SEQ ID NO: 3650387 - RNA, 18 nt, Salmonella enterica enterica serovar Typhi
aucugacaucagaaaaua

SEQ ID NO: 3650388 - RNA, 19 nt, Salmonella enterica enterica serovar Typhi
aucugacggauacguucgc

SEQ ID NO: 3650389 - RNA, 18 nt, Salmonella enterica enterica serovar Typhi
aucugacugcgugagugu

SEQ ID NO: 3650390 - RNA, 13 nt, Salmonella enterica enterica serovar Typhi
aucugauaaaaug

SEQ ID NO: 3650391 - RNA, 12 nt, Salmonella enterica enterica serovar Typhi
aucugauagccc

SEQ ID NO: 3650392 - RNA, 14 nt, Salmonella enterica enterica serovar Typhi
aucugaugauuaau

SEQ ID NO: 3650393 - RNA, 17 nt, Salmonella enterica enterica serovar Typhi
aucugauucaauuaaug

SEQ ID NO: 3650394 - RNA, 13 nt, Salmonella enterica enterica serovar Typhi
aucugcaaaauau

SEQ ID NO: 3650395 - RNA, 21 nt, Salmonella enterica enterica serovar Typhi
aucugcacaacauuccgcuuc

SEQ ID NO: 3650396 - RNA, 16 nt, Salmonella enterica enterica serovar Typhi
aucugcaugcgcugga

SEQ ID NO: 3650397 - RNA, 13 nt, Salmonella enterica enterica serovar Typhi
aucugcccuuucu

SEQ ID NO: 3650398 - RNA, 17 nt, Salmonella enterica enterica serovar Typhi
aucugcccuuucuuaug

SEQ ID NO: 3650399 - RNA, 18 nt, Salmonella enterica enterica serovar Typhi
aucugccgggagcagauu

SEQ ID NO: 3650400 - RNA, 15 nt, Salmonella enterica enterica serovar Typhi
aucugccgucaucga

SEQ ID NO: 3650401 - RNA, 24 nt, Salmonella enterica enterica serovar Typhi
aucugccucaacaaguccuucuuc

SEQ ID NO: 3650402 - RNA, 21 nt, Salmonella enterica enterica serovar Typhi
aucugcgcaacauucugcuuc

SEQ ID NO: 3650403 - RNA, 17 nt, Salmonella enterica enterica serovar Typhi
aucugcgcaacuggaag

SEQ ID NO: 3650404 - RNA, 16 nt, Salmonella enterica enterica serovar Typhi
aucugcgcauuaacgc

SEQ ID NO: 3650405 - RNA, 21 nt, Salmonella enterica enterica serovar Typhi
aucugcgccgacauucccugc

SEQ ID NO: 3650406 - RNA, 17 nt, Salmonella enterica enterica serovar Typhi
aucugcggucuccugaa

SEQ ID NO: 3650407 - RNA, 21 nt, Salmonella enterica enterica serovar Typhi
aucugcggucuccugaacgcc

SEQ ID NO: 3650408 - RNA, 18 nt, Salmonella enterica enterica serovar Typhi
aucugcgucaguaccuga

SEQ ID NO: 3650409 - RNA, 19 nt, Salmonella enterica enterica serovar Typhi
aucugcgucaguaccugau

SEQ ID NO: 3650410 - RNA, 18 nt, Salmonella enterica enterica serovar Typhi
aucugcgugaugcaucag

SEQ ID NO: 3650411 - RNA, 22 nt, Salmonella enterica enterica serovar Typhi
aucugcuaccgccacuuugcuu

SEQ ID NO: 3650412 - RNA, 23 nt, Salmonella enterica enterica serovar Typhi
aucugcuaccgccacuuugcuuu

SEQ ID NO: 3650413 - RNA, 14 nt, Salmonella enterica enterica serovar Typhi
aucugcuccgccag

SEQ ID NO: 3650414 - RNA, 18 nt, Salmonella enterica enterica serovar Typhi
aucugcuccgccagcaau

SEQ ID NO: 3650415 - RNA, 18 nt, Salmonella enterica enterica serovar Typhi
aucuggaugaaggagaaa

SEQ ID NO: 3650416 - RNA, 17 nt, Salmonella enterica enterica serovar Typhi
aucuggcgcaaccggcg

SEQ ID NO: 3650417 - RNA, 21 nt, Salmonella enterica enterica serovar Typhi
aucuggcgcuuuuccagcacg

SEQ ID NO: 3650418 - RNA, 18 nt, Salmonella enterica enterica serovar Typhi
aucuggcgguuugacggc

SEQ ID NO: 3650419 - RNA, 18 nt, Salmonella enterica enterica serovar Typhi
aucuggcugcguaaaauc

SEQ ID NO: 3650420 - RNA, 19 nt, Salmonella enterica enterica serovar Typhi
aucuggcuguggcguuuua

SEQ ID NO: 3650421 - RNA, 19 nt, Salmonella enterica enterica serovar Typhi
aucugggcugagaaaaauu

SEQ ID NO: 3650422 - RNA, 22 nt, Salmonella enterica enterica serovar Typhi
aucuggucaggugauugcccuc

SEQ ID NO: 3650423 - RNA, 16 nt, Salmonella enterica enterica serovar Typhi
aucuggucauggcuua

SEQ ID NO: 3650424 - RNA, 14 nt, Salmonella enterica enterica serovar Typhi
aucuggugauaaag

SEQ ID NO: 3650425 - RNA, 15 nt, Salmonella enterica enterica serovar Typhi
aucuggugauaaagc

SEQ ID NO: 3650426 - RNA, 18 nt, Salmonella enterica enterica serovar Typhi
aucuggugauaaagcaga

SEQ ID NO: 3650427 - RNA, 19 nt, Salmonella enterica enterica serovar Typhi
aucugguggaaaagaaaac

SEQ ID NO: 3650428 - RNA, 14 nt, Salmonella enterica enterica serovar Typhi
aucugguucacaga

SEQ ID NO: 3650429 - RNA, 17 nt, Salmonella enterica enterica serovar Typhi
aucugguuugguaaaga

SEQ ID NO: 3650430 - RNA, 20 nt, Salmonella enterica enterica serovar Typhi
augaaguuaucgaaggucag

SEQ ID NO: 3650431 - RNA, 17 nt, Salmonella enterica enterica serovar Typhi
augaauaaucucugcga

SEQ ID NO: 3650432 - RNA, 20 nt, Salmonella enterica enterica serovar Typhi
augaauacgcaagccgaacu

SEQ ID NO: 3650433 - RNA, 23 nt, Salmonella enterica enterica serovar Typhi
augaauacgcuccagcuggcugg

SEQ ID NO: 3650434 - RNA, 14 nt, Salmonella enterica enterica serovar Typhi
augaauaucaaacc

SEQ ID NO: 3650435 - RNA, 22 nt, Salmonella enterica enterica serovar Typhi
augaauauccgccgcccagcgg

SEQ ID NO: 3650436 - RNA, 14 nt, Salmonella enterica enterica serovar Typhi
augaaucaucagaa

SEQ ID NO: 3650437 - RNA, 16 nt, Salmonella enterica enterica serovar Typhi
augaaucaucgguaaa

SEQ ID NO: 3650438 - RNA, 23 nt, Salmonella enterica enterica serovar Typhi
augaaucgcgugcgcugcggcca

SEQ ID NO: 3650439 - RNA, 20 nt, Salmonella enterica enterica serovar Typhi
augaaugacaguucccugcu

SEQ ID NO: 3650440 - RNA, 12 nt, Salmonella enterica enterica serovar Typhi
augaauuauuuu

SEQ ID NO: 3650441 - RNA, 21 nt, Salmonella enterica enterica serovar Typhi
augaauuuaucccgugguggg

SEQ ID NO: 3650442 - RNA, 13 nt, Salmonella enterica enterica serovar Typhi
augacaaaaauua

SEQ ID NO: 3650443 - RNA, 13 nt, Salmonella enterica enterica serovar Typhi
augacaacauaaa

SEQ ID NO: 3650444 - RNA, 22 nt, Salmonella enterica enterica serovar Typhi
augacauagcauaauaaugaau

SEQ ID NO: 3650445 - RNA, 14 nt, Salmonella enterica enterica serovar Typhi
augacauccagagg

SEQ ID NO: 3650446 - RNA, 16 nt, Salmonella enterica enterica serovar Typhi
augacaugaaagaaga

SEQ ID NO: 3650447 - RNA, 13 nt, Salmonella enterica enterica serovar Typhi
augaccagaacau

SEQ ID NO: 3650448 - RNA, 15 nt, Salmonella enterica enterica serovar Typhi
augaccauaugcggc

SEQ ID NO: 3650449 - RNA, 20 nt, Salmonella enterica enterica serovar Typhi
augaccaucaaauaauacgc

SEQ ID NO: 3650450 - RNA, 13 nt, Salmonella enterica enterica serovar Typhi
augaccauucaca

SEQ ID NO: 3650451 - RNA, 14 nt, Salmonella enterica enterica serovar Typhi
augaccauucacac

SEQ ID NO: 3650452 - RNA, 17 nt, Salmonella enterica enterica serovar Typhi
augaccccuccggccag

SEQ ID NO: 3650453 - RNA, 22 nt, Salmonella enterica enterica serovar Typhi
augaccccuccggccagcgcca

SEQ ID NO: 3650454 - RNA, 15 nt, Salmonella enterica enterica serovar Typhi
augaccgccuuuuuu

SEQ ID NO: 3650455 - RNA, 16 nt, Salmonella enterica enterica serovar Typhi
augaccgcgacuugga

SEQ ID NO: 3650456 - RNA, 20 nt, Salmonella enterica enterica serovar Typhi
augaccguuaguaaucggau

SEQ ID NO: 3650457 - RNA, 18 nt, Salmonella enterica enterica serovar Typhi
augaccguugauucagcg

SEQ ID NO: 3650458 - RNA, 21 nt, Salmonella enterica enterica serovar Typhi
augaccugggcgccagagagc

SEQ ID NO: 3650459 - RNA, 18 nt, Salmonella enterica enterica serovar Typhi
augaccuggugcaucaua

SEQ ID NO: 3650460 - RNA, 14 nt, Salmonella enterica enterica serovar Typhi
augacgaccucauc

SEQ ID NO: 3650461 - RNA, 16 nt, Salmonella enterica enterica serovar Typhi
augacgauaaauaaga

SEQ ID NO: 3650462 - RNA, 19 nt, Salmonella enterica enterica serovar Typhi
augacgcccugcgccagca

SEQ ID NO: 3650463 - RNA, 12 nt, Salmonella enterica enterica serovar Typhi
augacgccgucu

SEQ ID NO: 3650464 - RNA, 17 nt, Salmonella enterica enterica serovar Typhi
augacgcuggaaguaug

SEQ ID NO: 3650465 - RNA, 11 nt, Salmonella enterica enterica serovar Typhi
augacgcuucg

SEQ ID NO: 3650466 - RNA, 20 nt, Salmonella enterica enterica serovar Typhi
augacggacgcagaccaaag

SEQ ID NO: 3650467 - RNA, 13 nt, Salmonella enterica enterica serovar Typhi
augacggcagggg

SEQ ID NO: 3650468 - RNA, 15 nt, Salmonella enterica enterica serovar Typhi
augacggcaggggcg

SEQ ID NO: 3650469 - RNA, 23 nt, Salmonella enterica enterica serovar Typhi
augacggcagucgcuacaaccag

SEQ ID NO: 3650470 - RNA, 18 nt, Salmonella enterica enterica serovar Typhi
augacggcgcguuaucgu

SEQ ID NO: 3650471 - RNA, 13 nt, Salmonella enterica enterica serovar Typhi
augacgggggcga

SEQ ID NO: 3650472 - RNA, 18 nt, Salmonella enterica enterica serovar Typhi
augacgguauucccgguc

SEQ ID NO: 3650473 - RNA, 16 nt, Salmonella enterica enterica serovar Typhi
augacguaagcggcga

SEQ ID NO: 3650474 - RNA, 19 nt, Salmonella enterica enterica serovar Typhi
augacguauucaccucccu

SEQ ID NO: 3650475 - RNA, 13 nt, Salmonella enterica enterica serovar Typhi
augacguucaauu

SEQ ID NO: 3650476 - RNA, 15 nt, Salmonella enterica enterica serovar Typhi
augacuaauggcauu

SEQ ID NO: 3650477 - RNA, 14 nt, Salmonella enterica enterica serovar Typhi
augacucaaacaga

SEQ ID NO: 3650478 - RNA, 19 nt, Salmonella enterica enterica serovar Typhi
augacucauuaaaaaaaca

SEQ ID NO: 3650479 - RNA, 14 nt, Salmonella enterica enterica serovar Typhi
augacugguuuuuc

SEQ ID NO: 3650480 - RNA, 13 nt, Salmonella enterica enterica serovar Typhi
augagaagaaaaa

SEQ ID NO: 3650481 - RNA, 18 nt, Salmonella enterica enterica serovar Typhi
augagagacggagaaaaa

SEQ ID NO: 3650482 - RNA, 22 nt, Salmonella enterica enterica serovar Typhi
augagauacgucaucaugcugc

SEQ ID NO: 3650483 - RNA, 18 nt, Salmonella enterica enterica serovar Typhi
augagcaaacugcucauu

SEQ ID NO: 3650484 - RNA, 21 nt, Salmonella enterica enterica serovar Typhi
augagcacgcggaagaaauag

SEQ ID NO: 3650485 - RNA, 12 nt, Salmonella enterica enterica serovar Typhi
augagcaggccc

SEQ ID NO: 3650486 - RNA, 18 nt, Salmonella enterica enterica serovar Typhi
augagccagauggauaac

SEQ ID NO: 3650487 - RNA, 12 nt, Salmonella enterica enterica serovar Typhi
augagccagccc

SEQ ID NO: 3650488 - RNA, 15 nt, Salmonella enterica enterica serovar Typhi
augagcgcaggcgag

SEQ ID NO: 3650489 - RNA, 16 nt, Salmonella enterica enterica serovar Typhi
augagcgcaggcgagc

SEQ ID NO: 3650490 - RNA, 20 nt, Salmonella enterica enterica serovar Typhi
augaggauauugguaucaaa

SEQ ID NO: 3650491 - RNA, 23 nt, Salmonella enterica enterica serovar Typhi
augaggccagaaggcgaacauaa

SEQ ID NO: 3650492 - RNA, 20 nt, Salmonella enterica enterica serovar Typhi
augaggcgcagccgccaucc

SEQ ID NO: 3650493 - RNA, 14 nt, Salmonella enterica enterica serovar Typhi
augaguaaaugaac

SEQ ID NO: 3650494 - RNA, 20 nt, Salmonella enterica enterica serovar Typhi
augaguagaacguauuauua

SEQ ID NO: 3650495 - RNA, 17 nt, Salmonella enterica enterica serovar Typhi
augagucgcgcgcgcca

SEQ ID NO: 3650496 - RNA, 15 nt, Salmonella enterica enterica serovar Typhi
augaguuaacgacug

SEQ ID NO: 3650497 - RNA, 23 nt, Salmonella enterica enterica serovar Typhi
augauaaccgccgccaaacugcg

SEQ ID NO: 3650498 - RNA, 17 nt, Salmonella enterica enterica serovar Typhi
augauaagccugacuac

SEQ ID NO: 3650499 - RNA, 14 nt, Salmonella enterica enterica serovar Typhi
augauaaugccgcu

SEQ ID NO: 3650500 - RNA, 19 nt, Salmonella enterica enterica serovar Typhi
augauaauuguuaauuauu

SEQ ID NO: 3650501 - RNA, 20 nt, Salmonella enterica enterica serovar Typhi
augauagcgccauauaaaua

SEQ ID NO: 3650502 - RNA, 16 nt, Salmonella enterica enterica serovar Typhi
augauauauucaugau

SEQ ID NO: 3650503 - RNA, 21 nt, Salmonella enterica enterica serovar Typhi
augauaucggccggaugccag

SEQ ID NO: 3650504 - RNA, 20 nt, Salmonella enterica enterica serovar Typhi
augaucacuuccgccaccac

SEQ ID NO: 3650505 - RNA, 24 nt, Salmonella enterica enterica serovar Typhi
augaucagcgacgguccuggccag

SEQ ID NO: 3650506 - RNA, 19 nt, Salmonella enterica enterica serovar Typhi
augauccacaccggcgcau

SEQ ID NO: 3650507 - RNA, 13 nt, Salmonella enterica enterica serovar Typhi
augaucgacaaug

SEQ ID NO: 3650508 - RNA, 16 nt, Salmonella enterica enterica serovar Typhi
augaucgcccagccac

SEQ ID NO: 3650509 - RNA, 14 nt, Salmonella enterica enterica serovar Typhi
augaucgccgccau

SEQ ID NO: 3650510 - RNA, 21 nt, Salmonella enterica enterica serovar Typhi
augaucguaugcagccaggcc

SEQ ID NO: 3650511 - RNA, 14 nt, Salmonella enterica enterica serovar Typhi
augaucgucaacga

SEQ ID NO: 3650512 - RNA, 18 nt, Salmonella enterica enterica serovar Typhi
augaucgucaggcgccag

SEQ ID NO: 3650513 - RNA, 17 nt, Salmonella enterica enterica serovar Typhi
augaucguuuccagcau

SEQ ID NO: 3650514 - RNA, 18 nt, Salmonella enterica enterica serovar Typhi
augaucguuuccagcauc

SEQ ID NO: 3650515 - RNA, 19 nt, Salmonella enterica enterica serovar Typhi
augaucguuuuuuguugau

SEQ ID NO: 3650516 - RNA, 13 nt, Salmonella enterica enterica serovar Typhi
augccgccauccg

SEQ ID NO: 3650517 - RNA, 22 nt, Salmonella enterica enterica serovar Typhi
augccgcccaggccaugcgccg

SEQ ID NO: 3650518 - RNA, 19 nt, Salmonella enterica enterica serovar Typhi
augccgccgacaaccagcg

SEQ ID NO: 3650519 - RNA, 16 nt, Salmonella enterica enterica serovar Typhi
augccgccgauaccgc

SEQ ID NO: 3650520 - RNA, 15 nt, Salmonella enterica enterica serovar Typhi
augccgccgcaacgc

SEQ ID NO: 3650521 - RNA, 18 nt, Salmonella enterica enterica serovar Typhi
augccgccuuuaucgaca

SEQ ID NO: 3650522 - RNA, 13 nt, Salmonella enterica enterica serovar Typhi
augccgcugcugg

SEQ ID NO: 3650523 - RNA, 21 nt, Salmonella enterica enterica serovar Typhi
augccgcuggccgaugucaau

SEQ ID NO: 3650524 - RNA, 15 nt, Salmonella enterica enterica serovar Typhi
augccggacgccacc

SEQ ID NO: 3650525 - RNA, 19 nt, Salmonella enterica enterica serovar Typhi
augccgguuuuagcaauga

SEQ ID NO: 3650526 - RNA, 19 nt, Salmonella enterica enterica serovar Typhi
augccguaaguuuugcucc

SEQ ID NO: 3650527 - RNA, 17 nt, Salmonella enterica enterica serovar Typhi
augccguagccaaguau

SEQ ID NO: 3650528 - RNA, 20 nt, Salmonella enterica enterica serovar Typhi
augccgugaggcugaagcgc

SEQ ID NO: 3650529 - RNA, 14 nt, Salmonella enterica enterica serovar Typhi
augccgugaguaau

SEQ ID NO: 3650530 - RNA, 21 nt, Salmonella enterica enterica serovar Typhi
augccguucuuuaaucagauu

SEQ ID NO: 3650531 - RNA, 24 nt, Salmonella enterica enterica serovar Typhi
augccuaaaccgacaauauucgcc

SEQ ID NO: 3650532 - RNA, 14 nt, Salmonella enterica enterica serovar Typhi
augccucaccccau

SEQ ID NO: 3650533 - RNA, 15 nt, Salmonella enterica enterica serovar Typhi
augccucuuccggua

SEQ ID NO: 3650534 - RNA, 20 nt, Salmonella enterica enterica serovar Typhi
augccugcgcauccucuuuc

SEQ ID NO: 3650535 - RNA, 21 nt, Salmonella enterica enterica serovar Typhi
augccugcgcauccucuuucc

SEQ ID NO: 3650536 - RNA, 17 nt, Salmonella enterica enterica serovar Typhi
augccuggggucgucag

SEQ ID NO: 3650537 - RNA, 21 nt, Salmonella enterica enterica serovar Typhi
augccuguguaucgcccugcc

SEQ ID NO: 3650538 - RNA, 22 nt, Salmonella enterica enterica serovar Typhi
augccuuauccggccugcaggc

SEQ ID NO: 3650539 - RNA, 13 nt, Salmonella enterica enterica serovar Typhi
augccuucgccgc

SEQ ID NO: 3650540 - RNA, 15 nt, Salmonella enterica enterica serovar Typhi
augcgaaaaguaaag

SEQ ID NO: 3650541 - RNA, 16 nt, Salmonella enterica enterica serovar Typhi
augcgaauaacaucau

SEQ ID NO: 3650542 - RNA, 15 nt, Salmonella enterica enterica serovar Typhi
augcgacugaaaauc

SEQ ID NO: 3650543 - RNA, 19 nt, Salmonella enterica enterica serovar Typhi
augcgaucgggcaauccau

SEQ ID NO: 3650544 - RNA, 18 nt, Salmonella enterica enterica serovar Typhi
augcgaugccgcacgccu

SEQ ID NO: 3650545 - RNA, 20 nt, Salmonella enterica enterica serovar Typhi
augcgcagaaacugaucgaa

SEQ ID NO: 3650546 - RNA, 18 nt, Salmonella enterica enterica serovar Typhi
augcgcaguaggcaugca

SEQ ID NO: 3650547 - RNA, 15 nt, Salmonella enterica enterica serovar Typhi
augcgcaugggcaua

SEQ ID NO: 3650548 - RNA, 21 nt, Salmonella enterica enterica serovar Typhi
augcgccacgacuaucgucac

SEQ ID NO: 3650549 - RNA, 13 nt, Salmonella enterica enterica serovar Typhi
augcgccagcggc

SEQ ID NO: 3650550 - RNA, 12 nt, Salmonella enterica enterica serovar Typhi
augcgccaggca

SEQ ID NO: 3650551 - RNA, 18 nt, Salmonella enterica enterica serovar Typhi
augcgccaggcagcaccu

SEQ ID NO: 3650552 - RNA, 18 nt, Salmonella enterica enterica serovar Typhi
augcgccaguucagcguc

SEQ ID NO: 3650553 - RNA, 13 nt, Salmonella enterica enterica serovar Typhi
augcgccauccca

SEQ ID NO: 3650554 - RNA, 22 nt, Salmonella enterica enterica serovar Typhi
augcgccccgcuucccgaaagg

SEQ ID NO: 3650555 - RNA, 17 nt, Salmonella enterica enterica serovar Typhi
augcgccccugcaggcg

SEQ ID NO: 3650556 - RNA, 17 nt, Salmonella enterica enterica serovar Typhi
augcgcccggagcggug

SEQ ID NO: 3650557 - RNA, 18 nt, Salmonella enterica enterica serovar Typhi
augcgccgacugaacaua

SEQ ID NO: 3650558 - RNA, 21 nt, Salmonella enterica enterica serovar Typhi
augcgccgcccaccgccaacc

SEQ ID NO: 3650559 - RNA, 20 nt, Salmonella enterica enterica serovar Typhi
augcgccgccuuggcgaccu

SEQ ID NO: 3650560 - RNA, 19 nt, Salmonella enterica enterica serovar Typhi
augcgccgcgucagcacau

SEQ ID NO: 3650561 - RNA, 12 nt, Salmonella enterica enterica serovar Typhi
augcgccgucag

SEQ ID NO: 3650562 - RNA, 13 nt, Salmonella enterica enterica serovar Typhi
augcgccugcaau

SEQ ID NO: 3650563 - RNA, 17 nt, Salmonella enterica enterica serovar Typhi
augcgccuguuagggcg

SEQ ID NO: 3650564 - RNA, 22 nt, Salmonella enterica enterica serovar Typhi
augcgcgcgcguuaugccgaca

SEQ ID NO: 3650565 - RNA, 21 nt, Salmonella enterica enterica serovar Typhi
augcgcgcgugaccccaggca

SEQ ID NO: 3650566 - RNA, 14 nt, Salmonella enterica enterica serovar Typhi
augcgcgucaggcc

SEQ ID NO: 3650567 - RNA, 15 nt, Salmonella enterica enterica serovar Typhi
augcgcgucaggcca

SEQ ID NO: 3650568 - RNA, 21 nt, Salmonella enterica enterica serovar Typhi
augcgcgucccggcagugcau

SEQ ID NO: 3650569 - RNA, 16 nt, Salmonella enterica enterica serovar Typhi
augcgcguugccgcca

SEQ ID NO: 3650570 - RNA, 16 nt, Salmonella enterica enterica serovar Typhi
augcgcguuuagcgcc

SEQ ID NO: 3650571 - RNA, 17 nt, Salmonella enterica enterica serovar Typhi
augcgcguuuagcgcca

SEQ ID NO: 3650572 - RNA, 16 nt, Salmonella enterica enterica serovar Typhi
augcgcuagcuggcag

SEQ ID NO: 3650573 - RNA, 16 nt, Salmonella enterica enterica serovar Typhi
augcgcucauaaccgc

SEQ ID NO: 3650574 - RNA, 17 nt, Salmonella enterica enterica serovar Typhi
augcgcugcacaaucgc

SEQ ID NO: 3650575 - RNA, 13 nt, Salmonella enterica enterica serovar Typhi
augcgcugggcac

SEQ ID NO: 3650576 - RNA, 17 nt, Salmonella enterica enterica serovar Typhi
augcgcuuccagcauga

SEQ ID NO: 3650577 - RNA, 13 nt, Salmonella enterica enterica serovar Typhi
augcgcuuuccgc

SEQ ID NO: 3650578 - RNA, 21 nt, Salmonella enterica enterica serovar Typhi
augcggaaaccaguucacgcg

SEQ ID NO: 3650579 - RNA, 23 nt, Salmonella enterica enterica serovar Typhi
augcggcaaaaauccuucuucca

SEQ ID NO: 3650580 - RNA, 16 nt, Salmonella enterica enterica serovar Typhi
augcggccauccugcg

SEQ ID NO: 3650581 - RNA, 12 nt, Salmonella enterica enterica serovar Typhi
augcggcgccau

SEQ ID NO: 3650582 - RNA, 13 nt, Salmonella enterica enterica serovar Typhi
augcggcuagcgc

SEQ ID NO: 3650583 - RNA, 19 nt, Salmonella enterica enterica serovar Typhi
augcggcuuugcgccggca

SEQ ID NO: 3650584 - RNA, 18 nt, Salmonella enterica enterica serovar Typhi
augcgggcgaucggcugu

SEQ ID NO: 3650585 - RNA, 17 nt, Salmonella enterica enterica serovar Typhi
augcgggguuugcagau

SEQ ID NO: 3650586 - RNA, 14 nt, Salmonella enterica enterica serovar Typhi
augcggguccugau

SEQ ID NO: 3650587 - RNA, 21 nt, Salmonella enterica enterica serovar Typhi
augcggucguauuaccaaccc

SEQ ID NO: 3650588 - RNA, 18 nt, Salmonella enterica enterica serovar Typhi
augcgguucucccggcau

SEQ ID NO: 3650589 - RNA, 13 nt, Salmonella enterica enterica serovar Typhi
augcguaccgcua

SEQ ID NO: 3650590 - RNA, 20 nt, Salmonella enterica enterica serovar Typhi
augcguagggugaugccuuc

SEQ ID NO: 3650591 - RNA, 17 nt, Salmonella enterica enterica serovar Typhi
augcguauuuccaccuu

SEQ ID NO: 3650592 - RNA, 15 nt, Salmonella enterica enterica serovar Typhi
augcguccgcccaga

SEQ ID NO: 3650593 - RNA, 16 nt, Salmonella enterica enterica serovar Typhi
augcguccgcccagaa

SEQ ID NO: 3650594 - RNA, 21 nt, Salmonella enterica enterica serovar Typhi
augcgucggcaccauucccac

SEQ ID NO: 3650595 - RNA, 21 nt, Salmonella enterica enterica serovar Typhi
augcgucguuggcauggucag

SEQ ID NO: 3650596 - RNA, 18 nt, Salmonella enterica enterica serovar Typhi
augcguguagcagauaga

SEQ ID NO: 3650597 - RNA, 18 nt, Salmonella enterica enterica serovar Typhi
augcguuauagacagcgg

SEQ ID NO: 3650598 - RNA, 17 nt, Salmonella enterica enterica serovar Typhi
augcguuguaccguuuu

SEQ ID NO: 3650599 - RNA, 19 nt, Salmonella enterica enterica serovar Typhi
augcguuuuuaucuuucuu

SEQ ID NO: 3650600 - RNA, 17 nt, Salmonella enterica enterica serovar Typhi
augcuaaaacagauaac

SEQ ID NO: 3650601 - RNA, 13 nt, Salmonella enterica enterica serovar Typhi
augcuaucccagg

SEQ ID NO: 3650602 - RNA, 23 nt, Salmonella enterica enterica serovar Typhi
augggcgaaaacggcgcaggcaa

SEQ ID NO: 3650603 - RNA, 16 nt, Salmonella enterica enterica serovar Typhi
augggcgggauccugc

SEQ ID NO: 3650604 - RNA, 22 nt, Salmonella enterica enterica serovar Typhi
augggcgugcugacggagcugg

SEQ ID NO: 3650605 - RNA, 16 nt, Salmonella enterica enterica serovar Typhi
auggggcaagcucagc

SEQ ID NO: 3650606 - RNA, 19 nt, Salmonella enterica enterica serovar Typhi
auggggcaagcucagcggc

SEQ ID NO: 3650607 - RNA, 21 nt, Salmonella enterica enterica serovar Typhi
augggguaucgccaagcggua

SEQ ID NO: 3650608 - RNA, 23 nt, Salmonella enterica enterica serovar Typhi
auggguaaaaauauggcgggccu

SEQ ID NO: 3650609 - RNA, 23 nt, Salmonella enterica enterica serovar Typhi
auggguaucgccuucgacuuccg

SEQ ID NO: 3650610 - RNA, 17 nt, Salmonella enterica enterica serovar Typhi
auggguuccaguugcac

SEQ ID NO: 3650611 - RNA, 20 nt, Salmonella enterica enterica serovar Typhi
augguacacauaugggaaga

SEQ ID NO: 3650612 - RNA, 21 nt, Salmonella enterica enterica serovar Typhi
augguacaccaggaguuaaac

SEQ ID NO: 3650613 - RNA, 17 nt, Salmonella enterica enterica serovar Typhi
auggucccugauauaca

SEQ ID NO: 3650614 - RNA, 15 nt, Salmonella enterica enterica serovar Typhi
auggucgguauuauc

SEQ ID NO: 3650615 - RNA, 21 nt, Salmonella enterica enterica serovar Typhi
auggucucguugccauugguu

SEQ ID NO: 3650616 - RNA, 16 nt, Salmonella enterica enterica serovar Typhi
auggucuguaccacca

SEQ ID NO: 3650617 - RNA, 18 nt, Salmonella enterica enterica serovar Typhi
augguggucgcggccacc

SEQ ID NO: 3650618 - RNA, 22 nt, Salmonella enterica enterica serovar Typhi
augguggucgcggccaccgcca

SEQ ID NO: 3650619 - RNA, 22 nt, Salmonella enterica enterica serovar Typhi
augguguuggcaaucagcggca

SEQ ID NO: 3650620 - RNA, 22 nt, Salmonella enterica enterica serovar Typhi
augguuaaauuaaauaacaaau

SEQ ID NO: 3650621 - RNA, 13 nt, Salmonella enterica enterica serovar Typhi
augguuaacgccg

SEQ ID NO: 3650622 - RNA, 17 nt, Salmonella enterica enterica serovar Typhi
augguuaagcagacgcu

SEQ ID NO: 3650623 - RNA, 18 nt, Salmonella enterica enterica serovar Typhi
augguuauaguccacuuu

SEQ ID NO: 3650624 - RNA, 17 nt, Salmonella enterica enterica serovar Typhi
augguuauccagcaggu

SEQ ID NO: 3650625 - RNA, 19 nt, Salmonella enterica enterica serovar Typhi
augguuauuaauuacgcug

SEQ ID NO: 3650626 - RNA, 11 nt, Salmonella enterica enterica serovar Typhi
augguuauuuu

SEQ ID NO: 3650627 - RNA, 20 nt, Salmonella enterica enterica serovar Typhi
augguucaggcggauauaug

SEQ ID NO: 3650628 - RNA, 20 nt, Salmonella enterica enterica serovar Typhi
augguugacuuacaaaaaau

SEQ ID NO: 3650629 - RNA, 22 nt, Salmonella enterica enterica serovar Typhi
augguuuugcccauuuccugca

SEQ ID NO: 3650630 - RNA, 16 nt, Salmonella enterica enterica serovar Typhi
auguaaaaaaauaaaa

SEQ ID NO: 3650631 - RNA, 19 nt, Salmonella enterica enterica serovar Typhi
auguaaaaaaauaaaaaag

SEQ ID NO: 3650632 - RNA, 13 nt, Salmonella enterica enterica serovar Typhi
auguaaaacaaga

SEQ ID NO: 3650633 - RNA, 19 nt, Salmonella enterica enterica serovar Typhi
auguaaacuccauuaaauu

SEQ ID NO: 3650634 - RNA, 23 nt, Salmonella enterica enterica serovar Typhi
auguaaacuccauuaaauuacuu

SEQ ID NO: 3650635 - RNA, 16 nt, Salmonella enterica enterica serovar Typhi
auguaaaggugagcuc

SEQ ID NO: 3650636 - RNA, 22 nt, Salmonella enterica enterica serovar Typhi
auguaaagucggccauuuuuuu

SEQ ID NO: 3650637 - RNA, 12 nt, Salmonella enterica enterica serovar Typhi
auguaaaugacg

SEQ ID NO: 3650638 - RNA, 16 nt, Salmonella enterica enterica serovar Typhi
auguaacgccuuugcc

SEQ ID NO: 3650639 - RNA, 24 nt, Salmonella enterica enterica serovar Typhi
auguaagcgucuauuacacgauca

SEQ ID NO: 3650640 - RNA, 16 nt, Salmonella enterica enterica serovar Typhi
auguaaucugacagau

SEQ ID NO: 3650641 - RNA, 16 nt, Salmonella enterica enterica serovar Typhi
auguaauucaccaaau

SEQ ID NO: 3650642 - RNA, 19 nt, Salmonella enterica enterica serovar Typhi
auguacagaaugguauuau

SEQ ID NO: 3650643 - RNA, 20 nt, Salmonella enterica enterica serovar Typhi
auguacauaggcaauauccu

SEQ ID NO: 3650644 - RNA, 20 nt, Salmonella enterica enterica serovar Typhi
auguaccauugucaaaaaua

SEQ ID NO: 3650645 - RNA, 16 nt, Salmonella enterica enterica serovar Typhi
auguacgccuaaaaau

SEQ ID NO: 3650646 - RNA, 20 nt, Salmonella enterica enterica serovar Typhi
auguacgccuaaaaaugagg

SEQ ID NO: 3650647 - RNA, 22 nt, Salmonella enterica enterica serovar Typhi
auguacuguauucgguggaaac

SEQ ID NO: 3650648 - RNA, 20 nt, Salmonella enterica enterica serovar Typhi
auguagagcggauaagcgca

SEQ ID NO: 3650649 - RNA, 13 nt, Salmonella enterica enterica serovar Typhi
auguagccagcca

SEQ ID NO: 3650650 - RNA, 20 nt, Salmonella enterica enterica serovar Typhi
auguaguccgggugcaaauc

SEQ ID NO: 3650651 - RNA, 21 nt, Salmonella enterica enterica serovar Typhi
auguaguuguucuuuuuaugg

SEQ ID NO: 3650652 - RNA, 17 nt, Salmonella enterica enterica serovar Typhi
auguaucgcgcggauuc

SEQ ID NO: 3650653 - RNA, 20 nt, Salmonella enterica enterica serovar Typhi
auguaucgcgcuuacacaga

SEQ ID NO: 3650654 - RNA, 22 nt, Salmonella enterica enterica serovar Typhi
auguauucucccgucagcaaca

SEQ ID NO: 3650655 - RNA, 13 nt, Salmonella enterica enterica serovar Typhi
auguauuuaaguc

SEQ ID NO: 3650656 - RNA, 15 nt, Salmonella enterica enterica serovar Typhi
auguauuucagacuu

SEQ ID NO: 3650657 - RNA, 14 nt, Salmonella enterica enterica serovar Typhi
augucaacuuaaac

SEQ ID NO: 3650658 - RNA, 12 nt, Salmonella enterica enterica serovar Typhi
augucaggauca

SEQ ID NO: 3650659 - RNA, 16 nt, Salmonella enterica enterica serovar Typhi
augucauagcaaugau

SEQ ID NO: 3650660 - RNA, 22 nt, Salmonella enterica enterica serovar Typhi
augucaucaacauuggaaaacu

SEQ ID NO: 3650661 - RNA, 17 nt, Salmonella enterica enterica serovar Typhi
augucaugacugguuuu

SEQ ID NO: 3650662 - RNA, 17 nt, Salmonella enterica enterica serovar Typhi
augucauucaggucuau

SEQ ID NO: 3650663 - RNA, 21 nt, Salmonella enterica enterica serovar Typhi
augucauucaggucuauugcc

SEQ ID NO: 3650664 - RNA, 19 nt, Salmonella enterica enterica serovar Typhi
auguccaggcgacaugaca

SEQ ID NO: 3650665 - RNA, 13 nt, Salmonella enterica enterica serovar Typhi
auguccagggcau

SEQ ID NO: 3650666 - RNA, 17 nt, Salmonella enterica enterica serovar Typhi
auguccauaaauagauc

SEQ ID NO: 3650667 - RNA, 18 nt, Salmonella enterica enterica serovar Typhi
auguccaucagauucaac

SEQ ID NO: 3650668 - RNA, 18 nt, Salmonella enterica enterica serovar Typhi
auguccauccauugcgcc

SEQ ID NO: 3650669 - RNA, 16 nt, Salmonella enterica enterica serovar Typhi
augucccaguaauauc

SEQ ID NO: 3650670 - RNA, 17 nt, Salmonella enterica enterica serovar Typhi
augucccgauauugguc

SEQ ID NO: 3650671 - RNA, 15 nt, Salmonella enterica enterica serovar Typhi
auguccgccuaccag

SEQ ID NO: 3650672 - RNA, 19 nt, Salmonella enterica enterica serovar Typhi
auguccgccuaccagcaca

SEQ ID NO: 3650673 - RNA, 20 nt, Salmonella enterica enterica serovar Typhi
auguccgccuaccagcacau

SEQ ID NO: 3650674 - RNA, 20 nt, Salmonella enterica enterica serovar Typhi
auguccugccgcaaacgccu

SEQ ID NO: 3650675 - RNA, 19 nt, Salmonella enterica enterica serovar Typhi
auguccuuuacugcgccag

SEQ ID NO: 3650676 - RNA, 23 nt, Salmonella enterica enterica serovar Typhi
auguccuuuacugcgccagccug

SEQ ID NO: 3650677 - RNA, 23 nt, Salmonella enterica enterica serovar Typhi
augucgauucacguagcguauca

SEQ ID NO: 3650678 - RNA, 17 nt, Salmonella enterica enterica serovar Typhi
augucgcgucagguuua

SEQ ID NO: 3650679 - RNA, 22 nt, Salmonella enterica enterica serovar Typhi
augucggcguaaauccagccuc

SEQ ID NO: 3650680 - RNA, 20 nt, Salmonella enterica enterica serovar Typhi
augucguuguaguuaucgcc

SEQ ID NO: 3650681 - RNA, 17 nt, Salmonella enterica enterica serovar Typhi
augucuggcgcuaaaau

SEQ ID NO: 3650682 - RNA, 22 nt, Salmonella enterica enterica serovar Typhi
augucuggcgcuaaaauccacu

SEQ ID NO: 3650683 - RNA, 15 nt, Salmonella enterica enterica serovar Typhi
augucuuuacggaug

SEQ ID NO: 3650684 - RNA, 23 nt, Salmonella enterica enterica serovar Typhi
augucuuuucgguauuuaucaaa

SEQ ID NO: 3650685 - RNA, 17 nt, Salmonella enterica enterica serovar Typhi
augugaaauacagccag

SEQ ID NO: 3650686 - RNA, 13 nt, Salmonella enterica enterica serovar Typhi
augugaauccagg

SEQ ID NO: 3650687 - RNA, 17 nt, Salmonella enterica enterica serovar Typhi
auuauuuuagugaaaaa

SEQ ID NO: 3650688 - RNA, 14 nt, Salmonella enterica enterica serovar Typhi
auuauuuucacgcu

SEQ ID NO: 3650689 - RNA, 17 nt, Salmonella enterica enterica serovar Typhi
auuauuuuuaaauaacu

SEQ ID NO: 3650690 - RNA, 22 nt, Salmonella enterica enterica serovar Typhi
auuauuuuuaaauaacuuuuaa

SEQ ID NO: 3650691 - RNA, 15 nt, Salmonella enterica enterica serovar Typhi
auucaaaauccgcca

SEQ ID NO: 3650692 - RNA, 21 nt, Salmonella enterica enterica serovar Typhi
auucaaaccuucaagaaucaa

SEQ ID NO: 3650693 - RNA, 22 nt, Salmonella enterica enterica serovar Typhi
auucaacacauuccauuuuucg

SEQ ID NO: 3650694 - RNA, 15 nt, Salmonella enterica enterica serovar Typhi
auucaacgcaucaaa

SEQ ID NO: 3650695 - RNA, 23 nt, Salmonella enterica enterica serovar Typhi
auucaagcaacuguagaaugcua

SEQ ID NO: 3650696 - RNA, 11 nt, Salmonella enterica enterica serovar Typhi
auucaauauug

SEQ ID NO: 3650697 - RNA, 17 nt, Salmonella enterica enterica serovar Typhi
auucaaucuggugacga

SEQ ID NO: 3650698 - RNA, 21 nt, Salmonella enterica enterica serovar Typhi
auucaauuagcgccuccccua

SEQ ID NO: 3650699 - RNA, 21 nt, Salmonella enterica enterica serovar Typhi
auucacaccaaugucauauuu

SEQ ID NO: 3650700 - RNA, 15 nt, Salmonella enterica enterica serovar Typhi
auucacaccuuuaua

SEQ ID NO: 3650701 - RNA, 18 nt, Salmonella enterica enterica serovar Typhi
auucacaccuuuauauuu

SEQ ID NO: 3650702 - RNA, 22 nt, Salmonella enterica enterica serovar Typhi
auucacaccuuuauauuuuucc

SEQ ID NO: 3650703 - RNA, 18 nt, Salmonella enterica enterica serovar Typhi
auucacauauauuucugu

SEQ ID NO: 3650704 - RNA, 16 nt, Salmonella enterica enterica serovar Typhi
auucaccaaaaggcag

SEQ ID NO: 3650705 - RNA, 14 nt, Salmonella enterica enterica serovar Typhi
auucaccaaauccu

SEQ ID NO: 3650706 - RNA, 19 nt, Salmonella enterica enterica serovar Typhi
auucaccuggauuccucca

SEQ ID NO: 3650707 - RNA, 22 nt, Salmonella enterica enterica serovar Typhi
auucacgcgauuguuauccccc

SEQ ID NO: 3650708 - RNA, 19 nt, Salmonella enterica enterica serovar Typhi
auucacuuuccgaaucagg

SEQ ID NO: 3650709 - RNA, 23 nt, Salmonella enterica enterica serovar Typhi
auucagaccccugugauuuaugu

SEQ ID NO: 3650710 - RNA, 13 nt, Salmonella enterica enterica serovar Typhi
auucagagcgucc

SEQ ID NO: 3650711 - RNA, 17 nt, Salmonella enterica enterica serovar Typhi
auucagagcguccacgc

SEQ ID NO: 3650712 - RNA, 17 nt, Salmonella enterica enterica serovar Typhi
auucagauccgaggcgu

SEQ ID NO: 3650713 - RNA, 17 nt, Salmonella enterica enterica serovar Typhi
auucagcacccagcgaa

SEQ ID NO: 3650714 - RNA, 15 nt, Salmonella enterica enterica serovar Typhi
auucagcaguucauu

SEQ ID NO: 3650715 - RNA, 13 nt, Salmonella enterica enterica serovar Typhi
auucagcggcugc

SEQ ID NO: 3650716 - RNA, 20 nt, Salmonella enterica enterica serovar Typhi
auucagcugcggcugaacca

SEQ ID NO: 3650717 - RNA, 16 nt, Salmonella enterica enterica serovar Typhi
auucaggccgccagca

SEQ ID NO: 3650718 - RNA, 17 nt, Salmonella enterica enterica serovar Typhi
auucaggccgccagcaa

SEQ ID NO: 3650719 - RNA, 16 nt, Salmonella enterica enterica serovar Typhi
auucaggcuuuccacg

SEQ ID NO: 3650720 - RNA, 20 nt, Salmonella enterica enterica serovar Typhi
auucagggaacguugcgcca

SEQ ID NO: 3650721 - RNA, 21 nt, Salmonella enterica enterica serovar Typhi
auucagggaacguugcgccau

SEQ ID NO: 3650722 - RNA, 16 nt, Salmonella enterica enterica serovar Typhi
auucaggguugucuca

SEQ ID NO: 3650723 - RNA, 18 nt, Salmonella enterica enterica serovar Typhi
auucagguggauuuuugc

SEQ ID NO: 3650724 - RNA, 17 nt, Salmonella enterica enterica serovar Typhi
auucagguuaauaacug

SEQ ID NO: 3650725 - RNA, 21 nt, Salmonella enterica enterica serovar Typhi
auucagguuauuugccucugg

SEQ ID NO: 3650726 - RNA, 16 nt, Salmonella enterica enterica serovar Typhi
auucaguaagagggug

SEQ ID NO: 3650727 - RNA, 16 nt, Salmonella enterica enterica serovar Typhi
auucauaccuuuaagc

SEQ ID NO: 3650728 - RNA, 15 nt, Salmonella enterica enterica serovar Typhi
auucauagccacagc

SEQ ID NO: 3650729 - RNA, 15 nt, Salmonella enterica enterica serovar Typhi
auucaucaucuuguc

SEQ ID NO: 3650730 - RNA, 16 nt, Salmonella enterica enterica serovar Typhi
auucaucaucuugucc

SEQ ID NO: 3650731 - RNA, 20 nt, Salmonella enterica enterica serovar Typhi
auucaucgauacgcggaugu

SEQ ID NO: 3650732 - RNA, 15 nt, Salmonella enterica enterica serovar Typhi
auucaugaucuuucc

SEQ ID NO: 3650733 - RNA, 19 nt, Salmonella enterica enterica serovar Typhi
auucaugcaacuucaccuc

SEQ ID NO: 3650734 - RNA, 19 nt, Salmonella enterica enterica serovar Typhi
auucaugccagaagcaaau

SEQ ID NO: 3650735 - RNA, 23 nt, Salmonella enterica enterica serovar Typhi
auucaugccagaagcaaauucag

SEQ ID NO: 3650736 - RNA, 20 nt, Salmonella enterica enterica serovar Typhi
auucaugguacucaacauca

SEQ ID NO: 3650737 - RNA, 22 nt, Salmonella enterica enterica serovar Typhi
auucauuaaaauugaacggacg

SEQ ID NO: 3650738 - RNA, 14 nt, Salmonella enterica enterica serovar Typhi
auucauuauuuuua

SEQ ID NO: 3650739 - RNA, 16 nt, Salmonella enterica enterica serovar Typhi
auucauuauuuuuaaa

SEQ ID NO: 3650740 - RNA, 17 nt, Salmonella enterica enterica serovar Typhi
auucauuauuuuuaaau

SEQ ID NO: 3650741 - RNA, 22 nt, Salmonella enterica enterica serovar Typhi
auucauuauuuuuaaauaacuu

SEQ ID NO: 3650742 - RNA, 22 nt, Salmonella enterica enterica serovar Typhi
auucauuguccguaauuugcuu

SEQ ID NO: 3650743 - RNA, 14 nt, Salmonella enterica enterica serovar Typhi
auucauuucaaugu

SEQ ID NO: 3650744 - RNA, 14 nt, Salmonella enterica enterica serovar Typhi
auucauuuccagca

SEQ ID NO: 3650745 - RNA, 12 nt, Salmonella enterica enterica serovar Typhi
auuccaccacgu

SEQ ID NO: 3650746 - RNA, 14 nt, Salmonella enterica enterica serovar Typhi
auuccagaaaggau

SEQ ID NO: 3650747 - RNA, 15 nt, Salmonella enterica enterica serovar Typhi
auuccagaaucuggc

SEQ ID NO: 3650748 - RNA, 21 nt, Salmonella enterica enterica serovar Typhi
auuccagccgguguuaaccag

SEQ ID NO: 3650749 - RNA, 22 nt, Salmonella enterica enterica serovar Typhi
auuccagccgguguuaaccaga

SEQ ID NO: 3650750 - RNA, 22 nt, Salmonella enterica enterica serovar Typhi
auuccagcgugccgagcaacag

SEQ ID NO: 3650751 - RNA, 18 nt, Salmonella enterica enterica serovar Typhi
auuccagggcauuuuuuc

SEQ ID NO: 3650752 - RNA, 22 nt, Salmonella enterica enterica serovar Typhi
auuccagggcauuuuuuccagu

SEQ ID NO: 3650753 - RNA, 19 nt, Salmonella enterica enterica serovar Typhi
auuccaguagcgcgcccau

SEQ ID NO: 3650754 - RNA, 12 nt, Salmonella enterica enterica serovar Typhi
auuccagucauu

SEQ ID NO: 3650755 - RNA, 14 nt, Salmonella enterica enterica serovar Typhi
auuccaguccuuuc

SEQ ID NO: 3650756 - RNA, 15 nt, Salmonella enterica enterica serovar Typhi
auuccagucgcucca

SEQ ID NO: 3650757 - RNA, 20 nt, Salmonella enterica enterica serovar Typhi
auuccauauaacagaauaag

SEQ ID NO: 3650758 - RNA, 13 nt, Salmonella enterica enterica serovar Typhi
auuccaucggcau

SEQ ID NO: 3650759 - RNA, 13 nt, Salmonella enterica enterica serovar Typhi
auuccauuggcca

SEQ ID NO: 3650760 - RNA, 20 nt, Salmonella enterica enterica serovar Typhi
auucccacgcauaguccugc

SEQ ID NO: 3650761 - RNA, 12 nt, Salmonella enterica enterica serovar Typhi
auucccaggcaa

SEQ ID NO: 3650762 - RNA, 16 nt, Salmonella enterica enterica serovar Typhi
auucccccauccgcgc

SEQ ID NO: 3650763 - RNA, 18 nt, Salmonella enterica enterica serovar Typhi
auucccggcggaaaugcg

SEQ ID NO: 3650764 - RNA, 18 nt, Salmonella enterica enterica serovar Typhi
auucccguaaaagaagaa

SEQ ID NO: 3650765 - RNA, 16 nt, Salmonella enterica enterica serovar Typhi
auucccgucccugcau

SEQ ID NO: 3650766 - RNA, 19 nt, Salmonella enterica enterica serovar Typhi
auucccugguucgaaucca

SEQ ID NO: 3650767 - RNA, 21 nt, Salmonella enterica enterica serovar Typhi
auucccugguucgaauccagg

SEQ ID NO: 3650768 - RNA, 13 nt, Salmonella enterica enterica serovar Typhi
auucccuucucgc

SEQ ID NO: 3650769 - RNA, 22 nt, Salmonella enterica enterica serovar Typhi
auuccgaaagaaagacgcugaa

SEQ ID NO: 3650770 - RNA, 21 nt, Salmonella enterica enterica serovar Typhi
auuccgacagugaacggcaua

SEQ ID NO: 3650771 - RNA, 15 nt, Salmonella enterica enterica serovar Typhi
auuccgaugaaaaac

SEQ ID NO: 3650772 - RNA, 14 nt, Salmonella enterica enterica serovar Typhi
auugaccaggagca

SEQ ID NO: 3650773 - RNA, 16 nt, Salmonella enterica enterica serovar Typhi
auugacccucccugcg

SEQ ID NO: 3650774 - RNA, 18 nt, Salmonella enterica enterica serovar Typhi
auugaccguccccagcca

SEQ ID NO: 3650775 - RNA, 20 nt, Salmonella enterica enterica serovar Typhi
auugaccguccccagccaga

SEQ ID NO: 3650776 - RNA, 13 nt, Salmonella enterica enterica serovar Typhi
auugaccuucaug

SEQ ID NO: 3650777 - RNA, 14 nt, Salmonella enterica enterica serovar Typhi
auugacuucaacgc

SEQ ID NO: 3650778 - RNA, 15 nt, Salmonella enterica enterica serovar Typhi
auugagacaaauaac

SEQ ID NO: 3650779 - RNA, 14 nt, Salmonella enterica enterica serovar Typhi
auugagacaugccg

SEQ ID NO: 3650780 - RNA, 19 nt, Salmonella enterica enterica serovar Typhi
auugaggcggguaauuugc

SEQ ID NO: 3650781 - RNA, 15 nt, Salmonella enterica enterica serovar Typhi
auugaggcuacccag

SEQ ID NO: 3650782 - RNA, 16 nt, Salmonella enterica enterica serovar Typhi
auugaggcuacccaga

SEQ ID NO: 3650783 - RNA, 18 nt, Salmonella enterica enterica serovar Typhi
auugaggcuacccagaca

SEQ ID NO: 3650784 - RNA, 22 nt, Salmonella enterica enterica serovar Typhi
auugaguaaauaaaucagcgcg

SEQ ID NO: 3650785 - RNA, 18 nt, Salmonella enterica enterica serovar Typhi
auugaguggacaucgcca

SEQ ID NO: 3650786 - RNA, 14 nt, Salmonella enterica enterica serovar Typhi
auugauauuccgcg

SEQ ID NO: 3650787 - RNA, 18 nt, Salmonella enterica enterica serovar Typhi
auugaucacaaaaucauu

SEQ ID NO: 3650788 - RNA, 21 nt, Salmonella enterica enterica serovar Typhi
auugaucacaaaaucauugcg

SEQ ID NO: 3650789 - RNA, 22 nt, Salmonella enterica enterica serovar Typhi
auugaucacaaaaucauugcgu

SEQ ID NO: 3650790 - RNA, 20 nt, Salmonella enterica enterica serovar Typhi
auugaugccugcccaucuaa

SEQ ID NO: 3650791 - RNA, 14 nt, Salmonella enterica enterica serovar Typhi
auugauucugugau

SEQ ID NO: 3650792 - RNA, 17 nt, Salmonella enterica enterica serovar Typhi
auugauuggcaaacugu

SEQ ID NO: 3650793 - RNA, 13 nt, Salmonella enterica enterica serovar Typhi
auugauuuuucug

SEQ ID NO: 3650794 - RNA, 15 nt, Salmonella enterica enterica serovar Typhi
auugauuuuucuggu

SEQ ID NO: 3650795 - RNA, 22 nt, Salmonella enterica enterica serovar Typhi
auugcaacgaucccuaauaaaa

SEQ ID NO: 3650796 - RNA, 16 nt, Salmonella enterica enterica serovar Typhi
auugcagaauauguuc

SEQ ID NO: 3650797 - RNA, 20 nt, Salmonella enterica enterica serovar Typhi
auugcagcgguaaacaccac

SEQ ID NO: 3650798 - RNA, 22 nt, Salmonella enterica enterica serovar Typhi
auugcagggugcagcaaauaau

SEQ ID NO: 3650799 - RNA, 13 nt, Salmonella enterica enterica serovar Typhi
auugcaucaucgg

SEQ ID NO: 3650800 - RNA, 21 nt, Salmonella enterica enterica serovar Typhi
auugccacuuaauaucaauau

SEQ ID NO: 3650801 - RNA, 12 nt, Salmonella enterica enterica serovar Typhi
auugccaggacu

SEQ ID NO: 3650802 - RNA, 23 nt, Salmonella enterica enterica serovar Typhi
auugccaguccggaugucucagc

SEQ ID NO: 3650803 - RNA, 23 nt, Salmonella enterica enterica serovar Typhi
auugccauaaauacaauucaacu

SEQ ID NO: 3650804 - RNA, 20 nt, Salmonella enterica enterica serovar Typhi
auugccaugaugagcgccau

SEQ ID NO: 3650805 - RNA, 20 nt, Salmonella enterica enterica serovar Typhi
auugccaugcgacuaaccug

SEQ ID NO: 3650806 - RNA, 18 nt, Salmonella enterica enterica serovar Typhi
auugccauguuaauacca

SEQ ID NO: 3650807 - RNA, 13 nt, Salmonella enterica enterica serovar Typhi
auugcccaccggc

SEQ ID NO: 3650808 - RNA, 17 nt, Salmonella enterica enterica serovar Typhi
auugcccaucgcgccau

SEQ ID NO: 3650809 - RNA, 17 nt, Salmonella enterica enterica serovar Typhi
auugcccgcggcgaucu

SEQ ID NO: 3650810 - RNA, 15 nt, Salmonella enterica enterica serovar Typhi
auugcccuuuuguuu

SEQ ID NO: 3650811 - RNA, 17 nt, Salmonella enterica enterica serovar Typhi
auugcccuuuuguuuuu

SEQ ID NO: 3650812 - RNA, 13 nt, Salmonella enterica enterica serovar Typhi
auugccgaccauu

SEQ ID NO: 3650813 - RNA, 21 nt, Salmonella enterica enterica serovar Typhi
auugccgaccgccagcagagc

SEQ ID NO: 3650814 - RNA, 18 nt, Salmonella enterica enterica serovar Typhi
auugccgccagcuccugc

SEQ ID NO: 3650815 - RNA, 18 nt, Salmonella enterica enterica serovar Typhi
auugccgcgcccugcgga

SEQ ID NO: 3650816 - RNA, 19 nt, Salmonella enterica enterica serovar Typhi
auugccggauggcggcgua

SEQ ID NO: 3650817 - RNA, 21 nt, Salmonella enterica enterica serovar Typhi
auugccguuguugucaauauc

SEQ ID NO: 3650818 - RNA, 15 nt, Salmonella enterica enterica serovar Typhi
auugccuaaauaacu

SEQ ID NO: 3650819 - RNA, 17 nt, Salmonella enterica enterica serovar Typhi
auugccuuccaggcggu

SEQ ID NO: 3650820 - RNA, 17 nt, Salmonella enterica enterica serovar Typhi
auugcgaauaaaacugc

SEQ ID NO: 3650821 - RNA, 13 nt, Salmonella enterica enterica serovar Typhi
auugcgagaaaaa

SEQ ID NO: 3650822 - RNA, 14 nt, Salmonella enterica enterica serovar Typhi
auugcgagaaaaaa

SEQ ID NO: 3650823 - RNA, 21 nt, Salmonella enterica enterica serovar Typhi
auugcgaucuccuuuaaugaa

SEQ ID NO: 3650824 - RNA, 13 nt, Salmonella enterica enterica serovar Typhi
auugcgccaccuu

SEQ ID NO: 3650825 - RNA, 14 nt, Salmonella enterica enterica serovar Typhi
auugcgccaccuua

SEQ ID NO: 3650826 - RNA, 16 nt, Salmonella enterica enterica serovar Typhi
auugcgccccagcaca

SEQ ID NO: 3650827 - RNA, 19 nt, Salmonella enterica enterica serovar Typhi
auugcggggguuguuuuac

SEQ ID NO: 3650828 - RNA, 16 nt, Salmonella enterica enterica serovar Typhi
auugcguaaugagcgu

SEQ ID NO: 3650829 - RNA, 13 nt, Salmonella enterica enterica serovar Typhi
auugcguugcuuu

SEQ ID NO: 3650830 - RNA, 22 nt, Salmonella enterica enterica serovar Typhi
auugcucuuccggcauaaaaag

SEQ ID NO: 3650831 - RNA, 21 nt, Salmonella enterica enterica serovar Typhi
auugcucuuuuaucguugcuu

SEQ ID NO: 3650832 - RNA, 15 nt, Salmonella enterica enterica serovar Typhi
auugcugaagauaaa

SEQ ID NO: 3650833 - RNA, 19 nt, Salmonella enterica enterica serovar Typhi
auugcugacgcgcuuuuuc

SEQ ID NO: 3650834 - RNA, 14 nt, Salmonella enterica enterica serovar Typhi
auugcugccuuauc

SEQ ID NO: 3650835 - RNA, 20 nt, Salmonella enterica enterica serovar Typhi
auugcugcuauauaacauau

SEQ ID NO: 3650836 - RNA, 14 nt, Salmonella enterica enterica serovar Typhi
auugcugcuauuuc

SEQ ID NO: 3650837 - RNA, 19 nt, Salmonella enterica enterica serovar Typhi
auugcuggcagaugaacau

SEQ ID NO: 3650838 - RNA, 15 nt, Salmonella enterica enterica serovar Typhi
auugcuguauuuuau

SEQ ID NO: 3650839 - RNA, 20 nt, Salmonella enterica enterica serovar Typhi
auugcugugaaguaauucuu

SEQ ID NO: 3650840 - RNA, 18 nt, Salmonella enterica enterica serovar Typhi
auugcuuucaauuuccgc

SEQ ID NO: 3650841 - RNA, 17 nt, Salmonella enterica enterica serovar Typhi
auuggaaaaccccaucc

SEQ ID NO: 3650842 - RNA, 18 nt, Salmonella enterica enterica serovar Typhi
auuggaaaacuccagcag

SEQ ID NO: 3650843 - RNA, 20 nt, Salmonella enterica enterica serovar Typhi
auuggcaaaccccugcucgc

SEQ ID NO: 3650844 - RNA, 19 nt, Salmonella enterica enterica serovar Typhi
auuggcaauuaaaccaccg

SEQ ID NO: 3650845 - RNA, 20 nt, Salmonella enterica enterica serovar Typhi
auuggcacgaaaguguggca

SEQ ID NO: 3650846 - RNA, 15 nt, Salmonella enterica enterica serovar Typhi
auuggcggcaaagaa

SEQ ID NO: 3650847 - RNA, 23 nt, Salmonella enterica enterica serovar Typhi
auuggcgucgacgugucuaugcu

SEQ ID NO: 3650848 - RNA, 15 nt, Salmonella enterica enterica serovar Typhi
auuggcguuuuauga

SEQ ID NO: 3650849 - RNA, 14 nt, Salmonella enterica enterica serovar Typhi
auuggcugccgaca

SEQ ID NO: 3650850 - RNA, 23 nt, Salmonella enterica enterica serovar Typhi
auugggccagcagcgcaucaucc

SEQ ID NO: 3650851 - RNA, 19 nt, Salmonella enterica enterica serovar Typhi
auuggguaguaauauuaaa

SEQ ID NO: 3650852 - RNA, 15 nt, Salmonella enterica enterica serovar Typhi
auugguagacgcacc

SEQ ID NO: 3650853 - RNA, 17 nt, Salmonella enterica enterica serovar Typhi
auuggucauucggcggu

SEQ ID NO: 3650854 - RNA, 14 nt, Salmonella enterica enterica serovar Typhi
auuggucugauuca

SEQ ID NO: 3650855 - RNA, 17 nt, Salmonella enterica enterica serovar Typhi
auuggugaaaaaucauu

SEQ ID NO: 3650856 - RNA, 15 nt, Salmonella enterica enterica serovar Typhi
auuggugauauaaac

SEQ ID NO: 3650857 - RNA, 16 nt, Salmonella enterica enterica serovar Typhi
auuguagcugcgccag

SEQ ID NO: 3650858 - RNA, 21 nt, Salmonella enterica enterica serovar Typhi
auuuccagugccaguuaagca

SEQ ID NO: 3650859 - RNA, 14 nt, Salmonella enterica enterica serovar Typhi
auuuccauauuaac

SEQ ID NO: 3650860 - RNA, 13 nt, Salmonella enterica enterica serovar Typhi
auuuccauuuuuc

SEQ ID NO: 3650861 - RNA, 14 nt, Salmonella enterica enterica serovar Typhi
auuuccauuuuuca

SEQ ID NO: 3650862 - RNA, 15 nt, Salmonella enterica enterica serovar Typhi
auuucccccacuucu

SEQ ID NO: 3650863 - RNA, 14 nt, Salmonella enterica enterica serovar Typhi
auuucccuucaauc

SEQ ID NO: 3650864 - RNA, 16 nt, Salmonella enterica enterica serovar Typhi
auuuccgccauuuuuc

SEQ ID NO: 3650865 - RNA, 17 nt, Salmonella enterica enterica serovar Typhi
auuuccgcgcaaucgcc

SEQ ID NO: 3650866 - RNA, 16 nt, Salmonella enterica enterica serovar Typhi
auuuccgcuucgcggg

SEQ ID NO: 3650867 - RNA, 21 nt, Salmonella enterica enterica serovar Typhi
auuuccggaccguuaucaaaa

SEQ ID NO: 3650868 - RNA, 21 nt, Salmonella enterica enterica serovar Typhi
auuuccgguuccagcggccgc

SEQ ID NO: 3650869 - RNA, 20 nt, Salmonella enterica enterica serovar Typhi
auuucgaaacaggaaaaaca

SEQ ID NO: 3650870 - RNA, 22 nt, Salmonella enterica enterica serovar Typhi
auuucgacgucaacgguaaaau

SEQ ID NO: 3650871 - RNA, 13 nt, Salmonella enterica enterica serovar Typhi
auuucgaucggcc

SEQ ID NO: 3650872 - RNA, 17 nt, Salmonella enterica enterica serovar Typhi
auuucgaugaugaccga

SEQ ID NO: 3650873 - RNA, 12 nt, Salmonella enterica enterica serovar Typhi
auuucgauggua

SEQ ID NO: 3650874 - RNA, 17 nt, Salmonella enterica enterica serovar Typhi
auuucgccccacuggcc

SEQ ID NO: 3650875 - RNA, 21 nt, Salmonella enterica enterica serovar Typhi
auuucgccccacuggcccccu

SEQ ID NO: 3650876 - RNA, 13 nt, Salmonella enterica enterica serovar Typhi
auuucgccgccau

SEQ ID NO: 3650877 - RNA, 13 nt, Salmonella enterica enterica serovar Typhi
auuucgccgccgc

SEQ ID NO: 3650878 - RNA, 19 nt, Salmonella enterica enterica serovar Typhi
auuucgccuauuuucucuu

SEQ ID NO: 3650879 - RNA, 19 nt, Salmonella enterica enterica serovar Typhi
auuucgcgaauaaucuguu

SEQ ID NO: 3650880 - RNA, 15 nt, Salmonella enterica enterica serovar Typhi
auuucgcguucgcuu

SEQ ID NO: 3650881 - RNA, 20 nt, Salmonella enterica enterica serovar Typhi
auuucgcuggcggccccucu

SEQ ID NO: 3650882 - RNA, 22 nt, Salmonella enterica enterica serovar Typhi
auuucgcuggcggccccucuuc

SEQ ID NO: 3650883 - RNA, 16 nt, Salmonella enterica enterica serovar Typhi
auuucggaaugagaga

SEQ ID NO: 3650884 - RNA, 19 nt, Salmonella enterica enterica serovar Typhi
auuucggcgcuguuuuccg

SEQ ID NO: 3650885 - RNA, 15 nt, Salmonella enterica enterica serovar Typhi
auuucguagccgcgc

SEQ ID NO: 3650886 - RNA, 23 nt, Salmonella enterica enterica serovar Typhi
auuucguagccgcgcgccgccuc

SEQ ID NO: 3650887 - RNA, 22 nt, Salmonella enterica enterica serovar Typhi
auuucguccggcugccacucuu

SEQ ID NO: 3650888 - RNA, 20 nt, Salmonella enterica enterica serovar Typhi
auuucgucgauguuacgacc

SEQ ID NO: 3650889 - RNA, 17 nt, Salmonella enterica enterica serovar Typhi
auuucuccgcccaucca

SEQ ID NO: 3650890 - RNA, 13 nt, Salmonella enterica enterica serovar Typhi
auuucuccugcau

SEQ ID NO: 3650891 - RNA, 15 nt, Salmonella enterica enterica serovar Typhi
auuucuccugcgcca

SEQ ID NO: 3650892 - RNA, 16 nt, Salmonella enterica enterica serovar Typhi
auuucuccugcgccag

SEQ ID NO: 3650893 - RNA, 18 nt, Salmonella enterica enterica serovar Typhi
auuucuccugcgccagcc

SEQ ID NO: 3650894 - RNA, 13 nt, Salmonella enterica enterica serovar Typhi
auuucucgcccgc

SEQ ID NO: 3650895 - RNA, 15 nt, Salmonella enterica enterica serovar Typhi
auuucucgccgccau

SEQ ID NO: 3650896 - RNA, 15 nt, Salmonella enterica enterica serovar Typhi
auuucucgccgccgg

SEQ ID NO: 3650897 - RNA, 19 nt, Salmonella enterica enterica serovar Typhi
auuucucuuuuauuauuuu

SEQ ID NO: 3650898 - RNA, 18 nt, Salmonella enterica enterica serovar Typhi
auuucugaccacauuuuc

SEQ ID NO: 3650899 - RNA, 17 nt, Salmonella enterica enterica serovar Typhi
auuucugccugcuucag

SEQ ID NO: 3650900 - RNA, 22 nt, Salmonella enterica enterica serovar Typhi
auuucugccugcuucagacaac

SEQ ID NO: 3650901 - RNA, 13 nt, Salmonella enterica enterica serovar Typhi
auuucugcugcca

SEQ ID NO: 3650902 - RNA, 17 nt, Salmonella enterica enterica serovar Typhi
auuucugcugccagcgc

SEQ ID NO: 3650903 - RNA, 17 nt, Salmonella enterica enterica serovar Typhi
auuucuuaauuccucag

SEQ ID NO: 3650904 - RNA, 20 nt, Salmonella enterica enterica serovar Typhi
auuucuuacauuuuuaccga

SEQ ID NO: 3650905 - RNA, 14 nt, Salmonella enterica enterica serovar Typhi
auuucuuagcgcca

SEQ ID NO: 3650906 - RNA, 20 nt, Salmonella enterica enterica serovar Typhi
auuucuugagcggcaucacu

SEQ ID NO: 3650907 - RNA, 19 nt, Salmonella enterica enterica serovar Typhi
auuucuuugguuucgcggu

SEQ ID NO: 3650908 - RNA, 10 nt, Salmonella enterica enterica serovar Typhi
auuugauuua

SEQ ID NO: 3650909 - RNA, 17 nt, Salmonella enterica enterica serovar Typhi
auuugauuuauuuugaa

SEQ ID NO: 3650910 - RNA, 15 nt, Salmonella enterica enterica serovar Typhi
auuugcaucaaacuu

SEQ ID NO: 3650911 - RNA, 13 nt, Salmonella enterica enterica serovar Typhi
auuugcgcaguuu

SEQ ID NO: 3650912 - RNA, 17 nt, Salmonella enterica enterica serovar Typhi
auuugcggcgucgccug

SEQ ID NO: 3650913 - RNA, 17 nt, Salmonella enterica enterica serovar Typhi
auuugcgucguuaacug

SEQ ID NO: 3650914 - RNA, 15 nt, Salmonella enterica enterica serovar Typhi
auuugcgugucauca

SEQ ID NO: 3650915 - RNA, 11 nt, Salmonella enterica enterica serovar Typhi
auuugcucagu

SEQ ID NO: 3650916 - RNA, 13 nt, Salmonella enterica enterica serovar Typhi
auuugcugcaacg

SEQ ID NO: 3650917 - RNA, 22 nt, Salmonella enterica enterica serovar Typhi
auuugcugcauuucuuguugac

SEQ ID NO: 3650918 - RNA, 14 nt, Salmonella enterica enterica serovar Typhi
auuugcuguuuuau

SEQ ID NO: 3650919 - RNA, 13 nt, Salmonella enterica enterica serovar Typhi
auuugcuguuuuu

SEQ ID NO: 3650920 - RNA, 23 nt, Salmonella enterica enterica serovar Typhi
auuugcuguuuuuuguugauuuu

SEQ ID NO: 3650921 - RNA, 22 nt, Salmonella enterica enterica serovar Typhi
auuuggcguaaucgauaagcuc

SEQ ID NO: 3650922 - RNA, 23 nt, Salmonella enterica enterica serovar Typhi
auuugguuagggaucaucuucac

SEQ ID NO: 3650923 - RNA, 16 nt, Salmonella enterica enterica serovar Typhi
auuugucagacaugau

SEQ ID NO: 3650924 - RNA, 22 nt, Salmonella enterica enterica serovar Typhi
auuugugagcuauacgguaaau

SEQ ID NO: 3650925 - RNA, 13 nt, Salmonella enterica enterica serovar Typhi
auuugugauaaag

SEQ ID NO: 3650926 - RNA, 19 nt, Salmonella enterica enterica serovar Typhi
auuugugauugcagauaau

SEQ ID NO: 3650927 - RNA, 14 nt, Salmonella enterica enterica serovar Typhi
auuuguuaguccgc

SEQ ID NO: 3650928 - RNA, 15 nt, Salmonella enterica enterica serovar Typhi
auuuguugacugucu

SEQ ID NO: 3650929 - RNA, 15 nt, Salmonella enterica enterica serovar Typhi
auuuguuucaucgcc

SEQ ID NO: 3650930 - RNA, 14 nt, Salmonella enterica enterica serovar Typhi
auuuuaaauacacc

SEQ ID NO: 3650931 - RNA, 18 nt, Salmonella enterica enterica serovar Typhi
auuuuaaauuuccucuug

SEQ ID NO: 3650932 - RNA, 21 nt, Salmonella enterica enterica serovar Typhi
auuuuaaauuuccucuuguca

SEQ ID NO: 3650933 - RNA, 13 nt, Salmonella enterica enterica serovar Typhi
auuuuaacaucac

SEQ ID NO: 3650934 - RNA, 23 nt, Salmonella enterica enterica serovar Typhi
auuuuaccuucgcguuuaucacc

SEQ ID NO: 3650935 - RNA, 14 nt, Salmonella enterica enterica serovar Typhi
auuuuacgagaacc

SEQ ID NO: 3650936 - RNA, 15 nt, Salmonella enterica enterica serovar Typhi
auuuuacuaaugaau

SEQ ID NO: 3650937 - RNA, 17 nt, Salmonella enterica enterica serovar Typhi
auuuuagaaauagaaau

SEQ ID NO: 3650938 - RNA, 21 nt, Salmonella enterica enterica serovar Typhi
auuuuagaaauagaaauugca

SEQ ID NO: 3650939 - RNA, 15 nt, Salmonella enterica enterica serovar Typhi
auuuuagcgcaucgc

SEQ ID NO: 3650940 - RNA, 16 nt, Salmonella enterica enterica serovar Typhi
auuuuauagcagucag

SEQ ID NO: 3650941 - RNA, 16 nt, Salmonella enterica enterica serovar Typhi
auuuuaugaugcauuu

SEQ ID NO: 3650942 - RNA, 21 nt, Salmonella enterica enterica serovar Typhi
auuuuauggaggauauaaaaa

SEQ ID NO: 3650943 - RNA, 14 nt, Salmonella enterica enterica serovar Typhi
auuuuauuuaaaaa

SEQ ID NO: 3650944 - RNA, 21 nt, Salmonella enterica enterica serovar Typhi
caaaacgucgugaguggcggc

SEQ ID NO: 3650945 - RNA, 12 nt, Salmonella enterica enterica serovar Typhi
caaaacuauuuu

SEQ ID NO: 3650946 - RNA, 21 nt, Salmonella enterica enterica serovar Typhi
caaaacuuauuuuauuuuuau

SEQ ID NO: 3650947 - RNA, 22 nt, Salmonella enterica enterica serovar Typhi
caaaagaggaaguugcucccgc

SEQ ID NO: 3650948 - RNA, 17 nt, Salmonella enterica enterica serovar Typhi
caaaagaggcuaauuau

SEQ ID NO: 3650949 - RNA, 16 nt, Salmonella enterica enterica serovar Typhi
caaaagcaucaauuug

SEQ ID NO: 3650950 - RNA, 15 nt, Salmonella enterica enterica serovar Typhi
caaaagccagauaaa

SEQ ID NO: 3650951 - RNA, 20 nt, Salmonella enterica enterica serovar Typhi
caaaagcgguuaagauacau

SEQ ID NO: 3650952 - RNA, 12 nt, Salmonella enterica enterica serovar Typhi
caaaaggcagac

SEQ ID NO: 3650953 - RNA, 15 nt, Salmonella enterica enterica serovar Typhi
caaaaggcuggaaca

SEQ ID NO: 3650954 - RNA, 17 nt, Salmonella enterica enterica serovar Typhi
caaaaggcuggaacaga

SEQ ID NO: 3650955 - RNA, 18 nt, Salmonella enterica enterica serovar Typhi
caaaaggcuggaacagau

SEQ ID NO: 3650956 - RNA, 21 nt, Salmonella enterica enterica serovar Typhi
caaaaggcuggaacagauguu

SEQ ID NO: 3650957 - RNA, 23 nt, Salmonella enterica enterica serovar Typhi
caaaaggucgauuaaacgccugg

SEQ ID NO: 3650958 - RNA, 18 nt, Salmonella enterica enterica serovar Typhi
caaaauaacgcuucaccu

SEQ ID NO: 3650959 - RNA, 15 nt, Salmonella enterica enterica serovar Typhi
caaaauaagucauau

SEQ ID NO: 3650960 - RNA, 16 nt, Salmonella enterica enterica serovar Typhi
caaaauaauaaaaauc

SEQ ID NO: 3650961 - RNA, 19 nt, Salmonella enterica enterica serovar Typhi
caaaauaauacguuuauuc

SEQ ID NO: 3650962 - RNA, 18 nt, Salmonella enterica enterica serovar Typhi
caaaauauauaauuuaua

SEQ ID NO: 3650963 - RNA, 22 nt, Salmonella enterica enterica serovar Typhi
caaaauaugggauuugaugccc

SEQ ID NO: 3650964 - RNA, 16 nt, Salmonella enterica enterica serovar Typhi
caaaaucaaacagaau

SEQ ID NO: 3650965 - RNA, 14 nt, Salmonella enterica enterica serovar Typhi
caaaaucacgcaca

SEQ ID NO: 3650966 - RNA, 20 nt, Salmonella enterica enterica serovar Typhi
caaaaucacgcacacgucug

SEQ ID NO: 3650967 - RNA, 17 nt, Salmonella enterica enterica serovar Typhi
caaaaucaggcaucccg

SEQ ID NO: 3650968 - RNA, 14 nt, Salmonella enterica enterica serovar Typhi
caaaaucaucauca

SEQ ID NO: 3650969 - RNA, 19 nt, Salmonella enterica enterica serovar Typhi
caaaaucgcccaggccuga

SEQ ID NO: 3650970 - RNA, 12 nt, Salmonella enterica enterica serovar Typhi
caaaaugaggac

SEQ ID NO: 3650971 - RNA, 17 nt, Salmonella enterica enterica serovar Typhi
caaaaugcgcaaagcau

SEQ ID NO: 3650972 - RNA, 19 nt, Salmonella enterica enterica serovar Typhi
caaaauggcaaguaaaaua

SEQ ID NO: 3650973 - RNA, 22 nt, Salmonella enterica enterica serovar Typhi
caaaaugugcaaucacacuaca

SEQ ID NO: 3650974 - RNA, 13 nt, Salmonella enterica enterica serovar Typhi
caaaauuaaucgc

SEQ ID NO: 3650975 - RNA, 20 nt, Salmonella enterica enterica serovar Typhi
caaaauuaaucgccagcagc

SEQ ID NO: 3650976 - RNA, 20 nt, Salmonella enterica enterica serovar Typhi
caaaauuugugguggucauc

SEQ ID NO: 3650977 - RNA, 22 nt, Salmonella enterica enterica serovar Typhi
caaaauuugugguggucauccg

SEQ ID NO: 3650978 - RNA, 18 nt, Salmonella enterica enterica serovar Typhi
caaaauuuuuuaucaggu

SEQ ID NO: 3650979 - RNA, 14 nt, Salmonella enterica enterica serovar Typhi
caaacaacccggcu

SEQ ID NO: 3650980 - RNA, 21 nt, Salmonella enterica enterica serovar Typhi
caaacacagccaucuucugcg

SEQ ID NO: 3650981 - RNA, 14 nt, Salmonella enterica enterica serovar Typhi
caaacaccaccagu

SEQ ID NO: 3650982 - RNA, 19 nt, Salmonella enterica enterica serovar Typhi
caaacaccucagccaccca

SEQ ID NO: 3650983 - RNA, 16 nt, Salmonella enterica enterica serovar Typhi
caaacaccugaaccag

SEQ ID NO: 3650984 - RNA, 14 nt, Salmonella enterica enterica serovar Typhi
caaacacgaccagc

SEQ ID NO: 3650985 - RNA, 12 nt, Salmonella enterica enterica serovar Typhi
caaacagcagaa

SEQ ID NO: 3650986 - RNA, 19 nt, Salmonella enterica enterica serovar Typhi
caaacagcagaacaaccag

SEQ ID NO: 3650987 - RNA, 18 nt, Salmonella enterica enterica serovar Typhi
caaacagcgacucgcugg

SEQ ID NO: 3650988 - RNA, 23 nt, Salmonella enterica enterica serovar Typhi
caaacagcgcgcccgccaccagc

SEQ ID NO: 3650989 - RNA, 16 nt, Salmonella enterica enterica serovar Typhi
caaacagugaaaaaac

SEQ ID NO: 3650990 - RNA, 18 nt, Salmonella enterica enterica serovar Typhi
caaacaguucagacacca

SEQ ID NO: 3650991 - RNA, 13 nt, Salmonella enterica enterica serovar Typhi
caaacaguuccug

SEQ ID NO: 3650992 - RNA, 14 nt, Salmonella enterica enterica serovar Typhi
caaacaugcggcuu

SEQ ID NO: 3650993 - RNA, 16 nt, Salmonella enterica enterica serovar Typhi
caaacauuagcggugc

SEQ ID NO: 3650994 - RNA, 22 nt, Salmonella enterica enterica serovar Typhi
caaaccaacaucgcugaauuuc

SEQ ID NO: 3650995 - RNA, 21 nt, Salmonella enterica enterica serovar Typhi
caaaccacagugaugacggca

SEQ ID NO: 3650996 - RNA, 21 nt, Salmonella enterica enterica serovar Typhi
caaaccagacgcguaaccccu

SEQ ID NO: 3650997 - RNA, 16 nt, Salmonella enterica enterica serovar Typhi
caaaccagcuuuucau

SEQ ID NO: 3650998 - RNA, 14 nt, Salmonella enterica enterica serovar Typhi
caaaccaucgucgg

SEQ ID NO: 3650999 - RNA, 23 nt, Salmonella enterica enterica serovar Typhi
caaaccccggacacaugaccuga

SEQ ID NO: 3651000 - RNA, 20 nt, Salmonella enterica enterica serovar Typhi
caaacccgaccucuucuuug

SEQ ID NO: 3651001 - RNA, 16 nt, Salmonella enterica enterica serovar Typhi
caaacccuuccgcauc

SEQ ID NO: 3651002 - RNA, 18 nt, Salmonella enterica enterica serovar Typhi
caaaccgaauucguccac

SEQ ID NO: 3651003 - RNA, 18 nt, Salmonella enterica enterica serovar Typhi
caaaccgauaaucaccag

SEQ ID NO: 3651004 - RNA, 22 nt, Salmonella enterica enterica serovar Typhi
caaaccgauagcuaucacacau

SEQ ID NO: 3651005 - RNA, 23 nt, Salmonella enterica enterica serovar Typhi
caaaccgauagcuaucacacaua

SEQ ID NO: 3651006 - RNA, 17 nt, Salmonella enterica enterica serovar Typhi
caaaccgcuuucaucau

SEQ ID NO: 3651007 - RNA, 16 nt, Salmonella enterica enterica serovar Typhi
caaaccggcgaauagc

SEQ ID NO: 3651008 - RNA, 21 nt, Salmonella enterica enterica serovar Typhi
caaaccgguaaucccuucacg

SEQ ID NO: 3651009 - RNA, 19 nt, Salmonella enterica enterica serovar Typhi
caaaccugagcauauaaau

SEQ ID NO: 3651010 - RNA, 15 nt, Salmonella enterica enterica serovar Typhi
caaaccugccacagg

SEQ ID NO: 3651011 - RNA, 18 nt, Salmonella enterica enterica serovar Typhi
caaaccugccacaggcca

SEQ ID NO: 3651012 - RNA, 19 nt, Salmonella enterica enterica serovar Typhi
caaacgaaccguggccucc

SEQ ID NO: 3651013 - RNA, 16 nt, Salmonella enterica enterica serovar Typhi
caaacgauaaaagcuc

SEQ ID NO: 3651014 - RNA, 12 nt, Salmonella enterica enterica serovar Typhi
caaacgccaccg

SEQ ID NO: 3651015 - RNA, 13 nt, Salmonella enterica enterica serovar Typhi
caaacgccaccgc

SEQ ID NO: 3651016 - RNA, 16 nt, Salmonella enterica enterica serovar Typhi
caaacgccaccgccac

SEQ ID NO: 3651017 - RNA, 11 nt, Salmonella enterica enterica serovar Typhi
caaacgccagc

SEQ ID NO: 3651018 - RNA, 20 nt, Salmonella enterica enterica serovar Typhi
caaacgccauagcaucgacc

SEQ ID NO: 3651019 - RNA, 16 nt, Salmonella enterica enterica serovar Typhi
caaacgccgugaacgc

SEQ ID NO: 3651020 - RNA, 15 nt, Salmonella enterica enterica serovar Typhi
caaacgccugcuccg

SEQ ID NO: 3651021 - RNA, 14 nt, Salmonella enterica enterica serovar Typhi
caaacgcgccgcua

SEQ ID NO: 3651022 - RNA, 23 nt, Salmonella enterica enterica serovar Typhi
caaacgcuaucaccgccgcccgu

SEQ ID NO: 3651023 - RNA, 15 nt, Salmonella enterica enterica serovar Typhi
caaacgcuggugcug

SEQ ID NO: 3651024 - RNA, 13 nt, Salmonella enterica enterica serovar Typhi
caaacgcuuuuuu

SEQ ID NO: 3651025 - RNA, 23 nt, Salmonella enterica enterica serovar Typhi
caaacggcacuacagcccuuuca

SEQ ID NO: 3651026 - RNA, 21 nt, Salmonella enterica enterica serovar Typhi
caaacggccugcgcuggaacu

SEQ ID NO: 3651027 - RNA, 15 nt, Salmonella enterica enterica serovar Typhi
caaacggcgccagcu

SEQ ID NO: 3651028 - RNA, 23 nt, Salmonella enterica enterica serovar Typhi
caaacuauguacgccaagcugca

SEQ ID NO: 3651029 - RNA, 20 nt, Salmonella enterica enterica serovar Typhi
caaauguuguuugaaaagug

SEQ ID NO: 3651030 - RNA, 23 nt, Salmonella enterica enterica serovar Typhi
caaauuaaugugcguaaacaggc

SEQ ID NO: 3651031 - RNA, 18 nt, Salmonella enterica enterica serovar Typhi
caaauuaugauucaaucg

SEQ ID NO: 3651032 - RNA, 21 nt, Salmonella enterica enterica serovar Typhi
caaauucagcgucgagcaccu

SEQ ID NO: 3651033 - RNA, 16 nt, Salmonella enterica enterica serovar Typhi
caaauuccagcaauga

SEQ ID NO: 3651034 - RNA, 22 nt, Salmonella enterica enterica serovar Typhi
caaauuccggcacaaccuggcu

SEQ ID NO: 3651035 - RNA, 18 nt, Salmonella enterica enterica serovar Typhi
caaauucuuuucacgcau

SEQ ID NO: 3651036 - RNA, 15 nt, Salmonella enterica enterica serovar Typhi
caaauugcuguucca

SEQ ID NO: 3651037 - RNA, 15 nt, Salmonella enterica enterica serovar Typhi
caaauuugugcuggu

SEQ ID NO: 3651038 - RNA, 17 nt, Salmonella enterica enterica serovar Typhi
caaauuuugauaaaaac

SEQ ID NO: 3651039 - RNA, 12 nt, Salmonella enterica enterica serovar Typhi
caacaaacauaa

SEQ ID NO: 3651040 - RNA, 14 nt, Salmonella enterica enterica serovar Typhi
caacaaacauaagc

SEQ ID NO: 3651041 - RNA, 18 nt, Salmonella enterica enterica serovar Typhi
caacaacaggccgccgag

SEQ ID NO: 3651042 - RNA, 14 nt, Salmonella enterica enterica serovar Typhi
caacaacaguugca

SEQ ID NO: 3651043 - RNA, 19 nt, Salmonella enterica enterica serovar Typhi
caacaaccucuuuuuccgc

SEQ ID NO: 3651044 - RNA, 19 nt, Salmonella enterica enterica serovar Typhi
caacaaucagaagaaauau

SEQ ID NO: 3651045 - RNA, 21 nt, Salmonella enterica enterica serovar Typhi
caacaaugccacgccccuaag

SEQ ID NO: 3651046 - RNA, 15 nt, Salmonella enterica enterica serovar Typhi
caacaaugcuuucac

SEQ ID NO: 3651047 - RNA, 16 nt, Salmonella enterica enterica serovar Typhi
caacacauaagccacu

SEQ ID NO: 3651048 - RNA, 21 nt, Salmonella enterica enterica serovar Typhi
caacacaucgacaugcagauc

SEQ ID NO: 3651049 - RNA, 14 nt, Salmonella enterica enterica serovar Typhi
caacaccaccgcuc

SEQ ID NO: 3651050 - RNA, 12 nt, Salmonella enterica enterica serovar Typhi
caacaccauccc

SEQ ID NO: 3651051 - RNA, 23 nt, Salmonella enterica enterica serovar Typhi
caacaccaucccgcucuucagua

SEQ ID NO: 3651052 - RNA, 19 nt, Salmonella enterica enterica serovar Typhi
caacaccgauccgaagaac

SEQ ID NO: 3651053 - RNA, 16 nt, Salmonella enterica enterica serovar Typhi
caacaccguaaaagga

SEQ ID NO: 3651054 - RNA, 14 nt, Salmonella enterica enterica serovar Typhi
caacacgcagaccc

SEQ ID NO: 3651055 - RNA, 24 nt, Salmonella enterica enterica serovar Typhi
caacacgccgaacaacacggcggc

SEQ ID NO: 3651056 - RNA, 17 nt, Salmonella enterica enterica serovar Typhi
caacacggcgcucagga

SEQ ID NO: 3651057 - RNA, 19 nt, Salmonella enterica enterica serovar Typhi
caacacuuagaacgcggaa

SEQ ID NO: 3651058 - RNA, 14 nt, Salmonella enterica enterica serovar Typhi
caacagcaauguuu

SEQ ID NO: 3651059 - RNA, 11 nt, Salmonella enterica enterica serovar Typhi
caacagcgacc

SEQ ID NO: 3651060 - RNA, 21 nt, Salmonella enterica enterica serovar Typhi
caacagcgaccacgccaccgc

SEQ ID NO: 3651061 - RNA, 15 nt, Salmonella enterica enterica serovar Typhi
caacagcgagcuaug

SEQ ID NO: 3651062 - RNA, 20 nt, Salmonella enterica enterica serovar Typhi
caacagcggcggcaguugcc

SEQ ID NO: 3651063 - RNA, 16 nt, Salmonella enterica enterica serovar Typhi
caacagcgugagcugu

SEQ ID NO: 3651064 - RNA, 14 nt, Salmonella enterica enterica serovar Typhi
caacagcucgccau

SEQ ID NO: 3651065 - RNA, 15 nt, Salmonella enterica enterica serovar Typhi
caacagcucgccaug

SEQ ID NO: 3651066 - RNA, 17 nt, Salmonella enterica enterica serovar Typhi
caacagcucgccaugca

SEQ ID NO: 3651067 - RNA, 18 nt, Salmonella enterica enterica serovar Typhi
caacagggcggccuccug

SEQ ID NO: 3651068 - RNA, 14 nt, Salmonella enterica enterica serovar Typhi
caacagguaccccg

SEQ ID NO: 3651069 - RNA, 21 nt, Salmonella enterica enterica serovar Typhi
caacagguaccccgccaccgc

SEQ ID NO: 3651070 - RNA, 17 nt, Salmonella enterica enterica serovar Typhi
caacagguuaaucagca

SEQ ID NO: 3651071 - RNA, 20 nt, Salmonella enterica enterica serovar Typhi
caacagugugccgucaucca

SEQ ID NO: 3651072 - RNA, 19 nt, Salmonella enterica enterica serovar Typhi
caacaguugcuggagcagg

SEQ ID NO: 3651073 - RNA, 16 nt, Salmonella enterica enterica serovar Typhi
caacauaaauaaacag

SEQ ID NO: 3651074 - RNA, 13 nt, Salmonella enterica enterica serovar Typhi
caacauacaugcc

SEQ ID NO: 3651075 - RNA, 23 nt, Salmonella enterica enterica serovar Typhi
caacauagcggcaaggaaaacca

SEQ ID NO: 3651076 - RNA, 20 nt, Salmonella enterica enterica serovar Typhi
caacauauuuuucacacaua

SEQ ID NO: 3651077 - RNA, 12 nt, Salmonella enterica enterica serovar Typhi
caacaucauccc

SEQ ID NO: 3651078 - RNA, 17 nt, Salmonella enterica enterica serovar Typhi
caacaucaucggaucca

SEQ ID NO: 3651079 - RNA, 17 nt, Salmonella enterica enterica serovar Typhi
caacaucgcaaaauucc

SEQ ID NO: 3651080 - RNA, 13 nt, Salmonella enterica enterica serovar Typhi
caacaucuuugcc

SEQ ID NO: 3651081 - RNA, 15 nt, Salmonella enterica enterica serovar Typhi
caacaugaccagcgc

SEQ ID NO: 3651082 - RNA, 22 nt, Salmonella enterica enterica serovar Typhi
caacaugccugauggcgcugcg

SEQ ID NO: 3651083 - RNA, 15 nt, Salmonella enterica enterica serovar Typhi
caacaugcugaccga

SEQ ID NO: 3651084 - RNA, 22 nt, Salmonella enterica enterica serovar Typhi
caacauggacaccggaagugaa

SEQ ID NO: 3651085 - RNA, 18 nt, Salmonella enterica enterica serovar Typhi
caacauuaucaaaaguga

SEQ ID NO: 3651086 - RNA, 15 nt, Salmonella enterica enterica serovar Typhi
caacauucugcuucc

SEQ ID NO: 3651087 - RNA, 19 nt, Salmonella enterica enterica serovar Typhi
caacauugaggcuacccag

SEQ ID NO: 3651088 - RNA, 20 nt, Salmonella enterica enterica serovar Typhi
caacauugaggcuacccaga

SEQ ID NO: 3651089 - RNA, 14 nt, Salmonella enterica enterica serovar Typhi
caacauugccggca

SEQ ID NO: 3651090 - RNA, 16 nt, Salmonella enterica enterica serovar Typhi
caacauugccggcauc

SEQ ID NO: 3651091 - RNA, 18 nt, Salmonella enterica enterica serovar Typhi
caaccaaccaacccaaaa

SEQ ID NO: 3651092 - RNA, 16 nt, Salmonella enterica enterica serovar Typhi
caaccaaugcaacgcc

SEQ ID NO: 3651093 - RNA, 14 nt, Salmonella enterica enterica serovar Typhi
caaccaccagcagu

SEQ ID NO: 3651094 - RNA, 23 nt, Salmonella enterica enterica serovar Typhi
caaccaccggauggaucaucggc

SEQ ID NO: 3651095 - RNA, 13 nt, Salmonella enterica enterica serovar Typhi
caaccagaauaau

SEQ ID NO: 3651096 - RNA, 21 nt, Salmonella enterica enterica serovar Typhi
caaccagcgaaaugacggcca

SEQ ID NO: 3651097 - RNA, 23 nt, Salmonella enterica enterica serovar Typhi
caaccagcgcggccagaaugccc

SEQ ID NO: 3651098 - RNA, 19 nt, Salmonella enterica enterica serovar Typhi
caaccagugcggcaaccac

SEQ ID NO: 3651099 - RNA, 19 nt, Salmonella enterica enterica serovar Typhi
caaccaguuaauuucuuuc

SEQ ID NO: 3651100 - RNA, 21 nt, Salmonella enterica enterica serovar Typhi
caaccaguuaauuucuuucca

SEQ ID NO: 3651101 - RNA, 11 nt, Salmonella enterica enterica serovar Typhi
caaccauacau

SEQ ID NO: 3651102 - RNA, 20 nt, Salmonella enterica enterica serovar Typhi
caaccaucacugaacccaaa

SEQ ID NO: 3651103 - RNA, 23 nt, Salmonella enterica enterica serovar Typhi
caaccaugauaaccagccccggg

SEQ ID NO: 3651104 - RNA, 22 nt, Salmonella enterica enterica serovar Typhi
caacccauauucgucuucaucu

SEQ ID NO: 3651105 - RNA, 20 nt, Salmonella enterica enterica serovar Typhi
caaccccaaacaccaacaaa

SEQ ID NO: 3651106 - RNA, 20 nt, Salmonella enterica enterica serovar Typhi
caaccccagacggcggcgaa

SEQ ID NO: 3651107 - RNA, 20 nt, Salmonella enterica enterica serovar Typhi
caacccgcaagcauaaaaaa

SEQ ID NO: 3651108 - RNA, 14 nt, Salmonella enterica enterica serovar Typhi
caacccgcuaccgc

SEQ ID NO: 3651109 - RNA, 21 nt, Salmonella enterica enterica serovar Typhi
caacccgcuccagaagcacuu

SEQ ID NO: 3651110 - RNA, 19 nt, Salmonella enterica enterica serovar Typhi
caacccguaccuccagcga

SEQ ID NO: 3651111 - RNA, 19 nt, Salmonella enterica enterica serovar Typhi
caacccuauugccacaaua

SEQ ID NO: 3651112 - RNA, 20 nt, Salmonella enterica enterica serovar Typhi
caaccgagcagcuuggcggc

SEQ ID NO: 3651113 - RNA, 14 nt, Salmonella enterica enterica serovar Typhi
caaccgccacaaua

SEQ ID NO: 3651114 - RNA, 18 nt, Salmonella enterica enterica serovar Typhi
caacuucaugaguaaaug

SEQ ID NO: 3651115 - RNA, 15 nt, Salmonella enterica enterica serovar Typhi
caacuuccaccaccu

SEQ ID NO: 3651116 - RNA, 21 nt, Salmonella enterica enterica serovar Typhi
caacuuccaccaccuccugcu

SEQ ID NO: 3651117 - RNA, 21 nt, Salmonella enterica enterica serovar Typhi
caacuucuaauuuuuccagca

SEQ ID NO: 3651118 - RNA, 23 nt, Salmonella enterica enterica serovar Typhi
caacuuguuuccuguucggggaa

SEQ ID NO: 3651119 - RNA, 20 nt, Salmonella enterica enterica serovar Typhi
caacuuuuucuuaagcugag

SEQ ID NO: 3651120 - RNA, 18 nt, Salmonella enterica enterica serovar Typhi
caagaacagagcaauuac

SEQ ID NO: 3651121 - RNA, 17 nt, Salmonella enterica enterica serovar Typhi
caagaaccgcuuuuccu

SEQ ID NO: 3651122 - RNA, 23 nt, Salmonella enterica enterica serovar Typhi
caagaaccgcuuuuccugcugcc

SEQ ID NO: 3651123 - RNA, 19 nt, Salmonella enterica enterica serovar Typhi
caagaagauuucuuaauuc

SEQ ID NO: 3651124 - RNA, 21 nt, Salmonella enterica enterica serovar Typhi
caagaagcguugaccguacug

SEQ ID NO: 3651125 - RNA, 18 nt, Salmonella enterica enterica serovar Typhi
caagaaguuccaccgucu

SEQ ID NO: 3651126 - RNA, 15 nt, Salmonella enterica enterica serovar Typhi
caagaauacccuuua

SEQ ID NO: 3651127 - RNA, 15 nt, Salmonella enterica enterica serovar Typhi
caagaauaugcagug

SEQ ID NO: 3651128 - RNA, 12 nt, Salmonella enterica enterica serovar Typhi
caagaaucaaua

SEQ ID NO: 3651129 - RNA, 15 nt, Salmonella enterica enterica serovar Typhi
caagaaucacgccga

SEQ ID NO: 3651130 - RNA, 21 nt, Salmonella enterica enterica serovar Typhi
caagaaugaccagccgaaguu

SEQ ID NO: 3651131 - RNA, 22 nt, Salmonella enterica enterica serovar Typhi
caagacacgcuuccagaugaag

SEQ ID NO: 3651132 - RNA, 22 nt, Salmonella enterica enterica serovar Typhi
caagaccgauagagacugccgc

SEQ ID NO: 3651133 - RNA, 17 nt, Salmonella enterica enterica serovar Typhi
caagaccgccuaacagc

SEQ ID NO: 3651134 - RNA, 20 nt, Salmonella enterica enterica serovar Typhi
caagagaaaaaucagucauu

SEQ ID NO: 3651135 - RNA, 15 nt, Salmonella enterica enterica serovar Typhi
caagagauucaggcc

SEQ ID NO: 3651136 - RNA, 19 nt, Salmonella enterica enterica serovar Typhi
caagagauucaggccgcca

SEQ ID NO: 3651137 - RNA, 14 nt, Salmonella enterica enterica serovar Typhi
caagagcagcaacc

SEQ ID NO: 3651138 - RNA, 19 nt, Salmonella enterica enterica serovar Typhi
caagagcagcaacccugcc

SEQ ID NO: 3651139 - RNA, 17 nt, Salmonella enterica enterica serovar Typhi
caagagcguccaguccu

SEQ ID NO: 3651140 - RNA, 13 nt, Salmonella enterica enterica serovar Typhi
caagauaaaaaga

SEQ ID NO: 3651141 - RNA, 19 nt, Salmonella enterica enterica serovar Typhi
caagaucaaugugcucaac

SEQ ID NO: 3651142 - RNA, 20 nt, Salmonella enterica enterica serovar Typhi
caagaucacauacaaagaga

SEQ ID NO: 3651143 - RNA, 14 nt, Salmonella enterica enterica serovar Typhi
caagaucauccggg

SEQ ID NO: 3651144 - RNA, 17 nt, Salmonella enterica enterica serovar Typhi
caagauccaacacggcg

SEQ ID NO: 3651145 - RNA, 20 nt, Salmonella enterica enterica serovar Typhi
caagaucgguugaaccaucu

SEQ ID NO: 3651146 - RNA, 13 nt, Salmonella enterica enterica serovar Typhi
caagaugcugaau

SEQ ID NO: 3651147 - RNA, 17 nt, Salmonella enterica enterica serovar Typhi
caagcaaugccagaaau

SEQ ID NO: 3651148 - RNA, 13 nt, Salmonella enterica enterica serovar Typhi
caagcacaaaaag

SEQ ID NO: 3651149 - RNA, 15 nt, Salmonella enterica enterica serovar Typhi
caagcacugaaugcu

SEQ ID NO: 3651150 - RNA, 17 nt, Salmonella enterica enterica serovar Typhi
caagcacugaaugcuga

SEQ ID NO: 3651151 - RNA, 15 nt, Salmonella enterica enterica serovar Typhi
caagcagcauaauga

SEQ ID NO: 3651152 - RNA, 14 nt, Salmonella enterica enterica serovar Typhi
caagcaguaugacc

SEQ ID NO: 3651153 - RNA, 15 nt, Salmonella enterica enterica serovar Typhi
caagcaguuccagca

SEQ ID NO: 3651154 - RNA, 13 nt, Salmonella enterica enterica serovar Typhi
caagcaguucuga

SEQ ID NO: 3651155 - RNA, 22 nt, Salmonella enterica enterica serovar Typhi
caagcauaaaaaacaucaugcc

SEQ ID NO: 3651156 - RNA, 21 nt, Salmonella enterica enterica serovar Typhi
caagcauaaaccggcggccua

SEQ ID NO: 3651157 - RNA, 22 nt, Salmonella enterica enterica serovar Typhi
caagccaggcccgguggcgcca

SEQ ID NO: 3651158 - RNA, 18 nt, Salmonella enterica enterica serovar Typhi
caagccagguugcgcccg

SEQ ID NO: 3651159 - RNA, 14 nt, Salmonella enterica enterica serovar Typhi
caagcccaacuauu

SEQ ID NO: 3651160 - RNA, 21 nt, Salmonella enterica enterica serovar Typhi
caagccccccgcacagcacau

SEQ ID NO: 3651161 - RNA, 23 nt, Salmonella enterica enterica serovar Typhi
caagcgaagcgccgucggcaucg

SEQ ID NO: 3651162 - RNA, 15 nt, Salmonella enterica enterica serovar Typhi
caagcgccaguaaug

SEQ ID NO: 3651163 - RNA, 17 nt, Salmonella enterica enterica serovar Typhi
caagcgccuguucaaca

SEQ ID NO: 3651164 - RNA, 18 nt, Salmonella enterica enterica serovar Typhi
caagcgccuguucaacau

SEQ ID NO: 3651165 - RNA, 20 nt, Salmonella enterica enterica serovar Typhi
caagcgcggcgaaauaggcc

SEQ ID NO: 3651166 - RNA, 13 nt, Salmonella enterica enterica serovar Typhi
caagcggcggcca

SEQ ID NO: 3651167 - RNA, 20 nt, Salmonella enterica enterica serovar Typhi
caagcgguuugaaaauggcg

SEQ ID NO: 3651168 - RNA, 13 nt, Salmonella enterica enterica serovar Typhi
caagcgucagcau

SEQ ID NO: 3651169 - RNA, 18 nt, Salmonella enterica enterica serovar Typhi
caagcgucagcaugguaa

SEQ ID NO: 3651170 - RNA, 17 nt, Salmonella enterica enterica serovar Typhi
caagcguuuaauuccau

SEQ ID NO: 3651171 - RNA, 20 nt, Salmonella enterica enterica serovar Typhi
caagcucaucgggcaacuga

SEQ ID NO: 3651172 - RNA, 17 nt, Salmonella enterica enterica serovar Typhi
caagcucauuucccaau

SEQ ID NO: 3651173 - RNA, 23 nt, Salmonella enterica enterica serovar Typhi
caagcugcuggcgagcaggaaaa

SEQ ID NO: 3651174 - RNA, 14 nt, Salmonella enterica enterica serovar Typhi
caagcugcuuuuug

SEQ ID NO: 3651175 - RNA, 14 nt, Salmonella enterica enterica serovar Typhi
caagcuggaauacc

SEQ ID NO: 3651176 - RNA, 20 nt, Salmonella enterica enterica serovar Typhi
caagcugggcguuacuggcg

SEQ ID NO: 3651177 - RNA, 15 nt, Salmonella enterica enterica serovar Typhi
caagcugguaaaugc

SEQ ID NO: 3651178 - RNA, 22 nt, Salmonella enterica enterica serovar Typhi
caagcugguuaaugaccugccg

SEQ ID NO: 3651179 - RNA, 22 nt, Salmonella enterica enterica serovar Typhi
caagcuguagcguuuccacgac

SEQ ID NO: 3651180 - RNA, 16 nt, Salmonella enterica enterica serovar Typhi
caaggaaaaccaguaa

SEQ ID NO: 3651181 - RNA, 12 nt, Salmonella enterica enterica serovar Typhi
caaggaaggaaa

SEQ ID NO: 3651182 - RNA, 19 nt, Salmonella enterica enterica serovar Typhi
caaggaaugacacauuucu

SEQ ID NO: 3651183 - RNA, 16 nt, Salmonella enterica enterica serovar Typhi
caaggcgacgcuucac

SEQ ID NO: 3651184 - RNA, 15 nt, Salmonella enterica enterica serovar Typhi
caaggcgcaaaacca

SEQ ID NO: 3651185 - RNA, 14 nt, Salmonella enterica enterica serovar Typhi
caaggcguucacac

SEQ ID NO: 3651186 - RNA, 12 nt, Salmonella enterica enterica serovar Typhi
caagggcuuucu

SEQ ID NO: 3651187 - RNA, 22 nt, Salmonella enterica enterica serovar Typhi
caagguuauuaaaaagccagcg

SEQ ID NO: 3651188 - RNA, 21 nt, Salmonella enterica enterica serovar Typhi
caagguucgacucgagcaaua

SEQ ID NO: 3651189 - RNA, 15 nt, Salmonella enterica enterica serovar Typhi
caaguaauaaaauaa

SEQ ID NO: 3651190 - RNA, 16 nt, Salmonella enterica enterica serovar Typhi
caaguaauaaaauaau

SEQ ID NO: 3651191 - RNA, 17 nt, Salmonella enterica enterica serovar Typhi
caaguaauaaaauaaua

SEQ ID NO: 3651192 - RNA, 14 nt, Salmonella enterica enterica serovar Typhi
caaguaauaaagag

SEQ ID NO: 3651193 - RNA, 14 nt, Salmonella enterica enterica serovar Typhi
caaguaguuguuau

SEQ ID NO: 3651194 - RNA, 14 nt, Salmonella enterica enterica serovar Typhi
caagucaccaucag

SEQ ID NO: 3651195 - RNA, 15 nt, Salmonella enterica enterica serovar Typhi
caaguccaaguaugu

SEQ ID NO: 3651196 - RNA, 21 nt, Salmonella enterica enterica serovar Typhi
caaguccgccgcuauuacccc

SEQ ID NO: 3651197 - RNA, 17 nt, Salmonella enterica enterica serovar Typhi
caaguccuucuuccccc

SEQ ID NO: 3651198 - RNA, 16 nt, Salmonella enterica enterica serovar Typhi
caaguuuagaaaaaau

SEQ ID NO: 3651199 - RNA, 17 nt, Salmonella enterica enterica serovar Typhi
caaguuuagaaaaaauu

SEQ ID NO: 3651200 - RNA, 23 nt, Salmonella enterica enterica serovar Typhi
caauccagaauaccagaaucacc

SEQ ID NO: 3651201 - RNA, 23 nt, Salmonella enterica enterica serovar Typhi
caauccagguggaucggaaauca

SEQ ID NO: 3651202 - RNA, 19 nt, Salmonella enterica enterica serovar Typhi
caauccauuaauggcgcaa

SEQ ID NO: 3651203 - RNA, 18 nt, Salmonella enterica enterica serovar Typhi
caauccguuauuucacag

SEQ ID NO: 3651204 - RNA, 22 nt, Salmonella enterica enterica serovar Typhi
caauccugucgucaccagcagg

SEQ ID NO: 3651205 - RNA, 23 nt, Salmonella enterica enterica serovar Typhi
caauccugucgucaccagcaggu

SEQ ID NO: 3651206 - RNA, 19 nt, Salmonella enterica enterica serovar Typhi
caaucgacaaaacacggcu

SEQ ID NO: 3651207 - RNA, 14 nt, Salmonella enterica enterica serovar Typhi
caaucgccagcccc

SEQ ID NO: 3651208 - RNA, 13 nt, Salmonella enterica enterica serovar Typhi
caaucgccugcaa

SEQ ID NO: 3651209 - RNA, 16 nt, Salmonella enterica enterica serovar Typhi
caaucgcgguaugcga

SEQ ID NO: 3651210 - RNA, 16 nt, Salmonella enterica enterica serovar Typhi
caaucgcguuuuccag

SEQ ID NO: 3651211 - RNA, 18 nt, Salmonella enterica enterica serovar Typhi
caaucgcuaucugacagc

SEQ ID NO: 3651212 - RNA, 21 nt, Salmonella enterica enterica serovar Typhi
caaucgucacuucaauuugcc

SEQ ID NO: 3651213 - RNA, 19 nt, Salmonella enterica enterica serovar Typhi
caaucguuaauucauggcc

SEQ ID NO: 3651214 - RNA, 13 nt, Salmonella enterica enterica serovar Typhi
caaucguucuugc

SEQ ID NO: 3651215 - RNA, 15 nt, Salmonella enterica enterica serovar Typhi
caaucucaauaccac

SEQ ID NO: 3651216 - RNA, 18 nt, Salmonella enterica enterica serovar Typhi
caaucuccagaccgcugc

SEQ ID NO: 3651217 - RNA, 22 nt, Salmonella enterica enterica serovar Typhi
caaucucgcaagauuccagaua

SEQ ID NO: 3651218 - RNA, 13 nt, Salmonella enterica enterica serovar Typhi
caaucucgccaau

SEQ ID NO: 3651219 - RNA, 13 nt, Salmonella enterica enterica serovar Typhi
caaucucuauacc

SEQ ID NO: 3651220 - RNA, 20 nt, Salmonella enterica enterica serovar Typhi
caaucucuggccaggcauug

SEQ ID NO: 3651221 - RNA, 21 nt, Salmonella enterica enterica serovar Typhi
caaucugcgucaguaccugau

SEQ ID NO: 3651222 - RNA, 21 nt, Salmonella enterica enterica serovar Typhi
caaucuggugacgaugauaac

SEQ ID NO: 3651223 - RNA, 18 nt, Salmonella enterica enterica serovar Typhi
caaucugguggcguuccu

SEQ ID NO: 3651224 - RNA, 20 nt, Salmonella enterica enterica serovar Typhi
caaucugguggcguuccuua

SEQ ID NO: 3651225 - RNA, 22 nt, Salmonella enterica enterica serovar Typhi
caaucugguggcguuccuuauc

SEQ ID NO: 3651226 - RNA, 18 nt, Salmonella enterica enterica serovar Typhi
caaucuguucguugcugu

SEQ ID NO: 3651227 - RNA, 19 nt, Salmonella enterica enterica serovar Typhi
caaucuguucguugcugua

SEQ ID NO: 3651228 - RNA, 16 nt, Salmonella enterica enterica serovar Typhi
caaucuuuacccggcg

SEQ ID NO: 3651229 - RNA, 19 nt, Salmonella enterica enterica serovar Typhi
caaugaacucgccucgcug

SEQ ID NO: 3651230 - RNA, 21 nt, Salmonella enterica enterica serovar Typhi
caaugacgcuucguuccgcga

SEQ ID NO: 3651231 - RNA, 19 nt, Salmonella enterica enterica serovar Typhi
caaugagacaacggcgacc

SEQ ID NO: 3651232 - RNA, 14 nt, Salmonella enterica enterica serovar Typhi
caaugagccgucgc

SEQ ID NO: 3651233 - RNA, 22 nt, Salmonella enterica enterica serovar Typhi
caaugagcugcuugucacgaag

SEQ ID NO: 3651234 - RNA, 16 nt, Salmonella enterica enterica serovar Typhi
caaugaucagacgcac

SEQ ID NO: 3651235 - RNA, 13 nt, Salmonella enterica enterica serovar Typhi
caaugauccggac

SEQ ID NO: 3651236 - RNA, 20 nt, Salmonella enterica enterica serovar Typhi
caaugcacuacgaaaagagg

SEQ ID NO: 3651237 - RNA, 15 nt, Salmonella enterica enterica serovar Typhi
caaugccaccagcgc

SEQ ID NO: 3651238 - RNA, 13 nt, Salmonella enterica enterica serovar Typhi
caaugcccaaaau

SEQ ID NO: 3651239 - RNA, 15 nt, Salmonella enterica enterica serovar Typhi
caaugcccacgccgu

SEQ ID NO: 3651240 - RNA, 13 nt, Salmonella enterica enterica serovar Typhi
caaugcccagcgc

SEQ ID NO: 3651241 - RNA, 21 nt, Salmonella enterica enterica serovar Typhi
caaugcccccaucacuuuacc

SEQ ID NO: 3651242 - RNA, 17 nt, Salmonella enterica enterica serovar Typhi
caaugccggacgccacc

SEQ ID NO: 3651243 - RNA, 18 nt, Salmonella enterica enterica serovar Typhi
caaugccggacgccacca

SEQ ID NO: 3651244 - RNA, 16 nt, Salmonella enterica enterica serovar Typhi
caaugccuaacccuuu

SEQ ID NO: 3651245 - RNA, 18 nt, Salmonella enterica enterica serovar Typhi
caaugccuuaugcccggc

SEQ ID NO: 3651246 - RNA, 18 nt, Salmonella enterica enterica serovar Typhi
caaugcgcguaauuugcg

SEQ ID NO: 3651247 - RNA, 21 nt, Salmonella enterica enterica serovar Typhi
caaugcgcuuuuuuugcccuu

SEQ ID NO: 3651248 - RNA, 18 nt, Salmonella enterica enterica serovar Typhi
caaugcggcaucucgcca

SEQ ID NO: 3651249 - RNA, 15 nt, Salmonella enterica enterica serovar Typhi
caaugcuuucaccag

SEQ ID NO: 3651250 - RNA, 19 nt, Salmonella enterica enterica serovar Typhi
caauggccgcagcgccaua

SEQ ID NO: 3651251 - RNA, 17 nt, Salmonella enterica enterica serovar Typhi
caauggcgcgucuuaaa

SEQ ID NO: 3651252 - RNA, 19 nt, Salmonella enterica enterica serovar Typhi
caaugguguuuuccagcgu

SEQ ID NO: 3651253 - RNA, 23 nt, Salmonella enterica enterica serovar Typhi
caauguaaaacgguaugaaacau

SEQ ID NO: 3651254 - RNA, 14 nt, Salmonella enterica enterica serovar Typhi
caauguaaaacuga

SEQ ID NO: 3651255 - RNA, 19 nt, Salmonella enterica enterica serovar Typhi
caauguaaaacugacuaaa

SEQ ID NO: 3651256 - RNA, 17 nt, Salmonella enterica enterica serovar Typhi
caauguacguaaaacca

SEQ ID NO: 3651257 - RNA, 18 nt, Salmonella enterica enterica serovar Typhi
caauguacguaaaaccag

SEQ ID NO: 3651258 - RNA, 14 nt, Salmonella enterica enterica serovar Typhi
caaugucauauuug

SEQ ID NO: 3651259 - RNA, 21 nt, Salmonella enterica enterica serovar Typhi
caaugugcagcaggacgcgca

SEQ ID NO: 3651260 - RNA, 17 nt, Salmonella enterica enterica serovar Typhi
caauguuaaauucagca

SEQ ID NO: 3651261 - RNA, 19 nt, Salmonella enterica enterica serovar Typhi
caauguuaacuacuuuaca

SEQ ID NO: 3651262 - RNA, 18 nt, Salmonella enterica enterica serovar Typhi
caauguucauacaccgca

SEQ ID NO: 3651263 - RNA, 20 nt, Salmonella enterica enterica serovar Typhi
caauguucugggaauaggcc

SEQ ID NO: 3651264 - RNA, 21 nt, Salmonella enterica enterica serovar Typhi
caauguugaaucccacgccgc

SEQ ID NO: 3651265 - RNA, 21 nt, Salmonella enterica enterica serovar Typhi
caauguuuuaccggcagcucu

SEQ ID NO: 3651266 - RNA, 20 nt, Salmonella enterica enterica serovar Typhi
caauuaauauuuaacacauu

SEQ ID NO: 3651267 - RNA, 12 nt, Salmonella enterica enterica serovar Typhi
caauuacguugg

SEQ ID NO: 3651268 - RNA, 22 nt, Salmonella enterica enterica serovar Typhi
caauuacguuggggauaaccag

SEQ ID NO: 3651269 - RNA, 23 nt, Salmonella enterica enterica serovar Typhi
caauuauguauuucucgccgccg

SEQ ID NO: 3651270 - RNA, 13 nt, Salmonella enterica enterica serovar Typhi
caauucagaaagu

SEQ ID NO: 3651271 - RNA, 14 nt, Salmonella enterica enterica serovar Typhi
caauuccacaggcg

SEQ ID NO: 3651272 - RNA, 15 nt, Salmonella enterica enterica serovar Typhi
caauuccgccauaac

SEQ ID NO: 3651273 - RNA, 19 nt, Salmonella enterica enterica serovar Typhi
caauuccggcccaggccau

SEQ ID NO: 3651274 - RNA, 23 nt, Salmonella enterica enterica serovar Typhi
caauucgagauuuuucugcgcca

SEQ ID NO: 3651275 - RNA, 16 nt, Salmonella enterica enterica serovar Typhi
caauucuggaaucaau

SEQ ID NO: 3651276 - RNA, 20 nt, Salmonella enterica enterica serovar Typhi
caauucuggaaucaauuucc

SEQ ID NO: 3651277 - RNA, 22 nt, Salmonella enterica enterica serovar Typhi
caauucuggaaucaauuucccu

SEQ ID NO: 3651278 - RNA, 24 nt, Salmonella enterica enterica serovar Typhi
caauugccacauagcauccagacc

SEQ ID NO: 3651279 - RNA, 17 nt, Salmonella enterica enterica serovar Typhi
caauuguagcugcgcca

SEQ ID NO: 3651280 - RNA, 17 nt, Salmonella enterica enterica serovar Typhi
caauuuaucugcgugau

SEQ ID NO: 3651281 - RNA, 15 nt, Salmonella enterica enterica serovar Typhi
caauuucaaugaugc

SEQ ID NO: 3651282 - RNA, 18 nt, Salmonella enterica enterica serovar Typhi
caauuucagcauccuccg

SEQ ID NO: 3651283 - RNA, 15 nt, Salmonella enterica enterica serovar Typhi
caauuucccccacuu

SEQ ID NO: 3651284 - RNA, 16 nt, Salmonella enterica enterica serovar Typhi
caauuuccgcugaaau

SEQ ID NO: 3651285 - RNA, 17 nt, Salmonella enterica enterica serovar Typhi
cacaggagccaguuuuc

SEQ ID NO: 3651286 - RNA, 16 nt, Salmonella enterica enterica serovar Typhi
cacaggccuucaugau

SEQ ID NO: 3651287 - RNA, 12 nt, Salmonella enterica enterica serovar Typhi
cacaggcggcca

SEQ ID NO: 3651288 - RNA, 17 nt, Salmonella enterica enterica serovar Typhi
cacaggcgugguggaua

SEQ ID NO: 3651289 - RNA, 16 nt, Salmonella enterica enterica serovar Typhi
cacaggcugcggcacg

SEQ ID NO: 3651290 - RNA, 23 nt, Salmonella enterica enterica serovar Typhi
cacaggcuucgacaaacagcuau

SEQ ID NO: 3651291 - RNA, 17 nt, Salmonella enterica enterica serovar Typhi
cacaggcuuggcagccc

SEQ ID NO: 3651292 - RNA, 18 nt, Salmonella enterica enterica serovar Typhi
cacagggacuauaggcaa

SEQ ID NO: 3651293 - RNA, 14 nt, Salmonella enterica enterica serovar Typhi
cacagguacaggcc

SEQ ID NO: 3651294 - RNA, 19 nt, Salmonella enterica enterica serovar Typhi
cacaguaaccccauacagu

SEQ ID NO: 3651295 - RNA, 19 nt, Salmonella enterica enterica serovar Typhi
cacaguaauggacagguaa

SEQ ID NO: 3651296 - RNA, 19 nt, Salmonella enterica enterica serovar Typhi
cacaguacaccugcagguu

SEQ ID NO: 3651297 - RNA, 12 nt, Salmonella enterica enterica serovar Typhi
cacaguacgccc

SEQ ID NO: 3651298 - RNA, 15 nt, Salmonella enterica enterica serovar Typhi
cacaguacgcccggc

SEQ ID NO: 3651299 - RNA, 16 nt, Salmonella enterica enterica serovar Typhi
cacagucaucgcgcca

SEQ ID NO: 3651300 - RNA, 18 nt, Salmonella enterica enterica serovar Typhi
cacagugacccgccgcca

SEQ ID NO: 3651301 - RNA, 22 nt, Salmonella enterica enterica serovar Typhi
cacagugacccgccgccagcac

SEQ ID NO: 3651302 - RNA, 15 nt, Salmonella enterica enterica serovar Typhi
cacaguuuuuccccg

SEQ ID NO: 3651303 - RNA, 18 nt, Salmonella enterica enterica serovar Typhi
cacauaacaaaaccagca

SEQ ID NO: 3651304 - RNA, 12 nt, Salmonella enterica enterica serovar Typhi
cacauaacugag

SEQ ID NO: 3651305 - RNA, 17 nt, Salmonella enterica enterica serovar Typhi
cacauaagcacaccauu

SEQ ID NO: 3651306 - RNA, 14 nt, Salmonella enterica enterica serovar Typhi
cacauaagccacuu

SEQ ID NO: 3651307 - RNA, 18 nt, Salmonella enterica enterica serovar Typhi
cacauaaucaccgcaaau

SEQ ID NO: 3651308 - RNA, 17 nt, Salmonella enterica enterica serovar Typhi
cacauacagcacuuccc

SEQ ID NO: 3651309 - RNA, 18 nt, Salmonella enterica enterica serovar Typhi
cacauagcauccagaccc

SEQ ID NO: 3651310 - RNA, 14 nt, Salmonella enterica enterica serovar Typhi
cacauaggcaaaca

SEQ ID NO: 3651311 - RNA, 15 nt, Salmonella enterica enterica serovar Typhi
cacauaggcaaacac

SEQ ID NO: 3651312 - RNA, 23 nt, Salmonella enterica enterica serovar Typhi
cacauaucgcaauugauacauuu

SEQ ID NO: 3651313 - RNA, 17 nt, Salmonella enterica enterica serovar Typhi
cacauauugcgcuucac

SEQ ID NO: 3651314 - RNA, 21 nt, Salmonella enterica enterica serovar Typhi
cacaucaaagccccauaaccg

SEQ ID NO: 3651315 - RNA, 18 nt, Salmonella enterica enterica serovar Typhi
cacaucagcaaaugaacc

SEQ ID NO: 3651316 - RNA, 20 nt, Salmonella enterica enterica serovar Typhi
cacaucagccaacuuuuucu

SEQ ID NO: 3651317 - RNA, 23 nt, Salmonella enterica enterica serovar Typhi
cacaucaugaugaucuucagccc

SEQ ID NO: 3651318 - RNA, 12 nt, Salmonella enterica enterica serovar Typhi
cacaucauuaaa

SEQ ID NO: 3651319 - RNA, 17 nt, Salmonella enterica enterica serovar Typhi
cacaucauuaaagcgcu

SEQ ID NO: 3651320 - RNA, 13 nt, Salmonella enterica enterica serovar Typhi
cacauccagcccc

SEQ ID NO: 3651321 - RNA, 16 nt, Salmonella enterica enterica serovar Typhi
cacauccgccagcgcc

SEQ ID NO: 3651322 - RNA, 17 nt, Salmonella enterica enterica serovar Typhi
cacauccgccagcgccu

SEQ ID NO: 3651323 - RNA, 20 nt, Salmonella enterica enterica serovar Typhi
cacaucgccauuaaaagcca

SEQ ID NO: 3651324 - RNA, 15 nt, Salmonella enterica enterica serovar Typhi
cacaucgcgcagcag

SEQ ID NO: 3651325 - RNA, 16 nt, Salmonella enterica enterica serovar Typhi
cacaucgugcgccauu

SEQ ID NO: 3651326 - RNA, 21 nt, Salmonella enterica enterica serovar Typhi
cacaucuacucauaugcggau

SEQ ID NO: 3651327 - RNA, 23 nt, Salmonella enterica enterica serovar Typhi
cacaucuguuugagaaaaacauc

SEQ ID NO: 3651328 - RNA, 15 nt, Salmonella enterica enterica serovar Typhi
cacaugaccagcgcc

SEQ ID NO: 3651329 - RNA, 14 nt, Salmonella enterica enterica serovar Typhi
cacaugagaagggc

SEQ ID NO: 3651330 - RNA, 17 nt, Salmonella enterica enterica serovar Typhi
cacaugauguuuuaaca

SEQ ID NO: 3651331 - RNA, 19 nt, Salmonella enterica enterica serovar Typhi
cacaugcaagucgaacggu

SEQ ID NO: 3651332 - RNA, 13 nt, Salmonella enterica enterica serovar Typhi
cacauuagcgggc

SEQ ID NO: 3651333 - RNA, 21 nt, Salmonella enterica enterica serovar Typhi
cacauucagagcguccacgcc

SEQ ID NO: 3651334 - RNA, 22 nt, Salmonella enterica enterica serovar Typhi
cacauucagagcguccacgcca

SEQ ID NO: 3651335 - RNA, 13 nt, Salmonella enterica enterica serovar Typhi
cacauucagcagc

SEQ ID NO: 3651336 - RNA, 23 nt, Salmonella enterica enterica serovar Typhi
cacauucagcagcgcccagccaa

SEQ ID NO: 3651337 - RNA, 14 nt, Salmonella enterica enterica serovar Typhi
cacauugagcgaga

SEQ ID NO: 3651338 - RNA, 15 nt, Salmonella enterica enterica serovar Typhi
cacauuggccccugg

SEQ ID NO: 3651339 - RNA, 10 nt, Salmonella enterica enterica serovar Typhi
caccaaaaac

SEQ ID NO: 3651340 - RNA, 12 nt, Salmonella enterica enterica serovar Typhi
caccaaaaagcc

SEQ ID NO: 3651341 - RNA, 16 nt, Salmonella enterica enterica serovar Typhi
caccaaagccaggccg

SEQ ID NO: 3651342 - RNA, 19 nt, Salmonella enterica enterica serovar Typhi
caccaaagccaggccgcca

SEQ ID NO: 3651343 - RNA, 15 nt, Salmonella enterica enterica serovar Typhi
caccaaaucccccaa

SEQ ID NO: 3651344 - RNA, 21 nt, Salmonella enterica enterica serovar Typhi
caccaaccaggcaaaccagca

SEQ ID NO: 3651345 - RNA, 19 nt, Salmonella enterica enterica serovar Typhi
caccaacgccgcuuuaccg

SEQ ID NO: 3651346 - RNA, 20 nt, Salmonella enterica enterica serovar Typhi
caccaacgccgcuuuaccgc

SEQ ID NO: 3651347 - RNA, 16 nt, Salmonella enterica enterica serovar Typhi
caccaaguagacagag

SEQ ID NO: 3651348 - RNA, 22 nt, Salmonella enterica enterica serovar Typhi
caccaauacgugagcgaaguuc

SEQ ID NO: 3651349 - RNA, 12 nt, Salmonella enterica enterica serovar Typhi
caccaauugcca

SEQ ID NO: 3651350 - RNA, 14 nt, Salmonella enterica enterica serovar Typhi
caccacaaaggcgc

SEQ ID NO: 3651351 - RNA, 19 nt, Salmonella enterica enterica serovar Typhi
caccacagucaucgcgcca

SEQ ID NO: 3651352 - RNA, 21 nt, Salmonella enterica enterica serovar Typhi
caccacauaccgucaccacgc

SEQ ID NO: 3651353 - RNA, 12 nt, Salmonella enterica enterica serovar Typhi
caccaccauggg

SEQ ID NO: 3651354 - RNA, 16 nt, Salmonella enterica enterica serovar Typhi
caccaccgcaggcagc

SEQ ID NO: 3651355 - RNA, 13 nt, Salmonella enterica enterica serovar Typhi
caccaccgccacu

SEQ ID NO: 3651356 - RNA, 14 nt, Salmonella enterica enterica serovar Typhi
caccaccucaaacg

SEQ ID NO: 3651357 - RNA, 14 nt, Salmonella enterica enterica serovar Typhi
caccaccuccugcu

SEQ ID NO: 3651358 - RNA, 15 nt, Salmonella enterica enterica serovar Typhi
caccaccuccugcug

SEQ ID NO: 3651359 - RNA, 13 nt, Salmonella enterica enterica serovar Typhi
caccaccugguua

SEQ ID NO: 3651360 - RNA, 15 nt, Salmonella enterica enterica serovar Typhi
caccacgcccuucac

SEQ ID NO: 3651361 - RNA, 19 nt, Salmonella enterica enterica serovar Typhi
caccacgccuaaugaagcg

SEQ ID NO: 3651362 - RNA, 16 nt, Salmonella enterica enterica serovar Typhi
caccacgguguacccc

SEQ ID NO: 3651363 - RNA, 19 nt, Salmonella enterica enterica serovar Typhi
caccacgguguaccccgcc

SEQ ID NO: 3651364 - RNA, 22 nt, Salmonella enterica enterica serovar Typhi
caccacguaacucggcagcgcg

SEQ ID NO: 3651365 - RNA, 18 nt, Salmonella enterica enterica serovar Typhi
caccacguaaugcgcccc

SEQ ID NO: 3651366 - RNA, 21 nt, Salmonella enterica enterica serovar Typhi
caccacguaaugcgccccggc

SEQ ID NO: 3651367 - RNA, 23 nt, Salmonella enterica enterica serovar Typhi
caccacuggcagcgccugacggc

SEQ ID NO: 3651368 - RNA, 18 nt, Salmonella enterica enterica serovar Typhi
caccagaacucccuguuc

SEQ ID NO: 3651369 - RNA, 21 nt, Salmonella enterica enterica serovar Typhi
caccagaacucccuguuccug

SEQ ID NO: 3651370 - RNA, 18 nt, Salmonella enterica enterica serovar Typhi
caccagaauaaugcccac

SEQ ID NO: 3651371 - RNA, 13 nt, Salmonella enterica enterica serovar Typhi
caccgccagcagu

SEQ ID NO: 3651372 - RNA, 18 nt, Salmonella enterica enterica serovar Typhi
caccgccagucccagcac

SEQ ID NO: 3651373 - RNA, 15 nt, Salmonella enterica enterica serovar Typhi
caccgccauauauuu

SEQ ID NO: 3651374 - RNA, 14 nt, Salmonella enterica enterica serovar Typhi
caccgccauccggc

SEQ ID NO: 3651375 - RNA, 15 nt, Salmonella enterica enterica serovar Typhi
caccgcccgccgggc

SEQ ID NO: 3651376 - RNA, 16 nt, Salmonella enterica enterica serovar Typhi
caccgcccgccgggcg

SEQ ID NO: 3651377 - RNA, 12 nt, Salmonella enterica enterica serovar Typhi
caccgccgcgcu

SEQ ID NO: 3651378 - RNA, 13 nt, Salmonella enterica enterica serovar Typhi
caccgcgaugacc

SEQ ID NO: 3651379 - RNA, 14 nt, Salmonella enterica enterica serovar Typhi
caccgcgaugcugc

SEQ ID NO: 3651380 - RNA, 15 nt, Salmonella enterica enterica serovar Typhi
caccgcgaugcugcu

SEQ ID NO: 3651381 - RNA, 22 nt, Salmonella enterica enterica serovar Typhi
caccgcggagaucgcucccgcg

SEQ ID NO: 3651382 - RNA, 20 nt, Salmonella enterica enterica serovar Typhi
caccgcggcaaccagcccau

SEQ ID NO: 3651383 - RNA, 23 nt, Salmonella enterica enterica serovar Typhi
caccgcuaaucccagcgcgcgcg

SEQ ID NO: 3651384 - RNA, 20 nt, Salmonella enterica enterica serovar Typhi
caccgcugcgcucacgcggc

SEQ ID NO: 3651385 - RNA, 20 nt, Salmonella enterica enterica serovar Typhi
caccgcuugccggcgcagcg

SEQ ID NO: 3651386 - RNA, 19 nt, Salmonella enterica enterica serovar Typhi
caccgcuuuggcgcccauu

SEQ ID NO: 3651387 - RNA, 13 nt, Salmonella enterica enterica serovar Typhi
caccggaagugaa

SEQ ID NO: 3651388 - RNA, 14 nt, Salmonella enterica enterica serovar Typhi
caccggacauccca

SEQ ID NO: 3651389 - RNA, 22 nt, Salmonella enterica enterica serovar Typhi
caccggacaucccaaacgcaau

SEQ ID NO: 3651390 - RNA, 16 nt, Salmonella enterica enterica serovar Typhi
caccggacucggcuga

SEQ ID NO: 3651391 - RNA, 14 nt, Salmonella enterica enterica serovar Typhi
caccggauacccag

SEQ ID NO: 3651392 - RNA, 18 nt, Salmonella enterica enterica serovar Typhi
caccggcacauccagcug

SEQ ID NO: 3651393 - RNA, 17 nt, Salmonella enterica enterica serovar Typhi
caccggccauugccgcg

SEQ ID NO: 3651394 - RNA, 15 nt, Salmonella enterica enterica serovar Typhi
caccggcccccggcc

SEQ ID NO: 3651395 - RNA, 13 nt, Salmonella enterica enterica serovar Typhi
caccggcgcgcca

SEQ ID NO: 3651396 - RNA, 14 nt, Salmonella enterica enterica serovar Typhi
caccggcgcgccag

SEQ ID NO: 3651397 - RNA, 18 nt, Salmonella enterica enterica serovar Typhi
caccgggagaaaacgcgg

SEQ ID NO: 3651398 - RNA, 21 nt, Salmonella enterica enterica serovar Typhi
caccgggagaaaacgcggccu

SEQ ID NO: 3651399 - RNA, 18 nt, Salmonella enterica enterica serovar Typhi
caccggguuaaagcccug

SEQ ID NO: 3651400 - RNA, 19 nt, Salmonella enterica enterica serovar Typhi
caccggguuaaagcccuga

SEQ ID NO: 3651401 - RNA, 22 nt, Salmonella enterica enterica serovar Typhi
caccgguacacacgcgcugacc

SEQ ID NO: 3651402 - RNA, 22 nt, Salmonella enterica enterica serovar Typhi
caccgguuuuuccgcuucaccu

SEQ ID NO: 3651403 - RNA, 19 nt, Salmonella enterica enterica serovar Typhi
caccguaaaaggaaucaac

SEQ ID NO: 3651404 - RNA, 15 nt, Salmonella enterica enterica serovar Typhi
caccguaaacggcuc

SEQ ID NO: 3651405 - RNA, 16 nt, Salmonella enterica enterica serovar Typhi
caccguagaucgccag

SEQ ID NO: 3651406 - RNA, 19 nt, Salmonella enterica enterica serovar Typhi
caccguaggccugauaaga

SEQ ID NO: 3651407 - RNA, 17 nt, Salmonella enterica enterica serovar Typhi
caccguauccggccugc

SEQ ID NO: 3651408 - RNA, 22 nt, Salmonella enterica enterica serovar Typhi
caccgucaacaucaucccgcgc

SEQ ID NO: 3651409 - RNA, 23 nt, Salmonella enterica enterica serovar Typhi
caccgucgagaaaccgcucgccg

SEQ ID NO: 3651410 - RNA, 16 nt, Salmonella enterica enterica serovar Typhi
caccgucuaucgugga

SEQ ID NO: 3651411 - RNA, 19 nt, Salmonella enterica enterica serovar Typhi
caccgucuccggcgcgccg

SEQ ID NO: 3651412 - RNA, 22 nt, Salmonella enterica enterica serovar Typhi
caccguggcaucaucaaacgau

SEQ ID NO: 3651413 - RNA, 21 nt, Salmonella enterica enterica serovar Typhi
caccguuacgaacgaagguca

SEQ ID NO: 3651414 - RNA, 13 nt, Salmonella enterica enterica serovar Typhi
caccguuauccgg

SEQ ID NO: 3651415 - RNA, 23 nt, Salmonella enterica enterica serovar Typhi
caccguugggcgcgacgccuggg

SEQ ID NO: 3651416 - RNA, 20 nt, Salmonella enterica enterica serovar Typhi
caccguuucuuugcugccgu

SEQ ID NO: 3651417 - RNA, 21 nt, Salmonella enterica enterica serovar Typhi
caccguuuuuuuaugcagccg

SEQ ID NO: 3651418 - RNA, 15 nt, Salmonella enterica enterica serovar Typhi
caccuaacccaccau

SEQ ID NO: 3651419 - RNA, 22 nt, Salmonella enterica enterica serovar Typhi
caccucaagguagcgugucuac

SEQ ID NO: 3651420 - RNA, 23 nt, Salmonella enterica enterica serovar Typhi
caccucaccggcuguauacacuu

SEQ ID NO: 3651421 - RNA, 19 nt, Salmonella enterica enterica serovar Typhi
caccucacguucugcauau

SEQ ID NO: 3651422 - RNA, 16 nt, Salmonella enterica enterica serovar Typhi
caccucacuccagacc

SEQ ID NO: 3651423 - RNA, 13 nt, Salmonella enterica enterica serovar Typhi
caccucagccaac

SEQ ID NO: 3651424 - RNA, 19 nt, Salmonella enterica enterica serovar Typhi
caccucagccaacccacgc

SEQ ID NO: 3651425 - RNA, 22 nt, Salmonella enterica enterica serovar Typhi
caccucagguaaauccgccagu

SEQ ID NO: 3651426 - RNA, 12 nt, Salmonella enterica enterica serovar Typhi
caccucauauuu

SEQ ID NO: 3651427 - RNA, 17 nt, Salmonella enterica enterica serovar Typhi
caccucaucacccaguc

SEQ ID NO: 3651428 - RNA, 23 nt, Salmonella enterica enterica serovar Typhi
caccucaucgcuaccuucuuccc

SEQ ID NO: 3651429 - RNA, 14 nt, Salmonella enterica enterica serovar Typhi
caccuccagcgccu

SEQ ID NO: 3651430 - RNA, 13 nt, Salmonella enterica enterica serovar Typhi
caccucgcaauau

SEQ ID NO: 3651431 - RNA, 23 nt, Salmonella enterica enterica serovar Typhi
caccucgcgacggugagcugaaa

SEQ ID NO: 3651432 - RNA, 20 nt, Salmonella enterica enterica serovar Typhi
caccucgguauguccugccg

SEQ ID NO: 3651433 - RNA, 18 nt, Salmonella enterica enterica serovar Typhi
caccucuuccccggucag

SEQ ID NO: 3651434 - RNA, 16 nt, Salmonella enterica enterica serovar Typhi
caccucuuccgccagg

SEQ ID NO: 3651435 - RNA, 23 nt, Salmonella enterica enterica serovar Typhi
caccucuuuaugcggcgcuucca

SEQ ID NO: 3651436 - RNA, 20 nt, Salmonella enterica enterica serovar Typhi
caccugaauaacccgcagcc

SEQ ID NO: 3651437 - RNA, 15 nt, Salmonella enterica enterica serovar Typhi
caccugaaugcaaag

SEQ ID NO: 3651438 - RNA, 16 nt, Salmonella enterica enterica serovar Typhi
caccugaaugcaaaga

SEQ ID NO: 3651439 - RNA, 15 nt, Salmonella enterica enterica serovar Typhi
caccugacggcagcc

SEQ ID NO: 3651440 - RNA, 13 nt, Salmonella enterica enterica serovar Typhi
caccugauucugc

SEQ ID NO: 3651441 - RNA, 22 nt, Salmonella enterica enterica serovar Typhi
caccugcaaacguagcgcguca

SEQ ID NO: 3651442 - RNA, 22 nt, Salmonella enterica enterica serovar Typhi
caccugcaucacgcccggcggu

SEQ ID NO: 3651443 - RNA, 18 nt, Salmonella enterica enterica serovar Typhi
caccugccaguccgcccg

SEQ ID NO: 3651444 - RNA, 20 nt, Salmonella enterica enterica serovar Typhi
caccugccauucacgcuggg

SEQ ID NO: 3651445 - RNA, 13 nt, Salmonella enterica enterica serovar Typhi
caccugcccuuuc

SEQ ID NO: 3651446 - RNA, 18 nt, Salmonella enterica enterica serovar Typhi
caccuggagcgccuccca

SEQ ID NO: 3651447 - RNA, 17 nt, Salmonella enterica enterica serovar Typhi
caccuggaugcugccug

SEQ ID NO: 3651448 - RNA, 23 nt, Salmonella enterica enterica serovar Typhi
caccugguaagcgccaagcggca

SEQ ID NO: 3651449 - RNA, 21 nt, Salmonella enterica enterica serovar Typhi
caccuggucuauucguucucu

SEQ ID NO: 3651450 - RNA, 23 nt, Salmonella enterica enterica serovar Typhi
caccuggucuauucguucucuga

SEQ ID NO: 3651451 - RNA, 15 nt, Salmonella enterica enterica serovar Typhi
caccuggugcauuuu

SEQ ID NO: 3651452 - RNA, 18 nt, Salmonella enterica enterica serovar Typhi
caccuguaaccccagcau

SEQ ID NO: 3651453 - RNA, 22 nt, Salmonella enterica enterica serovar Typhi
caccuguaaccccagcaucugc

SEQ ID NO: 3651454 - RNA, 19 nt, Salmonella enterica enterica serovar Typhi
caccuguuucugcuggccu

SEQ ID NO: 3651455 - RNA, 14 nt, Salmonella enterica enterica serovar Typhi
caccuuaaccgucu

SEQ ID NO: 3651456 - RNA, 14 nt, Salmonella enterica enterica serovar Typhi
cacgcgcgcgaaac

SEQ ID NO: 3651457 - RNA, 20 nt, Salmonella enterica enterica serovar Typhi
cacgcgcgcgcgucaacgcc

SEQ ID NO: 3651458 - RNA, 19 nt, Salmonella enterica enterica serovar Typhi
cacgcgcgcugcgccugga

SEQ ID NO: 3651459 - RNA, 14 nt, Salmonella enterica enterica serovar Typhi
cacgcgcgucagga

SEQ ID NO: 3651460 - RNA, 22 nt, Salmonella enterica enterica serovar Typhi
cacgcggaaucgucacagaccc

SEQ ID NO: 3651461 - RNA, 14 nt, Salmonella enterica enterica serovar Typhi
cacgcggcgcggaa

SEQ ID NO: 3651462 - RNA, 20 nt, Salmonella enterica enterica serovar Typhi
cacgcggucgucaucggcga

SEQ ID NO: 3651463 - RNA, 20 nt, Salmonella enterica enterica serovar Typhi
cacgcguaucuggucaucgu

SEQ ID NO: 3651464 - RNA, 14 nt, Salmonella enterica enterica serovar Typhi
cacgcguuauacgc

SEQ ID NO: 3651465 - RNA, 16 nt, Salmonella enterica enterica serovar Typhi
cacgcguuauacgcau

SEQ ID NO: 3651466 - RNA, 16 nt, Salmonella enterica enterica serovar Typhi
cacgcuaaucccgcuc

SEQ ID NO: 3651467 - RNA, 20 nt, Salmonella enterica enterica serovar Typhi
cacgcuauaaaguagccauu

SEQ ID NO: 3651468 - RNA, 22 nt, Salmonella enterica enterica serovar Typhi
cacgcucaagaugauagccauu

SEQ ID NO: 3651469 - RNA, 19 nt, Salmonella enterica enterica serovar Typhi
cacgcucaauggcgcgcca

SEQ ID NO: 3651470 - RNA, 18 nt, Salmonella enterica enterica serovar Typhi
cacgcucccggaaccgac

SEQ ID NO: 3651471 - RNA, 20 nt, Salmonella enterica enterica serovar Typhi
cacgcuccugcuccugcggc

SEQ ID NO: 3651472 - RNA, 15 nt, Salmonella enterica enterica serovar Typhi
cacgcucgaguucuu

SEQ ID NO: 3651473 - RNA, 19 nt, Salmonella enterica enterica serovar Typhi
cacgcucgcggaagcgacc

SEQ ID NO: 3651474 - RNA, 15 nt, Salmonella enterica enterica serovar Typhi
cacgcucgcuggugc

SEQ ID NO: 3651475 - RNA, 18 nt, Salmonella enterica enterica serovar Typhi
cacgcugaccacgccgcc

SEQ ID NO: 3651476 - RNA, 20 nt, Salmonella enterica enterica serovar Typhi
cacgcugaccacgccgccgc

SEQ ID NO: 3651477 - RNA, 17 nt, Salmonella enterica enterica serovar Typhi
cacgcugaggcgccguc

SEQ ID NO: 3651478 - RNA, 18 nt, Salmonella enterica enterica serovar Typhi
cacgcugaugcugugcag

SEQ ID NO: 3651479 - RNA, 13 nt, Salmonella enterica enterica serovar Typhi
cacgcugccgccg

SEQ ID NO: 3651480 - RNA, 14 nt, Salmonella enterica enterica serovar Typhi
cacgcugccgccgc

SEQ ID NO: 3651481 - RNA, 16 nt, Salmonella enterica enterica serovar Typhi
cacgcugccgccgcuc

SEQ ID NO: 3651482 - RNA, 15 nt, Salmonella enterica enterica serovar Typhi
cacgcuggcaucaau

SEQ ID NO: 3651483 - RNA, 18 nt, Salmonella enterica enterica serovar Typhi
cacgcuuuuacaucgcug

SEQ ID NO: 3651484 - RNA, 20 nt, Salmonella enterica enterica serovar Typhi
cacggaauccccggcuucca

SEQ ID NO: 3651485 - RNA, 23 nt, Salmonella enterica enterica serovar Typhi
cacggaauccccggcuuccagcg

SEQ ID NO: 3651486 - RNA, 14 nt, Salmonella enterica enterica serovar Typhi
cacggacucgccuu

SEQ ID NO: 3651487 - RNA, 19 nt, Salmonella enterica enterica serovar Typhi
cacggagagucgcaccgcg

SEQ ID NO: 3651488 - RNA, 19 nt, Salmonella enterica enterica serovar Typhi
cacggaucaucuacccgua

SEQ ID NO: 3651489 - RNA, 15 nt, Salmonella enterica enterica serovar Typhi
cacggaugaucuuca

SEQ ID NO: 3651490 - RNA, 21 nt, Salmonella enterica enterica serovar Typhi
cacggcaacgccguacuccag

SEQ ID NO: 3651491 - RNA, 15 nt, Salmonella enterica enterica serovar Typhi
cacggcauaagccuc

SEQ ID NO: 3651492 - RNA, 13 nt, Salmonella enterica enterica serovar Typhi
cacggcauacucc

SEQ ID NO: 3651493 - RNA, 15 nt, Salmonella enterica enterica serovar Typhi
cacggccacagccau

SEQ ID NO: 3651494 - RNA, 14 nt, Salmonella enterica enterica serovar Typhi
cacggccagcagcc

SEQ ID NO: 3651495 - RNA, 16 nt, Salmonella enterica enterica serovar Typhi
cacggcgacaaccgga

SEQ ID NO: 3651496 - RNA, 15 nt, Salmonella enterica enterica serovar Typhi
cacggcggccauuac

SEQ ID NO: 3651497 - RNA, 20 nt, Salmonella enterica enterica serovar Typhi
cacggcguguugaaauccuc

SEQ ID NO: 3651498 - RNA, 22 nt, Salmonella enterica enterica serovar Typhi
cacggcguguugaaauccucua

SEQ ID NO: 3651499 - RNA, 19 nt, Salmonella enterica enterica serovar Typhi
cacggcucgaucccgaccc

SEQ ID NO: 3651500 - RNA, 13 nt, Salmonella enterica enterica serovar Typhi
cacggcucgccuu

SEQ ID NO: 3651501 - RNA, 13 nt, Salmonella enterica enterica serovar Typhi
cacggcuggcaau

SEQ ID NO: 3651502 - RNA, 15 nt, Salmonella enterica enterica serovar Typhi
cacgggcgcaccaua

SEQ ID NO: 3651503 - RNA, 18 nt, Salmonella enterica enterica serovar Typhi
cacgggguuggcccuccc

SEQ ID NO: 3651504 - RNA, 18 nt, Salmonella enterica enterica serovar Typhi
cacggguagcuagccaau

SEQ ID NO: 3651505 - RNA, 16 nt, Salmonella enterica enterica serovar Typhi
cacgguaaaacacgcc

SEQ ID NO: 3651506 - RNA, 17 nt, Salmonella enterica enterica serovar Typhi
cacgguauuaacaggcg

SEQ ID NO: 3651507 - RNA, 15 nt, Salmonella enterica enterica serovar Typhi
cacggugugccgcca

SEQ ID NO: 3651508 - RNA, 13 nt, Salmonella enterica enterica serovar Typhi
cacgguugaagcg

SEQ ID NO: 3651509 - RNA, 15 nt, Salmonella enterica enterica serovar Typhi
cacgguuuuacgcug

SEQ ID NO: 3651510 - RNA, 19 nt, Salmonella enterica enterica serovar Typhi
cacguacccaaauaucaaa

SEQ ID NO: 3651511 - RNA, 18 nt, Salmonella enterica enterica serovar Typhi
cacguagccgucggcuuu

SEQ ID NO: 3651512 - RNA, 19 nt, Salmonella enterica enterica serovar Typhi
cacgucacgcaacaggccg

SEQ ID NO: 3651513 - RNA, 14 nt, Salmonella enterica enterica serovar Typhi
cacgucagcgacca

SEQ ID NO: 3651514 - RNA, 15 nt, Salmonella enterica enterica serovar Typhi
cacgucgauuuuccc

SEQ ID NO: 3651515 - RNA, 18 nt, Salmonella enterica enterica serovar Typhi
cacgucuccucagaugua

SEQ ID NO: 3651516 - RNA, 21 nt, Salmonella enterica enterica serovar Typhi
cacguguguugcgucaacgca

SEQ ID NO: 3651517 - RNA, 16 nt, Salmonella enterica enterica serovar Typhi
cacguuaaacaccuca

SEQ ID NO: 3651518 - RNA, 22 nt, Salmonella enterica enterica serovar Typhi
cacguuaaacaccucaccggcu

SEQ ID NO: 3651519 - RNA, 17 nt, Salmonella enterica enterica serovar Typhi
cacguuauaccacuggu

SEQ ID NO: 3651520 - RNA, 19 nt, Salmonella enterica enterica serovar Typhi
cacguugagaaagggauaa

SEQ ID NO: 3651521 - RNA, 22 nt, Salmonella enterica enterica serovar Typhi
cacguugccguaggcgacgcca

SEQ ID NO: 3651522 - RNA, 13 nt, Salmonella enterica enterica serovar Typhi
cacguuuuuacuc

SEQ ID NO: 3651523 - RNA, 14 nt, Salmonella enterica enterica serovar Typhi
cacuaaaaacaggc

SEQ ID NO: 3651524 - RNA, 13 nt, Salmonella enterica enterica serovar Typhi
cacuaaaacaccg

SEQ ID NO: 3651525 - RNA, 16 nt, Salmonella enterica enterica serovar Typhi
cacuaacgauguaaaa

SEQ ID NO: 3651526 - RNA, 18 nt, Salmonella enterica enterica serovar Typhi
cacuaacuaauuguuugu

SEQ ID NO: 3651527 - RNA, 19 nt, Salmonella enterica enterica serovar Typhi
cacuaauccccauuuuuuu

SEQ ID NO: 3651528 - RNA, 14 nt, Salmonella enterica enterica serovar Typhi
cacuaauuugaguc

SEQ ID NO: 3651529 - RNA, 12 nt, Salmonella enterica enterica serovar Typhi
cacuaauuugcg

SEQ ID NO: 3651530 - RNA, 13 nt, Salmonella enterica enterica serovar Typhi
cacuaccagaaac

SEQ ID NO: 3651531 - RNA, 17 nt, Salmonella enterica enterica serovar Typhi
cacuaccauuuccggcg

SEQ ID NO: 3651532 - RNA, 22 nt, Salmonella enterica enterica serovar Typhi
cacuaccauuuccggcgcgccu

SEQ ID NO: 3651533 - RNA, 16 nt, Salmonella enterica enterica serovar Typhi
cacuaccgccgcggau

SEQ ID NO: 3651534 - RNA, 21 nt, Salmonella enterica enterica serovar Typhi
cacuaccgggcagcaucucga

SEQ ID NO: 3651535 - RNA, 17 nt, Salmonella enterica enterica serovar Typhi
cacuacggcaaacgcug

SEQ ID NO: 3651536 - RNA, 16 nt, Salmonella enterica enterica serovar Typhi
cacuacggguuuuugu

SEQ ID NO: 3651537 - RNA, 18 nt, Salmonella enterica enterica serovar Typhi
cacuacggguuuuugugu

SEQ ID NO: 3651538 - RNA, 22 nt, Salmonella enterica enterica serovar Typhi
cacuacgguccaguugcccucu

SEQ ID NO: 3651539 - RNA, 17 nt, Salmonella enterica enterica serovar Typhi
cacuagcacuacggcaa

SEQ ID NO: 3651540 - RNA, 15 nt, Salmonella enterica enterica serovar Typhi
cacuauccagucagc

SEQ ID NO: 3651541 - RNA, 14 nt, Salmonella enterica enterica serovar Typhi
cacucaaccaacca

SEQ ID NO: 3651542 - RNA, 17 nt, Salmonella enterica enterica serovar Typhi
cacuuuccgaaucaggc

SEQ ID NO: 3651543 - RNA, 17 nt, Salmonella enterica enterica serovar Typhi
cacuuucucggcuuucc

SEQ ID NO: 3651544 - RNA, 21 nt, Salmonella enterica enterica serovar Typhi
cacuuucucggcuuuccagcu

SEQ ID NO: 3651545 - RNA, 15 nt, Salmonella enterica enterica serovar Typhi
cacuuugccuggguu

SEQ ID NO: 3651546 - RNA, 15 nt, Salmonella enterica enterica serovar Typhi
cacuuugcgcugcgc

SEQ ID NO: 3651547 - RNA, 15 nt, Salmonella enterica enterica serovar Typhi
cacuuuuccagccaa

SEQ ID NO: 3651548 - RNA, 13 nt, Salmonella enterica enterica serovar Typhi
cacuuuuuccucc

SEQ ID NO: 3651549 - RNA, 22 nt, Salmonella enterica enterica serovar Typhi
cacuuuuucucuuaucgccgcc

SEQ ID NO: 3651550 - RNA, 16 nt, Salmonella enterica enterica serovar Typhi
cagaaaaaaaagcgcc

SEQ ID NO: 3651551 - RNA, 14 nt, Salmonella enterica enterica serovar Typhi
cagaaaaaccuccg

SEQ ID NO: 3651552 - RNA, 14 nt, Salmonella enterica enterica serovar Typhi
cagaaaaagccccc

SEQ ID NO: 3651553 - RNA, 15 nt, Salmonella enterica enterica serovar Typhi
cagaaaaagccccca

SEQ ID NO: 3651554 - RNA, 13 nt, Salmonella enterica enterica serovar Typhi
cagaaaaccggca

SEQ ID NO: 3651555 - RNA, 16 nt, Salmonella enterica enterica serovar Typhi
cagaaaagaaccgacu

SEQ ID NO: 3651556 - RNA, 21 nt, Salmonella enterica enterica serovar Typhi
cagaaaaucuggcgagagcau

SEQ ID NO: 3651557 - RNA, 22 nt, Salmonella enterica enterica serovar Typhi
cagaaacaagaagcacgacaca

SEQ ID NO: 3651558 - RNA, 17 nt, Salmonella enterica enterica serovar Typhi
cagaaagccauaaaacu

SEQ ID NO: 3651559 - RNA, 18 nt, Salmonella enterica enterica serovar Typhi
cagaaagcggaccaaugc

SEQ ID NO: 3651560 - RNA, 23 nt, Salmonella enterica enterica serovar Typhi
cagaaauaaaauacgcucaauau

SEQ ID NO: 3651561 - RNA, 19 nt, Salmonella enterica enterica serovar Typhi
cagaaauaaaauacuucca

SEQ ID NO: 3651562 - RNA, 20 nt, Salmonella enterica enterica serovar Typhi
cagaaauaaaauacuuccau

SEQ ID NO: 3651563 - RNA, 23 nt, Salmonella enterica enterica serovar Typhi
cagaaauaacucccuauaaugcg

SEQ ID NO: 3651564 - RNA, 22 nt, Salmonella enterica enterica serovar Typhi
cagaaauccgcgaauaccuucc

SEQ ID NO: 3651565 - RNA, 13 nt, Salmonella enterica enterica serovar Typhi
cagaacaaaggcu

SEQ ID NO: 3651566 - RNA, 13 nt, Salmonella enterica enterica serovar Typhi
cagaacaucaagc

SEQ ID NO: 3651567 - RNA, 18 nt, Salmonella enterica enterica serovar Typhi
cagaaccccaucgccuga

SEQ ID NO: 3651568 - RNA, 20 nt, Salmonella enterica enterica serovar Typhi
cagaaccuguucaugccaga

SEQ ID NO: 3651569 - RNA, 15 nt, Salmonella enterica enterica serovar Typhi
cagaacgagaggagg

SEQ ID NO: 3651570 - RNA, 19 nt, Salmonella enterica enterica serovar Typhi
cagaacgcuuuugcgcacu

SEQ ID NO: 3651571 - RNA, 16 nt, Salmonella enterica enterica serovar Typhi
cagaacggcagcgucc

SEQ ID NO: 3651572 - RNA, 21 nt, Salmonella enterica enterica serovar Typhi
cagaacggcagcguccgccau

SEQ ID NO: 3651573 - RNA, 21 nt, Salmonella enterica enterica serovar Typhi
cagaacucacauauucaauaa

SEQ ID NO: 3651574 - RNA, 20 nt, Salmonella enterica enterica serovar Typhi
cagaacucaucuucuuuuuc

SEQ ID NO: 3651575 - RNA, 17 nt, Salmonella enterica enterica serovar Typhi
cagaacugcgaaaucac

SEQ ID NO: 3651576 - RNA, 23 nt, Salmonella enterica enterica serovar Typhi
cagaagaaaaucaacacgucgau

SEQ ID NO: 3651577 - RNA, 16 nt, Salmonella enterica enterica serovar Typhi
cagaagacagaagcug

SEQ ID NO: 3651578 - RNA, 22 nt, Salmonella enterica enterica serovar Typhi
cagaagaucuaaagccaguuuc

SEQ ID NO: 3651579 - RNA, 18 nt, Salmonella enterica enterica serovar Typhi
cagaagcaauccugacca

SEQ ID NO: 3651580 - RNA, 16 nt, Salmonella enterica enterica serovar Typhi
cagaagcacuucucca

SEQ ID NO: 3651581 - RNA, 12 nt, Salmonella enterica enterica serovar Typhi
cagaaggcaaaa

SEQ ID NO: 3651582 - RNA, 14 nt, Salmonella enterica enterica serovar Typhi
cagaaggcgaacau

SEQ ID NO: 3651583 - RNA, 17 nt, Salmonella enterica enterica serovar Typhi
cagaaggcuaacagcug

SEQ ID NO: 3651584 - RNA, 19 nt, Salmonella enterica enterica serovar Typhi
cagaaggcuaacagcuggc

SEQ ID NO: 3651585 - RNA, 20 nt, Salmonella enterica enterica serovar Typhi
cagaaggcuaacagcuggcu

SEQ ID NO: 3651586 - RNA, 21 nt, Salmonella enterica enterica serovar Typhi
cagaaggcuaacagcuggcuu

SEQ ID NO: 3651587 - RNA, 20 nt, Salmonella enterica enterica serovar Typhi
cagaagugccaguaacucau

SEQ ID NO: 3651588 - RNA, 18 nt, Salmonella enterica enterica serovar Typhi
cagaauaaugcuggcgga

SEQ ID NO: 3651589 - RNA, 17 nt, Salmonella enterica enterica serovar Typhi
cagaauacgaauauuca

SEQ ID NO: 3651590 - RNA, 18 nt, Salmonella enterica enterica serovar Typhi
cagaauacgaccucaaau

SEQ ID NO: 3651591 - RNA, 14 nt, Salmonella enterica enterica serovar Typhi
cagaauaugccagg

SEQ ID NO: 3651592 - RNA, 21 nt, Salmonella enterica enterica serovar Typhi
cagaauauugcugauaaucaa

SEQ ID NO: 3651593 - RNA, 15 nt, Salmonella enterica enterica serovar Typhi
cagaaucaccucuuu

SEQ ID NO: 3651594 - RNA, 21 nt, Salmonella enterica enterica serovar Typhi
cagaaucaccucuuucuccac

SEQ ID NO: 3651595 - RNA, 14 nt, Salmonella enterica enterica serovar Typhi
cagaaucagccgac

SEQ ID NO: 3651596 - RNA, 19 nt, Salmonella enterica enterica serovar Typhi
cagaaucaucaugucguca

SEQ ID NO: 3651597 - RNA, 22 nt, Salmonella enterica enterica serovar Typhi
cagaaucccacggagaaaagcg

SEQ ID NO: 3651598 - RNA, 23 nt, Salmonella enterica enterica serovar Typhi
cagaaucccgccuugcggcgcca

SEQ ID NO: 3651599 - RNA, 21 nt, Salmonella enterica enterica serovar Typhi
cagaauccgucagguuuuuug

SEQ ID NO: 3651600 - RNA, 14 nt, Salmonella enterica enterica serovar Typhi
cagaaucgccagca

SEQ ID NO: 3651601 - RNA, 14 nt, Salmonella enterica enterica serovar Typhi
cagaaugcaaaacu

SEQ ID NO: 3651602 - RNA, 15 nt, Salmonella enterica enterica serovar Typhi
cagaaugccagcgcc

SEQ ID NO: 3651603 - RNA, 16 nt, Salmonella enterica enterica serovar Typhi
cagaaugccagcgccg

SEQ ID NO: 3651604 - RNA, 18 nt, Salmonella enterica enterica serovar Typhi
cagaauuaacucaucaca

SEQ ID NO: 3651605 - RNA, 19 nt, Salmonella enterica enterica serovar Typhi
cagaauuaacucaucacag

SEQ ID NO: 3651606 - RNA, 21 nt, Salmonella enterica enterica serovar Typhi
cagaauuaacucaucacagcc

SEQ ID NO: 3651607 - RNA, 20 nt, Salmonella enterica enterica serovar Typhi
cagaauucguacguuuuucc

SEQ ID NO: 3651608 - RNA, 15 nt, Salmonella enterica enterica serovar Typhi
cagaauuuguuuaug

SEQ ID NO: 3651609 - RNA, 15 nt, Salmonella enterica enterica serovar Typhi
cagaauuuuuaacca

SEQ ID NO: 3651610 - RNA, 21 nt, Salmonella enterica enterica serovar Typhi
cagacaaaaucuuuccagcuc

SEQ ID NO: 3651611 - RNA, 16 nt, Salmonella enterica enterica serovar Typhi
cagacaacguccugcg

SEQ ID NO: 3651612 - RNA, 13 nt, Salmonella enterica enterica serovar Typhi
cagacaagcacau

SEQ ID NO: 3651613 - RNA, 20 nt, Salmonella enterica enterica serovar Typhi
cagacaaguagccugccagc

SEQ ID NO: 3651614 - RNA, 20 nt, Salmonella enterica enterica serovar Typhi
cagacaaucugugugggcac

SEQ ID NO: 3651615 - RNA, 20 nt, Salmonella enterica enterica serovar Typhi
cagacaauuuccgccgccag

SEQ ID NO: 3651616 - RNA, 13 nt, Salmonella enterica enterica serovar Typhi
cagacacugcacc

SEQ ID NO: 3651617 - RNA, 14 nt, Salmonella enterica enterica serovar Typhi
cagacacugcacca

SEQ ID NO: 3651618 - RNA, 12 nt, Salmonella enterica enterica serovar Typhi
cagacacugcca

SEQ ID NO: 3651619 - RNA, 13 nt, Salmonella enterica enterica serovar Typhi
cagacacugccac

SEQ ID NO: 3651620 - RNA, 12 nt, Salmonella enterica enterica serovar Typhi
cagacacuggaa

SEQ ID NO: 3651621 - RNA, 19 nt, Salmonella enterica enterica serovar Typhi
cagacacuggaaacagcca

SEQ ID NO: 3651622 - RNA, 22 nt, Salmonella enterica enterica serovar Typhi
cagacacuggaaacagccaauc

SEQ ID NO: 3651623 - RNA, 17 nt, Salmonella enterica enterica serovar Typhi
cagacagauaacaccag

SEQ ID NO: 3651624 - RNA, 19 nt, Salmonella enterica enterica serovar Typhi
cagacagauaacaccagcg

SEQ ID NO: 3651625 - RNA, 22 nt, Salmonella enterica enterica serovar Typhi
cagacagauaacaccagcgauc

SEQ ID NO: 3651626 - RNA, 17 nt, Salmonella enterica enterica serovar Typhi
cagacagaucgguuuau

SEQ ID NO: 3651627 - RNA, 21 nt, Salmonella enterica enterica serovar Typhi
cagagguaauuagaucggcaa

SEQ ID NO: 3651628 - RNA, 23 nt, Salmonella enterica enterica serovar Typhi
cagaggugaaccauugagauaug

SEQ ID NO: 3651629 - RNA, 18 nt, Salmonella enterica enterica serovar Typhi
cagaguaaaaaaaccggc

SEQ ID NO: 3651630 - RNA, 22 nt, Salmonella enterica enterica serovar Typhi
cagaguaacccgauacccugag

SEQ ID NO: 3651631 - RNA, 12 nt, Salmonella enterica enterica serovar Typhi
cagaguacauuc

SEQ ID NO: 3651632 - RNA, 20 nt, Salmonella enterica enterica serovar Typhi
cagaguacuggaauaucuaa

SEQ ID NO: 3651633 - RNA, 17 nt, Salmonella enterica enterica serovar Typhi
cagaguccagcggcagc

SEQ ID NO: 3651634 - RNA, 20 nt, Salmonella enterica enterica serovar Typhi
cagaguccggcgccugaaua

SEQ ID NO: 3651635 - RNA, 17 nt, Salmonella enterica enterica serovar Typhi
cagagucugaaaacuca

SEQ ID NO: 3651636 - RNA, 15 nt, Salmonella enterica enterica serovar Typhi
cagagugcucaauaa

SEQ ID NO: 3651637 - RNA, 18 nt, Salmonella enterica enterica serovar Typhi
cagaguucuuuugaggcu

SEQ ID NO: 3651638 - RNA, 12 nt, Salmonella enterica enterica serovar Typhi
cagauaaaccac

SEQ ID NO: 3651639 - RNA, 23 nt, Salmonella enterica enterica serovar Typhi
cagauaacaccagcgauccagau

SEQ ID NO: 3651640 - RNA, 13 nt, Salmonella enterica enterica serovar Typhi
cagauaaccgucg

SEQ ID NO: 3651641 - RNA, 22 nt, Salmonella enterica enterica serovar Typhi
cagauaacgcaucagacuguua

SEQ ID NO: 3651642 - RNA, 13 nt, Salmonella enterica enterica serovar Typhi
cagauaacugagc

SEQ ID NO: 3651643 - RNA, 21 nt, Salmonella enterica enterica serovar Typhi
cagauaagcucuccuggaugc

SEQ ID NO: 3651644 - RNA, 22 nt, Salmonella enterica enterica serovar Typhi
cagauaaugaucaacgcggcga

SEQ ID NO: 3651645 - RNA, 19 nt, Salmonella enterica enterica serovar Typhi
cagauaaugccgcuggcgu

SEQ ID NO: 3651646 - RNA, 23 nt, Salmonella enterica enterica serovar Typhi
cagauacacgccuuccuccagca

SEQ ID NO: 3651647 - RNA, 15 nt, Salmonella enterica enterica serovar Typhi
cagauacauggcuau

SEQ ID NO: 3651648 - RNA, 19 nt, Salmonella enterica enterica serovar Typhi
cagauaccagcguugaauc

SEQ ID NO: 3651649 - RNA, 21 nt, Salmonella enterica enterica serovar Typhi
cagauacgccuuuacgucgcc

SEQ ID NO: 3651650 - RNA, 15 nt, Salmonella enterica enterica serovar Typhi
cagauacgcgccggc

SEQ ID NO: 3651651 - RNA, 20 nt, Salmonella enterica enterica serovar Typhi
cagauacugcgcguggcaaa

SEQ ID NO: 3651652 - RNA, 15 nt, Salmonella enterica enterica serovar Typhi
cagauacuucaguuu

SEQ ID NO: 3651653 - RNA, 22 nt, Salmonella enterica enterica serovar Typhi
cagauagaaugcuucuucgcca

SEQ ID NO: 3651654 - RNA, 20 nt, Salmonella enterica enterica serovar Typhi
cagauagcaaaaaagcgccu

SEQ ID NO: 3651655 - RNA, 13 nt, Salmonella enterica enterica serovar Typhi
cagauagcccgcc

SEQ ID NO: 3651656 - RNA, 18 nt, Salmonella enterica enterica serovar Typhi
cagauagcccgccagcac

SEQ ID NO: 3651657 - RNA, 19 nt, Salmonella enterica enterica serovar Typhi
cagauagcccgccagcacc

SEQ ID NO: 3651658 - RNA, 21 nt, Salmonella enterica enterica serovar Typhi
cagauagcccgccagcaccag

SEQ ID NO: 3651659 - RNA, 17 nt, Salmonella enterica enterica serovar Typhi
cagauagcccugagccc

SEQ ID NO: 3651660 - RNA, 18 nt, Salmonella enterica enterica serovar Typhi
cagauagcgaucgccgcu

SEQ ID NO: 3651661 - RNA, 20 nt, Salmonella enterica enterica serovar Typhi
cagauaggcggcaaauaaag

SEQ ID NO: 3651662 - RNA, 17 nt, Salmonella enterica enterica serovar Typhi
cagauagggccaggcgc

SEQ ID NO: 3651663 - RNA, 18 nt, Salmonella enterica enterica serovar Typhi
cagauauuccagcgacau

SEQ ID NO: 3651664 - RNA, 16 nt, Salmonella enterica enterica serovar Typhi
cagauauugccgacca

SEQ ID NO: 3651665 - RNA, 15 nt, Salmonella enterica enterica serovar Typhi
cagaucaaaaaucug

SEQ ID NO: 3651666 - RNA, 21 nt, Salmonella enterica enterica serovar Typhi
cagauccaucgccugcggcgu

SEQ ID NO: 3651667 - RNA, 16 nt, Salmonella enterica enterica serovar Typhi
cagaucccagguaacc

SEQ ID NO: 3651668 - RNA, 19 nt, Salmonella enterica enterica serovar Typhi
cagaucccagguaaccgcu

SEQ ID NO: 3651669 - RNA, 15 nt, Salmonella enterica enterica serovar Typhi
cagauccuuuuucug

SEQ ID NO: 3651670 - RNA, 15 nt, Salmonella enterica enterica serovar Typhi
cagaucgaaugaaaa

SEQ ID NO: 3651671 - RNA, 15 nt, Salmonella enterica enterica serovar Typhi
cagaucgaccagcgc

SEQ ID NO: 3651672 - RNA, 22 nt, Salmonella enterica enterica serovar Typhi
cagaucgccacgauugaucuca

SEQ ID NO: 3651673 - RNA, 13 nt, Salmonella enterica enterica serovar Typhi
cagaucgccgccg

SEQ ID NO: 3651674 - RNA, 16 nt, Salmonella enterica enterica serovar Typhi
cagaucgcgcugcgca

SEQ ID NO: 3651675 - RNA, 18 nt, Salmonella enterica enterica serovar Typhi
cagaucggcaugauggcg

SEQ ID NO: 3651676 - RNA, 19 nt, Salmonella enterica enterica serovar Typhi
cagaucgguaaaagcguuu

SEQ ID NO: 3651677 - RNA, 15 nt, Salmonella enterica enterica serovar Typhi
cagaucgguuuaucc

SEQ ID NO: 3651678 - RNA, 16 nt, Salmonella enterica enterica serovar Typhi
cagaucgguuuauccc

SEQ ID NO: 3651679 - RNA, 18 nt, Salmonella enterica enterica serovar Typhi
cagaucguagccauguuc

SEQ ID NO: 3651680 - RNA, 22 nt, Salmonella enterica enterica serovar Typhi
cagaucuuauaugagcgggccg

SEQ ID NO: 3651681 - RNA, 21 nt, Salmonella enterica enterica serovar Typhi
cagaucuucaaucgugaccac

SEQ ID NO: 3651682 - RNA, 15 nt, Salmonella enterica enterica serovar Typhi
cagaucuucagaggc

SEQ ID NO: 3651683 - RNA, 17 nt, Salmonella enterica enterica serovar Typhi
cagaucuuuuugcuccu

SEQ ID NO: 3651684 - RNA, 22 nt, Salmonella enterica enterica serovar Typhi
cagaugaaacugcauaucgccg

SEQ ID NO: 3651685 - RNA, 17 nt, Salmonella enterica enterica serovar Typhi
cagaugacagugcgcca

SEQ ID NO: 3651686 - RNA, 17 nt, Salmonella enterica enterica serovar Typhi
cagaugagcgguaaguc

SEQ ID NO: 3651687 - RNA, 22 nt, Salmonella enterica enterica serovar Typhi
cagaugagcgguaagucgacca

SEQ ID NO: 3651688 - RNA, 14 nt, Salmonella enterica enterica serovar Typhi
cagaugcaaugcag

SEQ ID NO: 3651689 - RNA, 17 nt, Salmonella enterica enterica serovar Typhi
cagaugcagcaacguuu

SEQ ID NO: 3651690 - RNA, 13 nt, Salmonella enterica enterica serovar Typhi
cagaugcagcggc

SEQ ID NO: 3651691 - RNA, 16 nt, Salmonella enterica enterica serovar Typhi
cagaugcaguucaccc

SEQ ID NO: 3651692 - RNA, 19 nt, Salmonella enterica enterica serovar Typhi
cagaugcccguaaagcucg

SEQ ID NO: 3651693 - RNA, 14 nt, Salmonella enterica enterica serovar Typhi
cagaugcugcguuu

SEQ ID NO: 3651694 - RNA, 14 nt, Salmonella enterica enterica serovar Typhi
cagauggaaaccgg

SEQ ID NO: 3651695 - RNA, 21 nt, Salmonella enterica enterica serovar Typhi
cagauggcgucacauggcgaa

SEQ ID NO: 3651696 - RNA, 22 nt, Salmonella enterica enterica serovar Typhi
cagauggcuaugaagcuggagc

SEQ ID NO: 3651697 - RNA, 13 nt, Salmonella enterica enterica serovar Typhi
cagauggcugcac

SEQ ID NO: 3651698 - RNA, 22 nt, Salmonella enterica enterica serovar Typhi
cagauggcuuuacgcuuauucg

SEQ ID NO: 3651699 - RNA, 20 nt, Salmonella enterica enterica serovar Typhi
cagaugggccauuuacgcca

SEQ ID NO: 3651700 - RNA, 18 nt, Salmonella enterica enterica serovar Typhi
cagaugguuggcgccgau

SEQ ID NO: 3651701 - RNA, 16 nt, Salmonella enterica enterica serovar Typhi
cagauguaccagcggc

SEQ ID NO: 3651702 - RNA, 20 nt, Salmonella enterica enterica serovar Typhi
cagauguaccagcggcagcu

SEQ ID NO: 3651703 - RNA, 16 nt, Salmonella enterica enterica serovar Typhi
cagauguccaccgauu

SEQ ID NO: 3651704 - RNA, 19 nt, Salmonella enterica enterica serovar Typhi
cagauguccaccgauuuca

SEQ ID NO: 3651705 - RNA, 23 nt, Salmonella enterica enterica serovar Typhi
cagauguccaccgauuucaucgc

SEQ ID NO: 3651706 - RNA, 19 nt, Salmonella enterica enterica serovar Typhi
cagaugucgcggauaugca

SEQ ID NO: 3651707 - RNA, 20 nt, Salmonella enterica enterica serovar Typhi
cagauguuuacgcugcuccg

SEQ ID NO: 3651708 - RNA, 16 nt, Salmonella enterica enterica serovar Typhi
cagauuaucagcgaga

SEQ ID NO: 3651709 - RNA, 23 nt, Salmonella enterica enterica serovar Typhi
cagauuauccagucccaccgggc

SEQ ID NO: 3651710 - RNA, 14 nt, Salmonella enterica enterica serovar Typhi
cagauucagauggc

SEQ ID NO: 3651711 - RNA, 17 nt, Salmonella enterica enterica serovar Typhi
cagauuccgaacucaug

SEQ ID NO: 3651712 - RNA, 19 nt, Salmonella enterica enterica serovar Typhi
cagcagaauaacaucuucc

SEQ ID NO: 3651713 - RNA, 17 nt, Salmonella enterica enterica serovar Typhi
cagcagacaaccgacgc

SEQ ID NO: 3651714 - RNA, 20 nt, Salmonella enterica enterica serovar Typhi
cagcagacaaccgacgcauu

SEQ ID NO: 3651715 - RNA, 16 nt, Salmonella enterica enterica serovar Typhi
cagcagacaggugaac

SEQ ID NO: 3651716 - RNA, 22 nt, Salmonella enterica enterica serovar Typhi
cagcagacugccuacgcggcca

SEQ ID NO: 3651717 - RNA, 23 nt, Salmonella enterica enterica serovar Typhi
cagcagauagcccgccagcacca

SEQ ID NO: 3651718 - RNA, 15 nt, Salmonella enterica enterica serovar Typhi
cagcagcaccggcug

SEQ ID NO: 3651719 - RNA, 14 nt, Salmonella enterica enterica serovar Typhi
cagcagcagcaccg

SEQ ID NO: 3651720 - RNA, 19 nt, Salmonella enterica enterica serovar Typhi
cagcagcccgucuuuuucc

SEQ ID NO: 3651721 - RNA, 17 nt, Salmonella enterica enterica serovar Typhi
cagcagccgggccagac

SEQ ID NO: 3651722 - RNA, 19 nt, Salmonella enterica enterica serovar Typhi
cagcagccgguauccagcg

SEQ ID NO: 3651723 - RNA, 15 nt, Salmonella enterica enterica serovar Typhi
cagcagcgacgcauu

SEQ ID NO: 3651724 - RNA, 15 nt, Salmonella enterica enterica serovar Typhi
cagcagcgcaucaug

SEQ ID NO: 3651725 - RNA, 17 nt, Salmonella enterica enterica serovar Typhi
cagcagcgcgaucgccc

SEQ ID NO: 3651726 - RNA, 22 nt, Salmonella enterica enterica serovar Typhi
cagcagcgcgaucgccccgacc

SEQ ID NO: 3651727 - RNA, 13 nt, Salmonella enterica enterica serovar Typhi
cagcagcgcggca

SEQ ID NO: 3651728 - RNA, 16 nt, Salmonella enterica enterica serovar Typhi
cagcagcgcuuucuuc

SEQ ID NO: 3651729 - RNA, 20 nt, Salmonella enterica enterica serovar Typhi
cagcagcgcuuucuucuuca

SEQ ID NO: 3651730 - RNA, 22 nt, Salmonella enterica enterica serovar Typhi
cagcagcgcuuucuucuucacg

SEQ ID NO: 3651731 - RNA, 13 nt, Salmonella enterica enterica serovar Typhi
cagcagcugcugu

SEQ ID NO: 3651732 - RNA, 12 nt, Salmonella enterica enterica serovar Typhi
cagcaggcuuug

SEQ ID NO: 3651733 - RNA, 18 nt, Salmonella enterica enterica serovar Typhi
cagcaggcuuugcugcug

SEQ ID NO: 3651734 - RNA, 20 nt, Salmonella enterica enterica serovar Typhi
cagcagguuaaacagacaau

SEQ ID NO: 3651735 - RNA, 18 nt, Salmonella enterica enterica serovar Typhi
cagcaguggcucagucag

SEQ ID NO: 3651736 - RNA, 23 nt, Salmonella enterica enterica serovar Typhi
cagcaguggcucagucagucccg

SEQ ID NO: 3651737 - RNA, 18 nt, Salmonella enterica enterica serovar Typhi
cagcaguuuuucaaucuu

SEQ ID NO: 3651738 - RNA, 19 nt, Salmonella enterica enterica serovar Typhi
cagcauaauaaagcagcgg

SEQ ID NO: 3651739 - RNA, 20 nt, Salmonella enterica enterica serovar Typhi
cagcauaauaaagcagcggc

SEQ ID NO: 3651740 - RNA, 23 nt, Salmonella enterica enterica serovar Typhi
cagcauaauauccugcaccgccu

SEQ ID NO: 3651741 - RNA, 23 nt, Salmonella enterica enterica serovar Typhi
cagcauaauauucauaacgccga

SEQ ID NO: 3651742 - RNA, 17 nt, Salmonella enterica enterica serovar Typhi
cagcauaccgcccaaca

SEQ ID NO: 3651743 - RNA, 21 nt, Salmonella enterica enterica serovar Typhi
cagcauacugaugucguugua

SEQ ID NO: 3651744 - RNA, 14 nt, Salmonella enterica enterica serovar Typhi
cagcauauccagcg

SEQ ID NO: 3651745 - RNA, 15 nt, Salmonella enterica enterica serovar Typhi
cagcauauccagcgc

SEQ ID NO: 3651746 - RNA, 16 nt, Salmonella enterica enterica serovar Typhi
cagcauauccagcgcc

SEQ ID NO: 3651747 - RNA, 19 nt, Salmonella enterica enterica serovar Typhi
cagcauauccagcgccugc

SEQ ID NO: 3651748 - RNA, 23 nt, Salmonella enterica enterica serovar Typhi
cagcauaucgauagcaucgguca

SEQ ID NO: 3651749 - RNA, 21 nt, Salmonella enterica enterica serovar Typhi
cagcauauuuuccggcgucug

SEQ ID NO: 3651750 - RNA, 18 nt, Salmonella enterica enterica serovar Typhi
cagcaucaaccaccaaaa

SEQ ID NO: 3651751 - RNA, 12 nt, Salmonella enterica enterica serovar Typhi
cagcaucaaccc

SEQ ID NO: 3651752 - RNA, 15 nt, Salmonella enterica enterica serovar Typhi
cagcaucacaucaaa

SEQ ID NO: 3651753 - RNA, 16 nt, Salmonella enterica enterica serovar Typhi
cagcaucaccggcccc

SEQ ID NO: 3651754 - RNA, 12 nt, Salmonella enterica enterica serovar Typhi
cagcaucaucuc

SEQ ID NO: 3651755 - RNA, 22 nt, Salmonella enterica enterica serovar Typhi
cagcaucaucucccaggccgcc

SEQ ID NO: 3651756 - RNA, 21 nt, Salmonella enterica enterica serovar Typhi
cagcaucaugggcucaucaaa

SEQ ID NO: 3651757 - RNA, 14 nt, Salmonella enterica enterica serovar Typhi
cagcauccagcuca

SEQ ID NO: 3651758 - RNA, 16 nt, Salmonella enterica enterica serovar Typhi
cagcauccaugccagc

SEQ ID NO: 3651759 - RNA, 16 nt, Salmonella enterica enterica serovar Typhi
cagcauccuccggcga

SEQ ID NO: 3651760 - RNA, 14 nt, Salmonella enterica enterica serovar Typhi
cagcaucgaccagg

SEQ ID NO: 3651761 - RNA, 16 nt, Salmonella enterica enterica serovar Typhi
cagcaucgaccaggau

SEQ ID NO: 3651762 - RNA, 15 nt, Salmonella enterica enterica serovar Typhi
cagcaucgccaucaa

SEQ ID NO: 3651763 - RNA, 14 nt, Salmonella enterica enterica serovar Typhi
cagcaucgcccggg

SEQ ID NO: 3651764 - RNA, 16 nt, Salmonella enterica enterica serovar Typhi
cagcaucggcagcgcc

SEQ ID NO: 3651765 - RNA, 17 nt, Salmonella enterica enterica serovar Typhi
cagcaucggcagcgcca

SEQ ID NO: 3651766 - RNA, 17 nt, Salmonella enterica enterica serovar Typhi
cagcaucgggaaucauc

SEQ ID NO: 3651767 - RNA, 16 nt, Salmonella enterica enterica serovar Typhi
cagcaucgugccggaa

SEQ ID NO: 3651768 - RNA, 14 nt, Salmonella enterica enterica serovar Typhi
cagcaucuccuggc

SEQ ID NO: 3651769 - RNA, 24 nt, Salmonella enterica enterica serovar Typhi
cagcaucugcggcuuucaucauuc

SEQ ID NO: 3651770 - RNA, 21 nt, Salmonella enterica enterica serovar Typhi
cagcaugaauaaccucccgcc

SEQ ID NO: 3651771 - RNA, 17 nt, Salmonella enterica enterica serovar Typhi
cagcaugaucauacugc

SEQ ID NO: 3651772 - RNA, 19 nt, Salmonella enterica enterica serovar Typhi
cagcaugcccgccagcggg

SEQ ID NO: 3651773 - RNA, 23 nt, Salmonella enterica enterica serovar Typhi
cagcaugguguguucccgcgcca

SEQ ID NO: 3651774 - RNA, 20 nt, Salmonella enterica enterica serovar Typhi
cagcauguccgccuaccagc

SEQ ID NO: 3651775 - RNA, 12 nt, Salmonella enterica enterica serovar Typhi
cagcaugugccg

SEQ ID NO: 3651776 - RNA, 17 nt, Salmonella enterica enterica serovar Typhi
cagcauuaacccggccc

SEQ ID NO: 3651777 - RNA, 17 nt, Salmonella enterica enterica serovar Typhi
cagcauugaccaccaua

SEQ ID NO: 3651778 - RNA, 19 nt, Salmonella enterica enterica serovar Typhi
cagcauuucaaucgcgccc

SEQ ID NO: 3651779 - RNA, 12 nt, Salmonella enterica enterica serovar Typhi
cagcauuucuuc

SEQ ID NO: 3651780 - RNA, 13 nt, Salmonella enterica enterica serovar Typhi
cagcauuucuuca

SEQ ID NO: 3651781 - RNA, 21 nt, Salmonella enterica enterica serovar Typhi
cagcauuuuucacaguucuac

SEQ ID NO: 3651782 - RNA, 21 nt, Salmonella enterica enterica serovar Typhi
cagccaaaaauaacgcccugc

SEQ ID NO: 3651783 - RNA, 22 nt, Salmonella enterica enterica serovar Typhi
cagccaaaaauaacgcccugcg

SEQ ID NO: 3651784 - RNA, 15 nt, Salmonella enterica enterica serovar Typhi
cagccaaaacgucgu

SEQ ID NO: 3651785 - RNA, 17 nt, Salmonella enterica enterica serovar Typhi
cagccaaaauaugcugg

SEQ ID NO: 3651786 - RNA, 13 nt, Salmonella enterica enterica serovar Typhi
cagccaaacugcu

SEQ ID NO: 3651787 - RNA, 18 nt, Salmonella enterica enterica serovar Typhi
cagccaaacugcuguagc

SEQ ID NO: 3651788 - RNA, 23 nt, Salmonella enterica enterica serovar Typhi
cagccaaagcgagguaaaaagcg

SEQ ID NO: 3651789 - RNA, 17 nt, Salmonella enterica enterica serovar Typhi
cagccaaagucuggcca

SEQ ID NO: 3651790 - RNA, 15 nt, Salmonella enterica enterica serovar Typhi
cagccaaauagcgcc

SEQ ID NO: 3651791 - RNA, 17 nt, Salmonella enterica enterica serovar Typhi
cagccaaauagcgccag

SEQ ID NO: 3651792 - RNA, 19 nt, Salmonella enterica enterica serovar Typhi
cagccaaauagcgccagac

SEQ ID NO: 3651793 - RNA, 16 nt, Salmonella enterica enterica serovar Typhi
cagccaacaaagaggc

SEQ ID NO: 3651794 - RNA, 17 nt, Salmonella enterica enterica serovar Typhi
cagccaacccacgcgcc

SEQ ID NO: 3651795 - RNA, 14 nt, Salmonella enterica enterica serovar Typhi
cagccaaucauaaa

SEQ ID NO: 3651796 - RNA, 16 nt, Salmonella enterica enterica serovar Typhi
cagccaaucauaaacg

SEQ ID NO: 3651797 - RNA, 20 nt, Salmonella enterica enterica serovar Typhi
cagccuauccccgaaaguua

SEQ ID NO: 3651798 - RNA, 17 nt, Salmonella enterica enterica serovar Typhi
cagccucaggccugccg

SEQ ID NO: 3651799 - RNA, 19 nt, Salmonella enterica enterica serovar Typhi
cagccucgcgcauccgggc

SEQ ID NO: 3651800 - RNA, 17 nt, Salmonella enterica enterica serovar Typhi
cagccucucuugauaac

SEQ ID NO: 3651801 - RNA, 15 nt, Salmonella enterica enterica serovar Typhi
cagccugccgucuuu

SEQ ID NO: 3651802 - RNA, 23 nt, Salmonella enterica enterica serovar Typhi
cagccugcuggucugaaucugcu

SEQ ID NO: 3651803 - RNA, 11 nt, Salmonella enterica enterica serovar Typhi
cagccugugca

SEQ ID NO: 3651804 - RNA, 13 nt, Salmonella enterica enterica serovar Typhi
cagccuguuugga

SEQ ID NO: 3651805 - RNA, 20 nt, Salmonella enterica enterica serovar Typhi
cagccuuaaucaacugcgcc

SEQ ID NO: 3651806 - RNA, 18 nt, Salmonella enterica enterica serovar Typhi
cagccuucggacugcugg

SEQ ID NO: 3651807 - RNA, 18 nt, Salmonella enterica enterica serovar Typhi
cagccuuuucauauggaa

SEQ ID NO: 3651808 - RNA, 17 nt, Salmonella enterica enterica serovar Typhi
cagcgaaacgacgucga

SEQ ID NO: 3651809 - RNA, 23 nt, Salmonella enterica enterica serovar Typhi
cagcgaaacgacgucgacgccuu

SEQ ID NO: 3651810 - RNA, 21 nt, Salmonella enterica enterica serovar Typhi
cagcgaaaugacggccaccag

SEQ ID NO: 3651811 - RNA, 22 nt, Salmonella enterica enterica serovar Typhi
cagcgaaaugacggccaccagc

SEQ ID NO: 3651812 - RNA, 23 nt, Salmonella enterica enterica serovar Typhi
cagcgaaaugacggccaccagcg

SEQ ID NO: 3651813 - RNA, 16 nt, Salmonella enterica enterica serovar Typhi
cagcgaaccgcggcau

SEQ ID NO: 3651814 - RNA, 15 nt, Salmonella enterica enterica serovar Typhi
cagcgaaccuuccau

SEQ ID NO: 3651815 - RNA, 19 nt, Salmonella enterica enterica serovar Typhi
cagcgaacucccgggcgcu

SEQ ID NO: 3651816 - RNA, 16 nt, Salmonella enterica enterica serovar Typhi
cagcgaauuccggcca

SEQ ID NO: 3651817 - RNA, 15 nt, Salmonella enterica enterica serovar Typhi
cagcgacacuccgcg

SEQ ID NO: 3651818 - RNA, 14 nt, Salmonella enterica enterica serovar Typhi
cagcgacaggcugu

SEQ ID NO: 3651819 - RNA, 16 nt, Salmonella enterica enterica serovar Typhi
cagcgaccacgccacc

SEQ ID NO: 3651820 - RNA, 14 nt, Salmonella enterica enterica serovar Typhi
cagcgaccuccgcg

SEQ ID NO: 3651821 - RNA, 16 nt, Salmonella enterica enterica serovar Typhi
cagcgaccuccgcgca

SEQ ID NO: 3651822 - RNA, 20 nt, Salmonella enterica enterica serovar Typhi
cagcgacgaugaaauaaacg

SEQ ID NO: 3651823 - RNA, 15 nt, Salmonella enterica enterica serovar Typhi
cagcgacgcauugag

SEQ ID NO: 3651824 - RNA, 17 nt, Salmonella enterica enterica serovar Typhi
cagcgacgccagauuau

SEQ ID NO: 3651825 - RNA, 15 nt, Salmonella enterica enterica serovar Typhi
cagcgacgcccagug

SEQ ID NO: 3651826 - RNA, 22 nt, Salmonella enterica enterica serovar Typhi
cagcgacucauucagcaacugc

SEQ ID NO: 3651827 - RNA, 19 nt, Salmonella enterica enterica serovar Typhi
cagcgacugguguuauuaa

SEQ ID NO: 3651828 - RNA, 15 nt, Salmonella enterica enterica serovar Typhi
cagcgacuucaggcg

SEQ ID NO: 3651829 - RNA, 15 nt, Salmonella enterica enterica serovar Typhi
cagcgagaagucggc

SEQ ID NO: 3651830 - RNA, 14 nt, Salmonella enterica enterica serovar Typhi
cagcgagacgcugg

SEQ ID NO: 3651831 - RNA, 15 nt, Salmonella enterica enterica serovar Typhi
cagcgagacgcugga

SEQ ID NO: 3651832 - RNA, 15 nt, Salmonella enterica enterica serovar Typhi
cagcgagauggcuuu

SEQ ID NO: 3651833 - RNA, 22 nt, Salmonella enterica enterica serovar Typhi
cagcgaggugauaaucagcgcu

SEQ ID NO: 3651834 - RNA, 15 nt, Salmonella enterica enterica serovar Typhi
cagcgagugcgccca

SEQ ID NO: 3651835 - RNA, 14 nt, Salmonella enterica enterica serovar Typhi
cagcgauagucguu

SEQ ID NO: 3651836 - RNA, 15 nt, Salmonella enterica enterica serovar Typhi
cagcgauauuacuuu

SEQ ID NO: 3651837 - RNA, 19 nt, Salmonella enterica enterica serovar Typhi
cagcgauauuucuccgccc

SEQ ID NO: 3651838 - RNA, 23 nt, Salmonella enterica enterica serovar Typhi
cagcgaucccaguugaucggcca

SEQ ID NO: 3651839 - RNA, 16 nt, Salmonella enterica enterica serovar Typhi
cagcgauuacgccaga

SEQ ID NO: 3651840 - RNA, 17 nt, Salmonella enterica enterica serovar Typhi
cagcgauuacgccagac

SEQ ID NO: 3651841 - RNA, 16 nt, Salmonella enterica enterica serovar Typhi
cagcgauuccgucagg

SEQ ID NO: 3651842 - RNA, 16 nt, Salmonella enterica enterica serovar Typhi
cagcgauugcgccaga

SEQ ID NO: 3651843 - RNA, 22 nt, Salmonella enterica enterica serovar Typhi
cagcgcaaacgacgcugacuca

SEQ ID NO: 3651844 - RNA, 20 nt, Salmonella enterica enterica serovar Typhi
cagcgcaaaguuuucuuccg

SEQ ID NO: 3651845 - RNA, 12 nt, Salmonella enterica enterica serovar Typhi
cagcgcaacgcc

SEQ ID NO: 3651846 - RNA, 14 nt, Salmonella enterica enterica serovar Typhi
cagcgcaacgcgca

SEQ ID NO: 3651847 - RNA, 18 nt, Salmonella enterica enterica serovar Typhi
cagcgcaacgcgcaucaa

SEQ ID NO: 3651848 - RNA, 13 nt, Salmonella enterica enterica serovar Typhi
cagcgcaccugcc

SEQ ID NO: 3651849 - RNA, 21 nt, Salmonella enterica enterica serovar Typhi
cagcgcagagugaccagcggu

SEQ ID NO: 3651850 - RNA, 16 nt, Salmonella enterica enterica serovar Typhi
cagcgcauaccggcca

SEQ ID NO: 3651851 - RNA, 17 nt, Salmonella enterica enterica serovar Typhi
cagcgcauccaccagac

SEQ ID NO: 3651852 - RNA, 14 nt, Salmonella enterica enterica serovar Typhi
cagcgcauggaaga

SEQ ID NO: 3651853 - RNA, 14 nt, Salmonella enterica enterica serovar Typhi
cagcgcauugccuu

SEQ ID NO: 3651854 - RNA, 16 nt, Salmonella enterica enterica serovar Typhi
cagcgccaacgccacu

SEQ ID NO: 3651855 - RNA, 16 nt, Salmonella enterica enterica serovar Typhi
cagcgccaccacaaac

SEQ ID NO: 3651856 - RNA, 21 nt, Salmonella enterica enterica serovar Typhi
cagcgccacggagcauaauuu

SEQ ID NO: 3651857 - RNA, 14 nt, Salmonella enterica enterica serovar Typhi
cagcgccagauagu

SEQ ID NO: 3651858 - RNA, 17 nt, Salmonella enterica enterica serovar Typhi
cagcgccagauagucac

SEQ ID NO: 3651859 - RNA, 14 nt, Salmonella enterica enterica serovar Typhi
cagcgccagcagca

SEQ ID NO: 3651860 - RNA, 14 nt, Salmonella enterica enterica serovar Typhi
cagcgccagcccug

SEQ ID NO: 3651861 - RNA, 15 nt, Salmonella enterica enterica serovar Typhi
cagcgccagcccugc

SEQ ID NO: 3651862 - RNA, 13 nt, Salmonella enterica enterica serovar Typhi
cagcgccagccgc

SEQ ID NO: 3651863 - RNA, 14 nt, Salmonella enterica enterica serovar Typhi
cagcgccagccgcg

SEQ ID NO: 3651864 - RNA, 13 nt, Salmonella enterica enterica serovar Typhi
cagcgccagcgac

SEQ ID NO: 3651865 - RNA, 17 nt, Salmonella enterica enterica serovar Typhi
cagcgccagcggcggcu

SEQ ID NO: 3651866 - RNA, 19 nt, Salmonella enterica enterica serovar Typhi
cagcgccagcggcugcucc

SEQ ID NO: 3651867 - RNA, 13 nt, Salmonella enterica enterica serovar Typhi
cagcgccaggcca

SEQ ID NO: 3651868 - RNA, 18 nt, Salmonella enterica enterica serovar Typhi
cagcgccaguuuuucccg

SEQ ID NO: 3651869 - RNA, 22 nt, Salmonella enterica enterica serovar Typhi
cagcgccauaaucgcuuuuucc

SEQ ID NO: 3651870 - RNA, 22 nt, Salmonella enterica enterica serovar Typhi
cagcgccauauaaauuucaucc

SEQ ID NO: 3651871 - RNA, 23 nt, Salmonella enterica enterica serovar Typhi
cagcgccauauaaauuucaucca

SEQ ID NO: 3651872 - RNA, 22 nt, Salmonella enterica enterica serovar Typhi
cagcgccauccacggccccggg

SEQ ID NO: 3651873 - RNA, 23 nt, Salmonella enterica enterica serovar Typhi
cagcgccauccacggccccgggc

SEQ ID NO: 3651874 - RNA, 19 nt, Salmonella enterica enterica serovar Typhi
cagcgccauccggcaaaau

SEQ ID NO: 3651875 - RNA, 12 nt, Salmonella enterica enterica serovar Typhi
cagcgccaugaa

SEQ ID NO: 3651876 - RNA, 19 nt, Salmonella enterica enterica serovar Typhi
cagcgccaugaucgauagc

SEQ ID NO: 3651877 - RNA, 20 nt, Salmonella enterica enterica serovar Typhi
cagcgcccacaccauaccgc

SEQ ID NO: 3651878 - RNA, 15 nt, Salmonella enterica enterica serovar Typhi
cagcgcccagcagcu

SEQ ID NO: 3651879 - RNA, 14 nt, Salmonella enterica enterica serovar Typhi
cagcgcccgcuuca

SEQ ID NO: 3651880 - RNA, 14 nt, Salmonella enterica enterica serovar Typhi
cagcgccgccagaa

SEQ ID NO: 3651881 - RNA, 11 nt, Salmonella enterica enterica serovar Typhi
cagcgccgccu

SEQ ID NO: 3651882 - RNA, 13 nt, Salmonella enterica enterica serovar Typhi
cagcgccgccugu

SEQ ID NO: 3651883 - RNA, 17 nt, Salmonella enterica enterica serovar Typhi
cagcguaccacgccgca

SEQ ID NO: 3651884 - RNA, 15 nt, Salmonella enterica enterica serovar Typhi
cagcguaccgauaau

SEQ ID NO: 3651885 - RNA, 21 nt, Salmonella enterica enterica serovar Typhi
cagcguaccugcggcaauggc

SEQ ID NO: 3651886 - RNA, 16 nt, Salmonella enterica enterica serovar Typhi
cagcguauugagcugg

SEQ ID NO: 3651887 - RNA, 17 nt, Salmonella enterica enterica serovar Typhi
cagcguauugagcugga

SEQ ID NO: 3651888 - RNA, 17 nt, Salmonella enterica enterica serovar Typhi
cagcgucacaggcuucg

SEQ ID NO: 3651889 - RNA, 16 nt, Salmonella enterica enterica serovar Typhi
cagcgucaccucuuuc

SEQ ID NO: 3651890 - RNA, 20 nt, Salmonella enterica enterica serovar Typhi
cagcgucaggaacgcggcgc

SEQ ID NO: 3651891 - RNA, 18 nt, Salmonella enterica enterica serovar Typhi
cagcgucaucaggccauu

SEQ ID NO: 3651892 - RNA, 13 nt, Salmonella enterica enterica serovar Typhi
cagcgucauuaaa

SEQ ID NO: 3651893 - RNA, 16 nt, Salmonella enterica enterica serovar Typhi
cagcgucccggcgucu

SEQ ID NO: 3651894 - RNA, 22 nt, Salmonella enterica enterica serovar Typhi
cagcguccgccaucgccucgau

SEQ ID NO: 3651895 - RNA, 16 nt, Salmonella enterica enterica serovar Typhi
cagcgucgacagcccc

SEQ ID NO: 3651896 - RNA, 12 nt, Salmonella enterica enterica serovar Typhi
cagcgucgcuga

SEQ ID NO: 3651897 - RNA, 20 nt, Salmonella enterica enterica serovar Typhi
cagcgucgucauagcguuga

SEQ ID NO: 3651898 - RNA, 16 nt, Salmonella enterica enterica serovar Typhi
cagcgucucagcaggc

SEQ ID NO: 3651899 - RNA, 22 nt, Salmonella enterica enterica serovar Typhi
cagcgucuccagacaauccgcg

SEQ ID NO: 3651900 - RNA, 12 nt, Salmonella enterica enterica serovar Typhi
cagcgucugccc

SEQ ID NO: 3651901 - RNA, 22 nt, Salmonella enterica enterica serovar Typhi
cagcgucugccccaaacgcuca

SEQ ID NO: 3651902 - RNA, 18 nt, Salmonella enterica enterica serovar Typhi
cagcgucugcccuccuga

SEQ ID NO: 3651903 - RNA, 14 nt, Salmonella enterica enterica serovar Typhi
cagcgucuguuuca

SEQ ID NO: 3651904 - RNA, 14 nt, Salmonella enterica enterica serovar Typhi
cagcgucuuccugu

SEQ ID NO: 3651905 - RNA, 21 nt, Salmonella enterica enterica serovar Typhi
cagcgugaaacgcccuuccca

SEQ ID NO: 3651906 - RNA, 16 nt, Salmonella enterica enterica serovar Typhi
cagcgugaagcugccg

SEQ ID NO: 3651907 - RNA, 17 nt, Salmonella enterica enterica serovar Typhi
cagcgugaagcugccgu

SEQ ID NO: 3651908 - RNA, 15 nt, Salmonella enterica enterica serovar Typhi
cagcgugacccagac

SEQ ID NO: 3651909 - RNA, 23 nt, Salmonella enterica enterica serovar Typhi
cagcgugaguuaugacggggaac

SEQ ID NO: 3651910 - RNA, 20 nt, Salmonella enterica enterica serovar Typhi
cagcguguucaugcgcggcg

SEQ ID NO: 3651911 - RNA, 22 nt, Salmonella enterica enterica serovar Typhi
cagcguugcguguuguacagca

SEQ ID NO: 3651912 - RNA, 18 nt, Salmonella enterica enterica serovar Typhi
cagcguuuaacugaacau

SEQ ID NO: 3651913 - RNA, 13 nt, Salmonella enterica enterica serovar Typhi
cagcguuuccagc

SEQ ID NO: 3651914 - RNA, 19 nt, Salmonella enterica enterica serovar Typhi
cagcuaaaaacgccaauca

SEQ ID NO: 3651915 - RNA, 15 nt, Salmonella enterica enterica serovar Typhi
cagcuaauuuuacuu

SEQ ID NO: 3651916 - RNA, 15 nt, Salmonella enterica enterica serovar Typhi
cagcuacuucaggcu

SEQ ID NO: 3651917 - RNA, 17 nt, Salmonella enterica enterica serovar Typhi
cagcuacuucaggcugu

SEQ ID NO: 3651918 - RNA, 15 nt, Salmonella enterica enterica serovar Typhi
cagcuauccaguuuc

SEQ ID NO: 3651919 - RNA, 22 nt, Salmonella enterica enterica serovar Typhi
cagcuauuagcguuuuuaccgg

SEQ ID NO: 3651920 - RNA, 22 nt, Salmonella enterica enterica serovar Typhi
cagcucaaccgcgcggcguucu

SEQ ID NO: 3651921 - RNA, 16 nt, Salmonella enterica enterica serovar Typhi
cagcucaagcgccgcg

SEQ ID NO: 3651922 - RNA, 20 nt, Salmonella enterica enterica serovar Typhi
cagcucacgcgccagcacca

SEQ ID NO: 3651923 - RNA, 19 nt, Salmonella enterica enterica serovar Typhi
cagcucagaaauaaaacca

SEQ ID NO: 3651924 - RNA, 20 nt, Salmonella enterica enterica serovar Typhi
cagcucauacccuuccaguu

SEQ ID NO: 3651925 - RNA, 17 nt, Salmonella enterica enterica serovar Typhi
cagcucaucgaaccuau

SEQ ID NO: 3651926 - RNA, 17 nt, Salmonella enterica enterica serovar Typhi
cagcucaugcgcggcgg

SEQ ID NO: 3651927 - RNA, 17 nt, Salmonella enterica enterica serovar Typhi
cagcucauuuuuacaga

SEQ ID NO: 3651928 - RNA, 21 nt, Salmonella enterica enterica serovar Typhi
cagcucauuuuuacagacacg

SEQ ID NO: 3651929 - RNA, 16 nt, Salmonella enterica enterica serovar Typhi
cagcuccagcucaggg

SEQ ID NO: 3651930 - RNA, 23 nt, Salmonella enterica enterica serovar Typhi
cagcuccauagaaaucagcaggu

SEQ ID NO: 3651931 - RNA, 15 nt, Salmonella enterica enterica serovar Typhi
cagcuccauccacca

SEQ ID NO: 3651932 - RNA, 20 nt, Salmonella enterica enterica serovar Typhi
cagcuccauccaccagcccc

SEQ ID NO: 3651933 - RNA, 13 nt, Salmonella enterica enterica serovar Typhi
cagcuccaugucu

SEQ ID NO: 3651934 - RNA, 18 nt, Salmonella enterica enterica serovar Typhi
cagcucccgcgucacgac

SEQ ID NO: 3651935 - RNA, 13 nt, Salmonella enterica enterica serovar Typhi
cagcucgccaugc

SEQ ID NO: 3651936 - RNA, 18 nt, Salmonella enterica enterica serovar Typhi
cagcucggcaaagcccau

SEQ ID NO: 3651937 - RNA, 16 nt, Salmonella enterica enterica serovar Typhi
cagcucguuauuuccg

SEQ ID NO: 3651938 - RNA, 22 nt, Salmonella enterica enterica serovar Typhi
cagcucugccgguugaccggcc

SEQ ID NO: 3651939 - RNA, 22 nt, Salmonella enterica enterica serovar Typhi
cagcucugccuguagcagcgcc

SEQ ID NO: 3651940 - RNA, 23 nt, Salmonella enterica enterica serovar Typhi
cagcucugccuguagcagcgcca

SEQ ID NO: 3651941 - RNA, 22 nt, Salmonella enterica enterica serovar Typhi
cagcucugugugacguugccga

SEQ ID NO: 3651942 - RNA, 20 nt, Salmonella enterica enterica serovar Typhi
cagcucuuucaauccuucuu

SEQ ID NO: 3651943 - RNA, 19 nt, Salmonella enterica enterica serovar Typhi
cagcucuuugguccauaac

SEQ ID NO: 3651944 - RNA, 17 nt, Salmonella enterica enterica serovar Typhi
cagcugacgacgccagc

SEQ ID NO: 3651945 - RNA, 16 nt, Salmonella enterica enterica serovar Typhi
cagcugaugcgaacgc

SEQ ID NO: 3651946 - RNA, 17 nt, Salmonella enterica enterica serovar Typhi
cagcuggaaugcccacu

SEQ ID NO: 3651947 - RNA, 22 nt, Salmonella enterica enterica serovar Typhi
cagcuggcgauauccgugccgc

SEQ ID NO: 3651948 - RNA, 15 nt, Salmonella enterica enterica serovar Typhi
cagcugggccugcuc

SEQ ID NO: 3651949 - RNA, 17 nt, Salmonella enterica enterica serovar Typhi
cagcugggucgcgcuuu

SEQ ID NO: 3651950 - RNA, 16 nt, Salmonella enterica enterica serovar Typhi
cagcugguauaggcca

SEQ ID NO: 3651951 - RNA, 17 nt, Salmonella enterica enterica serovar Typhi
cagcugguuaaccaccu

SEQ ID NO: 3651952 - RNA, 22 nt, Salmonella enterica enterica serovar Typhi
cagcugguuaaccaccucauua

SEQ ID NO: 3651953 - RNA, 16 nt, Salmonella enterica enterica serovar Typhi
cagcuguuuaagcgcc

SEQ ID NO: 3651954 - RNA, 20 nt, Salmonella enterica enterica serovar Typhi
cagcuguuuaagcgccucca

SEQ ID NO: 3651955 - RNA, 16 nt, Salmonella enterica enterica serovar Typhi
cagcuuaaaucgcggc

SEQ ID NO: 3651956 - RNA, 18 nt, Salmonella enterica enterica serovar Typhi
cagcuuaaaucgcggcgc

SEQ ID NO: 3651957 - RNA, 14 nt, Salmonella enterica enterica serovar Typhi
cagcuuaccccugu

SEQ ID NO: 3651958 - RNA, 13 nt, Salmonella enterica enterica serovar Typhi
cagcuuaucugac

SEQ ID NO: 3651959 - RNA, 16 nt, Salmonella enterica enterica serovar Typhi
cagcuuaucuuuuucg

SEQ ID NO: 3651960 - RNA, 18 nt, Salmonella enterica enterica serovar Typhi
cagcuuauuccagucauu

SEQ ID NO: 3651961 - RNA, 21 nt, Salmonella enterica enterica serovar Typhi
cagcuucacgcgcuguaacuu

SEQ ID NO: 3651962 - RNA, 18 nt, Salmonella enterica enterica serovar Typhi
cagcuucagcaucaucuc

SEQ ID NO: 3651963 - RNA, 20 nt, Salmonella enterica enterica serovar Typhi
cagcuucagcaucaucuccc

SEQ ID NO: 3651964 - RNA, 19 nt, Salmonella enterica enterica serovar Typhi
cagcuucaggcucaucagc

SEQ ID NO: 3651965 - RNA, 22 nt, Salmonella enterica enterica serovar Typhi
cagcuucaggcucaucagcgcc

SEQ ID NO: 3651966 - RNA, 17 nt, Salmonella enterica enterica serovar Typhi
cagcuucaucaccgcau

SEQ ID NO: 3651967 - RNA, 15 nt, Salmonella enterica enterica serovar Typhi
cagcuucgccccggc

SEQ ID NO: 3651968 - RNA, 14 nt, Salmonella enterica enterica serovar Typhi
caggcagcgcgcca

SEQ ID NO: 3651969 - RNA, 13 nt, Salmonella enterica enterica serovar Typhi
caggcagggcgau

SEQ ID NO: 3651970 - RNA, 21 nt, Salmonella enterica enterica serovar Typhi
caggcaguuuauccggcgcca

SEQ ID NO: 3651971 - RNA, 14 nt, Salmonella enterica enterica serovar Typhi
caggcauaaaaaaa

SEQ ID NO: 3651972 - RNA, 17 nt, Salmonella enterica enterica serovar Typhi
caggcauaaaaaagagg

SEQ ID NO: 3651973 - RNA, 16 nt, Salmonella enterica enterica serovar Typhi
caggcauaauggaacu

SEQ ID NO: 3651974 - RNA, 23 nt, Salmonella enterica enterica serovar Typhi
caggcauagaaaaagaacugcaa

SEQ ID NO: 3651975 - RNA, 21 nt, Salmonella enterica enterica serovar Typhi
caggcauagaguaucgccugu

SEQ ID NO: 3651976 - RNA, 22 nt, Salmonella enterica enterica serovar Typhi
caggcaucaacguuguccagcg

SEQ ID NO: 3651977 - RNA, 13 nt, Salmonella enterica enterica serovar Typhi
caggcauccagac

SEQ ID NO: 3651978 - RNA, 15 nt, Salmonella enterica enterica serovar Typhi
caggcauccagaccc

SEQ ID NO: 3651979 - RNA, 17 nt, Salmonella enterica enterica serovar Typhi
caggcauccgugaccug

SEQ ID NO: 3651980 - RNA, 16 nt, Salmonella enterica enterica serovar Typhi
caggcauccugcccug

SEQ ID NO: 3651981 - RNA, 17 nt, Salmonella enterica enterica serovar Typhi
caggcauccugcccugg

SEQ ID NO: 3651982 - RNA, 17 nt, Salmonella enterica enterica serovar Typhi
caggcaucgacgccagc

SEQ ID NO: 3651983 - RNA, 20 nt, Salmonella enterica enterica serovar Typhi
caggcaucuuccagcgucgg

SEQ ID NO: 3651984 - RNA, 12 nt, Salmonella enterica enterica serovar Typhi
caggcauggcca

SEQ ID NO: 3651985 - RNA, 20 nt, Salmonella enterica enterica serovar Typhi
caggcauguugcgcaaucac

SEQ ID NO: 3651986 - RNA, 14 nt, Salmonella enterica enterica serovar Typhi
caggcauuaaaaaa

SEQ ID NO: 3651987 - RNA, 16 nt, Salmonella enterica enterica serovar Typhi
caggcauucagcgggu

SEQ ID NO: 3651988 - RNA, 18 nt, Salmonella enterica enterica serovar Typhi
caggcauuuuauuaccug

SEQ ID NO: 3651989 - RNA, 14 nt, Salmonella enterica enterica serovar Typhi
caggccaaaaccac

SEQ ID NO: 3651990 - RNA, 21 nt, Salmonella enterica enterica serovar Typhi
caggccaaaaccacagugacc

SEQ ID NO: 3651991 - RNA, 18 nt, Salmonella enterica enterica serovar Typhi
caggccaaacagcggcuc

SEQ ID NO: 3651992 - RNA, 19 nt, Salmonella enterica enterica serovar Typhi
caggccaaacccugcgccg

SEQ ID NO: 3651993 - RNA, 14 nt, Salmonella enterica enterica serovar Typhi
caggccaacauagc

SEQ ID NO: 3651994 - RNA, 19 nt, Salmonella enterica enterica serovar Typhi
caggccaacguaguuauug

SEQ ID NO: 3651995 - RNA, 23 nt, Salmonella enterica enterica serovar Typhi
caggccaagcgccuguucaacau

SEQ ID NO: 3651996 - RNA, 15 nt, Salmonella enterica enterica serovar Typhi
caggccaucauaccg

SEQ ID NO: 3651997 - RNA, 19 nt, Salmonella enterica enterica serovar Typhi
caggccaucauugauacug

SEQ ID NO: 3651998 - RNA, 20 nt, Salmonella enterica enterica serovar Typhi
caggccauuuuuucgaugau

SEQ ID NO: 3651999 - RNA, 13 nt, Salmonella enterica enterica serovar Typhi
caggcccagccgc

SEQ ID NO: 3652000 - RNA, 18 nt, Salmonella enterica enterica serovar Typhi
caggcccaguaccauuga

SEQ ID NO: 3652001 - RNA, 16 nt, Salmonella enterica enterica serovar Typhi
caggcccaugaucagg

SEQ ID NO: 3652002 - RNA, 14 nt, Salmonella enterica enterica serovar Typhi
caggccgccaccgc

SEQ ID NO: 3652003 - RNA, 15 nt, Salmonella enterica enterica serovar Typhi
caggccgccagcaac

SEQ ID NO: 3652004 - RNA, 18 nt, Salmonella enterica enterica serovar Typhi
caggccgccgcaaaagcc

SEQ ID NO: 3652005 - RNA, 21 nt, Salmonella enterica enterica serovar Typhi
caggccggauaaggcagcaau

SEQ ID NO: 3652006 - RNA, 17 nt, Salmonella enterica enterica serovar Typhi
caggccuaccagccgag

SEQ ID NO: 3652007 - RNA, 15 nt, Salmonella enterica enterica serovar Typhi
caggccuacccgcgu

SEQ ID NO: 3652008 - RNA, 18 nt, Salmonella enterica enterica serovar Typhi
caggccucugcuuuucuc

SEQ ID NO: 3652009 - RNA, 23 nt, Salmonella enterica enterica serovar Typhi
caggccugacuccggguaacgga

SEQ ID NO: 3652010 - RNA, 16 nt, Salmonella enterica enterica serovar Typhi
caggccugagccgaac

SEQ ID NO: 3652011 - RNA, 22 nt, Salmonella enterica enterica serovar Typhi
caggccugauaagcacaggcca

SEQ ID NO: 3652012 - RNA, 19 nt, Salmonella enterica enterica serovar Typhi
caggccugaugagcgcagc

SEQ ID NO: 3652013 - RNA, 17 nt, Salmonella enterica enterica serovar Typhi
caggccugcaaaccucu

SEQ ID NO: 3652014 - RNA, 19 nt, Salmonella enterica enterica serovar Typhi
caggccugccugaucgcca

SEQ ID NO: 3652015 - RNA, 16 nt, Salmonella enterica enterica serovar Typhi
caggccuuucggcagc

SEQ ID NO: 3652016 - RNA, 13 nt, Salmonella enterica enterica serovar Typhi
caggcgacgccgc

SEQ ID NO: 3652017 - RNA, 16 nt, Salmonella enterica enterica serovar Typhi
caggcgacgccgccau

SEQ ID NO: 3652018 - RNA, 19 nt, Salmonella enterica enterica serovar Typhi
caggcgacggaaacgcugu

SEQ ID NO: 3652019 - RNA, 17 nt, Salmonella enterica enterica serovar Typhi
caggcgauuacaacgcg

SEQ ID NO: 3652020 - RNA, 17 nt, Salmonella enterica enterica serovar Typhi
caggcgcagagugagca

SEQ ID NO: 3652021 - RNA, 13 nt, Salmonella enterica enterica serovar Typhi
caggcgcaggcau

SEQ ID NO: 3652022 - RNA, 14 nt, Salmonella enterica enterica serovar Typhi
caggcgcaucagaa

SEQ ID NO: 3652023 - RNA, 19 nt, Salmonella enterica enterica serovar Typhi
caggcgccaguuggcguac

SEQ ID NO: 3652024 - RNA, 22 nt, Salmonella enterica enterica serovar Typhi
caggcgcgaccucaucaaacag

SEQ ID NO: 3652025 - RNA, 13 nt, Salmonella enterica enterica serovar Typhi
caggcgcuauucc

SEQ ID NO: 3652026 - RNA, 17 nt, Salmonella enterica enterica serovar Typhi
caggcggaugaaacagu

SEQ ID NO: 3652027 - RNA, 16 nt, Salmonella enterica enterica serovar Typhi
caggcggcaaaaaacg

SEQ ID NO: 3652028 - RNA, 16 nt, Salmonella enterica enterica serovar Typhi
caggcggcugcgcaug

SEQ ID NO: 3652029 - RNA, 19 nt, Salmonella enterica enterica serovar Typhi
caggcggcuuuuucaucau

SEQ ID NO: 3652030 - RNA, 16 nt, Salmonella enterica enterica serovar Typhi
caggcggggaggguca

SEQ ID NO: 3652031 - RNA, 19 nt, Salmonella enterica enterica serovar Typhi
caggcggguagucccagga

SEQ ID NO: 3652032 - RNA, 22 nt, Salmonella enterica enterica serovar Typhi
caggcggguagucccaggauag

SEQ ID NO: 3652033 - RNA, 23 nt, Salmonella enterica enterica serovar Typhi
caggcggguggugagcucaucca

SEQ ID NO: 3652034 - RNA, 18 nt, Salmonella enterica enterica serovar Typhi
caggcgguauuucauaau

SEQ ID NO: 3652035 - RNA, 15 nt, Salmonella enterica enterica serovar Typhi
caggcggucagggug

SEQ ID NO: 3652036 - RNA, 13 nt, Salmonella enterica enterica serovar Typhi
caggcggucaucg

SEQ ID NO: 3652037 - RNA, 17 nt, Salmonella enterica enterica serovar Typhi
caggcguaagaucccag

SEQ ID NO: 3652038 - RNA, 18 nt, Salmonella enterica enterica serovar Typhi
caggcguaagaucccagg

SEQ ID NO: 3652039 - RNA, 21 nt, Salmonella enterica enterica serovar Typhi
caggcgucaaaacaggucugu

SEQ ID NO: 3652040 - RNA, 19 nt, Salmonella enterica enterica serovar Typhi
caggcgucauagccgcgcg

SEQ ID NO: 3652041 - RNA, 17 nt, Salmonella enterica enterica serovar Typhi
caggcgugauugagcag

SEQ ID NO: 3652042 - RNA, 15 nt, Salmonella enterica enterica serovar Typhi
caggcguuacagacg

SEQ ID NO: 3652043 - RNA, 16 nt, Salmonella enterica enterica serovar Typhi
caggcguuacgcgcca

SEQ ID NO: 3652044 - RNA, 22 nt, Salmonella enterica enterica serovar Typhi
caggcguugaccgcuucgccuu

SEQ ID NO: 3652045 - RNA, 15 nt, Salmonella enterica enterica serovar Typhi
caggcguugugcaga

SEQ ID NO: 3652046 - RNA, 18 nt, Salmonella enterica enterica serovar Typhi
caggcuaaauggcauagc

SEQ ID NO: 3652047 - RNA, 15 nt, Salmonella enterica enterica serovar Typhi
caggcuaaggcgucg

SEQ ID NO: 3652048 - RNA, 14 nt, Salmonella enterica enterica serovar Typhi
caggcuaccccccc

SEQ ID NO: 3652049 - RNA, 15 nt, Salmonella enterica enterica serovar Typhi
caggcucaccagccc

SEQ ID NO: 3652050 - RNA, 19 nt, Salmonella enterica enterica serovar Typhi
caggcucaggaaaacaaau

SEQ ID NO: 3652051 - RNA, 16 nt, Salmonella enterica enterica serovar Typhi
caggcucaucagcgcc

SEQ ID NO: 3652052 - RNA, 22 nt, Salmonella enterica enterica serovar Typhi
caggcugccgacaacgccuccu

SEQ ID NO: 3652053 - RNA, 22 nt, Salmonella enterica enterica serovar Typhi
caggcugggcgauaaaccgcug

SEQ ID NO: 3652054 - RNA, 21 nt, Salmonella enterica enterica serovar Typhi
caggucuauugccuaaauaac

SEQ ID NO: 3652055 - RNA, 14 nt, Salmonella enterica enterica serovar Typhi
caggucugagauaa

SEQ ID NO: 3652056 - RNA, 15 nt, Salmonella enterica enterica serovar Typhi
caggugacgaagauc

SEQ ID NO: 3652057 - RNA, 22 nt, Salmonella enterica enterica serovar Typhi
caggugauugcccuccagccau

SEQ ID NO: 3652058 - RNA, 16 nt, Salmonella enterica enterica serovar Typhi
caggugcggacugggc

SEQ ID NO: 3652059 - RNA, 16 nt, Salmonella enterica enterica serovar Typhi
caggugcugccacauc

SEQ ID NO: 3652060 - RNA, 17 nt, Salmonella enterica enterica serovar Typhi
caggugcugccacaucg

SEQ ID NO: 3652061 - RNA, 16 nt, Salmonella enterica enterica serovar Typhi
caggugcuuaucugag

SEQ ID NO: 3652062 - RNA, 17 nt, Salmonella enterica enterica serovar Typhi
caggugcuuaucugagu

SEQ ID NO: 3652063 - RNA, 11 nt, Salmonella enterica enterica serovar Typhi
cagguggaucc

SEQ ID NO: 3652064 - RNA, 18 nt, Salmonella enterica enterica serovar Typhi
cagguggaucccccuggc

SEQ ID NO: 3652065 - RNA, 20 nt, Salmonella enterica enterica serovar Typhi
cagguggaucccccuggccc

SEQ ID NO: 3652066 - RNA, 17 nt, Salmonella enterica enterica serovar Typhi
caggugugguacggcuu

SEQ ID NO: 3652067 - RNA, 12 nt, Salmonella enterica enterica serovar Typhi
cagguuaaccca

SEQ ID NO: 3652068 - RNA, 12 nt, Salmonella enterica enterica serovar Typhi
cagguuaacucc

SEQ ID NO: 3652069 - RNA, 15 nt, Salmonella enterica enterica serovar Typhi
cagguuaaucagcac

SEQ ID NO: 3652070 - RNA, 20 nt, Salmonella enterica enterica serovar Typhi
cagguuacucacugccgccc

SEQ ID NO: 3652071 - RNA, 13 nt, Salmonella enterica enterica serovar Typhi
cagguuagcagcc

SEQ ID NO: 3652072 - RNA, 20 nt, Salmonella enterica enterica serovar Typhi
cagguuauauuccgccucgu

SEQ ID NO: 3652073 - RNA, 16 nt, Salmonella enterica enterica serovar Typhi
cagguuaugcgcgcca

SEQ ID NO: 3652074 - RNA, 17 nt, Salmonella enterica enterica serovar Typhi
cagguuauuguugcuac

SEQ ID NO: 3652075 - RNA, 22 nt, Salmonella enterica enterica serovar Typhi
cagguuauuguugcuacgcgcc

SEQ ID NO: 3652076 - RNA, 21 nt, Salmonella enterica enterica serovar Typhi
cagguuauuugccucuggcca

SEQ ID NO: 3652077 - RNA, 17 nt, Salmonella enterica enterica serovar Typhi
cagguucccgcccugcc

SEQ ID NO: 3652078 - RNA, 21 nt, Salmonella enterica enterica serovar Typhi
cagguugccgaugacucccag

SEQ ID NO: 3652079 - RNA, 17 nt, Salmonella enterica enterica serovar Typhi
cagguugcguccgccgc

SEQ ID NO: 3652080 - RNA, 23 nt, Salmonella enterica enterica serovar Typhi
cagguuguaucauguuccggcag

SEQ ID NO: 3652081 - RNA, 20 nt, Salmonella enterica enterica serovar Typhi
cagguuguccugauagcaau

SEQ ID NO: 3652082 - RNA, 14 nt, Salmonella enterica enterica serovar Typhi
cagguugugcaucu

SEQ ID NO: 3652083 - RNA, 16 nt, Salmonella enterica enterica serovar Typhi
cagguugugcaucucc

SEQ ID NO: 3652084 - RNA, 19 nt, Salmonella enterica enterica serovar Typhi
cagguuuaaacgaacgaga

SEQ ID NO: 3652085 - RNA, 17 nt, Salmonella enterica enterica serovar Typhi
cagguuuacguagcagc

SEQ ID NO: 3652086 - RNA, 20 nt, Salmonella enterica enterica serovar Typhi
cagguuuacguagcagcgcg

SEQ ID NO: 3652087 - RNA, 22 nt, Salmonella enterica enterica serovar Typhi
cagguuuacguagcagcgcgcg

SEQ ID NO: 3652088 - RNA, 23 nt, Salmonella enterica enterica serovar Typhi
cagguuucaucgccgauuccugc

SEQ ID NO: 3652089 - RNA, 18 nt, Salmonella enterica enterica serovar Typhi
cagguuucuggcaacagc

SEQ ID NO: 3652090 - RNA, 13 nt, Salmonella enterica enterica serovar Typhi
cagguuuuacuuc

SEQ ID NO: 3652091 - RNA, 20 nt, Salmonella enterica enterica serovar Typhi
cagguuuuuaagcugcccac

SEQ ID NO: 3652092 - RNA, 13 nt, Salmonella enterica enterica serovar Typhi
caguaaaaaaacg

SEQ ID NO: 3652093 - RNA, 12 nt, Salmonella enterica enterica serovar Typhi
caguaaaagccc

SEQ ID NO: 3652094 - RNA, 17 nt, Salmonella enterica enterica serovar Typhi
caguaaaagcccgccca

SEQ ID NO: 3652095 - RNA, 21 nt, Salmonella enterica enterica serovar Typhi
caguaaaagcccgcccagcau

SEQ ID NO: 3652096 - RNA, 22 nt, Salmonella enterica enterica serovar Typhi
caguaaaagcccgcccagcauu

SEQ ID NO: 3652097 - RNA, 19 nt, Salmonella enterica enterica serovar Typhi
caguaaaaucggaccuccg

SEQ ID NO: 3652098 - RNA, 13 nt, Salmonella enterica enterica serovar Typhi
caguaaaggggag

SEQ ID NO: 3652099 - RNA, 18 nt, Salmonella enterica enterica serovar Typhi
caguaacacaaucaggcg

SEQ ID NO: 3652100 - RNA, 12 nt, Salmonella enterica enterica serovar Typhi
caguaacacccg

SEQ ID NO: 3652101 - RNA, 16 nt, Salmonella enterica enterica serovar Typhi
caguaacacccgcgcc

SEQ ID NO: 3652102 - RNA, 21 nt, Salmonella enterica enterica serovar Typhi
caguaacacccgcgccuucgc

SEQ ID NO: 3652103 - RNA, 17 nt, Salmonella enterica enterica serovar Typhi
caguaaccgccacagca

SEQ ID NO: 3652104 - RNA, 18 nt, Salmonella enterica enterica serovar Typhi
caguaaccgccacagcau

SEQ ID NO: 3652105 - RNA, 15 nt, Salmonella enterica enterica serovar Typhi
caguaacgcguccaa

SEQ ID NO: 3652106 - RNA, 14 nt, Salmonella enterica enterica serovar Typhi
caguaacguucuuc

SEQ ID NO: 3652107 - RNA, 22 nt, Salmonella enterica enterica serovar Typhi
caguaacguucuucgauaaagg

SEQ ID NO: 3652108 - RNA, 14 nt, Salmonella enterica enterica serovar Typhi
caguaacucaucgc

SEQ ID NO: 3652109 - RNA, 17 nt, Salmonella enterica enterica serovar Typhi
caguaacucaucgccag

SEQ ID NO: 3652110 - RNA, 13 nt, Salmonella enterica enterica serovar Typhi
caguaacugcaaa

SEQ ID NO: 3652111 - RNA, 12 nt, Salmonella enterica enterica serovar Typhi
caguaaggggau

SEQ ID NO: 3652112 - RNA, 21 nt, Salmonella enterica enterica serovar Typhi
caguaagucgccgcagcucca

SEQ ID NO: 3652113 - RNA, 22 nt, Salmonella enterica enterica serovar Typhi
caguaaucaccgucuccggcgc

SEQ ID NO: 3652114 - RNA, 20 nt, Salmonella enterica enterica serovar Typhi
caguaaucccggucgcgcca

SEQ ID NO: 3652115 - RNA, 15 nt, Salmonella enterica enterica serovar Typhi
caguaauccggcaac

SEQ ID NO: 3652116 - RNA, 17 nt, Salmonella enterica enterica serovar Typhi
caguaauccggcaacug

SEQ ID NO: 3652117 - RNA, 18 nt, Salmonella enterica enterica serovar Typhi
caguaauguccagauuac

SEQ ID NO: 3652118 - RNA, 13 nt, Salmonella enterica enterica serovar Typhi
caguaauuuuucc

SEQ ID NO: 3652119 - RNA, 18 nt, Salmonella enterica enterica serovar Typhi
caguaauuuuuccgccuc

SEQ ID NO: 3652120 - RNA, 20 nt, Salmonella enterica enterica serovar Typhi
caguaauuuuucucccagca

SEQ ID NO: 3652121 - RNA, 15 nt, Salmonella enterica enterica serovar Typhi
caguacaaacaaaua

SEQ ID NO: 3652122 - RNA, 23 nt, Salmonella enterica enterica serovar Typhi
caguacaaacaaauaaauccaug

SEQ ID NO: 3652123 - RNA, 18 nt, Salmonella enterica enterica serovar Typhi
caguacaaacgcaccgcc

SEQ ID NO: 3652124 - RNA, 13 nt, Salmonella enterica enterica serovar Typhi
caguacagccaaa

SEQ ID NO: 3652125 - RNA, 16 nt, Salmonella enterica enterica serovar Typhi
caguacagccaaaaau

SEQ ID NO: 3652126 - RNA, 17 nt, Salmonella enterica enterica serovar Typhi
caguacagccaaaaaua

SEQ ID NO: 3652127 - RNA, 17 nt, Salmonella enterica enterica serovar Typhi
caguaccgaaaucauca

SEQ ID NO: 3652128 - RNA, 17 nt, Salmonella enterica enterica serovar Typhi
caguaccggcaggacaa

SEQ ID NO: 3652129 - RNA, 21 nt, Salmonella enterica enterica serovar Typhi
caguaccgggccuccuuuccu

SEQ ID NO: 3652130 - RNA, 11 nt, Salmonella enterica enterica serovar Typhi
caguaccuuua

SEQ ID NO: 3652131 - RNA, 17 nt, Salmonella enterica enterica serovar Typhi
caguacgaucaugaguc

SEQ ID NO: 3652132 - RNA, 15 nt, Salmonella enterica enterica serovar Typhi
caguacgcccgccuc

SEQ ID NO: 3652133 - RNA, 21 nt, Salmonella enterica enterica serovar Typhi
caguacgcccgugacgccagg

SEQ ID NO: 3652134 - RNA, 17 nt, Salmonella enterica enterica serovar Typhi
caguacgcgaccgccgc

SEQ ID NO: 3652135 - RNA, 17 nt, Salmonella enterica enterica serovar Typhi
caguacgcgcgcggcgu

SEQ ID NO: 3652136 - RNA, 15 nt, Salmonella enterica enterica serovar Typhi
caguacgcugccauc

SEQ ID NO: 3652137 - RNA, 19 nt, Salmonella enterica enterica serovar Typhi
caguacggaugauguacag

SEQ ID NO: 3652138 - RNA, 13 nt, Salmonella enterica enterica serovar Typhi
caguacggcgcac

SEQ ID NO: 3652139 - RNA, 19 nt, Salmonella enterica enterica serovar Typhi
caguacguaacggaaaagc

SEQ ID NO: 3652140 - RNA, 18 nt, Salmonella enterica enterica serovar Typhi
cagugcgucacuuuaacc

SEQ ID NO: 3652141 - RNA, 18 nt, Salmonella enterica enterica serovar Typhi
cagugcuaaaauuauaca

SEQ ID NO: 3652142 - RNA, 20 nt, Salmonella enterica enterica serovar Typhi
cagugcugagcacgcccggu

SEQ ID NO: 3652143 - RNA, 14 nt, Salmonella enterica enterica serovar Typhi
caguggaaaacagc

SEQ ID NO: 3652144 - RNA, 17 nt, Salmonella enterica enterica serovar Typhi
caguggacgauaagcac

SEQ ID NO: 3652145 - RNA, 18 nt, Salmonella enterica enterica serovar Typhi
caguggagaggccaccag

SEQ ID NO: 3652146 - RNA, 22 nt, Salmonella enterica enterica serovar Typhi
caguggagaggccaccagcgcc

SEQ ID NO: 3652147 - RNA, 16 nt, Salmonella enterica enterica serovar Typhi
caguggccaucuucca

SEQ ID NO: 3652148 - RNA, 18 nt, Salmonella enterica enterica serovar Typhi
caguggcuuuaacgucag

SEQ ID NO: 3652149 - RNA, 20 nt, Salmonella enterica enterica serovar Typhi
caguggcuuuaacgucagca

SEQ ID NO: 3652150 - RNA, 19 nt, Salmonella enterica enterica serovar Typhi
cagugggaaaacgugcccc

SEQ ID NO: 3652151 - RNA, 13 nt, Salmonella enterica enterica serovar Typhi
cagugggaaaauu

SEQ ID NO: 3652152 - RNA, 17 nt, Salmonella enterica enterica serovar Typhi
caguggucaggcgacca

SEQ ID NO: 3652153 - RNA, 22 nt, Salmonella enterica enterica serovar Typhi
caguggucguuagccagauggc

SEQ ID NO: 3652154 - RNA, 19 nt, Salmonella enterica enterica serovar Typhi
cagugguggcuauagcuca

SEQ ID NO: 3652155 - RNA, 15 nt, Salmonella enterica enterica serovar Typhi
caguguaaacgccag

SEQ ID NO: 3652156 - RNA, 14 nt, Salmonella enterica enterica serovar Typhi
cagugugccgucau

SEQ ID NO: 3652157 - RNA, 20 nt, Salmonella enterica enterica serovar Typhi
caguguuaaucucacgcuca

SEQ ID NO: 3652158 - RNA, 17 nt, Salmonella enterica enterica serovar Typhi
caguuaaauaaacaaaa

SEQ ID NO: 3652159 - RNA, 16 nt, Salmonella enterica enterica serovar Typhi
caguuaccccgaagcg

SEQ ID NO: 3652160 - RNA, 16 nt, Salmonella enterica enterica serovar Typhi
caguuagcgaaacagu

SEQ ID NO: 3652161 - RNA, 23 nt, Salmonella enterica enterica serovar Typhi
caguuauagcgcagauugaggcu

SEQ ID NO: 3652162 - RNA, 20 nt, Salmonella enterica enterica serovar Typhi
caguucaaacggcccggcgu

SEQ ID NO: 3652163 - RNA, 20 nt, Salmonella enterica enterica serovar Typhi
caguucacgacugauagguu

SEQ ID NO: 3652164 - RNA, 16 nt, Salmonella enterica enterica serovar Typhi
caguucacgccgccgc

SEQ ID NO: 3652165 - RNA, 23 nt, Salmonella enterica enterica serovar Typhi
caguucagcagcaccacucccca

SEQ ID NO: 3652166 - RNA, 16 nt, Salmonella enterica enterica serovar Typhi
caguucagccgccagu

SEQ ID NO: 3652167 - RNA, 16 nt, Salmonella enterica enterica serovar Typhi
caguucagcggucaua

SEQ ID NO: 3652168 - RNA, 18 nt, Salmonella enterica enterica serovar Typhi
caguucauaagucaucca

SEQ ID NO: 3652169 - RNA, 23 nt, Salmonella enterica enterica serovar Typhi
caguucauauuugcuggcuugcu

SEQ ID NO: 3652170 - RNA, 17 nt, Salmonella enterica enterica serovar Typhi
caguucauccacgcggg

SEQ ID NO: 3652171 - RNA, 18 nt, Salmonella enterica enterica serovar Typhi
caguucauccacgucaua

SEQ ID NO: 3652172 - RNA, 12 nt, Salmonella enterica enterica serovar Typhi
caguucauuaac

SEQ ID NO: 3652173 - RNA, 17 nt, Salmonella enterica enterica serovar Typhi
caguucauucgccacca

SEQ ID NO: 3652174 - RNA, 17 nt, Salmonella enterica enterica serovar Typhi
caguucauuucaggcaa

SEQ ID NO: 3652175 - RNA, 20 nt, Salmonella enterica enterica serovar Typhi
caguuccaccguaugugcgc

SEQ ID NO: 3652176 - RNA, 23 nt, Salmonella enterica enterica serovar Typhi
caguuccaccguaugugcgccgu

SEQ ID NO: 3652177 - RNA, 14 nt, Salmonella enterica enterica serovar Typhi
caguuccccgccgc

SEQ ID NO: 3652178 - RNA, 16 nt, Salmonella enterica enterica serovar Typhi
caguuccccgccgcgg

SEQ ID NO: 3652179 - RNA, 18 nt, Salmonella enterica enterica serovar Typhi
caguucgccuucuucauc

SEQ ID NO: 3652180 - RNA, 14 nt, Salmonella enterica enterica serovar Typhi
caguucggcaaagc

SEQ ID NO: 3652181 - RNA, 21 nt, Salmonella enterica enterica serovar Typhi
caguucggcgauuuccagcgc

SEQ ID NO: 3652182 - RNA, 23 nt, Salmonella enterica enterica serovar Typhi
caguucggcgauuuccagcgccg

SEQ ID NO: 3652183 - RNA, 18 nt, Salmonella enterica enterica serovar Typhi
caguucgucuuccggaua

SEQ ID NO: 3652184 - RNA, 14 nt, Salmonella enterica enterica serovar Typhi
caguucguucugcg

SEQ ID NO: 3652185 - RNA, 16 nt, Salmonella enterica enterica serovar Typhi
caguucuaacaggaag

SEQ ID NO: 3652186 - RNA, 16 nt, Salmonella enterica enterica serovar Typhi
caguucuggcugcgcu

SEQ ID NO: 3652187 - RNA, 16 nt, Salmonella enterica enterica serovar Typhi
caguugaccaaacagc

SEQ ID NO: 3652188 - RNA, 17 nt, Salmonella enterica enterica serovar Typhi
caguugaccaaacagca

SEQ ID NO: 3652189 - RNA, 12 nt, Salmonella enterica enterica serovar Typhi
caguugcagcgc

SEQ ID NO: 3652190 - RNA, 16 nt, Salmonella enterica enterica serovar Typhi
caguugcccauuuucc

SEQ ID NO: 3652191 - RNA, 17 nt, Salmonella enterica enterica serovar Typhi
caguugccuugccucac

SEQ ID NO: 3652192 - RNA, 14 nt, Salmonella enterica enterica serovar Typhi
caguugcuggagca

SEQ ID NO: 3652193 - RNA, 13 nt, Salmonella enterica enterica serovar Typhi
caguugcuggauu

SEQ ID NO: 3652194 - RNA, 19 nt, Salmonella enterica enterica serovar Typhi
caguuggcguaccaucagc

SEQ ID NO: 3652195 - RNA, 17 nt, Salmonella enterica enterica serovar Typhi
caguuggcuucagcaaa

SEQ ID NO: 3652196 - RNA, 18 nt, Salmonella enterica enterica serovar Typhi
caguugguuagaauaccu

SEQ ID NO: 3652197 - RNA, 23 nt, Salmonella enterica enterica serovar Typhi
caguugguuagagcacaucacuc

SEQ ID NO: 3652198 - RNA, 21 nt, Salmonella enterica enterica serovar Typhi
caguugguuguagcacagccc

SEQ ID NO: 3652199 - RNA, 21 nt, Salmonella enterica enterica serovar Typhi
caguuguaguagccacagcgg

SEQ ID NO: 3652200 - RNA, 19 nt, Salmonella enterica enterica serovar Typhi
caguugucguggguucgaa

SEQ ID NO: 3652201 - RNA, 16 nt, Salmonella enterica enterica serovar Typhi
caguuguuccagcagc

SEQ ID NO: 3652202 - RNA, 18 nt, Salmonella enterica enterica serovar Typhi
caguuuaaaucacagggg

SEQ ID NO: 3652203 - RNA, 23 nt, Salmonella enterica enterica serovar Typhi
caguuuagagguuccccagccgc

SEQ ID NO: 3652204 - RNA, 13 nt, Salmonella enterica enterica serovar Typhi
caguuucggcccc

SEQ ID NO: 3652205 - RNA, 19 nt, Salmonella enterica enterica serovar Typhi
caguuucucgucauaguga

SEQ ID NO: 3652206 - RNA, 22 nt, Salmonella enterica enterica serovar Typhi
caguuucuucggcuucaccgau

SEQ ID NO: 3652207 - RNA, 14 nt, Salmonella enterica enterica serovar Typhi
caguuugcgaaaag

SEQ ID NO: 3652208 - RNA, 15 nt, Salmonella enterica enterica serovar Typhi
caguuugcgaaaagc

SEQ ID NO: 3652209 - RNA, 20 nt, Salmonella enterica enterica serovar Typhi
caguuugcguucacagcacc

SEQ ID NO: 3652210 - RNA, 16 nt, Salmonella enterica enterica serovar Typhi
caguuugguaauacua

SEQ ID NO: 3652211 - RNA, 19 nt, Salmonella enterica enterica serovar Typhi
caguuuugaucgaaucucc

SEQ ID NO: 3652212 - RNA, 15 nt, Salmonella enterica enterica serovar Typhi
caguuuuuccuuucu

SEQ ID NO: 3652213 - RNA, 21 nt, Salmonella enterica enterica serovar Typhi
caguuuuuccuuucugcgcca

SEQ ID NO: 3652214 - RNA, 17 nt, Salmonella enterica enterica serovar Typhi
caguuuuugcauuauau

SEQ ID NO: 3652215 - RNA, 18 nt, Salmonella enterica enterica serovar Typhi
caguuuuugcauuauauu

SEQ ID NO: 3652216 - RNA, 23 nt, Salmonella enterica enterica serovar Typhi
caguuuuuuacuuucaaaauacu

SEQ ID NO: 3652217 - RNA, 13 nt, Salmonella enterica enterica serovar Typhi
caguuuuuuccag

SEQ ID NO: 3652218 - RNA, 19 nt, Salmonella enterica enterica serovar Typhi
caguuuuuugaccauucca

SEQ ID NO: 3652219 - RNA, 15 nt, Salmonella enterica enterica serovar Typhi
cauaaaaaagaggaa

SEQ ID NO: 3652220 - RNA, 24 nt, Salmonella enterica enterica serovar Typhi
cauaaaaagacgaucuucgcagua

SEQ ID NO: 3652221 - RNA, 19 nt, Salmonella enterica enterica serovar Typhi
cauaaaaagcguacaaaaa

SEQ ID NO: 3652222 - RNA, 12 nt, Salmonella enterica enterica serovar Typhi
cauaaaaccauu

SEQ ID NO: 3652223 - RNA, 15 nt, Salmonella enterica enterica serovar Typhi
cauaaacaaaacaac

SEQ ID NO: 3652224 - RNA, 12 nt, Salmonella enterica enterica serovar Typhi
cauaaacauuau

SEQ ID NO: 3652225 - RNA, 20 nt, Salmonella enterica enterica serovar Typhi
cauaccacaacagaaucgcg

SEQ ID NO: 3652226 - RNA, 17 nt, Salmonella enterica enterica serovar Typhi
cauaccacgcagcggca

SEQ ID NO: 3652227 - RNA, 17 nt, Salmonella enterica enterica serovar Typhi
cauaccagccauaaaua

SEQ ID NO: 3652228 - RNA, 15 nt, Salmonella enterica enterica serovar Typhi
cauaccagcgaaaug

SEQ ID NO: 3652229 - RNA, 14 nt, Salmonella enterica enterica serovar Typhi
cauacccagguuug

SEQ ID NO: 3652230 - RNA, 19 nt, Salmonella enterica enterica serovar Typhi
cauacccggcucccauuug

SEQ ID NO: 3652231 - RNA, 19 nt, Salmonella enterica enterica serovar Typhi
cauacccuauuuacagagc

SEQ ID NO: 3652232 - RNA, 21 nt, Salmonella enterica enterica serovar Typhi
cauaccgcuuaacagcguaca

SEQ ID NO: 3652233 - RNA, 22 nt, Salmonella enterica enterica serovar Typhi
cauaccggacuccaggcaacgu

SEQ ID NO: 3652234 - RNA, 15 nt, Salmonella enterica enterica serovar Typhi
cauaccggagccugg

SEQ ID NO: 3652235 - RNA, 14 nt, Salmonella enterica enterica serovar Typhi
cauaccggugcgcc

SEQ ID NO: 3652236 - RNA, 19 nt, Salmonella enterica enterica serovar Typhi
cauaccggugcgccccagc

SEQ ID NO: 3652237 - RNA, 21 nt, Salmonella enterica enterica serovar Typhi
cauaccggugcgccccagcau

SEQ ID NO: 3652238 - RNA, 19 nt, Salmonella enterica enterica serovar Typhi
cauaccgguguagcuggca

SEQ ID NO: 3652239 - RNA, 14 nt, Salmonella enterica enterica serovar Typhi
cauaccgucaccac

SEQ ID NO: 3652240 - RNA, 21 nt, Salmonella enterica enterica serovar Typhi
cauaccgucgugaaucaucau

SEQ ID NO: 3652241 - RNA, 16 nt, Salmonella enterica enterica serovar Typhi
cauaccuauaaaaaug

SEQ ID NO: 3652242 - RNA, 21 nt, Salmonella enterica enterica serovar Typhi
cauaccuauaaaaaugaggua

SEQ ID NO: 3652243 - RNA, 18 nt, Salmonella enterica enterica serovar Typhi
cauaccuguaucaaacca

SEQ ID NO: 3652244 - RNA, 19 nt, Salmonella enterica enterica serovar Typhi
cauaccuguaucaaaccaa

SEQ ID NO: 3652245 - RNA, 17 nt, Salmonella enterica enterica serovar Typhi
cauaccuguuccucuuu

SEQ ID NO: 3652246 - RNA, 20 nt, Salmonella enterica enterica serovar Typhi
cauaccuguuccucuuuccc

SEQ ID NO: 3652247 - RNA, 14 nt, Salmonella enterica enterica serovar Typhi
cauacgccgccagc

SEQ ID NO: 3652248 - RNA, 18 nt, Salmonella enterica enterica serovar Typhi
cauacgccgccagccacu

SEQ ID NO: 3652249 - RNA, 15 nt, Salmonella enterica enterica serovar Typhi
cauacggaugaaaua

SEQ ID NO: 3652250 - RNA, 20 nt, Salmonella enterica enterica serovar Typhi
cauacgggcaugaagaaaau

SEQ ID NO: 3652251 - RNA, 23 nt, Salmonella enterica enterica serovar Typhi
cauacgggcaugaagaaaauacu

SEQ ID NO: 3652252 - RNA, 22 nt, Salmonella enterica enterica serovar Typhi
cauacgguuguugauuaagcac

SEQ ID NO: 3652253 - RNA, 13 nt, Salmonella enterica enterica serovar Typhi
cauacguuuuuau

SEQ ID NO: 3652254 - RNA, 13 nt, Salmonella enterica enterica serovar Typhi
cauacuaccgcug

SEQ ID NO: 3652255 - RNA, 19 nt, Salmonella enterica enterica serovar Typhi
cauacuauccaacagaagg

SEQ ID NO: 3652256 - RNA, 12 nt, Salmonella enterica enterica serovar Typhi
cauacuauuucc

SEQ ID NO: 3652257 - RNA, 21 nt, Salmonella enterica enterica serovar Typhi
cauacucacauucauaaaaga

SEQ ID NO: 3652258 - RNA, 16 nt, Salmonella enterica enterica serovar Typhi
cauacucacgaauaag

SEQ ID NO: 3652259 - RNA, 17 nt, Salmonella enterica enterica serovar Typhi
cauacucacgaauaaga

SEQ ID NO: 3652260 - RNA, 18 nt, Salmonella enterica enterica serovar Typhi
cauacucauuaccggcug

SEQ ID NO: 3652261 - RNA, 21 nt, Salmonella enterica enterica serovar Typhi
cauacuccugccugacaauga

SEQ ID NO: 3652262 - RNA, 15 nt, Salmonella enterica enterica serovar Typhi
cauacucuccuccau

SEQ ID NO: 3652263 - RNA, 21 nt, Salmonella enterica enterica serovar Typhi
cauacucuuggagagcaucau

SEQ ID NO: 3652264 - RNA, 22 nt, Salmonella enterica enterica serovar Typhi
cauacugaaauuucuuuuccag

SEQ ID NO: 3652265 - RNA, 19 nt, Salmonella enterica enterica serovar Typhi
cauacugaacaagcgaucg

SEQ ID NO: 3652266 - RNA, 15 nt, Salmonella enterica enterica serovar Typhi
cauacugaagauaaa

SEQ ID NO: 3652267 - RNA, 14 nt, Salmonella enterica enterica serovar Typhi
cauacugcccagcc

SEQ ID NO: 3652268 - RNA, 18 nt, Salmonella enterica enterica serovar Typhi
cauacuguuuaucagacc

SEQ ID NO: 3652269 - RNA, 16 nt, Salmonella enterica enterica serovar Typhi
cauacuuacugcuguc

SEQ ID NO: 3652270 - RNA, 13 nt, Salmonella enterica enterica serovar Typhi
cauacuuugcauu

SEQ ID NO: 3652271 - RNA, 23 nt, Salmonella enterica enterica serovar Typhi
cauagaaaauauaugacaacacu

SEQ ID NO: 3652272 - RNA, 18 nt, Salmonella enterica enterica serovar Typhi
cauagaaagauuucauca

SEQ ID NO: 3652273 - RNA, 16 nt, Salmonella enterica enterica serovar Typhi
cauagaaauagccccg

SEQ ID NO: 3652274 - RNA, 12 nt, Salmonella enterica enterica serovar Typhi
cauagaaccacu

SEQ ID NO: 3652275 - RNA, 17 nt, Salmonella enterica enterica serovar Typhi
cauagaaccacuuauuu

SEQ ID NO: 3652276 - RNA, 16 nt, Salmonella enterica enterica serovar Typhi
cauagaacgcuugucu

SEQ ID NO: 3652277 - RNA, 14 nt, Salmonella enterica enterica serovar Typhi
cauagacgcccugc

SEQ ID NO: 3652278 - RNA, 23 nt, Salmonella enterica enterica serovar Typhi
cauagacgcccugcaaagcaaaa

SEQ ID NO: 3652279 - RNA, 17 nt, Salmonella enterica enterica serovar Typhi
cauagaguaucgccugu

SEQ ID NO: 3652280 - RNA, 17 nt, Salmonella enterica enterica serovar Typhi
cauagauaacgauguga

SEQ ID NO: 3652281 - RNA, 13 nt, Salmonella enterica enterica serovar Typhi
cauagcaucacca

SEQ ID NO: 3652282 - RNA, 20 nt, Salmonella enterica enterica serovar Typhi
cauagccaacacauaagcca

SEQ ID NO: 3652283 - RNA, 14 nt, Salmonella enterica enterica serovar Typhi
cauagccgccaccc

SEQ ID NO: 3652284 - RNA, 15 nt, Salmonella enterica enterica serovar Typhi
cauagccgcgcguca

SEQ ID NO: 3652285 - RNA, 16 nt, Salmonella enterica enterica serovar Typhi
cauagccggcgauagc

SEQ ID NO: 3652286 - RNA, 22 nt, Salmonella enterica enterica serovar Typhi
cauagccggcgauagcgcccca

SEQ ID NO: 3652287 - RNA, 13 nt, Salmonella enterica enterica serovar Typhi
cauagccuaauga

SEQ ID NO: 3652288 - RNA, 15 nt, Salmonella enterica enterica serovar Typhi
cauagcgccaucagg

SEQ ID NO: 3652289 - RNA, 15 nt, Salmonella enterica enterica serovar Typhi
cauagcgcgaaugau

SEQ ID NO: 3652290 - RNA, 19 nt, Salmonella enterica enterica serovar Typhi
cauagcgcgaaugauuuua

SEQ ID NO: 3652291 - RNA, 19 nt, Salmonella enterica enterica serovar Typhi
cauagcgggcagcauugac

SEQ ID NO: 3652292 - RNA, 18 nt, Salmonella enterica enterica serovar Typhi
cauagcgucaucaacaua

SEQ ID NO: 3652293 - RNA, 18 nt, Salmonella enterica enterica serovar Typhi
cauagcguuaucuggucg

SEQ ID NO: 3652294 - RNA, 20 nt, Salmonella enterica enterica serovar Typhi
cauagcuaaauaaaaauaau

SEQ ID NO: 3652295 - RNA, 13 nt, Salmonella enterica enterica serovar Typhi
cauagcuaccgcg

SEQ ID NO: 3652296 - RNA, 18 nt, Salmonella enterica enterica serovar Typhi
cauaguacccucugcacc

SEQ ID NO: 3652297 - RNA, 22 nt, Salmonella enterica enterica serovar Typhi
cauaguauugacgguuacgcaa

SEQ ID NO: 3652298 - RNA, 16 nt, Salmonella enterica enterica serovar Typhi
cauagucgucuauuuc

SEQ ID NO: 3652299 - RNA, 19 nt, Salmonella enterica enterica serovar Typhi
cauaguuugcauaaccggu

SEQ ID NO: 3652300 - RNA, 16 nt, Salmonella enterica enterica serovar Typhi
cauauaacuuucaaua

SEQ ID NO: 3652301 - RNA, 15 nt, Salmonella enterica enterica serovar Typhi
cauauaaggcccaua

SEQ ID NO: 3652302 - RNA, 20 nt, Salmonella enterica enterica serovar Typhi
cauauaauuaacauuuaaga

SEQ ID NO: 3652303 - RNA, 23 nt, Salmonella enterica enterica serovar Typhi
cauauacccugcggcgaaacaga

SEQ ID NO: 3652304 - RNA, 22 nt, Salmonella enterica enterica serovar Typhi
cauauacgccacggccagcagc

SEQ ID NO: 3652305 - RNA, 22 nt, Salmonella enterica enterica serovar Typhi
cauauacugucuuguggaacac

SEQ ID NO: 3652306 - RNA, 18 nt, Salmonella enterica enterica serovar Typhi
cauauagugcgugacaau

SEQ ID NO: 3652307 - RNA, 16 nt, Salmonella enterica enterica serovar Typhi
cauauaugcgacagaa

SEQ ID NO: 3652308 - RNA, 17 nt, Salmonella enterica enterica serovar Typhi
cauauaugcgacagaaa

SEQ ID NO: 3652309 - RNA, 12 nt, Salmonella enterica enterica serovar Typhi
cauauauuauua

SEQ ID NO: 3652310 - RNA, 18 nt, Salmonella enterica enterica serovar Typhi
caucagcacaaaauccca

SEQ ID NO: 3652311 - RNA, 14 nt, Salmonella enterica enterica serovar Typhi
caucagcacaugau

SEQ ID NO: 3652312 - RNA, 15 nt, Salmonella enterica enterica serovar Typhi
caucagccagcagcu

SEQ ID NO: 3652313 - RNA, 17 nt, Salmonella enterica enterica serovar Typhi
caucagccagcagcuca

SEQ ID NO: 3652314 - RNA, 14 nt, Salmonella enterica enterica serovar Typhi
caucagccagcauc

SEQ ID NO: 3652315 - RNA, 12 nt, Salmonella enterica enterica serovar Typhi
caucagccaggc

SEQ ID NO: 3652316 - RNA, 22 nt, Salmonella enterica enterica serovar Typhi
caucagccauuuguuagcguuu

SEQ ID NO: 3652317 - RNA, 22 nt, Salmonella enterica enterica serovar Typhi
caucagcccuaucgcugcgcug

SEQ ID NO: 3652318 - RNA, 21 nt, Salmonella enterica enterica serovar Typhi
caucagccguuacuuccccca

SEQ ID NO: 3652319 - RNA, 18 nt, Salmonella enterica enterica serovar Typhi
caucagcgcuaccagcgc

SEQ ID NO: 3652320 - RNA, 20 nt, Salmonella enterica enterica serovar Typhi
caucaggaucuucaucccau

SEQ ID NO: 3652321 - RNA, 14 nt, Salmonella enterica enterica serovar Typhi
caucaggcacaaug

SEQ ID NO: 3652322 - RNA, 16 nt, Salmonella enterica enterica serovar Typhi
caucaggcacggcgua

SEQ ID NO: 3652323 - RNA, 19 nt, Salmonella enterica enterica serovar Typhi
caucaggcauggcagcagg

SEQ ID NO: 3652324 - RNA, 11 nt, Salmonella enterica enterica serovar Typhi
caucaggcuga

SEQ ID NO: 3652325 - RNA, 16 nt, Salmonella enterica enterica serovar Typhi
caucaggcuggcguua

SEQ ID NO: 3652326 - RNA, 17 nt, Salmonella enterica enterica serovar Typhi
caucaggcuuugcgcca

SEQ ID NO: 3652327 - RNA, 20 nt, Salmonella enterica enterica serovar Typhi
caucagguaauacaggguuu

SEQ ID NO: 3652328 - RNA, 17 nt, Salmonella enterica enterica serovar Typhi
caucagguggaagaaac

SEQ ID NO: 3652329 - RNA, 15 nt, Salmonella enterica enterica serovar Typhi
caucaguacaaacgc

SEQ ID NO: 3652330 - RNA, 21 nt, Salmonella enterica enterica serovar Typhi
caucaguaugagcgaacggcu

SEQ ID NO: 3652331 - RNA, 13 nt, Salmonella enterica enterica serovar Typhi
caucagucucaaa

SEQ ID NO: 3652332 - RNA, 14 nt, Salmonella enterica enterica serovar Typhi
caucaguuuaaccg

SEQ ID NO: 3652333 - RNA, 22 nt, Salmonella enterica enterica serovar Typhi
caucauaaaaggcaucgcucuu

SEQ ID NO: 3652334 - RNA, 14 nt, Salmonella enterica enterica serovar Typhi
caucauaauaauug

SEQ ID NO: 3652335 - RNA, 16 nt, Salmonella enterica enterica serovar Typhi
caucauaauccuuauu

SEQ ID NO: 3652336 - RNA, 16 nt, Salmonella enterica enterica serovar Typhi
caucauagugcgcgcg

SEQ ID NO: 3652337 - RNA, 20 nt, Salmonella enterica enterica serovar Typhi
caucauauaaccacgaaaau

SEQ ID NO: 3652338 - RNA, 22 nt, Salmonella enterica enterica serovar Typhi
caucauauaaccacgaaaauua

SEQ ID NO: 3652339 - RNA, 19 nt, Salmonella enterica enterica serovar Typhi
caucauaucccggcugaca

SEQ ID NO: 3652340 - RNA, 18 nt, Salmonella enterica enterica serovar Typhi
caucaucaggacucaauc

SEQ ID NO: 3652341 - RNA, 14 nt, Salmonella enterica enterica serovar Typhi
caucaucaggccug

SEQ ID NO: 3652342 - RNA, 19 nt, Salmonella enterica enterica serovar Typhi
caucaucaucggcacagcc

SEQ ID NO: 3652343 - RNA, 22 nt, Salmonella enterica enterica serovar Typhi
caucauccccggcaggcucacc

SEQ ID NO: 3652344 - RNA, 13 nt, Salmonella enterica enterica serovar Typhi
caucauccgcgcu

SEQ ID NO: 3652345 - RNA, 17 nt, Salmonella enterica enterica serovar Typhi
caucauccugcagggua

SEQ ID NO: 3652346 - RNA, 15 nt, Salmonella enterica enterica serovar Typhi
caucaucgaacgccg

SEQ ID NO: 3652347 - RNA, 22 nt, Salmonella enterica enterica serovar Typhi
caucaucgaacgccgccugcgc

SEQ ID NO: 3652348 - RNA, 12 nt, Salmonella enterica enterica serovar Typhi
caucaucgccaa

SEQ ID NO: 3652349 - RNA, 23 nt, Salmonella enterica enterica serovar Typhi
caucaucgcuggugugcagccag

SEQ ID NO: 3652350 - RNA, 19 nt, Salmonella enterica enterica serovar Typhi
caucaucggcacagccagu

SEQ ID NO: 3652351 - RNA, 18 nt, Salmonella enterica enterica serovar Typhi
caucaucguuugcgcgca

SEQ ID NO: 3652352 - RNA, 14 nt, Salmonella enterica enterica serovar Typhi
caucaucucauaaa

SEQ ID NO: 3652353 - RNA, 19 nt, Salmonella enterica enterica serovar Typhi
caucaucugccauuucugc

SEQ ID NO: 3652354 - RNA, 21 nt, Salmonella enterica enterica serovar Typhi
caucaucuuguccucaucauu

SEQ ID NO: 3652355 - RNA, 15 nt, Salmonella enterica enterica serovar Typhi
caucaugauauaauu

SEQ ID NO: 3652356 - RNA, 23 nt, Salmonella enterica enterica serovar Typhi
caucaugaugaucuucagcccgu

SEQ ID NO: 3652357 - RNA, 15 nt, Salmonella enterica enterica serovar Typhi
caucaugcagccggc

SEQ ID NO: 3652358 - RNA, 15 nt, Salmonella enterica enterica serovar Typhi
caucaugcgccaggu

SEQ ID NO: 3652359 - RNA, 17 nt, Salmonella enterica enterica serovar Typhi
caucaugucacccacgc

SEQ ID NO: 3652360 - RNA, 19 nt, Salmonella enterica enterica serovar Typhi
caucauuaaagcgcucaag

SEQ ID NO: 3652361 - RNA, 14 nt, Salmonella enterica enterica serovar Typhi
caucauuaauauaa

SEQ ID NO: 3652362 - RNA, 18 nt, Salmonella enterica enterica serovar Typhi
caucauuaauauaauccu

SEQ ID NO: 3652363 - RNA, 21 nt, Salmonella enterica enterica serovar Typhi
caucauuacaggcgaauagcg

SEQ ID NO: 3652364 - RNA, 23 nt, Salmonella enterica enterica serovar Typhi
caucauuaccuuuuccggcggca

SEQ ID NO: 3652365 - RNA, 14 nt, Salmonella enterica enterica serovar Typhi
caucauuauucccc

SEQ ID NO: 3652366 - RNA, 15 nt, Salmonella enterica enterica serovar Typhi
caucauucaacgcau

SEQ ID NO: 3652367 - RNA, 14 nt, Salmonella enterica enterica serovar Typhi
caucauucccauug

SEQ ID NO: 3652368 - RNA, 15 nt, Salmonella enterica enterica serovar Typhi
caucauucugcaggc

SEQ ID NO: 3652369 - RNA, 15 nt, Salmonella enterica enterica serovar Typhi
caucauugauacugu

SEQ ID NO: 3652370 - RNA, 17 nt, Salmonella enterica enterica serovar Typhi
caucauuggcugucuua

SEQ ID NO: 3652371 - RNA, 15 nt, Salmonella enterica enterica serovar Typhi
cauccaacugcgccu

SEQ ID NO: 3652372 - RNA, 17 nt, Salmonella enterica enterica serovar Typhi
cauccaacugcgccuga

SEQ ID NO: 3652373 - RNA, 13 nt, Salmonella enterica enterica serovar Typhi
cauccacagcgcc

SEQ ID NO: 3652374 - RNA, 14 nt, Salmonella enterica enterica serovar Typhi
cauccacagcgcca

SEQ ID NO: 3652375 - RNA, 12 nt, Salmonella enterica enterica serovar Typhi
cauccacauucg

SEQ ID NO: 3652376 - RNA, 13 nt, Salmonella enterica enterica serovar Typhi
cauccagaaggca

SEQ ID NO: 3652377 - RNA, 18 nt, Salmonella enterica enterica serovar Typhi
cauccagaaggcaaaaug

SEQ ID NO: 3652378 - RNA, 17 nt, Salmonella enterica enterica serovar Typhi
cauccagacagccgacg

SEQ ID NO: 3652379 - RNA, 16 nt, Salmonella enterica enterica serovar Typhi
cauccagacaugcaca

SEQ ID NO: 3652380 - RNA, 14 nt, Salmonella enterica enterica serovar Typhi
cauccagagcaguc

SEQ ID NO: 3652381 - RNA, 14 nt, Salmonella enterica enterica serovar Typhi
cauccagaucggca

SEQ ID NO: 3652382 - RNA, 18 nt, Salmonella enterica enterica serovar Typhi
cauccagcacgagcgcca

SEQ ID NO: 3652383 - RNA, 17 nt, Salmonella enterica enterica serovar Typhi
cauccagcgcucaauca

SEQ ID NO: 3652384 - RNA, 14 nt, Salmonella enterica enterica serovar Typhi
cauccagcucaugu

SEQ ID NO: 3652385 - RNA, 20 nt, Salmonella enterica enterica serovar Typhi
cauccagcuugccgucacag

SEQ ID NO: 3652386 - RNA, 22 nt, Salmonella enterica enterica serovar Typhi
cauccaggguuuaaucacgcca

SEQ ID NO: 3652387 - RNA, 15 nt, Salmonella enterica enterica serovar Typhi
cauccagucagcaau

SEQ ID NO: 3652388 - RNA, 19 nt, Salmonella enterica enterica serovar Typhi
cauccaguuguuuauucca

SEQ ID NO: 3652389 - RNA, 13 nt, Salmonella enterica enterica serovar Typhi
cauccaucaucua

SEQ ID NO: 3652390 - RNA, 14 nt, Salmonella enterica enterica serovar Typhi
cauccaucaucuau

SEQ ID NO: 3652391 - RNA, 14 nt, Salmonella enterica enterica serovar Typhi
cauccauugcgcca

SEQ ID NO: 3652392 - RNA, 16 nt, Salmonella enterica enterica serovar Typhi
cauccauugcgccacg

SEQ ID NO: 3652393 - RNA, 18 nt, Salmonella enterica enterica serovar Typhi
cauccauugcgccacgga

SEQ ID NO: 3652394 - RNA, 16 nt, Salmonella enterica enterica serovar Typhi
caucccaccggaaaug

SEQ ID NO: 3652395 - RNA, 10 nt, Salmonella enterica enterica serovar Typhi
caucccagac

SEQ ID NO: 3652396 - RNA, 13 nt, Salmonella enterica enterica serovar Typhi
caucgcuccagac

SEQ ID NO: 3652397 - RNA, 14 nt, Salmonella enterica enterica serovar Typhi
caucgcuccccaac

SEQ ID NO: 3652398 - RNA, 13 nt, Salmonella enterica enterica serovar Typhi
caucgcucgcgcc

SEQ ID NO: 3652399 - RNA, 16 nt, Salmonella enterica enterica serovar Typhi
caucgcuugcccagca

SEQ ID NO: 3652400 - RNA, 14 nt, Salmonella enterica enterica serovar Typhi
caucggagauuuca

SEQ ID NO: 3652401 - RNA, 21 nt, Salmonella enterica enterica serovar Typhi
caucggauucauuugauacgu

SEQ ID NO: 3652402 - RNA, 12 nt, Salmonella enterica enterica serovar Typhi
caucggcaaacg

SEQ ID NO: 3652403 - RNA, 22 nt, Salmonella enterica enterica serovar Typhi
caucggcacacuuucgcccggc

SEQ ID NO: 3652404 - RNA, 14 nt, Salmonella enterica enterica serovar Typhi
caucggcacagcca

SEQ ID NO: 3652405 - RNA, 16 nt, Salmonella enterica enterica serovar Typhi
caucggcacagccagu

SEQ ID NO: 3652406 - RNA, 21 nt, Salmonella enterica enterica serovar Typhi
caucggcacguaguaaugcau

SEQ ID NO: 3652407 - RNA, 13 nt, Salmonella enterica enterica serovar Typhi
caucggcaucaaa

SEQ ID NO: 3652408 - RNA, 24 nt, Salmonella enterica enterica serovar Typhi
caucggcgaguuuggugcccgcgu

SEQ ID NO: 3652409 - RNA, 16 nt, Salmonella enterica enterica serovar Typhi
caucggcgcgcuggcg

SEQ ID NO: 3652410 - RNA, 15 nt, Salmonella enterica enterica serovar Typhi
caucggcgcgucgcu

SEQ ID NO: 3652411 - RNA, 21 nt, Salmonella enterica enterica serovar Typhi
caucggcucagcaaucacuuc

SEQ ID NO: 3652412 - RNA, 18 nt, Salmonella enterica enterica serovar Typhi
caucgggauuuacaaccg

SEQ ID NO: 3652413 - RNA, 21 nt, Salmonella enterica enterica serovar Typhi
caucgggccguuaucuacgga

SEQ ID NO: 3652414 - RNA, 21 nt, Salmonella enterica enterica serovar Typhi
caucgggcuguuauucagcag

SEQ ID NO: 3652415 - RNA, 17 nt, Salmonella enterica enterica serovar Typhi
caucgggucgcgcgccg

SEQ ID NO: 3652416 - RNA, 15 nt, Salmonella enterica enterica serovar Typhi
caucggucaguguuu

SEQ ID NO: 3652417 - RNA, 17 nt, Salmonella enterica enterica serovar Typhi
caucggucaguuugccc

SEQ ID NO: 3652418 - RNA, 18 nt, Salmonella enterica enterica serovar Typhi
caucgguguacggcguca

SEQ ID NO: 3652419 - RNA, 17 nt, Salmonella enterica enterica serovar Typhi
caucgguucucugccau

SEQ ID NO: 3652420 - RNA, 14 nt, Salmonella enterica enterica serovar Typhi
caucgguuucgcgg

SEQ ID NO: 3652421 - RNA, 17 nt, Salmonella enterica enterica serovar Typhi
caucguccggcgaaaac

SEQ ID NO: 3652422 - RNA, 21 nt, Salmonella enterica enterica serovar Typhi
caucguggccgauauugccuu

SEQ ID NO: 3652423 - RNA, 14 nt, Salmonella enterica enterica serovar Typhi
caucguuacccauu

SEQ ID NO: 3652424 - RNA, 21 nt, Salmonella enterica enterica serovar Typhi
caucguuacccauuaccuggc

SEQ ID NO: 3652425 - RNA, 18 nt, Salmonella enterica enterica serovar Typhi
caucguuaccgcuucaca

SEQ ID NO: 3652426 - RNA, 19 nt, Salmonella enterica enterica serovar Typhi
caucguugagaaaaccaua

SEQ ID NO: 3652427 - RNA, 20 nt, Salmonella enterica enterica serovar Typhi
caucguuugcgcuacgcugc

SEQ ID NO: 3652428 - RNA, 15 nt, Salmonella enterica enterica serovar Typhi
caucuaacacaaauu

SEQ ID NO: 3652429 - RNA, 20 nt, Salmonella enterica enterica serovar Typhi
caucuaacacaaauucgcua

SEQ ID NO: 3652430 - RNA, 15 nt, Salmonella enterica enterica serovar Typhi
caucuacuucagcac

SEQ ID NO: 3652431 - RNA, 21 nt, Salmonella enterica enterica serovar Typhi
caucuauaauaccuccugucu

SEQ ID NO: 3652432 - RNA, 12 nt, Salmonella enterica enterica serovar Typhi
caucuauuuaac

SEQ ID NO: 3652433 - RNA, 22 nt, Salmonella enterica enterica serovar Typhi
caucucaauaucguugccgccg

SEQ ID NO: 3652434 - RNA, 12 nt, Salmonella enterica enterica serovar Typhi
caucucaucuug

SEQ ID NO: 3652435 - RNA, 16 nt, Salmonella enterica enterica serovar Typhi
caucucaucuugcagg

SEQ ID NO: 3652436 - RNA, 14 nt, Salmonella enterica enterica serovar Typhi
caucuccagcgcau

SEQ ID NO: 3652437 - RNA, 21 nt, Salmonella enterica enterica serovar Typhi
caucuccagcguggcagugag

SEQ ID NO: 3652438 - RNA, 14 nt, Salmonella enterica enterica serovar Typhi
caucucccaggccg

SEQ ID NO: 3652439 - RNA, 18 nt, Salmonella enterica enterica serovar Typhi
caucucccaggccgccac

SEQ ID NO: 3652440 - RNA, 20 nt, Salmonella enterica enterica serovar Typhi
caucucccaggccgccaccg

SEQ ID NO: 3652441 - RNA, 21 nt, Salmonella enterica enterica serovar Typhi
caucucccaggccgccaccgc

SEQ ID NO: 3652442 - RNA, 22 nt, Salmonella enterica enterica serovar Typhi
caucuccuccucauucagcggc

SEQ ID NO: 3652443 - RNA, 23 nt, Salmonella enterica enterica serovar Typhi
caucuccucgcgcguuugcaaua

SEQ ID NO: 3652444 - RNA, 16 nt, Salmonella enterica enterica serovar Typhi
caucuccugcgauagc

SEQ ID NO: 3652445 - RNA, 18 nt, Salmonella enterica enterica serovar Typhi
caucucgguuaugaccaa

SEQ ID NO: 3652446 - RNA, 22 nt, Salmonella enterica enterica serovar Typhi
caucucgguuaugaccaauggc

SEQ ID NO: 3652447 - RNA, 13 nt, Salmonella enterica enterica serovar Typhi
caucucuccgcgu

SEQ ID NO: 3652448 - RNA, 15 nt, Salmonella enterica enterica serovar Typhi
caucucuggcggcgu

SEQ ID NO: 3652449 - RNA, 14 nt, Salmonella enterica enterica serovar Typhi
caucucuuugcccg

SEQ ID NO: 3652450 - RNA, 21 nt, Salmonella enterica enterica serovar Typhi
caucugaacucuuccagauac

SEQ ID NO: 3652451 - RNA, 19 nt, Salmonella enterica enterica serovar Typhi
caucugcauaauggcgacg

SEQ ID NO: 3652452 - RNA, 23 nt, Salmonella enterica enterica serovar Typhi
caucugcauaauggcgacggcca

SEQ ID NO: 3652453 - RNA, 17 nt, Salmonella enterica enterica serovar Typhi
caucugcgcaacuggaa

SEQ ID NO: 3652454 - RNA, 20 nt, Salmonella enterica enterica serovar Typhi
caucugcguugcgcgcguca

SEQ ID NO: 3652455 - RNA, 16 nt, Salmonella enterica enterica serovar Typhi
caucugcuucaacagc

SEQ ID NO: 3652456 - RNA, 13 nt, Salmonella enterica enterica serovar Typhi
caucuggcacagg

SEQ ID NO: 3652457 - RNA, 16 nt, Salmonella enterica enterica serovar Typhi
caucuggcguugccug

SEQ ID NO: 3652458 - RNA, 16 nt, Salmonella enterica enterica serovar Typhi
caucugggggaagaua

SEQ ID NO: 3652459 - RNA, 17 nt, Salmonella enterica enterica serovar Typhi
caucuguggcaauuuuc

SEQ ID NO: 3652460 - RNA, 16 nt, Salmonella enterica enterica serovar Typhi
caucuuauauuuuggu

SEQ ID NO: 3652461 - RNA, 14 nt, Salmonella enterica enterica serovar Typhi
caucuuaucaggcc

SEQ ID NO: 3652462 - RNA, 16 nt, Salmonella enterica enterica serovar Typhi
caucuucacgcagcgu

SEQ ID NO: 3652463 - RNA, 13 nt, Salmonella enterica enterica serovar Typhi
caucuucacuuca

SEQ ID NO: 3652464 - RNA, 16 nt, Salmonella enterica enterica serovar Typhi
caucuucacuucacaa

SEQ ID NO: 3652465 - RNA, 17 nt, Salmonella enterica enterica serovar Typhi
caucuucacuucacaaa

SEQ ID NO: 3652466 - RNA, 12 nt, Salmonella enterica enterica serovar Typhi
caucuucagcaa

SEQ ID NO: 3652467 - RNA, 14 nt, Salmonella enterica enterica serovar Typhi
caucuuccaugccu

SEQ ID NO: 3652468 - RNA, 15 nt, Salmonella enterica enterica serovar Typhi
caucuucccgcagau

SEQ ID NO: 3652469 - RNA, 20 nt, Salmonella enterica enterica serovar Typhi
caucuucggcgggaucucca

SEQ ID NO: 3652470 - RNA, 13 nt, Salmonella enterica enterica serovar Typhi
caucuucugcguc

SEQ ID NO: 3652471 - RNA, 17 nt, Salmonella enterica enterica serovar Typhi
caucuuuaaccgccugc

SEQ ID NO: 3652472 - RNA, 19 nt, Salmonella enterica enterica serovar Typhi
caucuuuaaccgccugcuc

SEQ ID NO: 3652473 - RNA, 13 nt, Salmonella enterica enterica serovar Typhi
caucuuucuuuuc

SEQ ID NO: 3652474 - RNA, 14 nt, Salmonella enterica enterica serovar Typhi
caucuuucuuuucg

SEQ ID NO: 3652475 - RNA, 21 nt, Salmonella enterica enterica serovar Typhi
caucuuugccaaacugcugga

SEQ ID NO: 3652476 - RNA, 22 nt, Salmonella enterica enterica serovar Typhi
caucuuuuacaggccggacagg

SEQ ID NO: 3652477 - RNA, 13 nt, Salmonella enterica enterica serovar Typhi
caucuuuuuucac

SEQ ID NO: 3652478 - RNA, 18 nt, Salmonella enterica enterica serovar Typhi
caugaaacucgacacacu

SEQ ID NO: 3652479 - RNA, 23 nt, Salmonella enterica enterica serovar Typhi
caugaacguuggcgauaaggucg

SEQ ID NO: 3652480 - RNA, 14 nt, Salmonella enterica enterica serovar Typhi
caugaagaaaauac

SEQ ID NO: 3652481 - RNA, 24 nt, Salmonella enterica enterica serovar Typhi
caugaagauggucuguaccaccag

SEQ ID NO: 3652482 - RNA, 21 nt, Salmonella enterica enterica serovar Typhi
cauggcgaauccguugaucgu

SEQ ID NO: 3652483 - RNA, 14 nt, Salmonella enterica enterica serovar Typhi
cauggcuaaaagaa

SEQ ID NO: 3652484 - RNA, 22 nt, Salmonella enterica enterica serovar Typhi
caugggacgggucuccaucaga

SEQ ID NO: 3652485 - RNA, 14 nt, Salmonella enterica enterica serovar Typhi
caugggcaggaaca

SEQ ID NO: 3652486 - RNA, 20 nt, Salmonella enterica enterica serovar Typhi
caugguaaaauccuuuuuca

SEQ ID NO: 3652487 - RNA, 23 nt, Salmonella enterica enterica serovar Typhi
cauggucgccguccauuucaaug

SEQ ID NO: 3652488 - RNA, 15 nt, Salmonella enterica enterica serovar Typhi
cauggugaugaucgc

SEQ ID NO: 3652489 - RNA, 13 nt, Salmonella enterica enterica serovar Typhi
caugguugaaaaa

SEQ ID NO: 3652490 - RNA, 19 nt, Salmonella enterica enterica serovar Typhi
caugguugacuuacaaaaa

SEQ ID NO: 3652491 - RNA, 14 nt, Salmonella enterica enterica serovar Typhi
cauguaaacuccau

SEQ ID NO: 3652492 - RNA, 19 nt, Salmonella enterica enterica serovar Typhi
cauguaaacuccauuaaau

SEQ ID NO: 3652493 - RNA, 16 nt, Salmonella enterica enterica serovar Typhi
cauguaaauaaggcug

SEQ ID NO: 3652494 - RNA, 17 nt, Salmonella enterica enterica serovar Typhi
cauguaaauaaggcugc

SEQ ID NO: 3652495 - RNA, 21 nt, Salmonella enterica enterica serovar Typhi
cauguaaaugacgccagacua

SEQ ID NO: 3652496 - RNA, 14 nt, Salmonella enterica enterica serovar Typhi
cauguaaccaaagc

SEQ ID NO: 3652497 - RNA, 20 nt, Salmonella enterica enterica serovar Typhi
cauguaaccaaagcaccauu

SEQ ID NO: 3652498 - RNA, 19 nt, Salmonella enterica enterica serovar Typhi
cauguacaacuucaugagu

SEQ ID NO: 3652499 - RNA, 19 nt, Salmonella enterica enterica serovar Typhi
cauguagcgcggcagcgcg

SEQ ID NO: 3652500 - RNA, 22 nt, Salmonella enterica enterica serovar Typhi
caugucagcgcaaagccaauac

SEQ ID NO: 3652501 - RNA, 16 nt, Salmonella enterica enterica serovar Typhi
cauguccagaucuuca

SEQ ID NO: 3652502 - RNA, 14 nt, Salmonella enterica enterica serovar Typhi
cauguccccaggug

SEQ ID NO: 3652503 - RNA, 23 nt, Salmonella enterica enterica serovar Typhi
cauguccggcgacuccagaauau

SEQ ID NO: 3652504 - RNA, 23 nt, Salmonella enterica enterica serovar Typhi
caugucggccuuuuugcgccgcg

SEQ ID NO: 3652505 - RNA, 19 nt, Salmonella enterica enterica serovar Typhi
caugucucacccguuuucu

SEQ ID NO: 3652506 - RNA, 22 nt, Salmonella enterica enterica serovar Typhi
caugucugucuaugcacaggcg

SEQ ID NO: 3652507 - RNA, 12 nt, Salmonella enterica enterica serovar Typhi
caugucuucacu

SEQ ID NO: 3652508 - RNA, 22 nt, Salmonella enterica enterica serovar Typhi
cauguggccagcggccagccau

SEQ ID NO: 3652509 - RNA, 22 nt, Salmonella enterica enterica serovar Typhi
cauguguaauguuuucugccag

SEQ ID NO: 3652510 - RNA, 19 nt, Salmonella enterica enterica serovar Typhi
cauguguggguaggguugc

SEQ ID NO: 3652511 - RNA, 17 nt, Salmonella enterica enterica serovar Typhi
cauguuaaauacgccgc

SEQ ID NO: 3652512 - RNA, 22 nt, Salmonella enterica enterica serovar Typhi
cauguuaauaccagcgccaauc

SEQ ID NO: 3652513 - RNA, 21 nt, Salmonella enterica enterica serovar Typhi
cauguucaugaaccacgccaa

SEQ ID NO: 3652514 - RNA, 14 nt, Salmonella enterica enterica serovar Typhi
cauguuccggcaga

SEQ ID NO: 3652515 - RNA, 22 nt, Salmonella enterica enterica serovar Typhi
cauguugaucguaaaaugaaaa

SEQ ID NO: 3652516 - RNA, 23 nt, Salmonella enterica enterica serovar Typhi
cauguugaucguaaaaugaaaaa

SEQ ID NO: 3652517 - RNA, 14 nt, Salmonella enterica enterica serovar Typhi
cauguugccaugau

SEQ ID NO: 3652518 - RNA, 21 nt, Salmonella enterica enterica serovar Typhi
cauguugcggguuucugaaua

SEQ ID NO: 3652519 - RNA, 17 nt, Salmonella enterica enterica serovar Typhi
cauguugcguaaauaaa

SEQ ID NO: 3652520 - RNA, 18 nt, Salmonella enterica enterica serovar Typhi
cauguugcguaaauaaau

SEQ ID NO: 3652521 - RNA, 17 nt, Salmonella enterica enterica serovar Typhi
cauguuuccccuucugg

SEQ ID NO: 3652522 - RNA, 19 nt, Salmonella enterica enterica serovar Typhi
cauguuuuuuaauugugau

SEQ ID NO: 3652523 - RNA, 10 nt, Salmonella enterica enterica serovar Typhi
cauuaaaaaa

SEQ ID NO: 3652524 - RNA, 12 nt, Salmonella enterica enterica serovar Typhi
cauuaaaaaaac

SEQ ID NO: 3652525 - RNA, 14 nt, Salmonella enterica enterica serovar Typhi
cauuaaaaaaacau

SEQ ID NO: 3652526 - RNA, 18 nt, Salmonella enterica enterica serovar Typhi
cauuaaaauugaacggac

SEQ ID NO: 3652527 - RNA, 19 nt, Salmonella enterica enterica serovar Typhi
cauuaaaugcgcccagccc

SEQ ID NO: 3652528 - RNA, 14 nt, Salmonella enterica enterica serovar Typhi
cauuaacccggccc

SEQ ID NO: 3652529 - RNA, 17 nt, Salmonella enterica enterica serovar Typhi
cauuaaccuugcccaug

SEQ ID NO: 3652530 - RNA, 17 nt, Salmonella enterica enterica serovar Typhi
cauuaacgggaaacugu

SEQ ID NO: 3652531 - RNA, 13 nt, Salmonella enterica enterica serovar Typhi
cauuaacguccau

SEQ ID NO: 3652532 - RNA, 20 nt, Salmonella enterica enterica serovar Typhi
cauuaacuccggacguaccc

SEQ ID NO: 3652533 - RNA, 23 nt, Salmonella enterica enterica serovar Typhi
cauuaagcccauaaagcacuggu

SEQ ID NO: 3652534 - RNA, 23 nt, Salmonella enterica enterica serovar Typhi
cauuaauaaccccagcugcggca

SEQ ID NO: 3652535 - RNA, 17 nt, Salmonella enterica enterica serovar Typhi
cauuaauacaggccagc

SEQ ID NO: 3652536 - RNA, 13 nt, Salmonella enterica enterica serovar Typhi
cauuaauaccauc

SEQ ID NO: 3652537 - RNA, 17 nt, Salmonella enterica enterica serovar Typhi
cauuaauaucagcccca

SEQ ID NO: 3652538 - RNA, 19 nt, Salmonella enterica enterica serovar Typhi
cauuaauaugcgcaaucac

SEQ ID NO: 3652539 - RNA, 16 nt, Salmonella enterica enterica serovar Typhi
cauuaaucuauuuaau

SEQ ID NO: 3652540 - RNA, 23 nt, Salmonella enterica enterica serovar Typhi
cauuaauggcgauaauagaaccg

SEQ ID NO: 3652541 - RNA, 22 nt, Salmonella enterica enterica serovar Typhi
cauuaauuucuugcaauagcgc

SEQ ID NO: 3652542 - RNA, 13 nt, Salmonella enterica enterica serovar Typhi
cauuacaaacagg

SEQ ID NO: 3652543 - RNA, 17 nt, Salmonella enterica enterica serovar Typhi
cauuacaggcaucuucc

SEQ ID NO: 3652544 - RNA, 21 nt, Salmonella enterica enterica serovar Typhi
cauuacaggcaucuuccagcg

SEQ ID NO: 3652545 - RNA, 22 nt, Salmonella enterica enterica serovar Typhi
cauuacaggcaucuuccagcgu

SEQ ID NO: 3652546 - RNA, 20 nt, Salmonella enterica enterica serovar Typhi
cauuaccgaccuguaccgcg

SEQ ID NO: 3652547 - RNA, 15 nt, Salmonella enterica enterica serovar Typhi
cauuaccgcuaacau

SEQ ID NO: 3652548 - RNA, 13 nt, Salmonella enterica enterica serovar Typhi
cauuaccuuuucc

SEQ ID NO: 3652549 - RNA, 20 nt, Salmonella enterica enterica serovar Typhi
cauuacugaccgagaucagg

SEQ ID NO: 3652550 - RNA, 22 nt, Salmonella enterica enterica serovar Typhi
cauuacugaccgagaucaggcc

SEQ ID NO: 3652551 - RNA, 15 nt, Salmonella enterica enterica serovar Typhi
cauuacuguaaaccg

SEQ ID NO: 3652552 - RNA, 23 nt, Salmonella enterica enterica serovar Typhi
cauuagacaguuuuuucguucca

SEQ ID NO: 3652553 - RNA, 21 nt, Salmonella enterica enterica serovar Typhi
cauuagaccggacguugaaaa

SEQ ID NO: 3652554 - RNA, 22 nt, Salmonella enterica enterica serovar Typhi
cauuagcaugggcuaaagcauc

SEQ ID NO: 3652555 - RNA, 19 nt, Salmonella enterica enterica serovar Typhi
cauuagcauucccuuaucu

SEQ ID NO: 3652556 - RNA, 19 nt, Salmonella enterica enterica serovar Typhi
cauuagcgcgauaaaacca

SEQ ID NO: 3652557 - RNA, 20 nt, Salmonella enterica enterica serovar Typhi
cauuagcggcauugaagagu

SEQ ID NO: 3652558 - RNA, 13 nt, Salmonella enterica enterica serovar Typhi
cauuaggcguaau

SEQ ID NO: 3652559 - RNA, 20 nt, Salmonella enterica enterica serovar Typhi
cauuaggcguaauuauuaca

SEQ ID NO: 3652560 - RNA, 22 nt, Salmonella enterica enterica serovar Typhi
cauuaggcuuuucauucagcgc

SEQ ID NO: 3652561 - RNA, 23 nt, Salmonella enterica enterica serovar Typhi
cauuaguucaaguuuagaaaaaa

SEQ ID NO: 3652562 - RNA, 15 nt, Salmonella enterica enterica serovar Typhi
cauuauaaauaucau

SEQ ID NO: 3652563 - RNA, 12 nt, Salmonella enterica enterica serovar Typhi
cauuaucaccau

SEQ ID NO: 3652564 - RNA, 19 nt, Salmonella enterica enterica serovar Typhi
cauuaucgaugcguauuuc

SEQ ID NO: 3652565 - RNA, 19 nt, Salmonella enterica enterica serovar Typhi
cauuaugaucgguuuuuuu

SEQ ID NO: 3652566 - RNA, 23 nt, Salmonella enterica enterica serovar Typhi
cauuaugaucgguuuuuuuagaa

SEQ ID NO: 3652567 - RNA, 23 nt, Salmonella enterica enterica serovar Typhi
cauuguacuuuuaaaucaucagg

SEQ ID NO: 3652568 - RNA, 19 nt, Salmonella enterica enterica serovar Typhi
cauuguagucaauaaacug

SEQ ID NO: 3652569 - RNA, 19 nt, Salmonella enterica enterica serovar Typhi
cauuguccuuuaucugccc

SEQ ID NO: 3652570 - RNA, 17 nt, Salmonella enterica enterica serovar Typhi
cauugucggcgcuaucu

SEQ ID NO: 3652571 - RNA, 19 nt, Salmonella enterica enterica serovar Typhi
cauugucggcgcuaucuau

SEQ ID NO: 3652572 - RNA, 14 nt, Salmonella enterica enterica serovar Typhi
cauugucgggcaga

SEQ ID NO: 3652573 - RNA, 13 nt, Salmonella enterica enterica serovar Typhi
cauugucuuuuuc

SEQ ID NO: 3652574 - RNA, 14 nt, Salmonella enterica enterica serovar Typhi
cauugucuuuuucu

SEQ ID NO: 3652575 - RNA, 22 nt, Salmonella enterica enterica serovar Typhi
cauuguuccugcuggcaaaacg

SEQ ID NO: 3652576 - RNA, 16 nt, Salmonella enterica enterica serovar Typhi
cauuuaagauuuaaaa

SEQ ID NO: 3652577 - RNA, 20 nt, Salmonella enterica enterica serovar Typhi
cauuuaagauuuaaaacaag

SEQ ID NO: 3652578 - RNA, 13 nt, Salmonella enterica enterica serovar Typhi
cauuuacaauaau

SEQ ID NO: 3652579 - RNA, 17 nt, Salmonella enterica enterica serovar Typhi
cauuuacgccagccaga

SEQ ID NO: 3652580 - RNA, 20 nt, Salmonella enterica enterica serovar Typhi
cauuuagcgccgauuuccac

SEQ ID NO: 3652581 - RNA, 13 nt, Salmonella enterica enterica serovar Typhi
cauuuagcgccug

SEQ ID NO: 3652582 - RNA, 15 nt, Salmonella enterica enterica serovar Typhi
cauuuaugccgccau

SEQ ID NO: 3652583 - RNA, 12 nt, Salmonella enterica enterica serovar Typhi
cauuucaagcag

SEQ ID NO: 3652584 - RNA, 23 nt, Salmonella enterica enterica serovar Typhi
cauuucaaucgccaccacauuca

SEQ ID NO: 3652585 - RNA, 13 nt, Salmonella enterica enterica serovar Typhi
cauuucaaugcau

SEQ ID NO: 3652586 - RNA, 16 nt, Salmonella enterica enterica serovar Typhi
cauuucacaaauuaaa

SEQ ID NO: 3652587 - RNA, 20 nt, Salmonella enterica enterica serovar Typhi
cauuucacgauacuguugca

SEQ ID NO: 3652588 - RNA, 16 nt, Salmonella enterica enterica serovar Typhi
cauuucacuauaaaaa

SEQ ID NO: 3652589 - RNA, 16 nt, Salmonella enterica enterica serovar Typhi
cauuucaggcaaaaaa

SEQ ID NO: 3652590 - RNA, 18 nt, Salmonella enterica enterica serovar Typhi
cauuucaggcaaaggaau

SEQ ID NO: 3652591 - RNA, 17 nt, Salmonella enterica enterica serovar Typhi
cauuucaggcacuggcu

SEQ ID NO: 3652592 - RNA, 23 nt, Salmonella enterica enterica serovar Typhi
cauuucaucuaucugcuucuggc

SEQ ID NO: 3652593 - RNA, 12 nt, Salmonella enterica enterica serovar Typhi
cauuucaugacc

SEQ ID NO: 3652594 - RNA, 14 nt, Salmonella enterica enterica serovar Typhi
cauuucaugaccga

SEQ ID NO: 3652595 - RNA, 14 nt, Salmonella enterica enterica serovar Typhi
cauuuccgcagcca

SEQ ID NO: 3652596 - RNA, 15 nt, Salmonella enterica enterica serovar Typhi
cauuuccgcagccaa

SEQ ID NO: 3652597 - RNA, 18 nt, Salmonella enterica enterica serovar Typhi
cauuuccggcgcggucaa

SEQ ID NO: 3652598 - RNA, 13 nt, Salmonella enterica enterica serovar Typhi
cauuuccucugcg

SEQ ID NO: 3652599 - RNA, 17 nt, Salmonella enterica enterica serovar Typhi
cauuuccugcauuaacg

SEQ ID NO: 3652600 - RNA, 15 nt, Salmonella enterica enterica serovar Typhi
cauuucgaucuguuu

SEQ ID NO: 3652601 - RNA, 16 nt, Salmonella enterica enterica serovar Typhi
cauuucgcccucgcca

SEQ ID NO: 3652602 - RNA, 19 nt, Salmonella enterica enterica serovar Typhi
cauuucgccgccauccggc

SEQ ID NO: 3652603 - RNA, 12 nt, Salmonella enterica enterica serovar Typhi
cauuucugccug

SEQ ID NO: 3652604 - RNA, 20 nt, Salmonella enterica enterica serovar Typhi
cauuucugucugacgacccg

SEQ ID NO: 3652605 - RNA, 14 nt, Salmonella enterica enterica serovar Typhi
cauuucuucuucaa

SEQ ID NO: 3652606 - RNA, 16 nt, Salmonella enterica enterica serovar Typhi
cauuucuucuucaagc

SEQ ID NO: 3652607 - RNA, 17 nt, Salmonella enterica enterica serovar Typhi
cauuucuuguugacgac

SEQ ID NO: 3652608 - RNA, 21 nt, Salmonella enterica enterica serovar Typhi
cauuugauuuguuuuuuauau

SEQ ID NO: 3652609 - RNA, 14 nt, Salmonella enterica enterica serovar Typhi
cauuugcagguuac

SEQ ID NO: 3652610 - RNA, 21 nt, Salmonella enterica enterica serovar Typhi
cauuugcggcgucugcaccgg

SEQ ID NO: 3652611 - RNA, 16 nt, Salmonella enterica enterica serovar Typhi
cauuugcuguuuuauu

SEQ ID NO: 3652612 - RNA, 16 nt, Salmonella enterica enterica serovar Typhi
cauuuguacaaaaaau

SEQ ID NO: 3652613 - RNA, 22 nt, Salmonella enterica enterica serovar Typhi
cauuugucgcuguuaaucucau

SEQ ID NO: 3652614 - RNA, 13 nt, Salmonella enterica enterica serovar Typhi
cauuuguuccucg

SEQ ID NO: 3652615 - RNA, 13 nt, Salmonella enterica enterica serovar Typhi
cauuuuaaaaaua

SEQ ID NO: 3652616 - RNA, 14 nt, Salmonella enterica enterica serovar Typhi
cauuuuaaauacac

SEQ ID NO: 3652617 - RNA, 16 nt, Salmonella enterica enterica serovar Typhi
cauuuuauccaacagc

SEQ ID NO: 3652618 - RNA, 15 nt, Salmonella enterica enterica serovar Typhi
cauuuuauccucuuc

SEQ ID NO: 3652619 - RNA, 15 nt, Salmonella enterica enterica serovar Typhi
cauuuuauuuaaaaa

SEQ ID NO: 3652620 - RNA, 17 nt, Salmonella enterica enterica serovar Typhi
cauuuuauuuaaaaagg

SEQ ID NO: 3652621 - RNA, 13 nt, Salmonella enterica enterica serovar Typhi
cauuuucaauguc

SEQ ID NO: 3652622 - RNA, 18 nt, Salmonella enterica enterica serovar Typhi
cauuuuccacaauaccgu

SEQ ID NO: 3652623 - RNA, 20 nt, Salmonella enterica enterica serovar Typhi
cauuuuccgcugucuaucca

SEQ ID NO: 3652624 - RNA, 22 nt, Salmonella enterica enterica serovar Typhi
cauuuuccgcugucuauccacu

SEQ ID NO: 3652625 - RNA, 16 nt, Salmonella enterica enterica serovar Typhi
cauuuucggcagcgcg

SEQ ID NO: 3652626 - RNA, 16 nt, Salmonella enterica enterica serovar Typhi
cauuuucuuucaucaa

SEQ ID NO: 3652627 - RNA, 17 nt, Salmonella enterica enterica serovar Typhi
cauuuucuuucaucaaa

SEQ ID NO: 3652628 - RNA, 16 nt, Salmonella enterica enterica serovar Typhi
cauuuucuuugcagcu

SEQ ID NO: 3652629 - RNA, 22 nt, Salmonella enterica enterica serovar Typhi
cauuuugcgguuuuaauuucca

SEQ ID NO: 3652630 - RNA, 21 nt, Salmonella enterica enterica serovar Typhi
cauuuugcuggaaaaauaaga

SEQ ID NO: 3652631 - RNA, 18 nt, Salmonella enterica enterica serovar Typhi
cauuuuggccgcuuuagu

SEQ ID NO: 3652632 - RNA, 18 nt, Salmonella enterica enterica serovar Typhi
cauuuuggggaaaauacc

SEQ ID NO: 3652633 - RNA, 22 nt, Salmonella enterica enterica serovar Typhi
cauuuuguggcggauacgcuuc

SEQ ID NO: 3652634 - RNA, 14 nt, Salmonella enterica enterica serovar Typhi
cauuuuuaucagcu

SEQ ID NO: 3652635 - RNA, 13 nt, Salmonella enterica enterica serovar Typhi
cauuuuucccgau

SEQ ID NO: 3652636 - RNA, 18 nt, Salmonella enterica enterica serovar Typhi
cauuuuucgaucuucucc

SEQ ID NO: 3652637 - RNA, 18 nt, Salmonella enterica enterica serovar Typhi
cauuuuucgcccacaucu

SEQ ID NO: 3652638 - RNA, 19 nt, Salmonella enterica enterica serovar Typhi
cauuuuucucaggacgcca

SEQ ID NO: 3652639 - RNA, 19 nt, Salmonella enterica enterica serovar Typhi
cauuuuuucgaugaugaga

SEQ ID NO: 3652640 - RNA, 15 nt, Salmonella enterica enterica serovar Typhi
cauuuuuuucagccu

SEQ ID NO: 3652641 - RNA, 16 nt, Salmonella enterica enterica serovar Typhi
cauuuuuuuggcuucu

SEQ ID NO: 3652642 - RNA, 22 nt, Salmonella enterica enterica serovar Typhi
cauuuuuuuguccgucauuuac

SEQ ID NO: 3652643 - RNA, 20 nt, Salmonella enterica enterica serovar Typhi
cauuuuuuuugcaugguagu

SEQ ID NO: 3652644 - RNA, 13 nt, Salmonella enterica enterica serovar Typhi
ccaaaaaccccga

SEQ ID NO: 3652645 - RNA, 16 nt, Salmonella enterica enterica serovar Typhi
ccaaaaccacagugac

SEQ ID NO: 3652646 - RNA, 14 nt, Salmonella enterica enterica serovar Typhi
ccaaaacgaacagg

SEQ ID NO: 3652647 - RNA, 19 nt, Salmonella enterica enterica serovar Typhi
ccaaaauaauaaaaaucgg

SEQ ID NO: 3652648 - RNA, 17 nt, Salmonella enterica enterica serovar Typhi
ccaaaauagauaaucgc

SEQ ID NO: 3652649 - RNA, 20 nt, Salmonella enterica enterica serovar Typhi
ccaaaauccagggaaaccau

SEQ ID NO: 3652650 - RNA, 15 nt, Salmonella enterica enterica serovar Typhi
ccaaacacuuccccu

SEQ ID NO: 3652651 - RNA, 13 nt, Salmonella enterica enterica serovar Typhi
ccaaacagcggcu

SEQ ID NO: 3652652 - RNA, 19 nt, Salmonella enterica enterica serovar Typhi
ccaaacaucgcucgcgcca

SEQ ID NO: 3652653 - RNA, 20 nt, Salmonella enterica enterica serovar Typhi
ccaauauugacguuaaaaug

SEQ ID NO: 3652654 - RNA, 12 nt, Salmonella enterica enterica serovar Typhi
ccaauauuuauu

SEQ ID NO: 3652655 - RNA, 17 nt, Salmonella enterica enterica serovar Typhi
ccaaucaacgccgccag

SEQ ID NO: 3652656 - RNA, 21 nt, Salmonella enterica enterica serovar Typhi
ccaaucaacgccgccaggaua

SEQ ID NO: 3652657 - RNA, 13 nt, Salmonella enterica enterica serovar Typhi
ccaaucagcccca

SEQ ID NO: 3652658 - RNA, 16 nt, Salmonella enterica enterica serovar Typhi
ccaauccagaauacca

SEQ ID NO: 3652659 - RNA, 19 nt, Salmonella enterica enterica serovar Typhi
ccaaucgagaagccaucaa

SEQ ID NO: 3652660 - RNA, 17 nt, Salmonella enterica enterica serovar Typhi
ccaaucgccgccgcgug

SEQ ID NO: 3652661 - RNA, 15 nt, Salmonella enterica enterica serovar Typhi
ccaaucuccagcauc

SEQ ID NO: 3652662 - RNA, 16 nt, Salmonella enterica enterica serovar Typhi
ccaaugaugcgcugua

SEQ ID NO: 3652663 - RNA, 15 nt, Salmonella enterica enterica serovar Typhi
ccaaugcaacgccuu

SEQ ID NO: 3652664 - RNA, 13 nt, Salmonella enterica enterica serovar Typhi
ccaaugcagcgcg

SEQ ID NO: 3652665 - RNA, 16 nt, Salmonella enterica enterica serovar Typhi
ccaaugccaaaaaaac

SEQ ID NO: 3652666 - RNA, 21 nt, Salmonella enterica enterica serovar Typhi
ccaauggcgcgucuuaaaauu

SEQ ID NO: 3652667 - RNA, 22 nt, Salmonella enterica enterica serovar Typhi
ccaauguuaauaagcagaacgu

SEQ ID NO: 3652668 - RNA, 20 nt, Salmonella enterica enterica serovar Typhi
ccaauucguguuuuugaaca

SEQ ID NO: 3652669 - RNA, 15 nt, Salmonella enterica enterica serovar Typhi
ccacaaaggcgcgua

SEQ ID NO: 3652670 - RNA, 21 nt, Salmonella enterica enterica serovar Typhi
ccacaaauuuugauaaaaaca

SEQ ID NO: 3652671 - RNA, 22 nt, Salmonella enterica enterica serovar Typhi
ccacaaauuuugauaaaaacac

SEQ ID NO: 3652672 - RNA, 17 nt, Salmonella enterica enterica serovar Typhi
ccacaacgccugaugcu

SEQ ID NO: 3652673 - RNA, 23 nt, Salmonella enterica enterica serovar Typhi
ccacaacgccugaugcugcgcau

SEQ ID NO: 3652674 - RNA, 18 nt, Salmonella enterica enterica serovar Typhi
ccacaacggcaauuuuua

SEQ ID NO: 3652675 - RNA, 22 nt, Salmonella enterica enterica serovar Typhi
ccacaacgugauaaccaacagg

SEQ ID NO: 3652676 - RNA, 19 nt, Salmonella enterica enterica serovar Typhi
ccacaagaaaugcaggcgu

SEQ ID NO: 3652677 - RNA, 23 nt, Salmonella enterica enterica serovar Typhi
ccacaagagcagcaacccugccg

SEQ ID NO: 3652678 - RNA, 18 nt, Salmonella enterica enterica serovar Typhi
ccacaaucacagcgcaga

SEQ ID NO: 3652679 - RNA, 14 nt, Salmonella enterica enterica serovar Typhi
ccacaaucccgcca

SEQ ID NO: 3652680 - RNA, 19 nt, Salmonella enterica enterica serovar Typhi
ccacaauggcaggcagcag

SEQ ID NO: 3652681 - RNA, 20 nt, Salmonella enterica enterica serovar Typhi
ccacaauuguagcugcgcca

SEQ ID NO: 3652682 - RNA, 14 nt, Salmonella enterica enterica serovar Typhi
ccacacaugcaaaa

SEQ ID NO: 3652683 - RNA, 15 nt, Salmonella enterica enterica serovar Typhi
ccacacaugcaaaaa

SEQ ID NO: 3652684 - RNA, 20 nt, Salmonella enterica enterica serovar Typhi
ccacacaugcaaaaaagccc

SEQ ID NO: 3652685 - RNA, 16 nt, Salmonella enterica enterica serovar Typhi
ccacaccauaccgcuu

SEQ ID NO: 3652686 - RNA, 17 nt, Salmonella enterica enterica serovar Typhi
ccacacccauagcagcu

SEQ ID NO: 3652687 - RNA, 14 nt, Salmonella enterica enterica serovar Typhi
ccacaccggcgcau

SEQ ID NO: 3652688 - RNA, 21 nt, Salmonella enterica enterica serovar Typhi
ccacacgcuuauccugccacu

SEQ ID NO: 3652689 - RNA, 19 nt, Salmonella enterica enterica serovar Typhi
ccacagaucuaucugaaca

SEQ ID NO: 3652690 - RNA, 20 nt, Salmonella enterica enterica serovar Typhi
ccacagccgcauuuuuucuu

SEQ ID NO: 3652691 - RNA, 20 nt, Salmonella enterica enterica serovar Typhi
ccacagccgguuagccacaa

SEQ ID NO: 3652692 - RNA, 14 nt, Salmonella enterica enterica serovar Typhi
ccacagccucagca

SEQ ID NO: 3652693 - RNA, 17 nt, Salmonella enterica enterica serovar Typhi
ccacagcgccagacacu

SEQ ID NO: 3652694 - RNA, 23 nt, Salmonella enterica enterica serovar Typhi
ccacaggaaccgguagccaggcg

SEQ ID NO: 3652695 - RNA, 17 nt, Salmonella enterica enterica serovar Typhi
ccacaggcagggcgaug

SEQ ID NO: 3652696 - RNA, 21 nt, Salmonella enterica enterica serovar Typhi
ccacaggccguucauucgccc

SEQ ID NO: 3652697 - RNA, 20 nt, Salmonella enterica enterica serovar Typhi
ccacaggcgcuaauuaauuc

SEQ ID NO: 3652698 - RNA, 17 nt, Salmonella enterica enterica serovar Typhi
ccacagguuaucgccgc

SEQ ID NO: 3652699 - RNA, 20 nt, Salmonella enterica enterica serovar Typhi
ccacaguaauggacagguaa

SEQ ID NO: 3652700 - RNA, 18 nt, Salmonella enterica enterica serovar Typhi
ccacagucgucuggcgcu

SEQ ID NO: 3652701 - RNA, 20 nt, Salmonella enterica enterica serovar Typhi
ccacagucgucuggcgcuau

SEQ ID NO: 3652702 - RNA, 22 nt, Salmonella enterica enterica serovar Typhi
ccacagugacccgccgccagca

SEQ ID NO: 3652703 - RNA, 17 nt, Salmonella enterica enterica serovar Typhi
ccacauacugaaauuuc

SEQ ID NO: 3652704 - RNA, 15 nt, Salmonella enterica enterica serovar Typhi
ccacauagcauccag

SEQ ID NO: 3652705 - RNA, 17 nt, Salmonella enterica enterica serovar Typhi
ccacauauaacaaacgc

SEQ ID NO: 3652706 - RNA, 22 nt, Salmonella enterica enterica serovar Typhi
ccacaucagaccgccaagcgcg

SEQ ID NO: 3652707 - RNA, 14 nt, Salmonella enterica enterica serovar Typhi
ccacaucagcggca

SEQ ID NO: 3652708 - RNA, 18 nt, Salmonella enterica enterica serovar Typhi
ccacaucgcgacgggaua

SEQ ID NO: 3652709 - RNA, 23 nt, Salmonella enterica enterica serovar Typhi
ccacaucgcgagcacuuuuuccu

SEQ ID NO: 3652710 - RNA, 21 nt, Salmonella enterica enterica serovar Typhi
ccacaucggaucgauaugugu

SEQ ID NO: 3652711 - RNA, 21 nt, Salmonella enterica enterica serovar Typhi
ccacaucggauuauuuucacg

SEQ ID NO: 3652712 - RNA, 13 nt, Salmonella enterica enterica serovar Typhi
ccacaugaccagc

SEQ ID NO: 3652713 - RNA, 14 nt, Salmonella enterica enterica serovar Typhi
ccacaugaccagcg

SEQ ID NO: 3652714 - RNA, 21 nt, Salmonella enterica enterica serovar Typhi
ccacaugagaagggcaauauc

SEQ ID NO: 3652715 - RNA, 15 nt, Salmonella enterica enterica serovar Typhi
ccacauuaaagagcg

SEQ ID NO: 3652716 - RNA, 15 nt, Salmonella enterica enterica serovar Typhi
ccacauugaccccau

SEQ ID NO: 3652717 - RNA, 19 nt, Salmonella enterica enterica serovar Typhi
ccaccaaagccaggccgcc

SEQ ID NO: 3652718 - RNA, 20 nt, Salmonella enterica enterica serovar Typhi
ccaccaaagccaggccgcca

SEQ ID NO: 3652719 - RNA, 14 nt, Salmonella enterica enterica serovar Typhi
ccaccaacgaccau

SEQ ID NO: 3652720 - RNA, 14 nt, Salmonella enterica enterica serovar Typhi
ccaccaccagcauc

SEQ ID NO: 3652721 - RNA, 13 nt, Salmonella enterica enterica serovar Typhi
ccaccacgcccaa

SEQ ID NO: 3652722 - RNA, 20 nt, Salmonella enterica enterica serovar Typhi
ccaccacgcccaacgaccau

SEQ ID NO: 3652723 - RNA, 18 nt, Salmonella enterica enterica serovar Typhi
ccaccacguaaugcgccc

SEQ ID NO: 3652724 - RNA, 12 nt, Salmonella enterica enterica serovar Typhi
ccaccagaaccu

SEQ ID NO: 3652725 - RNA, 22 nt, Salmonella enterica enterica serovar Typhi
ccaccagaauaaaggccgggaa

SEQ ID NO: 3652726 - RNA, 14 nt, Salmonella enterica enterica serovar Typhi
ccaccagaucuuca

SEQ ID NO: 3652727 - RNA, 14 nt, Salmonella enterica enterica serovar Typhi
ccaccagcagggca

SEQ ID NO: 3652728 - RNA, 23 nt, Salmonella enterica enterica serovar Typhi
ccaccagcccaucuuucgccagc

SEQ ID NO: 3652729 - RNA, 23 nt, Salmonella enterica enterica serovar Typhi
ccaccagccgauaacucuucauc

SEQ ID NO: 3652730 - RNA, 12 nt, Salmonella enterica enterica serovar Typhi
ccaccagcgcca

SEQ ID NO: 3652731 - RNA, 19 nt, Salmonella enterica enterica serovar Typhi
ccaccagcgccaggccauu

SEQ ID NO: 3652732 - RNA, 16 nt, Salmonella enterica enterica serovar Typhi
ccaccagcuuaucuga

SEQ ID NO: 3652733 - RNA, 16 nt, Salmonella enterica enterica serovar Typhi
ccaccaggaacgccau

SEQ ID NO: 3652734 - RNA, 20 nt, Salmonella enterica enterica serovar Typhi
ccaccaggccugagccgaac

SEQ ID NO: 3652735 - RNA, 20 nt, Salmonella enterica enterica serovar Typhi
ccaccaguaaccgccacagc

SEQ ID NO: 3652736 - RNA, 15 nt, Salmonella enterica enterica serovar Typhi
ccaccauaggccagc

SEQ ID NO: 3652737 - RNA, 19 nt, Salmonella enterica enterica serovar Typhi
ccaccauaggccagcguca

SEQ ID NO: 3652738 - RNA, 12 nt, Salmonella enterica enterica serovar Typhi
ccacgggcgcac

SEQ ID NO: 3652739 - RNA, 21 nt, Salmonella enterica enterica serovar Typhi
ccacgggcgcguuaaugcauu

SEQ ID NO: 3652740 - RNA, 15 nt, Salmonella enterica enterica serovar Typhi
ccacgguguaccccg

SEQ ID NO: 3652741 - RNA, 16 nt, Salmonella enterica enterica serovar Typhi
ccacgguguaccccgc

SEQ ID NO: 3652742 - RNA, 16 nt, Salmonella enterica enterica serovar Typhi
ccacguaacucggcag

SEQ ID NO: 3652743 - RNA, 17 nt, Salmonella enterica enterica serovar Typhi
ccacguaacucggcagc

SEQ ID NO: 3652744 - RNA, 18 nt, Salmonella enterica enterica serovar Typhi
ccacguaacucggcagcg

SEQ ID NO: 3652745 - RNA, 16 nt, Salmonella enterica enterica serovar Typhi
ccacguacugcuuacc

SEQ ID NO: 3652746 - RNA, 14 nt, Salmonella enterica enterica serovar Typhi
ccacgucauccggc

SEQ ID NO: 3652747 - RNA, 17 nt, Salmonella enterica enterica serovar Typhi
ccacgucauccuccuga

SEQ ID NO: 3652748 - RNA, 18 nt, Salmonella enterica enterica serovar Typhi
ccacgugcggacguagcg

SEQ ID NO: 3652749 - RNA, 14 nt, Salmonella enterica enterica serovar Typhi
ccacguuaccgcgc

SEQ ID NO: 3652750 - RNA, 17 nt, Salmonella enterica enterica serovar Typhi
ccacguucuuccagaac

SEQ ID NO: 3652751 - RNA, 19 nt, Salmonella enterica enterica serovar Typhi
ccacguucuuccagaacgc

SEQ ID NO: 3652752 - RNA, 15 nt, Salmonella enterica enterica serovar Typhi
ccacuacgcagcucc

SEQ ID NO: 3652753 - RNA, 16 nt, Salmonella enterica enterica serovar Typhi
ccacuacgcagcucca

SEQ ID NO: 3652754 - RNA, 18 nt, Salmonella enterica enterica serovar Typhi
ccacucacgcucgcggaa

SEQ ID NO: 3652755 - RNA, 16 nt, Salmonella enterica enterica serovar Typhi
ccacuccaucgccuga

SEQ ID NO: 3652756 - RNA, 22 nt, Salmonella enterica enterica serovar Typhi
ccacucggcgagcaguacgccu

SEQ ID NO: 3652757 - RNA, 22 nt, Salmonella enterica enterica serovar Typhi
ccacugauaguccaucaccucu

SEQ ID NO: 3652758 - RNA, 14 nt, Salmonella enterica enterica serovar Typhi
ccacugcacauccc

SEQ ID NO: 3652759 - RNA, 14 nt, Salmonella enterica enterica serovar Typhi
ccacugcacgccag

SEQ ID NO: 3652760 - RNA, 17 nt, Salmonella enterica enterica serovar Typhi
ccacugcgccauuaacg

SEQ ID NO: 3652761 - RNA, 21 nt, Salmonella enterica enterica serovar Typhi
ccacuggcagcgccugacggc

SEQ ID NO: 3652762 - RNA, 18 nt, Salmonella enterica enterica serovar Typhi
ccacuggcccccuguucc

SEQ ID NO: 3652763 - RNA, 14 nt, Salmonella enterica enterica serovar Typhi
ccacuggccuccca

SEQ ID NO: 3652764 - RNA, 15 nt, Salmonella enterica enterica serovar Typhi
ccacuggguuuccca

SEQ ID NO: 3652765 - RNA, 19 nt, Salmonella enterica enterica serovar Typhi
ccacuuauuuguauugacg

SEQ ID NO: 3652766 - RNA, 12 nt, Salmonella enterica enterica serovar Typhi
ccacuucagcag

SEQ ID NO: 3652767 - RNA, 14 nt, Salmonella enterica enterica serovar Typhi
ccacuuucagcucc

SEQ ID NO: 3652768 - RNA, 19 nt, Salmonella enterica enterica serovar Typhi
ccacuuucuguaauuugaa

SEQ ID NO: 3652769 - RNA, 16 nt, Salmonella enterica enterica serovar Typhi
ccacuuugcgcuccug

SEQ ID NO: 3652770 - RNA, 15 nt, Salmonella enterica enterica serovar Typhi
ccacuuugggccgaa

SEQ ID NO: 3652771 - RNA, 16 nt, Salmonella enterica enterica serovar Typhi
ccagaaaaaaaagcgc

SEQ ID NO: 3652772 - RNA, 16 nt, Salmonella enterica enterica serovar Typhi
ccagaaaaagggaaaa

SEQ ID NO: 3652773 - RNA, 20 nt, Salmonella enterica enterica serovar Typhi
ccagaaaaccgacagcaaua

SEQ ID NO: 3652774 - RNA, 17 nt, Salmonella enterica enterica serovar Typhi
ccagaaacgguccugau

SEQ ID NO: 3652775 - RNA, 15 nt, Salmonella enterica enterica serovar Typhi
ccagaaagaucagca

SEQ ID NO: 3652776 - RNA, 12 nt, Salmonella enterica enterica serovar Typhi
ccagaacagaag

SEQ ID NO: 3652777 - RNA, 23 nt, Salmonella enterica enterica serovar Typhi
ccagaacgaauuuacucgccaau

SEQ ID NO: 3652778 - RNA, 13 nt, Salmonella enterica enterica serovar Typhi
ccagaacggcagc

SEQ ID NO: 3652779 - RNA, 14 nt, Salmonella enterica enterica serovar Typhi
ccagaacucaucuu

SEQ ID NO: 3652780 - RNA, 14 nt, Salmonella enterica enterica serovar Typhi
ccagaagcacuucu

SEQ ID NO: 3652781 - RNA, 14 nt, Salmonella enterica enterica serovar Typhi
ccagaaggcaggcu

SEQ ID NO: 3652782 - RNA, 15 nt, Salmonella enterica enterica serovar Typhi
ccagaauacaccgcc

SEQ ID NO: 3652783 - RNA, 16 nt, Salmonella enterica enterica serovar Typhi
ccagaauacaccgccu

SEQ ID NO: 3652784 - RNA, 18 nt, Salmonella enterica enterica serovar Typhi
ccagaauacacuucucaa

SEQ ID NO: 3652785 - RNA, 15 nt, Salmonella enterica enterica serovar Typhi
ccagaauacgccgcc

SEQ ID NO: 3652786 - RNA, 19 nt, Salmonella enterica enterica serovar Typhi
ccagaauacgccgccgccc

SEQ ID NO: 3652787 - RNA, 18 nt, Salmonella enterica enterica serovar Typhi
ccagaaucaccgacagca

SEQ ID NO: 3652788 - RNA, 16 nt, Salmonella enterica enterica serovar Typhi
ccagaaucaccucuuu

SEQ ID NO: 3652789 - RNA, 19 nt, Salmonella enterica enterica serovar Typhi
ccagaaucguggcugccac

SEQ ID NO: 3652790 - RNA, 13 nt, Salmonella enterica enterica serovar Typhi
ccagaaucuggcc

SEQ ID NO: 3652791 - RNA, 13 nt, Salmonella enterica enterica serovar Typhi
ccagaauucagca

SEQ ID NO: 3652792 - RNA, 18 nt, Salmonella enterica enterica serovar Typhi
ccagaauucagcauguac

SEQ ID NO: 3652793 - RNA, 23 nt, Salmonella enterica enterica serovar Typhi
ccagacaaaaucuuuccagcucc

SEQ ID NO: 3652794 - RNA, 14 nt, Salmonella enterica enterica serovar Typhi
ccagacaagcacau

SEQ ID NO: 3652795 - RNA, 16 nt, Salmonella enterica enterica serovar Typhi
ccagacaagcacauaa

SEQ ID NO: 3652796 - RNA, 23 nt, Salmonella enterica enterica serovar Typhi
ccagacaauccgcggcaaacccc

SEQ ID NO: 3652797 - RNA, 13 nt, Salmonella enterica enterica serovar Typhi
ccagacacuggaa

SEQ ID NO: 3652798 - RNA, 20 nt, Salmonella enterica enterica serovar Typhi
ccagacacuggaaacagcca

SEQ ID NO: 3652799 - RNA, 19 nt, Salmonella enterica enterica serovar Typhi
ccagacagauaacaccagc

SEQ ID NO: 3652800 - RNA, 19 nt, Salmonella enterica enterica serovar Typhi
ccagacagauuuggucagu

SEQ ID NO: 3652801 - RNA, 13 nt, Salmonella enterica enterica serovar Typhi
ccagacaggacgc

SEQ ID NO: 3652802 - RNA, 17 nt, Salmonella enterica enterica serovar Typhi
ccagacaggacgccagc

SEQ ID NO: 3652803 - RNA, 21 nt, Salmonella enterica enterica serovar Typhi
ccagaccacuaacccggcgac

SEQ ID NO: 3652804 - RNA, 19 nt, Salmonella enterica enterica serovar Typhi
ccagaccauucaaccagcc

SEQ ID NO: 3652805 - RNA, 14 nt, Salmonella enterica enterica serovar Typhi
ccagaccgcuuaac

SEQ ID NO: 3652806 - RNA, 23 nt, Salmonella enterica enterica serovar Typhi
ccagaccgcuuaacuccggcgac

SEQ ID NO: 3652807 - RNA, 21 nt, Salmonella enterica enterica serovar Typhi
ccagaccggauugcccgcggc

SEQ ID NO: 3652808 - RNA, 19 nt, Salmonella enterica enterica serovar Typhi
ccagaccggcaucucaucu

SEQ ID NO: 3652809 - RNA, 13 nt, Salmonella enterica enterica serovar Typhi
ccagaccggcgac

SEQ ID NO: 3652810 - RNA, 18 nt, Salmonella enterica enterica serovar Typhi
ccagacgaccguaauagc

SEQ ID NO: 3652811 - RNA, 20 nt, Salmonella enterica enterica serovar Typhi
ccagacgccauaucgccgcc

SEQ ID NO: 3652812 - RNA, 14 nt, Salmonella enterica enterica serovar Typhi
ccagacgcgcagca

SEQ ID NO: 3652813 - RNA, 17 nt, Salmonella enterica enterica serovar Typhi
ccagacgcguaaccccu

SEQ ID NO: 3652814 - RNA, 19 nt, Salmonella enterica enterica serovar Typhi
ccagacgcguaaccccugc

SEQ ID NO: 3652815 - RNA, 15 nt, Salmonella enterica enterica serovar Typhi
ccagacggcgcuguu

SEQ ID NO: 3652816 - RNA, 15 nt, Salmonella enterica enterica serovar Typhi
ccagacgggccaggc

SEQ ID NO: 3652817 - RNA, 17 nt, Salmonella enterica enterica serovar Typhi
ccagacgggccaggcga

SEQ ID NO: 3652818 - RNA, 22 nt, Salmonella enterica enterica serovar Typhi
ccagacgguaagcguucgcaua

SEQ ID NO: 3652819 - RNA, 15 nt, Salmonella enterica enterica serovar Typhi
ccagacuaaaacgug

SEQ ID NO: 3652820 - RNA, 13 nt, Salmonella enterica enterica serovar Typhi
ccagacuaaucca

SEQ ID NO: 3652821 - RNA, 16 nt, Salmonella enterica enterica serovar Typhi
ccagacucaccccuuc

SEQ ID NO: 3652822 - RNA, 16 nt, Salmonella enterica enterica serovar Typhi
ccagacucagccaggu

SEQ ID NO: 3652823 - RNA, 22 nt, Salmonella enterica enterica serovar Typhi
ccagacuccuuuuaccggcgaa

SEQ ID NO: 3652824 - RNA, 17 nt, Salmonella enterica enterica serovar Typhi
ccagcauaccgcccaac

SEQ ID NO: 3652825 - RNA, 14 nt, Salmonella enterica enterica serovar Typhi
ccagcauacgucug

SEQ ID NO: 3652826 - RNA, 15 nt, Salmonella enterica enterica serovar Typhi
ccagcauauaaauac

SEQ ID NO: 3652827 - RNA, 22 nt, Salmonella enterica enterica serovar Typhi
ccagcauaugcacacgcagcug

SEQ ID NO: 3652828 - RNA, 15 nt, Salmonella enterica enterica serovar Typhi
ccagcauauuaacag

SEQ ID NO: 3652829 - RNA, 20 nt, Salmonella enterica enterica serovar Typhi
ccagcauauuaacagugagu

SEQ ID NO: 3652830 - RNA, 17 nt, Salmonella enterica enterica serovar Typhi
ccagcaucaauagcagc

SEQ ID NO: 3652831 - RNA, 18 nt, Salmonella enterica enterica serovar Typhi
ccagcaucaauagcagcu

SEQ ID NO: 3652832 - RNA, 19 nt, Salmonella enterica enterica serovar Typhi
ccagcaucagaauaaugcu

SEQ ID NO: 3652833 - RNA, 14 nt, Salmonella enterica enterica serovar Typhi
ccagcaucccgcug

SEQ ID NO: 3652834 - RNA, 16 nt, Salmonella enterica enterica serovar Typhi
ccagcaucgcccgggc

SEQ ID NO: 3652835 - RNA, 17 nt, Salmonella enterica enterica serovar Typhi
ccagcaucggcagcgcc

SEQ ID NO: 3652836 - RNA, 17 nt, Salmonella enterica enterica serovar Typhi
ccagcaugagccagccc

SEQ ID NO: 3652837 - RNA, 20 nt, Salmonella enterica enterica serovar Typhi
ccagcaugauaguaucgcug

SEQ ID NO: 3652838 - RNA, 14 nt, Salmonella enterica enterica serovar Typhi
ccagcaugcccgcc

SEQ ID NO: 3652839 - RNA, 11 nt, Salmonella enterica enterica serovar Typhi
ccagcauggcg

SEQ ID NO: 3652840 - RNA, 15 nt, Salmonella enterica enterica serovar Typhi
ccagcauuagcgcca

SEQ ID NO: 3652841 - RNA, 17 nt, Salmonella enterica enterica serovar Typhi
ccagcauuagcgccacc

SEQ ID NO: 3652842 - RNA, 18 nt, Salmonella enterica enterica serovar Typhi
ccagcauugggccgauaa

SEQ ID NO: 3652843 - RNA, 17 nt, Salmonella enterica enterica serovar Typhi
ccagcauuuccagcugg

SEQ ID NO: 3652844 - RNA, 12 nt, Salmonella enterica enterica serovar Typhi
ccagccacaaga

SEQ ID NO: 3652845 - RNA, 18 nt, Salmonella enterica enterica serovar Typhi
ccagccacaagagcagca

SEQ ID NO: 3652846 - RNA, 15 nt, Salmonella enterica enterica serovar Typhi
ccagccacuccuuac

SEQ ID NO: 3652847 - RNA, 15 nt, Salmonella enterica enterica serovar Typhi
ccagccagacgccag

SEQ ID NO: 3652848 - RNA, 16 nt, Salmonella enterica enterica serovar Typhi
ccagccagacgccagc

SEQ ID NO: 3652849 - RNA, 17 nt, Salmonella enterica enterica serovar Typhi
ccagccagacgccagcc

SEQ ID NO: 3652850 - RNA, 17 nt, Salmonella enterica enterica serovar Typhi
ccagccagcgacgcaug

SEQ ID NO: 3652851 - RNA, 18 nt, Salmonella enterica enterica serovar Typhi
ccagccaggaaccgccga

SEQ ID NO: 3652852 - RNA, 18 nt, Salmonella enterica enterica serovar Typhi
ccagccagggaucaagca

SEQ ID NO: 3652853 - RNA, 14 nt, Salmonella enterica enterica serovar Typhi
ccagccauaaauau

SEQ ID NO: 3652854 - RNA, 14 nt, Salmonella enterica enterica serovar Typhi
ccagccaugccagc

SEQ ID NO: 3652855 - RNA, 14 nt, Salmonella enterica enterica serovar Typhi
ccagccaugccaua

SEQ ID NO: 3652856 - RNA, 21 nt, Salmonella enterica enterica serovar Typhi
ccagccauggcccuuuugccc

SEQ ID NO: 3652857 - RNA, 16 nt, Salmonella enterica enterica serovar Typhi
ccagccauuaaagaag

SEQ ID NO: 3652858 - RNA, 18 nt, Salmonella enterica enterica serovar Typhi
ccagccauugcugacaaa

SEQ ID NO: 3652859 - RNA, 14 nt, Salmonella enterica enterica serovar Typhi
ccagccccagcccu

SEQ ID NO: 3652860 - RNA, 15 nt, Salmonella enterica enterica serovar Typhi
ccagcccccugccag

SEQ ID NO: 3652861 - RNA, 18 nt, Salmonella enterica enterica serovar Typhi
ccagccccgaugucgcca

SEQ ID NO: 3652862 - RNA, 14 nt, Salmonella enterica enterica serovar Typhi
ccagcccgccgccc

SEQ ID NO: 3652863 - RNA, 23 nt, Salmonella enterica enterica serovar Typhi
ccagcccggaaauaaacgccagu

SEQ ID NO: 3652864 - RNA, 16 nt, Salmonella enterica enterica serovar Typhi
ccagcccuaaaaauag

SEQ ID NO: 3652865 - RNA, 22 nt, Salmonella enterica enterica serovar Typhi
ccagcccuaaaaauagcaccag

SEQ ID NO: 3652866 - RNA, 18 nt, Salmonella enterica enterica serovar Typhi
ccagcccugcgaucauca

SEQ ID NO: 3652867 - RNA, 19 nt, Salmonella enterica enterica serovar Typhi
ccagccgcgccaucuccuc

SEQ ID NO: 3652868 - RNA, 18 nt, Salmonella enterica enterica serovar Typhi
ccagccgcuuuccgccgc

SEQ ID NO: 3652869 - RNA, 19 nt, Salmonella enterica enterica serovar Typhi
ccagccgggcaggaaaagc

SEQ ID NO: 3652870 - RNA, 16 nt, Salmonella enterica enterica serovar Typhi
ccagccgggcuucagg

SEQ ID NO: 3652871 - RNA, 19 nt, Salmonella enterica enterica serovar Typhi
ccagccgguguuaaccaga

SEQ ID NO: 3652872 - RNA, 20 nt, Salmonella enterica enterica serovar Typhi
ccagccguugugcugguuga

SEQ ID NO: 3652873 - RNA, 19 nt, Salmonella enterica enterica serovar Typhi
ccagccuaccugccgccau

SEQ ID NO: 3652874 - RNA, 20 nt, Salmonella enterica enterica serovar Typhi
ccagccuaccugccgccaua

SEQ ID NO: 3652875 - RNA, 16 nt, Salmonella enterica enterica serovar Typhi
ccagccuaucgccaua

SEQ ID NO: 3652876 - RNA, 19 nt, Salmonella enterica enterica serovar Typhi
ccagccucgcgcauccggg

SEQ ID NO: 3652877 - RNA, 13 nt, Salmonella enterica enterica serovar Typhi
ccagccucuccca

SEQ ID NO: 3652878 - RNA, 19 nt, Salmonella enterica enterica serovar Typhi
ccagccugaacaucuucca

SEQ ID NO: 3652879 - RNA, 15 nt, Salmonella enterica enterica serovar Typhi
ccagccugccugccu

SEQ ID NO: 3652880 - RNA, 18 nt, Salmonella enterica enterica serovar Typhi
ccagccuuccuggucugc

SEQ ID NO: 3652881 - RNA, 22 nt, Salmonella enterica enterica serovar Typhi
ccagcgaaaaccagcgccgcca

SEQ ID NO: 3652882 - RNA, 23 nt, Salmonella enterica enterica serovar Typhi
ccagcgaaaugacggccaccagc

SEQ ID NO: 3652883 - RNA, 18 nt, Salmonella enterica enterica serovar Typhi
ccagcgaacugauaaaag

SEQ ID NO: 3652884 - RNA, 21 nt, Salmonella enterica enterica serovar Typhi
ccagcgaacugauaaaagaga

SEQ ID NO: 3652885 - RNA, 14 nt, Salmonella enterica enterica serovar Typhi
ccagcgaauaauga

SEQ ID NO: 3652886 - RNA, 17 nt, Salmonella enterica enterica serovar Typhi
ccagcgaauccgugcgu

SEQ ID NO: 3652887 - RNA, 13 nt, Salmonella enterica enterica serovar Typhi
ccagcgacaguag

SEQ ID NO: 3652888 - RNA, 23 nt, Salmonella enterica enterica serovar Typhi
ccagcgacaguaguaucauccau

SEQ ID NO: 3652889 - RNA, 16 nt, Salmonella enterica enterica serovar Typhi
ccagcgacaucccaga

SEQ ID NO: 3652890 - RNA, 16 nt, Salmonella enterica enterica serovar Typhi
ccagcgacaucgcaua

SEQ ID NO: 3652891 - RNA, 23 nt, Salmonella enterica enterica serovar Typhi
ccagcgacauggcggucgccaua

SEQ ID NO: 3652892 - RNA, 20 nt, Salmonella enterica enterica serovar Typhi
ccagcgaccaccgucccagu

SEQ ID NO: 3652893 - RNA, 15 nt, Salmonella enterica enterica serovar Typhi
ccagcgacgcccagu

SEQ ID NO: 3652894 - RNA, 14 nt, Salmonella enterica enterica serovar Typhi
ccagcgacggccag

SEQ ID NO: 3652895 - RNA, 19 nt, Salmonella enterica enterica serovar Typhi
ccagcgacgguaauaccaa

SEQ ID NO: 3652896 - RNA, 20 nt, Salmonella enterica enterica serovar Typhi
ccagcgacuccggauagaga

SEQ ID NO: 3652897 - RNA, 19 nt, Salmonella enterica enterica serovar Typhi
ccagcgagaugaaaaguca

SEQ ID NO: 3652898 - RNA, 18 nt, Salmonella enterica enterica serovar Typhi
ccagcgaucccaguugau

SEQ ID NO: 3652899 - RNA, 17 nt, Salmonella enterica enterica serovar Typhi
ccagcgaugagcgccag

SEQ ID NO: 3652900 - RNA, 22 nt, Salmonella enterica enterica serovar Typhi
ccagcgaugagcgccagcaaca

SEQ ID NO: 3652901 - RNA, 24 nt, Salmonella enterica enterica serovar Typhi
ccagcgaugagcgccagcaacagc

SEQ ID NO: 3652902 - RNA, 21 nt, Salmonella enterica enterica serovar Typhi
ccagcgauggggcaagcucag

SEQ ID NO: 3652903 - RNA, 19 nt, Salmonella enterica enterica serovar Typhi
ccagcgauuacgccagaca

SEQ ID NO: 3652904 - RNA, 15 nt, Salmonella enterica enterica serovar Typhi
ccagcgcauugacga

SEQ ID NO: 3652905 - RNA, 18 nt, Salmonella enterica enterica serovar Typhi
ccagcgccaccaaagcca

SEQ ID NO: 3652906 - RNA, 17 nt, Salmonella enterica enterica serovar Typhi
ccagcgcccacaccaua

SEQ ID NO: 3652907 - RNA, 13 nt, Salmonella enterica enterica serovar Typhi
ccagcgcccuauc

SEQ ID NO: 3652908 - RNA, 14 nt, Salmonella enterica enterica serovar Typhi
ccagcgccgagaaa

SEQ ID NO: 3652909 - RNA, 14 nt, Salmonella enterica enterica serovar Typhi
ccagcgccgccaga

SEQ ID NO: 3652910 - RNA, 18 nt, Salmonella enterica enterica serovar Typhi
ccaggcaaagccccaguc

SEQ ID NO: 3652911 - RNA, 16 nt, Salmonella enterica enterica serovar Typhi
ccaggcaaagcucaac

SEQ ID NO: 3652912 - RNA, 22 nt, Salmonella enterica enterica serovar Typhi
ccaggcaaaugauuaucuccau

SEQ ID NO: 3652913 - RNA, 23 nt, Salmonella enterica enterica serovar Typhi
ccaggcacuugagaaauuauuuu

SEQ ID NO: 3652914 - RNA, 19 nt, Salmonella enterica enterica serovar Typhi
ccaggcagauccaaauggc

SEQ ID NO: 3652915 - RNA, 21 nt, Salmonella enterica enterica serovar Typhi
ccaggcagcgcgccagcgcua

SEQ ID NO: 3652916 - RNA, 19 nt, Salmonella enterica enterica serovar Typhi
ccaggcagcguggcgagcu

SEQ ID NO: 3652917 - RNA, 13 nt, Salmonella enterica enterica serovar Typhi
ccaggcauagaaa

SEQ ID NO: 3652918 - RNA, 21 nt, Salmonella enterica enterica serovar Typhi
ccaggcauagaaaaagaacug

SEQ ID NO: 3652919 - RNA, 18 nt, Salmonella enterica enterica serovar Typhi
ccaggcauguuaugaaua

SEQ ID NO: 3652920 - RNA, 12 nt, Salmonella enterica enterica serovar Typhi
ccaggccaaaac

SEQ ID NO: 3652921 - RNA, 18 nt, Salmonella enterica enterica serovar Typhi
ccaggccaauuccgccau

SEQ ID NO: 3652922 - RNA, 15 nt, Salmonella enterica enterica serovar Typhi
ccaggccagauggcu

SEQ ID NO: 3652923 - RNA, 18 nt, Salmonella enterica enterica serovar Typhi
ccaggcccagccgcuccg

SEQ ID NO: 3652924 - RNA, 15 nt, Salmonella enterica enterica serovar Typhi
ccaggccgccaccgc

SEQ ID NO: 3652925 - RNA, 23 nt, Salmonella enterica enterica serovar Typhi
ccaggccgguuguuuacacggca

SEQ ID NO: 3652926 - RNA, 20 nt, Salmonella enterica enterica serovar Typhi
ccaggccgucggcgccagcc

SEQ ID NO: 3652927 - RNA, 13 nt, Salmonella enterica enterica serovar Typhi
ccaggccugagcc

SEQ ID NO: 3652928 - RNA, 21 nt, Salmonella enterica enterica serovar Typhi
ccaggccugaugagcgcagcg

SEQ ID NO: 3652929 - RNA, 18 nt, Salmonella enterica enterica serovar Typhi
ccaggcgcgaaucgacaa

SEQ ID NO: 3652930 - RNA, 14 nt, Salmonella enterica enterica serovar Typhi
ccaggcgcgcaccg

SEQ ID NO: 3652931 - RNA, 20 nt, Salmonella enterica enterica serovar Typhi
ccaggcggauaaaacagaaa

SEQ ID NO: 3652932 - RNA, 22 nt, Salmonella enterica enterica serovar Typhi
ccaggcggcuuuuucaucaucg

SEQ ID NO: 3652933 - RNA, 17 nt, Salmonella enterica enterica serovar Typhi
ccaggcguuuaugagau

SEQ ID NO: 3652934 - RNA, 14 nt, Salmonella enterica enterica serovar Typhi
ccaggcuauccagc

SEQ ID NO: 3652935 - RNA, 18 nt, Salmonella enterica enterica serovar Typhi
ccaggcuauccagcucac

SEQ ID NO: 3652936 - RNA, 21 nt, Salmonella enterica enterica serovar Typhi
ccaggcuuuaaauucagcacc

SEQ ID NO: 3652937 - RNA, 14 nt, Salmonella enterica enterica serovar Typhi
ccagggagggccaa

SEQ ID NO: 3652938 - RNA, 20 nt, Salmonella enterica enterica serovar Typhi
ccagggauugauggccagcc

SEQ ID NO: 3652939 - RNA, 21 nt, Salmonella enterica enterica serovar Typhi
ccagggauuuugcuuuuucgg

SEQ ID NO: 3652940 - RNA, 22 nt, Salmonella enterica enterica serovar Typhi
ccagggcaaauuaucccuuccu

SEQ ID NO: 3652941 - RNA, 18 nt, Salmonella enterica enterica serovar Typhi
ccagggcaucaugauguu

SEQ ID NO: 3652942 - RNA, 14 nt, Salmonella enterica enterica serovar Typhi
ccagggcgauuccc

SEQ ID NO: 3652943 - RNA, 19 nt, Salmonella enterica enterica serovar Typhi
ccagggcgggauccccugc

SEQ ID NO: 3652944 - RNA, 20 nt, Salmonella enterica enterica serovar Typhi
ccagggcgggauccccugcu

SEQ ID NO: 3652945 - RNA, 17 nt, Salmonella enterica enterica serovar Typhi
ccaggguucgcuggcca

SEQ ID NO: 3652946 - RNA, 21 nt, Salmonella enterica enterica serovar Typhi
ccaggguuuagccccagaccg

SEQ ID NO: 3652947 - RNA, 22 nt, Salmonella enterica enterica serovar Typhi
ccagguaacauacaaaaaguac

SEQ ID NO: 3652948 - RNA, 20 nt, Salmonella enterica enterica serovar Typhi
ccagguaaguucaaacaggu

SEQ ID NO: 3652949 - RNA, 17 nt, Salmonella enterica enterica serovar Typhi
ccaggucaucaccucca

SEQ ID NO: 3652950 - RNA, 16 nt, Salmonella enterica enterica serovar Typhi
ccaggucgcccagcca

SEQ ID NO: 3652951 - RNA, 16 nt, Salmonella enterica enterica serovar Typhi
ccaggucugcgcguuu

SEQ ID NO: 3652952 - RNA, 20 nt, Salmonella enterica enterica serovar Typhi
ccaggugacuuugcccuuuu

SEQ ID NO: 3652953 - RNA, 21 nt, Salmonella enterica enterica serovar Typhi
ccaggugcguggcccgcacug

SEQ ID NO: 3652954 - RNA, 15 nt, Salmonella enterica enterica serovar Typhi
ccagguuaauccuua

SEQ ID NO: 3652955 - RNA, 15 nt, Salmonella enterica enterica serovar Typhi
ccagguuagcagcca

SEQ ID NO: 3652956 - RNA, 17 nt, Salmonella enterica enterica serovar Typhi
ccagguucaagcuggaa

SEQ ID NO: 3652957 - RNA, 12 nt, Salmonella enterica enterica serovar Typhi
ccagguucagca

SEQ ID NO: 3652958 - RNA, 19 nt, Salmonella enterica enterica serovar Typhi
ccagguuccccaaugauca

SEQ ID NO: 3652959 - RNA, 23 nt, Salmonella enterica enterica serovar Typhi
ccagguugcucagguuauacugu

SEQ ID NO: 3652960 - RNA, 13 nt, Salmonella enterica enterica serovar Typhi
ccagguuuuacau

SEQ ID NO: 3652961 - RNA, 19 nt, Salmonella enterica enterica serovar Typhi
ccagguuuucaggccgcgu

SEQ ID NO: 3652962 - RNA, 20 nt, Salmonella enterica enterica serovar Typhi
ccaguaacgcguccaacugg

SEQ ID NO: 3652963 - RNA, 20 nt, Salmonella enterica enterica serovar Typhi
ccaguaacucaucgccagcc

SEQ ID NO: 3652964 - RNA, 19 nt, Salmonella enterica enterica serovar Typhi
ccaguaauaucgccucccu

SEQ ID NO: 3652965 - RNA, 15 nt, Salmonella enterica enterica serovar Typhi
ccaguaauccggcaa

SEQ ID NO: 3652966 - RNA, 23 nt, Salmonella enterica enterica serovar Typhi
ccaguaaucggcgcgaaacaggu

SEQ ID NO: 3652967 - RNA, 14 nt, Salmonella enterica enterica serovar Typhi
ccaguaaugccaua

SEQ ID NO: 3652968 - RNA, 23 nt, Salmonella enterica enterica serovar Typhi
ccaguaauuuuucucccagcaga

SEQ ID NO: 3652969 - RNA, 17 nt, Salmonella enterica enterica serovar Typhi
ccaguacaaacaaauaa

SEQ ID NO: 3652970 - RNA, 13 nt, Salmonella enterica enterica serovar Typhi
ccaguaccagcac

SEQ ID NO: 3652971 - RNA, 14 nt, Salmonella enterica enterica serovar Typhi
ccaguaccagcacu

SEQ ID NO: 3652972 - RNA, 17 nt, Salmonella enterica enterica serovar Typhi
ccaguacggcgcgaauc

SEQ ID NO: 3652973 - RNA, 21 nt, Salmonella enterica enterica serovar Typhi
ccaguacgucaacaaugcuuu

SEQ ID NO: 3652974 - RNA, 15 nt, Salmonella enterica enterica serovar Typhi
ccaguacuuucuuuu

SEQ ID NO: 3652975 - RNA, 13 nt, Salmonella enterica enterica serovar Typhi
ccaguagcagaca

SEQ ID NO: 3652976 - RNA, 12 nt, Salmonella enterica enterica serovar Typhi
ccaguagcagcg

SEQ ID NO: 3652977 - RNA, 18 nt, Salmonella enterica enterica serovar Typhi
ccaguagcgcgacgccaa

SEQ ID NO: 3652978 - RNA, 14 nt, Salmonella enterica enterica serovar Typhi
ccaguagcugcucc

SEQ ID NO: 3652979 - RNA, 17 nt, Salmonella enterica enterica serovar Typhi
ccaguaucgcgccgcca

SEQ ID NO: 3652980 - RNA, 20 nt, Salmonella enterica enterica serovar Typhi
ccagucaggcgaucccggcc

SEQ ID NO: 3652981 - RNA, 18 nt, Salmonella enterica enterica serovar Typhi
ccagucaucauaauucag

SEQ ID NO: 3652982 - RNA, 13 nt, Salmonella enterica enterica serovar Typhi
ccagucauccggu

SEQ ID NO: 3652983 - RNA, 16 nt, Salmonella enterica enterica serovar Typhi
ccagucauuaauuccc

SEQ ID NO: 3652984 - RNA, 23 nt, Salmonella enterica enterica serovar Typhi
ccagucauuaauucccgcagcca

SEQ ID NO: 3652985 - RNA, 13 nt, Salmonella enterica enterica serovar Typhi
ccagucccagcac

SEQ ID NO: 3652986 - RNA, 14 nt, Salmonella enterica enterica serovar Typhi
ccaguccccuuuuc

SEQ ID NO: 3652987 - RNA, 23 nt, Salmonella enterica enterica serovar Typhi
ccagucccugaagaaaaggaaug

SEQ ID NO: 3652988 - RNA, 21 nt, Salmonella enterica enterica serovar Typhi
ccaguccuccggcugaagccc

SEQ ID NO: 3652989 - RNA, 16 nt, Salmonella enterica enterica serovar Typhi
ccaguccuuccgccgg

SEQ ID NO: 3652990 - RNA, 18 nt, Salmonella enterica enterica serovar Typhi
ccagucgcagcaaacggc

SEQ ID NO: 3652991 - RNA, 13 nt, Salmonella enterica enterica serovar Typhi
ccagucgcagcca

SEQ ID NO: 3652992 - RNA, 15 nt, Salmonella enterica enterica serovar Typhi
ccagucgcuccacca

SEQ ID NO: 3652993 - RNA, 16 nt, Salmonella enterica enterica serovar Typhi
ccagucgcuccaccac

SEQ ID NO: 3652994 - RNA, 17 nt, Salmonella enterica enterica serovar Typhi
ccagucgcuccaccacu

SEQ ID NO: 3652995 - RNA, 22 nt, Salmonella enterica enterica serovar Typhi
ccauagcguuuaaaaagcugca

SEQ ID NO: 3652996 - RNA, 23 nt, Salmonella enterica enterica serovar Typhi
ccauagcguuuaaaaagcugcau

SEQ ID NO: 3652997 - RNA, 14 nt, Salmonella enterica enterica serovar Typhi
ccauaggccagcgu

SEQ ID NO: 3652998 - RNA, 14 nt, Salmonella enterica enterica serovar Typhi
ccauaguccaugcc

SEQ ID NO: 3652999 - RNA, 18 nt, Salmonella enterica enterica serovar Typhi
ccauauaacagaauaagc

SEQ ID NO: 3653000 - RNA, 13 nt, Salmonella enterica enterica serovar Typhi
ccauauacucuuu

SEQ ID NO: 3653001 - RNA, 20 nt, Salmonella enterica enterica serovar Typhi
ccauauagacauacaggaau

SEQ ID NO: 3653002 - RNA, 13 nt, Salmonella enterica enterica serovar Typhi
ccauauaucugaa

SEQ ID NO: 3653003 - RNA, 14 nt, Salmonella enterica enterica serovar Typhi
ccauauaugaaauc

SEQ ID NO: 3653004 - RNA, 20 nt, Salmonella enterica enterica serovar Typhi
ccauauauuuacugaauaaa

SEQ ID NO: 3653005 - RNA, 21 nt, Salmonella enterica enterica serovar Typhi
ccauauauuuacugaauaaau

SEQ ID NO: 3653006 - RNA, 14 nt, Salmonella enterica enterica serovar Typhi
ccauaucgccgcca

SEQ ID NO: 3653007 - RNA, 21 nt, Salmonella enterica enterica serovar Typhi
ccauaucgccgcugccgcuau

SEQ ID NO: 3653008 - RNA, 14 nt, Salmonella enterica enterica serovar Typhi
ccauauuauucugc

SEQ ID NO: 3653009 - RNA, 17 nt, Salmonella enterica enterica serovar Typhi
ccauauuccagaaagga

SEQ ID NO: 3653010 - RNA, 16 nt, Salmonella enterica enterica serovar Typhi
ccauauucuucgcaua

SEQ ID NO: 3653011 - RNA, 20 nt, Salmonella enterica enterica serovar Typhi
ccauauucuuugcgccuuau

SEQ ID NO: 3653012 - RNA, 15 nt, Salmonella enterica enterica serovar Typhi
ccauauuuaugcagc

SEQ ID NO: 3653013 - RNA, 18 nt, Salmonella enterica enterica serovar Typhi
ccauauuuaugcagcgcg

SEQ ID NO: 3653014 - RNA, 23 nt, Salmonella enterica enterica serovar Typhi
ccauauuuuuucugccaguuucu

SEQ ID NO: 3653015 - RNA, 15 nt, Salmonella enterica enterica serovar Typhi
ccaucaaaaaaaaua

SEQ ID NO: 3653016 - RNA, 16 nt, Salmonella enterica enterica serovar Typhi
ccaucaaacgcagcaa

SEQ ID NO: 3653017 - RNA, 19 nt, Salmonella enterica enterica serovar Typhi
ccaucaacuucucgcaggc

SEQ ID NO: 3653018 - RNA, 15 nt, Salmonella enterica enterica serovar Typhi
ccaucaaucaccuua

SEQ ID NO: 3653019 - RNA, 16 nt, Salmonella enterica enterica serovar Typhi
ccaucaauccaacgaa

SEQ ID NO: 3653020 - RNA, 21 nt, Salmonella enterica enterica serovar Typhi
ccaucaauccaacgaaacuca

SEQ ID NO: 3653021 - RNA, 15 nt, Salmonella enterica enterica serovar Typhi
ccaucaccgccaguc

SEQ ID NO: 3653022 - RNA, 14 nt, Salmonella enterica enterica serovar Typhi
ccaucaccucuucg

SEQ ID NO: 3653023 - RNA, 18 nt, Salmonella enterica enterica serovar Typhi
ccaucacgaucgcgguuc

SEQ ID NO: 3653024 - RNA, 22 nt, Salmonella enterica enterica serovar Typhi
ccaucacguuggggaauaaaua

SEQ ID NO: 3653025 - RNA, 23 nt, Salmonella enterica enterica serovar Typhi
ccaucacguuggggaauaaauau

SEQ ID NO: 3653026 - RNA, 15 nt, Salmonella enterica enterica serovar Typhi
ccaucagauucaaca

SEQ ID NO: 3653027 - RNA, 13 nt, Salmonella enterica enterica serovar Typhi
ccaucagcaaaau

SEQ ID NO: 3653028 - RNA, 21 nt, Salmonella enterica enterica serovar Typhi
ccaucagcaaaauaccggcag

SEQ ID NO: 3653029 - RNA, 13 nt, Salmonella enterica enterica serovar Typhi
ccaucagcaccuu

SEQ ID NO: 3653030 - RNA, 19 nt, Salmonella enterica enterica serovar Typhi
ccaucagcaucccaccgga

SEQ ID NO: 3653031 - RNA, 19 nt, Salmonella enterica enterica serovar Typhi
ccaucagcccgcaaaggac

SEQ ID NO: 3653032 - RNA, 17 nt, Salmonella enterica enterica serovar Typhi
ccaucagcgccagcccu

SEQ ID NO: 3653033 - RNA, 20 nt, Salmonella enterica enterica serovar Typhi
ccaucagcgccagcccugcg

SEQ ID NO: 3653034 - RNA, 21 nt, Salmonella enterica enterica serovar Typhi
ccaucagcgcgggauaacgca

SEQ ID NO: 3653035 - RNA, 16 nt, Salmonella enterica enterica serovar Typhi
ccaucaggcaauaugu

SEQ ID NO: 3653036 - RNA, 22 nt, Salmonella enterica enterica serovar Typhi
ccaucaggcaaucuuuaacgcu

SEQ ID NO: 3653037 - RNA, 17 nt, Salmonella enterica enterica serovar Typhi
ccaucaggcaauucugg

SEQ ID NO: 3653038 - RNA, 22 nt, Salmonella enterica enterica serovar Typhi
ccaucaggcaucugaaaugcuc

SEQ ID NO: 3653039 - RNA, 13 nt, Salmonella enterica enterica serovar Typhi
ccaucaggcaugc

SEQ ID NO: 3653040 - RNA, 13 nt, Salmonella enterica enterica serovar Typhi
ccaucagggaaaa

SEQ ID NO: 3653041 - RNA, 15 nt, Salmonella enterica enterica serovar Typhi
ccaucagggaaaaau

SEQ ID NO: 3653042 - RNA, 23 nt, Salmonella enterica enterica serovar Typhi
ccaucaucaucggcacagccagu

SEQ ID NO: 3653043 - RNA, 22 nt, Salmonella enterica enterica serovar Typhi
ccaucaugcaagagucccagaa

SEQ ID NO: 3653044 - RNA, 17 nt, Salmonella enterica enterica serovar Typhi
ccaucaugcccacaggc

SEQ ID NO: 3653045 - RNA, 22 nt, Salmonella enterica enterica serovar Typhi
ccaucauggcuuucagauuagc

SEQ ID NO: 3653046 - RNA, 13 nt, Salmonella enterica enterica serovar Typhi
ccaucauuaauau

SEQ ID NO: 3653047 - RNA, 15 nt, Salmonella enterica enterica serovar Typhi
ccaucauuaauauaa

SEQ ID NO: 3653048 - RNA, 13 nt, Salmonella enterica enterica serovar Typhi
ccaucauuaccaa

SEQ ID NO: 3653049 - RNA, 15 nt, Salmonella enterica enterica serovar Typhi
ccaucauucaacgca

SEQ ID NO: 3653050 - RNA, 20 nt, Salmonella enterica enterica serovar Typhi
ccaucauugacuucaacgca

SEQ ID NO: 3653051 - RNA, 16 nt, Salmonella enterica enterica serovar Typhi
ccaucauuuccggcgg

SEQ ID NO: 3653052 - RNA, 13 nt, Salmonella enterica enterica serovar Typhi
ccauccaccagaa

SEQ ID NO: 3653053 - RNA, 16 nt, Salmonella enterica enterica serovar Typhi
ccauccaccagaaccu

SEQ ID NO: 3653054 - RNA, 17 nt, Salmonella enterica enterica serovar Typhi
ccauccaccaggcaugc

SEQ ID NO: 3653055 - RNA, 19 nt, Salmonella enterica enterica serovar Typhi
ccauccaccaggcaugcag

SEQ ID NO: 3653056 - RNA, 21 nt, Salmonella enterica enterica serovar Typhi
ccauccauauugagcgguagc

SEQ ID NO: 3653057 - RNA, 17 nt, Salmonella enterica enterica serovar Typhi
ccaucccagguuauuca

SEQ ID NO: 3653058 - RNA, 21 nt, Salmonella enterica enterica serovar Typhi
ccaucccagguuauucaggug

SEQ ID NO: 3653059 - RNA, 22 nt, Salmonella enterica enterica serovar Typhi
ccaucccagguuauucaggugg

SEQ ID NO: 3653060 - RNA, 14 nt, Salmonella enterica enterica serovar Typhi
ccaucccccugccg

SEQ ID NO: 3653061 - RNA, 15 nt, Salmonella enterica enterica serovar Typhi
ccaucccccugccgu

SEQ ID NO: 3653062 - RNA, 23 nt, Salmonella enterica enterica serovar Typhi
ccauccgacgccuuuaccacccg

SEQ ID NO: 3653063 - RNA, 16 nt, Salmonella enterica enterica serovar Typhi
ccauccggcaaacuca

SEQ ID NO: 3653064 - RNA, 19 nt, Salmonella enterica enterica serovar Typhi
ccauccggcaaacucagcg

SEQ ID NO: 3653065 - RNA, 11 nt, Salmonella enterica enterica serovar Typhi
ccauccggcac

SEQ ID NO: 3653066 - RNA, 20 nt, Salmonella enterica enterica serovar Typhi
ccauccggcacacagaauua

SEQ ID NO: 3653067 - RNA, 17 nt, Salmonella enterica enterica serovar Typhi
ccauccggcacaguauu

SEQ ID NO: 3653068 - RNA, 22 nt, Salmonella enterica enterica serovar Typhi
ccauccggcacggucaaucauc

SEQ ID NO: 3653069 - RNA, 11 nt, Salmonella enterica enterica serovar Typhi
ccauccggcag

SEQ ID NO: 3653070 - RNA, 15 nt, Salmonella enterica enterica serovar Typhi
ccauccggcaucucu

SEQ ID NO: 3653071 - RNA, 19 nt, Salmonella enterica enterica serovar Typhi
ccauccggcauuuuucuca

SEQ ID NO: 3653072 - RNA, 16 nt, Salmonella enterica enterica serovar Typhi
ccaucgacgaaauggu

SEQ ID NO: 3653073 - RNA, 16 nt, Salmonella enterica enterica serovar Typhi
ccaucgauagcagcgc

SEQ ID NO: 3653074 - RNA, 18 nt, Salmonella enterica enterica serovar Typhi
ccaucgccagauaaauag

SEQ ID NO: 3653075 - RNA, 21 nt, Salmonella enterica enterica serovar Typhi
ccaucgccauuacgccgacgu

SEQ ID NO: 3653076 - RNA, 21 nt, Salmonella enterica enterica serovar Typhi
ccaucgccugaugaccgccgu

SEQ ID NO: 3653077 - RNA, 23 nt, Salmonella enterica enterica serovar Typhi
ccaucgcgaauuucaaucgccag

SEQ ID NO: 3653078 - RNA, 18 nt, Salmonella enterica enterica serovar Typhi
ccaucgcgccaucggcuu

SEQ ID NO: 3653079 - RNA, 13 nt, Salmonella enterica enterica serovar Typhi
ccaucgcggcgca

SEQ ID NO: 3653080 - RNA, 20 nt, Salmonella enterica enterica serovar Typhi
ccauugcuaggaacagugac

SEQ ID NO: 3653081 - RNA, 14 nt, Salmonella enterica enterica serovar Typhi
ccauuggccagaua

SEQ ID NO: 3653082 - RNA, 21 nt, Salmonella enterica enterica serovar Typhi
ccauuggcuauuuuuugcugg

SEQ ID NO: 3653083 - RNA, 21 nt, Salmonella enterica enterica serovar Typhi
ccauugggggguuagugcugu

SEQ ID NO: 3653084 - RNA, 23 nt, Salmonella enterica enterica serovar Typhi
ccauuguugucauuguaaaaccg

SEQ ID NO: 3653085 - RNA, 22 nt, Salmonella enterica enterica serovar Typhi
ccauuuauguuugcccagcuca

SEQ ID NO: 3653086 - RNA, 15 nt, Salmonella enterica enterica serovar Typhi
ccauuucaugaccga

SEQ ID NO: 3653087 - RNA, 18 nt, Salmonella enterica enterica serovar Typhi
ccauuucuucuucaagcc

SEQ ID NO: 3653088 - RNA, 15 nt, Salmonella enterica enterica serovar Typhi
ccauuugcauccgua

SEQ ID NO: 3653089 - RNA, 17 nt, Salmonella enterica enterica serovar Typhi
ccauuugccagauagcg

SEQ ID NO: 3653090 - RNA, 14 nt, Salmonella enterica enterica serovar Typhi
ccauuuuaaauaca

SEQ ID NO: 3653091 - RNA, 15 nt, Salmonella enterica enterica serovar Typhi
ccauuuuaaauacac

SEQ ID NO: 3653092 - RNA, 23 nt, Salmonella enterica enterica serovar Typhi
ccauuuuagggccgggcagugcu

SEQ ID NO: 3653093 - RNA, 23 nt, Salmonella enterica enterica serovar Typhi
ccauuuuccuauggacauuggcc

SEQ ID NO: 3653094 - RNA, 23 nt, Salmonella enterica enterica serovar Typhi
ccauuuuggacuugggcagugcu

SEQ ID NO: 3653095 - RNA, 23 nt, Salmonella enterica enterica serovar Typhi
ccauuuuggggaaaauaccggua

SEQ ID NO: 3653096 - RNA, 18 nt, Salmonella enterica enterica serovar Typhi
ccauuuugguuacuauuu

SEQ ID NO: 3653097 - RNA, 11 nt, Salmonella enterica enterica serovar Typhi
ccauuuuucag

SEQ ID NO: 3653098 - RNA, 21 nt, Salmonella enterica enterica serovar Typhi
ccauuuuuuuagcuuaaaaaa

SEQ ID NO: 3653099 - RNA, 22 nt, Salmonella enterica enterica serovar Typhi
ccauuuuuuuguccgucauuua

SEQ ID NO: 3653100 - RNA, 12 nt, Salmonella enterica enterica serovar Typhi
cccaaaagguag

SEQ ID NO: 3653101 - RNA, 21 nt, Salmonella enterica enterica serovar Typhi
cccaaacugcucguaaagcau

SEQ ID NO: 3653102 - RNA, 18 nt, Salmonella enterica enterica serovar Typhi
cccaaauaaaagccgccg

SEQ ID NO: 3653103 - RNA, 20 nt, Salmonella enterica enterica serovar Typhi
cccaaaugaaaaaucggcaa

SEQ ID NO: 3653104 - RNA, 20 nt, Salmonella enterica enterica serovar Typhi
cccaaauuaauuuauugacg

SEQ ID NO: 3653105 - RNA, 19 nt, Salmonella enterica enterica serovar Typhi
cccaacagcgaccacgcca

SEQ ID NO: 3653106 - RNA, 14 nt, Salmonella enterica enterica serovar Typhi
cccaaccagcccag

SEQ ID NO: 3653107 - RNA, 12 nt, Salmonella enterica enterica serovar Typhi
cccaaccagugg

SEQ ID NO: 3653108 - RNA, 21 nt, Salmonella enterica enterica serovar Typhi
cccaaccaguggcggggcaga

SEQ ID NO: 3653109 - RNA, 13 nt, Salmonella enterica enterica serovar Typhi
cccaaccgccagc

SEQ ID NO: 3653110 - RNA, 23 nt, Salmonella enterica enterica serovar Typhi
cccaaccgccagccauugaugca

SEQ ID NO: 3653111 - RNA, 20 nt, Salmonella enterica enterica serovar Typhi
cccaacgacagcacuacgcu

SEQ ID NO: 3653112 - RNA, 15 nt, Salmonella enterica enterica serovar Typhi
cccaacgaccauaaa

SEQ ID NO: 3653113 - RNA, 20 nt, Salmonella enterica enterica serovar Typhi
cccaacggaugcgccauccc

SEQ ID NO: 3653114 - RNA, 22 nt, Salmonella enterica enterica serovar Typhi
cccaacggaugcgccaucccau

SEQ ID NO: 3653115 - RNA, 15 nt, Salmonella enterica enterica serovar Typhi
cccaacuacacucuu

SEQ ID NO: 3653116 - RNA, 11 nt, Salmonella enterica enterica serovar Typhi
cccaauaauga

SEQ ID NO: 3653117 - RNA, 15 nt, Salmonella enterica enterica serovar Typhi
cccaauaccacaacc

SEQ ID NO: 3653118 - RNA, 13 nt, Salmonella enterica enterica serovar Typhi
cccaauaccggcg

SEQ ID NO: 3653119 - RNA, 22 nt, Salmonella enterica enterica serovar Typhi
cccaaucuugcguaccacguua

SEQ ID NO: 3653120 - RNA, 20 nt, Salmonella enterica enterica serovar Typhi
cccaauguuuuaccggcagc

SEQ ID NO: 3653121 - RNA, 15 nt, Salmonella enterica enterica serovar Typhi
cccacaaccgacgca

SEQ ID NO: 3653122 - RNA, 18 nt, Salmonella enterica enterica serovar Typhi
cccacaacgcgccaaccg

SEQ ID NO: 3653123 - RNA, 17 nt, Salmonella enterica enterica serovar Typhi
cccacaaucccgccaga

SEQ ID NO: 3653124 - RNA, 19 nt, Salmonella enterica enterica serovar Typhi
cccacagcuugccguagcg

SEQ ID NO: 3653125 - RNA, 21 nt, Salmonella enterica enterica serovar Typhi
cccacaguaauggacagguaa

SEQ ID NO: 3653126 - RNA, 15 nt, Salmonella enterica enterica serovar Typhi
cccacauguuggcau

SEQ ID NO: 3653127 - RNA, 16 nt, Salmonella enterica enterica serovar Typhi
cccacauuacgcccau

SEQ ID NO: 3653128 - RNA, 14 nt, Salmonella enterica enterica serovar Typhi
cccacauuggcccc

SEQ ID NO: 3653129 - RNA, 15 nt, Salmonella enterica enterica serovar Typhi
cccaccacgcagcca

SEQ ID NO: 3653130 - RNA, 15 nt, Salmonella enterica enterica serovar Typhi
cccaccagcgccagg

SEQ ID NO: 3653131 - RNA, 16 nt, Salmonella enterica enterica serovar Typhi
cccaccauaggccagc

SEQ ID NO: 3653132 - RNA, 15 nt, Salmonella enterica enterica serovar Typhi
cccaccaucacuucc

SEQ ID NO: 3653133 - RNA, 16 nt, Salmonella enterica enterica serovar Typhi
cccaccaucacuucca

SEQ ID NO: 3653134 - RNA, 20 nt, Salmonella enterica enterica serovar Typhi
cccaccgcuggauauguuuu

SEQ ID NO: 3653135 - RNA, 15 nt, Salmonella enterica enterica serovar Typhi
cccaccggcccacgc

SEQ ID NO: 3653136 - RNA, 15 nt, Salmonella enterica enterica serovar Typhi
cccaccgggccaccg

SEQ ID NO: 3653137 - RNA, 18 nt, Salmonella enterica enterica serovar Typhi
cccaccuuuugcagcgcg

SEQ ID NO: 3653138 - RNA, 19 nt, Salmonella enterica enterica serovar Typhi
cccacgacgcgguacccac

SEQ ID NO: 3653139 - RNA, 18 nt, Salmonella enterica enterica serovar Typhi
cccacgauguaugccgac

SEQ ID NO: 3653140 - RNA, 17 nt, Salmonella enterica enterica serovar Typhi
cccacgcauaguccugc

SEQ ID NO: 3653141 - RNA, 14 nt, Salmonella enterica enterica serovar Typhi
cccacgccagcagc

SEQ ID NO: 3653142 - RNA, 23 nt, Salmonella enterica enterica serovar Typhi
cccacgccagcagcucgccgacc

SEQ ID NO: 3653143 - RNA, 12 nt, Salmonella enterica enterica serovar Typhi
cccacgccaucg

SEQ ID NO: 3653144 - RNA, 19 nt, Salmonella enterica enterica serovar Typhi
cccacgcccgccaucgccg

SEQ ID NO: 3653145 - RNA, 15 nt, Salmonella enterica enterica serovar Typhi
cccacgcgccacguc

SEQ ID NO: 3653146 - RNA, 21 nt, Salmonella enterica enterica serovar Typhi
cccacgcggaaucgucacaga

SEQ ID NO: 3653147 - RNA, 15 nt, Salmonella enterica enterica serovar Typhi
cccacgcuuuuuuau

SEQ ID NO: 3653148 - RNA, 15 nt, Salmonella enterica enterica serovar Typhi
cccacuauuuuucau

SEQ ID NO: 3653149 - RNA, 19 nt, Salmonella enterica enterica serovar Typhi
cccacucauccagcaaaau

SEQ ID NO: 3653150 - RNA, 21 nt, Salmonella enterica enterica serovar Typhi
cccacuccggcgugaacgccu

SEQ ID NO: 3653151 - RNA, 15 nt, Salmonella enterica enterica serovar Typhi
cccacugauaaaauu

SEQ ID NO: 3653152 - RNA, 13 nt, Salmonella enterica enterica serovar Typhi
cccacuguucaau

SEQ ID NO: 3653153 - RNA, 20 nt, Salmonella enterica enterica serovar Typhi
cccacuuauggucguauuuu

SEQ ID NO: 3653154 - RNA, 12 nt, Salmonella enterica enterica serovar Typhi
cccacuucgccg

SEQ ID NO: 3653155 - RNA, 19 nt, Salmonella enterica enterica serovar Typhi
cccagaaagaucagcagaa

SEQ ID NO: 3653156 - RNA, 23 nt, Salmonella enterica enterica serovar Typhi
cccagaacggcagcguccgccau

SEQ ID NO: 3653157 - RNA, 14 nt, Salmonella enterica enterica serovar Typhi
cccagaaucacccc

SEQ ID NO: 3653158 - RNA, 18 nt, Salmonella enterica enterica serovar Typhi
cccagauaacgcaucaga

SEQ ID NO: 3653159 - RNA, 23 nt, Salmonella enterica enterica serovar Typhi
cccagauaucaggauugaugguc

SEQ ID NO: 3653160 - RNA, 20 nt, Salmonella enterica enterica serovar Typhi
cccagauaucagucugcaag

SEQ ID NO: 3653161 - RNA, 19 nt, Salmonella enterica enterica serovar Typhi
cccagauauccgcgcucaa

SEQ ID NO: 3653162 - RNA, 13 nt, Salmonella enterica enterica serovar Typhi
cccagaucaggcc

SEQ ID NO: 3653163 - RNA, 12 nt, Salmonella enterica enterica serovar Typhi
cccagaucgccc

SEQ ID NO: 3653164 - RNA, 20 nt, Salmonella enterica enterica serovar Typhi
cccagauguugauacagaaa

SEQ ID NO: 3653165 - RNA, 18 nt, Salmonella enterica enterica serovar Typhi
cccauggaugcgccgccc

SEQ ID NO: 3653166 - RNA, 15 nt, Salmonella enterica enterica serovar Typhi
cccauggccccaugu

SEQ ID NO: 3653167 - RNA, 22 nt, Salmonella enterica enterica serovar Typhi
cccauguucaugaaccacgcca

SEQ ID NO: 3653168 - RNA, 20 nt, Salmonella enterica enterica serovar Typhi
cccauguugagcgcuugcug

SEQ ID NO: 3653169 - RNA, 14 nt, Salmonella enterica enterica serovar Typhi
cccauguugcgccg

SEQ ID NO: 3653170 - RNA, 15 nt, Salmonella enterica enterica serovar Typhi
cccauuaauaucagc

SEQ ID NO: 3653171 - RNA, 13 nt, Salmonella enterica enterica serovar Typhi
cccauuauugauc

SEQ ID NO: 3653172 - RNA, 13 nt, Salmonella enterica enterica serovar Typhi
cccauucugcuga

SEQ ID NO: 3653173 - RNA, 15 nt, Salmonella enterica enterica serovar Typhi
cccauucugcugaug

SEQ ID NO: 3653174 - RNA, 19 nt, Salmonella enterica enterica serovar Typhi
cccauugaaaucgccucau

SEQ ID NO: 3653175 - RNA, 21 nt, Salmonella enterica enterica serovar Typhi
cccauugucaucaguaugagc

SEQ ID NO: 3653176 - RNA, 22 nt, Salmonella enterica enterica serovar Typhi
cccauuuaacagauaauuaaua

SEQ ID NO: 3653177 - RNA, 22 nt, Salmonella enterica enterica serovar Typhi
cccauuugcggguggugugcgu

SEQ ID NO: 3653178 - RNA, 13 nt, Salmonella enterica enterica serovar Typhi
cccauuuuauccu

SEQ ID NO: 3653179 - RNA, 19 nt, Salmonella enterica enterica serovar Typhi
cccauuuuauccucuucaa

SEQ ID NO: 3653180 - RNA, 13 nt, Salmonella enterica enterica serovar Typhi
cccauuuuccgcu

SEQ ID NO: 3653181 - RNA, 19 nt, Salmonella enterica enterica serovar Typhi
cccauuuucggcaucagca

SEQ ID NO: 3653182 - RNA, 14 nt, Salmonella enterica enterica serovar Typhi
ccccaaacugcucg

SEQ ID NO: 3653183 - RNA, 19 nt, Salmonella enterica enterica serovar Typhi
ccccacaaucccgccagac

SEQ ID NO: 3653184 - RNA, 19 nt, Salmonella enterica enterica serovar Typhi
ccccacacggccaccauau

SEQ ID NO: 3653185 - RNA, 12 nt, Salmonella enterica enterica serovar Typhi
ccccaccaggaa

SEQ ID NO: 3653186 - RNA, 13 nt, Salmonella enterica enterica serovar Typhi
ccccaccgccaga

SEQ ID NO: 3653187 - RNA, 23 nt, Salmonella enterica enterica serovar Typhi
ccccacgauacgccccugcuggc

SEQ ID NO: 3653188 - RNA, 13 nt, Salmonella enterica enterica serovar Typhi
ccccacgcccgcc

SEQ ID NO: 3653189 - RNA, 19 nt, Salmonella enterica enterica serovar Typhi
ccccagaaucccgccuugc

SEQ ID NO: 3653190 - RNA, 18 nt, Salmonella enterica enterica serovar Typhi
ccccagcacgacagagau

SEQ ID NO: 3653191 - RNA, 11 nt, Salmonella enterica enterica serovar Typhi
ccccagcgcca

SEQ ID NO: 3653192 - RNA, 21 nt, Salmonella enterica enterica serovar Typhi
ccccagcgcuccaccaaccag

SEQ ID NO: 3653193 - RNA, 17 nt, Salmonella enterica enterica serovar Typhi
ccccagcguaccacgcc

SEQ ID NO: 3653194 - RNA, 13 nt, Salmonella enterica enterica serovar Typhi
ccccagcugcggc

SEQ ID NO: 3653195 - RNA, 14 nt, Salmonella enterica enterica serovar Typhi
ccccauaaauaauc

SEQ ID NO: 3653196 - RNA, 12 nt, Salmonella enterica enterica serovar Typhi
ccccauacgcgc

SEQ ID NO: 3653197 - RNA, 19 nt, Salmonella enterica enterica serovar Typhi
ccccauauugaucgggauu

SEQ ID NO: 3653198 - RNA, 18 nt, Salmonella enterica enterica serovar Typhi
ccccaucaugcgccaggu

SEQ ID NO: 3653199 - RNA, 16 nt, Salmonella enterica enterica serovar Typhi
ccccaucccagaccau

SEQ ID NO: 3653200 - RNA, 13 nt, Salmonella enterica enterica serovar Typhi
ccccaucuccaga

SEQ ID NO: 3653201 - RNA, 14 nt, Salmonella enterica enterica serovar Typhi
ccccauuaaacugg

SEQ ID NO: 3653202 - RNA, 14 nt, Salmonella enterica enterica serovar Typhi
ccccauucugcuga

SEQ ID NO: 3653203 - RNA, 18 nt, Salmonella enterica enterica serovar Typhi
cccccaacgucaccauca

SEQ ID NO: 3653204 - RNA, 15 nt, Salmonella enterica enterica serovar Typhi
cccccaccucaauca

SEQ ID NO: 3653205 - RNA, 20 nt, Salmonella enterica enterica serovar Typhi
cccccagaaugccgcccauc

SEQ ID NO: 3653206 - RNA, 21 nt, Salmonella enterica enterica serovar Typhi
cccccgcacagcacauagaag

SEQ ID NO: 3653207 - RNA, 19 nt, Salmonella enterica enterica serovar Typhi
cccccgguagccacaccca

SEQ ID NO: 3653208 - RNA, 15 nt, Salmonella enterica enterica serovar Typhi
cccccuaucuggaug

SEQ ID NO: 3653209 - RNA, 17 nt, Salmonella enterica enterica serovar Typhi
cccccuccauacccuau

SEQ ID NO: 3653210 - RNA, 13 nt, Salmonella enterica enterica serovar Typhi
cccccucggcagc

SEQ ID NO: 3653211 - RNA, 15 nt, Salmonella enterica enterica serovar Typhi
cccccugccagcgcu

SEQ ID NO: 3653212 - RNA, 15 nt, Salmonella enterica enterica serovar Typhi
cccccuuugacaacc

SEQ ID NO: 3653213 - RNA, 17 nt, Salmonella enterica enterica serovar Typhi
ccccgauaaaccaggca

SEQ ID NO: 3653214 - RNA, 18 nt, Salmonella enterica enterica serovar Typhi
ccccgauaaaccaggcag

SEQ ID NO: 3653215 - RNA, 17 nt, Salmonella enterica enterica serovar Typhi
ccccgcaucgcccgcuc

SEQ ID NO: 3653216 - RNA, 15 nt, Salmonella enterica enterica serovar Typhi
ccccgccaccgccgc

SEQ ID NO: 3653217 - RNA, 16 nt, Salmonella enterica enterica serovar Typhi
ccccgccaccgccgcu

SEQ ID NO: 3653218 - RNA, 24 nt, Salmonella enterica enterica serovar Typhi
ccccgccauaaugcacaauacgcc

SEQ ID NO: 3653219 - RNA, 18 nt, Salmonella enterica enterica serovar Typhi
ccccgccaucuucacgca

SEQ ID NO: 3653220 - RNA, 12 nt, Salmonella enterica enterica serovar Typhi
ccccgccccagc

SEQ ID NO: 3653221 - RNA, 12 nt, Salmonella enterica enterica serovar Typhi
ccccgccgccau

SEQ ID NO: 3653222 - RNA, 16 nt, Salmonella enterica enterica serovar Typhi
ccccgccgcugaggau

SEQ ID NO: 3653223 - RNA, 14 nt, Salmonella enterica enterica serovar Typhi
ccccgcuggcgcgg

SEQ ID NO: 3653224 - RNA, 18 nt, Salmonella enterica enterica serovar Typhi
ccccggaucaccggcauu

SEQ ID NO: 3653225 - RNA, 13 nt, Salmonella enterica enterica serovar Typhi
ccccggcaccacg

SEQ ID NO: 3653226 - RNA, 22 nt, Salmonella enterica enterica serovar Typhi
ccccggcagcuuuaaucuacca

SEQ ID NO: 3653227 - RNA, 17 nt, Salmonella enterica enterica serovar Typhi
ccccggccauagcguga

SEQ ID NO: 3653228 - RNA, 15 nt, Salmonella enterica enterica serovar Typhi
ccccggccucgcccg

SEQ ID NO: 3653229 - RNA, 15 nt, Salmonella enterica enterica serovar Typhi
ccccggcgaaagaaa

SEQ ID NO: 3653230 - RNA, 17 nt, Salmonella enterica enterica serovar Typhi
ccccggcgcccggaggg

SEQ ID NO: 3653231 - RNA, 13 nt, Salmonella enterica enterica serovar Typhi
ccccggcuuccag

SEQ ID NO: 3653232 - RNA, 13 nt, Salmonella enterica enterica serovar Typhi
ccccggcuugcgg

SEQ ID NO: 3653233 - RNA, 20 nt, Salmonella enterica enterica serovar Typhi
ccccggcuuuaugaugguga

SEQ ID NO: 3653234 - RNA, 22 nt, Salmonella enterica enterica serovar Typhi
ccccgggcgaccacccgcgacc

SEQ ID NO: 3653235 - RNA, 22 nt, Salmonella enterica enterica serovar Typhi
ccccggucaacgcgccgccaac

SEQ ID NO: 3653236 - RNA, 16 nt, Salmonella enterica enterica serovar Typhi
ccccuaccgaggcagg

SEQ ID NO: 3653237 - RNA, 18 nt, Salmonella enterica enterica serovar Typhi
ccccucggcagcaauacg

SEQ ID NO: 3653238 - RNA, 20 nt, Salmonella enterica enterica serovar Typhi
ccccucggcagcaauacgcc

SEQ ID NO: 3653239 - RNA, 13 nt, Salmonella enterica enterica serovar Typhi
ccccucugauugg

SEQ ID NO: 3653240 - RNA, 21 nt, Salmonella enterica enterica serovar Typhi
ccccugaaauaacagacuccg

SEQ ID NO: 3653241 - RNA, 14 nt, Salmonella enterica enterica serovar Typhi
ccccugacgcgcgc

SEQ ID NO: 3653242 - RNA, 20 nt, Salmonella enterica enterica serovar Typhi
ccccugcccgcgaucgagcg

SEQ ID NO: 3653243 - RNA, 21 nt, Salmonella enterica enterica serovar Typhi
ccccugcuggcgaaccaccag

SEQ ID NO: 3653244 - RNA, 18 nt, Salmonella enterica enterica serovar Typhi
ccccuggccgacggcaua

SEQ ID NO: 3653245 - RNA, 21 nt, Salmonella enterica enterica serovar Typhi
ccccuuacuaagccaguucuc

SEQ ID NO: 3653246 - RNA, 13 nt, Salmonella enterica enterica serovar Typhi
ccccuucgcuguc

SEQ ID NO: 3653247 - RNA, 22 nt, Salmonella enterica enterica serovar Typhi
ccccuucuuuaucuucugcugc

SEQ ID NO: 3653248 - RNA, 20 nt, Salmonella enterica enterica serovar Typhi
ccccuuucgguucgccgcgc

SEQ ID NO: 3653249 - RNA, 19 nt, Salmonella enterica enterica serovar Typhi
ccccuuuucacccaacauu

SEQ ID NO: 3653250 - RNA, 14 nt, Salmonella enterica enterica serovar Typhi
ccccuuuuuugcug

SEQ ID NO: 3653251 - RNA, 23 nt, Salmonella enterica enterica serovar Typhi
cccggcagugcauaaagauuggc

SEQ ID NO: 3653252 - RNA, 15 nt, Salmonella enterica enterica serovar Typhi
cccggcauacgccgg

SEQ ID NO: 3653253 - RNA, 18 nt, Salmonella enterica enterica serovar Typhi
cccggcaucaagcugcug

SEQ ID NO: 3653254 - RNA, 12 nt, Salmonella enterica enterica serovar Typhi
cccggccacagc

SEQ ID NO: 3653255 - RNA, 17 nt, Salmonella enterica enterica serovar Typhi
cccggccacagcgccag

SEQ ID NO: 3653256 - RNA, 14 nt, Salmonella enterica enterica serovar Typhi
cccggcccgccgcu

SEQ ID NO: 3653257 - RNA, 21 nt, Salmonella enterica enterica serovar Typhi
cccggccguuaccguggcggc

SEQ ID NO: 3653258 - RNA, 15 nt, Salmonella enterica enterica serovar Typhi
cccggcgaccgguga

SEQ ID NO: 3653259 - RNA, 15 nt, Salmonella enterica enterica serovar Typhi
cccggcgagugccug

SEQ ID NO: 3653260 - RNA, 22 nt, Salmonella enterica enterica serovar Typhi
cccggcgcacuuccucucccac

SEQ ID NO: 3653261 - RNA, 21 nt, Salmonella enterica enterica serovar Typhi
cccggcgccaaucaccgccag

SEQ ID NO: 3653262 - RNA, 21 nt, Salmonella enterica enterica serovar Typhi
cccggcgcgcacgcgggccaa

SEQ ID NO: 3653263 - RNA, 21 nt, Salmonella enterica enterica serovar Typhi
cccggcggcgcgaugccugcc

SEQ ID NO: 3653264 - RNA, 21 nt, Salmonella enterica enterica serovar Typhi
cccggcggguauggcaaugcc

SEQ ID NO: 3653265 - RNA, 22 nt, Salmonella enterica enterica serovar Typhi
cccggcugccauuaucaccauu

SEQ ID NO: 3653266 - RNA, 17 nt, Salmonella enterica enterica serovar Typhi
cccggcuuaaauuuuua

SEQ ID NO: 3653267 - RNA, 21 nt, Salmonella enterica enterica serovar Typhi
cccggcuuaccggcuaucagc

SEQ ID NO: 3653268 - RNA, 15 nt, Salmonella enterica enterica serovar Typhi
cccggcuuccagcgg

SEQ ID NO: 3653269 - RNA, 19 nt, Salmonella enterica enterica serovar Typhi
cccggcuuuaugaugguga

SEQ ID NO: 3653270 - RNA, 20 nt, Salmonella enterica enterica serovar Typhi
cccggcuuuauuacuucuuc

SEQ ID NO: 3653271 - RNA, 20 nt, Salmonella enterica enterica serovar Typhi
cccggcuuuuugccgggcgu

SEQ ID NO: 3653272 - RNA, 24 nt, Salmonella enterica enterica serovar Typhi
cccggcuuuuuuauugccuaagau

SEQ ID NO: 3653273 - RNA, 20 nt, Salmonella enterica enterica serovar Typhi
cccgggagaacgccgggccu

SEQ ID NO: 3653274 - RNA, 17 nt, Salmonella enterica enterica serovar Typhi
cccggguaaugcugcag

SEQ ID NO: 3653275 - RNA, 15 nt, Salmonella enterica enterica serovar Typhi
cccgguaaacgucga

SEQ ID NO: 3653276 - RNA, 16 nt, Salmonella enterica enterica serovar Typhi
cccgguaagaaugcgc

SEQ ID NO: 3653277 - RNA, 20 nt, Salmonella enterica enterica serovar Typhi
cccgguaagcgcagcgccac

SEQ ID NO: 3653278 - RNA, 18 nt, Salmonella enterica enterica serovar Typhi
cccgguacacuucagcca

SEQ ID NO: 3653279 - RNA, 17 nt, Salmonella enterica enterica serovar Typhi
cccgguagccacaccca

SEQ ID NO: 3653280 - RNA, 18 nt, Salmonella enterica enterica serovar Typhi
cccggucaacgcgccgcc

SEQ ID NO: 3653281 - RNA, 19 nt, Salmonella enterica enterica serovar Typhi
cccggucaacgcgccgcca

SEQ ID NO: 3653282 - RNA, 23 nt, Salmonella enterica enterica serovar Typhi
cccggucaagcgcaaucacguua

SEQ ID NO: 3653283 - RNA, 16 nt, Salmonella enterica enterica serovar Typhi
cccggugagcgccgcg

SEQ ID NO: 3653284 - RNA, 18 nt, Salmonella enterica enterica serovar Typhi
cccgguggcgccacgcca

SEQ ID NO: 3653285 - RNA, 21 nt, Salmonella enterica enterica serovar Typhi
cccgguggcgccacgccaccg

SEQ ID NO: 3653286 - RNA, 11 nt, Salmonella enterica enterica serovar Typhi
cccggugggca

SEQ ID NO: 3653287 - RNA, 23 nt, Salmonella enterica enterica serovar Typhi
cccgguuuaugcgguucucccgg

SEQ ID NO: 3653288 - RNA, 23 nt, Salmonella enterica enterica serovar Typhi
cccgguuugggcgcgaaacugcu

SEQ ID NO: 3653289 - RNA, 23 nt, Salmonella enterica enterica serovar Typhi
cccguagauaagcgccacgucgg

SEQ ID NO: 3653290 - RNA, 15 nt, Salmonella enterica enterica serovar Typhi
cccguagugauagca

SEQ ID NO: 3653291 - RNA, 13 nt, Salmonella enterica enterica serovar Typhi
cccgucacagcgg

SEQ ID NO: 3653292 - RNA, 20 nt, Salmonella enterica enterica serovar Typhi
cccgucaccagaauaaugcc

SEQ ID NO: 3653293 - RNA, 21 nt, Salmonella enterica enterica serovar Typhi
cccgucaucuucuaccuggaa

SEQ ID NO: 3653294 - RNA, 16 nt, Salmonella enterica enterica serovar Typhi
cccgucgccuguuucu

SEQ ID NO: 3653295 - RNA, 20 nt, Salmonella enterica enterica serovar Typhi
cccgucgccuguuucugcgc

SEQ ID NO: 3653296 - RNA, 21 nt, Salmonella enterica enterica serovar Typhi
cccgucgccuguuucugcgcc

SEQ ID NO: 3653297 - RNA, 17 nt, Salmonella enterica enterica serovar Typhi
cccgucgcgaucacaga

SEQ ID NO: 3653298 - RNA, 18 nt, Salmonella enterica enterica serovar Typhi
cccgucgcgcccacgcgc

SEQ ID NO: 3653299 - RNA, 14 nt, Salmonella enterica enterica serovar Typhi
cccgucucuuuauc

SEQ ID NO: 3653300 - RNA, 22 nt, Salmonella enterica enterica serovar Typhi
cccgucugggagccgcugcuca

SEQ ID NO: 3653301 - RNA, 19 nt, Salmonella enterica enterica serovar Typhi
cccgugcgcgucgccugaa

SEQ ID NO: 3653302 - RNA, 18 nt, Salmonella enterica enterica serovar Typhi
cccguggcgggaugcccc

SEQ ID NO: 3653303 - RNA, 23 nt, Salmonella enterica enterica serovar Typhi
cccguggugggguucccgagcga

SEQ ID NO: 3653304 - RNA, 23 nt, Salmonella enterica enterica serovar Typhi
cccguggugggguucccgagcgg

SEQ ID NO: 3653305 - RNA, 19 nt, Salmonella enterica enterica serovar Typhi
cccgugucggauaucagac

SEQ ID NO: 3653306 - RNA, 14 nt, Salmonella enterica enterica serovar Typhi
cccguuaaauacca

SEQ ID NO: 3653307 - RNA, 12 nt, Salmonella enterica enterica serovar Typhi
cccguuauucau

SEQ ID NO: 3653308 - RNA, 22 nt, Salmonella enterica enterica serovar Typhi
cccguucacguuuuuacucuug

SEQ ID NO: 3653309 - RNA, 15 nt, Salmonella enterica enterica serovar Typhi
cccguucucgccgcg

SEQ ID NO: 3653310 - RNA, 16 nt, Salmonella enterica enterica serovar Typhi
cccguugcgucacgaa

SEQ ID NO: 3653311 - RNA, 21 nt, Salmonella enterica enterica serovar Typhi
cccguugucuucaccuugcug

SEQ ID NO: 3653312 - RNA, 16 nt, Salmonella enterica enterica serovar Typhi
cccguuucagccccuu

SEQ ID NO: 3653313 - RNA, 20 nt, Salmonella enterica enterica serovar Typhi
cccguuucagccccuugcug

SEQ ID NO: 3653314 - RNA, 21 nt, Salmonella enterica enterica serovar Typhi
cccguuugcaguccguccaga

SEQ ID NO: 3653315 - RNA, 19 nt, Salmonella enterica enterica serovar Typhi
cccguuugcgagacggcga

SEQ ID NO: 3653316 - RNA, 16 nt, Salmonella enterica enterica serovar Typhi
cccguuuucgccggau

SEQ ID NO: 3653317 - RNA, 19 nt, Salmonella enterica enterica serovar Typhi
cccuacgcuucucuccaua

SEQ ID NO: 3653318 - RNA, 14 nt, Salmonella enterica enterica serovar Typhi
cccuauuguuccag

SEQ ID NO: 3653319 - RNA, 22 nt, Salmonella enterica enterica serovar Typhi
cccucaaacaggcugucugcca

SEQ ID NO: 3653320 - RNA, 20 nt, Salmonella enterica enterica serovar Typhi
cccucaacgcccugcuccca

SEQ ID NO: 3653321 - RNA, 21 nt, Salmonella enterica enterica serovar Typhi
cccucaacgcccugcucccac

SEQ ID NO: 3653322 - RNA, 22 nt, Salmonella enterica enterica serovar Typhi
cccucaacgcccugcucccaca

SEQ ID NO: 3653323 - RNA, 14 nt, Salmonella enterica enterica serovar Typhi
cccucaacgcgccc

SEQ ID NO: 3653324 - RNA, 17 nt, Salmonella enterica enterica serovar Typhi
cccucaagacgguuauu

SEQ ID NO: 3653325 - RNA, 23 nt, Salmonella enterica enterica serovar Typhi
cccucaaguuauguuauccccac

SEQ ID NO: 3653326 - RNA, 18 nt, Salmonella enterica enterica serovar Typhi
cccucaauaucuuugccu

SEQ ID NO: 3653327 - RNA, 16 nt, Salmonella enterica enterica serovar Typhi
cccucaccucccccgc

SEQ ID NO: 3653328 - RNA, 12 nt, Salmonella enterica enterica serovar Typhi
cccuccagccau

SEQ ID NO: 3653329 - RNA, 15 nt, Salmonella enterica enterica serovar Typhi
cccuccaguagcagc

SEQ ID NO: 3653330 - RNA, 16 nt, Salmonella enterica enterica serovar Typhi
cccuccggccagcgcc

SEQ ID NO: 3653331 - RNA, 17 nt, Salmonella enterica enterica serovar Typhi
cccuccggccagcgcca

SEQ ID NO: 3653332 - RNA, 13 nt, Salmonella enterica enterica serovar Typhi
cccucgccagcaa

SEQ ID NO: 3653333 - RNA, 22 nt, Salmonella enterica enterica serovar Typhi
cccucugaaacgcuucaccggc

SEQ ID NO: 3653334 - RNA, 22 nt, Salmonella enterica enterica serovar Typhi
cccucugauuggcuguuaguaa

SEQ ID NO: 3653335 - RNA, 17 nt, Salmonella enterica enterica serovar Typhi
cccucugcaccagaacu

SEQ ID NO: 3653336 - RNA, 16 nt, Salmonella enterica enterica serovar Typhi
ccgacacauucaggcu

SEQ ID NO: 3653337 - RNA, 21 nt, Salmonella enterica enterica serovar Typhi
ccgacacugaaacuccgcagc

SEQ ID NO: 3653338 - RNA, 16 nt, Salmonella enterica enterica serovar Typhi
ccgacaggguuugcca

SEQ ID NO: 3653339 - RNA, 21 nt, Salmonella enterica enterica serovar Typhi
ccgacauagcugaacaauccc

SEQ ID NO: 3653340 - RNA, 21 nt, Salmonella enterica enterica serovar Typhi
ccgacauaggccagccgacgc

SEQ ID NO: 3653341 - RNA, 18 nt, Salmonella enterica enterica serovar Typhi
ccgacaucgccaccgcau

SEQ ID NO: 3653342 - RNA, 22 nt, Salmonella enterica enterica serovar Typhi
ccgacaugguuaaccaccagcg

SEQ ID NO: 3653343 - RNA, 14 nt, Salmonella enterica enterica serovar Typhi
ccgacauucccagu

SEQ ID NO: 3653344 - RNA, 18 nt, Salmonella enterica enterica serovar Typhi
ccgacauucccugcgcau

SEQ ID NO: 3653345 - RNA, 20 nt, Salmonella enterica enterica serovar Typhi
ccgacauucccugcgcauac

SEQ ID NO: 3653346 - RNA, 18 nt, Salmonella enterica enterica serovar Typhi
ccgaccaauugcaggcag

SEQ ID NO: 3653347 - RNA, 16 nt, Salmonella enterica enterica serovar Typhi
ccgaccaccauccggc

SEQ ID NO: 3653348 - RNA, 19 nt, Salmonella enterica enterica serovar Typhi
ccgaccaucgcgccgcugg

SEQ ID NO: 3653349 - RNA, 15 nt, Salmonella enterica enterica serovar Typhi
ccgaccauuacccac

SEQ ID NO: 3653350 - RNA, 15 nt, Salmonella enterica enterica serovar Typhi
ccgacccaccugacu

SEQ ID NO: 3653351 - RNA, 16 nt, Salmonella enterica enterica serovar Typhi
ccgaccccaugacggc

SEQ ID NO: 3653352 - RNA, 22 nt, Salmonella enterica enterica serovar Typhi
ccgaccccgccgucagacaggc

SEQ ID NO: 3653353 - RNA, 13 nt, Salmonella enterica enterica serovar Typhi
ccgaccgccagca

SEQ ID NO: 3653354 - RNA, 15 nt, Salmonella enterica enterica serovar Typhi
ccgaccgccagcaga

SEQ ID NO: 3653355 - RNA, 14 nt, Salmonella enterica enterica serovar Typhi
ccgaccgccgaugc

SEQ ID NO: 3653356 - RNA, 15 nt, Salmonella enterica enterica serovar Typhi
ccgaccgucagcucc

SEQ ID NO: 3653357 - RNA, 14 nt, Salmonella enterica enterica serovar Typhi
ccgaccgucggcgc

SEQ ID NO: 3653358 - RNA, 15 nt, Salmonella enterica enterica serovar Typhi
ccgaccgucggcgca

SEQ ID NO: 3653359 - RNA, 17 nt, Salmonella enterica enterica serovar Typhi
ccgaccuguaccgcgac

SEQ ID NO: 3653360 - RNA, 17 nt, Salmonella enterica enterica serovar Typhi
ccgacgaaaaagccaaa

SEQ ID NO: 3653361 - RNA, 16 nt, Salmonella enterica enterica serovar Typhi
ccgacgacaagcagaa

SEQ ID NO: 3653362 - RNA, 23 nt, Salmonella enterica enterica serovar Typhi
ccgacgauaaacagauaugaaau

SEQ ID NO: 3653363 - RNA, 14 nt, Salmonella enterica enterica serovar Typhi
ccgacgcacgugua

SEQ ID NO: 3653364 - RNA, 19 nt, Salmonella enterica enterica serovar Typhi
ccgacgcauuucuccugau

SEQ ID NO: 3653365 - RNA, 15 nt, Salmonella enterica enterica serovar Typhi
ccgacgcgaugccag

SEQ ID NO: 3653366 - RNA, 15 nt, Salmonella enterica enterica serovar Typhi
ccgacgcucaaccgg

SEQ ID NO: 3653367 - RNA, 15 nt, Salmonella enterica enterica serovar Typhi
ccgacgcucuuccuc

SEQ ID NO: 3653368 - RNA, 19 nt, Salmonella enterica enterica serovar Typhi
ccgacggcaaaaagcauau

SEQ ID NO: 3653369 - RNA, 18 nt, Salmonella enterica enterica serovar Typhi
ccgacggcauaacggccu

SEQ ID NO: 3653370 - RNA, 13 nt, Salmonella enterica enterica serovar Typhi
ccgacguaguuca

SEQ ID NO: 3653371 - RNA, 14 nt, Salmonella enterica enterica serovar Typhi
ccgacuaauuauuu

SEQ ID NO: 3653372 - RNA, 16 nt, Salmonella enterica enterica serovar Typhi
ccgacuaauuauuuuu

SEQ ID NO: 3653373 - RNA, 17 nt, Salmonella enterica enterica serovar Typhi
ccgacuaauuauuuuuc

SEQ ID NO: 3653374 - RNA, 21 nt, Salmonella enterica enterica serovar Typhi
ccgacuaauuauuuuucaaau

SEQ ID NO: 3653375 - RNA, 14 nt, Salmonella enterica enterica serovar Typhi
ccgacuuuucgccc

SEQ ID NO: 3653376 - RNA, 19 nt, Salmonella enterica enterica serovar Typhi
ccgacuuuuuugccuuuca

SEQ ID NO: 3653377 - RNA, 14 nt, Salmonella enterica enterica serovar Typhi
ccgagaauccacuc

SEQ ID NO: 3653378 - RNA, 16 nt, Salmonella enterica enterica serovar Typhi
ccgagacgcgugacca

SEQ ID NO: 3653379 - RNA, 12 nt, Salmonella enterica enterica serovar Typhi
ccgagcaacaga

SEQ ID NO: 3653380 - RNA, 19 nt, Salmonella enterica enterica serovar Typhi
ccgagcaacagaaaccaua

SEQ ID NO: 3653381 - RNA, 18 nt, Salmonella enterica enterica serovar Typhi
ccgagcagcuuggcggcu

SEQ ID NO: 3653382 - RNA, 23 nt, Salmonella enterica enterica serovar Typhi
ccgagcaggacgcgcgcgaaaag

SEQ ID NO: 3653383 - RNA, 22 nt, Salmonella enterica enterica serovar Typhi
ccgagcauccgcgcaauaugcg

SEQ ID NO: 3653384 - RNA, 11 nt, Salmonella enterica enterica serovar Typhi
ccgagcgcugg

SEQ ID NO: 3653385 - RNA, 17 nt, Salmonella enterica enterica serovar Typhi
ccgagcgguaagagcca

SEQ ID NO: 3653386 - RNA, 12 nt, Salmonella enterica enterica serovar Typhi
ccgaggcgaaac

SEQ ID NO: 3653387 - RNA, 15 nt, Salmonella enterica enterica serovar Typhi
ccgagguucaccagc

SEQ ID NO: 3653388 - RNA, 21 nt, Salmonella enterica enterica serovar Typhi
ccgagguucaccagcgcgccg

SEQ ID NO: 3653389 - RNA, 17 nt, Salmonella enterica enterica serovar Typhi
ccgagguuuucauccac

SEQ ID NO: 3653390 - RNA, 14 nt, Salmonella enterica enterica serovar Typhi
ccgaguagcugagc

SEQ ID NO: 3653391 - RNA, 22 nt, Salmonella enterica enterica serovar Typhi
ccgagugcuuauguaggccuga

SEQ ID NO: 3653392 - RNA, 17 nt, Salmonella enterica enterica serovar Typhi
ccgaguggaaucagcca

SEQ ID NO: 3653393 - RNA, 16 nt, Salmonella enterica enterica serovar Typhi
ccgaguuccggauacu

SEQ ID NO: 3653394 - RNA, 16 nt, Salmonella enterica enterica serovar Typhi
ccgaguuucugguaga

SEQ ID NO: 3653395 - RNA, 13 nt, Salmonella enterica enterica serovar Typhi
ccgauaaaccagg

SEQ ID NO: 3653396 - RNA, 15 nt, Salmonella enterica enterica serovar Typhi
ccgauaacgcggccc

SEQ ID NO: 3653397 - RNA, 18 nt, Salmonella enterica enterica serovar Typhi
ccgauaagcaagcgccau

SEQ ID NO: 3653398 - RNA, 18 nt, Salmonella enterica enterica serovar Typhi
ccgauaauacgcgcgauu

SEQ ID NO: 3653399 - RNA, 15 nt, Salmonella enterica enterica serovar Typhi
ccgauaaucaccagc

SEQ ID NO: 3653400 - RNA, 21 nt, Salmonella enterica enterica serovar Typhi
ccgauacaggacugacugcug

SEQ ID NO: 3653401 - RNA, 22 nt, Salmonella enterica enterica serovar Typhi
ccgauacaggacugacugcugu

SEQ ID NO: 3653402 - RNA, 13 nt, Salmonella enterica enterica serovar Typhi
ccgauaccggcaa

SEQ ID NO: 3653403 - RNA, 22 nt, Salmonella enterica enterica serovar Typhi
ccgauagagacugccgccguca

SEQ ID NO: 3653404 - RNA, 23 nt, Salmonella enterica enterica serovar Typhi
ccgauagcgaaacugauauuaga

SEQ ID NO: 3653405 - RNA, 15 nt, Salmonella enterica enterica serovar Typhi
ccgauagcgccgcgc

SEQ ID NO: 3653406 - RNA, 19 nt, Salmonella enterica enterica serovar Typhi
ccgauagcgccgcgcuauc

SEQ ID NO: 3653407 - RNA, 15 nt, Salmonella enterica enterica serovar Typhi
ccgauagcggcgcag

SEQ ID NO: 3653408 - RNA, 17 nt, Salmonella enterica enterica serovar Typhi
ccgauagcggcgcagac

SEQ ID NO: 3653409 - RNA, 22 nt, Salmonella enterica enterica serovar Typhi
ccgauagcugaagugcggauag

SEQ ID NO: 3653410 - RNA, 21 nt, Salmonella enterica enterica serovar Typhi
ccgauaguguaaacgcgccau

SEQ ID NO: 3653411 - RNA, 22 nt, Salmonella enterica enterica serovar Typhi
ccgaucacggcgaaucgccugu

SEQ ID NO: 3653412 - RNA, 12 nt, Salmonella enterica enterica serovar Typhi
ccgaucagauug

SEQ ID NO: 3653413 - RNA, 13 nt, Salmonella enterica enterica serovar Typhi
ccgaucagauuga

SEQ ID NO: 3653414 - RNA, 23 nt, Salmonella enterica enterica serovar Typhi
ccgaucagcaccacgcccggauc

SEQ ID NO: 3653415 - RNA, 22 nt, Salmonella enterica enterica serovar Typhi
ccgaucuacgcuauuuccagaa

SEQ ID NO: 3653416 - RNA, 21 nt, Salmonella enterica enterica serovar Typhi
ccgaucugguuauccaccagc

SEQ ID NO: 3653417 - RNA, 16 nt, Salmonella enterica enterica serovar Typhi
ccgaugaaaaacugga

SEQ ID NO: 3653418 - RNA, 15 nt, Salmonella enterica enterica serovar Typhi
ccgaugacccgcaau

SEQ ID NO: 3653419 - RNA, 21 nt, Salmonella enterica enterica serovar Typhi
ccgaugagaaguagcccauau

SEQ ID NO: 3653420 - RNA, 11 nt, Salmonella enterica enterica serovar Typhi
ccgaugcacau

SEQ ID NO: 3653421 - RNA, 18 nt, Salmonella enterica enterica serovar Typhi
ccgaugccgacggcgcuu

SEQ ID NO: 3653422 - RNA, 15 nt, Salmonella enterica enterica serovar Typhi
ccgccaauauccggc

SEQ ID NO: 3653423 - RNA, 14 nt, Salmonella enterica enterica serovar Typhi
ccgccaaugaccau

SEQ ID NO: 3653424 - RNA, 13 nt, Salmonella enterica enterica serovar Typhi
ccgccaccacaaa

SEQ ID NO: 3653425 - RNA, 14 nt, Salmonella enterica enterica serovar Typhi
ccgccaccacaaag

SEQ ID NO: 3653426 - RNA, 15 nt, Salmonella enterica enterica serovar Typhi
ccgccaccaccgauc

SEQ ID NO: 3653427 - RNA, 11 nt, Salmonella enterica enterica serovar Typhi
ccgccaccacg

SEQ ID NO: 3653428 - RNA, 15 nt, Salmonella enterica enterica serovar Typhi
ccgccacccggcaaa

SEQ ID NO: 3653429 - RNA, 13 nt, Salmonella enterica enterica serovar Typhi
ccgccaccgccgc

SEQ ID NO: 3653430 - RNA, 15 nt, Salmonella enterica enterica serovar Typhi
ccgccaccgccucgc

SEQ ID NO: 3653431 - RNA, 18 nt, Salmonella enterica enterica serovar Typhi
ccgccaccuuucugcucc

SEQ ID NO: 3653432 - RNA, 19 nt, Salmonella enterica enterica serovar Typhi
ccgccacgccgcuccacag

SEQ ID NO: 3653433 - RNA, 13 nt, Salmonella enterica enterica serovar Typhi
ccgccagacgccc

SEQ ID NO: 3653434 - RNA, 13 nt, Salmonella enterica enterica serovar Typhi
ccgccagacucag

SEQ ID NO: 3653435 - RNA, 17 nt, Salmonella enterica enterica serovar Typhi
ccgccagacucagccag

SEQ ID NO: 3653436 - RNA, 22 nt, Salmonella enterica enterica serovar Typhi
ccgccagacucagccaggucug

SEQ ID NO: 3653437 - RNA, 14 nt, Salmonella enterica enterica serovar Typhi
ccgccagagcacga

SEQ ID NO: 3653438 - RNA, 15 nt, Salmonella enterica enterica serovar Typhi
ccgccagauuaucca

SEQ ID NO: 3653439 - RNA, 20 nt, Salmonella enterica enterica serovar Typhi
ccgccagauuauccaguccc

SEQ ID NO: 3653440 - RNA, 14 nt, Salmonella enterica enterica serovar Typhi
ccgccagcaccagg

SEQ ID NO: 3653441 - RNA, 18 nt, Salmonella enterica enterica serovar Typhi
ccgccagcgacauggcgg

SEQ ID NO: 3653442 - RNA, 10 nt, Salmonella enterica enterica serovar Typhi
ccgccagcgc

SEQ ID NO: 3653443 - RNA, 12 nt, Salmonella enterica enterica serovar Typhi
ccgccagcgcaa

SEQ ID NO: 3653444 - RNA, 13 nt, Salmonella enterica enterica serovar Typhi
ccgccagcgccgc

SEQ ID NO: 3653445 - RNA, 12 nt, Salmonella enterica enterica serovar Typhi
ccgccagcgccu

SEQ ID NO: 3653446 - RNA, 15 nt, Salmonella enterica enterica serovar Typhi
ccgccagcggcgcca

SEQ ID NO: 3653447 - RNA, 19 nt, Salmonella enterica enterica serovar Typhi
ccgccagcgugacccagac

SEQ ID NO: 3653448 - RNA, 18 nt, Salmonella enterica enterica serovar Typhi
ccgccagcuccugcgggc

SEQ ID NO: 3653449 - RNA, 19 nt, Salmonella enterica enterica serovar Typhi
ccgccaggcauguuaugaa

SEQ ID NO: 3653450 - RNA, 21 nt, Salmonella enterica enterica serovar Typhi
ccgccaggucuuuaucuauca

SEQ ID NO: 3653451 - RNA, 18 nt, Salmonella enterica enterica serovar Typhi
ccgccaguucgccggcaa

SEQ ID NO: 3653452 - RNA, 17 nt, Salmonella enterica enterica serovar Typhi
ccgccaguugcucaaca

SEQ ID NO: 3653453 - RNA, 22 nt, Salmonella enterica enterica serovar Typhi
ccgccaguuguucaacauagua

SEQ ID NO: 3653454 - RNA, 21 nt, Salmonella enterica enterica serovar Typhi
ccgccaguuuguaaccaacaa

SEQ ID NO: 3653455 - RNA, 15 nt, Salmonella enterica enterica serovar Typhi
ccgccauaagaaugu

SEQ ID NO: 3653456 - RNA, 19 nt, Salmonella enterica enterica serovar Typhi
ccgccauacccggcuccca

SEQ ID NO: 3653457 - RNA, 20 nt, Salmonella enterica enterica serovar Typhi
ccgccauagaaauagccccg

SEQ ID NO: 3653458 - RNA, 17 nt, Salmonella enterica enterica serovar Typhi
ccgccaucaacgaccau

SEQ ID NO: 3653459 - RNA, 23 nt, Salmonella enterica enterica serovar Typhi
ccgccaucaguaaaggaugccac

SEQ ID NO: 3653460 - RNA, 17 nt, Salmonella enterica enterica serovar Typhi
ccgccauccgacacagc

SEQ ID NO: 3653461 - RNA, 12 nt, Salmonella enterica enterica serovar Typhi
ccgccauccggc

SEQ ID NO: 3653462 - RNA, 14 nt, Salmonella enterica enterica serovar Typhi
ccgccauccggcaa

SEQ ID NO: 3653463 - RNA, 22 nt, Salmonella enterica enterica serovar Typhi
ccgccauccggcaaacucagcg

SEQ ID NO: 3653464 - RNA, 19 nt, Salmonella enterica enterica serovar Typhi
ccgccauccggcacaguau

SEQ ID NO: 3653465 - RNA, 19 nt, Salmonella enterica enterica serovar Typhi
ccgccauccggcauuuuuu

SEQ ID NO: 3653466 - RNA, 14 nt, Salmonella enterica enterica serovar Typhi
ccgccaucgacagc

SEQ ID NO: 3653467 - RNA, 16 nt, Salmonella enterica enterica serovar Typhi
ccgccaucgcugggau

SEQ ID NO: 3653468 - RNA, 11 nt, Salmonella enterica enterica serovar Typhi
ccgccaucgua

SEQ ID NO: 3653469 - RNA, 13 nt, Salmonella enterica enterica serovar Typhi
ccgccaucucacg

SEQ ID NO: 3653470 - RNA, 20 nt, Salmonella enterica enterica serovar Typhi
ccgccaucucacgcauggcg

SEQ ID NO: 3653471 - RNA, 22 nt, Salmonella enterica enterica serovar Typhi
ccgccaucuuuacccugagccu

SEQ ID NO: 3653472 - RNA, 12 nt, Salmonella enterica enterica serovar Typhi
ccgccaugaaaa

SEQ ID NO: 3653473 - RNA, 20 nt, Salmonella enterica enterica serovar Typhi
ccgccaugaaaaaaacgcau

SEQ ID NO: 3653474 - RNA, 20 nt, Salmonella enterica enterica serovar Typhi
ccgccauucgcuuccgccgg

SEQ ID NO: 3653475 - RNA, 18 nt, Salmonella enterica enterica serovar Typhi
ccgccauugccaguaccg

SEQ ID NO: 3653476 - RNA, 20 nt, Salmonella enterica enterica serovar Typhi
ccgccauuuuauccaggcca

SEQ ID NO: 3653477 - RNA, 15 nt, Salmonella enterica enterica serovar Typhi
ccgcccaaccagccc

SEQ ID NO: 3653478 - RNA, 22 nt, Salmonella enterica enterica serovar Typhi
ccgcccagaaagaucagcagaa

SEQ ID NO: 3653479 - RNA, 13 nt, Salmonella enterica enterica serovar Typhi
ccgcccagaacgg

SEQ ID NO: 3653480 - RNA, 17 nt, Salmonella enterica enterica serovar Typhi
ccgcccagagaauauug

SEQ ID NO: 3653481 - RNA, 13 nt, Salmonella enterica enterica serovar Typhi
ccgcccaggccug

SEQ ID NO: 3653482 - RNA, 13 nt, Salmonella enterica enterica serovar Typhi
ccgcccagucacg

SEQ ID NO: 3653483 - RNA, 14 nt, Salmonella enterica enterica serovar Typhi
ccgcccauccaggg

SEQ ID NO: 3653484 - RNA, 16 nt, Salmonella enterica enterica serovar Typhi
ccgccccagcagcagc

SEQ ID NO: 3653485 - RNA, 14 nt, Salmonella enterica enterica serovar Typhi
ccgcccccuccagu

SEQ ID NO: 3653486 - RNA, 13 nt, Salmonella enterica enterica serovar Typhi
ccgccccugugga

SEQ ID NO: 3653487 - RNA, 21 nt, Salmonella enterica enterica serovar Typhi
ccgcccgcggcgaucaccacg

SEQ ID NO: 3653488 - RNA, 13 nt, Salmonella enterica enterica serovar Typhi
ccgcccgcguagc

SEQ ID NO: 3653489 - RNA, 16 nt, Salmonella enterica enterica serovar Typhi
ccgcccggacccgcuu

SEQ ID NO: 3653490 - RNA, 14 nt, Salmonella enterica enterica serovar Typhi
ccgcccggcgcgcu

SEQ ID NO: 3653491 - RNA, 23 nt, Salmonella enterica enterica serovar Typhi
ccgcccguacagacaucaucgaa

SEQ ID NO: 3653492 - RNA, 18 nt, Salmonella enterica enterica serovar Typhi
ccgcccguccgcuaaucu

SEQ ID NO: 3653493 - RNA, 13 nt, Salmonella enterica enterica serovar Typhi
ccgcccugacgcc

SEQ ID NO: 3653494 - RNA, 13 nt, Salmonella enterica enterica serovar Typhi
ccgcccugcccgc

SEQ ID NO: 3653495 - RNA, 23 nt, Salmonella enterica enterica serovar Typhi
ccgcccuucacaaccaucgucug

SEQ ID NO: 3653496 - RNA, 11 nt, Salmonella enterica enterica serovar Typhi
ccgcccuuucg

SEQ ID NO: 3653497 - RNA, 14 nt, Salmonella enterica enterica serovar Typhi
ccgccgacaaccag

SEQ ID NO: 3653498 - RNA, 16 nt, Salmonella enterica enterica serovar Typhi
ccgccgacaccggccu

SEQ ID NO: 3653499 - RNA, 16 nt, Salmonella enterica enterica serovar Typhi
ccgccgacccccuccu

SEQ ID NO: 3653500 - RNA, 20 nt, Salmonella enterica enterica serovar Typhi
ccgccgagcauuuccgcagc

SEQ ID NO: 3653501 - RNA, 20 nt, Salmonella enterica enterica serovar Typhi
ccgccgaggcuaagccagaa

SEQ ID NO: 3653502 - RNA, 13 nt, Salmonella enterica enterica serovar Typhi
ccgccgcaaaagc

SEQ ID NO: 3653503 - RNA, 18 nt, Salmonella enterica enterica serovar Typhi
ccgccgcaauuccugacu

SEQ ID NO: 3653504 - RNA, 22 nt, Salmonella enterica enterica serovar Typhi
ccgccgcaauuccugacugcgc

SEQ ID NO: 3653505 - RNA, 18 nt, Salmonella enterica enterica serovar Typhi
ccgccgcaggccaucaua

SEQ ID NO: 3653506 - RNA, 13 nt, Salmonella enterica enterica serovar Typhi
ccgccgcccagcg

SEQ ID NO: 3653507 - RNA, 13 nt, Salmonella enterica enterica serovar Typhi
ccgccgccgcgcc

SEQ ID NO: 3653508 - RNA, 14 nt, Salmonella enterica enterica serovar Typhi
ccgccgccggccug

SEQ ID NO: 3653509 - RNA, 18 nt, Salmonella enterica enterica serovar Typhi
ccgcgucacgaccggcga

SEQ ID NO: 3653510 - RNA, 12 nt, Salmonella enterica enterica serovar Typhi
ccgcgucagcac

SEQ ID NO: 3653511 - RNA, 20 nt, Salmonella enterica enterica serovar Typhi
ccgcguccuaccgccgcgau

SEQ ID NO: 3653512 - RNA, 20 nt, Salmonella enterica enterica serovar Typhi
ccgcgucguuacgcucguca

SEQ ID NO: 3653513 - RNA, 20 nt, Salmonella enterica enterica serovar Typhi
ccgcgugaacaccacugaaa

SEQ ID NO: 3653514 - RNA, 14 nt, Salmonella enterica enterica serovar Typhi
ccgcguuggcggcu

SEQ ID NO: 3653515 - RNA, 19 nt, Salmonella enterica enterica serovar Typhi
ccgcguugguuaaggcggc

SEQ ID NO: 3653516 - RNA, 13 nt, Salmonella enterica enterica serovar Typhi
ccgcguuuaucgc

SEQ ID NO: 3653517 - RNA, 17 nt, Salmonella enterica enterica serovar Typhi
ccgcuaacggcaccagc

SEQ ID NO: 3653518 - RNA, 18 nt, Salmonella enterica enterica serovar Typhi
ccgcuacaauccaggacg

SEQ ID NO: 3653519 - RNA, 21 nt, Salmonella enterica enterica serovar Typhi
ccgcuacccggcacaaugccc

SEQ ID NO: 3653520 - RNA, 19 nt, Salmonella enterica enterica serovar Typhi
ccgcuacguaauucaugca

SEQ ID NO: 3653521 - RNA, 19 nt, Salmonella enterica enterica serovar Typhi
ccgcuagcugcagcgcucc

SEQ ID NO: 3653522 - RNA, 15 nt, Salmonella enterica enterica serovar Typhi
ccgcuaucgaccagc

SEQ ID NO: 3653523 - RNA, 21 nt, Salmonella enterica enterica serovar Typhi
ccgcuaucgaccagcaccugc

SEQ ID NO: 3653524 - RNA, 22 nt, Salmonella enterica enterica serovar Typhi
ccgcuaugcggcguuaauggcc

SEQ ID NO: 3653525 - RNA, 21 nt, Salmonella enterica enterica serovar Typhi
ccgcucaauaucauagugccg

SEQ ID NO: 3653526 - RNA, 22 nt, Salmonella enterica enterica serovar Typhi
ccgcucacgguuucaacuucca

SEQ ID NO: 3653527 - RNA, 13 nt, Salmonella enterica enterica serovar Typhi
ccgcuccagaagc

SEQ ID NO: 3653528 - RNA, 14 nt, Salmonella enterica enterica serovar Typhi
ccgcuccgcgcauc

SEQ ID NO: 3653529 - RNA, 17 nt, Salmonella enterica enterica serovar Typhi
ccgcuccgggccgauac

SEQ ID NO: 3653530 - RNA, 15 nt, Salmonella enterica enterica serovar Typhi
ccgcucgccauaucu

SEQ ID NO: 3653531 - RNA, 16 nt, Salmonella enterica enterica serovar Typhi
ccgcucuucagcgucc

SEQ ID NO: 3653532 - RNA, 19 nt, Salmonella enterica enterica serovar Typhi
ccgcugaaauagccccguc

SEQ ID NO: 3653533 - RNA, 23 nt, Salmonella enterica enterica serovar Typhi
ccgcugaaccugauuauucagua

SEQ ID NO: 3653534 - RNA, 24 nt, Salmonella enterica enterica serovar Typhi
ccgcugacgcugcccgccggacag

SEQ ID NO: 3653535 - RNA, 18 nt, Salmonella enterica enterica serovar Typhi
ccgcugauauucaccugu

SEQ ID NO: 3653536 - RNA, 14 nt, Salmonella enterica enterica serovar Typhi
ccgcugaucgccgg

SEQ ID NO: 3653537 - RNA, 22 nt, Salmonella enterica enterica serovar Typhi
ccgcugauguuuugcgccgcgc

SEQ ID NO: 3653538 - RNA, 23 nt, Salmonella enterica enterica serovar Typhi
ccgcugauucguuuuuacacuga

SEQ ID NO: 3653539 - RNA, 16 nt, Salmonella enterica enterica serovar Typhi
ccgcugcaacucccgc

SEQ ID NO: 3653540 - RNA, 23 nt, Salmonella enterica enterica serovar Typhi
ccgcugcggaacaccagcgccgc

SEQ ID NO: 3653541 - RNA, 19 nt, Salmonella enterica enterica serovar Typhi
ccgcugcugccuuccaguu

SEQ ID NO: 3653542 - RNA, 11 nt, Salmonella enterica enterica serovar Typhi
ccgcugcugug

SEQ ID NO: 3653543 - RNA, 16 nt, Salmonella enterica enterica serovar Typhi
ccgcugcuucacggaa

SEQ ID NO: 3653544 - RNA, 12 nt, Salmonella enterica enterica serovar Typhi
ccgcuggaauaa

SEQ ID NO: 3653545 - RNA, 13 nt, Salmonella enterica enterica serovar Typhi
ccgcuggccgguu

SEQ ID NO: 3653546 - RNA, 19 nt, Salmonella enterica enterica serovar Typhi
ccgcuggcgccaccgcugc

SEQ ID NO: 3653547 - RNA, 22 nt, Salmonella enterica enterica serovar Typhi
ccgcuggcgcggggaacaccca

SEQ ID NO: 3653548 - RNA, 22 nt, Salmonella enterica enterica serovar Typhi
ccgcuggcgcggggaacacucu

SEQ ID NO: 3653549 - RNA, 22 nt, Salmonella enterica enterica serovar Typhi
ccgcuggcgcggggaucgguuu

SEQ ID NO: 3653550 - RNA, 20 nt, Salmonella enterica enterica serovar Typhi
ccgcuggcgcuuugccguuc

SEQ ID NO: 3653551 - RNA, 20 nt, Salmonella enterica enterica serovar Typhi
ccgcuggcggaaauaaacac

SEQ ID NO: 3653552 - RNA, 12 nt, Salmonella enterica enterica serovar Typhi
ccgcuggcgucu

SEQ ID NO: 3653553 - RNA, 15 nt, Salmonella enterica enterica serovar Typhi
ccgcuggucaacacg

SEQ ID NO: 3653554 - RNA, 18 nt, Salmonella enterica enterica serovar Typhi
ccgcugguugccuuccug

SEQ ID NO: 3653555 - RNA, 22 nt, Salmonella enterica enterica serovar Typhi
ccgcuguguacgcguucugaau

SEQ ID NO: 3653556 - RNA, 19 nt, Salmonella enterica enterica serovar Typhi
ccgcuguuacugucggcga

SEQ ID NO: 3653557 - RNA, 14 nt, Salmonella enterica enterica serovar Typhi
ccgcuguuaugcac

SEQ ID NO: 3653558 - RNA, 18 nt, Salmonella enterica enterica serovar Typhi
ccgcuguuuuucaucauc

SEQ ID NO: 3653559 - RNA, 21 nt, Salmonella enterica enterica serovar Typhi
ccgcuuauuugccuaacgggc

SEQ ID NO: 3653560 - RNA, 23 nt, Salmonella enterica enterica serovar Typhi
ccgcuucaccuuucgccgccaga

SEQ ID NO: 3653561 - RNA, 16 nt, Salmonella enterica enterica serovar Typhi
ccgcuucacgcgcggc

SEQ ID NO: 3653562 - RNA, 17 nt, Salmonella enterica enterica serovar Typhi
ccgcuucauuggcgucu

SEQ ID NO: 3653563 - RNA, 13 nt, Salmonella enterica enterica serovar Typhi
ccgcuuccagaau

SEQ ID NO: 3653564 - RNA, 13 nt, Salmonella enterica enterica serovar Typhi
ccgcuuccggcag

SEQ ID NO: 3653565 - RNA, 14 nt, Salmonella enterica enterica serovar Typhi
ccgcuuccggcagg

SEQ ID NO: 3653566 - RNA, 14 nt, Salmonella enterica enterica serovar Typhi
ccgcuucgccacuc

SEQ ID NO: 3653567 - RNA, 14 nt, Salmonella enterica enterica serovar Typhi
ccgcuucgcgggac

SEQ ID NO: 3653568 - RNA, 22 nt, Salmonella enterica enterica serovar Typhi
ccgcuucguaaaacucaugacc

SEQ ID NO: 3653569 - RNA, 13 nt, Salmonella enterica enterica serovar Typhi
ccgcuucuuccau

SEQ ID NO: 3653570 - RNA, 18 nt, Salmonella enterica enterica serovar Typhi
ccgcuuuaccgccuuccu

SEQ ID NO: 3653571 - RNA, 16 nt, Salmonella enterica enterica serovar Typhi
ccgcuuuaucauacca

SEQ ID NO: 3653572 - RNA, 21 nt, Salmonella enterica enterica serovar Typhi
ccgcuuuaucguaaccgaugu

SEQ ID NO: 3653573 - RNA, 23 nt, Salmonella enterica enterica serovar Typhi
ccgcuuuaucguaaccgaugugc

SEQ ID NO: 3653574 - RNA, 22 nt, Salmonella enterica enterica serovar Typhi
ccgcuuuaugcgcuuccagcau

SEQ ID NO: 3653575 - RNA, 19 nt, Salmonella enterica enterica serovar Typhi
ccgcuuucuucccggcagg

SEQ ID NO: 3653576 - RNA, 19 nt, Salmonella enterica enterica serovar Typhi
ccgcuuuucuggcuucagc

SEQ ID NO: 3653577 - RNA, 18 nt, Salmonella enterica enterica serovar Typhi
ccgcuuuuuccgccgucg

SEQ ID NO: 3653578 - RNA, 17 nt, Salmonella enterica enterica serovar Typhi
ccggaaaagcgcuggcu

SEQ ID NO: 3653579 - RNA, 20 nt, Salmonella enterica enterica serovar Typhi
ccggaaaagcgcuggcuggc

SEQ ID NO: 3653580 - RNA, 22 nt, Salmonella enterica enterica serovar Typhi
ccggaaaggauauaagcgccau

SEQ ID NO: 3653581 - RNA, 12 nt, Salmonella enterica enterica serovar Typhi
ccggaaaucaca

SEQ ID NO: 3653582 - RNA, 22 nt, Salmonella enterica enterica serovar Typhi
ccggaaaucacaaacaccacca

SEQ ID NO: 3653583 - RNA, 19 nt, Salmonella enterica enterica serovar Typhi
ccggaaauuugcagcgcug

SEQ ID NO: 3653584 - RNA, 15 nt, Salmonella enterica enterica serovar Typhi
ccggaacaaaagaaa

SEQ ID NO: 3653585 - RNA, 18 nt, Salmonella enterica enterica serovar Typhi
ccggaacaaaagaaagca

SEQ ID NO: 3653586 - RNA, 20 nt, Salmonella enterica enterica serovar Typhi
ccggaacaggcuuuucaggc

SEQ ID NO: 3653587 - RNA, 21 nt, Salmonella enterica enterica serovar Typhi
ccggaacauacacguaauaca

SEQ ID NO: 3653588 - RNA, 13 nt, Salmonella enterica enterica serovar Typhi
ccggaaccggcau

SEQ ID NO: 3653589 - RNA, 17 nt, Salmonella enterica enterica serovar Typhi
ccggaaccguucucaau

SEQ ID NO: 3653590 - RNA, 18 nt, Salmonella enterica enterica serovar Typhi
ccggaacggacgugcgcu

SEQ ID NO: 3653591 - RNA, 13 nt, Salmonella enterica enterica serovar Typhi
ccggaacgggcau

SEQ ID NO: 3653592 - RNA, 17 nt, Salmonella enterica enterica serovar Typhi
ccggaacgggcaugacu

SEQ ID NO: 3653593 - RNA, 15 nt, Salmonella enterica enterica serovar Typhi
ccggaagagcgcaga

SEQ ID NO: 3653594 - RNA, 17 nt, Salmonella enterica enterica serovar Typhi
ccggcgaaagcggacac

SEQ ID NO: 3653595 - RNA, 18 nt, Salmonella enterica enterica serovar Typhi
ccggcgaaaucgugcgcc

SEQ ID NO: 3653596 - RNA, 19 nt, Salmonella enterica enterica serovar Typhi
ccggcgaacguuggcuggg

SEQ ID NO: 3653597 - RNA, 18 nt, Salmonella enterica enterica serovar Typhi
ccggcgacgcuuucaccu

SEQ ID NO: 3653598 - RNA, 14 nt, Salmonella enterica enterica serovar Typhi
ccggcgacguauuc

SEQ ID NO: 3653599 - RNA, 22 nt, Salmonella enterica enterica serovar Typhi
ccggcgcaaacaguacgcccgc

SEQ ID NO: 3653600 - RNA, 18 nt, Salmonella enterica enterica serovar Typhi
ccggcgcagcaucugcgg

SEQ ID NO: 3653601 - RNA, 14 nt, Salmonella enterica enterica serovar Typhi
ccggcgcauccagu

SEQ ID NO: 3653602 - RNA, 21 nt, Salmonella enterica enterica serovar Typhi
ccggcgccaaucaccgccagc

SEQ ID NO: 3653603 - RNA, 18 nt, Salmonella enterica enterica serovar Typhi
ccggcgccagaagcuggc

SEQ ID NO: 3653604 - RNA, 21 nt, Salmonella enterica enterica serovar Typhi
ccggcgccuguuaauaccgug

SEQ ID NO: 3653605 - RNA, 15 nt, Salmonella enterica enterica serovar Typhi
ccggcgcgacgccgc

SEQ ID NO: 3653606 - RNA, 11 nt, Salmonella enterica enterica serovar Typhi
ccggcgcgccu

SEQ ID NO: 3653607 - RNA, 17 nt, Salmonella enterica enterica serovar Typhi
ccggcgcgccuuccagc

SEQ ID NO: 3653608 - RNA, 15 nt, Salmonella enterica enterica serovar Typhi
ccggcgcgcuggugc

SEQ ID NO: 3653609 - RNA, 13 nt, Salmonella enterica enterica serovar Typhi
ccggcgcggcauc

SEQ ID NO: 3653610 - RNA, 12 nt, Salmonella enterica enterica serovar Typhi
ccggcgcggcgc

SEQ ID NO: 3653611 - RNA, 14 nt, Salmonella enterica enterica serovar Typhi
ccggcgcgggugau

SEQ ID NO: 3653612 - RNA, 13 nt, Salmonella enterica enterica serovar Typhi
ccggcgcgguauu

SEQ ID NO: 3653613 - RNA, 19 nt, Salmonella enterica enterica serovar Typhi
ccggcgcguuuuggcagac

SEQ ID NO: 3653614 - RNA, 20 nt, Salmonella enterica enterica serovar Typhi
ccggcgcguuuuggcagaca

SEQ ID NO: 3653615 - RNA, 15 nt, Salmonella enterica enterica serovar Typhi
ccggcgcuaaccagc

SEQ ID NO: 3653616 - RNA, 17 nt, Salmonella enterica enterica serovar Typhi
ccggcgcuggcgcacgc

SEQ ID NO: 3653617 - RNA, 14 nt, Salmonella enterica enterica serovar Typhi
ccggcggaauagcu

SEQ ID NO: 3653618 - RNA, 15 nt, Salmonella enterica enterica serovar Typhi
ccggcggcaaggucu

SEQ ID NO: 3653619 - RNA, 11 nt, Salmonella enterica enterica serovar Typhi
ccggcggccua

SEQ ID NO: 3653620 - RNA, 14 nt, Salmonella enterica enterica serovar Typhi
ccggcggccuacca

SEQ ID NO: 3653621 - RNA, 16 nt, Salmonella enterica enterica serovar Typhi
ccggcggcgacuggcu

SEQ ID NO: 3653622 - RNA, 23 nt, Salmonella enterica enterica serovar Typhi
ccggcgggguuuuuuuaugcguu

SEQ ID NO: 3653623 - RNA, 20 nt, Salmonella enterica enterica serovar Typhi
ccggcggucgauuuugccuu

SEQ ID NO: 3653624 - RNA, 17 nt, Salmonella enterica enterica serovar Typhi
ccggcguaauugcgccu

SEQ ID NO: 3653625 - RNA, 18 nt, Salmonella enterica enterica serovar Typhi
ccggcgucauacugccaa

SEQ ID NO: 3653626 - RNA, 23 nt, Salmonella enterica enterica serovar Typhi
ccggcgugaaagcgcuugauaau

SEQ ID NO: 3653627 - RNA, 15 nt, Salmonella enterica enterica serovar Typhi
ccggcgugaacgccu

SEQ ID NO: 3653628 - RNA, 12 nt, Salmonella enterica enterica serovar Typhi
ccggcgugcgcu

SEQ ID NO: 3653629 - RNA, 18 nt, Salmonella enterica enterica serovar Typhi
ccggcguuccgcccaggc

SEQ ID NO: 3653630 - RNA, 18 nt, Salmonella enterica enterica serovar Typhi
ccggcguucucccgggcc

SEQ ID NO: 3653631 - RNA, 13 nt, Salmonella enterica enterica serovar Typhi
ccggcguugaaau

SEQ ID NO: 3653632 - RNA, 14 nt, Salmonella enterica enterica serovar Typhi
ccggcguugcgccg

SEQ ID NO: 3653633 - RNA, 19 nt, Salmonella enterica enterica serovar Typhi
ccggcguuuuuagugacag

SEQ ID NO: 3653634 - RNA, 22 nt, Salmonella enterica enterica serovar Typhi
ccggcuccgaccaucgccgcga

SEQ ID NO: 3653635 - RNA, 11 nt, Salmonella enterica enterica serovar Typhi
ccggcucgccc

SEQ ID NO: 3653636 - RNA, 23 nt, Salmonella enterica enterica serovar Typhi
ccggcugaacguuguauaaacag

SEQ ID NO: 3653637 - RNA, 15 nt, Salmonella enterica enterica serovar Typhi
ccggcugacauaauc

SEQ ID NO: 3653638 - RNA, 22 nt, Salmonella enterica enterica serovar Typhi
ccggcugcauauacucacugaa

SEQ ID NO: 3653639 - RNA, 15 nt, Salmonella enterica enterica serovar Typhi
ccggcuggcuauagu

SEQ ID NO: 3653640 - RNA, 20 nt, Salmonella enterica enterica serovar Typhi
ccggcugguuaaucacuuuu

SEQ ID NO: 3653641 - RNA, 23 nt, Salmonella enterica enterica serovar Typhi
ccggcuguucgacgaauggcggc

SEQ ID NO: 3653642 - RNA, 17 nt, Salmonella enterica enterica serovar Typhi
ccggcuuaccagcgggc

SEQ ID NO: 3653643 - RNA, 18 nt, Salmonella enterica enterica serovar Typhi
ccggcuuaggcaggggau

SEQ ID NO: 3653644 - RNA, 13 nt, Salmonella enterica enterica serovar Typhi
ccggcuuauccgg

SEQ ID NO: 3653645 - RNA, 17 nt, Salmonella enterica enterica serovar Typhi
ccggcuucuccaccaua

SEQ ID NO: 3653646 - RNA, 19 nt, Salmonella enterica enterica serovar Typhi
ccggcuucuccaccauauc

SEQ ID NO: 3653647 - RNA, 15 nt, Salmonella enterica enterica serovar Typhi
ccggcuuuauuacuu

SEQ ID NO: 3653648 - RNA, 17 nt, Salmonella enterica enterica serovar Typhi
ccggcuuuccgcaccgc

SEQ ID NO: 3653649 - RNA, 21 nt, Salmonella enterica enterica serovar Typhi
ccgggaaaacaucacccggcg

SEQ ID NO: 3653650 - RNA, 16 nt, Salmonella enterica enterica serovar Typhi
ccgggaagaaggcucc

SEQ ID NO: 3653651 - RNA, 17 nt, Salmonella enterica enterica serovar Typhi
ccgggacugacugagcc

SEQ ID NO: 3653652 - RNA, 15 nt, Salmonella enterica enterica serovar Typhi
ccgggacuucaggca

SEQ ID NO: 3653653 - RNA, 23 nt, Salmonella enterica enterica serovar Typhi
ccgggacuuuaaacgucaugcug

SEQ ID NO: 3653654 - RNA, 23 nt, Salmonella enterica enterica serovar Typhi
ccgggagaaaacgcggccuggaa

SEQ ID NO: 3653655 - RNA, 17 nt, Salmonella enterica enterica serovar Typhi
ccgggagaacgccgggc

SEQ ID NO: 3653656 - RNA, 22 nt, Salmonella enterica enterica serovar Typhi
ccgggagaacgccgggccugcc

SEQ ID NO: 3653657 - RNA, 15 nt, Salmonella enterica enterica serovar Typhi
ccgggauauuuccgc

SEQ ID NO: 3653658 - RNA, 14 nt, Salmonella enterica enterica serovar Typhi
ccgggauucaggga

SEQ ID NO: 3653659 - RNA, 21 nt, Salmonella enterica enterica serovar Typhi
ccgggcaguacgcacguuuug

SEQ ID NO: 3653660 - RNA, 11 nt, Salmonella enterica enterica serovar Typhi
ccgggcaucug

SEQ ID NO: 3653661 - RNA, 13 nt, Salmonella enterica enterica serovar Typhi
ccgggcauggcuc

SEQ ID NO: 3653662 - RNA, 13 nt, Salmonella enterica enterica serovar Typhi
ccgggccaaugcc

SEQ ID NO: 3653663 - RNA, 20 nt, Salmonella enterica enterica serovar Typhi
ccgggccgacaggcggccgc

SEQ ID NO: 3653664 - RNA, 16 nt, Salmonella enterica enterica serovar Typhi
ccgggccgccgauacu

SEQ ID NO: 3653665 - RNA, 19 nt, Salmonella enterica enterica serovar Typhi
ccgggccgcuagcugcagc

SEQ ID NO: 3653666 - RNA, 16 nt, Salmonella enterica enterica serovar Typhi
ccgggccgugacacau

SEQ ID NO: 3653667 - RNA, 19 nt, Salmonella enterica enterica serovar Typhi
ccgggccugagcgcgcagc

SEQ ID NO: 3653668 - RNA, 13 nt, Salmonella enterica enterica serovar Typhi
ccgggccuggcau

SEQ ID NO: 3653669 - RNA, 18 nt, Salmonella enterica enterica serovar Typhi
ccgggcgacacgcgcgcu

SEQ ID NO: 3653670 - RNA, 13 nt, Salmonella enterica enterica serovar Typhi
ccgggcgaccacc

SEQ ID NO: 3653671 - RNA, 21 nt, Salmonella enterica enterica serovar Typhi
ccgggcgauaaaccagcccca

SEQ ID NO: 3653672 - RNA, 14 nt, Salmonella enterica enterica serovar Typhi
ccgggcggcgcagc

SEQ ID NO: 3653673 - RNA, 18 nt, Salmonella enterica enterica serovar Typhi
ccgggcggcugucccaga

SEQ ID NO: 3653674 - RNA, 22 nt, Salmonella enterica enterica serovar Typhi
ccgggcgucacccgccggcagc

SEQ ID NO: 3653675 - RNA, 16 nt, Salmonella enterica enterica serovar Typhi
ccgggcucacgcuggu

SEQ ID NO: 3653676 - RNA, 18 nt, Salmonella enterica enterica serovar Typhi
ccgggcucacgcuggugc

SEQ ID NO: 3653677 - RNA, 23 nt, Salmonella enterica enterica serovar Typhi
ccgggcucauuuuauccaacagc

SEQ ID NO: 3653678 - RNA, 21 nt, Salmonella enterica enterica serovar Typhi
ccgggcugaacgccaggccgu

SEQ ID NO: 3653679 - RNA, 15 nt, Salmonella enterica enterica serovar Typhi
ccgggcugcacgcca

SEQ ID NO: 3653680 - RNA, 19 nt, Salmonella enterica enterica serovar Typhi
ccgucaaacaagccgccaa

SEQ ID NO: 3653681 - RNA, 17 nt, Salmonella enterica enterica serovar Typhi
ccgucaaacaucgcgcu

SEQ ID NO: 3653682 - RNA, 21 nt, Salmonella enterica enterica serovar Typhi
ccgucaaaguugguucccagc

SEQ ID NO: 3653683 - RNA, 13 nt, Salmonella enterica enterica serovar Typhi
ccgucaauaauau

SEQ ID NO: 3653684 - RNA, 18 nt, Salmonella enterica enterica serovar Typhi
ccgucaaugccuggcaga

SEQ ID NO: 3653685 - RNA, 14 nt, Salmonella enterica enterica serovar Typhi
ccgucaccacgcgc

SEQ ID NO: 3653686 - RNA, 16 nt, Salmonella enterica enterica serovar Typhi
ccgucacccgcguauc

SEQ ID NO: 3653687 - RNA, 19 nt, Salmonella enterica enterica serovar Typhi
ccgucacgccgacgaccgg

SEQ ID NO: 3653688 - RNA, 21 nt, Salmonella enterica enterica serovar Typhi
ccgucacugaaccugccuuug

SEQ ID NO: 3653689 - RNA, 14 nt, Salmonella enterica enterica serovar Typhi
ccgucagcaacccc

SEQ ID NO: 3653690 - RNA, 15 nt, Salmonella enterica enterica serovar Typhi
ccgucagcaaccccu

SEQ ID NO: 3653691 - RNA, 23 nt, Salmonella enterica enterica serovar Typhi
ccgucagcgguuguucagugcca

SEQ ID NO: 3653692 - RNA, 23 nt, Salmonella enterica enterica serovar Typhi
ccgucaggcuugccgcgccagac

SEQ ID NO: 3653693 - RNA, 14 nt, Salmonella enterica enterica serovar Typhi
ccgucagggcgagg

SEQ ID NO: 3653694 - RNA, 23 nt, Salmonella enterica enterica serovar Typhi
ccgucagggucuuauuucuccug

SEQ ID NO: 3653695 - RNA, 18 nt, Salmonella enterica enterica serovar Typhi
ccgucaguaccagcgaga

SEQ ID NO: 3653696 - RNA, 23 nt, Salmonella enterica enterica serovar Typhi
ccgucaguaccagcgagauaacc

SEQ ID NO: 3653697 - RNA, 16 nt, Salmonella enterica enterica serovar Typhi
ccgucagucgccagaa

SEQ ID NO: 3653698 - RNA, 18 nt, Salmonella enterica enterica serovar Typhi
ccgucagugagcccuccu

SEQ ID NO: 3653699 - RNA, 23 nt, Salmonella enterica enterica serovar Typhi
ccgucaguuauaggucagguuua

SEQ ID NO: 3653700 - RNA, 20 nt, Salmonella enterica enterica serovar Typhi
ccgucauaaaaucaaucugc

SEQ ID NO: 3653701 - RNA, 16 nt, Salmonella enterica enterica serovar Typhi
ccgucauccagcagca

SEQ ID NO: 3653702 - RNA, 18 nt, Salmonella enterica enterica serovar Typhi
ccgucauccagcagcaga

SEQ ID NO: 3653703 - RNA, 20 nt, Salmonella enterica enterica serovar Typhi
ccgucauccagcagcagagc

SEQ ID NO: 3653704 - RNA, 17 nt, Salmonella enterica enterica serovar Typhi
ccgucauccugcaacuc

SEQ ID NO: 3653705 - RNA, 14 nt, Salmonella enterica enterica serovar Typhi
ccgucaucgacuuc

SEQ ID NO: 3653706 - RNA, 16 nt, Salmonella enterica enterica serovar Typhi
ccgucaucgacuucaa

SEQ ID NO: 3653707 - RNA, 17 nt, Salmonella enterica enterica serovar Typhi
ccgucaucgacuucgaa

SEQ ID NO: 3653708 - RNA, 15 nt, Salmonella enterica enterica serovar Typhi
ccgucaucgcccagg

SEQ ID NO: 3653709 - RNA, 16 nt, Salmonella enterica enterica serovar Typhi
ccgucaugcuucaccu

SEQ ID NO: 3653710 - RNA, 13 nt, Salmonella enterica enterica serovar Typhi
ccgucauggugau

SEQ ID NO: 3653711 - RNA, 19 nt, Salmonella enterica enterica serovar Typhi
ccgucauucgagucaugaa

SEQ ID NO: 3653712 - RNA, 14 nt, Salmonella enterica enterica serovar Typhi
ccguccaccuggcc

SEQ ID NO: 3653713 - RNA, 18 nt, Salmonella enterica enterica serovar Typhi
ccguccagaccgucauga

SEQ ID NO: 3653714 - RNA, 13 nt, Salmonella enterica enterica serovar Typhi
ccgucccagcgga

SEQ ID NO: 3653715 - RNA, 23 nt, Salmonella enterica enterica serovar Typhi
ccgucccagcggaugucggucau

SEQ ID NO: 3653716 - RNA, 13 nt, Salmonella enterica enterica serovar Typhi
ccguccccagcca

SEQ ID NO: 3653717 - RNA, 19 nt, Salmonella enterica enterica serovar Typhi
ccguccccagcccaucggu

SEQ ID NO: 3653718 - RNA, 22 nt, Salmonella enterica enterica serovar Typhi
ccgucccuaagccggcaggcag

SEQ ID NO: 3653719 - RNA, 14 nt, Salmonella enterica enterica serovar Typhi
ccgucccuuccgcc

SEQ ID NO: 3653720 - RNA, 18 nt, Salmonella enterica enterica serovar Typhi
ccguccggcuuuuuucac

SEQ ID NO: 3653721 - RNA, 21 nt, Salmonella enterica enterica serovar Typhi
ccgucgagaaaccgcucgccg

SEQ ID NO: 3653722 - RNA, 17 nt, Salmonella enterica enterica serovar Typhi
ccgucgccaucaccagg

SEQ ID NO: 3653723 - RNA, 12 nt, Salmonella enterica enterica serovar Typhi
ccgucgccggaa

SEQ ID NO: 3653724 - RNA, 16 nt, Salmonella enterica enterica serovar Typhi
ccgucggcgccagcca

SEQ ID NO: 3653725 - RNA, 17 nt, Salmonella enterica enterica serovar Typhi
ccgucggcgccagccac

SEQ ID NO: 3653726 - RNA, 18 nt, Salmonella enterica enterica serovar Typhi
ccgucggcgccagccaca

SEQ ID NO: 3653727 - RNA, 18 nt, Salmonella enterica enterica serovar Typhi
ccgucggggauggcggau

SEQ ID NO: 3653728 - RNA, 21 nt, Salmonella enterica enterica serovar Typhi
ccgucgugacuaauagccaaa

SEQ ID NO: 3653729 - RNA, 18 nt, Salmonella enterica enterica serovar Typhi
ccgucgugauagccauac

SEQ ID NO: 3653730 - RNA, 22 nt, Salmonella enterica enterica serovar Typhi
ccgucgugccuuucaggcgcgg

SEQ ID NO: 3653731 - RNA, 18 nt, Salmonella enterica enterica serovar Typhi
ccgucguugcugucgcgc

SEQ ID NO: 3653732 - RNA, 14 nt, Salmonella enterica enterica serovar Typhi
ccgucuucagguca

SEQ ID NO: 3653733 - RNA, 19 nt, Salmonella enterica enterica serovar Typhi
ccgucuuuucugucguguc

SEQ ID NO: 3653734 - RNA, 14 nt, Salmonella enterica enterica serovar Typhi
ccgucuuuuuccug

SEQ ID NO: 3653735 - RNA, 21 nt, Salmonella enterica enterica serovar Typhi
ccgugaaagcauaccuucaca

SEQ ID NO: 3653736 - RNA, 18 nt, Salmonella enterica enterica serovar Typhi
ccgugaaugccaagcgca

SEQ ID NO: 3653737 - RNA, 18 nt, Salmonella enterica enterica serovar Typhi
ccgugaauuucugcugcc

SEQ ID NO: 3653738 - RNA, 14 nt, Salmonella enterica enterica serovar Typhi
ccgugaccugcuga

SEQ ID NO: 3653739 - RNA, 14 nt, Salmonella enterica enterica serovar Typhi
ccgugaguuuuaac

SEQ ID NO: 3653740 - RNA, 16 nt, Salmonella enterica enterica serovar Typhi
ccgugauuuauuuucg

SEQ ID NO: 3653741 - RNA, 21 nt, Salmonella enterica enterica serovar Typhi
ccgugcaaaaucacgcggcgc

SEQ ID NO: 3653742 - RNA, 13 nt, Salmonella enterica enterica serovar Typhi
ccgugcacgcugc

SEQ ID NO: 3653743 - RNA, 23 nt, Salmonella enterica enterica serovar Typhi
ccgugcaguuuugcuucaugcac

SEQ ID NO: 3653744 - RNA, 14 nt, Salmonella enterica enterica serovar Typhi
ccgugccgccgcga

SEQ ID NO: 3653745 - RNA, 16 nt, Salmonella enterica enterica serovar Typhi
ccgugcucuucgugga

SEQ ID NO: 3653746 - RNA, 20 nt, Salmonella enterica enterica serovar Typhi
ccguggaaaagagcgucguu

SEQ ID NO: 3653747 - RNA, 16 nt, Salmonella enterica enterica serovar Typhi
ccguggccaaaaaauc

SEQ ID NO: 3653748 - RNA, 16 nt, Salmonella enterica enterica serovar Typhi
ccguggguggcaaggc

SEQ ID NO: 3653749 - RNA, 18 nt, Salmonella enterica enterica serovar Typhi
ccguguucaugcagccau

SEQ ID NO: 3653750 - RNA, 19 nt, Salmonella enterica enterica serovar Typhi
ccguguugugugccgcgcu

SEQ ID NO: 3653751 - RNA, 22 nt, Salmonella enterica enterica serovar Typhi
ccguguuuuuuacaggcauccg

SEQ ID NO: 3653752 - RNA, 23 nt, Salmonella enterica enterica serovar Typhi
ccguuaaacugcgcgauaucugc

SEQ ID NO: 3653753 - RNA, 23 nt, Salmonella enterica enterica serovar Typhi
ccguuaaauaccagcaccugaau

SEQ ID NO: 3653754 - RNA, 14 nt, Salmonella enterica enterica serovar Typhi
ccguuaagcccuga

SEQ ID NO: 3653755 - RNA, 13 nt, Salmonella enterica enterica serovar Typhi
ccguuacaaauag

SEQ ID NO: 3653756 - RNA, 13 nt, Salmonella enterica enterica serovar Typhi
ccguuaccagcau

SEQ ID NO: 3653757 - RNA, 14 nt, Salmonella enterica enterica serovar Typhi
ccguuacuuccccc

SEQ ID NO: 3653758 - RNA, 15 nt, Salmonella enterica enterica serovar Typhi
ccguuacuuccccca

SEQ ID NO: 3653759 - RNA, 21 nt, Salmonella enterica enterica serovar Typhi
ccguuaugaaucgcgugcgcu

SEQ ID NO: 3653760 - RNA, 21 nt, Salmonella enterica enterica serovar Typhi
ccguuaugcaguucaaaaggu

SEQ ID NO: 3653761 - RNA, 16 nt, Salmonella enterica enterica serovar Typhi
ccguuauucauucacc

SEQ ID NO: 3653762 - RNA, 14 nt, Salmonella enterica enterica serovar Typhi
ccguucacggcgau

SEQ ID NO: 3653763 - RNA, 17 nt, Salmonella enterica enterica serovar Typhi
ccguucaucggcauaca

SEQ ID NO: 3653764 - RNA, 15 nt, Salmonella enterica enterica serovar Typhi
ccguuccaccgccaa

SEQ ID NO: 3653765 - RNA, 14 nt, Salmonella enterica enterica serovar Typhi
ccguuccgccagau

SEQ ID NO: 3653766 - RNA, 13 nt, Salmonella enterica enterica serovar Typhi
ccuccaucgccag

SEQ ID NO: 3653767 - RNA, 17 nt, Salmonella enterica enterica serovar Typhi
ccuccauggcuugucgc

SEQ ID NO: 3653768 - RNA, 21 nt, Salmonella enterica enterica serovar Typhi
ccuccauggcuugucgccaac

SEQ ID NO: 3653769 - RNA, 13 nt, Salmonella enterica enterica serovar Typhi
ccucccaguuccc

SEQ ID NO: 3653770 - RNA, 13 nt, Salmonella enterica enterica serovar Typhi
ccuccccaggcgc

SEQ ID NO: 3653771 - RNA, 18 nt, Salmonella enterica enterica serovar Typhi
ccuccccaggcgcuauuc

SEQ ID NO: 3653772 - RNA, 23 nt, Salmonella enterica enterica serovar Typhi
ccucccggugcgggaggaauaaa

SEQ ID NO: 3653773 - RNA, 11 nt, Salmonella enterica enterica serovar Typhi
ccucccuuucu

SEQ ID NO: 3653774 - RNA, 18 nt, Salmonella enterica enterica serovar Typhi
ccuccgccacuagcgcuu

SEQ ID NO: 3653775 - RNA, 11 nt, Salmonella enterica enterica serovar Typhi
ccuccgcccgg

SEQ ID NO: 3653776 - RNA, 17 nt, Salmonella enterica enterica serovar Typhi
ccuccgcgcagcaacag

SEQ ID NO: 3653777 - RNA, 17 nt, Salmonella enterica enterica serovar Typhi
ccuccgcguaccucagc

SEQ ID NO: 3653778 - RNA, 23 nt, Salmonella enterica enterica serovar Typhi
ccuccgcguagcccagcgccgca

SEQ ID NO: 3653779 - RNA, 19 nt, Salmonella enterica enterica serovar Typhi
ccuccgcuuccugcgccag

SEQ ID NO: 3653780 - RNA, 22 nt, Salmonella enterica enterica serovar Typhi
ccuccggcagaaaugaccacgu

SEQ ID NO: 3653781 - RNA, 17 nt, Salmonella enterica enterica serovar Typhi
ccuccggccagcgccag

SEQ ID NO: 3653782 - RNA, 15 nt, Salmonella enterica enterica serovar Typhi
ccuccggcgcggcgc

SEQ ID NO: 3653783 - RNA, 17 nt, Salmonella enterica enterica serovar Typhi
ccuccggcggugaagca

SEQ ID NO: 3653784 - RNA, 14 nt, Salmonella enterica enterica serovar Typhi
ccuccggcuucagc

SEQ ID NO: 3653785 - RNA, 15 nt, Salmonella enterica enterica serovar Typhi
ccuccgggaaaacau

SEQ ID NO: 3653786 - RNA, 15 nt, Salmonella enterica enterica serovar Typhi
ccuccguaugaccgc

SEQ ID NO: 3653787 - RNA, 16 nt, Salmonella enterica enterica serovar Typhi
ccuccgucaccuccgc

SEQ ID NO: 3653788 - RNA, 18 nt, Salmonella enterica enterica serovar Typhi
ccuccucgacguuuucca

SEQ ID NO: 3653789 - RNA, 20 nt, Salmonella enterica enterica serovar Typhi
ccuccugccaggcgcuaucu

SEQ ID NO: 3653790 - RNA, 19 nt, Salmonella enterica enterica serovar Typhi
ccuccugccgaugccgccg

SEQ ID NO: 3653791 - RNA, 17 nt, Salmonella enterica enterica serovar Typhi
ccuccuucgcgccugug

SEQ ID NO: 3653792 - RNA, 16 nt, Salmonella enterica enterica serovar Typhi
ccuccuuguaagggag

SEQ ID NO: 3653793 - RNA, 20 nt, Salmonella enterica enterica serovar Typhi
ccuccuuguaagggaggugc

SEQ ID NO: 3653794 - RNA, 14 nt, Salmonella enterica enterica serovar Typhi
ccucgaaguauuac

SEQ ID NO: 3653795 - RNA, 19 nt, Salmonella enterica enterica serovar Typhi
ccucgacaauuucaccuuu

SEQ ID NO: 3653796 - RNA, 16 nt, Salmonella enterica enterica serovar Typhi
ccucgaccaguuuuuc

SEQ ID NO: 3653797 - RNA, 21 nt, Salmonella enterica enterica serovar Typhi
ccucgauggcauuguccuuua

SEQ ID NO: 3653798 - RNA, 13 nt, Salmonella enterica enterica serovar Typhi
ccucgcauccucc

SEQ ID NO: 3653799 - RNA, 19 nt, Salmonella enterica enterica serovar Typhi
ccucgcauccuccauccag

SEQ ID NO: 3653800 - RNA, 16 nt, Salmonella enterica enterica serovar Typhi
ccucgcgauccgccag

SEQ ID NO: 3653801 - RNA, 19 nt, Salmonella enterica enterica serovar Typhi
ccucgcgauccgccagcgu

SEQ ID NO: 3653802 - RNA, 20 nt, Salmonella enterica enterica serovar Typhi
ccucgcgcauccgggccgcu

SEQ ID NO: 3653803 - RNA, 16 nt, Salmonella enterica enterica serovar Typhi
ccucgcgcggcgguuc

SEQ ID NO: 3653804 - RNA, 15 nt, Salmonella enterica enterica serovar Typhi
ccucgcuaaugcccg

SEQ ID NO: 3653805 - RNA, 13 nt, Salmonella enterica enterica serovar Typhi
ccucgcucaccgg

SEQ ID NO: 3653806 - RNA, 21 nt, Salmonella enterica enterica serovar Typhi
ccucgcucaccggucccggaa

SEQ ID NO: 3653807 - RNA, 23 nt, Salmonella enterica enterica serovar Typhi
ccucgcucucuuucaccagcgcc

SEQ ID NO: 3653808 - RNA, 15 nt, Salmonella enterica enterica serovar Typhi
ccucggcaacauacc

SEQ ID NO: 3653809 - RNA, 20 nt, Salmonella enterica enterica serovar Typhi
ccucgguauguccugccgca

SEQ ID NO: 3653810 - RNA, 16 nt, Salmonella enterica enterica serovar Typhi
ccucguccagaugggc

SEQ ID NO: 3653811 - RNA, 14 nt, Salmonella enterica enterica serovar Typhi
ccucguucggcgca

SEQ ID NO: 3653812 - RNA, 13 nt, Salmonella enterica enterica serovar Typhi
ccucuaucuucuc

SEQ ID NO: 3653813 - RNA, 13 nt, Salmonella enterica enterica serovar Typhi
ccucuaucuuuuc

SEQ ID NO: 3653814 - RNA, 22 nt, Salmonella enterica enterica serovar Typhi
ccucucccgaacugucugaauc

SEQ ID NO: 3653815 - RNA, 21 nt, Salmonella enterica enterica serovar Typhi
ccucuccugaauugcaaggcg

SEQ ID NO: 3653816 - RNA, 14 nt, Salmonella enterica enterica serovar Typhi
ccucucuucucgcu

SEQ ID NO: 3653817 - RNA, 12 nt, Salmonella enterica enterica serovar Typhi
ccucugauuuuu

SEQ ID NO: 3653818 - RNA, 23 nt, Salmonella enterica enterica serovar Typhi
ccucugccguagcguacuuucaa

SEQ ID NO: 3653819 - RNA, 21 nt, Salmonella enterica enterica serovar Typhi
ccucuggccgcgcuuuuuuaa

SEQ ID NO: 3653820 - RNA, 20 nt, Salmonella enterica enterica serovar Typhi
ccucuuauccggcugccguu

SEQ ID NO: 3653821 - RNA, 23 nt, Salmonella enterica enterica serovar Typhi
ccucuucauagcguuuuuucauc

SEQ ID NO: 3653822 - RNA, 14 nt, Salmonella enterica enterica serovar Typhi
ccucuuccgccagg

SEQ ID NO: 3653823 - RNA, 21 nt, Salmonella enterica enterica serovar Typhi
ccucuuccgguagcgccugug

SEQ ID NO: 3653824 - RNA, 20 nt, Salmonella enterica enterica serovar Typhi
ccucuucuuuuaauugccag

SEQ ID NO: 3653825 - RNA, 13 nt, Salmonella enterica enterica serovar Typhi
ccucuugugcgac

SEQ ID NO: 3653826 - RNA, 23 nt, Salmonella enterica enterica serovar Typhi
ccucuuuaucuuuuagcgcgccg

SEQ ID NO: 3653827 - RNA, 20 nt, Salmonella enterica enterica serovar Typhi
ccucuuucagccgacuaucu

SEQ ID NO: 3653828 - RNA, 12 nt, Salmonella enterica enterica serovar Typhi
ccucuuuccguu

SEQ ID NO: 3653829 - RNA, 13 nt, Salmonella enterica enterica serovar Typhi
ccucuuuggaggc

SEQ ID NO: 3653830 - RNA, 15 nt, Salmonella enterica enterica serovar Typhi
ccucuuuugucgucc

SEQ ID NO: 3653831 - RNA, 21 nt, Salmonella enterica enterica serovar Typhi
ccucuuuugucguccccugga

SEQ ID NO: 3653832 - RNA, 12 nt, Salmonella enterica enterica serovar Typhi
ccucuuuuucau

SEQ ID NO: 3653833 - RNA, 16 nt, Salmonella enterica enterica serovar Typhi
ccugaaaaaauucccg

SEQ ID NO: 3653834 - RNA, 13 nt, Salmonella enterica enterica serovar Typhi
ccugaaaaagggu

SEQ ID NO: 3653835 - RNA, 22 nt, Salmonella enterica enterica serovar Typhi
ccugaaaagagcgacguugucu

SEQ ID NO: 3653836 - RNA, 13 nt, Salmonella enterica enterica serovar Typhi
ccugaaacgcggc

SEQ ID NO: 3653837 - RNA, 15 nt, Salmonella enterica enterica serovar Typhi
ccugaaagaagcgcc

SEQ ID NO: 3653838 - RNA, 15 nt, Salmonella enterica enterica serovar Typhi
ccugaaccagcgccg

SEQ ID NO: 3653839 - RNA, 16 nt, Salmonella enterica enterica serovar Typhi
ccugaaccagcgccgu

SEQ ID NO: 3653840 - RNA, 13 nt, Salmonella enterica enterica serovar Typhi
ccugaaccagcgg

SEQ ID NO: 3653841 - RNA, 20 nt, Salmonella enterica enterica serovar Typhi
ccugaacgcccggcgcgaca

SEQ ID NO: 3653842 - RNA, 14 nt, Salmonella enterica enterica serovar Typhi
ccugaagacaugcu

SEQ ID NO: 3653843 - RNA, 23 nt, Salmonella enterica enterica serovar Typhi
ccugaagauagucgauccccaac

SEQ ID NO: 3653844 - RNA, 15 nt, Salmonella enterica enterica serovar Typhi
ccugaagccauccuc

SEQ ID NO: 3653845 - RNA, 15 nt, Salmonella enterica enterica serovar Typhi
ccugaaggacaagcu

SEQ ID NO: 3653846 - RNA, 16 nt, Salmonella enterica enterica serovar Typhi
ccugaaggacaagcug

SEQ ID NO: 3653847 - RNA, 19 nt, Salmonella enterica enterica serovar Typhi
ccugaauaacccgcagccc

SEQ ID NO: 3653848 - RNA, 22 nt, Salmonella enterica enterica serovar Typhi
ccugaauaacccgcagcccugc

SEQ ID NO: 3653849 - RNA, 23 nt, Salmonella enterica enterica serovar Typhi
ccugaauaacccgcagcccugcg

SEQ ID NO: 3653850 - RNA, 15 nt, Salmonella enterica enterica serovar Typhi
ccugaauauggccag

SEQ ID NO: 3653851 - RNA, 20 nt, Salmonella enterica enterica serovar Typhi
ccugaauauggccagucccc

SEQ ID NO: 3653852 - RNA, 20 nt, Salmonella enterica enterica serovar Typhi
ccugccauucccagccgagc

SEQ ID NO: 3653853 - RNA, 19 nt, Salmonella enterica enterica serovar Typhi
ccugcccacuuugccauga

SEQ ID NO: 3653854 - RNA, 12 nt, Salmonella enterica enterica serovar Typhi
ccugcccuuuca

SEQ ID NO: 3653855 - RNA, 15 nt, Salmonella enterica enterica serovar Typhi
ccugcccuuucuuca

SEQ ID NO: 3653856 - RNA, 19 nt, Salmonella enterica enterica serovar Typhi
ccugcccuuucuucaaugg

SEQ ID NO: 3653857 - RNA, 14 nt, Salmonella enterica enterica serovar Typhi
ccugccgccuccag

SEQ ID NO: 3653858 - RNA, 15 nt, Salmonella enterica enterica serovar Typhi
ccugccgcgccgccg

SEQ ID NO: 3653859 - RNA, 17 nt, Salmonella enterica enterica serovar Typhi
ccugccggaaaaugcgc

SEQ ID NO: 3653860 - RNA, 15 nt, Salmonella enterica enterica serovar Typhi
ccugccggcggcaga

SEQ ID NO: 3653861 - RNA, 23 nt, Salmonella enterica enterica serovar Typhi
ccugccgucaaacuuaaugccug

SEQ ID NO: 3653862 - RNA, 20 nt, Salmonella enterica enterica serovar Typhi
ccugccguccugaucaaggc

SEQ ID NO: 3653863 - RNA, 17 nt, Salmonella enterica enterica serovar Typhi
ccugccguuuauuauuu

SEQ ID NO: 3653864 - RNA, 23 nt, Salmonella enterica enterica serovar Typhi
ccugccugaagcgcaguguuaau

SEQ ID NO: 3653865 - RNA, 21 nt, Salmonella enterica enterica serovar Typhi
ccugccugacaaugacgcuuc

SEQ ID NO: 3653866 - RNA, 13 nt, Salmonella enterica enterica serovar Typhi
ccugccugacgcc

SEQ ID NO: 3653867 - RNA, 10 nt, Salmonella enterica enterica serovar Typhi
ccugccuguu

SEQ ID NO: 3653868 - RNA, 21 nt, Salmonella enterica enterica serovar Typhi
ccugccuuaauccccggcccg

SEQ ID NO: 3653869 - RNA, 21 nt, Salmonella enterica enterica serovar Typhi
ccugccuuugucacccgcuuu

SEQ ID NO: 3653870 - RNA, 21 nt, Salmonella enterica enterica serovar Typhi
ccugcgaaaagcgugcgccuu

SEQ ID NO: 3653871 - RNA, 22 nt, Salmonella enterica enterica serovar Typhi
ccugcgauaccggacacccggc

SEQ ID NO: 3653872 - RNA, 14 nt, Salmonella enterica enterica serovar Typhi
ccugcgccagccgg

SEQ ID NO: 3653873 - RNA, 15 nt, Salmonella enterica enterica serovar Typhi
ccugcgccagccgga

SEQ ID NO: 3653874 - RNA, 12 nt, Salmonella enterica enterica serovar Typhi
ccugcgccagcg

SEQ ID NO: 3653875 - RNA, 20 nt, Salmonella enterica enterica serovar Typhi
ccugcgccaggauaucgccc

SEQ ID NO: 3653876 - RNA, 14 nt, Salmonella enterica enterica serovar Typhi
ccugcgcgccugac

SEQ ID NO: 3653877 - RNA, 14 nt, Salmonella enterica enterica serovar Typhi
ccugcgcugacggc

SEQ ID NO: 3653878 - RNA, 17 nt, Salmonella enterica enterica serovar Typhi
ccugcgcugauuuucuc

SEQ ID NO: 3653879 - RNA, 15 nt, Salmonella enterica enterica serovar Typhi
ccugcgcuuugacau

SEQ ID NO: 3653880 - RNA, 23 nt, Salmonella enterica enterica serovar Typhi
ccugcgcuuuggguuaaugccag

SEQ ID NO: 3653881 - RNA, 23 nt, Salmonella enterica enterica serovar Typhi
ccugcggacgcagcucauacccu

SEQ ID NO: 3653882 - RNA, 13 nt, Salmonella enterica enterica serovar Typhi
ccugcggccccag

SEQ ID NO: 3653883 - RNA, 15 nt, Salmonella enterica enterica serovar Typhi
ccugcggccucgccu

SEQ ID NO: 3653884 - RNA, 19 nt, Salmonella enterica enterica serovar Typhi
ccugcggccuugccgccag

SEQ ID NO: 3653885 - RNA, 16 nt, Salmonella enterica enterica serovar Typhi
ccugcggcguggaaaa

SEQ ID NO: 3653886 - RNA, 14 nt, Salmonella enterica enterica serovar Typhi
ccugcggcugauug

SEQ ID NO: 3653887 - RNA, 20 nt, Salmonella enterica enterica serovar Typhi
ccugcggguucaucgccaca

SEQ ID NO: 3653888 - RNA, 17 nt, Salmonella enterica enterica serovar Typhi
ccugcgguaaucgccgc

SEQ ID NO: 3653889 - RNA, 15 nt, Salmonella enterica enterica serovar Typhi
ccugcgguagcgccg

SEQ ID NO: 3653890 - RNA, 18 nt, Salmonella enterica enterica serovar Typhi
ccugcgguuucuaccacc

SEQ ID NO: 3653891 - RNA, 22 nt, Salmonella enterica enterica serovar Typhi
ccugcgguuucuaccacccagc

SEQ ID NO: 3653892 - RNA, 14 nt, Salmonella enterica enterica serovar Typhi
ccugcgucacagac

SEQ ID NO: 3653893 - RNA, 16 nt, Salmonella enterica enterica serovar Typhi
ccugcgucgccccaau

SEQ ID NO: 3653894 - RNA, 18 nt, Salmonella enterica enterica serovar Typhi
ccugcguuaaacgcugug

SEQ ID NO: 3653895 - RNA, 20 nt, Salmonella enterica enterica serovar Typhi
ccugcguuucuacggccaca

SEQ ID NO: 3653896 - RNA, 16 nt, Salmonella enterica enterica serovar Typhi
ccugcguuugcggauc

SEQ ID NO: 3653897 - RNA, 17 nt, Salmonella enterica enterica serovar Typhi
ccugcuaucuuauccgc

SEQ ID NO: 3653898 - RNA, 13 nt, Salmonella enterica enterica serovar Typhi
ccugcucaaucgc

SEQ ID NO: 3653899 - RNA, 13 nt, Salmonella enterica enterica serovar Typhi
ccugcucaucagg

SEQ ID NO: 3653900 - RNA, 13 nt, Salmonella enterica enterica serovar Typhi
ccugcuccgccag

SEQ ID NO: 3653901 - RNA, 17 nt, Salmonella enterica enterica serovar Typhi
ccugcucuggacguuga

SEQ ID NO: 3653902 - RNA, 13 nt, Salmonella enterica enterica serovar Typhi
ccugcucuugcgg

SEQ ID NO: 3653903 - RNA, 22 nt, Salmonella enterica enterica serovar Typhi
ccugcugagugacgggcuggcg

SEQ ID NO: 3653904 - RNA, 21 nt, Salmonella enterica enterica serovar Typhi
ccugcugccagccgccgccgg

SEQ ID NO: 3653905 - RNA, 18 nt, Salmonella enterica enterica serovar Typhi
ccugcugcgccagcgcau

SEQ ID NO: 3653906 - RNA, 18 nt, Salmonella enterica enterica serovar Typhi
ccugcugcggauaacguu

SEQ ID NO: 3653907 - RNA, 16 nt, Salmonella enterica enterica serovar Typhi
ccugcuggcaaaacgc

SEQ ID NO: 3653908 - RNA, 23 nt, Salmonella enterica enterica serovar Typhi
ccugcugggucugcugggcgauu

SEQ ID NO: 3653909 - RNA, 19 nt, Salmonella enterica enterica serovar Typhi
ccugcuggucgccgcccau

SEQ ID NO: 3653910 - RNA, 21 nt, Salmonella enterica enterica serovar Typhi
ccugcuggucugaaucugcuc

SEQ ID NO: 3653911 - RNA, 16 nt, Salmonella enterica enterica serovar Typhi
ccugcuguaaccccug

SEQ ID NO: 3653912 - RNA, 17 nt, Salmonella enterica enterica serovar Typhi
ccugcuguaaccccugc

SEQ ID NO: 3653913 - RNA, 15 nt, Salmonella enterica enterica serovar Typhi
ccugcuguacuuuug

SEQ ID NO: 3653914 - RNA, 13 nt, Salmonella enterica enterica serovar Typhi
ccugcugugacau

SEQ ID NO: 3653915 - RNA, 22 nt, Salmonella enterica enterica serovar Typhi
ccugcuguugcggaauacacga

SEQ ID NO: 3653916 - RNA, 11 nt, Salmonella enterica enterica serovar Typhi
ccugcuucaga

SEQ ID NO: 3653917 - RNA, 22 nt, Salmonella enterica enterica serovar Typhi
ccugcuucagacaacgccgccu

SEQ ID NO: 3653918 - RNA, 16 nt, Salmonella enterica enterica serovar Typhi
ccugcuugucgaucau

SEQ ID NO: 3653919 - RNA, 20 nt, Salmonella enterica enterica serovar Typhi
ccugcuugucgaucaucaga

SEQ ID NO: 3653920 - RNA, 20 nt, Salmonella enterica enterica serovar Typhi
ccugcuuuuucaucauacug

SEQ ID NO: 3653921 - RNA, 17 nt, Salmonella enterica enterica serovar Typhi
ccuggaaaaaagcgccc

SEQ ID NO: 3653922 - RNA, 23 nt, Salmonella enterica enterica serovar Typhi
ccuggaaaaaagcgcccagcgcc

SEQ ID NO: 3653923 - RNA, 15 nt, Salmonella enterica enterica serovar Typhi
ccuggaaccaggcgc

SEQ ID NO: 3653924 - RNA, 22 nt, Salmonella enterica enterica serovar Typhi
ccuggaauagcgugggcagacc

SEQ ID NO: 3653925 - RNA, 15 nt, Salmonella enterica enterica serovar Typhi
ccuggaauuuuucca

SEQ ID NO: 3653926 - RNA, 17 nt, Salmonella enterica enterica serovar Typhi
ccuggacgcgagccaca

SEQ ID NO: 3653927 - RNA, 16 nt, Salmonella enterica enterica serovar Typhi
ccuggagagcagcgcc

SEQ ID NO: 3653928 - RNA, 18 nt, Salmonella enterica enterica serovar Typhi
ccuggagaucagcauggu

SEQ ID NO: 3653929 - RNA, 18 nt, Salmonella enterica enterica serovar Typhi
ccuggaggaacagcgccg

SEQ ID NO: 3653930 - RNA, 24 nt, Salmonella enterica enterica serovar Typhi
ccuggagugacuaaaagacgccau

SEQ ID NO: 3653931 - RNA, 20 nt, Salmonella enterica enterica serovar Typhi
ccuggauaauaagacgccag

SEQ ID NO: 3653932 - RNA, 22 nt, Salmonella enterica enterica serovar Typhi
ccuggauacguuccagcagcgc

SEQ ID NO: 3653933 - RNA, 23 nt, Salmonella enterica enterica serovar Typhi
ccuggauacguuccagcagcgca

SEQ ID NO: 3653934 - RNA, 21 nt, Salmonella enterica enterica serovar Typhi
ccuggaugcgcugaauagcgc

SEQ ID NO: 3653935 - RNA, 16 nt, Salmonella enterica enterica serovar Typhi
ccuggaugcugccugc

SEQ ID NO: 3653936 - RNA, 13 nt, Salmonella enterica enterica serovar Typhi
ccuggcagaaagg

SEQ ID NO: 3653937 - RNA, 22 nt, Salmonella enterica enterica serovar Typhi
ccuguucuggcucggccugucg

SEQ ID NO: 3653938 - RNA, 23 nt, Salmonella enterica enterica serovar Typhi
ccuguugcgggccagcagccagg

SEQ ID NO: 3653939 - RNA, 20 nt, Salmonella enterica enterica serovar Typhi
ccuguuuuuucagcgcgccg

SEQ ID NO: 3653940 - RNA, 23 nt, Salmonella enterica enterica serovar Typhi
ccuuaauccccggcccgccgcug

SEQ ID NO: 3653941 - RNA, 15 nt, Salmonella enterica enterica serovar Typhi
ccuuaaugucaucau

SEQ ID NO: 3653942 - RNA, 24 nt, Salmonella enterica enterica serovar Typhi
ccuuaauuugugauugcagauaau

SEQ ID NO: 3653943 - RNA, 14 nt, Salmonella enterica enterica serovar Typhi
ccuuacaggcgcau

SEQ ID NO: 3653944 - RNA, 21 nt, Salmonella enterica enterica serovar Typhi
ccuuacaggcgcaucagaaaa

SEQ ID NO: 3653945 - RNA, 17 nt, Salmonella enterica enterica serovar Typhi
ccuuaccgucagccacu

SEQ ID NO: 3653946 - RNA, 13 nt, Salmonella enterica enterica serovar Typhi
ccuuacggcuccu

SEQ ID NO: 3653947 - RNA, 12 nt, Salmonella enterica enterica serovar Typhi
ccuuauaaugcu

SEQ ID NO: 3653948 - RNA, 22 nt, Salmonella enterica enterica serovar Typhi
ccuuauacaggcgcagggcauu

SEQ ID NO: 3653949 - RNA, 17 nt, Salmonella enterica enterica serovar Typhi
ccuuauccggcguguaa

SEQ ID NO: 3653950 - RNA, 18 nt, Salmonella enterica enterica serovar Typhi
ccuuaucgaccaggcgac

SEQ ID NO: 3653951 - RNA, 22 nt, Salmonella enterica enterica serovar Typhi
ccuuaucgagugucaauaagcc

SEQ ID NO: 3653952 - RNA, 22 nt, Salmonella enterica enterica serovar Typhi
ccuuaugggucacauccagaca

SEQ ID NO: 3653953 - RNA, 14 nt, Salmonella enterica enterica serovar Typhi
ccuuaugucauuca

SEQ ID NO: 3653954 - RNA, 23 nt, Salmonella enterica enterica serovar Typhi
ccuuauucgcuagcgugccauua

SEQ ID NO: 3653955 - RNA, 13 nt, Salmonella enterica enterica serovar Typhi
ccuuauuuuucag

SEQ ID NO: 3653956 - RNA, 19 nt, Salmonella enterica enterica serovar Typhi
ccuuauuuuucagcgccag

SEQ ID NO: 3653957 - RNA, 20 nt, Salmonella enterica enterica serovar Typhi
ccuucaauaucaacgaccgu

SEQ ID NO: 3653958 - RNA, 23 nt, Salmonella enterica enterica serovar Typhi
ccuucacauuggcaaaccccugc

SEQ ID NO: 3653959 - RNA, 16 nt, Salmonella enterica enterica serovar Typhi
ccuucacccccaucgc

SEQ ID NO: 3653960 - RNA, 18 nt, Salmonella enterica enterica serovar Typhi
ccuucacgcagugcgcga

SEQ ID NO: 3653961 - RNA, 15 nt, Salmonella enterica enterica serovar Typhi
ccuucacgccgccaa

SEQ ID NO: 3653962 - RNA, 14 nt, Salmonella enterica enterica serovar Typhi
ccuucagcgcgccc

SEQ ID NO: 3653963 - RNA, 22 nt, Salmonella enterica enterica serovar Typhi
ccuucagugauaaagcacagcc

SEQ ID NO: 3653964 - RNA, 15 nt, Salmonella enterica enterica serovar Typhi
ccuucauacugcgga

SEQ ID NO: 3653965 - RNA, 23 nt, Salmonella enterica enterica serovar Typhi
ccuucauucagaucaaaaaucug

SEQ ID NO: 3653966 - RNA, 21 nt, Salmonella enterica enterica serovar Typhi
ccuucauuguccucggcaaca

SEQ ID NO: 3653967 - RNA, 19 nt, Salmonella enterica enterica serovar Typhi
ccuucccccagaaugccgc

SEQ ID NO: 3653968 - RNA, 19 nt, Salmonella enterica enterica serovar Typhi
ccuucccgcgauaaaaaca

SEQ ID NO: 3653969 - RNA, 19 nt, Salmonella enterica enterica serovar Typhi
ccuuccgcaagcucaccau

SEQ ID NO: 3653970 - RNA, 17 nt, Salmonella enterica enterica serovar Typhi
ccuuccggccacuccgc

SEQ ID NO: 3653971 - RNA, 19 nt, Salmonella enterica enterica serovar Typhi
ccuuccucauuuuugccca

SEQ ID NO: 3653972 - RNA, 14 nt, Salmonella enterica enterica serovar Typhi
ccuucgaacagcuc

SEQ ID NO: 3653973 - RNA, 24 nt, Salmonella enterica enterica serovar Typhi
ccuucgauaguccauuuuccuaug

SEQ ID NO: 3653974 - RNA, 17 nt, Salmonella enterica enterica serovar Typhi
ccuucgaugaucaugcg

SEQ ID NO: 3653975 - RNA, 14 nt, Salmonella enterica enterica serovar Typhi
ccuucgcccggcgc

SEQ ID NO: 3653976 - RNA, 12 nt, Salmonella enterica enterica serovar Typhi
ccuucgccgccg

SEQ ID NO: 3653977 - RNA, 13 nt, Salmonella enterica enterica serovar Typhi
ccuucgccuucac

SEQ ID NO: 3653978 - RNA, 19 nt, Salmonella enterica enterica serovar Typhi
ccuucgcggugaucccagg

SEQ ID NO: 3653979 - RNA, 20 nt, Salmonella enterica enterica serovar Typhi
ccuucgcggugaucccaggc

SEQ ID NO: 3653980 - RNA, 21 nt, Salmonella enterica enterica serovar Typhi
ccuucggugaaaucacgaccg

SEQ ID NO: 3653981 - RNA, 13 nt, Salmonella enterica enterica serovar Typhi
ccuucguccggau

SEQ ID NO: 3653982 - RNA, 18 nt, Salmonella enterica enterica serovar Typhi
ccuucguuauaaggccug

SEQ ID NO: 3653983 - RNA, 19 nt, Salmonella enterica enterica serovar Typhi
ccuucguuauaaggccugc

SEQ ID NO: 3653984 - RNA, 14 nt, Salmonella enterica enterica serovar Typhi
ccuucuccccuuca

SEQ ID NO: 3653985 - RNA, 16 nt, Salmonella enterica enterica serovar Typhi
ccuucuccgguaauca

SEQ ID NO: 3653986 - RNA, 19 nt, Salmonella enterica enterica serovar Typhi
ccuucuguaagcaauuaau

SEQ ID NO: 3653987 - RNA, 15 nt, Salmonella enterica enterica serovar Typhi
ccuucuucacccacu

SEQ ID NO: 3653988 - RNA, 20 nt, Salmonella enterica enterica serovar Typhi
ccuucuucccauauuuuuuc

SEQ ID NO: 3653989 - RNA, 14 nt, Salmonella enterica enterica serovar Typhi
ccuucuucccccug

SEQ ID NO: 3653990 - RNA, 19 nt, Salmonella enterica enterica serovar Typhi
ccuucuuccgucaccguau

SEQ ID NO: 3653991 - RNA, 14 nt, Salmonella enterica enterica serovar Typhi
ccuucuucgccaac

SEQ ID NO: 3653992 - RNA, 15 nt, Salmonella enterica enterica serovar Typhi
ccuucuucgccguca

SEQ ID NO: 3653993 - RNA, 15 nt, Salmonella enterica enterica serovar Typhi
ccuucuuuaugcgcc

SEQ ID NO: 3653994 - RNA, 13 nt, Salmonella enterica enterica serovar Typhi
ccuucuuuggcuu

SEQ ID NO: 3653995 - RNA, 21 nt, Salmonella enterica enterica serovar Typhi
ccuucuuuggugcgacgccag

SEQ ID NO: 3653996 - RNA, 12 nt, Salmonella enterica enterica serovar Typhi
ccuucuuuuacu

SEQ ID NO: 3653997 - RNA, 19 nt, Salmonella enterica enterica serovar Typhi
ccuugaaguuauccagcgc

SEQ ID NO: 3653998 - RNA, 20 nt, Salmonella enterica enterica serovar Typhi
ccuugaaguuauccagcgcc

SEQ ID NO: 3653999 - RNA, 15 nt, Salmonella enterica enterica serovar Typhi
ccuugaccgccugau

SEQ ID NO: 3654000 - RNA, 17 nt, Salmonella enterica enterica serovar Typhi
ccuugagcaaaacaccg

SEQ ID NO: 3654001 - RNA, 22 nt, Salmonella enterica enterica serovar Typhi
ccuugagcaaaacaccgcucaa

SEQ ID NO: 3654002 - RNA, 22 nt, Salmonella enterica enterica serovar Typhi
ccuugaucaggaaaucuuccag

SEQ ID NO: 3654003 - RNA, 18 nt, Salmonella enterica enterica serovar Typhi
ccuugccagugaaaaaaa

SEQ ID NO: 3654004 - RNA, 19 nt, Salmonella enterica enterica serovar Typhi
ccuugcccuggaauuuuuc

SEQ ID NO: 3654005 - RNA, 20 nt, Salmonella enterica enterica serovar Typhi
ccuugccgcuuccaguccag

SEQ ID NO: 3654006 - RNA, 13 nt, Salmonella enterica enterica serovar Typhi
ccuugcgaagacc

SEQ ID NO: 3654007 - RNA, 18 nt, Salmonella enterica enterica serovar Typhi
ccuugcgggauacaugcc

SEQ ID NO: 3654008 - RNA, 16 nt, Salmonella enterica enterica serovar Typhi
ccuugcggugagaaac

SEQ ID NO: 3654009 - RNA, 15 nt, Salmonella enterica enterica serovar Typhi
ccuugcggugcagca

SEQ ID NO: 3654010 - RNA, 18 nt, Salmonella enterica enterica serovar Typhi
ccuugcggugcagcagac

SEQ ID NO: 3654011 - RNA, 21 nt, Salmonella enterica enterica serovar Typhi
ccuugcuggccuguucaagug

SEQ ID NO: 3654012 - RNA, 14 nt, Salmonella enterica enterica serovar Typhi
ccuuguaagggagg

SEQ ID NO: 3654013 - RNA, 14 nt, Salmonella enterica enterica serovar Typhi
ccuuguaggccuga

SEQ ID NO: 3654014 - RNA, 22 nt, Salmonella enterica enterica serovar Typhi
ccuuguccauguaaacuccauu

SEQ ID NO: 3654015 - RNA, 20 nt, Salmonella enterica enterica serovar Typhi
ccuuguuauccuaaaucugc

SEQ ID NO: 3654016 - RNA, 22 nt, Salmonella enterica enterica serovar Typhi
ccuuguucaauagagcgcagca

SEQ ID NO: 3654017 - RNA, 18 nt, Salmonella enterica enterica serovar Typhi
ccuuuaaccucuuuuuca

SEQ ID NO: 3654018 - RNA, 19 nt, Salmonella enterica enterica serovar Typhi
ccuuuaaccucuuuuucau

SEQ ID NO: 3654019 - RNA, 22 nt, Salmonella enterica enterica serovar Typhi
ccuuuaacgccuucauauuaaa

SEQ ID NO: 3654020 - RNA, 22 nt, Salmonella enterica enterica serovar Typhi
ccuuuacugaaucucagauaau

SEQ ID NO: 3654021 - RNA, 18 nt, Salmonella enterica enterica serovar Typhi
ccuuuacugacaauaagu

SEQ ID NO: 3654022 - RNA, 13 nt, Salmonella enterica enterica serovar Typhi
cgaacugaauagu

SEQ ID NO: 3654023 - RNA, 22 nt, Salmonella enterica enterica serovar Typhi
cgaacugauggcgcuaagccag

SEQ ID NO: 3654024 - RNA, 15 nt, Salmonella enterica enterica serovar Typhi
cgaacugauguuccg

SEQ ID NO: 3654025 - RNA, 18 nt, Salmonella enterica enterica serovar Typhi
cgaacugucugaaucagu

SEQ ID NO: 3654026 - RNA, 24 nt, Salmonella enterica enterica serovar Typhi
cgaacugucugaaucagugcaucu

SEQ ID NO: 3654027 - RNA, 20 nt, Salmonella enterica enterica serovar Typhi
cgaacuucgcgguugcgccc

SEQ ID NO: 3654028 - RNA, 16 nt, Salmonella enterica enterica serovar Typhi
cgaacuugaccagcac

SEQ ID NO: 3654029 - RNA, 19 nt, Salmonella enterica enterica serovar Typhi
cgaagagcauaugcgcugc

SEQ ID NO: 3654030 - RNA, 19 nt, Salmonella enterica enterica serovar Typhi
cgaagaucguuauccagca

SEQ ID NO: 3654031 - RNA, 23 nt, Salmonella enterica enterica serovar Typhi
cgaagaucguuauccagcagcca

SEQ ID NO: 3654032 - RNA, 13 nt, Salmonella enterica enterica serovar Typhi
cgaagaugaggag

SEQ ID NO: 3654033 - RNA, 17 nt, Salmonella enterica enterica serovar Typhi
cgaagccgcgggcggua

SEQ ID NO: 3654034 - RNA, 23 nt, Salmonella enterica enterica serovar Typhi
cgaagccgcgggcgguauuacau

SEQ ID NO: 3654035 - RNA, 17 nt, Salmonella enterica enterica serovar Typhi
cgaagcgaauagcguau

SEQ ID NO: 3654036 - RNA, 14 nt, Salmonella enterica enterica serovar Typhi
cgaagcgcggcagu

SEQ ID NO: 3654037 - RNA, 15 nt, Salmonella enterica enterica serovar Typhi
cgaaggaagauagcg

SEQ ID NO: 3654038 - RNA, 19 nt, Salmonella enterica enterica serovar Typhi
cgaaggggcgggcagcagc

SEQ ID NO: 3654039 - RNA, 18 nt, Salmonella enterica enterica serovar Typhi
cgaagggggccgggaaag

SEQ ID NO: 3654040 - RNA, 23 nt, Salmonella enterica enterica serovar Typhi
cgaaggguagggauagcaucuuc

SEQ ID NO: 3654041 - RNA, 16 nt, Salmonella enterica enterica serovar Typhi
cgaagggugaggagcu

SEQ ID NO: 3654042 - RNA, 18 nt, Salmonella enterica enterica serovar Typhi
cgaagguaaacgcgacca

SEQ ID NO: 3654043 - RNA, 16 nt, Salmonella enterica enterica serovar Typhi
cgaaggucagauccuu

SEQ ID NO: 3654044 - RNA, 18 nt, Salmonella enterica enterica serovar Typhi
cgaagguuaccuacgguu

SEQ ID NO: 3654045 - RNA, 12 nt, Salmonella enterica enterica serovar Typhi
cgaagucgagcu

SEQ ID NO: 3654046 - RNA, 22 nt, Salmonella enterica enterica serovar Typhi
cgaagugcagcguuuccagcca

SEQ ID NO: 3654047 - RNA, 15 nt, Salmonella enterica enterica serovar Typhi
cgaauaaaauucagc

SEQ ID NO: 3654048 - RNA, 17 nt, Salmonella enterica enterica serovar Typhi
cgaauaacgccagguag

SEQ ID NO: 3654049 - RNA, 16 nt, Salmonella enterica enterica serovar Typhi
cgaauaaggaauggua

SEQ ID NO: 3654050 - RNA, 18 nt, Salmonella enterica enterica serovar Typhi
cgaauaaucaaccauaca

SEQ ID NO: 3654051 - RNA, 22 nt, Salmonella enterica enterica serovar Typhi
cgaauaccgugcacgcugcgca

SEQ ID NO: 3654052 - RNA, 13 nt, Salmonella enterica enterica serovar Typhi
cgaauacuacugg

SEQ ID NO: 3654053 - RNA, 17 nt, Salmonella enterica enterica serovar Typhi
cgaauacuguuccaggc

SEQ ID NO: 3654054 - RNA, 21 nt, Salmonella enterica enterica serovar Typhi
cgaauagaguaauacauccau

SEQ ID NO: 3654055 - RNA, 13 nt, Salmonella enterica enterica serovar Typhi
cgaauagcgccag

SEQ ID NO: 3654056 - RNA, 18 nt, Salmonella enterica enterica serovar Typhi
cgaauagugauaccaguc

SEQ ID NO: 3654057 - RNA, 22 nt, Salmonella enterica enterica serovar Typhi
cgaauaguggcgcgccagcgau

SEQ ID NO: 3654058 - RNA, 18 nt, Salmonella enterica enterica serovar Typhi
cgaauauaacgacagccu

SEQ ID NO: 3654059 - RNA, 18 nt, Salmonella enterica enterica serovar Typhi
cgaauauacgcaccugau

SEQ ID NO: 3654060 - RNA, 15 nt, Salmonella enterica enterica serovar Typhi
cgaauaucuuugucc

SEQ ID NO: 3654061 - RNA, 19 nt, Salmonella enterica enterica serovar Typhi
cgaaucagcgauugcgcca

SEQ ID NO: 3654062 - RNA, 13 nt, Salmonella enterica enterica serovar Typhi
cgaauccagcagg

SEQ ID NO: 3654063 - RNA, 19 nt, Salmonella enterica enterica serovar Typhi
cgaauccccaucuccagac

SEQ ID NO: 3654064 - RNA, 12 nt, Salmonella enterica enterica serovar Typhi
cgaauccggggg

SEQ ID NO: 3654065 - RNA, 13 nt, Salmonella enterica enterica serovar Typhi
cgaauccuccugu

SEQ ID NO: 3654066 - RNA, 22 nt, Salmonella enterica enterica serovar Typhi
cgaaucgacaauccgccacgcu

SEQ ID NO: 3654067 - RNA, 13 nt, Salmonella enterica enterica serovar Typhi
cgaaucgccucaa

SEQ ID NO: 3654068 - RNA, 22 nt, Salmonella enterica enterica serovar Typhi
cgaaucgccuguaccgggcaga

SEQ ID NO: 3654069 - RNA, 15 nt, Salmonella enterica enterica serovar Typhi
cgaaucuaccagauc

SEQ ID NO: 3654070 - RNA, 18 nt, Salmonella enterica enterica serovar Typhi
cgaaugcgccagcgagac

SEQ ID NO: 3654071 - RNA, 19 nt, Salmonella enterica enterica serovar Typhi
cgaauggccuccagcagca

SEQ ID NO: 3654072 - RNA, 15 nt, Salmonella enterica enterica serovar Typhi
cgaaugucauccgga

SEQ ID NO: 3654073 - RNA, 20 nt, Salmonella enterica enterica serovar Typhi
cgaaugugcaccuuaaccgu

SEQ ID NO: 3654074 - RNA, 22 nt, Salmonella enterica enterica serovar Typhi
cgaaugugcaccuuaaccgucu

SEQ ID NO: 3654075 - RNA, 12 nt, Salmonella enterica enterica serovar Typhi
cgaauuccgccu

SEQ ID NO: 3654076 - RNA, 15 nt, Salmonella enterica enterica serovar Typhi
cgaauuuaaauagca

SEQ ID NO: 3654077 - RNA, 18 nt, Salmonella enterica enterica serovar Typhi
cgaauuuacugugaucca

SEQ ID NO: 3654078 - RNA, 21 nt, Salmonella enterica enterica serovar Typhi
cgaauuuauaagccugagcgc

SEQ ID NO: 3654079 - RNA, 15 nt, Salmonella enterica enterica serovar Typhi
cgaauuucaccaccg

SEQ ID NO: 3654080 - RNA, 15 nt, Salmonella enterica enterica serovar Typhi
cgaauuucacgcagc

SEQ ID NO: 3654081 - RNA, 21 nt, Salmonella enterica enterica serovar Typhi
cgaauuucggcaaugacggua

SEQ ID NO: 3654082 - RNA, 17 nt, Salmonella enterica enterica serovar Typhi
cgaauuugccccagaua

SEQ ID NO: 3654083 - RNA, 15 nt, Salmonella enterica enterica serovar Typhi
cgacaaaaagcgcgc

SEQ ID NO: 3654084 - RNA, 20 nt, Salmonella enterica enterica serovar Typhi
cgacaaaaccguucugagcg

SEQ ID NO: 3654085 - RNA, 23 nt, Salmonella enterica enterica serovar Typhi
cgacaaaacuuuuggugcccauc

SEQ ID NO: 3654086 - RNA, 15 nt, Salmonella enterica enterica serovar Typhi
cgacaaaagccagau

SEQ ID NO: 3654087 - RNA, 15 nt, Salmonella enterica enterica serovar Typhi
cgacaaacagcuauc

SEQ ID NO: 3654088 - RNA, 13 nt, Salmonella enterica enterica serovar Typhi
cgacaaagccgac

SEQ ID NO: 3654089 - RNA, 22 nt, Salmonella enterica enterica serovar Typhi
cgacaaagcguggggaaaaccc

SEQ ID NO: 3654090 - RNA, 16 nt, Salmonella enterica enterica serovar Typhi
cgacaaccagcgaaau

SEQ ID NO: 3654091 - RNA, 20 nt, Salmonella enterica enterica serovar Typhi
cgacaacgccuccugccgau

SEQ ID NO: 3654092 - RNA, 17 nt, Salmonella enterica enterica serovar Typhi
cgacaacgcuuccggcg

SEQ ID NO: 3654093 - RNA, 21 nt, Salmonella enterica enterica serovar Typhi
cgacaacuucuaauuuuucca

SEQ ID NO: 3654094 - RNA, 23 nt, Salmonella enterica enterica serovar Typhi
cgacaagaagauuucuuaauucc

SEQ ID NO: 3654095 - RNA, 20 nt, Salmonella enterica enterica serovar Typhi
cgacaagcggguggucugga

SEQ ID NO: 3654096 - RNA, 22 nt, Salmonella enterica enterica serovar Typhi
cgacaagcuaauccccagcgcu

SEQ ID NO: 3654097 - RNA, 21 nt, Salmonella enterica enterica serovar Typhi
cgacaagguauaucaacccgc

SEQ ID NO: 3654098 - RNA, 16 nt, Salmonella enterica enterica serovar Typhi
cgacaaucucaccggc

SEQ ID NO: 3654099 - RNA, 16 nt, Salmonella enterica enterica serovar Typhi
cgacaaugaaccagcc

SEQ ID NO: 3654100 - RNA, 17 nt, Salmonella enterica enterica serovar Typhi
cgacaauuucaccuuug

SEQ ID NO: 3654101 - RNA, 15 nt, Salmonella enterica enterica serovar Typhi
cgacacaacggcaca

SEQ ID NO: 3654102 - RNA, 22 nt, Salmonella enterica enterica serovar Typhi
cgacacagcguuuaacugaaca

SEQ ID NO: 3654103 - RNA, 13 nt, Salmonella enterica enterica serovar Typhi
cgacacaucaucg

SEQ ID NO: 3654104 - RNA, 15 nt, Salmonella enterica enterica serovar Typhi
cgacacauccugcgg

SEQ ID NO: 3654105 - RNA, 21 nt, Salmonella enterica enterica serovar Typhi
cgacacauccugcgggaugcg

SEQ ID NO: 3654106 - RNA, 23 nt, Salmonella enterica enterica serovar Typhi
cgacacauuuucaaugcacgcca

SEQ ID NO: 3654107 - RNA, 22 nt, Salmonella enterica enterica serovar Typhi
cgacgccgccgacacaguaaaa

SEQ ID NO: 3654108 - RNA, 18 nt, Salmonella enterica enterica serovar Typhi
cgacgccgucucuuuuug

SEQ ID NO: 3654109 - RNA, 12 nt, Salmonella enterica enterica serovar Typhi
cgacgccugcau

SEQ ID NO: 3654110 - RNA, 16 nt, Salmonella enterica enterica serovar Typhi
cgacgcgccaccaucg

SEQ ID NO: 3654111 - RNA, 14 nt, Salmonella enterica enterica serovar Typhi
cgacgcgccagcca

SEQ ID NO: 3654112 - RNA, 17 nt, Salmonella enterica enterica serovar Typhi
cgacgcguggcaucuua

SEQ ID NO: 3654113 - RNA, 14 nt, Salmonella enterica enterica serovar Typhi
cgacgcguuuucca

SEQ ID NO: 3654114 - RNA, 12 nt, Salmonella enterica enterica serovar Typhi
cgacgcucauua

SEQ ID NO: 3654115 - RNA, 16 nt, Salmonella enterica enterica serovar Typhi
cgacgcuuaucagccc

SEQ ID NO: 3654116 - RNA, 12 nt, Salmonella enterica enterica serovar Typhi
cgacggaaguca

SEQ ID NO: 3654117 - RNA, 20 nt, Salmonella enterica enterica serovar Typhi
cgacggaguggaugacaucg

SEQ ID NO: 3654118 - RNA, 18 nt, Salmonella enterica enterica serovar Typhi
cgacggccaguugcgcag

SEQ ID NO: 3654119 - RNA, 14 nt, Salmonella enterica enterica serovar Typhi
cgacggccauaaac

SEQ ID NO: 3654120 - RNA, 17 nt, Salmonella enterica enterica serovar Typhi
cgacggcguauucggca

SEQ ID NO: 3654121 - RNA, 21 nt, Salmonella enterica enterica serovar Typhi
cgacgggcggcgacagagaau

SEQ ID NO: 3654122 - RNA, 16 nt, Salmonella enterica enterica serovar Typhi
cgacggggcgcagaag

SEQ ID NO: 3654123 - RNA, 20 nt, Salmonella enterica enterica serovar Typhi
cgacggugaugacccgcagc

SEQ ID NO: 3654124 - RNA, 18 nt, Salmonella enterica enterica serovar Typhi
cgacuaccgccgauaaac

SEQ ID NO: 3654125 - RNA, 14 nt, Salmonella enterica enterica serovar Typhi
cgacuacgguaaac

SEQ ID NO: 3654126 - RNA, 14 nt, Salmonella enterica enterica serovar Typhi
cgacuaucuucuuc

SEQ ID NO: 3654127 - RNA, 21 nt, Salmonella enterica enterica serovar Typhi
cgacuauuccgcaaacgccgu

SEQ ID NO: 3654128 - RNA, 16 nt, Salmonella enterica enterica serovar Typhi
cgacucacgcagcgcu

SEQ ID NO: 3654129 - RNA, 13 nt, Salmonella enterica enterica serovar Typhi
cgacuccagaaua

SEQ ID NO: 3654130 - RNA, 13 nt, Salmonella enterica enterica serovar Typhi
cgacucucccggc

SEQ ID NO: 3654131 - RNA, 23 nt, Salmonella enterica enterica serovar Typhi
cgacucuguauuuaauaccuggu

SEQ ID NO: 3654132 - RNA, 12 nt, Salmonella enterica enterica serovar Typhi
cgacugaacaua

SEQ ID NO: 3654133 - RNA, 16 nt, Salmonella enterica enterica serovar Typhi
cgacugaccagacaga

SEQ ID NO: 3654134 - RNA, 15 nt, Salmonella enterica enterica serovar Typhi
cgacugauaacggcg

SEQ ID NO: 3654135 - RNA, 21 nt, Salmonella enterica enterica serovar Typhi
cgacugccaccgucgcggcau

SEQ ID NO: 3654136 - RNA, 22 nt, Salmonella enterica enterica serovar Typhi
cgacugcggucguauuuaccgc

SEQ ID NO: 3654137 - RNA, 17 nt, Salmonella enterica enterica serovar Typhi
cgacuuaucuuccacgc

SEQ ID NO: 3654138 - RNA, 14 nt, Salmonella enterica enterica serovar Typhi
cgacuucaagguuc

SEQ ID NO: 3654139 - RNA, 16 nt, Salmonella enterica enterica serovar Typhi
cgacuucauucaggca

SEQ ID NO: 3654140 - RNA, 15 nt, Salmonella enterica enterica serovar Typhi
cgacuucgaagguuc

SEQ ID NO: 3654141 - RNA, 21 nt, Salmonella enterica enterica serovar Typhi
cgacuuuaaacuuauccgcca

SEQ ID NO: 3654142 - RNA, 18 nt, Salmonella enterica enterica serovar Typhi
cgacuuucuucggauuau

SEQ ID NO: 3654143 - RNA, 14 nt, Salmonella enterica enterica serovar Typhi
cgagaaaaaacuca

SEQ ID NO: 3654144 - RNA, 18 nt, Salmonella enterica enterica serovar Typhi
cgagaaaauaccgcacau

SEQ ID NO: 3654145 - RNA, 21 nt, Salmonella enterica enterica serovar Typhi
cgagaaaaucagugaacaccc

SEQ ID NO: 3654146 - RNA, 14 nt, Salmonella enterica enterica serovar Typhi
cgagaaacaccaga

SEQ ID NO: 3654147 - RNA, 15 nt, Salmonella enterica enterica serovar Typhi
cgagaaacaccagaa

SEQ ID NO: 3654148 - RNA, 14 nt, Salmonella enterica enterica serovar Typhi
cgagaaagcguugc

SEQ ID NO: 3654149 - RNA, 22 nt, Salmonella enterica enterica serovar Typhi
cgagaaagcguugccguaggca

SEQ ID NO: 3654150 - RNA, 16 nt, Salmonella enterica enterica serovar Typhi
cgagaaccaacugcca

SEQ ID NO: 3654151 - RNA, 21 nt, Salmonella enterica enterica serovar Typhi
cgagaacugcugcauccgcgc

SEQ ID NO: 3654152 - RNA, 18 nt, Salmonella enterica enterica serovar Typhi
cgagaagaagaauuauua

SEQ ID NO: 3654153 - RNA, 18 nt, Salmonella enterica enterica serovar Typhi
cgagaauacugaagucga

SEQ ID NO: 3654154 - RNA, 17 nt, Salmonella enterica enterica serovar Typhi
cgagaccaucaacagcg

SEQ ID NO: 3654155 - RNA, 17 nt, Salmonella enterica enterica serovar Typhi
cgagacucaaagaaaac

SEQ ID NO: 3654156 - RNA, 13 nt, Salmonella enterica enterica serovar Typhi
cgagagaaaaaaa

SEQ ID NO: 3654157 - RNA, 15 nt, Salmonella enterica enterica serovar Typhi
cgagagaaaaaaauc

SEQ ID NO: 3654158 - RNA, 22 nt, Salmonella enterica enterica serovar Typhi
cgagagauuaagcgaaccuuaa

SEQ ID NO: 3654159 - RNA, 16 nt, Salmonella enterica enterica serovar Typhi
cgagagucaaggcauc

SEQ ID NO: 3654160 - RNA, 17 nt, Salmonella enterica enterica serovar Typhi
cgagaguccagcgccag

SEQ ID NO: 3654161 - RNA, 15 nt, Salmonella enterica enterica serovar Typhi
cgagaguuugugaug

SEQ ID NO: 3654162 - RNA, 13 nt, Salmonella enterica enterica serovar Typhi
cgagauaaaaacg

SEQ ID NO: 3654163 - RNA, 19 nt, Salmonella enterica enterica serovar Typhi
cgagauacugcaacgccag

SEQ ID NO: 3654164 - RNA, 13 nt, Salmonella enterica enterica serovar Typhi
cgagaucaggccg

SEQ ID NO: 3654165 - RNA, 11 nt, Salmonella enterica enterica serovar Typhi
cgagaucgcca

SEQ ID NO: 3654166 - RNA, 13 nt, Salmonella enterica enterica serovar Typhi
cgagaugaaaagu

SEQ ID NO: 3654167 - RNA, 16 nt, Salmonella enterica enterica serovar Typhi
cgagauucaauaaugu

SEQ ID NO: 3654168 - RNA, 21 nt, Salmonella enterica enterica serovar Typhi
cgagauuuaccgggaaauguc

SEQ ID NO: 3654169 - RNA, 16 nt, Salmonella enterica enterica serovar Typhi
cgagauuuuucugcgc

SEQ ID NO: 3654170 - RNA, 20 nt, Salmonella enterica enterica serovar Typhi
cgagauuuuucugcgccacc

SEQ ID NO: 3654171 - RNA, 23 nt, Salmonella enterica enterica serovar Typhi
cgagauuuuucugcgccaccagc

SEQ ID NO: 3654172 - RNA, 21 nt, Salmonella enterica enterica serovar Typhi
cgagcaaaacccggugcggca

SEQ ID NO: 3654173 - RNA, 14 nt, Salmonella enterica enterica serovar Typhi
cgagcacuuuuucc

SEQ ID NO: 3654174 - RNA, 15 nt, Salmonella enterica enterica serovar Typhi
cgagcaggaaccaca

SEQ ID NO: 3654175 - RNA, 20 nt, Salmonella enterica enterica serovar Typhi
cgagcaggaaccacaucgcg

SEQ ID NO: 3654176 - RNA, 16 nt, Salmonella enterica enterica serovar Typhi
cgagcaggaauagcuc

SEQ ID NO: 3654177 - RNA, 17 nt, Salmonella enterica enterica serovar Typhi
cgagcaguucagcagca

SEQ ID NO: 3654178 - RNA, 17 nt, Salmonella enterica enterica serovar Typhi
cgagcaucuccagcgca

SEQ ID NO: 3654179 - RNA, 18 nt, Salmonella enterica enterica serovar Typhi
cgagccgucgccggccug

SEQ ID NO: 3654180 - RNA, 20 nt, Salmonella enterica enterica serovar Typhi
cgagcgaaggggcgggcagc

SEQ ID NO: 3654181 - RNA, 21 nt, Salmonella enterica enterica serovar Typhi
cgagcgaaggggcgggcagca

SEQ ID NO: 3654182 - RNA, 22 nt, Salmonella enterica enterica serovar Typhi
cgagcgaaggggcgggcagcag

SEQ ID NO: 3654183 - RNA, 20 nt, Salmonella enterica enterica serovar Typhi
cgagcgacgcccugcccaug

SEQ ID NO: 3654184 - RNA, 21 nt, Salmonella enterica enterica serovar Typhi
cgagcgauagagaguuccucc

SEQ ID NO: 3654185 - RNA, 23 nt, Salmonella enterica enterica serovar Typhi
cgagcgauagagaguuccuccug

SEQ ID NO: 3654186 - RNA, 15 nt, Salmonella enterica enterica serovar Typhi
cgagcgccguuaaac

SEQ ID NO: 3654187 - RNA, 12 nt, Salmonella enterica enterica serovar Typhi
cgagcgccugau

SEQ ID NO: 3654188 - RNA, 13 nt, Salmonella enterica enterica serovar Typhi
cgagcgccugaug

SEQ ID NO: 3654189 - RNA, 17 nt, Salmonella enterica enterica serovar Typhi
cgagcgcgucagcgccu

SEQ ID NO: 3654190 - RNA, 19 nt, Salmonella enterica enterica serovar Typhi
cgagcggccaaagggagca

SEQ ID NO: 3654191 - RNA, 19 nt, Salmonella enterica enterica serovar Typhi
cgagcuauguuuaagccag

SEQ ID NO: 3654192 - RNA, 15 nt, Salmonella enterica enterica serovar Typhi
cgagcugguuucaau

SEQ ID NO: 3654193 - RNA, 19 nt, Salmonella enterica enterica serovar Typhi
cgauauaucgcgucaucaa

SEQ ID NO: 3654194 - RNA, 20 nt, Salmonella enterica enterica serovar Typhi
cgauauaucgcgucaucaaa

SEQ ID NO: 3654195 - RNA, 14 nt, Salmonella enterica enterica serovar Typhi
cgauauauuuuccg

SEQ ID NO: 3654196 - RNA, 23 nt, Salmonella enterica enterica serovar Typhi
cgauaucagggcuuuuuucucgc

SEQ ID NO: 3654197 - RNA, 16 nt, Salmonella enterica enterica serovar Typhi
cgauaucauucucuac

SEQ ID NO: 3654198 - RNA, 14 nt, Salmonella enterica enterica serovar Typhi
cgauaucgauaaag

SEQ ID NO: 3654199 - RNA, 13 nt, Salmonella enterica enterica serovar Typhi
cgauaucgauaau

SEQ ID NO: 3654200 - RNA, 22 nt, Salmonella enterica enterica serovar Typhi
cgauaucgccuggugugaacau

SEQ ID NO: 3654201 - RNA, 23 nt, Salmonella enterica enterica serovar Typhi
cgauaugaauaauuucggcggcg

SEQ ID NO: 3654202 - RNA, 17 nt, Salmonella enterica enterica serovar Typhi
cgauauguggacgccau

SEQ ID NO: 3654203 - RNA, 18 nt, Salmonella enterica enterica serovar Typhi
cgauauuacuccagcgua

SEQ ID NO: 3654204 - RNA, 23 nt, Salmonella enterica enterica serovar Typhi
cgauauuucgccuaucaugcugc

SEQ ID NO: 3654205 - RNA, 16 nt, Salmonella enterica enterica serovar Typhi
cgauauuuugcugcac

SEQ ID NO: 3654206 - RNA, 12 nt, Salmonella enterica enterica serovar Typhi
cgaucaaucacg

SEQ ID NO: 3654207 - RNA, 12 nt, Salmonella enterica enterica serovar Typhi
cgaucaccacgc

SEQ ID NO: 3654208 - RNA, 15 nt, Salmonella enterica enterica serovar Typhi
cgaucaccacgccuu

SEQ ID NO: 3654209 - RNA, 14 nt, Salmonella enterica enterica serovar Typhi
cgaucaccagcgca

SEQ ID NO: 3654210 - RNA, 23 nt, Salmonella enterica enterica serovar Typhi
cgaucacccacaucagcggcaca

SEQ ID NO: 3654211 - RNA, 21 nt, Salmonella enterica enterica serovar Typhi
cgaucacuucgacaugcguac

SEQ ID NO: 3654212 - RNA, 14 nt, Salmonella enterica enterica serovar Typhi
cgaucagcgccacg

SEQ ID NO: 3654213 - RNA, 22 nt, Salmonella enterica enterica serovar Typhi
cgaucaugagucgcgcgcgcca

SEQ ID NO: 3654214 - RNA, 14 nt, Salmonella enterica enterica serovar Typhi
cgaucaugccgccc

SEQ ID NO: 3654215 - RNA, 15 nt, Salmonella enterica enterica serovar Typhi
cgaucaugccgccca

SEQ ID NO: 3654216 - RNA, 18 nt, Salmonella enterica enterica serovar Typhi
cgaucccaguugaucggc

SEQ ID NO: 3654217 - RNA, 22 nt, Salmonella enterica enterica serovar Typhi
cgaucccaguugaucggccagc

SEQ ID NO: 3654218 - RNA, 18 nt, Salmonella enterica enterica serovar Typhi
cgauccccaacgacagca

SEQ ID NO: 3654219 - RNA, 22 nt, Salmonella enterica enterica serovar Typhi
cgaucccggcaaaaaucagccc

SEQ ID NO: 3654220 - RNA, 18 nt, Salmonella enterica enterica serovar Typhi
cgaucccgggcgauaaac

SEQ ID NO: 3654221 - RNA, 14 nt, Salmonella enterica enterica serovar Typhi
cgaucccuaauaaa

SEQ ID NO: 3654222 - RNA, 16 nt, Salmonella enterica enterica serovar Typhi
cgauccgaagaacaga

SEQ ID NO: 3654223 - RNA, 18 nt, Salmonella enterica enterica serovar Typhi
cgauccgcgagacgccug

SEQ ID NO: 3654224 - RNA, 21 nt, Salmonella enterica enterica serovar Typhi
cgauccggcauccaaccgaac

SEQ ID NO: 3654225 - RNA, 20 nt, Salmonella enterica enterica serovar Typhi
cgaucgaugugauaaaugcg

SEQ ID NO: 3654226 - RNA, 20 nt, Salmonella enterica enterica serovar Typhi
cgaucgccagcuacgacaag

SEQ ID NO: 3654227 - RNA, 23 nt, Salmonella enterica enterica serovar Typhi
cgaucgcgauucgcccacggaug

SEQ ID NO: 3654228 - RNA, 22 nt, Salmonella enterica enterica serovar Typhi
cgaucgcgccaucgauagucau

SEQ ID NO: 3654229 - RNA, 12 nt, Salmonella enterica enterica serovar Typhi
cgaucgcggcaa

SEQ ID NO: 3654230 - RNA, 18 nt, Salmonella enterica enterica serovar Typhi
cgaucgcucaacuccugc

SEQ ID NO: 3654231 - RNA, 12 nt, Salmonella enterica enterica serovar Typhi
cgaucuauuuca

SEQ ID NO: 3654232 - RNA, 16 nt, Salmonella enterica enterica serovar Typhi
cgaucuccgccgucgu

SEQ ID NO: 3654233 - RNA, 12 nt, Salmonella enterica enterica serovar Typhi
cgaucugagcgc

SEQ ID NO: 3654234 - RNA, 19 nt, Salmonella enterica enterica serovar Typhi
cgaucugguuauccaccag

SEQ ID NO: 3654235 - RNA, 20 nt, Salmonella enterica enterica serovar Typhi
cgaucuguacggcauauucc

SEQ ID NO: 3654236 - RNA, 23 nt, Salmonella enterica enterica serovar Typhi
cgaucuguguacuuuuaacgccc

SEQ ID NO: 3654237 - RNA, 19 nt, Salmonella enterica enterica serovar Typhi
cgaucugugucguccaggc

SEQ ID NO: 3654238 - RNA, 15 nt, Salmonella enterica enterica serovar Typhi
cgaugaaaaacugga

SEQ ID NO: 3654239 - RNA, 14 nt, Salmonella enterica enterica serovar Typhi
cgaugaaaaagagg

SEQ ID NO: 3654240 - RNA, 23 nt, Salmonella enterica enterica serovar Typhi
cgaugacagcaggaacggcagga

SEQ ID NO: 3654241 - RNA, 13 nt, Salmonella enterica enterica serovar Typhi
cgaugaccaucaa

SEQ ID NO: 3654242 - RNA, 17 nt, Salmonella enterica enterica serovar Typhi
cgaugacgacuuuuugc

SEQ ID NO: 3654243 - RNA, 20 nt, Salmonella enterica enterica serovar Typhi
cgaugacucguauuuaaacc

SEQ ID NO: 3654244 - RNA, 17 nt, Salmonella enterica enterica serovar Typhi
cgaugagauaauaaaug

SEQ ID NO: 3654245 - RNA, 19 nt, Salmonella enterica enterica serovar Typhi
cgaugagcgccagcaacag

SEQ ID NO: 3654246 - RNA, 22 nt, Salmonella enterica enterica serovar Typhi
cgaugagcucguuauaagcuuu

SEQ ID NO: 3654247 - RNA, 23 nt, Salmonella enterica enterica serovar Typhi
cgaugagcuugcacuaucgggca

SEQ ID NO: 3654248 - RNA, 16 nt, Salmonella enterica enterica serovar Typhi
cgaugaguucaguaug

SEQ ID NO: 3654249 - RNA, 19 nt, Salmonella enterica enterica serovar Typhi
cgaugauaacgcgccgcgc

SEQ ID NO: 3654250 - RNA, 18 nt, Salmonella enterica enterica serovar Typhi
cgaugauauccagcacgc

SEQ ID NO: 3654251 - RNA, 18 nt, Salmonella enterica enterica serovar Typhi
cgaugaucgaggcgugcg

SEQ ID NO: 3654252 - RNA, 20 nt, Salmonella enterica enterica serovar Typhi
cgaugaucgucgcgaucgcg

SEQ ID NO: 3654253 - RNA, 21 nt, Salmonella enterica enterica serovar Typhi
cgaugauuauuguuaaaaaga

SEQ ID NO: 3654254 - RNA, 22 nt, Salmonella enterica enterica serovar Typhi
cgaugcccugugcaaucagcga

SEQ ID NO: 3654255 - RNA, 16 nt, Salmonella enterica enterica serovar Typhi
cgaugccgccgcaacg

SEQ ID NO: 3654256 - RNA, 19 nt, Salmonella enterica enterica serovar Typhi
cgaugccguuuuaacguca

SEQ ID NO: 3654257 - RNA, 17 nt, Salmonella enterica enterica serovar Typhi
cgaugccuuauccggcc

SEQ ID NO: 3654258 - RNA, 19 nt, Salmonella enterica enterica serovar Typhi
cgaugcgcgagccguaaac

SEQ ID NO: 3654259 - RNA, 19 nt, Salmonella enterica enterica serovar Typhi
cgaugcgcguuuuccacca

SEQ ID NO: 3654260 - RNA, 15 nt, Salmonella enterica enterica serovar Typhi
cgaugcgcuuuucca

SEQ ID NO: 3654261 - RNA, 14 nt, Salmonella enterica enterica serovar Typhi
cgaugcggauccgg

SEQ ID NO: 3654262 - RNA, 23 nt, Salmonella enterica enterica serovar Typhi
cgaugcgguucaacgcgcugcag

SEQ ID NO: 3654263 - RNA, 16 nt, Salmonella enterica enterica serovar Typhi
cgaugcucaaccagua

SEQ ID NO: 3654264 - RNA, 23 nt, Salmonella enterica enterica serovar Typhi
cgaugcucaaccaguaccgggcc

SEQ ID NO: 3654265 - RNA, 22 nt, Salmonella enterica enterica serovar Typhi
cgaugcucagggcauccgccgc

SEQ ID NO: 3654266 - RNA, 17 nt, Salmonella enterica enterica serovar Typhi
cgaugcugcuccaucuc

SEQ ID NO: 3654267 - RNA, 14 nt, Salmonella enterica enterica serovar Typhi
cgauggcaaauaau

SEQ ID NO: 3654268 - RNA, 16 nt, Salmonella enterica enterica serovar Typhi
cgauggcaaauaauac

SEQ ID NO: 3654269 - RNA, 22 nt, Salmonella enterica enterica serovar Typhi
cgauggcaaauaauaccacgau

SEQ ID NO: 3654270 - RNA, 13 nt, Salmonella enterica enterica serovar Typhi
cgauggugccgac

SEQ ID NO: 3654271 - RNA, 17 nt, Salmonella enterica enterica serovar Typhi
cgauggugccgacaacc

SEQ ID NO: 3654272 - RNA, 14 nt, Salmonella enterica enterica serovar Typhi
cgauggugcggcgc

SEQ ID NO: 3654273 - RNA, 20 nt, Salmonella enterica enterica serovar Typhi
cgauggugcggcgcacugcc

SEQ ID NO: 3654274 - RNA, 21 nt, Salmonella enterica enterica serovar Typhi
cgaugguguuggcaaucagcg

SEQ ID NO: 3654275 - RNA, 23 nt, Salmonella enterica enterica serovar Typhi
cgaugugcguauugagcgcagug

SEQ ID NO: 3654276 - RNA, 14 nt, Salmonella enterica enterica serovar Typhi
cgauguucgauaau

SEQ ID NO: 3654277 - RNA, 16 nt, Salmonella enterica enterica serovar Typhi
cgauguucuugccgcc

SEQ ID NO: 3654278 - RNA, 21 nt, Salmonella enterica enterica serovar Typhi
cgcacgcgacgcgccagccag

SEQ ID NO: 3654279 - RNA, 12 nt, Salmonella enterica enterica serovar Typhi
cgcacgcgcgcc

SEQ ID NO: 3654280 - RNA, 22 nt, Salmonella enterica enterica serovar Typhi
cgcacggcgcguccucacacug

SEQ ID NO: 3654281 - RNA, 23 nt, Salmonella enterica enterica serovar Typhi
cgcacguuuugguccaugccggc

SEQ ID NO: 3654282 - RNA, 15 nt, Salmonella enterica enterica serovar Typhi
cgcacuaccagcucg

SEQ ID NO: 3654283 - RNA, 17 nt, Salmonella enterica enterica serovar Typhi
cgcacuacggcaaacgc

SEQ ID NO: 3654284 - RNA, 14 nt, Salmonella enterica enterica serovar Typhi
cgcacucagaaaau

SEQ ID NO: 3654285 - RNA, 14 nt, Salmonella enterica enterica serovar Typhi
cgcacuccagaugc

SEQ ID NO: 3654286 - RNA, 13 nt, Salmonella enterica enterica serovar Typhi
cgcacuccccaga

SEQ ID NO: 3654287 - RNA, 18 nt, Salmonella enterica enterica serovar Typhi
cgcacugauagccgccag

SEQ ID NO: 3654288 - RNA, 19 nt, Salmonella enterica enterica serovar Typhi
cgcacugauagccgccagu

SEQ ID NO: 3654289 - RNA, 19 nt, Salmonella enterica enterica serovar Typhi
cgcacuggcgagcggcacc

SEQ ID NO: 3654290 - RNA, 14 nt, Salmonella enterica enterica serovar Typhi
cgcacuuuuccagc

SEQ ID NO: 3654291 - RNA, 15 nt, Salmonella enterica enterica serovar Typhi
cgcacuuuuccagcc

SEQ ID NO: 3654292 - RNA, 16 nt, Salmonella enterica enterica serovar Typhi
cgcacuuuucccgcca

SEQ ID NO: 3654293 - RNA, 13 nt, Salmonella enterica enterica serovar Typhi
cgcagaaucagcg

SEQ ID NO: 3654294 - RNA, 15 nt, Salmonella enterica enterica serovar Typhi
cgcagaauuuauuuc

SEQ ID NO: 3654295 - RNA, 15 nt, Salmonella enterica enterica serovar Typhi
cgcagaccaaaguca

SEQ ID NO: 3654296 - RNA, 16 nt, Salmonella enterica enterica serovar Typhi
cgcagacgccgcgguu

SEQ ID NO: 3654297 - RNA, 14 nt, Salmonella enterica enterica serovar Typhi
cgcagagauagcca

SEQ ID NO: 3654298 - RNA, 18 nt, Salmonella enterica enterica serovar Typhi
cgcagagauagccagcga

SEQ ID NO: 3654299 - RNA, 21 nt, Salmonella enterica enterica serovar Typhi
cgcagaguaaaaaaaccggcg

SEQ ID NO: 3654300 - RNA, 15 nt, Salmonella enterica enterica serovar Typhi
cgcagagucgcagcg

SEQ ID NO: 3654301 - RNA, 21 nt, Salmonella enterica enterica serovar Typhi
cgcagauaucuuccagcgcgu

SEQ ID NO: 3654302 - RNA, 12 nt, Salmonella enterica enterica serovar Typhi
cgcagaucgccu

SEQ ID NO: 3654303 - RNA, 14 nt, Salmonella enterica enterica serovar Typhi
cgcagaucgccugg

SEQ ID NO: 3654304 - RNA, 23 nt, Salmonella enterica enterica serovar Typhi
cgcagaucguauccagcggcaaa

SEQ ID NO: 3654305 - RNA, 15 nt, Salmonella enterica enterica serovar Typhi
cgcagcaaacgccau

SEQ ID NO: 3654306 - RNA, 14 nt, Salmonella enterica enterica serovar Typhi
cgcagcaacgguuu

SEQ ID NO: 3654307 - RNA, 15 nt, Salmonella enterica enterica serovar Typhi
cgcagcaagaacaga

SEQ ID NO: 3654308 - RNA, 12 nt, Salmonella enterica enterica serovar Typhi
cgcagcaccgcc

SEQ ID NO: 3654309 - RNA, 20 nt, Salmonella enterica enterica serovar Typhi
cgcagcagauguggcggccc

SEQ ID NO: 3654310 - RNA, 21 nt, Salmonella enterica enterica serovar Typhi
cgcagcaguuggcggagguga

SEQ ID NO: 3654311 - RNA, 14 nt, Salmonella enterica enterica serovar Typhi
cgcagcaucgccau

SEQ ID NO: 3654312 - RNA, 11 nt, Salmonella enterica enterica serovar Typhi
cgcagccagaa

SEQ ID NO: 3654313 - RNA, 17 nt, Salmonella enterica enterica serovar Typhi
cgcagccagaacagaag

SEQ ID NO: 3654314 - RNA, 12 nt, Salmonella enterica enterica serovar Typhi
cgcagccccagc

SEQ ID NO: 3654315 - RNA, 13 nt, Salmonella enterica enterica serovar Typhi
cgcagccccagcg

SEQ ID NO: 3654316 - RNA, 22 nt, Salmonella enterica enterica serovar Typhi
cgcagccccagcgccagccgcg

SEQ ID NO: 3654317 - RNA, 16 nt, Salmonella enterica enterica serovar Typhi
cgcagcccugcgucgc

SEQ ID NO: 3654318 - RNA, 20 nt, Salmonella enterica enterica serovar Typhi
cgcagccgccauccggcaca

SEQ ID NO: 3654319 - RNA, 16 nt, Salmonella enterica enterica serovar Typhi
cgcagcgaaaauccag

SEQ ID NO: 3654320 - RNA, 22 nt, Salmonella enterica enterica serovar Typhi
cgcagcgaccuccgcgcagcaa

SEQ ID NO: 3654321 - RNA, 15 nt, Salmonella enterica enterica serovar Typhi
cgcagcgauauuucu

SEQ ID NO: 3654322 - RNA, 14 nt, Salmonella enterica enterica serovar Typhi
cgcagcgccauccg

SEQ ID NO: 3654323 - RNA, 19 nt, Salmonella enterica enterica serovar Typhi
cgcagcgccauccggcaaa

SEQ ID NO: 3654324 - RNA, 17 nt, Salmonella enterica enterica serovar Typhi
cgcagcgccugcgccgc

SEQ ID NO: 3654325 - RNA, 14 nt, Salmonella enterica enterica serovar Typhi
cgcagcgccuucgc

SEQ ID NO: 3654326 - RNA, 12 nt, Salmonella enterica enterica serovar Typhi
cgcagcgcggcc

SEQ ID NO: 3654327 - RNA, 13 nt, Salmonella enterica enterica serovar Typhi
cgcagcgcggccu

SEQ ID NO: 3654328 - RNA, 23 nt, Salmonella enterica enterica serovar Typhi
cgcagcgcuuugccgcugcugcc

SEQ ID NO: 3654329 - RNA, 19 nt, Salmonella enterica enterica serovar Typhi
cgcagcggcauuggcguua

SEQ ID NO: 3654330 - RNA, 12 nt, Salmonella enterica enterica serovar Typhi
cgcagcggcggu

SEQ ID NO: 3654331 - RNA, 14 nt, Salmonella enterica enterica serovar Typhi
cgcagcgugaaacg

SEQ ID NO: 3654332 - RNA, 17 nt, Salmonella enterica enterica serovar Typhi
cgcagcgugaaacgccc

SEQ ID NO: 3654333 - RNA, 19 nt, Salmonella enterica enterica serovar Typhi
cgcagcugccacaccacau

SEQ ID NO: 3654334 - RNA, 22 nt, Salmonella enterica enterica serovar Typhi
cgcagcugccacaccacaugcg

SEQ ID NO: 3654335 - RNA, 15 nt, Salmonella enterica enterica serovar Typhi
cgcagcugggccugc

SEQ ID NO: 3654336 - RNA, 14 nt, Salmonella enterica enterica serovar Typhi
cgcagcugguugau

SEQ ID NO: 3654337 - RNA, 15 nt, Salmonella enterica enterica serovar Typhi
cgcagcuucgccgcg

SEQ ID NO: 3654338 - RNA, 14 nt, Salmonella enterica enterica serovar Typhi
cgcaggaagcauau

SEQ ID NO: 3654339 - RNA, 13 nt, Salmonella enterica enterica serovar Typhi
cgcaggagagcca

SEQ ID NO: 3654340 - RNA, 13 nt, Salmonella enterica enterica serovar Typhi
cgcaggagggagg

SEQ ID NO: 3654341 - RNA, 21 nt, Salmonella enterica enterica serovar Typhi
cgcaggauaaagaccggcaca

SEQ ID NO: 3654342 - RNA, 15 nt, Salmonella enterica enterica serovar Typhi
cgcaggcaacggccc

SEQ ID NO: 3654343 - RNA, 22 nt, Salmonella enterica enterica serovar Typhi
cgcaggcauuaaaaaaacguag

SEQ ID NO: 3654344 - RNA, 14 nt, Salmonella enterica enterica serovar Typhi
cgcaggccaucaua

SEQ ID NO: 3654345 - RNA, 16 nt, Salmonella enterica enterica serovar Typhi
cgcaggcuaacgcgcc

SEQ ID NO: 3654346 - RNA, 15 nt, Salmonella enterica enterica serovar Typhi
cgcaggcuugcccau

SEQ ID NO: 3654347 - RNA, 20 nt, Salmonella enterica enterica serovar Typhi
cgcagggcgucuuauccggc

SEQ ID NO: 3654348 - RNA, 17 nt, Salmonella enterica enterica serovar Typhi
cgcagguuaaagccucu

SEQ ID NO: 3654349 - RNA, 16 nt, Salmonella enterica enterica serovar Typhi
cgcaguaaacuccucu

SEQ ID NO: 3654350 - RNA, 18 nt, Salmonella enterica enterica serovar Typhi
cgcaguaauacgccgccg

SEQ ID NO: 3654351 - RNA, 15 nt, Salmonella enterica enterica serovar Typhi
cgcaguaaucaccgu

SEQ ID NO: 3654352 - RNA, 22 nt, Salmonella enterica enterica serovar Typhi
cgcaguaaucaccgucuccggc

SEQ ID NO: 3654353 - RNA, 14 nt, Salmonella enterica enterica serovar Typhi
cgcaguacggcgca

SEQ ID NO: 3654354 - RNA, 16 nt, Salmonella enterica enterica serovar Typhi
cgcagucaagcuugcc

SEQ ID NO: 3654355 - RNA, 18 nt, Salmonella enterica enterica serovar Typhi
cgcagucagcacuggcga

SEQ ID NO: 3654356 - RNA, 22 nt, Salmonella enterica enterica serovar Typhi
cgcaguccagaugcgccagauu

SEQ ID NO: 3654357 - RNA, 16 nt, Salmonella enterica enterica serovar Typhi
cgcagucguuccagac

SEQ ID NO: 3654358 - RNA, 14 nt, Salmonella enterica enterica serovar Typhi
cgcagugaccagca

SEQ ID NO: 3654359 - RNA, 16 nt, Salmonella enterica enterica serovar Typhi
cgcagugaccagcauc

SEQ ID NO: 3654360 - RNA, 17 nt, Salmonella enterica enterica serovar Typhi
cgcagugaccagcauca

SEQ ID NO: 3654361 - RNA, 16 nt, Salmonella enterica enterica serovar Typhi
cgcagugcagcggaug

SEQ ID NO: 3654362 - RNA, 12 nt, Salmonella enterica enterica serovar Typhi
cgcaguucaaua

SEQ ID NO: 3654363 - RNA, 16 nt, Salmonella enterica enterica serovar Typhi
cgcaguucaauauuca

SEQ ID NO: 3654364 - RNA, 19 nt, Salmonella enterica enterica serovar Typhi
cgcaguucauccacgcggg

SEQ ID NO: 3654365 - RNA, 13 nt, Salmonella enterica enterica serovar Typhi
cgccaacgccagc

SEQ ID NO: 3654366 - RNA, 17 nt, Salmonella enterica enterica serovar Typhi
cgccaacgccggcaaca

SEQ ID NO: 3654367 - RNA, 15 nt, Salmonella enterica enterica serovar Typhi
cgccaacguccgccg

SEQ ID NO: 3654368 - RNA, 16 nt, Salmonella enterica enterica serovar Typhi
cgccaacuuuuugcgc

SEQ ID NO: 3654369 - RNA, 21 nt, Salmonella enterica enterica serovar Typhi
cgccaacuuuuugcgcaauac

SEQ ID NO: 3654370 - RNA, 21 nt, Salmonella enterica enterica serovar Typhi
cgccaagaaggguauccagcg

SEQ ID NO: 3654371 - RNA, 13 nt, Salmonella enterica enterica serovar Typhi
cgccaagcgcggc

SEQ ID NO: 3654372 - RNA, 13 nt, Salmonella enterica enterica serovar Typhi
cgccaagcggcaa

SEQ ID NO: 3654373 - RNA, 13 nt, Salmonella enterica enterica serovar Typhi
cgccaauaaagcu

SEQ ID NO: 3654374 - RNA, 15 nt, Salmonella enterica enterica serovar Typhi
cgccaauaccgccgu

SEQ ID NO: 3654375 - RNA, 12 nt, Salmonella enterica enterica serovar Typhi
cgccaauaucca

SEQ ID NO: 3654376 - RNA, 14 nt, Salmonella enterica enterica serovar Typhi
cgccaauauccauu

SEQ ID NO: 3654377 - RNA, 17 nt, Salmonella enterica enterica serovar Typhi
cgccaaucaccgccagc

SEQ ID NO: 3654378 - RNA, 18 nt, Salmonella enterica enterica serovar Typhi
cgccaaucaccgccagca

SEQ ID NO: 3654379 - RNA, 12 nt, Salmonella enterica enterica serovar Typhi
cgccaaucagca

SEQ ID NO: 3654380 - RNA, 15 nt, Salmonella enterica enterica serovar Typhi
cgccaauccaugccg

SEQ ID NO: 3654381 - RNA, 15 nt, Salmonella enterica enterica serovar Typhi
cgccaauugaugaac

SEQ ID NO: 3654382 - RNA, 14 nt, Salmonella enterica enterica serovar Typhi
cgccacaaaagauu

SEQ ID NO: 3654383 - RNA, 14 nt, Salmonella enterica enterica serovar Typhi
cgccacaauauccg

SEQ ID NO: 3654384 - RNA, 18 nt, Salmonella enterica enterica serovar Typhi
cgccacaauauccgcccc

SEQ ID NO: 3654385 - RNA, 23 nt, Salmonella enterica enterica serovar Typhi
cgccacaccgagacagagaaccu

SEQ ID NO: 3654386 - RNA, 14 nt, Salmonella enterica enterica serovar Typhi
cgccacauucaauu

SEQ ID NO: 3654387 - RNA, 15 nt, Salmonella enterica enterica serovar Typhi
cgccacauugcgcgc

SEQ ID NO: 3654388 - RNA, 17 nt, Salmonella enterica enterica serovar Typhi
cgccacauugcgcgccg

SEQ ID NO: 3654389 - RNA, 12 nt, Salmonella enterica enterica serovar Typhi
cgccaccacaaa

SEQ ID NO: 3654390 - RNA, 22 nt, Salmonella enterica enterica serovar Typhi
cgccaccacagucaucgcgcca

SEQ ID NO: 3654391 - RNA, 16 nt, Salmonella enterica enterica serovar Typhi
cgccaccaccagcgua

SEQ ID NO: 3654392 - RNA, 13 nt, Salmonella enterica enterica serovar Typhi
cgccaccacgccg

SEQ ID NO: 3654393 - RNA, 16 nt, Salmonella enterica enterica serovar Typhi
cgccaccacucggcga

SEQ ID NO: 3654394 - RNA, 14 nt, Salmonella enterica enterica serovar Typhi
cgccacccaacauc

SEQ ID NO: 3654395 - RNA, 13 nt, Salmonella enterica enterica serovar Typhi
cgccacccggcuu

SEQ ID NO: 3654396 - RNA, 13 nt, Salmonella enterica enterica serovar Typhi
cgccaccgccagc

SEQ ID NO: 3654397 - RNA, 16 nt, Salmonella enterica enterica serovar Typhi
cgccaccgccagccau

SEQ ID NO: 3654398 - RNA, 18 nt, Salmonella enterica enterica serovar Typhi
cgccaccgccagccaugg

SEQ ID NO: 3654399 - RNA, 17 nt, Salmonella enterica enterica serovar Typhi
cgccaccgccgccacca

SEQ ID NO: 3654400 - RNA, 13 nt, Salmonella enterica enterica serovar Typhi
cgccaccgccgcu

SEQ ID NO: 3654401 - RNA, 22 nt, Salmonella enterica enterica serovar Typhi
cgccaccgggccgucagggucu

SEQ ID NO: 3654402 - RNA, 20 nt, Salmonella enterica enterica serovar Typhi
cgccaccggguuaaagcccu

SEQ ID NO: 3654403 - RNA, 19 nt, Salmonella enterica enterica serovar Typhi
cgccaccucgcgacgguga

SEQ ID NO: 3654404 - RNA, 22 nt, Salmonella enterica enterica serovar Typhi
cgccaccugaauaacccgcagc

SEQ ID NO: 3654405 - RNA, 18 nt, Salmonella enterica enterica serovar Typhi
cgccaccuuaaucgacuu

SEQ ID NO: 3654406 - RNA, 21 nt, Salmonella enterica enterica serovar Typhi
cgccacgacgcugguuccccg

SEQ ID NO: 3654407 - RNA, 22 nt, Salmonella enterica enterica serovar Typhi
cgccacgcagauaucuuccagc

SEQ ID NO: 3654408 - RNA, 15 nt, Salmonella enterica enterica serovar Typhi
cgccacgccaccggg

SEQ ID NO: 3654409 - RNA, 19 nt, Salmonella enterica enterica serovar Typhi
cgccacgcccaacauaaac

SEQ ID NO: 3654410 - RNA, 19 nt, Salmonella enterica enterica serovar Typhi
cgccacgccgcuccacagc

SEQ ID NO: 3654411 - RNA, 16 nt, Salmonella enterica enterica serovar Typhi
cgccacgccuaaacug

SEQ ID NO: 3654412 - RNA, 21 nt, Salmonella enterica enterica serovar Typhi
cgccacgcuccuucuucgccg

SEQ ID NO: 3654413 - RNA, 14 nt, Salmonella enterica enterica serovar Typhi
cgccacggcuuuca

SEQ ID NO: 3654414 - RNA, 17 nt, Salmonella enterica enterica serovar Typhi
cgccacucuggcgacgc

SEQ ID NO: 3654415 - RNA, 15 nt, Salmonella enterica enterica serovar Typhi
cgccacuuccagcgc

SEQ ID NO: 3654416 - RNA, 19 nt, Salmonella enterica enterica serovar Typhi
cgccacuuccagcgcgccg

SEQ ID NO: 3654417 - RNA, 20 nt, Salmonella enterica enterica serovar Typhi
cgccacuuccagcgcgccgu

SEQ ID NO: 3654418 - RNA, 17 nt, Salmonella enterica enterica serovar Typhi
cgccagaaaagaaccga

SEQ ID NO: 3654419 - RNA, 17 nt, Salmonella enterica enterica serovar Typhi
cgccagaagccgucgau

SEQ ID NO: 3654420 - RNA, 22 nt, Salmonella enterica enterica serovar Typhi
cgccagacacuggaaacagcca

SEQ ID NO: 3654421 - RNA, 14 nt, Salmonella enterica enterica serovar Typhi
cgccagacccagcg

SEQ ID NO: 3654422 - RNA, 16 nt, Salmonella enterica enterica serovar Typhi
cgccagaccgacgcca

SEQ ID NO: 3654423 - RNA, 15 nt, Salmonella enterica enterica serovar Typhi
cgccagacgccauau

SEQ ID NO: 3654424 - RNA, 14 nt, Salmonella enterica enterica serovar Typhi
cgccagacgcgcau

SEQ ID NO: 3654425 - RNA, 21 nt, Salmonella enterica enterica serovar Typhi
cgccagagcacgaaaagugug

SEQ ID NO: 3654426 - RNA, 15 nt, Salmonella enterica enterica serovar Typhi
cgccagaggcgugca

SEQ ID NO: 3654427 - RNA, 22 nt, Salmonella enterica enterica serovar Typhi
cgccagaggcgugcaugggcag

SEQ ID NO: 3654428 - RNA, 20 nt, Salmonella enterica enterica serovar Typhi
cgccagauaaagcgaauaac

SEQ ID NO: 3654429 - RNA, 16 nt, Salmonella enterica enterica serovar Typhi
cgccagauaaaucagc

SEQ ID NO: 3654430 - RNA, 19 nt, Salmonella enterica enterica serovar Typhi
cgccagauaaucgccgcca

SEQ ID NO: 3654431 - RNA, 20 nt, Salmonella enterica enterica serovar Typhi
cgccagauaaucgccgccag

SEQ ID NO: 3654432 - RNA, 17 nt, Salmonella enterica enterica serovar Typhi
cgccagaucaggcguca

SEQ ID NO: 3654433 - RNA, 23 nt, Salmonella enterica enterica serovar Typhi
cgccagaucaggcgucagcaugg

SEQ ID NO: 3654434 - RNA, 22 nt, Salmonella enterica enterica serovar Typhi
cgccagauccggcagcgggcaa

SEQ ID NO: 3654435 - RNA, 22 nt, Salmonella enterica enterica serovar Typhi
cgccagaucgaacagcggcagg

SEQ ID NO: 3654436 - RNA, 15 nt, Salmonella enterica enterica serovar Typhi
cgccagauggcguca

SEQ ID NO: 3654437 - RNA, 17 nt, Salmonella enterica enterica serovar Typhi
cgccagauucaugauuu

SEQ ID NO: 3654438 - RNA, 19 nt, Salmonella enterica enterica serovar Typhi
cgccagcaacagguacccc

SEQ ID NO: 3654439 - RNA, 15 nt, Salmonella enterica enterica serovar Typhi
cgccagcaacgccca

SEQ ID NO: 3654440 - RNA, 15 nt, Salmonella enterica enterica serovar Typhi
cgccagcaaugccgc

SEQ ID NO: 3654441 - RNA, 21 nt, Salmonella enterica enterica serovar Typhi
cgccagcaaugccgccgccag

SEQ ID NO: 3654442 - RNA, 23 nt, Salmonella enterica enterica serovar Typhi
cgccagcacauuaagcauggcgu

SEQ ID NO: 3654443 - RNA, 14 nt, Salmonella enterica enterica serovar Typhi
cgccagcaccacgu

SEQ ID NO: 3654444 - RNA, 14 nt, Salmonella enterica enterica serovar Typhi
cgccagcaccagca

SEQ ID NO: 3654445 - RNA, 15 nt, Salmonella enterica enterica serovar Typhi
cgccagcaccagcag

SEQ ID NO: 3654446 - RNA, 16 nt, Salmonella enterica enterica serovar Typhi
cgccagcaccagcagc

SEQ ID NO: 3654447 - RNA, 13 nt, Salmonella enterica enterica serovar Typhi
cgccagcagcagc

SEQ ID NO: 3654448 - RNA, 23 nt, Salmonella enterica enterica serovar Typhi
cgccagcaggucgcacuccucug

SEQ ID NO: 3654449 - RNA, 16 nt, Salmonella enterica enterica serovar Typhi
cgccagcaguugcagc

SEQ ID NO: 3654450 - RNA, 21 nt, Salmonella enterica enterica serovar Typhi
cgccagccacaagagcagcaa

SEQ ID NO: 3654451 - RNA, 18 nt, Salmonella enterica enterica serovar Typhi
cgccaucaggcuggguaa

SEQ ID NO: 3654452 - RNA, 19 nt, Salmonella enterica enterica serovar Typhi
cgccaucaggcuggguaac

SEQ ID NO: 3654453 - RNA, 23 nt, Salmonella enterica enterica serovar Typhi
cgccaucaguucggcgcgccagc

SEQ ID NO: 3654454 - RNA, 16 nt, Salmonella enterica enterica serovar Typhi
cgccaucauccggcaa

SEQ ID NO: 3654455 - RNA, 17 nt, Salmonella enterica enterica serovar Typhi
cgccauccaccaggcau

SEQ ID NO: 3654456 - RNA, 12 nt, Salmonella enterica enterica serovar Typhi
cgccauccacgg

SEQ ID NO: 3654457 - RNA, 18 nt, Salmonella enterica enterica serovar Typhi
cgccauccgacacagcgu

SEQ ID NO: 3654458 - RNA, 11 nt, Salmonella enterica enterica serovar Typhi
cgccauccggc

SEQ ID NO: 3654459 - RNA, 13 nt, Salmonella enterica enterica serovar Typhi
cgccauccggcaa

SEQ ID NO: 3654460 - RNA, 14 nt, Salmonella enterica enterica serovar Typhi
cgccauccggcaac

SEQ ID NO: 3654461 - RNA, 14 nt, Salmonella enterica enterica serovar Typhi
cgccauccggcaau

SEQ ID NO: 3654462 - RNA, 17 nt, Salmonella enterica enterica serovar Typhi
cgccauccggcaaugau

SEQ ID NO: 3654463 - RNA, 19 nt, Salmonella enterica enterica serovar Typhi
cgccauccggcacggucaa

SEQ ID NO: 3654464 - RNA, 13 nt, Salmonella enterica enterica serovar Typhi
cgccauccggcau

SEQ ID NO: 3654465 - RNA, 18 nt, Salmonella enterica enterica serovar Typhi
cgccauccggcaucacgu

SEQ ID NO: 3654466 - RNA, 15 nt, Salmonella enterica enterica serovar Typhi
cgccauccggcauuu

SEQ ID NO: 3654467 - RNA, 17 nt, Salmonella enterica enterica serovar Typhi
cgccauccggcauuuuu

SEQ ID NO: 3654468 - RNA, 14 nt, Salmonella enterica enterica serovar Typhi
cgccauccggccug

SEQ ID NO: 3654469 - RNA, 13 nt, Salmonella enterica enterica serovar Typhi
cgccauccggcga

SEQ ID NO: 3654470 - RNA, 14 nt, Salmonella enterica enterica serovar Typhi
cgccauccggcgag

SEQ ID NO: 3654471 - RNA, 15 nt, Salmonella enterica enterica serovar Typhi
cgccauccggcgaga

SEQ ID NO: 3654472 - RNA, 22 nt, Salmonella enterica enterica serovar Typhi
cgccauccgguaaacgugcugg

SEQ ID NO: 3654473 - RNA, 23 nt, Salmonella enterica enterica serovar Typhi
cgccauccuuaauugccgcacgc

SEQ ID NO: 3654474 - RNA, 14 nt, Salmonella enterica enterica serovar Typhi
cgccaucgccgccu

SEQ ID NO: 3654475 - RNA, 17 nt, Salmonella enterica enterica serovar Typhi
cgccaucgccgccucgc

SEQ ID NO: 3654476 - RNA, 19 nt, Salmonella enterica enterica serovar Typhi
cgccaucgccgccucgcgu

SEQ ID NO: 3654477 - RNA, 21 nt, Salmonella enterica enterica serovar Typhi
cgccaucgcgaauuucaaucg

SEQ ID NO: 3654478 - RNA, 14 nt, Salmonella enterica enterica serovar Typhi
cgccaucgcggcgc

SEQ ID NO: 3654479 - RNA, 14 nt, Salmonella enterica enterica serovar Typhi
cgccaucggcgagc

SEQ ID NO: 3654480 - RNA, 20 nt, Salmonella enterica enterica serovar Typhi
cgccaucggcgcguaaguuu

SEQ ID NO: 3654481 - RNA, 18 nt, Salmonella enterica enterica serovar Typhi
cgccaucguaugcugucg

SEQ ID NO: 3654482 - RNA, 15 nt, Salmonella enterica enterica serovar Typhi
cgccaucgucacgca

SEQ ID NO: 3654483 - RNA, 17 nt, Salmonella enterica enterica serovar Typhi
cgccaucguccagccau

SEQ ID NO: 3654484 - RNA, 14 nt, Salmonella enterica enterica serovar Typhi
cgccaucucacgca

SEQ ID NO: 3654485 - RNA, 17 nt, Salmonella enterica enterica serovar Typhi
cgccaucucacgcaugg

SEQ ID NO: 3654486 - RNA, 18 nt, Salmonella enterica enterica serovar Typhi
cgccaucucauucgccag

SEQ ID NO: 3654487 - RNA, 19 nt, Salmonella enterica enterica serovar Typhi
cgccaucucauucgccagc

SEQ ID NO: 3654488 - RNA, 23 nt, Salmonella enterica enterica serovar Typhi
cgccaucucauucgccagcggau

SEQ ID NO: 3654489 - RNA, 14 nt, Salmonella enterica enterica serovar Typhi
cgccaucugugcca

SEQ ID NO: 3654490 - RNA, 16 nt, Salmonella enterica enterica serovar Typhi
cgccaucugugccagc

SEQ ID NO: 3654491 - RNA, 15 nt, Salmonella enterica enterica serovar Typhi
cgccaucuucacgca

SEQ ID NO: 3654492 - RNA, 16 nt, Salmonella enterica enterica serovar Typhi
cgccaucuucacgcag

SEQ ID NO: 3654493 - RNA, 18 nt, Salmonella enterica enterica serovar Typhi
cgccaucuuccgggucag

SEQ ID NO: 3654494 - RNA, 17 nt, Salmonella enterica enterica serovar Typhi
cgccaucuuccucacag

SEQ ID NO: 3654495 - RNA, 13 nt, Salmonella enterica enterica serovar Typhi
cgccaucuuucuu

SEQ ID NO: 3654496 - RNA, 21 nt, Salmonella enterica enterica serovar Typhi
cgccaugaccugggcgccaga

SEQ ID NO: 3654497 - RNA, 22 nt, Salmonella enterica enterica serovar Typhi
cgccaugaccugggcgccagag

SEQ ID NO: 3654498 - RNA, 22 nt, Salmonella enterica enterica serovar Typhi
cgccaugccaucggccagcagg

SEQ ID NO: 3654499 - RNA, 15 nt, Salmonella enterica enterica serovar Typhi
cgccauuccgcagaa

SEQ ID NO: 3654500 - RNA, 18 nt, Salmonella enterica enterica serovar Typhi
cgccauuccugccgccgc

SEQ ID NO: 3654501 - RNA, 18 nt, Salmonella enterica enterica serovar Typhi
cgccauucucuucuacca

SEQ ID NO: 3654502 - RNA, 23 nt, Salmonella enterica enterica serovar Typhi
cgccauuggcucggcgucauccc

SEQ ID NO: 3654503 - RNA, 16 nt, Salmonella enterica enterica serovar Typhi
cgccauuuagcgccga

SEQ ID NO: 3654504 - RNA, 16 nt, Salmonella enterica enterica serovar Typhi
cgccauuuccagcccc

SEQ ID NO: 3654505 - RNA, 16 nt, Salmonella enterica enterica serovar Typhi
cgccauuugccagaua

SEQ ID NO: 3654506 - RNA, 18 nt, Salmonella enterica enterica serovar Typhi
cgcccaacggaugcgcca

SEQ ID NO: 3654507 - RNA, 22 nt, Salmonella enterica enterica serovar Typhi
cgcccaacggaugcgccauccc

SEQ ID NO: 3654508 - RNA, 16 nt, Salmonella enterica enterica serovar Typhi
cgcccacaaccgacgc

SEQ ID NO: 3654509 - RNA, 22 nt, Salmonella enterica enterica serovar Typhi
cgcccacaggcugcggcacgcu

SEQ ID NO: 3654510 - RNA, 22 nt, Salmonella enterica enterica serovar Typhi
cgcccacaucuguuugagaaaa

SEQ ID NO: 3654511 - RNA, 21 nt, Salmonella enterica enterica serovar Typhi
cgcccaccgccaaccgcccgu

SEQ ID NO: 3654512 - RNA, 14 nt, Salmonella enterica enterica serovar Typhi
cgcccacgccgcgc

SEQ ID NO: 3654513 - RNA, 19 nt, Salmonella enterica enterica serovar Typhi
cgcccacgcggcgugcgcu

SEQ ID NO: 3654514 - RNA, 17 nt, Salmonella enterica enterica serovar Typhi
cgcccagauauccgcgc

SEQ ID NO: 3654515 - RNA, 11 nt, Salmonella enterica enterica serovar Typhi
cgcccagcagc

SEQ ID NO: 3654516 - RNA, 23 nt, Salmonella enterica enterica serovar Typhi
cgcccagcagcagaaauucggca

SEQ ID NO: 3654517 - RNA, 15 nt, Salmonella enterica enterica serovar Typhi
cgcccagcaugggca

SEQ ID NO: 3654518 - RNA, 12 nt, Salmonella enterica enterica serovar Typhi
cgcccagcgccg

SEQ ID NO: 3654519 - RNA, 21 nt, Salmonella enterica enterica serovar Typhi
cgcccagcguacguaacuucu

SEQ ID NO: 3654520 - RNA, 14 nt, Salmonella enterica enterica serovar Typhi
cgcccaggccaugc

SEQ ID NO: 3654521 - RNA, 14 nt, Salmonella enterica enterica serovar Typhi
cgcccaggcgggua

SEQ ID NO: 3654522 - RNA, 12 nt, Salmonella enterica enterica serovar Typhi
cgcccagucacg

SEQ ID NO: 3654523 - RNA, 18 nt, Salmonella enterica enterica serovar Typhi
cgcccaguccuuccggcg

SEQ ID NO: 3654524 - RNA, 16 nt, Salmonella enterica enterica serovar Typhi
cgcccaucaacaccag

SEQ ID NO: 3654525 - RNA, 15 nt, Salmonella enterica enterica serovar Typhi
cgcccaucacaugua

SEQ ID NO: 3654526 - RNA, 14 nt, Salmonella enterica enterica serovar Typhi
cgcccaucgccaca

SEQ ID NO: 3654527 - RNA, 15 nt, Salmonella enterica enterica serovar Typhi
cgcccaucuccagcc

SEQ ID NO: 3654528 - RNA, 15 nt, Salmonella enterica enterica serovar Typhi
cgcccaugcggcuga

SEQ ID NO: 3654529 - RNA, 20 nt, Salmonella enterica enterica serovar Typhi
cgcccauggaugcgccgccc

SEQ ID NO: 3654530 - RNA, 20 nt, Salmonella enterica enterica serovar Typhi
cgcccauuaauaucagcccc

SEQ ID NO: 3654531 - RNA, 21 nt, Salmonella enterica enterica serovar Typhi
cgcccauuaauaucagcccca

SEQ ID NO: 3654532 - RNA, 22 nt, Salmonella enterica enterica serovar Typhi
cgcccauuaauaucagccccac

SEQ ID NO: 3654533 - RNA, 16 nt, Salmonella enterica enterica serovar Typhi
cgcccauuaugccgca

SEQ ID NO: 3654534 - RNA, 15 nt, Salmonella enterica enterica serovar Typhi
cgcccauuccgccug

SEQ ID NO: 3654535 - RNA, 17 nt, Salmonella enterica enterica serovar Typhi
cgcccauuccgccugcc

SEQ ID NO: 3654536 - RNA, 15 nt, Salmonella enterica enterica serovar Typhi
cgccccaaucgccag

SEQ ID NO: 3654537 - RNA, 17 nt, Salmonella enterica enterica serovar Typhi
cgccgcaaaccagacca

SEQ ID NO: 3654538 - RNA, 15 nt, Salmonella enterica enterica serovar Typhi
cgccgcaacgcgcac

SEQ ID NO: 3654539 - RNA, 22 nt, Salmonella enterica enterica serovar Typhi
cgccgcaagcggcaaucgccuc

SEQ ID NO: 3654540 - RNA, 14 nt, Salmonella enterica enterica serovar Typhi
cgccgcaaucacuu

SEQ ID NO: 3654541 - RNA, 17 nt, Salmonella enterica enterica serovar Typhi
cgccgcaaugccgccug

SEQ ID NO: 3654542 - RNA, 18 nt, Salmonella enterica enterica serovar Typhi
cgccgcaaugccgccugc

SEQ ID NO: 3654543 - RNA, 22 nt, Salmonella enterica enterica serovar Typhi
cgccgcaauuccugacugcgcg

SEQ ID NO: 3654544 - RNA, 17 nt, Salmonella enterica enterica serovar Typhi
cgccgcacacagcagaa

SEQ ID NO: 3654545 - RNA, 16 nt, Salmonella enterica enterica serovar Typhi
cgccgcagcuccaugu

SEQ ID NO: 3654546 - RNA, 23 nt, Salmonella enterica enterica serovar Typhi
cgccgcaggccaucauaccgcca

SEQ ID NO: 3654547 - RNA, 15 nt, Salmonella enterica enterica serovar Typhi
cgccgcaggguauau

SEQ ID NO: 3654548 - RNA, 17 nt, Salmonella enterica enterica serovar Typhi
cgccgcaucgauacccu

SEQ ID NO: 3654549 - RNA, 20 nt, Salmonella enterica enterica serovar Typhi
cgccgcaucuuuugccgcgg

SEQ ID NO: 3654550 - RNA, 21 nt, Salmonella enterica enterica serovar Typhi
cgccgcauugguaaagccggu

SEQ ID NO: 3654551 - RNA, 13 nt, Salmonella enterica enterica serovar Typhi
cgccgccaccaug

SEQ ID NO: 3654552 - RNA, 22 nt, Salmonella enterica enterica serovar Typhi
cgccgccagaaucaccucuuuc

SEQ ID NO: 3654553 - RNA, 13 nt, Salmonella enterica enterica serovar Typhi
cgccgccagccga

SEQ ID NO: 3654554 - RNA, 19 nt, Salmonella enterica enterica serovar Typhi
cgccgccaucaacgaccau

SEQ ID NO: 3654555 - RNA, 14 nt, Salmonella enterica enterica serovar Typhi
cgccgccaucacca

SEQ ID NO: 3654556 - RNA, 12 nt, Salmonella enterica enterica serovar Typhi
cgccgccauccg

SEQ ID NO: 3654557 - RNA, 17 nt, Salmonella enterica enterica serovar Typhi
cgccgccauccggcaca

SEQ ID NO: 3654558 - RNA, 20 nt, Salmonella enterica enterica serovar Typhi
cgccgccauccggcacgguc

SEQ ID NO: 3654559 - RNA, 14 nt, Salmonella enterica enterica serovar Typhi
cgccgccaucggcg

SEQ ID NO: 3654560 - RNA, 20 nt, Salmonella enterica enterica serovar Typhi
cgccgcccaacgcggcuuua

SEQ ID NO: 3654561 - RNA, 14 nt, Salmonella enterica enterica serovar Typhi
cgccgcccacgcug

SEQ ID NO: 3654562 - RNA, 23 nt, Salmonella enterica enterica serovar Typhi
cgccgcccagauguugauacaga

SEQ ID NO: 3654563 - RNA, 23 nt, Salmonella enterica enterica serovar Typhi
cgccgcccaucgggccgcucagc

SEQ ID NO: 3654564 - RNA, 14 nt, Salmonella enterica enterica serovar Typhi
cgccgcccgcaugg

SEQ ID NO: 3654565 - RNA, 14 nt, Salmonella enterica enterica serovar Typhi
cgccgccgccaacg

SEQ ID NO: 3654566 - RNA, 14 nt, Salmonella enterica enterica serovar Typhi
cgccgccgcccaga

SEQ ID NO: 3654567 - RNA, 12 nt, Salmonella enterica enterica serovar Typhi
cgccgccgccga

SEQ ID NO: 3654568 - RNA, 16 nt, Salmonella enterica enterica serovar Typhi
cgccgccgcgaccgcu

SEQ ID NO: 3654569 - RNA, 13 nt, Salmonella enterica enterica serovar Typhi
cgccgccggcgag

SEQ ID NO: 3654570 - RNA, 13 nt, Salmonella enterica enterica serovar Typhi
cgccgccguacuu

SEQ ID NO: 3654571 - RNA, 16 nt, Salmonella enterica enterica serovar Typhi
cgccgccuaucgccag

SEQ ID NO: 3654572 - RNA, 17 nt, Salmonella enterica enterica serovar Typhi
cgccgccuaucgccagc

SEQ ID NO: 3654573 - RNA, 15 nt, Salmonella enterica enterica serovar Typhi
cgccgccucccccuc

SEQ ID NO: 3654574 - RNA, 23 nt, Salmonella enterica enterica serovar Typhi
cgccgccucccccucaaucggcg

SEQ ID NO: 3654575 - RNA, 21 nt, Salmonella enterica enterica serovar Typhi
cgccgccucgcgauccgccag

SEQ ID NO: 3654576 - RNA, 13 nt, Salmonella enterica enterica serovar Typhi
cgccgccucuuca

SEQ ID NO: 3654577 - RNA, 15 nt, Salmonella enterica enterica serovar Typhi
cgccgccugcgccaa

SEQ ID NO: 3654578 - RNA, 16 nt, Salmonella enterica enterica serovar Typhi
cgccgccugcgccagc

SEQ ID NO: 3654579 - RNA, 18 nt, Salmonella enterica enterica serovar Typhi
cgccgcgaacaaagcccc

SEQ ID NO: 3654580 - RNA, 20 nt, Salmonella enterica enterica serovar Typhi
cgccgcgaagcguuccgcca

SEQ ID NO: 3654581 - RNA, 21 nt, Salmonella enterica enterica serovar Typhi
cgccgcgaccagcagcaucac

SEQ ID NO: 3654582 - RNA, 13 nt, Salmonella enterica enterica serovar Typhi
cgccgcgagcagc

SEQ ID NO: 3654583 - RNA, 17 nt, Salmonella enterica enterica serovar Typhi
cgccgcgaugcaucuug

SEQ ID NO: 3654584 - RNA, 20 nt, Salmonella enterica enterica serovar Typhi
cgccgcgauguuugcucgcc

SEQ ID NO: 3654585 - RNA, 23 nt, Salmonella enterica enterica serovar Typhi
cgccgcgccguuuagcacguugg

SEQ ID NO: 3654586 - RNA, 16 nt, Salmonella enterica enterica serovar Typhi
cgccgcgcggccccau

SEQ ID NO: 3654587 - RNA, 13 nt, Salmonella enterica enterica serovar Typhi
cgccgcgcuaucg

SEQ ID NO: 3654588 - RNA, 14 nt, Salmonella enterica enterica serovar Typhi
cgccgcggccuccg

SEQ ID NO: 3654589 - RNA, 18 nt, Salmonella enterica enterica serovar Typhi
cgccgcguaaauccacau

SEQ ID NO: 3654590 - RNA, 21 nt, Salmonella enterica enterica serovar Typhi
cgccgcguaaucuucgcggcu

SEQ ID NO: 3654591 - RNA, 20 nt, Salmonella enterica enterica serovar Typhi
cgccgcgugaauugcgguuu

SEQ ID NO: 3654592 - RNA, 17 nt, Salmonella enterica enterica serovar Typhi
cgccgcguuucucgccg

SEQ ID NO: 3654593 - RNA, 16 nt, Salmonella enterica enterica serovar Typhi
cgccgcuacugccgcc

SEQ ID NO: 3654594 - RNA, 17 nt, Salmonella enterica enterica serovar Typhi
cgccgcuacugccgcca

SEQ ID NO: 3654595 - RNA, 19 nt, Salmonella enterica enterica serovar Typhi
cgccgcuaucgaccagcac

SEQ ID NO: 3654596 - RNA, 17 nt, Salmonella enterica enterica serovar Typhi
cgccgcuauuaccccgc

SEQ ID NO: 3654597 - RNA, 14 nt, Salmonella enterica enterica serovar Typhi
cgccgcuccacagc

SEQ ID NO: 3654598 - RNA, 23 nt, Salmonella enterica enterica serovar Typhi
cgccgcuggcgcuuugccguucu

SEQ ID NO: 3654599 - RNA, 17 nt, Salmonella enterica enterica serovar Typhi
cgccgcuuuaccgccuu

SEQ ID NO: 3654600 - RNA, 17 nt, Salmonella enterica enterica serovar Typhi
cgccgcuuuucaggggu

SEQ ID NO: 3654601 - RNA, 19 nt, Salmonella enterica enterica serovar Typhi
cgccgcuuuucaggggucc

SEQ ID NO: 3654602 - RNA, 15 nt, Salmonella enterica enterica serovar Typhi
cgccgcuuuuuccgc

SEQ ID NO: 3654603 - RNA, 17 nt, Salmonella enterica enterica serovar Typhi
cgccgcuuuuuccgccg

SEQ ID NO: 3654604 - RNA, 22 nt, Salmonella enterica enterica serovar Typhi
cgccgcuuuuuucagcggcagc

SEQ ID NO: 3654605 - RNA, 20 nt, Salmonella enterica enterica serovar Typhi
cgccggaaaaccggucauau

SEQ ID NO: 3654606 - RNA, 18 nt, Salmonella enterica enterica serovar Typhi
cgccggaaacuggcguca

SEQ ID NO: 3654607 - RNA, 22 nt, Salmonella enterica enterica serovar Typhi
cgccggaaagaaacgccgcgca

SEQ ID NO: 3654608 - RNA, 15 nt, Salmonella enterica enterica serovar Typhi
cgccggaaauuugca

SEQ ID NO: 3654609 - RNA, 19 nt, Salmonella enterica enterica serovar Typhi
cgccggaaucgcgauccag

SEQ ID NO: 3654610 - RNA, 13 nt, Salmonella enterica enterica serovar Typhi
cgccggacgccac

SEQ ID NO: 3654611 - RNA, 18 nt, Salmonella enterica enterica serovar Typhi
cgccggacuguugaugau

SEQ ID NO: 3654612 - RNA, 15 nt, Salmonella enterica enterica serovar Typhi
cgccggagaucagca

SEQ ID NO: 3654613 - RNA, 16 nt, Salmonella enterica enterica serovar Typhi
cgccggagccgccugg

SEQ ID NO: 3654614 - RNA, 20 nt, Salmonella enterica enterica serovar Typhi
cgccggauauggcguccggc

SEQ ID NO: 3654615 - RNA, 23 nt, Salmonella enterica enterica serovar Typhi
cgccggcagcaguucuucgccgg

SEQ ID NO: 3654616 - RNA, 22 nt, Salmonella enterica enterica serovar Typhi
cgccggcaguccuugcagccag

SEQ ID NO: 3654617 - RNA, 16 nt, Salmonella enterica enterica serovar Typhi
cgccggccccgcuucc

SEQ ID NO: 3654618 - RNA, 18 nt, Salmonella enterica enterica serovar Typhi
cgccggccugacgaccgu

SEQ ID NO: 3654619 - RNA, 18 nt, Salmonella enterica enterica serovar Typhi
cgccggcgcuuuguuucc

SEQ ID NO: 3654620 - RNA, 18 nt, Salmonella enterica enterica serovar Typhi
cgccggcugcgcugccag

SEQ ID NO: 3654621 - RNA, 15 nt, Salmonella enterica enterica serovar Typhi
cgccgggaacuggca

SEQ ID NO: 3654622 - RNA, 20 nt, Salmonella enterica enterica serovar Typhi
cgccgggagcguuaaucacc

SEQ ID NO: 3654623 - RNA, 16 nt, Salmonella enterica enterica serovar Typhi
cgccuggagcugaucg

SEQ ID NO: 3654624 - RNA, 22 nt, Salmonella enterica enterica serovar Typhi
cgccuggcaucggguugauuac

SEQ ID NO: 3654625 - RNA, 16 nt, Salmonella enterica enterica serovar Typhi
cgccuggcgguaugaa

SEQ ID NO: 3654626 - RNA, 17 nt, Salmonella enterica enterica serovar Typhi
cgccuguaaacguuccu

SEQ ID NO: 3654627 - RNA, 23 nt, Salmonella enterica enterica serovar Typhi
cgccuguaaugucuggugcagca

SEQ ID NO: 3654628 - RNA, 22 nt, Salmonella enterica enterica serovar Typhi
cgccugugcuuucgccaccagc

SEQ ID NO: 3654629 - RNA, 23 nt, Salmonella enterica enterica serovar Typhi
cgccuguuagggcgcggcuggua

SEQ ID NO: 3654630 - RNA, 15 nt, Salmonella enterica enterica serovar Typhi
cgccuguucaacaug

SEQ ID NO: 3654631 - RNA, 17 nt, Salmonella enterica enterica serovar Typhi
cgccuguuucugcgccg

SEQ ID NO: 3654632 - RNA, 21 nt, Salmonella enterica enterica serovar Typhi
cgccuguuugacgaaaucgca

SEQ ID NO: 3654633 - RNA, 15 nt, Salmonella enterica enterica serovar Typhi
cgccuuaaaccgucg

SEQ ID NO: 3654634 - RNA, 20 nt, Salmonella enterica enterica serovar Typhi
cgccuuaagaauguccaucu

SEQ ID NO: 3654635 - RNA, 16 nt, Salmonella enterica enterica serovar Typhi
cgccuuacccaaccgu

SEQ ID NO: 3654636 - RNA, 15 nt, Salmonella enterica enterica serovar Typhi
cgccuuaccgcggua

SEQ ID NO: 3654637 - RNA, 20 nt, Salmonella enterica enterica serovar Typhi
cgccuuaccgggccuacgga

SEQ ID NO: 3654638 - RNA, 19 nt, Salmonella enterica enterica serovar Typhi
cgccuuauccgaccuacag

SEQ ID NO: 3654639 - RNA, 20 nt, Salmonella enterica enterica serovar Typhi
cgccuuauccgaccuacaga

SEQ ID NO: 3654640 - RNA, 19 nt, Salmonella enterica enterica serovar Typhi
cgccuuauccggccuacaa

SEQ ID NO: 3654641 - RNA, 20 nt, Salmonella enterica enterica serovar Typhi
cgccuuauccggccuacaaa

SEQ ID NO: 3654642 - RNA, 14 nt, Salmonella enterica enterica serovar Typhi
cgccuuauucaggc

SEQ ID NO: 3654643 - RNA, 20 nt, Salmonella enterica enterica serovar Typhi
cgccuucauauuaaauuccg

SEQ ID NO: 3654644 - RNA, 21 nt, Salmonella enterica enterica serovar Typhi
cgccuuccggccacuccgcca

SEQ ID NO: 3654645 - RNA, 15 nt, Salmonella enterica enterica serovar Typhi
cgccuuccuccagca

SEQ ID NO: 3654646 - RNA, 20 nt, Salmonella enterica enterica serovar Typhi
cgccuucgcggugaucccag

SEQ ID NO: 3654647 - RNA, 21 nt, Salmonella enterica enterica serovar Typhi
cgccuucggccugaaucagca

SEQ ID NO: 3654648 - RNA, 15 nt, Salmonella enterica enterica serovar Typhi
cgccuucuucaccca

SEQ ID NO: 3654649 - RNA, 14 nt, Salmonella enterica enterica serovar Typhi
cgccuucuucaucu

SEQ ID NO: 3654650 - RNA, 16 nt, Salmonella enterica enterica serovar Typhi
cgccuucuucaucuuc

SEQ ID NO: 3654651 - RNA, 21 nt, Salmonella enterica enterica serovar Typhi
cgccuugcccgcgccagaggc

SEQ ID NO: 3654652 - RNA, 15 nt, Salmonella enterica enterica serovar Typhi
cgccuugccgggggc

SEQ ID NO: 3654653 - RNA, 15 nt, Salmonella enterica enterica serovar Typhi
cgccuugcggcggcg

SEQ ID NO: 3654654 - RNA, 22 nt, Salmonella enterica enterica serovar Typhi
cgccuugcuuaacagaauugcg

SEQ ID NO: 3654655 - RNA, 17 nt, Salmonella enterica enterica serovar Typhi
cgccuuguugcggauga

SEQ ID NO: 3654656 - RNA, 22 nt, Salmonella enterica enterica serovar Typhi
cgccuuuaauuccgccgggcaa

SEQ ID NO: 3654657 - RNA, 23 nt, Salmonella enterica enterica serovar Typhi
cgccuuucagacuucaacgccgc

SEQ ID NO: 3654658 - RNA, 15 nt, Salmonella enterica enterica serovar Typhi
cgccuuucagauggu

SEQ ID NO: 3654659 - RNA, 23 nt, Salmonella enterica enterica serovar Typhi
cgccuuugcgaauggccuccagc

SEQ ID NO: 3654660 - RNA, 15 nt, Salmonella enterica enterica serovar Typhi
cgccuuuucccccag

SEQ ID NO: 3654661 - RNA, 18 nt, Salmonella enterica enterica serovar Typhi
cgcgaaaacagcuggcga

SEQ ID NO: 3654662 - RNA, 18 nt, Salmonella enterica enterica serovar Typhi
cgcgaaacugcugccgca

SEQ ID NO: 3654663 - RNA, 18 nt, Salmonella enterica enterica serovar Typhi
cgcgaaaugucccgauau

SEQ ID NO: 3654664 - RNA, 19 nt, Salmonella enterica enterica serovar Typhi
cgcgaacguucaaaaucaa

SEQ ID NO: 3654665 - RNA, 15 nt, Salmonella enterica enterica serovar Typhi
cgcgaacugcacucg

SEQ ID NO: 3654666 - RNA, 22 nt, Salmonella enterica enterica serovar Typhi
cgcgaagaucguuauccagcag

SEQ ID NO: 3654667 - RNA, 14 nt, Salmonella enterica enterica serovar Typhi
cgcgaagcggcgcu

SEQ ID NO: 3654668 - RNA, 20 nt, Salmonella enterica enterica serovar Typhi
cgcgaauaccuaacagccgc

SEQ ID NO: 3654669 - RNA, 15 nt, Salmonella enterica enterica serovar Typhi
cgcgaauagccagac

SEQ ID NO: 3654670 - RNA, 19 nt, Salmonella enterica enterica serovar Typhi
cgcgaauaguggcgcgcca

SEQ ID NO: 3654671 - RNA, 15 nt, Salmonella enterica enterica serovar Typhi
cgcgaauccgccaua

SEQ ID NO: 3654672 - RNA, 22 nt, Salmonella enterica enterica serovar Typhi
cgcgaauuccuuuuuccgccac

SEQ ID NO: 3654673 - RNA, 17 nt, Salmonella enterica enterica serovar Typhi
cgcgaauuucaacgcga

SEQ ID NO: 3654674 - RNA, 17 nt, Salmonella enterica enterica serovar Typhi
cgcgaauuugccccaga

SEQ ID NO: 3654675 - RNA, 23 nt, Salmonella enterica enterica serovar Typhi
cgcgaauuugccccagauacgca

SEQ ID NO: 3654676 - RNA, 17 nt, Salmonella enterica enterica serovar Typhi
cgcgacaaaaagcgcgc

SEQ ID NO: 3654677 - RNA, 19 nt, Salmonella enterica enterica serovar Typhi
cgcgacaaaaagcgcgccg

SEQ ID NO: 3654678 - RNA, 14 nt, Salmonella enterica enterica serovar Typhi
cgcgacaacgccgg

SEQ ID NO: 3654679 - RNA, 21 nt, Salmonella enterica enterica serovar Typhi
cgcgacaacgccggaccagac

SEQ ID NO: 3654680 - RNA, 16 nt, Salmonella enterica enterica serovar Typhi
cgcgacaaggccgaua

SEQ ID NO: 3654681 - RNA, 13 nt, Salmonella enterica enterica serovar Typhi
cgcgacagcgcgc

SEQ ID NO: 3654682 - RNA, 16 nt, Salmonella enterica enterica serovar Typhi
cgcgacagcgcugcgg

SEQ ID NO: 3654683 - RNA, 16 nt, Salmonella enterica enterica serovar Typhi
cgcgacagucgcagag

SEQ ID NO: 3654684 - RNA, 14 nt, Salmonella enterica enterica serovar Typhi
cgcgacauggcgaa

SEQ ID NO: 3654685 - RNA, 14 nt, Salmonella enterica enterica serovar Typhi
cgcgacauggcggu

SEQ ID NO: 3654686 - RNA, 15 nt, Salmonella enterica enterica serovar Typhi
cgcgacauggcggua

SEQ ID NO: 3654687 - RNA, 16 nt, Salmonella enterica enterica serovar Typhi
cgcgacauggcgguaa

SEQ ID NO: 3654688 - RNA, 13 nt, Salmonella enterica enterica serovar Typhi
cgcgaccacgcau

SEQ ID NO: 3654689 - RNA, 14 nt, Salmonella enterica enterica serovar Typhi
cgcgaccagcgcgc

SEQ ID NO: 3654690 - RNA, 17 nt, Salmonella enterica enterica serovar Typhi
cgcgaccagcgcgccaa

SEQ ID NO: 3654691 - RNA, 14 nt, Salmonella enterica enterica serovar Typhi
cgcgaccaguucac

SEQ ID NO: 3654692 - RNA, 15 nt, Salmonella enterica enterica serovar Typhi
cgcgacccagcgcau

SEQ ID NO: 3654693 - RNA, 21 nt, Salmonella enterica enterica serovar Typhi
cgcgaccggaucaauaaacag

SEQ ID NO: 3654694 - RNA, 14 nt, Salmonella enterica enterica serovar Typhi
cgcgacgacgccag

SEQ ID NO: 3654695 - RNA, 19 nt, Salmonella enterica enterica serovar Typhi
cgcgacgacgccagccagc

SEQ ID NO: 3654696 - RNA, 16 nt, Salmonella enterica enterica serovar Typhi
cgcgacgaugcgcauu

SEQ ID NO: 3654697 - RNA, 18 nt, Salmonella enterica enterica serovar Typhi
cgcgacgccagccgauca

SEQ ID NO: 3654698 - RNA, 16 nt, Salmonella enterica enterica serovar Typhi
cgcgacgcgccagcca

SEQ ID NO: 3654699 - RNA, 22 nt, Salmonella enterica enterica serovar Typhi
cgcgacgcgccagccagcgcca

SEQ ID NO: 3654700 - RNA, 20 nt, Salmonella enterica enterica serovar Typhi
cgcgacgcuuaucagcccua

SEQ ID NO: 3654701 - RNA, 17 nt, Salmonella enterica enterica serovar Typhi
cgcgacggaccggcagc

SEQ ID NO: 3654702 - RNA, 21 nt, Salmonella enterica enterica serovar Typhi
cgcgacggcagccucuuucag

SEQ ID NO: 3654703 - RNA, 18 nt, Salmonella enterica enterica serovar Typhi
cgcgacgggaaggaaauu

SEQ ID NO: 3654704 - RNA, 21 nt, Salmonella enterica enterica serovar Typhi
cgcgacgggaaggaaauucag

SEQ ID NO: 3654705 - RNA, 21 nt, Salmonella enterica enterica serovar Typhi
cgcgacgggcggcgacagaga

SEQ ID NO: 3654706 - RNA, 19 nt, Salmonella enterica enterica serovar Typhi
cgcgacguacuggaacagu

SEQ ID NO: 3654707 - RNA, 18 nt, Salmonella enterica enterica serovar Typhi
cgcgacguccgccaacag

SEQ ID NO: 3654708 - RNA, 19 nt, Salmonella enterica enterica serovar Typhi
cgcgccaggucucauagcg

SEQ ID NO: 3654709 - RNA, 23 nt, Salmonella enterica enterica serovar Typhi
cgcgccaguaaucggcgcgaaac

SEQ ID NO: 3654710 - RNA, 19 nt, Salmonella enterica enterica serovar Typhi
cgcgccagucaucgccgcu

SEQ ID NO: 3654711 - RNA, 22 nt, Salmonella enterica enterica serovar Typhi
cgcgccaguuuggugaugcgau

SEQ ID NO: 3654712 - RNA, 20 nt, Salmonella enterica enterica serovar Typhi
cgcgccauacuuacugcugu

SEQ ID NO: 3654713 - RNA, 14 nt, Salmonella enterica enterica serovar Typhi
cgcgcccagcagca

SEQ ID NO: 3654714 - RNA, 14 nt, Salmonella enterica enterica serovar Typhi
cgcgcccagcgccg

SEQ ID NO: 3654715 - RNA, 20 nt, Salmonella enterica enterica serovar Typhi
cgcgcccgaucguccgccuc

SEQ ID NO: 3654716 - RNA, 14 nt, Salmonella enterica enterica serovar Typhi
cgcgcccgccgcca

SEQ ID NO: 3654717 - RNA, 16 nt, Salmonella enterica enterica serovar Typhi
cgcgcccuccuccagc

SEQ ID NO: 3654718 - RNA, 22 nt, Salmonella enterica enterica serovar Typhi
cgcgccgacauagcugaacaau

SEQ ID NO: 3654719 - RNA, 14 nt, Salmonella enterica enterica serovar Typhi
cgcgccgcagcgcc

SEQ ID NO: 3654720 - RNA, 14 nt, Salmonella enterica enterica serovar Typhi
cgcgccgcaucuuc

SEQ ID NO: 3654721 - RNA, 13 nt, Salmonella enterica enterica serovar Typhi
cgcgccgccaacg

SEQ ID NO: 3654722 - RNA, 15 nt, Salmonella enterica enterica serovar Typhi
cgcgccgccaacgau

SEQ ID NO: 3654723 - RNA, 16 nt, Salmonella enterica enterica serovar Typhi
cgcgccgccaacgcca

SEQ ID NO: 3654724 - RNA, 17 nt, Salmonella enterica enterica serovar Typhi
cgcgccgccaauaucca

SEQ ID NO: 3654725 - RNA, 13 nt, Salmonella enterica enterica serovar Typhi
cgcgccgccgccu

SEQ ID NO: 3654726 - RNA, 14 nt, Salmonella enterica enterica serovar Typhi
cgcgccgccgccug

SEQ ID NO: 3654727 - RNA, 12 nt, Salmonella enterica enterica serovar Typhi
cgcgccgccucu

SEQ ID NO: 3654728 - RNA, 23 nt, Salmonella enterica enterica serovar Typhi
cgcgccggggcggggaaaccguc

SEQ ID NO: 3654729 - RNA, 16 nt, Salmonella enterica enterica serovar Typhi
cgcgccggucgccagc

SEQ ID NO: 3654730 - RNA, 21 nt, Salmonella enterica enterica serovar Typhi
cgcgccggugaucccaccagc

SEQ ID NO: 3654731 - RNA, 15 nt, Salmonella enterica enterica serovar Typhi
cgcgccgugcccagc

SEQ ID NO: 3654732 - RNA, 16 nt, Salmonella enterica enterica serovar Typhi
cgcgccuaccagcgcu

SEQ ID NO: 3654733 - RNA, 14 nt, Salmonella enterica enterica serovar Typhi
cgcgccuaccgcca

SEQ ID NO: 3654734 - RNA, 15 nt, Salmonella enterica enterica serovar Typhi
cgcgccuaccgccau

SEQ ID NO: 3654735 - RNA, 17 nt, Salmonella enterica enterica serovar Typhi
cgcgccuagcgcgcgca

SEQ ID NO: 3654736 - RNA, 15 nt, Salmonella enterica enterica serovar Typhi
cgcgccugacgcgga

SEQ ID NO: 3654737 - RNA, 16 nt, Salmonella enterica enterica serovar Typhi
cgcgccugacgcggac

SEQ ID NO: 3654738 - RNA, 23 nt, Salmonella enterica enterica serovar Typhi
cgcgccugccauagcaucaccag

SEQ ID NO: 3654739 - RNA, 19 nt, Salmonella enterica enterica serovar Typhi
cgcgccugccugacgccug

SEQ ID NO: 3654740 - RNA, 15 nt, Salmonella enterica enterica serovar Typhi
cgcgccugcucccgc

SEQ ID NO: 3654741 - RNA, 19 nt, Salmonella enterica enterica serovar Typhi
cgcgccuggaucugcgcau

SEQ ID NO: 3654742 - RNA, 20 nt, Salmonella enterica enterica serovar Typhi
cgcgccugugaaacggcgga

SEQ ID NO: 3654743 - RNA, 18 nt, Salmonella enterica enterica serovar Typhi
cgcgcgaaacgcacccgc

SEQ ID NO: 3654744 - RNA, 21 nt, Salmonella enterica enterica serovar Typhi
cgcgcgaauaucgcugccggu

SEQ ID NO: 3654745 - RNA, 22 nt, Salmonella enterica enterica serovar Typhi
cgcgcgaugguaggccugauaa

SEQ ID NO: 3654746 - RNA, 17 nt, Salmonella enterica enterica serovar Typhi
cgcgcgcagguucgucu

SEQ ID NO: 3654747 - RNA, 21 nt, Salmonella enterica enterica serovar Typhi
cgcgcgccagucaucgccgcu

SEQ ID NO: 3654748 - RNA, 19 nt, Salmonella enterica enterica serovar Typhi
cgcgcgcccaugcggcuga

SEQ ID NO: 3654749 - RNA, 12 nt, Salmonella enterica enterica serovar Typhi
cgcgcgccgccu

SEQ ID NO: 3654750 - RNA, 13 nt, Salmonella enterica enterica serovar Typhi
cgcgcgccgccug

SEQ ID NO: 3654751 - RNA, 21 nt, Salmonella enterica enterica serovar Typhi
cgcgcgccgcuuccggcaggu

SEQ ID NO: 3654752 - RNA, 14 nt, Salmonella enterica enterica serovar Typhi
cgcgcgccggugau

SEQ ID NO: 3654753 - RNA, 13 nt, Salmonella enterica enterica serovar Typhi
cgcgcgcgcguca

SEQ ID NO: 3654754 - RNA, 12 nt, Salmonella enterica enterica serovar Typhi
cgcgcggcguuc

SEQ ID NO: 3654755 - RNA, 16 nt, Salmonella enterica enterica serovar Typhi
cgcgcggcuaccggac

SEQ ID NO: 3654756 - RNA, 13 nt, Salmonella enterica enterica serovar Typhi
cgcgcguauccgc

SEQ ID NO: 3654757 - RNA, 14 nt, Salmonella enterica enterica serovar Typhi
cgcgcgucagcacg

SEQ ID NO: 3654758 - RNA, 14 nt, Salmonella enterica enterica serovar Typhi
cgcgcguucaucca

SEQ ID NO: 3654759 - RNA, 18 nt, Salmonella enterica enterica serovar Typhi
cgcgcguucauccaccgc

SEQ ID NO: 3654760 - RNA, 22 nt, Salmonella enterica enterica serovar Typhi
cgcgcguuccaucacuuccugu

SEQ ID NO: 3654761 - RNA, 19 nt, Salmonella enterica enterica serovar Typhi
cgcgcuaauuuucagggug

SEQ ID NO: 3654762 - RNA, 23 nt, Salmonella enterica enterica serovar Typhi
cgcgcuagugccgccaggcaaau

SEQ ID NO: 3654763 - RNA, 15 nt, Salmonella enterica enterica serovar Typhi
cgcgcuaucaacgcc

SEQ ID NO: 3654764 - RNA, 22 nt, Salmonella enterica enterica serovar Typhi
cgcgcuaucaacgccuccaggc

SEQ ID NO: 3654765 - RNA, 16 nt, Salmonella enterica enterica serovar Typhi
cgcgcuaucgguauca

SEQ ID NO: 3654766 - RNA, 19 nt, Salmonella enterica enterica serovar Typhi
cgcgcucaaauggucccug

SEQ ID NO: 3654767 - RNA, 17 nt, Salmonella enterica enterica serovar Typhi
cgcgcucaagcgaaaaa

SEQ ID NO: 3654768 - RNA, 15 nt, Salmonella enterica enterica serovar Typhi
cgcgcucaagcuggg

SEQ ID NO: 3654769 - RNA, 11 nt, Salmonella enterica enterica serovar Typhi
cgcgcucgcca

SEQ ID NO: 3654770 - RNA, 12 nt, Salmonella enterica enterica serovar Typhi
cgcgcucgccag

SEQ ID NO: 3654771 - RNA, 16 nt, Salmonella enterica enterica serovar Typhi
cgcgcucgccagcgcu

SEQ ID NO: 3654772 - RNA, 17 nt, Salmonella enterica enterica serovar Typhi
cgcgcucggucacuuca

SEQ ID NO: 3654773 - RNA, 15 nt, Salmonella enterica enterica serovar Typhi
cgcgcucuccggcac

SEQ ID NO: 3654774 - RNA, 16 nt, Salmonella enterica enterica serovar Typhi
cgcgcucuuccgccag

SEQ ID NO: 3654775 - RNA, 17 nt, Salmonella enterica enterica serovar Typhi
cgcgcucuuccgccagc

SEQ ID NO: 3654776 - RNA, 21 nt, Salmonella enterica enterica serovar Typhi
cgcgcucuuccgccagcgcca

SEQ ID NO: 3654777 - RNA, 14 nt, Salmonella enterica enterica serovar Typhi
cgcgcugaugguuu

SEQ ID NO: 3654778 - RNA, 17 nt, Salmonella enterica enterica serovar Typhi
cgcgcugccgcccuuuc

SEQ ID NO: 3654779 - RNA, 17 nt, Salmonella enterica enterica serovar Typhi
cgcgcugcugcggcguu

SEQ ID NO: 3654780 - RNA, 19 nt, Salmonella enterica enterica serovar Typhi
cgcgcuggaucagauuccc

SEQ ID NO: 3654781 - RNA, 12 nt, Salmonella enterica enterica serovar Typhi
cgcgcuggcaag

SEQ ID NO: 3654782 - RNA, 19 nt, Salmonella enterica enterica serovar Typhi
cgcgcuggcaagcgccagc

SEQ ID NO: 3654783 - RNA, 12 nt, Salmonella enterica enterica serovar Typhi
cgcgcuggcaau

SEQ ID NO: 3654784 - RNA, 16 nt, Salmonella enterica enterica serovar Typhi
cgcgcugucugccggc

SEQ ID NO: 3654785 - RNA, 14 nt, Salmonella enterica enterica serovar Typhi
cgcgcuuaaucgag

SEQ ID NO: 3654786 - RNA, 15 nt, Salmonella enterica enterica serovar Typhi
cgcgcuuccugccag

SEQ ID NO: 3654787 - RNA, 20 nt, Salmonella enterica enterica serovar Typhi
cgcgcuuuucgccagcgcau

SEQ ID NO: 3654788 - RNA, 19 nt, Salmonella enterica enterica serovar Typhi
cgcgcuuuuuuuacgccug

SEQ ID NO: 3654789 - RNA, 19 nt, Salmonella enterica enterica serovar Typhi
cgcggaagccacguucuuc

SEQ ID NO: 3654790 - RNA, 18 nt, Salmonella enterica enterica serovar Typhi
cgcggaagcgaccggcgu

SEQ ID NO: 3654791 - RNA, 20 nt, Salmonella enterica enterica serovar Typhi
cgcggaagcgaccggcguca

SEQ ID NO: 3654792 - RNA, 20 nt, Salmonella enterica enterica serovar Typhi
cgcggaaggcgccucgcgcg

SEQ ID NO: 3654793 - RNA, 23 nt, Salmonella enterica enterica serovar Typhi
cgcggaaucgucacagaccccgc

SEQ ID NO: 3654794 - RNA, 15 nt, Salmonella enterica enterica serovar Typhi
cgcgucagggcgaua

SEQ ID NO: 3654795 - RNA, 22 nt, Salmonella enterica enterica serovar Typhi
cgcgucauaaugcccagcgccg

SEQ ID NO: 3654796 - RNA, 23 nt, Salmonella enterica enterica serovar Typhi
cgcguccaacuggcuuucaucca

SEQ ID NO: 3654797 - RNA, 13 nt, Salmonella enterica enterica serovar Typhi
cgcgucccucucc

SEQ ID NO: 3654798 - RNA, 15 nt, Salmonella enterica enterica serovar Typhi
cgcgucgcauccggc

SEQ ID NO: 3654799 - RNA, 21 nt, Salmonella enterica enterica serovar Typhi
cgcgucggccggcaccagcca

SEQ ID NO: 3654800 - RNA, 21 nt, Salmonella enterica enterica serovar Typhi
cgcgucguucacgucgcgaag

SEQ ID NO: 3654801 - RNA, 20 nt, Salmonella enterica enterica serovar Typhi
cgcgucugaguuaaugccau

SEQ ID NO: 3654802 - RNA, 12 nt, Salmonella enterica enterica serovar Typhi
cgcgucuucauc

SEQ ID NO: 3654803 - RNA, 17 nt, Salmonella enterica enterica serovar Typhi
cgcgucuucaucagcca

SEQ ID NO: 3654804 - RNA, 14 nt, Salmonella enterica enterica serovar Typhi
cgcgugacgcagua

SEQ ID NO: 3654805 - RNA, 17 nt, Salmonella enterica enterica serovar Typhi
cgcgugcucgcggcgga

SEQ ID NO: 3654806 - RNA, 19 nt, Salmonella enterica enterica serovar Typhi
cgcguggaaauaaucugua

SEQ ID NO: 3654807 - RNA, 13 nt, Salmonella enterica enterica serovar Typhi
cgcguggcaucuu

SEQ ID NO: 3654808 - RNA, 15 nt, Salmonella enterica enterica serovar Typhi
cgcguucagcgccug

SEQ ID NO: 3654809 - RNA, 21 nt, Salmonella enterica enterica serovar Typhi
cgcguucgcaccauagcagcc

SEQ ID NO: 3654810 - RNA, 18 nt, Salmonella enterica enterica serovar Typhi
cgcguucugaauaaauug

SEQ ID NO: 3654811 - RNA, 15 nt, Salmonella enterica enterica serovar Typhi
cgcguugccaucggc

SEQ ID NO: 3654812 - RNA, 12 nt, Salmonella enterica enterica serovar Typhi
cgcguugccgca

SEQ ID NO: 3654813 - RNA, 12 nt, Salmonella enterica enterica serovar Typhi
cgcguugccgcc

SEQ ID NO: 3654814 - RNA, 13 nt, Salmonella enterica enterica serovar Typhi
cgcguugccgccg

SEQ ID NO: 3654815 - RNA, 14 nt, Salmonella enterica enterica serovar Typhi
cgcguugccgccga

SEQ ID NO: 3654816 - RNA, 15 nt, Salmonella enterica enterica serovar Typhi
cgcguuguaaucgcc

SEQ ID NO: 3654817 - RNA, 20 nt, Salmonella enterica enterica serovar Typhi
cgcguuuaaauaaaaauucc

SEQ ID NO: 3654818 - RNA, 20 nt, Salmonella enterica enterica serovar Typhi
cgcuaaacagcaaaucggga

SEQ ID NO: 3654819 - RNA, 13 nt, Salmonella enterica enterica serovar Typhi
cgcuaaaccggcg

SEQ ID NO: 3654820 - RNA, 14 nt, Salmonella enterica enterica serovar Typhi
cgcuaaaugcauag

SEQ ID NO: 3654821 - RNA, 14 nt, Salmonella enterica enterica serovar Typhi
cgcuaaccaucagc

SEQ ID NO: 3654822 - RNA, 15 nt, Salmonella enterica enterica serovar Typhi
cgcuaagccagccaa

SEQ ID NO: 3654823 - RNA, 12 nt, Salmonella enterica enterica serovar Typhi
cgcuaauaauuc

SEQ ID NO: 3654824 - RNA, 14 nt, Salmonella enterica enterica serovar Typhi
cgcuaauauccacc

SEQ ID NO: 3654825 - RNA, 21 nt, Salmonella enterica enterica serovar Typhi
cgcuaaugcccggcgcggcau

SEQ ID NO: 3654826 - RNA, 22 nt, Salmonella enterica enterica serovar Typhi
cgcuaaugcccggcgcggcauc

SEQ ID NO: 3654827 - RNA, 22 nt, Salmonella enterica enterica serovar Typhi
cgcuacaaccagcgcggccaga

SEQ ID NO: 3654828 - RNA, 15 nt, Salmonella enterica enterica serovar Typhi
cgcuacaauccagga

SEQ ID NO: 3654829 - RNA, 13 nt, Salmonella enterica enterica serovar Typhi
cgcuacagggcgu

SEQ ID NO: 3654830 - RNA, 18 nt, Salmonella enterica enterica serovar Typhi
cgcuacauccgccagccg

SEQ ID NO: 3654831 - RNA, 21 nt, Salmonella enterica enterica serovar Typhi
cgcuacauccgccagccgcca

SEQ ID NO: 3654832 - RNA, 19 nt, Salmonella enterica enterica serovar Typhi
cgcuaccagcgcggcgcca

SEQ ID NO: 3654833 - RNA, 17 nt, Salmonella enterica enterica serovar Typhi
cgcuaccuucuucccau

SEQ ID NO: 3654834 - RNA, 12 nt, Salmonella enterica enterica serovar Typhi
cgcuaccuuuuu

SEQ ID NO: 3654835 - RNA, 19 nt, Salmonella enterica enterica serovar Typhi
cgcuacguuuaucaggccu

SEQ ID NO: 3654836 - RNA, 20 nt, Salmonella enterica enterica serovar Typhi
cgcuacguuuaucaggccua

SEQ ID NO: 3654837 - RNA, 16 nt, Salmonella enterica enterica serovar Typhi
cgcuacguuuaucugg

SEQ ID NO: 3654838 - RNA, 15 nt, Salmonella enterica enterica serovar Typhi
cgcuacugccgccau

SEQ ID NO: 3654839 - RNA, 22 nt, Salmonella enterica enterica serovar Typhi
cgcuacugugggccguuccgca

SEQ ID NO: 3654840 - RNA, 14 nt, Salmonella enterica enterica serovar Typhi
cgcuagccgcaucc

SEQ ID NO: 3654841 - RNA, 15 nt, Salmonella enterica enterica serovar Typhi
cgcuagcucaacgcc

SEQ ID NO: 3654842 - RNA, 19 nt, Salmonella enterica enterica serovar Typhi
cgcuagcuuaucgggccua

SEQ ID NO: 3654843 - RNA, 16 nt, Salmonella enterica enterica serovar Typhi
cgcuagggcaucagac

SEQ ID NO: 3654844 - RNA, 19 nt, Salmonella enterica enterica serovar Typhi
cgcuaucaccgccgcccgu

SEQ ID NO: 3654845 - RNA, 18 nt, Salmonella enterica enterica serovar Typhi
cgcuauccaggccgucgg

SEQ ID NO: 3654846 - RNA, 23 nt, Salmonella enterica enterica serovar Typhi
cgcuauccgcgcucgccagcaua

SEQ ID NO: 3654847 - RNA, 13 nt, Salmonella enterica enterica serovar Typhi
cgcuauccggcau

SEQ ID NO: 3654848 - RNA, 15 nt, Salmonella enterica enterica serovar Typhi
cgcuauccggcgcgc

SEQ ID NO: 3654849 - RNA, 16 nt, Salmonella enterica enterica serovar Typhi
cgcuauccggcgcgcu

SEQ ID NO: 3654850 - RNA, 17 nt, Salmonella enterica enterica serovar Typhi
cgcuaucgaccagcacc

SEQ ID NO: 3654851 - RNA, 12 nt, Salmonella enterica enterica serovar Typhi
cgcuaucgccaa

SEQ ID NO: 3654852 - RNA, 21 nt, Salmonella enterica enterica serovar Typhi
cgcuaucucuuccagcgucuc

SEQ ID NO: 3654853 - RNA, 16 nt, Salmonella enterica enterica serovar Typhi
cgcuaucugacagcca

SEQ ID NO: 3654854 - RNA, 19 nt, Salmonella enterica enterica serovar Typhi
cgcuaucugcuccgccagc

SEQ ID NO: 3654855 - RNA, 20 nt, Salmonella enterica enterica serovar Typhi
cgcuaucuguugcgccaggg

SEQ ID NO: 3654856 - RNA, 24 nt, Salmonella enterica enterica serovar Typhi
cgcuaucuuuuaacaaacgccagg

SEQ ID NO: 3654857 - RNA, 18 nt, Salmonella enterica enterica serovar Typhi
cgcuaugcccaccgcgcg

SEQ ID NO: 3654858 - RNA, 16 nt, Salmonella enterica enterica serovar Typhi
cgcuaugcuuaccauc

SEQ ID NO: 3654859 - RNA, 15 nt, Salmonella enterica enterica serovar Typhi
cgcuauuaccaguaa

SEQ ID NO: 3654860 - RNA, 19 nt, Salmonella enterica enterica serovar Typhi
cgcuauuaccccgcggcau

SEQ ID NO: 3654861 - RNA, 21 nt, Salmonella enterica enterica serovar Typhi
cgcuauuaccccgcggcaugg

SEQ ID NO: 3654862 - RNA, 15 nt, Salmonella enterica enterica serovar Typhi
cgcucaaauaaugca

SEQ ID NO: 3654863 - RNA, 16 nt, Salmonella enterica enterica serovar Typhi
cgcucaaccgguuugu

SEQ ID NO: 3654864 - RNA, 14 nt, Salmonella enterica enterica serovar Typhi
cgcucaacuccugc

SEQ ID NO: 3654865 - RNA, 15 nt, Salmonella enterica enterica serovar Typhi
cgcucaagcggcacc

SEQ ID NO: 3654866 - RNA, 18 nt, Salmonella enterica enterica serovar Typhi
cgcucaagcggcaccaca

SEQ ID NO: 3654867 - RNA, 22 nt, Salmonella enterica enterica serovar Typhi
cgcucaauuauuaaucuuuaca

SEQ ID NO: 3654868 - RNA, 23 nt, Salmonella enterica enterica serovar Typhi
cgcucacauucauugccgccagu

SEQ ID NO: 3654869 - RNA, 16 nt, Salmonella enterica enterica serovar Typhi
cgcucaccaccgccgc

SEQ ID NO: 3654870 - RNA, 18 nt, Salmonella enterica enterica serovar Typhi
cgcucaccaccgccgcga

SEQ ID NO: 3654871 - RNA, 16 nt, Salmonella enterica enterica serovar Typhi
cgcucacccgauaaaa

SEQ ID NO: 3654872 - RNA, 15 nt, Salmonella enterica enterica serovar Typhi
cgcucaccgacuccu

SEQ ID NO: 3654873 - RNA, 15 nt, Salmonella enterica enterica serovar Typhi
cgcucaccuccgcca

SEQ ID NO: 3654874 - RNA, 16 nt, Salmonella enterica enterica serovar Typhi
cgcucaccuccgccac

SEQ ID NO: 3654875 - RNA, 16 nt, Salmonella enterica enterica serovar Typhi
cgcucacgauaacgca

SEQ ID NO: 3654876 - RNA, 11 nt, Salmonella enterica enterica serovar Typhi
cgcucacgcca

SEQ ID NO: 3654877 - RNA, 14 nt, Salmonella enterica enterica serovar Typhi
cgcucacgcggcgc

SEQ ID NO: 3654878 - RNA, 20 nt, Salmonella enterica enterica serovar Typhi
cgcucacgguuucaacuucc

SEQ ID NO: 3654879 - RNA, 21 nt, Salmonella enterica enterica serovar Typhi
cgcucacgguuucaacuucca

SEQ ID NO: 3654880 - RNA, 16 nt, Salmonella enterica enterica serovar Typhi
cgcugcgcuuauccgc

SEQ ID NO: 3654881 - RNA, 17 nt, Salmonella enterica enterica serovar Typhi
cgcugcgcuuauccggc

SEQ ID NO: 3654882 - RNA, 19 nt, Salmonella enterica enterica serovar Typhi
cgcugcgcuuauccggccu

SEQ ID NO: 3654883 - RNA, 20 nt, Salmonella enterica enterica serovar Typhi
cgcugcggccagaccgccgc

SEQ ID NO: 3654884 - RNA, 21 nt, Salmonella enterica enterica serovar Typhi
cgcugcggccagaccgccgcu

SEQ ID NO: 3654885 - RNA, 22 nt, Salmonella enterica enterica serovar Typhi
cgcugcggguagucaucgccuu

SEQ ID NO: 3654886 - RNA, 15 nt, Salmonella enterica enterica serovar Typhi
cgcugcguggcgggc

SEQ ID NO: 3654887 - RNA, 17 nt, Salmonella enterica enterica serovar Typhi
cgcugcguggcgggcgu

SEQ ID NO: 3654888 - RNA, 20 nt, Salmonella enterica enterica serovar Typhi
cgcugcguuuauuaggccua

SEQ ID NO: 3654889 - RNA, 12 nt, Salmonella enterica enterica serovar Typhi
cgcugcuccggc

SEQ ID NO: 3654890 - RNA, 15 nt, Salmonella enterica enterica serovar Typhi
cgcugcugcggcguu

SEQ ID NO: 3654891 - RNA, 22 nt, Salmonella enterica enterica serovar Typhi
cgcugcuggcagcgcugaaucg

SEQ ID NO: 3654892 - RNA, 18 nt, Salmonella enterica enterica serovar Typhi
cgcugcuguaacagacgc

SEQ ID NO: 3654893 - RNA, 22 nt, Salmonella enterica enterica serovar Typhi
cgcugcuguaacagacgcaggc

SEQ ID NO: 3654894 - RNA, 21 nt, Salmonella enterica enterica serovar Typhi
cgcuggaacugaucgugccca

SEQ ID NO: 3654895 - RNA, 23 nt, Salmonella enterica enterica serovar Typhi
cgcuggaaguaugccucgcgcac

SEQ ID NO: 3654896 - RNA, 20 nt, Salmonella enterica enterica serovar Typhi
cgcuggaaucauccaccaga

SEQ ID NO: 3654897 - RNA, 13 nt, Salmonella enterica enterica serovar Typhi
cgcuggacauuaa

SEQ ID NO: 3654898 - RNA, 23 nt, Salmonella enterica enterica serovar Typhi
cgcuggacgucgucaccacggug

SEQ ID NO: 3654899 - RNA, 16 nt, Salmonella enterica enterica serovar Typhi
cgcuggcaauaaagca

SEQ ID NO: 3654900 - RNA, 22 nt, Salmonella enterica enterica serovar Typhi
cgcuggcaauaaagcagggcgg

SEQ ID NO: 3654901 - RNA, 16 nt, Salmonella enterica enterica serovar Typhi
cgcuggcacaggauau

SEQ ID NO: 3654902 - RNA, 12 nt, Salmonella enterica enterica serovar Typhi
cgcuggcgcgcu

SEQ ID NO: 3654903 - RNA, 16 nt, Salmonella enterica enterica serovar Typhi
cgcuggcgcgucugug

SEQ ID NO: 3654904 - RNA, 13 nt, Salmonella enterica enterica serovar Typhi
cgcuggcgcuguc

SEQ ID NO: 3654905 - RNA, 22 nt, Salmonella enterica enterica serovar Typhi
cgcuggcggcgacgauaggcau

SEQ ID NO: 3654906 - RNA, 17 nt, Salmonella enterica enterica serovar Typhi
cgcuggcggcguccggc

SEQ ID NO: 3654907 - RNA, 20 nt, Salmonella enterica enterica serovar Typhi
cgcuggcguauucgcccggc

SEQ ID NO: 3654908 - RNA, 23 nt, Salmonella enterica enterica serovar Typhi
cgcuggcguauucgcccggcagg

SEQ ID NO: 3654909 - RNA, 17 nt, Salmonella enterica enterica serovar Typhi
cgcuggcguccagcccg

SEQ ID NO: 3654910 - RNA, 21 nt, Salmonella enterica enterica serovar Typhi
cgcuggcgucuguccggcgcu

SEQ ID NO: 3654911 - RNA, 15 nt, Salmonella enterica enterica serovar Typhi
cgcuggcugccgcca

SEQ ID NO: 3654912 - RNA, 22 nt, Salmonella enterica enterica serovar Typhi
cgcugggaaucgcgauuccgga

SEQ ID NO: 3654913 - RNA, 12 nt, Salmonella enterica enterica serovar Typhi
cgcugggaugac

SEQ ID NO: 3654914 - RNA, 14 nt, Salmonella enterica enterica serovar Typhi
cgcugggcacgcua

SEQ ID NO: 3654915 - RNA, 22 nt, Salmonella enterica enterica serovar Typhi
cgcugggugagcgggcuggugc

SEQ ID NO: 3654916 - RNA, 13 nt, Salmonella enterica enterica serovar Typhi
cgcuggugcagcc

SEQ ID NO: 3654917 - RNA, 16 nt, Salmonella enterica enterica serovar Typhi
cgcugguggccggggg

SEQ ID NO: 3654918 - RNA, 16 nt, Salmonella enterica enterica serovar Typhi
cgcuguaaaccggccc

SEQ ID NO: 3654919 - RNA, 14 nt, Salmonella enterica enterica serovar Typhi
cgcuguaacccgcc

SEQ ID NO: 3654920 - RNA, 18 nt, Salmonella enterica enterica serovar Typhi
cgcuguaacccgccgcca

SEQ ID NO: 3654921 - RNA, 13 nt, Salmonella enterica enterica serovar Typhi
cgcuguagcgcca

SEQ ID NO: 3654922 - RNA, 17 nt, Salmonella enterica enterica serovar Typhi
cgcugucaccagcagca

SEQ ID NO: 3654923 - RNA, 19 nt, Salmonella enterica enterica serovar Typhi
cgcugucacuccggcugca

SEQ ID NO: 3654924 - RNA, 20 nt, Salmonella enterica enterica serovar Typhi
cgcugucagugaaaaaccga

SEQ ID NO: 3654925 - RNA, 14 nt, Salmonella enterica enterica serovar Typhi
cgcuguccgcccag

SEQ ID NO: 3654926 - RNA, 15 nt, Salmonella enterica enterica serovar Typhi
cgcugucgccgcgca

SEQ ID NO: 3654927 - RNA, 15 nt, Salmonella enterica enterica serovar Typhi
cgcugucggcgccca

SEQ ID NO: 3654928 - RNA, 13 nt, Salmonella enterica enterica serovar Typhi
cgcugucggucag

SEQ ID NO: 3654929 - RNA, 20 nt, Salmonella enterica enterica serovar Typhi
cgcugucggucagauucaga

SEQ ID NO: 3654930 - RNA, 18 nt, Salmonella enterica enterica serovar Typhi
cgcugucguuccacacgu

SEQ ID NO: 3654931 - RNA, 21 nt, Salmonella enterica enterica serovar Typhi
cgcugugcuaucaggccuaca

SEQ ID NO: 3654932 - RNA, 15 nt, Salmonella enterica enterica serovar Typhi
cgcuguuaugcacgc

SEQ ID NO: 3654933 - RNA, 12 nt, Salmonella enterica enterica serovar Typhi
cgcuguuguucc

SEQ ID NO: 3654934 - RNA, 16 nt, Salmonella enterica enterica serovar Typhi
cgcuguuuauccacag

SEQ ID NO: 3654935 - RNA, 15 nt, Salmonella enterica enterica serovar Typhi
cgcuuaacgaugcgg

SEQ ID NO: 3654936 - RNA, 17 nt, Salmonella enterica enterica serovar Typhi
cgcuuaacggcccaggc

SEQ ID NO: 3654937 - RNA, 21 nt, Salmonella enterica enterica serovar Typhi
cgcuuaauaauaagcggccua

SEQ ID NO: 3654938 - RNA, 23 nt, Salmonella enterica enterica serovar Typhi
cgcuuaauaauaagcggccuaua

SEQ ID NO: 3654939 - RNA, 23 nt, Salmonella enterica enterica serovar Typhi
cgcuuaaucaguugcaggaaggu

SEQ ID NO: 3654940 - RNA, 20 nt, Salmonella enterica enterica serovar Typhi
cgcuuaauggcgucaaucaa

SEQ ID NO: 3654941 - RNA, 17 nt, Salmonella enterica enterica serovar Typhi
cgcuuacaauuuaucug

SEQ ID NO: 3654942 - RNA, 14 nt, Salmonella enterica enterica serovar Typhi
cgcuuaccaggccu

SEQ ID NO: 3654943 - RNA, 12 nt, Salmonella enterica enterica serovar Typhi
cgcuuaccgggc

SEQ ID NO: 3654944 - RNA, 15 nt, Salmonella enterica enterica serovar Typhi
cgcuuaccgggcagg

SEQ ID NO: 3654945 - RNA, 18 nt, Salmonella enterica enterica serovar Typhi
cgcuuaccgggcaggaua

SEQ ID NO: 3654946 - RNA, 14 nt, Salmonella enterica enterica serovar Typhi
cgcuuaccgggccu

SEQ ID NO: 3654947 - RNA, 14 nt, Salmonella enterica enterica serovar Typhi
cgcuuacgcggcgc

SEQ ID NO: 3654948 - RNA, 18 nt, Salmonella enterica enterica serovar Typhi
cgcuuacucagccagaua

SEQ ID NO: 3654949 - RNA, 19 nt, Salmonella enterica enterica serovar Typhi
cgcuuacucagccagauac

SEQ ID NO: 3654950 - RNA, 13 nt, Salmonella enterica enterica serovar Typhi
cgcuuaucaggcc

SEQ ID NO: 3654951 - RNA, 14 nt, Salmonella enterica enterica serovar Typhi
cgcuuaucaggccu

SEQ ID NO: 3654952 - RNA, 18 nt, Salmonella enterica enterica serovar Typhi
cgcuuaucaggccuacaa

SEQ ID NO: 3654953 - RNA, 19 nt, Salmonella enterica enterica serovar Typhi
cgcuuaucaggccuacaac

SEQ ID NO: 3654954 - RNA, 21 nt, Salmonella enterica enterica serovar Typhi
cgcuuaucaggccuacauccg

SEQ ID NO: 3654955 - RNA, 23 nt, Salmonella enterica enterica serovar Typhi
cgcuuaucaggccuacauccggc

SEQ ID NO: 3654956 - RNA, 17 nt, Salmonella enterica enterica serovar Typhi
cgcuuaucaggccuacg

SEQ ID NO: 3654957 - RNA, 19 nt, Salmonella enterica enterica serovar Typhi
cgcuuaucccagccgcgau

SEQ ID NO: 3654958 - RNA, 14 nt, Salmonella enterica enterica serovar Typhi
cgcuuauccggccu

SEQ ID NO: 3654959 - RNA, 19 nt, Salmonella enterica enterica serovar Typhi
cgcuuauccggccuacaga

SEQ ID NO: 3654960 - RNA, 22 nt, Salmonella enterica enterica serovar Typhi
cgcuuauccggcuuauccggcc

SEQ ID NO: 3654961 - RNA, 13 nt, Salmonella enterica enterica serovar Typhi
cgcuuauccugcc

SEQ ID NO: 3654962 - RNA, 14 nt, Salmonella enterica enterica serovar Typhi
cgcuucaccggcgu

SEQ ID NO: 3654963 - RNA, 20 nt, Salmonella enterica enterica serovar Typhi
cgcuucaccggcgugcgcuu

SEQ ID NO: 3654964 - RNA, 23 nt, Salmonella enterica enterica serovar Typhi
cgcuucacgcgcggcuacugcca

SEQ ID NO: 3654965 - RNA, 15 nt, Salmonella enterica enterica serovar Typhi
cggaaguauccugga

SEQ ID NO: 3654966 - RNA, 11 nt, Salmonella enterica enterica serovar Typhi
cggaauaacuc

SEQ ID NO: 3654967 - RNA, 16 nt, Salmonella enterica enterica serovar Typhi
cggaauaauguaaaaa

SEQ ID NO: 3654968 - RNA, 20 nt, Salmonella enterica enterica serovar Typhi
cggaauaauguaaaaaaaua

SEQ ID NO: 3654969 - RNA, 20 nt, Salmonella enterica enterica serovar Typhi
cggaauagacggccugcaaa

SEQ ID NO: 3654970 - RNA, 21 nt, Salmonella enterica enterica serovar Typhi
cggaauagagauagaacgguu

SEQ ID NO: 3654971 - RNA, 19 nt, Salmonella enterica enterica serovar Typhi
cggaaucgcgauccagccc

SEQ ID NO: 3654972 - RNA, 18 nt, Salmonella enterica enterica serovar Typhi
cggaaugacaaacgccac

SEQ ID NO: 3654973 - RNA, 23 nt, Salmonella enterica enterica serovar Typhi
cggaaugacaaacgccaccgcca

SEQ ID NO: 3654974 - RNA, 15 nt, Salmonella enterica enterica serovar Typhi
cggaaugagagaagg

SEQ ID NO: 3654975 - RNA, 19 nt, Salmonella enterica enterica serovar Typhi
cggaauggcacagcgcagc

SEQ ID NO: 3654976 - RNA, 21 nt, Salmonella enterica enterica serovar Typhi
cggaauggcacagcgcagcaa

SEQ ID NO: 3654977 - RNA, 18 nt, Salmonella enterica enterica serovar Typhi
cggaauggcgggcgcagg

SEQ ID NO: 3654978 - RNA, 20 nt, Salmonella enterica enterica serovar Typhi
cggaaugugaaauacagcca

SEQ ID NO: 3654979 - RNA, 21 nt, Salmonella enterica enterica serovar Typhi
cggaaugugaaauacagccag

SEQ ID NO: 3654980 - RNA, 14 nt, Salmonella enterica enterica serovar Typhi
cggaauuucaggaa

SEQ ID NO: 3654981 - RNA, 15 nt, Salmonella enterica enterica serovar Typhi
cggacaacgcuccag

SEQ ID NO: 3654982 - RNA, 17 nt, Salmonella enterica enterica serovar Typhi
cggacaacgcuccagca

SEQ ID NO: 3654983 - RNA, 16 nt, Salmonella enterica enterica serovar Typhi
cggacacaugaccuga

SEQ ID NO: 3654984 - RNA, 14 nt, Salmonella enterica enterica serovar Typhi
cggacacccgcagc

SEQ ID NO: 3654985 - RNA, 17 nt, Salmonella enterica enterica serovar Typhi
cggacacccgcagccag

SEQ ID NO: 3654986 - RNA, 18 nt, Salmonella enterica enterica serovar Typhi
cggacacccgcagccaga

SEQ ID NO: 3654987 - RNA, 15 nt, Salmonella enterica enterica serovar Typhi
cggacagcagaauau

SEQ ID NO: 3654988 - RNA, 12 nt, Salmonella enterica enterica serovar Typhi
cggacagcagca

SEQ ID NO: 3654989 - RNA, 15 nt, Salmonella enterica enterica serovar Typhi
cggacagcggcagcg

SEQ ID NO: 3654990 - RNA, 19 nt, Salmonella enterica enterica serovar Typhi
cggacaucauccccggcag

SEQ ID NO: 3654991 - RNA, 20 nt, Salmonella enterica enterica serovar Typhi
cggacaucauccccggcagg

SEQ ID NO: 3654992 - RNA, 21 nt, Salmonella enterica enterica serovar Typhi
cggacauuuauuucacuggcc

SEQ ID NO: 3654993 - RNA, 17 nt, Salmonella enterica enterica serovar Typhi
cggaccccucuucuuuu

SEQ ID NO: 3654994 - RNA, 18 nt, Salmonella enterica enterica serovar Typhi
cggaccuccgcguaccuc

SEQ ID NO: 3654995 - RNA, 15 nt, Salmonella enterica enterica serovar Typhi
cggacgaaccuggcg

SEQ ID NO: 3654996 - RNA, 19 nt, Salmonella enterica enterica serovar Typhi
cggacgaacgcuaugcgcc

SEQ ID NO: 3654997 - RNA, 18 nt, Salmonella enterica enterica serovar Typhi
cggacgauaaccaugcuc

SEQ ID NO: 3654998 - RNA, 14 nt, Salmonella enterica enterica serovar Typhi
cggacgcaccagcc

SEQ ID NO: 3654999 - RNA, 19 nt, Salmonella enterica enterica serovar Typhi
cggacgcagaccaaaguca

SEQ ID NO: 3655000 - RNA, 14 nt, Salmonella enterica enterica serovar Typhi
cggacgcagcucau

SEQ ID NO: 3655001 - RNA, 15 nt, Salmonella enterica enterica serovar Typhi
cggacgccgggugau

SEQ ID NO: 3655002 - RNA, 17 nt, Salmonella enterica enterica serovar Typhi
cggacgguaccugaagc

SEQ ID NO: 3655003 - RNA, 23 nt, Salmonella enterica enterica serovar Typhi
cggacggucggcguaauguugcu

SEQ ID NO: 3655004 - RNA, 16 nt, Salmonella enterica enterica serovar Typhi
cggacuagacagccuc

SEQ ID NO: 3655005 - RNA, 14 nt, Salmonella enterica enterica serovar Typhi
cggacucaggccuu

SEQ ID NO: 3655006 - RNA, 13 nt, Salmonella enterica enterica serovar Typhi
cggacucagggug

SEQ ID NO: 3655007 - RNA, 16 nt, Salmonella enterica enterica serovar Typhi
cggacucauacuugcc

SEQ ID NO: 3655008 - RNA, 15 nt, Salmonella enterica enterica serovar Typhi
cggacucgcuggaca

SEQ ID NO: 3655009 - RNA, 16 nt, Salmonella enterica enterica serovar Typhi
cggacucgcuggacau

SEQ ID NO: 3655010 - RNA, 13 nt, Salmonella enterica enterica serovar Typhi
cggacugcgggga

SEQ ID NO: 3655011 - RNA, 11 nt, Salmonella enterica enterica serovar Typhi
cggacugcugg

SEQ ID NO: 3655012 - RNA, 16 nt, Salmonella enterica enterica serovar Typhi
cggagaaaaagcgaua

SEQ ID NO: 3655013 - RNA, 19 nt, Salmonella enterica enterica serovar Typhi
cggagaaaagcgaaaauaa

SEQ ID NO: 3655014 - RNA, 23 nt, Salmonella enterica enterica serovar Typhi
cggagaaauagacgagcgaaaaa

SEQ ID NO: 3655015 - RNA, 14 nt, Salmonella enterica enterica serovar Typhi
cggagaacggcaca

SEQ ID NO: 3655016 - RNA, 22 nt, Salmonella enterica enterica serovar Typhi
cggagaacggcacaauagcgcu

SEQ ID NO: 3655017 - RNA, 21 nt, Salmonella enterica enterica serovar Typhi
cggagaacgguucauccagca

SEQ ID NO: 3655018 - RNA, 17 nt, Salmonella enterica enterica serovar Typhi
cggagaagacgccgccg

SEQ ID NO: 3655019 - RNA, 21 nt, Salmonella enterica enterica serovar Typhi
cggagagagcaacuggcaaua

SEQ ID NO: 3655020 - RNA, 14 nt, Salmonella enterica enterica serovar Typhi
cggagagucgacca

SEQ ID NO: 3655021 - RNA, 21 nt, Salmonella enterica enterica serovar Typhi
cggagaguucauaacgcacaa

SEQ ID NO: 3655022 - RNA, 23 nt, Salmonella enterica enterica serovar Typhi
cggagauacccuuaugauagccg

SEQ ID NO: 3655023 - RNA, 15 nt, Salmonella enterica enterica serovar Typhi
cggagaucuccagau

SEQ ID NO: 3655024 - RNA, 23 nt, Salmonella enterica enterica serovar Typhi
cggagaugaucguuuccagcauc

SEQ ID NO: 3655025 - RNA, 20 nt, Salmonella enterica enterica serovar Typhi
cggagauuaacagcgcgacc

SEQ ID NO: 3655026 - RNA, 22 nt, Salmonella enterica enterica serovar Typhi
cggagcaaaaaaugagaacacc

SEQ ID NO: 3655027 - RNA, 16 nt, Salmonella enterica enterica serovar Typhi
cggagccaauaaucaa

SEQ ID NO: 3655028 - RNA, 17 nt, Salmonella enterica enterica serovar Typhi
cggagcggcguccgcca

SEQ ID NO: 3655029 - RNA, 15 nt, Salmonella enterica enterica serovar Typhi
cggagcgucauuuuc

SEQ ID NO: 3655030 - RNA, 17 nt, Salmonella enterica enterica serovar Typhi
cggagcguucaugcugg

SEQ ID NO: 3655031 - RNA, 22 nt, Salmonella enterica enterica serovar Typhi
cggagcuaaaccgucauuuacc

SEQ ID NO: 3655032 - RNA, 15 nt, Salmonella enterica enterica serovar Typhi
cggagcuggcacgcg

SEQ ID NO: 3655033 - RNA, 15 nt, Salmonella enterica enterica serovar Typhi
cggaggagugcgcca

SEQ ID NO: 3655034 - RNA, 22 nt, Salmonella enterica enterica serovar Typhi
cggaggauauuuauuauuucca

SEQ ID NO: 3655035 - RNA, 19 nt, Salmonella enterica enterica serovar Typhi
cggaggccagauucaccac

SEQ ID NO: 3655036 - RNA, 21 nt, Salmonella enterica enterica serovar Typhi
cggaggccagauucaccacca

SEQ ID NO: 3655037 - RNA, 16 nt, Salmonella enterica enterica serovar Typhi
cggaggcgggcgcgca

SEQ ID NO: 3655038 - RNA, 14 nt, Salmonella enterica enterica serovar Typhi
cggaguccagcaac

SEQ ID NO: 3655039 - RNA, 15 nt, Salmonella enterica enterica serovar Typhi
cggagucuuauccga

SEQ ID NO: 3655040 - RNA, 22 nt, Salmonella enterica enterica serovar Typhi
cggaguggccgcaaaugauaau

SEQ ID NO: 3655041 - RNA, 15 nt, Salmonella enterica enterica serovar Typhi
cggauaaaauuauuu

SEQ ID NO: 3655042 - RNA, 13 nt, Salmonella enterica enterica serovar Typhi
cggauaacgcgcu

SEQ ID NO: 3655043 - RNA, 16 nt, Salmonella enterica enterica serovar Typhi
cggauaacgcgcuggc

SEQ ID NO: 3655044 - RNA, 19 nt, Salmonella enterica enterica serovar Typhi
cggauaacgcgcuggcgga

SEQ ID NO: 3655045 - RNA, 13 nt, Salmonella enterica enterica serovar Typhi
cggauaacggcgc

SEQ ID NO: 3655046 - RNA, 15 nt, Salmonella enterica enterica serovar Typhi
cggauaagcaacgcg

SEQ ID NO: 3655047 - RNA, 16 nt, Salmonella enterica enterica serovar Typhi
cggauaagcauagcgu

SEQ ID NO: 3655048 - RNA, 19 nt, Salmonella enterica enterica serovar Typhi
cggauaagcauuagcgcca

SEQ ID NO: 3655049 - RNA, 14 nt, Salmonella enterica enterica serovar Typhi
cggauaagcccggc

SEQ ID NO: 3655050 - RNA, 17 nt, Salmonella enterica enterica serovar Typhi
cggauaagcgcagcgcc

SEQ ID NO: 3655051 - RNA, 20 nt, Salmonella enterica enterica serovar Typhi
cggcacaaugcccggcauac

SEQ ID NO: 3655052 - RNA, 13 nt, Salmonella enterica enterica serovar Typhi
cggcacacagcac

SEQ ID NO: 3655053 - RNA, 13 nt, Salmonella enterica enterica serovar Typhi
cggcacagccagu

SEQ ID NO: 3655054 - RNA, 23 nt, Salmonella enterica enterica serovar Typhi
cggcacauaggcaaacaccucag

SEQ ID NO: 3655055 - RNA, 15 nt, Salmonella enterica enterica serovar Typhi
cggcacaucaauaaa

SEQ ID NO: 3655056 - RNA, 17 nt, Salmonella enterica enterica serovar Typhi
cggcacaucgcgcguga

SEQ ID NO: 3655057 - RNA, 20 nt, Salmonella enterica enterica serovar Typhi
cggcacauucaccacgcagc

SEQ ID NO: 3655058 - RNA, 21 nt, Salmonella enterica enterica serovar Typhi
cggcacauugucagcugaaca

SEQ ID NO: 3655059 - RNA, 15 nt, Salmonella enterica enterica serovar Typhi
cggcaccacauuaaa

SEQ ID NO: 3655060 - RNA, 23 nt, Salmonella enterica enterica serovar Typhi
cggcaccacgcacaguacgcccg

SEQ ID NO: 3655061 - RNA, 13 nt, Salmonella enterica enterica serovar Typhi
cggcaccagccag

SEQ ID NO: 3655062 - RNA, 16 nt, Salmonella enterica enterica serovar Typhi
cggcaccagcgaugcg

SEQ ID NO: 3655063 - RNA, 21 nt, Salmonella enterica enterica serovar Typhi
cggcaccagcgaugcgcgcgc

SEQ ID NO: 3655064 - RNA, 18 nt, Salmonella enterica enterica serovar Typhi
cggcaccggaaccggcau

SEQ ID NO: 3655065 - RNA, 23 nt, Salmonella enterica enterica serovar Typhi
cggcaccggaaccggcaucggga

SEQ ID NO: 3655066 - RNA, 14 nt, Salmonella enterica enterica serovar Typhi
cggcaccggacauc

SEQ ID NO: 3655067 - RNA, 17 nt, Salmonella enterica enterica serovar Typhi
cggcacgaaaaauaaaa

SEQ ID NO: 3655068 - RNA, 15 nt, Salmonella enterica enterica serovar Typhi
cggcacgccagcgcc

SEQ ID NO: 3655069 - RNA, 18 nt, Salmonella enterica enterica serovar Typhi
cggcacgguuaaugaaau

SEQ ID NO: 3655070 - RNA, 20 nt, Salmonella enterica enterica serovar Typhi
cggcacgucgucccaggcca

SEQ ID NO: 3655071 - RNA, 21 nt, Salmonella enterica enterica serovar Typhi
cggcacgucgucccaggccag

SEQ ID NO: 3655072 - RNA, 21 nt, Salmonella enterica enterica serovar Typhi
cggcacucaccucuuccgcca

SEQ ID NO: 3655073 - RNA, 21 nt, Salmonella enterica enterica serovar Typhi
cggcacugacucuuccgggcg

SEQ ID NO: 3655074 - RNA, 11 nt, Salmonella enterica enterica serovar Typhi
cggcagaccgg

SEQ ID NO: 3655075 - RNA, 12 nt, Salmonella enterica enterica serovar Typhi
cggcagaccgga

SEQ ID NO: 3655076 - RNA, 15 nt, Salmonella enterica enterica serovar Typhi
cggcagaccggcagc

SEQ ID NO: 3655077 - RNA, 17 nt, Salmonella enterica enterica serovar Typhi
cggcagaccggcagccu

SEQ ID NO: 3655078 - RNA, 19 nt, Salmonella enterica enterica serovar Typhi
cggcagacgauagcgggug

SEQ ID NO: 3655079 - RNA, 15 nt, Salmonella enterica enterica serovar Typhi
cggcagacggcuggg

SEQ ID NO: 3655080 - RNA, 18 nt, Salmonella enterica enterica serovar Typhi
cggcagauaucgcugacc

SEQ ID NO: 3655081 - RNA, 17 nt, Salmonella enterica enterica serovar Typhi
cggcagcaauacgcccg

SEQ ID NO: 3655082 - RNA, 14 nt, Salmonella enterica enterica serovar Typhi
cggcagcagcuuca

SEQ ID NO: 3655083 - RNA, 20 nt, Salmonella enterica enterica serovar Typhi
cggcagcagcuucagcauca

SEQ ID NO: 3655084 - RNA, 13 nt, Salmonella enterica enterica serovar Typhi
cggcagccacgcc

SEQ ID NO: 3655085 - RNA, 15 nt, Salmonella enterica enterica serovar Typhi
cggcagccacgccga

SEQ ID NO: 3655086 - RNA, 16 nt, Salmonella enterica enterica serovar Typhi
cggcagccgccaccac

SEQ ID NO: 3655087 - RNA, 17 nt, Salmonella enterica enterica serovar Typhi
cggcagccgccaccaca

SEQ ID NO: 3655088 - RNA, 17 nt, Salmonella enterica enterica serovar Typhi
cggcagccgggccgcaa

SEQ ID NO: 3655089 - RNA, 15 nt, Salmonella enterica enterica serovar Typhi
cggcagcgccauccg

SEQ ID NO: 3655090 - RNA, 19 nt, Salmonella enterica enterica serovar Typhi
cggcagcgcgacauagagc

SEQ ID NO: 3655091 - RNA, 21 nt, Salmonella enterica enterica serovar Typhi
cggcagcgcgcacguucaggu

SEQ ID NO: 3655092 - RNA, 11 nt, Salmonella enterica enterica serovar Typhi
cggcagcucug

SEQ ID NO: 3655093 - RNA, 17 nt, Salmonella enterica enterica serovar Typhi
cggcagcuucagccagu

SEQ ID NO: 3655094 - RNA, 23 nt, Salmonella enterica enterica serovar Typhi
cggcaggacaaucauaauaaacu

SEQ ID NO: 3655095 - RNA, 12 nt, Salmonella enterica enterica serovar Typhi
cggcaggcacua

SEQ ID NO: 3655096 - RNA, 12 nt, Salmonella enterica enterica serovar Typhi
cggcaggcauuu

SEQ ID NO: 3655097 - RNA, 11 nt, Salmonella enterica enterica serovar Typhi
cggcaggcugg

SEQ ID NO: 3655098 - RNA, 14 nt, Salmonella enterica enterica serovar Typhi
cggcaggcuggcgg

SEQ ID NO: 3655099 - RNA, 16 nt, Salmonella enterica enterica serovar Typhi
cggcagggcagcgagc

SEQ ID NO: 3655100 - RNA, 23 nt, Salmonella enterica enterica serovar Typhi
cggcaggugauggcggcuuggcu

SEQ ID NO: 3655101 - RNA, 15 nt, Salmonella enterica enterica serovar Typhi
cggcaguacacgcau

SEQ ID NO: 3655102 - RNA, 20 nt, Salmonella enterica enterica serovar Typhi
cggcagucacuuucagauuu

SEQ ID NO: 3655103 - RNA, 12 nt, Salmonella enterica enterica serovar Typhi
cggcagucgcua

SEQ ID NO: 3655104 - RNA, 17 nt, Salmonella enterica enterica serovar Typhi
cggcagugcggugguau

SEQ ID NO: 3655105 - RNA, 22 nt, Salmonella enterica enterica serovar Typhi
cggcaguggcauguucccaugu

SEQ ID NO: 3655106 - RNA, 22 nt, Salmonella enterica enterica serovar Typhi
cggcaguucuaacaggaagcga

SEQ ID NO: 3655107 - RNA, 18 nt, Salmonella enterica enterica serovar Typhi
cggcaguugccggaacca

SEQ ID NO: 3655108 - RNA, 17 nt, Salmonella enterica enterica serovar Typhi
cggcaguugcuggcgcu

SEQ ID NO: 3655109 - RNA, 15 nt, Salmonella enterica enterica serovar Typhi
cggcauaauccggca

SEQ ID NO: 3655110 - RNA, 12 nt, Salmonella enterica enterica serovar Typhi
cggcauacaccg

SEQ ID NO: 3655111 - RNA, 17 nt, Salmonella enterica enterica serovar Typhi
cggcauacaccgccagc

SEQ ID NO: 3655112 - RNA, 19 nt, Salmonella enterica enterica serovar Typhi
cggcauacaccgccagcgu

SEQ ID NO: 3655113 - RNA, 21 nt, Salmonella enterica enterica serovar Typhi
cggcauacaccgccagcgucu

SEQ ID NO: 3655114 - RNA, 14 nt, Salmonella enterica enterica serovar Typhi
cggcauacacgccg

SEQ ID NO: 3655115 - RNA, 12 nt, Salmonella enterica enterica serovar Typhi
cggcauacagcg

SEQ ID NO: 3655116 - RNA, 23 nt, Salmonella enterica enterica serovar Typhi
cggcauacaggccgccgggucag

SEQ ID NO: 3655117 - RNA, 15 nt, Salmonella enterica enterica serovar Typhi
cggcauacgccgggc

SEQ ID NO: 3655118 - RNA, 19 nt, Salmonella enterica enterica serovar Typhi
cggcauacugucgcgcggc

SEQ ID NO: 3655119 - RNA, 19 nt, Salmonella enterica enterica serovar Typhi
cggcauacuuucgcgcggc

SEQ ID NO: 3655120 - RNA, 16 nt, Salmonella enterica enterica serovar Typhi
cggcauaugcaggucg

SEQ ID NO: 3655121 - RNA, 19 nt, Salmonella enterica enterica serovar Typhi
cggcauaugcaggucgcgc

SEQ ID NO: 3655122 - RNA, 20 nt, Salmonella enterica enterica serovar Typhi
cggcauauucaggagcaugg

SEQ ID NO: 3655123 - RNA, 18 nt, Salmonella enterica enterica serovar Typhi
cggcauauucccugacug

SEQ ID NO: 3655124 - RNA, 11 nt, Salmonella enterica enterica serovar Typhi
cggcaucaagc

SEQ ID NO: 3655125 - RNA, 19 nt, Salmonella enterica enterica serovar Typhi
cggcaucaagcccauguuc

SEQ ID NO: 3655126 - RNA, 16 nt, Salmonella enterica enterica serovar Typhi
cggcaucacaggcuua

SEQ ID NO: 3655127 - RNA, 11 nt, Salmonella enterica enterica serovar Typhi
cggcaucacgc

SEQ ID NO: 3655128 - RNA, 13 nt, Salmonella enterica enterica serovar Typhi
cggcaucacgccg

SEQ ID NO: 3655129 - RNA, 15 nt, Salmonella enterica enterica serovar Typhi
cggcaucacgccggu

SEQ ID NO: 3655130 - RNA, 14 nt, Salmonella enterica enterica serovar Typhi
cggcaucaggaaaa

SEQ ID NO: 3655131 - RNA, 18 nt, Salmonella enterica enterica serovar Typhi
cggcaucguagucaggca

SEQ ID NO: 3655132 - RNA, 17 nt, Salmonella enterica enterica serovar Typhi
cggcaucucaaggucug

SEQ ID NO: 3655133 - RNA, 14 nt, Salmonella enterica enterica serovar Typhi
cggcaucucaucuu

SEQ ID NO: 3655134 - RNA, 15 nt, Salmonella enterica enterica serovar Typhi
cggcaucucuucguu

SEQ ID NO: 3655135 - RNA, 19 nt, Salmonella enterica enterica serovar Typhi
cggcaucuuuaaccgccug

SEQ ID NO: 3655136 - RNA, 20 nt, Salmonella enterica enterica serovar Typhi
cggcaugauagggcgccugu

SEQ ID NO: 3655137 - RNA, 18 nt, Salmonella enterica enterica serovar Typhi
cggcgaacguuggcuggg

SEQ ID NO: 3655138 - RNA, 18 nt, Salmonella enterica enterica serovar Typhi
cggcgaacucggucaggg

SEQ ID NO: 3655139 - RNA, 18 nt, Salmonella enterica enterica serovar Typhi
cggcgaagauccgcucac

SEQ ID NO: 3655140 - RNA, 17 nt, Salmonella enterica enterica serovar Typhi
cggcgaagggggccggg

SEQ ID NO: 3655141 - RNA, 15 nt, Salmonella enterica enterica serovar Typhi
cggcgaaggucgcgc

SEQ ID NO: 3655142 - RNA, 18 nt, Salmonella enterica enterica serovar Typhi
cggcgaaggucgcgccgc

SEQ ID NO: 3655143 - RNA, 20 nt, Salmonella enterica enterica serovar Typhi
cggcgaaucgcagagcguaa

SEQ ID NO: 3655144 - RNA, 14 nt, Salmonella enterica enterica serovar Typhi
cggcgacagcgacc

SEQ ID NO: 3655145 - RNA, 13 nt, Salmonella enterica enterica serovar Typhi
cggcgaccagcag

SEQ ID NO: 3655146 - RNA, 20 nt, Salmonella enterica enterica serovar Typhi
cggcgaccuucacgccgcca

SEQ ID NO: 3655147 - RNA, 21 nt, Salmonella enterica enterica serovar Typhi
cggcgaccuucacgccgccaa

SEQ ID NO: 3655148 - RNA, 15 nt, Salmonella enterica enterica serovar Typhi
cggcgacgcccgcca

SEQ ID NO: 3655149 - RNA, 20 nt, Salmonella enterica enterica serovar Typhi
cggcgacggacucgcgcaga

SEQ ID NO: 3655150 - RNA, 16 nt, Salmonella enterica enterica serovar Typhi
cggcgacgugacgcgc

SEQ ID NO: 3655151 - RNA, 20 nt, Salmonella enterica enterica serovar Typhi
cggcgacgugacgcgccagc

SEQ ID NO: 3655152 - RNA, 14 nt, Salmonella enterica enterica serovar Typhi
cggcgacuccagaa

SEQ ID NO: 3655153 - RNA, 16 nt, Salmonella enterica enterica serovar Typhi
cggcgacugccgcaga

SEQ ID NO: 3655154 - RNA, 17 nt, Salmonella enterica enterica serovar Typhi
cggcgacugccgcagac

SEQ ID NO: 3655155 - RNA, 13 nt, Salmonella enterica enterica serovar Typhi
cggcgagcaguac

SEQ ID NO: 3655156 - RNA, 15 nt, Salmonella enterica enterica serovar Typhi
cggcgagcaguacgc

SEQ ID NO: 3655157 - RNA, 16 nt, Salmonella enterica enterica serovar Typhi
cggcgauauagcgcug

SEQ ID NO: 3655158 - RNA, 13 nt, Salmonella enterica enterica serovar Typhi
cggcgaucaccac

SEQ ID NO: 3655159 - RNA, 19 nt, Salmonella enterica enterica serovar Typhi
cggcgauggugcggcgcac

SEQ ID NO: 3655160 - RNA, 17 nt, Salmonella enterica enterica serovar Typhi
cggcgaugguugccagc

SEQ ID NO: 3655161 - RNA, 15 nt, Salmonella enterica enterica serovar Typhi
cggcgcaaacaguac

SEQ ID NO: 3655162 - RNA, 23 nt, Salmonella enterica enterica serovar Typhi
cggcgcaaaggccuuauccggcc

SEQ ID NO: 3655163 - RNA, 19 nt, Salmonella enterica enterica serovar Typhi
cggcgcaaauggcugcgac

SEQ ID NO: 3655164 - RNA, 13 nt, Salmonella enterica enterica serovar Typhi
cggcgcacugccu

SEQ ID NO: 3655165 - RNA, 20 nt, Salmonella enterica enterica serovar Typhi
cggcgcacugccugauggcg

SEQ ID NO: 3655166 - RNA, 14 nt, Salmonella enterica enterica serovar Typhi
cggcgcagacacug

SEQ ID NO: 3655167 - RNA, 19 nt, Salmonella enterica enterica serovar Typhi
cggcgcagacacugccacc

SEQ ID NO: 3655168 - RNA, 22 nt, Salmonella enterica enterica serovar Typhi
cggcgcaggggcauuuuccggc

SEQ ID NO: 3655169 - RNA, 22 nt, Salmonella enterica enterica serovar Typhi
cggcgcagguccauuuuuuauc

SEQ ID NO: 3655170 - RNA, 21 nt, Salmonella enterica enterica serovar Typhi
cggcgcaguucgccgccagga

SEQ ID NO: 3655171 - RNA, 12 nt, Salmonella enterica enterica serovar Typhi
cggcgccaacgc

SEQ ID NO: 3655172 - RNA, 20 nt, Salmonella enterica enterica serovar Typhi
cggcgccaaucaccgccagc

SEQ ID NO: 3655173 - RNA, 13 nt, Salmonella enterica enterica serovar Typhi
cggcgccagccac

SEQ ID NO: 3655174 - RNA, 16 nt, Salmonella enterica enterica serovar Typhi
cggcgccaggacaacg

SEQ ID NO: 3655175 - RNA, 15 nt, Salmonella enterica enterica serovar Typhi
cggcgccaucaccau

SEQ ID NO: 3655176 - RNA, 15 nt, Salmonella enterica enterica serovar Typhi
cggcgccaucgccuc

SEQ ID NO: 3655177 - RNA, 17 nt, Salmonella enterica enterica serovar Typhi
cggcgcccagccugccu

SEQ ID NO: 3655178 - RNA, 21 nt, Salmonella enterica enterica serovar Typhi
cggcgcccagcuuacgcgcag

SEQ ID NO: 3655179 - RNA, 14 nt, Salmonella enterica enterica serovar Typhi
cggcgcccggaggg

SEQ ID NO: 3655180 - RNA, 15 nt, Salmonella enterica enterica serovar Typhi
cggcgccgaagcagg

SEQ ID NO: 3655181 - RNA, 17 nt, Salmonella enterica enterica serovar Typhi
cggcgccggggugcugu

SEQ ID NO: 3655182 - RNA, 14 nt, Salmonella enterica enterica serovar Typhi
cggcgccuuccggc

SEQ ID NO: 3655183 - RNA, 21 nt, Salmonella enterica enterica serovar Typhi
cggcgccuuuaauuccgccgg

SEQ ID NO: 3655184 - RNA, 14 nt, Salmonella enterica enterica serovar Typhi
cggcgcgaaucccg

SEQ ID NO: 3655185 - RNA, 16 nt, Salmonella enterica enterica serovar Typhi
cggcgcgaaugcguag

SEQ ID NO: 3655186 - RNA, 18 nt, Salmonella enterica enterica serovar Typhi
cggcgcgacuuuaaucac

SEQ ID NO: 3655187 - RNA, 23 nt, Salmonella enterica enterica serovar Typhi
cggcgcgacuuuaaucaccugcc

SEQ ID NO: 3655188 - RNA, 23 nt, Salmonella enterica enterica serovar Typhi
cggcgcgaguguagucccgccgg

SEQ ID NO: 3655189 - RNA, 17 nt, Salmonella enterica enterica serovar Typhi
cggcgcgauauccacca

SEQ ID NO: 3655190 - RNA, 16 nt, Salmonella enterica enterica serovar Typhi
cggcgcgaucaucgca

SEQ ID NO: 3655191 - RNA, 15 nt, Salmonella enterica enterica serovar Typhi
cggcgcgccagcgca

SEQ ID NO: 3655192 - RNA, 14 nt, Salmonella enterica enterica serovar Typhi
cggcgcgccuucca

SEQ ID NO: 3655193 - RNA, 20 nt, Salmonella enterica enterica serovar Typhi
cggcgcgccuuccagcaauu

SEQ ID NO: 3655194 - RNA, 12 nt, Salmonella enterica enterica serovar Typhi
cggcgcgcgcgc

SEQ ID NO: 3655195 - RNA, 13 nt, Salmonella enterica enterica serovar Typhi
cggcgcggaaggg

SEQ ID NO: 3655196 - RNA, 13 nt, Salmonella enterica enterica serovar Typhi
cggcgcggcauca

SEQ ID NO: 3655197 - RNA, 20 nt, Salmonella enterica enterica serovar Typhi
cggcgcgggugaugacgcgc

SEQ ID NO: 3655198 - RNA, 23 nt, Salmonella enterica enterica serovar Typhi
cggcgcgggugaugacgcgcagg

SEQ ID NO: 3655199 - RNA, 22 nt, Salmonella enterica enterica serovar Typhi
cggcgcgguauuucgccgccgc

SEQ ID NO: 3655200 - RNA, 16 nt, Salmonella enterica enterica serovar Typhi
cggcgcgguuuccggu

SEQ ID NO: 3655201 - RNA, 20 nt, Salmonella enterica enterica serovar Typhi
cggcgcgucgggcagggaug

SEQ ID NO: 3655202 - RNA, 20 nt, Salmonella enterica enterica serovar Typhi
cggcgcgucuucccggcgcu

SEQ ID NO: 3655203 - RNA, 16 nt, Salmonella enterica enterica serovar Typhi
cggcgcguucgccaaa

SEQ ID NO: 3655204 - RNA, 14 nt, Salmonella enterica enterica serovar Typhi
cggcgcuaaccagc

SEQ ID NO: 3655205 - RNA, 16 nt, Salmonella enterica enterica serovar Typhi
cggcgcuacggcguuu

SEQ ID NO: 3655206 - RNA, 14 nt, Salmonella enterica enterica serovar Typhi
cggcgcucacgcug

SEQ ID NO: 3655207 - RNA, 18 nt, Salmonella enterica enterica serovar Typhi
cggcgcucaggaucgccg

SEQ ID NO: 3655208 - RNA, 14 nt, Salmonella enterica enterica serovar Typhi
cggcgcucgccagc

SEQ ID NO: 3655209 - RNA, 17 nt, Salmonella enterica enterica serovar Typhi
cggcgcugaugacgcgc

SEQ ID NO: 3655210 - RNA, 15 nt, Salmonella enterica enterica serovar Typhi
cggcgcuggcgcgcu

SEQ ID NO: 3655211 - RNA, 13 nt, Salmonella enterica enterica serovar Typhi
cggcgcuggcgcu

SEQ ID NO: 3655212 - RNA, 22 nt, Salmonella enterica enterica serovar Typhi
cggcgcuguacggacauugacc

SEQ ID NO: 3655213 - RNA, 22 nt, Salmonella enterica enterica serovar Typhi
cggcgcugucacuccggcugca

SEQ ID NO: 3655214 - RNA, 16 nt, Salmonella enterica enterica serovar Typhi
cggcgcuuccugcagu

SEQ ID NO: 3655215 - RNA, 19 nt, Salmonella enterica enterica serovar Typhi
cggcgcuuccugcagugga

SEQ ID NO: 3655216 - RNA, 15 nt, Salmonella enterica enterica serovar Typhi
cggcgcuucgcagcg

SEQ ID NO: 3655217 - RNA, 23 nt, Salmonella enterica enterica serovar Typhi
cggcggaaaaaagcagcaucccg

SEQ ID NO: 3655218 - RNA, 19 nt, Salmonella enterica enterica serovar Typhi
cggcggaaaauagccagaa

SEQ ID NO: 3655219 - RNA, 22 nt, Salmonella enterica enterica serovar Typhi
cggcggaaaauagccagaaugc

SEQ ID NO: 3655220 - RNA, 22 nt, Salmonella enterica enterica serovar Typhi
cggcggaaccauuuuccccaga

SEQ ID NO: 3655221 - RNA, 23 nt, Salmonella enterica enterica serovar Typhi
cggcggaaccauuuuccccagaa

SEQ ID NO: 3655222 - RNA, 12 nt, Salmonella enterica enterica serovar Typhi
cggcggaagcga

SEQ ID NO: 3655223 - RNA, 20 nt, Salmonella enterica enterica serovar Typhi
cggcuuacugcuucgcgccu

SEQ ID NO: 3655224 - RNA, 23 nt, Salmonella enterica enterica serovar Typhi
cggcuuacugcuucgcgccuucu

SEQ ID NO: 3655225 - RNA, 22 nt, Salmonella enterica enterica serovar Typhi
cggcuuaucguuaaggccugcg

SEQ ID NO: 3655226 - RNA, 14 nt, Salmonella enterica enterica serovar Typhi
cggcuucaaucguc

SEQ ID NO: 3655227 - RNA, 18 nt, Salmonella enterica enterica serovar Typhi
cggcuucacgccauccag

SEQ ID NO: 3655228 - RNA, 14 nt, Salmonella enterica enterica serovar Typhi
cggcuucagcgaca

SEQ ID NO: 3655229 - RNA, 16 nt, Salmonella enterica enterica serovar Typhi
cggcuucagcggcgca

SEQ ID NO: 3655230 - RNA, 23 nt, Salmonella enterica enterica serovar Typhi
cggcuuccguuuuguugccgccc

SEQ ID NO: 3655231 - RNA, 15 nt, Salmonella enterica enterica serovar Typhi
cggcuuccucgcagu

SEQ ID NO: 3655232 - RNA, 17 nt, Salmonella enterica enterica serovar Typhi
cggcuugucauccugcu

SEQ ID NO: 3655233 - RNA, 16 nt, Salmonella enterica enterica serovar Typhi
cggcuugugagcgucg

SEQ ID NO: 3655234 - RNA, 15 nt, Salmonella enterica enterica serovar Typhi
cggcuuguuaugcgg

SEQ ID NO: 3655235 - RNA, 15 nt, Salmonella enterica enterica serovar Typhi
cggcuuuauuacuuc

SEQ ID NO: 3655236 - RNA, 22 nt, Salmonella enterica enterica serovar Typhi
cggcuuucacaccguuauccgg

SEQ ID NO: 3655237 - RNA, 21 nt, Salmonella enterica enterica serovar Typhi
cggcuuucuguuccgaaauaa

SEQ ID NO: 3655238 - RNA, 17 nt, Salmonella enterica enterica serovar Typhi
cggcuuugcgccggcag

SEQ ID NO: 3655239 - RNA, 19 nt, Salmonella enterica enterica serovar Typhi
cggcuuugcgccggcaguc

SEQ ID NO: 3655240 - RNA, 17 nt, Salmonella enterica enterica serovar Typhi
cggcuuuuugccgggcg

SEQ ID NO: 3655241 - RNA, 15 nt, Salmonella enterica enterica serovar Typhi
cggcuuuuuucucca

SEQ ID NO: 3655242 - RNA, 22 nt, Salmonella enterica enterica serovar Typhi
cgggaaaacggccagugaaaua

SEQ ID NO: 3655243 - RNA, 22 nt, Salmonella enterica enterica serovar Typhi
cgggaaagauaauaccucaaau

SEQ ID NO: 3655244 - RNA, 18 nt, Salmonella enterica enterica serovar Typhi
cgggaaagggcggcagcg

SEQ ID NO: 3655245 - RNA, 15 nt, Salmonella enterica enterica serovar Typhi
cgggaaauagagcag

SEQ ID NO: 3655246 - RNA, 15 nt, Salmonella enterica enterica serovar Typhi
cgggaacagauaaau

SEQ ID NO: 3655247 - RNA, 22 nt, Salmonella enterica enterica serovar Typhi
cgggaagaugugccacuccgcc

SEQ ID NO: 3655248 - RNA, 13 nt, Salmonella enterica enterica serovar Typhi
cgggacauccgga

SEQ ID NO: 3655249 - RNA, 21 nt, Salmonella enterica enterica serovar Typhi
cgggacauguucagcgcagaa

SEQ ID NO: 3655250 - RNA, 17 nt, Salmonella enterica enterica serovar Typhi
cgggacggcggccagca

SEQ ID NO: 3655251 - RNA, 23 nt, Salmonella enterica enterica serovar Typhi
cgggacugguggcgagauaagcc

SEQ ID NO: 3655252 - RNA, 15 nt, Salmonella enterica enterica serovar Typhi
cgggacuucaggcau

SEQ ID NO: 3655253 - RNA, 21 nt, Salmonella enterica enterica serovar Typhi
cgggagauuaggguucacggc

SEQ ID NO: 3655254 - RNA, 18 nt, Salmonella enterica enterica serovar Typhi
cgggagcguuaaucaccu

SEQ ID NO: 3655255 - RNA, 12 nt, Salmonella enterica enterica serovar Typhi
cgggagcuugcc

SEQ ID NO: 3655256 - RNA, 15 nt, Salmonella enterica enterica serovar Typhi
cgggaggggcuuucc

SEQ ID NO: 3655257 - RNA, 18 nt, Salmonella enterica enterica serovar Typhi
cgggagguucaccaccac

SEQ ID NO: 3655258 - RNA, 17 nt, Salmonella enterica enterica serovar Typhi
cgggauaauauugccau

SEQ ID NO: 3655259 - RNA, 19 nt, Salmonella enterica enterica serovar Typhi
cgggauacggcgagaccau

SEQ ID NO: 3655260 - RNA, 14 nt, Salmonella enterica enterica serovar Typhi
cgggauauccucuu

SEQ ID NO: 3655261 - RNA, 16 nt, Salmonella enterica enterica serovar Typhi
cgggaucagcgcgcuc

SEQ ID NO: 3655262 - RNA, 17 nt, Salmonella enterica enterica serovar Typhi
cgggauccccugcuccu

SEQ ID NO: 3655263 - RNA, 18 nt, Salmonella enterica enterica serovar Typhi
cgggauccccugcuccug

SEQ ID NO: 3655264 - RNA, 23 nt, Salmonella enterica enterica serovar Typhi
cgggaucgaaccgccgacccccu

SEQ ID NO: 3655265 - RNA, 15 nt, Salmonella enterica enterica serovar Typhi
cgggaucgagcgcgg

SEQ ID NO: 3655266 - RNA, 13 nt, Salmonella enterica enterica serovar Typhi
cgggaucgccaga

SEQ ID NO: 3655267 - RNA, 16 nt, Salmonella enterica enterica serovar Typhi
cgggaugcauaaaaaa

SEQ ID NO: 3655268 - RNA, 17 nt, Salmonella enterica enterica serovar Typhi
cgggaugcauaaaaaaa

SEQ ID NO: 3655269 - RNA, 22 nt, Salmonella enterica enterica serovar Typhi
cgggauggccgccgagcuguga

SEQ ID NO: 3655270 - RNA, 22 nt, Salmonella enterica enterica serovar Typhi
cgggauguuaauuucaucgccg

SEQ ID NO: 3655271 - RNA, 19 nt, Salmonella enterica enterica serovar Typhi
cgggauuguauaccgcuuu

SEQ ID NO: 3655272 - RNA, 14 nt, Salmonella enterica enterica serovar Typhi
cgggcaacacacgc

SEQ ID NO: 3655273 - RNA, 14 nt, Salmonella enterica enterica serovar Typhi
cgggcaauacgcug

SEQ ID NO: 3655274 - RNA, 17 nt, Salmonella enterica enterica serovar Typhi
cgggcaaugccaccagc

SEQ ID NO: 3655275 - RNA, 13 nt, Salmonella enterica enterica serovar Typhi
cgggcacgauggc

SEQ ID NO: 3655276 - RNA, 15 nt, Salmonella enterica enterica serovar Typhi
cgggcacgcugacca

SEQ ID NO: 3655277 - RNA, 23 nt, Salmonella enterica enterica serovar Typhi
cgggcacuccggcucgcacauau

SEQ ID NO: 3655278 - RNA, 23 nt, Salmonella enterica enterica serovar Typhi
cgggcagacauucgcgcacggcg

SEQ ID NO: 3655279 - RNA, 18 nt, Salmonella enterica enterica serovar Typhi
cgggcagcggcaagacag

SEQ ID NO: 3655280 - RNA, 19 nt, Salmonella enterica enterica serovar Typhi
cgggcagcggcaagacaga

SEQ ID NO: 3655281 - RNA, 19 nt, Salmonella enterica enterica serovar Typhi
cgggcagggaauacccgcc

SEQ ID NO: 3655282 - RNA, 12 nt, Salmonella enterica enterica serovar Typhi
cgggcagggcug

SEQ ID NO: 3655283 - RNA, 20 nt, Salmonella enterica enterica serovar Typhi
cgggcagggcuguacgaccg

SEQ ID NO: 3655284 - RNA, 19 nt, Salmonella enterica enterica serovar Typhi
cgggcaggucgucuucuug

SEQ ID NO: 3655285 - RNA, 19 nt, Salmonella enterica enterica serovar Typhi
cgggcagucuggcggcagc

SEQ ID NO: 3655286 - RNA, 15 nt, Salmonella enterica enterica serovar Typhi
cgggccauucgccau

SEQ ID NO: 3655287 - RNA, 21 nt, Salmonella enterica enterica serovar Typhi
cgggccgccaucuccggcagc

SEQ ID NO: 3655288 - RNA, 21 nt, Salmonella enterica enterica serovar Typhi
cgggccgccgcagcagaugug

SEQ ID NO: 3655289 - RNA, 21 nt, Salmonella enterica enterica serovar Typhi
cgggccguaaaguucccagcg

SEQ ID NO: 3655290 - RNA, 20 nt, Salmonella enterica enterica serovar Typhi
cgggccguagugcuucucuu

SEQ ID NO: 3655291 - RNA, 19 nt, Salmonella enterica enterica serovar Typhi
cgggccguccggcaaaccc

SEQ ID NO: 3655292 - RNA, 19 nt, Salmonella enterica enterica serovar Typhi
cgggccguggccaggaaua

SEQ ID NO: 3655293 - RNA, 21 nt, Salmonella enterica enterica serovar Typhi
cgggccguuaucuacggagua

SEQ ID NO: 3655294 - RNA, 18 nt, Salmonella enterica enterica serovar Typhi
cgggccuacaaaaucgcc

SEQ ID NO: 3655295 - RNA, 23 nt, Salmonella enterica enterica serovar Typhi
cgggccuacaaaaucgcccaggc

SEQ ID NO: 3655296 - RNA, 17 nt, Salmonella enterica enterica serovar Typhi
cgggccugagcgcgcag

SEQ ID NO: 3655297 - RNA, 18 nt, Salmonella enterica enterica serovar Typhi
cgggccugagcgcgcagc

SEQ ID NO: 3655298 - RNA, 14 nt, Salmonella enterica enterica serovar Typhi
cgggccugccaggu

SEQ ID NO: 3655299 - RNA, 12 nt, Salmonella enterica enterica serovar Typhi
cgggccugugcc

SEQ ID NO: 3655300 - RNA, 17 nt, Salmonella enterica enterica serovar Typhi
cgggccugugccugaca

SEQ ID NO: 3655301 - RNA, 17 nt, Salmonella enterica enterica serovar Typhi
cgggcgacacgcgcgcu

SEQ ID NO: 3655302 - RNA, 15 nt, Salmonella enterica enterica serovar Typhi
cgggcgaccacccgc

SEQ ID NO: 3655303 - RNA, 14 nt, Salmonella enterica enterica serovar Typhi
cgggcgaggccucg

SEQ ID NO: 3655304 - RNA, 15 nt, Salmonella enterica enterica serovar Typhi
cgggcgauaaaccag

SEQ ID NO: 3655305 - RNA, 15 nt, Salmonella enterica enterica serovar Typhi
cgggcgauaaccucu

SEQ ID NO: 3655306 - RNA, 18 nt, Salmonella enterica enterica serovar Typhi
cgggcgauacaccuucac

SEQ ID NO: 3655307 - RNA, 12 nt, Salmonella enterica enterica serovar Typhi
cgggcgccacgu

SEQ ID NO: 3655308 - RNA, 14 nt, Salmonella enterica enterica serovar Typhi
cgguaaucacugcc

SEQ ID NO: 3655309 - RNA, 18 nt, Salmonella enterica enterica serovar Typhi
cgguaaucacugccgcca

SEQ ID NO: 3655310 - RNA, 16 nt, Salmonella enterica enterica serovar Typhi
cgguaaucagacuggc

SEQ ID NO: 3655311 - RNA, 22 nt, Salmonella enterica enterica serovar Typhi
cgguaaucgaucccgccgcauc

SEQ ID NO: 3655312 - RNA, 20 nt, Salmonella enterica enterica serovar Typhi
cgguaauuccuuuacgccca

SEQ ID NO: 3655313 - RNA, 18 nt, Salmonella enterica enterica serovar Typhi
cgguaauugcgccguuca

SEQ ID NO: 3655314 - RNA, 19 nt, Salmonella enterica enterica serovar Typhi
cgguacaaaccccacccac

SEQ ID NO: 3655315 - RNA, 16 nt, Salmonella enterica enterica serovar Typhi
cgguacacgcagucca

SEQ ID NO: 3655316 - RNA, 18 nt, Salmonella enterica enterica serovar Typhi
cgguacacuucagccaga

SEQ ID NO: 3655317 - RNA, 15 nt, Salmonella enterica enterica serovar Typhi
cgguaccauaccugc

SEQ ID NO: 3655318 - RNA, 18 nt, Salmonella enterica enterica serovar Typhi
cgguacccgcugcuucac

SEQ ID NO: 3655319 - RNA, 20 nt, Salmonella enterica enterica serovar Typhi
cgguaccgcguuuugcugau

SEQ ID NO: 3655320 - RNA, 16 nt, Salmonella enterica enterica serovar Typhi
cgguacgcaucaccag

SEQ ID NO: 3655321 - RNA, 17 nt, Salmonella enterica enterica serovar Typhi
cgguacgcaucaccagg

SEQ ID NO: 3655322 - RNA, 14 nt, Salmonella enterica enterica serovar Typhi
cgguacgccgccau

SEQ ID NO: 3655323 - RNA, 15 nt, Salmonella enterica enterica serovar Typhi
cgguacggcauggcg

SEQ ID NO: 3655324 - RNA, 14 nt, Salmonella enterica enterica serovar Typhi
cgguacuccccuuu

SEQ ID NO: 3655325 - RNA, 15 nt, Salmonella enterica enterica serovar Typhi
cgguacuccccuuuu

SEQ ID NO: 3655326 - RNA, 14 nt, Salmonella enterica enterica serovar Typhi
cgguacucuuuuuc

SEQ ID NO: 3655327 - RNA, 16 nt, Salmonella enterica enterica serovar Typhi
cgguacuggagaccgg

SEQ ID NO: 3655328 - RNA, 17 nt, Salmonella enterica enterica serovar Typhi
cgguacuggugcccgca

SEQ ID NO: 3655329 - RNA, 11 nt, Salmonella enterica enterica serovar Typhi
cgguacuucug

SEQ ID NO: 3655330 - RNA, 18 nt, Salmonella enterica enterica serovar Typhi
cgguagagcgcggucagg

SEQ ID NO: 3655331 - RNA, 16 nt, Salmonella enterica enterica serovar Typhi
cgguagaggcgccgac

SEQ ID NO: 3655332 - RNA, 14 nt, Salmonella enterica enterica serovar Typhi
cgguagccacaccc

SEQ ID NO: 3655333 - RNA, 13 nt, Salmonella enterica enterica serovar Typhi
cgguagcugcgcc

SEQ ID NO: 3655334 - RNA, 14 nt, Salmonella enterica enterica serovar Typhi
cgguagcugcgcca

SEQ ID NO: 3655335 - RNA, 16 nt, Salmonella enterica enterica serovar Typhi
cgguagcuuuuuaaau

SEQ ID NO: 3655336 - RNA, 17 nt, Salmonella enterica enterica serovar Typhi
cgguagcuuuuuaaaua

SEQ ID NO: 3655337 - RNA, 15 nt, Salmonella enterica enterica serovar Typhi
cgguauaaaaccccu

SEQ ID NO: 3655338 - RNA, 20 nt, Salmonella enterica enterica serovar Typhi
cgguauaaauuuccgcagcc

SEQ ID NO: 3655339 - RNA, 21 nt, Salmonella enterica enterica serovar Typhi
cgguauaaauuuccgcagcca

SEQ ID NO: 3655340 - RNA, 23 nt, Salmonella enterica enterica serovar Typhi
cgguauaaauuuccgcagccaga

SEQ ID NO: 3655341 - RNA, 18 nt, Salmonella enterica enterica serovar Typhi
cgguaucacgcgugcgcg

SEQ ID NO: 3655342 - RNA, 20 nt, Salmonella enterica enterica serovar Typhi
cgguaucgaucacgcgcagg

SEQ ID NO: 3655343 - RNA, 16 nt, Salmonella enterica enterica serovar Typhi
cgguaucgccggcaga

SEQ ID NO: 3655344 - RNA, 16 nt, Salmonella enterica enterica serovar Typhi
cgguaugcaccucuuu

SEQ ID NO: 3655345 - RNA, 15 nt, Salmonella enterica enterica serovar Typhi
cgguaugccuuccag

SEQ ID NO: 3655346 - RNA, 18 nt, Salmonella enterica enterica serovar Typhi
cgguauuuauccagcagg

SEQ ID NO: 3655347 - RNA, 22 nt, Salmonella enterica enterica serovar Typhi
cgguauuucgcaacgccgccga

SEQ ID NO: 3655348 - RNA, 15 nt, Salmonella enterica enterica serovar Typhi
cggucaaaagcugca

SEQ ID NO: 3655349 - RNA, 16 nt, Salmonella enterica enterica serovar Typhi
cggucaacgcgccgcc

SEQ ID NO: 3655350 - RNA, 20 nt, Salmonella enterica enterica serovar Typhi
cggucaacguuaacugcugc

SEQ ID NO: 3655351 - RNA, 16 nt, Salmonella enterica enterica serovar Typhi
cggucaacguuucccc

SEQ ID NO: 3655352 - RNA, 20 nt, Salmonella enterica enterica serovar Typhi
cggucaacugaauuucaucc

SEQ ID NO: 3655353 - RNA, 15 nt, Salmonella enterica enterica serovar Typhi
cggucaauacaucac

SEQ ID NO: 3655354 - RNA, 15 nt, Salmonella enterica enterica serovar Typhi
cggucaaucaucaga

SEQ ID NO: 3655355 - RNA, 13 nt, Salmonella enterica enterica serovar Typhi
cggucacaggcau

SEQ ID NO: 3655356 - RNA, 16 nt, Salmonella enterica enterica serovar Typhi
cggucacaggcauaca

SEQ ID NO: 3655357 - RNA, 12 nt, Salmonella enterica enterica serovar Typhi
cggucagccaca

SEQ ID NO: 3655358 - RNA, 16 nt, Salmonella enterica enterica serovar Typhi
cggucagccacaugcc

SEQ ID NO: 3655359 - RNA, 16 nt, Salmonella enterica enterica serovar Typhi
cggucagcggcggaaa

SEQ ID NO: 3655360 - RNA, 19 nt, Salmonella enterica enterica serovar Typhi
cggucaggggucagcguau

SEQ ID NO: 3655361 - RNA, 15 nt, Salmonella enterica enterica serovar Typhi
cggucagguagcaga

SEQ ID NO: 3655362 - RNA, 22 nt, Salmonella enterica enterica serovar Typhi
cggucaguguuuccauacauuu

SEQ ID NO: 3655363 - RNA, 14 nt, Salmonella enterica enterica serovar Typhi
cggucaguuugccc

SEQ ID NO: 3655364 - RNA, 18 nt, Salmonella enterica enterica serovar Typhi
cggucauaaccggccgau

SEQ ID NO: 3655365 - RNA, 18 nt, Salmonella enterica enterica serovar Typhi
cggucauacugaacaagc

SEQ ID NO: 3655366 - RNA, 17 nt, Salmonella enterica enterica serovar Typhi
cggucauggauaacaug

SEQ ID NO: 3655367 - RNA, 17 nt, Salmonella enterica enterica serovar Typhi
cggucauguuccaacaa

SEQ ID NO: 3655368 - RNA, 15 nt, Salmonella enterica enterica serovar Typhi
cggucccuggcuggu

SEQ ID NO: 3655369 - RNA, 23 nt, Salmonella enterica enterica serovar Typhi
cggucgacagccacacgccacaa

SEQ ID NO: 3655370 - RNA, 21 nt, Salmonella enterica enterica serovar Typhi
cggucgccguuaacuggcgca

SEQ ID NO: 3655371 - RNA, 16 nt, Salmonella enterica enterica serovar Typhi
cggucgcuucaaucgu

SEQ ID NO: 3655372 - RNA, 20 nt, Salmonella enterica enterica serovar Typhi
cggucgcuuuuugcgccagc

SEQ ID NO: 3655373 - RNA, 21 nt, Salmonella enterica enterica serovar Typhi
cggucucuuaaugccagcggc

SEQ ID NO: 3655374 - RNA, 16 nt, Salmonella enterica enterica serovar Typhi
cggucugcgcgccgca

SEQ ID NO: 3655375 - RNA, 19 nt, Salmonella enterica enterica serovar Typhi
cggucuggaugcguucaaa

SEQ ID NO: 3655376 - RNA, 15 nt, Salmonella enterica enterica serovar Typhi
cggucuucacucacc

SEQ ID NO: 3655377 - RNA, 15 nt, Salmonella enterica enterica serovar Typhi
cggucuuucaacaua

SEQ ID NO: 3655378 - RNA, 17 nt, Salmonella enterica enterica serovar Typhi
cggugaaaguaccgcuu

SEQ ID NO: 3655379 - RNA, 13 nt, Salmonella enterica enterica serovar Typhi
cggugaagaaaaa

SEQ ID NO: 3655380 - RNA, 17 nt, Salmonella enterica enterica serovar Typhi
cggugaagaaaaucccg

SEQ ID NO: 3655381 - RNA, 17 nt, Salmonella enterica enterica serovar Typhi
cggugaauagguaugua

SEQ ID NO: 3655382 - RNA, 22 nt, Salmonella enterica enterica serovar Typhi
cggugacgcgaucgucgguaau

SEQ ID NO: 3655383 - RNA, 17 nt, Salmonella enterica enterica serovar Typhi
cggugacggaaaccagc

SEQ ID NO: 3655384 - RNA, 17 nt, Salmonella enterica enterica serovar Typhi
cggugagaaacgcgcca

SEQ ID NO: 3655385 - RNA, 14 nt, Salmonella enterica enterica serovar Typhi
cggugagcgccgcg

SEQ ID NO: 3655386 - RNA, 23 nt, Salmonella enterica enterica serovar Typhi
cggugauauugccgaccgccagc

SEQ ID NO: 3655387 - RNA, 24 nt, Salmonella enterica enterica serovar Typhi
cggugauauuuuagccaucccggc

SEQ ID NO: 3655388 - RNA, 14 nt, Salmonella enterica enterica serovar Typhi
cggugaucccacca

SEQ ID NO: 3655389 - RNA, 13 nt, Salmonella enterica enterica serovar Typhi
cggugaucccagg

SEQ ID NO: 3655390 - RNA, 18 nt, Salmonella enterica enterica serovar Typhi
cggugccaaauguauacu

SEQ ID NO: 3655391 - RNA, 17 nt, Salmonella enterica enterica serovar Typhi
cggugcgauucagcgca

SEQ ID NO: 3655392 - RNA, 17 nt, Salmonella enterica enterica serovar Typhi
cggugcguuuaaagaga

SEQ ID NO: 3655393 - RNA, 16 nt, Salmonella enterica enterica serovar Typhi
cggugcucaauaaaag

SEQ ID NO: 3655394 - RNA, 17 nt, Salmonella enterica enterica serovar Typhi
cguaaguuaaaacgcca

SEQ ID NO: 3655395 - RNA, 18 nt, Salmonella enterica enterica serovar Typhi
cguaaguuaaaacgccau

SEQ ID NO: 3655396 - RNA, 16 nt, Salmonella enterica enterica serovar Typhi
cguaauaaggcggaua

SEQ ID NO: 3655397 - RNA, 17 nt, Salmonella enterica enterica serovar Typhi
cguaauauacgccaccu

SEQ ID NO: 3655398 - RNA, 23 nt, Salmonella enterica enterica serovar Typhi
cguaauaugaauauccgccgccc

SEQ ID NO: 3655399 - RNA, 19 nt, Salmonella enterica enterica serovar Typhi
cguaaucacccgcuuccag

SEQ ID NO: 3655400 - RNA, 15 nt, Salmonella enterica enterica serovar Typhi
cguaaucccgccagc

SEQ ID NO: 3655401 - RNA, 19 nt, Salmonella enterica enterica serovar Typhi
cguaaucuaaaauuauuuu

SEQ ID NO: 3655402 - RNA, 22 nt, Salmonella enterica enterica serovar Typhi
cguaaucuuuucauauuauuug

SEQ ID NO: 3655403 - RNA, 12 nt, Salmonella enterica enterica serovar Typhi
cguaaugagcac

SEQ ID NO: 3655404 - RNA, 22 nt, Salmonella enterica enterica serovar Typhi
cguaaugugaaaaacgggagau

SEQ ID NO: 3655405 - RNA, 14 nt, Salmonella enterica enterica serovar Typhi
cguaauuauuacag

SEQ ID NO: 3655406 - RNA, 17 nt, Salmonella enterica enterica serovar Typhi
cguaauuccgcauugag

SEQ ID NO: 3655407 - RNA, 13 nt, Salmonella enterica enterica serovar Typhi
cguacagcgccau

SEQ ID NO: 3655408 - RNA, 21 nt, Salmonella enterica enterica serovar Typhi
cguacaggcggaaaucaacaa

SEQ ID NO: 3655409 - RNA, 17 nt, Salmonella enterica enterica serovar Typhi
cguacauaacagcagca

SEQ ID NO: 3655410 - RNA, 18 nt, Salmonella enterica enterica serovar Typhi
cguacauaacagcagcag

SEQ ID NO: 3655411 - RNA, 15 nt, Salmonella enterica enterica serovar Typhi
cguacaugaauaaua

SEQ ID NO: 3655412 - RNA, 16 nt, Salmonella enterica enterica serovar Typhi
cguacauugccggaug

SEQ ID NO: 3655413 - RNA, 23 nt, Salmonella enterica enterica serovar Typhi
cguaccaauacccagcgccaacg

SEQ ID NO: 3655414 - RNA, 14 nt, Salmonella enterica enterica serovar Typhi
cguaccaggcagcg

SEQ ID NO: 3655415 - RNA, 19 nt, Salmonella enterica enterica serovar Typhi
cguaccaucgcgcaagacc

SEQ ID NO: 3655416 - RNA, 20 nt, Salmonella enterica enterica serovar Typhi
cguacccggcuuacaacauu

SEQ ID NO: 3655417 - RNA, 20 nt, Salmonella enterica enterica serovar Typhi
cguaccgaugacggcaaagc

SEQ ID NO: 3655418 - RNA, 17 nt, Salmonella enterica enterica serovar Typhi
cguaccgcauacccgac

SEQ ID NO: 3655419 - RNA, 20 nt, Salmonella enterica enterica serovar Typhi
cguaccggcgcucagccaga

SEQ ID NO: 3655420 - RNA, 20 nt, Salmonella enterica enterica serovar Typhi
cguaccgucuggcgaggcgc

SEQ ID NO: 3655421 - RNA, 15 nt, Salmonella enterica enterica serovar Typhi
cguaccuccagcgac

SEQ ID NO: 3655422 - RNA, 19 nt, Salmonella enterica enterica serovar Typhi
cguaccugucguacgccua

SEQ ID NO: 3655423 - RNA, 18 nt, Salmonella enterica enterica serovar Typhi
cguaccuucauguugcgg

SEQ ID NO: 3655424 - RNA, 21 nt, Salmonella enterica enterica serovar Typhi
cguacgcagaucguauccagc

SEQ ID NO: 3655425 - RNA, 17 nt, Salmonella enterica enterica serovar Typhi
cguacgccuaaaugaac

SEQ ID NO: 3655426 - RNA, 15 nt, Salmonella enterica enterica serovar Typhi
cguacggcugccuuu

SEQ ID NO: 3655427 - RNA, 20 nt, Salmonella enterica enterica serovar Typhi
cguacguuuuuccauucaca

SEQ ID NO: 3655428 - RNA, 15 nt, Salmonella enterica enterica serovar Typhi
cguacucagcagacc

SEQ ID NO: 3655429 - RNA, 21 nt, Salmonella enterica enterica serovar Typhi
cguacucuaggcgcugcuggc

SEQ ID NO: 3655430 - RNA, 22 nt, Salmonella enterica enterica serovar Typhi
cguacucuaggcgcugcuggca

SEQ ID NO: 3655431 - RNA, 16 nt, Salmonella enterica enterica serovar Typhi
cguacuuucgccaguu

SEQ ID NO: 3655432 - RNA, 16 nt, Salmonella enterica enterica serovar Typhi
cguagaaaaugcgcug

SEQ ID NO: 3655433 - RNA, 17 nt, Salmonella enterica enterica serovar Typhi
cguagaacagcaugaau

SEQ ID NO: 3655434 - RNA, 15 nt, Salmonella enterica enterica serovar Typhi
cguagaacgggccga

SEQ ID NO: 3655435 - RNA, 17 nt, Salmonella enterica enterica serovar Typhi
cguagauaagcgccacg

SEQ ID NO: 3655436 - RNA, 13 nt, Salmonella enterica enterica serovar Typhi
cguagaucgccag

SEQ ID NO: 3655437 - RNA, 18 nt, Salmonella enterica enterica serovar Typhi
cguagauuuucaucauau

SEQ ID NO: 3655438 - RNA, 12 nt, Salmonella enterica enterica serovar Typhi
cguagcaaauag

SEQ ID NO: 3655439 - RNA, 13 nt, Salmonella enterica enterica serovar Typhi
cguagccagagcg

SEQ ID NO: 3655440 - RNA, 19 nt, Salmonella enterica enterica serovar Typhi
cguagcccagcgccgcauc

SEQ ID NO: 3655441 - RNA, 17 nt, Salmonella enterica enterica serovar Typhi
cguagccgaacaguuuc

SEQ ID NO: 3655442 - RNA, 18 nt, Salmonella enterica enterica serovar Typhi
cguagccgcagaaccauu

SEQ ID NO: 3655443 - RNA, 17 nt, Salmonella enterica enterica serovar Typhi
cguagccgccgagcgcc

SEQ ID NO: 3655444 - RNA, 21 nt, Salmonella enterica enterica serovar Typhi
cguagccgcuuacucagccag

SEQ ID NO: 3655445 - RNA, 22 nt, Salmonella enterica enterica serovar Typhi
cguagccgcuuacucagccaga

SEQ ID NO: 3655446 - RNA, 19 nt, Salmonella enterica enterica serovar Typhi
cguagcgaauaaucccggc

SEQ ID NO: 3655447 - RNA, 23 nt, Salmonella enterica enterica serovar Typhi
cguagcgaauaaucccggcgcca

SEQ ID NO: 3655448 - RNA, 18 nt, Salmonella enterica enterica serovar Typhi
cguagcgagaaggcuuug

SEQ ID NO: 3655449 - RNA, 18 nt, Salmonella enterica enterica serovar Typhi
cguagcgagucaaaccuc

SEQ ID NO: 3655450 - RNA, 11 nt, Salmonella enterica enterica serovar Typhi
cguagcgccau

SEQ ID NO: 3655451 - RNA, 22 nt, Salmonella enterica enterica serovar Typhi
cguagcgccaucaggcacaaug

SEQ ID NO: 3655452 - RNA, 11 nt, Salmonella enterica enterica serovar Typhi
cguagcgcguu

SEQ ID NO: 3655453 - RNA, 20 nt, Salmonella enterica enterica serovar Typhi
cguagcgcguucaggguauc

SEQ ID NO: 3655454 - RNA, 20 nt, Salmonella enterica enterica serovar Typhi
cguagcguucauucccgcca

SEQ ID NO: 3655455 - RNA, 21 nt, Salmonella enterica enterica serovar Typhi
cguagcuggucgccagcgccg

SEQ ID NO: 3655456 - RNA, 19 nt, Salmonella enterica enterica serovar Typhi
cguaggccggauaagcgca

SEQ ID NO: 3655457 - RNA, 20 nt, Salmonella enterica enterica serovar Typhi
cguaggccugauaagacgca

SEQ ID NO: 3655458 - RNA, 19 nt, Salmonella enterica enterica serovar Typhi
cguaggccugauaagcgca

SEQ ID NO: 3655459 - RNA, 22 nt, Salmonella enterica enterica serovar Typhi
cguaggccugauaagcgcagcg

SEQ ID NO: 3655460 - RNA, 14 nt, Salmonella enterica enterica serovar Typhi
cguaggcgacgcca

SEQ ID NO: 3655461 - RNA, 15 nt, Salmonella enterica enterica serovar Typhi
cguaggcgcaaaccg

SEQ ID NO: 3655462 - RNA, 13 nt, Salmonella enterica enterica serovar Typhi
cguaggcggcgga

SEQ ID NO: 3655463 - RNA, 13 nt, Salmonella enterica enterica serovar Typhi
cguaguaagcgga

SEQ ID NO: 3655464 - RNA, 20 nt, Salmonella enterica enterica serovar Typhi
cguaguagguauccagcaga

SEQ ID NO: 3655465 - RNA, 22 nt, Salmonella enterica enterica serovar Typhi
cguaguagucaggaucgcuggc

SEQ ID NO: 3655466 - RNA, 18 nt, Salmonella enterica enterica serovar Typhi
cguaguucccccaucugu

SEQ ID NO: 3655467 - RNA, 19 nt, Salmonella enterica enterica serovar Typhi
cguauaaggcgaagcccau

SEQ ID NO: 3655468 - RNA, 15 nt, Salmonella enterica enterica serovar Typhi
cguauaauccagcuu

SEQ ID NO: 3655469 - RNA, 20 nt, Salmonella enterica enterica serovar Typhi
cguauacuucucgaaguucu

SEQ ID NO: 3655470 - RNA, 11 nt, Salmonella enterica enterica serovar Typhi
cguauccagca

SEQ ID NO: 3655471 - RNA, 12 nt, Salmonella enterica enterica serovar Typhi
cguauccagcgc

SEQ ID NO: 3655472 - RNA, 13 nt, Salmonella enterica enterica serovar Typhi
cguauccagcgcg

SEQ ID NO: 3655473 - RNA, 20 nt, Salmonella enterica enterica serovar Typhi
cguauccccagucuuccugc

SEQ ID NO: 3655474 - RNA, 17 nt, Salmonella enterica enterica serovar Typhi
cguaucgcccagauggc

SEQ ID NO: 3655475 - RNA, 15 nt, Salmonella enterica enterica serovar Typhi
cguaucgcucugcuu

SEQ ID NO: 3655476 - RNA, 20 nt, Salmonella enterica enterica serovar Typhi
cguaucggugcguuuaaaga

SEQ ID NO: 3655477 - RNA, 22 nt, Salmonella enterica enterica serovar Typhi
cguaucucgcgguugacgcugc

SEQ ID NO: 3655478 - RNA, 17 nt, Salmonella enterica enterica serovar Typhi
cguaucugucccagccu

SEQ ID NO: 3655479 - RNA, 21 nt, Salmonella enterica enterica serovar Typhi
cgucaucgcucaucucaagcc

SEQ ID NO: 3655480 - RNA, 16 nt, Salmonella enterica enterica serovar Typhi
cgucaucgggcuguua

SEQ ID NO: 3655481 - RNA, 18 nt, Salmonella enterica enterica serovar Typhi
cgucaucgggcuguuauu

SEQ ID NO: 3655482 - RNA, 21 nt, Salmonella enterica enterica serovar Typhi
cgucauggcuaaucgccacga

SEQ ID NO: 3655483 - RNA, 21 nt, Salmonella enterica enterica serovar Typhi
cgucauuaccaguugaccaaa

SEQ ID NO: 3655484 - RNA, 24 nt, Salmonella enterica enterica serovar Typhi
cgucauuaugcauugccaugcgac

SEQ ID NO: 3655485 - RNA, 21 nt, Salmonella enterica enterica serovar Typhi
cgucauugaccggaaaaaaau

SEQ ID NO: 3655486 - RNA, 19 nt, Salmonella enterica enterica serovar Typhi
cgucauuuucuuucaucaa

SEQ ID NO: 3655487 - RNA, 14 nt, Salmonella enterica enterica serovar Typhi
cguccacacgccug

SEQ ID NO: 3655488 - RNA, 18 nt, Salmonella enterica enterica serovar Typhi
cguccacauccagcgcca

SEQ ID NO: 3655489 - RNA, 23 nt, Salmonella enterica enterica serovar Typhi
cguccacggcgggacgcugcgcg

SEQ ID NO: 3655490 - RNA, 15 nt, Salmonella enterica enterica serovar Typhi
cguccagacuccuuu

SEQ ID NO: 3655491 - RNA, 13 nt, Salmonella enterica enterica serovar Typhi
cguccagauaaug

SEQ ID NO: 3655492 - RNA, 22 nt, Salmonella enterica enterica serovar Typhi
cguccagccagcguuucuggaa

SEQ ID NO: 3655493 - RNA, 18 nt, Salmonella enterica enterica serovar Typhi
cguccagccgcucuguau

SEQ ID NO: 3655494 - RNA, 23 nt, Salmonella enterica enterica serovar Typhi
cguccaguaaaaucggaccuccg

SEQ ID NO: 3655495 - RNA, 19 nt, Salmonella enterica enterica serovar Typhi
cguccaguucguucugcgu

SEQ ID NO: 3655496 - RNA, 14 nt, Salmonella enterica enterica serovar Typhi
cguccauccgggua

SEQ ID NO: 3655497 - RNA, 16 nt, Salmonella enterica enterica serovar Typhi
cguccauuacucucau

SEQ ID NO: 3655498 - RNA, 21 nt, Salmonella enterica enterica serovar Typhi
cguccauuucaaugcauacug

SEQ ID NO: 3655499 - RNA, 16 nt, Salmonella enterica enterica serovar Typhi
cgucccagcggauguc

SEQ ID NO: 3655500 - RNA, 13 nt, Salmonella enterica enterica serovar Typhi
cguccccagccag

SEQ ID NO: 3655501 - RNA, 14 nt, Salmonella enterica enterica serovar Typhi
cguccccagccaga

SEQ ID NO: 3655502 - RNA, 22 nt, Salmonella enterica enterica serovar Typhi
cguccccugcgguuucuaccac

SEQ ID NO: 3655503 - RNA, 17 nt, Salmonella enterica enterica serovar Typhi
cgucccgauauaaaggu

SEQ ID NO: 3655504 - RNA, 16 nt, Salmonella enterica enterica serovar Typhi
cgucccggcauuauaa

SEQ ID NO: 3655505 - RNA, 17 nt, Salmonella enterica enterica serovar Typhi
cgucccugcaacgccug

SEQ ID NO: 3655506 - RNA, 15 nt, Salmonella enterica enterica serovar Typhi
cgucccuuccgccac

SEQ ID NO: 3655507 - RNA, 14 nt, Salmonella enterica enterica serovar Typhi
cgucccuuucccuu

SEQ ID NO: 3655508 - RNA, 21 nt, Salmonella enterica enterica serovar Typhi
cgucccuuucccuuccagcga

SEQ ID NO: 3655509 - RNA, 18 nt, Salmonella enterica enterica serovar Typhi
cguccgcagccgacgcau

SEQ ID NO: 3655510 - RNA, 12 nt, Salmonella enterica enterica serovar Typhi
cguccgccaggc

SEQ ID NO: 3655511 - RNA, 17 nt, Salmonella enterica enterica serovar Typhi
cguccgccaggcccaug

SEQ ID NO: 3655512 - RNA, 16 nt, Salmonella enterica enterica serovar Typhi
cguccggcacgcgcag

SEQ ID NO: 3655513 - RNA, 20 nt, Salmonella enterica enterica serovar Typhi
cguccggcgaaaaccgagca

SEQ ID NO: 3655514 - RNA, 17 nt, Salmonella enterica enterica serovar Typhi
cguccgguagagaacga

SEQ ID NO: 3655515 - RNA, 13 nt, Salmonella enterica enterica serovar Typhi
cguccuaccgccg

SEQ ID NO: 3655516 - RNA, 21 nt, Salmonella enterica enterica serovar Typhi
cguccugacggugcgcgacgc

SEQ ID NO: 3655517 - RNA, 19 nt, Salmonella enterica enterica serovar Typhi
cguccuguagccgugccug

SEQ ID NO: 3655518 - RNA, 15 nt, Salmonella enterica enterica serovar Typhi
cgucgaaugacgcgc

SEQ ID NO: 3655519 - RNA, 21 nt, Salmonella enterica enterica serovar Typhi
cgucgacaaagccgacgccac

SEQ ID NO: 3655520 - RNA, 14 nt, Salmonella enterica enterica serovar Typhi
cgucgacagccccc

SEQ ID NO: 3655521 - RNA, 13 nt, Salmonella enterica enterica serovar Typhi
cgucgacagcgcc

SEQ ID NO: 3655522 - RNA, 16 nt, Salmonella enterica enterica serovar Typhi
cgucgacgccuuccac

SEQ ID NO: 3655523 - RNA, 18 nt, Salmonella enterica enterica serovar Typhi
cgucgagaaaccgcucgc

SEQ ID NO: 3655524 - RNA, 14 nt, Salmonella enterica enterica serovar Typhi
cgucgagacggugu

SEQ ID NO: 3655525 - RNA, 18 nt, Salmonella enterica enterica serovar Typhi
cgucgaggaagcugcgca

SEQ ID NO: 3655526 - RNA, 21 nt, Salmonella enterica enterica serovar Typhi
cgucgauauguaaaucgguuu

SEQ ID NO: 3655527 - RNA, 14 nt, Salmonella enterica enterica serovar Typhi
cgucgaucagcgcg

SEQ ID NO: 3655528 - RNA, 20 nt, Salmonella enterica enterica serovar Typhi
cgucgccaaagcagcugcug

SEQ ID NO: 3655529 - RNA, 16 nt, Salmonella enterica enterica serovar Typhi
cgucgccauccggcga

SEQ ID NO: 3655530 - RNA, 14 nt, Salmonella enterica enterica serovar Typhi
cgucgccgacaacg

SEQ ID NO: 3655531 - RNA, 18 nt, Salmonella enterica enterica serovar Typhi
cgucgccggaaugcgaau

SEQ ID NO: 3655532 - RNA, 23 nt, Salmonella enterica enterica serovar Typhi
cgucgccggugcuguagcugccc

SEQ ID NO: 3655533 - RNA, 15 nt, Salmonella enterica enterica serovar Typhi
cgucgccugaaugca

SEQ ID NO: 3655534 - RNA, 18 nt, Salmonella enterica enterica serovar Typhi
cgucgccuguccggccug

SEQ ID NO: 3655535 - RNA, 18 nt, Salmonella enterica enterica serovar Typhi
cgucgccuguuucugcgc

SEQ ID NO: 3655536 - RNA, 22 nt, Salmonella enterica enterica serovar Typhi
cgucgccuguuucugcgccgcu

SEQ ID NO: 3655537 - RNA, 19 nt, Salmonella enterica enterica serovar Typhi
cgucgcgaauaauuauuuu

SEQ ID NO: 3655538 - RNA, 23 nt, Salmonella enterica enterica serovar Typhi
cgucgcgacguccgccaacagcc

SEQ ID NO: 3655539 - RNA, 17 nt, Salmonella enterica enterica serovar Typhi
cgucgcgaucgcgccag

SEQ ID NO: 3655540 - RNA, 17 nt, Salmonella enterica enterica serovar Typhi
cgucgcgcauggcaggg

SEQ ID NO: 3655541 - RNA, 12 nt, Salmonella enterica enterica serovar Typhi
cgucgcgcgccg

SEQ ID NO: 3655542 - RNA, 16 nt, Salmonella enterica enterica serovar Typhi
cgucgcgcgccgccug

SEQ ID NO: 3655543 - RNA, 21 nt, Salmonella enterica enterica serovar Typhi
cgucgcgcgccgccugcgcca

SEQ ID NO: 3655544 - RNA, 21 nt, Salmonella enterica enterica serovar Typhi
cgucgcucuuuucaggcgcug

SEQ ID NO: 3655545 - RNA, 14 nt, Salmonella enterica enterica serovar Typhi
cgucggcaccauuc

SEQ ID NO: 3655546 - RNA, 22 nt, Salmonella enterica enterica serovar Typhi
cgucggcaccgaauguuccgca

SEQ ID NO: 3655547 - RNA, 14 nt, Salmonella enterica enterica serovar Typhi
cgucggccaccauu

SEQ ID NO: 3655548 - RNA, 16 nt, Salmonella enterica enterica serovar Typhi
cgucggcgacgacgau

SEQ ID NO: 3655549 - RNA, 17 nt, Salmonella enterica enterica serovar Typhi
cgucggcgccagccaca

SEQ ID NO: 3655550 - RNA, 15 nt, Salmonella enterica enterica serovar Typhi
cgucggcgccggcgu

SEQ ID NO: 3655551 - RNA, 18 nt, Salmonella enterica enterica serovar Typhi
cgucggcgucugcgcgcu

SEQ ID NO: 3655552 - RNA, 21 nt, Salmonella enterica enterica serovar Typhi
cgucgggauaagcgaugcgcg

SEQ ID NO: 3655553 - RNA, 14 nt, Salmonella enterica enterica serovar Typhi
cgucggucgcguag

SEQ ID NO: 3655554 - RNA, 16 nt, Salmonella enterica enterica serovar Typhi
cgucggugcccggcug

SEQ ID NO: 3655555 - RNA, 17 nt, Salmonella enterica enterica serovar Typhi
cgucguccacucuuccg

SEQ ID NO: 3655556 - RNA, 16 nt, Salmonella enterica enterica serovar Typhi
cgucgucguuuguagg

SEQ ID NO: 3655557 - RNA, 21 nt, Salmonella enterica enterica serovar Typhi
cgucgugaguggcggcgcgca

SEQ ID NO: 3655558 - RNA, 14 nt, Salmonella enterica enterica serovar Typhi
cgucgugauagcca

SEQ ID NO: 3655559 - RNA, 19 nt, Salmonella enterica enterica serovar Typhi
cgucgugcagcgccgccug

SEQ ID NO: 3655560 - RNA, 18 nt, Salmonella enterica enterica serovar Typhi
cgucgugcugggcgcgcc

SEQ ID NO: 3655561 - RNA, 19 nt, Salmonella enterica enterica serovar Typhi
cgucgugcugggcgcgccu

SEQ ID NO: 3655562 - RNA, 23 nt, Salmonella enterica enterica serovar Typhi
cgucguuaacaucaucaggccug

SEQ ID NO: 3655563 - RNA, 19 nt, Salmonella enterica enterica serovar Typhi
cgucguuaacugcauuaca

SEQ ID NO: 3655564 - RNA, 17 nt, Salmonella enterica enterica serovar Typhi
cgugcaguuuugcuuca

SEQ ID NO: 3655565 - RNA, 22 nt, Salmonella enterica enterica serovar Typhi
cgugcaguuuugcuucaugcac

SEQ ID NO: 3655566 - RNA, 20 nt, Salmonella enterica enterica serovar Typhi
cgugcaugggauacgccagc

SEQ ID NO: 3655567 - RNA, 21 nt, Salmonella enterica enterica serovar Typhi
cgugcaugggauacgccagca

SEQ ID NO: 3655568 - RNA, 21 nt, Salmonella enterica enterica serovar Typhi
cgugcaugggcagcuugccgc

SEQ ID NO: 3655569 - RNA, 19 nt, Salmonella enterica enterica serovar Typhi
cgugccaugaccauucaca

SEQ ID NO: 3655570 - RNA, 20 nt, Salmonella enterica enterica serovar Typhi
cgugccaugaccauucacac

SEQ ID NO: 3655571 - RNA, 14 nt, Salmonella enterica enterica serovar Typhi
cgugccgaccagcg

SEQ ID NO: 3655572 - RNA, 16 nt, Salmonella enterica enterica serovar Typhi
cgugccgaccagcggu

SEQ ID NO: 3655573 - RNA, 18 nt, Salmonella enterica enterica serovar Typhi
cgugccggaagcgauugu

SEQ ID NO: 3655574 - RNA, 23 nt, Salmonella enterica enterica serovar Typhi
cgugccggaugauguuuauccgg

SEQ ID NO: 3655575 - RNA, 22 nt, Salmonella enterica enterica serovar Typhi
cgugccguagaaaaugcgcugg

SEQ ID NO: 3655576 - RNA, 18 nt, Salmonella enterica enterica serovar Typhi
cgugccuuccaucggccc

SEQ ID NO: 3655577 - RNA, 13 nt, Salmonella enterica enterica serovar Typhi
cgugcgcagcgcg

SEQ ID NO: 3655578 - RNA, 15 nt, Salmonella enterica enterica serovar Typhi
cgugcgccauccggc

SEQ ID NO: 3655579 - RNA, 15 nt, Salmonella enterica enterica serovar Typhi
cgugcgccgacaucg

SEQ ID NO: 3655580 - RNA, 15 nt, Salmonella enterica enterica serovar Typhi
cgugcgccguccugc

SEQ ID NO: 3655581 - RNA, 19 nt, Salmonella enterica enterica serovar Typhi
cgugcgcucagggucagaa

SEQ ID NO: 3655582 - RNA, 15 nt, Salmonella enterica enterica serovar Typhi
cgugcgcugcggcca

SEQ ID NO: 3655583 - RNA, 23 nt, Salmonella enterica enterica serovar Typhi
cgugcgcugcggccagaccgccg

SEQ ID NO: 3655584 - RNA, 17 nt, Salmonella enterica enterica serovar Typhi
cgugcggacguagcggc

SEQ ID NO: 3655585 - RNA, 21 nt, Salmonella enterica enterica serovar Typhi
cgugcggcgaagcaucuuucc

SEQ ID NO: 3655586 - RNA, 17 nt, Salmonella enterica enterica serovar Typhi
cgugcggcggacgccgg

SEQ ID NO: 3655587 - RNA, 20 nt, Salmonella enterica enterica serovar Typhi
cgugcgguauaucacgccau

SEQ ID NO: 3655588 - RNA, 18 nt, Salmonella enterica enterica serovar Typhi
cgugcucuucguggaacu

SEQ ID NO: 3655589 - RNA, 12 nt, Salmonella enterica enterica serovar Typhi
cgugcuggaugg

SEQ ID NO: 3655590 - RNA, 16 nt, Salmonella enterica enterica serovar Typhi
cgugcugggcgcgccu

SEQ ID NO: 3655591 - RNA, 17 nt, Salmonella enterica enterica serovar Typhi
cguggaacugcagcgcg

SEQ ID NO: 3655592 - RNA, 20 nt, Salmonella enterica enterica serovar Typhi
cguggaccguauagcccaga

SEQ ID NO: 3655593 - RNA, 15 nt, Salmonella enterica enterica serovar Typhi
cguggacgcuggguu

SEQ ID NO: 3655594 - RNA, 13 nt, Salmonella enterica enterica serovar Typhi
cguggcaaucagc

SEQ ID NO: 3655595 - RNA, 12 nt, Salmonella enterica enterica serovar Typhi
cguggcaucuua

SEQ ID NO: 3655596 - RNA, 17 nt, Salmonella enterica enterica serovar Typhi
cguggcauucgcuugcc

SEQ ID NO: 3655597 - RNA, 14 nt, Salmonella enterica enterica serovar Typhi
cguggccaaaaaau

SEQ ID NO: 3655598 - RNA, 15 nt, Salmonella enterica enterica serovar Typhi
cguggccaaaaaauc

SEQ ID NO: 3655599 - RNA, 19 nt, Salmonella enterica enterica serovar Typhi
cguggccaaaaaaucgcug

SEQ ID NO: 3655600 - RNA, 22 nt, Salmonella enterica enterica serovar Typhi
cguggccagcaugcccgccagc

SEQ ID NO: 3655601 - RNA, 13 nt, Salmonella enterica enterica serovar Typhi
cguggccuccggc

SEQ ID NO: 3655602 - RNA, 16 nt, Salmonella enterica enterica serovar Typhi
cguggcgaucaguggc

SEQ ID NO: 3655603 - RNA, 16 nt, Salmonella enterica enterica serovar Typhi
cguggcgcaaccgaua

SEQ ID NO: 3655604 - RNA, 13 nt, Salmonella enterica enterica serovar Typhi
cguggcgcaucuc

SEQ ID NO: 3655605 - RNA, 12 nt, Salmonella enterica enterica serovar Typhi
cguggcgccacc

SEQ ID NO: 3655606 - RNA, 22 nt, Salmonella enterica enterica serovar Typhi
cguggcgcgaauuuucgauaau

SEQ ID NO: 3655607 - RNA, 16 nt, Salmonella enterica enterica serovar Typhi
cguggcgcuuuccggc

SEQ ID NO: 3655608 - RNA, 16 nt, Salmonella enterica enterica serovar Typhi
cguggcgggaugcccc

SEQ ID NO: 3655609 - RNA, 22 nt, Salmonella enterica enterica serovar Typhi
cguggcguuuucauuagccgcc

SEQ ID NO: 3655610 - RNA, 20 nt, Salmonella enterica enterica serovar Typhi
cguggguucgaaucccauua

SEQ ID NO: 3655611 - RNA, 14 nt, Salmonella enterica enterica serovar Typhi
cgugguaucgaaaa

SEQ ID NO: 3655612 - RNA, 20 nt, Salmonella enterica enterica serovar Typhi
cguggucguaaaacugcacc

SEQ ID NO: 3655613 - RNA, 21 nt, Salmonella enterica enterica serovar Typhi
cguggucguaaaacugcacca

SEQ ID NO: 3655614 - RNA, 22 nt, Salmonella enterica enterica serovar Typhi
cguggucuccgccuggaaccca

SEQ ID NO: 3655615 - RNA, 14 nt, Salmonella enterica enterica serovar Typhi
cguggugggguucc

SEQ ID NO: 3655616 - RNA, 17 nt, Salmonella enterica enterica serovar Typhi
cgugguuuccggcagcu

SEQ ID NO: 3655617 - RNA, 21 nt, Salmonella enterica enterica serovar Typhi
cgugguuuguugcgcgacgac

SEQ ID NO: 3655618 - RNA, 17 nt, Salmonella enterica enterica serovar Typhi
cguguaaggcuuccggc

SEQ ID NO: 3655619 - RNA, 22 nt, Salmonella enterica enterica serovar Typhi
cguguaguuauaaauuuauuuu

SEQ ID NO: 3655620 - RNA, 20 nt, Salmonella enterica enterica serovar Typhi
cguguauuccagucgcucca

SEQ ID NO: 3655621 - RNA, 23 nt, Salmonella enterica enterica serovar Typhi
cgugucaucaaaaucaucgccac

SEQ ID NO: 3655622 - RNA, 19 nt, Salmonella enterica enterica serovar Typhi
cgugucggauaucagacag

SEQ ID NO: 3655623 - RNA, 18 nt, Salmonella enterica enterica serovar Typhi
cguguggcggaaugaccu

SEQ ID NO: 3655624 - RNA, 11 nt, Salmonella enterica enterica serovar Typhi
cguguggcugu

SEQ ID NO: 3655625 - RNA, 21 nt, Salmonella enterica enterica serovar Typhi
cguguggucgcggcucaccag

SEQ ID NO: 3655626 - RNA, 20 nt, Salmonella enterica enterica serovar Typhi
cgugugucccggacaaugua

SEQ ID NO: 3655627 - RNA, 23 nt, Salmonella enterica enterica serovar Typhi
cguguuacgccgcaaucacuuca

SEQ ID NO: 3655628 - RNA, 21 nt, Salmonella enterica enterica serovar Typhi
cguguuacugacgaccggcag

SEQ ID NO: 3655629 - RNA, 19 nt, Salmonella enterica enterica serovar Typhi
cguguuuuuccagcaacgg

SEQ ID NO: 3655630 - RNA, 17 nt, Salmonella enterica enterica serovar Typhi
cguuaaaauaccgccug

SEQ ID NO: 3655631 - RNA, 22 nt, Salmonella enterica enterica serovar Typhi
cguuaaaauaccgccugccgau

SEQ ID NO: 3655632 - RNA, 18 nt, Salmonella enterica enterica serovar Typhi
cguuaaauaccagcaccu

SEQ ID NO: 3655633 - RNA, 22 nt, Salmonella enterica enterica serovar Typhi
cguuaaauagccccaacgcgcu

SEQ ID NO: 3655634 - RNA, 20 nt, Salmonella enterica enterica serovar Typhi
cguuaaauccucccaucgag

SEQ ID NO: 3655635 - RNA, 22 nt, Salmonella enterica enterica serovar Typhi
cguuaaauccucccaucgagcc

SEQ ID NO: 3655636 - RNA, 19 nt, Salmonella enterica enterica serovar Typhi
cguuaacaucaucaggccu

SEQ ID NO: 3655637 - RNA, 14 nt, Salmonella enterica enterica serovar Typhi
cguuaaccagcggc

SEQ ID NO: 3655638 - RNA, 15 nt, Salmonella enterica enterica serovar Typhi
cguuaaccagcggcg

SEQ ID NO: 3655639 - RNA, 16 nt, Salmonella enterica enterica serovar Typhi
cguuaaccagcggcga

SEQ ID NO: 3655640 - RNA, 14 nt, Salmonella enterica enterica serovar Typhi
cguuaacccggcau

SEQ ID NO: 3655641 - RNA, 15 nt, Salmonella enterica enterica serovar Typhi
cguuaacccggcauu

SEQ ID NO: 3655642 - RNA, 15 nt, Salmonella enterica enterica serovar Typhi
cguuaacgcagcauc

SEQ ID NO: 3655643 - RNA, 17 nt, Salmonella enterica enterica serovar Typhi
cguuaaggccugcgcga

SEQ ID NO: 3655644 - RNA, 22 nt, Salmonella enterica enterica serovar Typhi
cguuaaggugcauuccgcgcaa

SEQ ID NO: 3655645 - RNA, 16 nt, Salmonella enterica enterica serovar Typhi
cguuaaguagcggaac

SEQ ID NO: 3655646 - RNA, 15 nt, Salmonella enterica enterica serovar Typhi
cguuaauaccgugca

SEQ ID NO: 3655647 - RNA, 18 nt, Salmonella enterica enterica serovar Typhi
cguuaauccaaauccgca

SEQ ID NO: 3655648 - RNA, 18 nt, Salmonella enterica enterica serovar Typhi
cguuaaucgauuuucucc

SEQ ID NO: 3655649 - RNA, 23 nt, Salmonella enterica enterica serovar Typhi
cguugauccugaccgggcucacg

SEQ ID NO: 3655650 - RNA, 13 nt, Salmonella enterica enterica serovar Typhi
cguugaucgccau

SEQ ID NO: 3655651 - RNA, 22 nt, Salmonella enterica enterica serovar Typhi
cguugaugugcccguuccaggc

SEQ ID NO: 3655652 - RNA, 15 nt, Salmonella enterica enterica serovar Typhi
cguugccaaaagguu

SEQ ID NO: 3655653 - RNA, 16 nt, Salmonella enterica enterica serovar Typhi
cguugccagcggccag

SEQ ID NO: 3655654 - RNA, 21 nt, Salmonella enterica enterica serovar Typhi
cguugccgcaggcaacggccc

SEQ ID NO: 3655655 - RNA, 12 nt, Salmonella enterica enterica serovar Typhi
cguugccgccgu

SEQ ID NO: 3655656 - RNA, 17 nt, Salmonella enterica enterica serovar Typhi
cguugccguaggcaacg

SEQ ID NO: 3655657 - RNA, 21 nt, Salmonella enterica enterica serovar Typhi
cguugccguaggcaacgaccc

SEQ ID NO: 3655658 - RNA, 15 nt, Salmonella enterica enterica serovar Typhi
cguugccugauaaau

SEQ ID NO: 3655659 - RNA, 18 nt, Salmonella enterica enterica serovar Typhi
cguugccuggccuccggc

SEQ ID NO: 3655660 - RNA, 20 nt, Salmonella enterica enterica serovar Typhi
cguugccuggccuccggcgg

SEQ ID NO: 3655661 - RNA, 17 nt, Salmonella enterica enterica serovar Typhi
cguugcgaaucagguac

SEQ ID NO: 3655662 - RNA, 18 nt, Salmonella enterica enterica serovar Typhi
cguugcgaaucagguaca

SEQ ID NO: 3655663 - RNA, 23 nt, Salmonella enterica enterica serovar Typhi
cguugcgacaaccuguaggccgg

SEQ ID NO: 3655664 - RNA, 16 nt, Salmonella enterica enterica serovar Typhi
cguugcgacuaucggc

SEQ ID NO: 3655665 - RNA, 19 nt, Salmonella enterica enterica serovar Typhi
cguugcgcccaucaucauc

SEQ ID NO: 3655666 - RNA, 15 nt, Salmonella enterica enterica serovar Typhi
cguugcgccgccagg

SEQ ID NO: 3655667 - RNA, 17 nt, Salmonella enterica enterica serovar Typhi
cguugcgccuuuccggc

SEQ ID NO: 3655668 - RNA, 16 nt, Salmonella enterica enterica serovar Typhi
cguugcgcgcgucaca

SEQ ID NO: 3655669 - RNA, 19 nt, Salmonella enterica enterica serovar Typhi
cguugcguguuguacagca

SEQ ID NO: 3655670 - RNA, 22 nt, Salmonella enterica enterica serovar Typhi
cguugcugucgcgcaauaccug

SEQ ID NO: 3655671 - RNA, 20 nt, Salmonella enterica enterica serovar Typhi
cguuggaagugcguuaaccc

SEQ ID NO: 3655672 - RNA, 16 nt, Salmonella enterica enterica serovar Typhi
cguuggcgauuuccag

SEQ ID NO: 3655673 - RNA, 20 nt, Salmonella enterica enterica serovar Typhi
cguuggcguaaaucaggcca

SEQ ID NO: 3655674 - RNA, 17 nt, Salmonella enterica enterica serovar Typhi
cguuggcuaucgcacug

SEQ ID NO: 3655675 - RNA, 19 nt, Salmonella enterica enterica serovar Typhi
cguuguaguuaucgccgaa

SEQ ID NO: 3655676 - RNA, 21 nt, Salmonella enterica enterica serovar Typhi
cguugucauggcgccaccagc

SEQ ID NO: 3655677 - RNA, 14 nt, Salmonella enterica enterica serovar Typhi
cguuguccagcaga

SEQ ID NO: 3655678 - RNA, 16 nt, Salmonella enterica enterica serovar Typhi
cguuguccagcggcca

SEQ ID NO: 3655679 - RNA, 15 nt, Salmonella enterica enterica serovar Typhi
cguugugcaagcuca

SEQ ID NO: 3655680 - RNA, 17 nt, Salmonella enterica enterica serovar Typhi
cguugugcagaaucauu

SEQ ID NO: 3655681 - RNA, 21 nt, Salmonella enterica enterica serovar Typhi
cguugugcuccagcgugugau

SEQ ID NO: 3655682 - RNA, 17 nt, Salmonella enterica enterica serovar Typhi
cguuguguccagggugu

SEQ ID NO: 3655683 - RNA, 12 nt, Salmonella enterica enterica serovar Typhi
cguuuaaagcgc

SEQ ID NO: 3655684 - RNA, 19 nt, Salmonella enterica enterica serovar Typhi
cguuuaacgcaucgcggau

SEQ ID NO: 3655685 - RNA, 20 nt, Salmonella enterica enterica serovar Typhi
cguuuacaccgccauccggc

SEQ ID NO: 3655686 - RNA, 21 nt, Salmonella enterica enterica serovar Typhi
cguuuacaccgccauccggca

SEQ ID NO: 3655687 - RNA, 18 nt, Salmonella enterica enterica serovar Typhi
cguuuaccggugcagacc

SEQ ID NO: 3655688 - RNA, 15 nt, Salmonella enterica enterica serovar Typhi
cguuuacgccgccau

SEQ ID NO: 3655689 - RNA, 16 nt, Salmonella enterica enterica serovar Typhi
cguuuauaccccacca

SEQ ID NO: 3655690 - RNA, 23 nt, Salmonella enterica enterica serovar Typhi
cguuuauauaaaaauagcuggcu

SEQ ID NO: 3655691 - RNA, 14 nt, Salmonella enterica enterica serovar Typhi
cguuuaugccgcca

SEQ ID NO: 3655692 - RNA, 15 nt, Salmonella enterica enterica serovar Typhi
cguuuaugccgccau

SEQ ID NO: 3655693 - RNA, 16 nt, Salmonella enterica enterica serovar Typhi
cguuuaugccgccauc

SEQ ID NO: 3655694 - RNA, 19 nt, Salmonella enterica enterica serovar Typhi
cguuuauguucuuugugau

SEQ ID NO: 3655695 - RNA, 17 nt, Salmonella enterica enterica serovar Typhi
cguuuauguuugcugau

SEQ ID NO: 3655696 - RNA, 15 nt, Salmonella enterica enterica serovar Typhi
cguuuauuauaaaca

SEQ ID NO: 3655697 - RNA, 14 nt, Salmonella enterica enterica serovar Typhi
cguuucagccccuu

SEQ ID NO: 3655698 - RNA, 15 nt, Salmonella enterica enterica serovar Typhi
cguuucauguaaaug

SEQ ID NO: 3655699 - RNA, 16 nt, Salmonella enterica enterica serovar Typhi
cguuucauguaaauga

SEQ ID NO: 3655700 - RNA, 22 nt, Salmonella enterica enterica serovar Typhi
cguuucauuuuucccaucaauc

SEQ ID NO: 3655701 - RNA, 16 nt, Salmonella enterica enterica serovar Typhi
cguuuccgcaauaagu

SEQ ID NO: 3655702 - RNA, 18 nt, Salmonella enterica enterica serovar Typhi
cguuucgauaaccaccag

SEQ ID NO: 3655703 - RNA, 19 nt, Salmonella enterica enterica serovar Typhi
cguuucguguuguccggcu

SEQ ID NO: 3655704 - RNA, 19 nt, Salmonella enterica enterica serovar Typhi
cguuucguuuagcgccugc

SEQ ID NO: 3655705 - RNA, 13 nt, Salmonella enterica enterica serovar Typhi
cguuucuacaaua

SEQ ID NO: 3655706 - RNA, 19 nt, Salmonella enterica enterica serovar Typhi
cguuucucgcgaccagaga

SEQ ID NO: 3655707 - RNA, 12 nt, Salmonella enterica enterica serovar Typhi
cguuucucuugu

SEQ ID NO: 3655708 - RNA, 15 nt, Salmonella enterica enterica serovar Typhi
cguuucuuucaucag

SEQ ID NO: 3655709 - RNA, 17 nt, Salmonella enterica enterica serovar Typhi
cguuugccccucuuccc

SEQ ID NO: 3655710 - RNA, 22 nt, Salmonella enterica enterica serovar Typhi
cguuugcgcgaagucgagcuca

SEQ ID NO: 3655711 - RNA, 21 nt, Salmonella enterica enterica serovar Typhi
cguuuguaacagcaggacccg

SEQ ID NO: 3655712 - RNA, 18 nt, Salmonella enterica enterica serovar Typhi
cguuuuagguucuucaau

SEQ ID NO: 3655713 - RNA, 13 nt, Salmonella enterica enterica serovar Typhi
cguuuuauaagcc

SEQ ID NO: 3655714 - RNA, 18 nt, Salmonella enterica enterica serovar Typhi
cguuuucauuagccgcca

SEQ ID NO: 3655715 - RNA, 20 nt, Salmonella enterica enterica serovar Typhi
cguuuucauuagccgccagc

SEQ ID NO: 3655716 - RNA, 21 nt, Salmonella enterica enterica serovar Typhi
cguuuuccagcaccaguugcg

SEQ ID NO: 3655717 - RNA, 15 nt, Salmonella enterica enterica serovar Typhi
cguuuuccagcucac

SEQ ID NO: 3655718 - RNA, 23 nt, Salmonella enterica enterica serovar Typhi
cguuuuccaggugcugccacauc

SEQ ID NO: 3655719 - RNA, 13 nt, Salmonella enterica enterica serovar Typhi
cguuuucugagcg

SEQ ID NO: 3655720 - RNA, 15 nt, Salmonella enterica enterica serovar Typhi
cguuuugcagcgcca

SEQ ID NO: 3655721 - RNA, 14 nt, Salmonella enterica enterica serovar Typhi
cguuuugcgcguaa

SEQ ID NO: 3655722 - RNA, 20 nt, Salmonella enterica enterica serovar Typhi
cguuuugcucuucuuccggc

SEQ ID NO: 3655723 - RNA, 17 nt, Salmonella enterica enterica serovar Typhi
cguuuuggcagcgcccg

SEQ ID NO: 3655724 - RNA, 19 nt, Salmonella enterica enterica serovar Typhi
cguuuuggguaaauaccag

SEQ ID NO: 3655725 - RNA, 22 nt, Salmonella enterica enterica serovar Typhi
cguuuugugucaaaaaguuguc

SEQ ID NO: 3655726 - RNA, 17 nt, Salmonella enterica enterica serovar Typhi
cguuuuucagccgcgca

SEQ ID NO: 3655727 - RNA, 22 nt, Salmonella enterica enterica serovar Typhi
cguuuuucugaagcguaacagc

SEQ ID NO: 3655728 - RNA, 15 nt, Salmonella enterica enterica serovar Typhi
cguuuuuuccagcgc

SEQ ID NO: 3655729 - RNA, 19 nt, Salmonella enterica enterica serovar Typhi
cguuuuuucgcacgccucu

SEQ ID NO: 3655730 - RNA, 19 nt, Salmonella enterica enterica serovar Typhi
cguuuuuuuguuuuaccug

SEQ ID NO: 3655731 - RNA, 14 nt, Salmonella enterica enterica serovar Typhi
cuaaaaaccagaau

SEQ ID NO: 3655732 - RNA, 22 nt, Salmonella enterica enterica serovar Typhi
cuaaaaaucaaucuacuguuau

SEQ ID NO: 3655733 - RNA, 17 nt, Salmonella enterica enterica serovar Typhi
cuaaacccaccauaggc

SEQ ID NO: 3655734 - RNA, 13 nt, Salmonella enterica enterica serovar Typhi
cuacacucaauac

SEQ ID NO: 3655735 - RNA, 21 nt, Salmonella enterica enterica serovar Typhi
cuacacucuuaacauggcgga

SEQ ID NO: 3655736 - RNA, 22 nt, Salmonella enterica enterica serovar Typhi
cuacagaaagccauaaaacugg

SEQ ID NO: 3655737 - RNA, 21 nt, Salmonella enterica enterica serovar Typhi
cuacagacaucuuugccaaac

SEQ ID NO: 3655738 - RNA, 22 nt, Salmonella enterica enterica serovar Typhi
cuacaggucggguaagcguagc

SEQ ID NO: 3655739 - RNA, 20 nt, Salmonella enterica enterica serovar Typhi
cuacaguguaaaaauuuuug

SEQ ID NO: 3655740 - RNA, 13 nt, Salmonella enterica enterica serovar Typhi
cuacauaucuaua

SEQ ID NO: 3655741 - RNA, 16 nt, Salmonella enterica enterica serovar Typhi
cuaccaacaaaucauu

SEQ ID NO: 3655742 - RNA, 17 nt, Salmonella enterica enterica serovar Typhi
cuaccaacaaaucauuu

SEQ ID NO: 3655743 - RNA, 16 nt, Salmonella enterica enterica serovar Typhi
cuaccaacugagcuaa

SEQ ID NO: 3655744 - RNA, 18 nt, Salmonella enterica enterica serovar Typhi
cuaccaauuccaccaccu

SEQ ID NO: 3655745 - RNA, 15 nt, Salmonella enterica enterica serovar Typhi
cuaccacgcugccgc

SEQ ID NO: 3655746 - RNA, 16 nt, Salmonella enterica enterica serovar Typhi
cuaccacgcugccgcc

SEQ ID NO: 3655747 - RNA, 19 nt, Salmonella enterica enterica serovar Typhi
cuaccacucccaaauuuug

SEQ ID NO: 3655748 - RNA, 16 nt, Salmonella enterica enterica serovar Typhi
cuaccagaucgcggua

SEQ ID NO: 3655749 - RNA, 15 nt, Salmonella enterica enterica serovar Typhi
cuaccaucgcgcgca

SEQ ID NO: 3655750 - RNA, 11 nt, Salmonella enterica enterica serovar Typhi
cuaccaucggc

SEQ ID NO: 3655751 - RNA, 20 nt, Salmonella enterica enterica serovar Typhi
cuacccaauugaauuuaaau

SEQ ID NO: 3655752 - RNA, 19 nt, Salmonella enterica enterica serovar Typhi
cuacccagacaagcacaua

SEQ ID NO: 3655753 - RNA, 16 nt, Salmonella enterica enterica serovar Typhi
cuacccgcaauaccaa

SEQ ID NO: 3655754 - RNA, 14 nt, Salmonella enterica enterica serovar Typhi
cuaccgaggcaggg

SEQ ID NO: 3655755 - RNA, 15 nt, Salmonella enterica enterica serovar Typhi
cuaccgccaccaucg

SEQ ID NO: 3655756 - RNA, 17 nt, Salmonella enterica enterica serovar Typhi
cuaccgcuucgcgcgcc

SEQ ID NO: 3655757 - RNA, 14 nt, Salmonella enterica enterica serovar Typhi
cuaccggaaaacag

SEQ ID NO: 3655758 - RNA, 23 nt, Salmonella enterica enterica serovar Typhi
cuaccggcgguucuuuugcuaac

SEQ ID NO: 3655759 - RNA, 14 nt, Salmonella enterica enterica serovar Typhi
cuaccgggcaaaca

SEQ ID NO: 3655760 - RNA, 16 nt, Salmonella enterica enterica serovar Typhi
cuaccgggcagcaucu

SEQ ID NO: 3655761 - RNA, 17 nt, Salmonella enterica enterica serovar Typhi
cuaccggggcgcucgcc

SEQ ID NO: 3655762 - RNA, 17 nt, Salmonella enterica enterica serovar Typhi
cuaccguucacggcgau

SEQ ID NO: 3655763 - RNA, 18 nt, Salmonella enterica enterica serovar Typhi
cuaccugcagggugaaga

SEQ ID NO: 3655764 - RNA, 17 nt, Salmonella enterica enterica serovar Typhi
cuacgcaaaaaaagcca

SEQ ID NO: 3655765 - RNA, 19 nt, Salmonella enterica enterica serovar Typhi
cuacgcgauaaaaaacgcc

SEQ ID NO: 3655766 - RNA, 20 nt, Salmonella enterica enterica serovar Typhi
cuacgcggcgggcggaaagc

SEQ ID NO: 3655767 - RNA, 19 nt, Salmonella enterica enterica serovar Typhi
cuacgcuauccggcgcgcu

SEQ ID NO: 3655768 - RNA, 13 nt, Salmonella enterica enterica serovar Typhi
cuacgcuauuucc

SEQ ID NO: 3655769 - RNA, 14 nt, Salmonella enterica enterica serovar Typhi
cuacgcuauuucca

SEQ ID NO: 3655770 - RNA, 21 nt, Salmonella enterica enterica serovar Typhi
cuacgcugccauccucauuuu

SEQ ID NO: 3655771 - RNA, 17 nt, Salmonella enterica enterica serovar Typhi
cuacgcuuauccggcuu

SEQ ID NO: 3655772 - RNA, 18 nt, Salmonella enterica enterica serovar Typhi
cuacgcuuauccggcuua

SEQ ID NO: 3655773 - RNA, 18 nt, Salmonella enterica enterica serovar Typhi
cuacgcuucguauuucuu

SEQ ID NO: 3655774 - RNA, 14 nt, Salmonella enterica enterica serovar Typhi
cuacgcuucucucc

SEQ ID NO: 3655775 - RNA, 14 nt, Salmonella enterica enterica serovar Typhi
cuacggcccuggcu

SEQ ID NO: 3655776 - RNA, 15 nt, Salmonella enterica enterica serovar Typhi
cuacgguaaaccagg

SEQ ID NO: 3655777 - RNA, 22 nt, Salmonella enterica enterica serovar Typhi
cuacgugauagaucacuuguuu

SEQ ID NO: 3655778 - RNA, 13 nt, Salmonella enterica enterica serovar Typhi
cuacguucaucag

SEQ ID NO: 3655779 - RNA, 17 nt, Salmonella enterica enterica serovar Typhi
cuacuauuaguucugag

SEQ ID NO: 3655780 - RNA, 21 nt, Salmonella enterica enterica serovar Typhi
cuacuccgcgguguccugcuu

SEQ ID NO: 3655781 - RNA, 22 nt, Salmonella enterica enterica serovar Typhi
cuacucgggccagcucuuuucu

SEQ ID NO: 3655782 - RNA, 16 nt, Salmonella enterica enterica serovar Typhi
cuacuuaccggcgcca

SEQ ID NO: 3655783 - RNA, 17 nt, Salmonella enterica enterica serovar Typhi
cuacuucaauuuuccag

SEQ ID NO: 3655784 - RNA, 14 nt, Salmonella enterica enterica serovar Typhi
cuacuucagcacgg

SEQ ID NO: 3655785 - RNA, 15 nt, Salmonella enterica enterica serovar Typhi
cuacuuuauuuuucg

SEQ ID NO: 3655786 - RNA, 14 nt, Salmonella enterica enterica serovar Typhi
cuacuuuuacccuu

SEQ ID NO: 3655787 - RNA, 21 nt, Salmonella enterica enterica serovar Typhi
cuagaugaugauuuaugaaua

SEQ ID NO: 3655788 - RNA, 20 nt, Salmonella enterica enterica serovar Typhi
cuagcacuacggcaaacaca

SEQ ID NO: 3655789 - RNA, 16 nt, Salmonella enterica enterica serovar Typhi
cuagcgccuuauccgg

SEQ ID NO: 3655790 - RNA, 20 nt, Salmonella enterica enterica serovar Typhi
cuagcgccuuauccggccua

SEQ ID NO: 3655791 - RNA, 14 nt, Salmonella enterica enterica serovar Typhi
cuaggaacagugac

SEQ ID NO: 3655792 - RNA, 15 nt, Salmonella enterica enterica serovar Typhi
cuagggcaucagacg

SEQ ID NO: 3655793 - RNA, 19 nt, Salmonella enterica enterica serovar Typhi
cuaguaaagaaauuuugca

SEQ ID NO: 3655794 - RNA, 15 nt, Salmonella enterica enterica serovar Typhi
cuagucaauaaagac

SEQ ID NO: 3655795 - RNA, 16 nt, Salmonella enterica enterica serovar Typhi
cuauaaaaaugaggua

SEQ ID NO: 3655796 - RNA, 23 nt, Salmonella enterica enterica serovar Typhi
cuauaaaauugccgauauggaug

SEQ ID NO: 3655797 - RNA, 14 nt, Salmonella enterica enterica serovar Typhi
cuauaaaccacggu

SEQ ID NO: 3655798 - RNA, 15 nt, Salmonella enterica enterica serovar Typhi
cuauaacagcgcugg

SEQ ID NO: 3655799 - RNA, 18 nt, Salmonella enterica enterica serovar Typhi
cuauaauaccuccugucu

SEQ ID NO: 3655800 - RNA, 17 nt, Salmonella enterica enterica serovar Typhi
cuauacccaaaauaauu

SEQ ID NO: 3655801 - RNA, 14 nt, Salmonella enterica enterica serovar Typhi
cuauacgcggcgua

SEQ ID NO: 3655802 - RNA, 23 nt, Salmonella enterica enterica serovar Typhi
cuauagagagauggaacaucuuu

SEQ ID NO: 3655803 - RNA, 23 nt, Salmonella enterica enterica serovar Typhi
cuauagcccacgcauaaugagcg

SEQ ID NO: 3655804 - RNA, 17 nt, Salmonella enterica enterica serovar Typhi
cuauaguggcauuuacc

SEQ ID NO: 3655805 - RNA, 15 nt, Salmonella enterica enterica serovar Typhi
cuauaugcaggcaua

SEQ ID NO: 3655806 - RNA, 20 nt, Salmonella enterica enterica serovar Typhi
cuauaugcaggcauaaaaaa

SEQ ID NO: 3655807 - RNA, 17 nt, Salmonella enterica enterica serovar Typhi
cuauauggcgcaagugu

SEQ ID NO: 3655808 - RNA, 22 nt, Salmonella enterica enterica serovar Typhi
cuauauguccuuuacugcgcca

SEQ ID NO: 3655809 - RNA, 16 nt, Salmonella enterica enterica serovar Typhi
cuaucaagauaaaaag

SEQ ID NO: 3655810 - RNA, 13 nt, Salmonella enterica enterica serovar Typhi
cuaucaccgccuc

SEQ ID NO: 3655811 - RNA, 20 nt, Salmonella enterica enterica serovar Typhi
cuaucaccgccucgaccccu

SEQ ID NO: 3655812 - RNA, 16 nt, Salmonella enterica enterica serovar Typhi
cuaucagaaaaaauua

SEQ ID NO: 3655813 - RNA, 20 nt, Salmonella enterica enterica serovar Typhi
cuaucaggauucgacggcca

SEQ ID NO: 3655814 - RNA, 15 nt, Salmonella enterica enterica serovar Typhi
cuaucaguacgaccc

SEQ ID NO: 3655815 - RNA, 16 nt, Salmonella enterica enterica serovar Typhi
cuaucaugcugcgguu

SEQ ID NO: 3655816 - RNA, 19 nt, Salmonella enterica enterica serovar Typhi
cuauccaccccuugcgcgu

SEQ ID NO: 3655817 - RNA, 11 nt, Salmonella enterica enterica serovar Typhi
cuauccacgca

SEQ ID NO: 3655818 - RNA, 12 nt, Salmonella enterica enterica serovar Typhi
cuauccagcagu

SEQ ID NO: 3655819 - RNA, 17 nt, Salmonella enterica enterica serovar Typhi
cuauccagcaguaaaua

SEQ ID NO: 3655820 - RNA, 19 nt, Salmonella enterica enterica serovar Typhi
cucacagaaucaucaggcu

SEQ ID NO: 3655821 - RNA, 14 nt, Salmonella enterica enterica serovar Typhi
cucacauaacaaaa

SEQ ID NO: 3655822 - RNA, 19 nt, Salmonella enterica enterica serovar Typhi
cucacauucauaaaagauc

SEQ ID NO: 3655823 - RNA, 19 nt, Salmonella enterica enterica serovar Typhi
cucacauucauugccgcca

SEQ ID NO: 3655824 - RNA, 14 nt, Salmonella enterica enterica serovar Typhi
cucaccaguagcgc

SEQ ID NO: 3655825 - RNA, 22 nt, Salmonella enterica enterica serovar Typhi
cucaccaguagcgcgacgccaa

SEQ ID NO: 3655826 - RNA, 18 nt, Salmonella enterica enterica serovar Typhi
cucaccaguccggcagaa

SEQ ID NO: 3655827 - RNA, 13 nt, Salmonella enterica enterica serovar Typhi
cucacccaggcga

SEQ ID NO: 3655828 - RNA, 15 nt, Salmonella enterica enterica serovar Typhi
cucaccccuucuuua

SEQ ID NO: 3655829 - RNA, 17 nt, Salmonella enterica enterica serovar Typhi
cucaccgagacugcccg

SEQ ID NO: 3655830 - RNA, 18 nt, Salmonella enterica enterica serovar Typhi
cucaccguagcuccagac

SEQ ID NO: 3655831 - RNA, 19 nt, Salmonella enterica enterica serovar Typhi
cucaccguagcuccagacc

SEQ ID NO: 3655832 - RNA, 13 nt, Salmonella enterica enterica serovar Typhi
cucaccgugguga

SEQ ID NO: 3655833 - RNA, 14 nt, Salmonella enterica enterica serovar Typhi
cucaccugaugcga

SEQ ID NO: 3655834 - RNA, 22 nt, Salmonella enterica enterica serovar Typhi
cucaccuuuuuauuuacugccg

SEQ ID NO: 3655835 - RNA, 22 nt, Salmonella enterica enterica serovar Typhi
cucacgaaguuuacguugguau

SEQ ID NO: 3655836 - RNA, 18 nt, Salmonella enterica enterica serovar Typhi
cucacgcccgcggcauga

SEQ ID NO: 3655837 - RNA, 18 nt, Salmonella enterica enterica serovar Typhi
cucacgcucauagccgcu

SEQ ID NO: 3655838 - RNA, 22 nt, Salmonella enterica enterica serovar Typhi
cucacgcuggugcuuggcguga

SEQ ID NO: 3655839 - RNA, 21 nt, Salmonella enterica enterica serovar Typhi
cucacgcuuaucgccaaacca

SEQ ID NO: 3655840 - RNA, 14 nt, Salmonella enterica enterica serovar Typhi
cucacguuccccag

SEQ ID NO: 3655841 - RNA, 15 nt, Salmonella enterica enterica serovar Typhi
cucacguuccccagc

SEQ ID NO: 3655842 - RNA, 21 nt, Salmonella enterica enterica serovar Typhi
cucacuaucacacuggcgaua

SEQ ID NO: 3655843 - RNA, 18 nt, Salmonella enterica enterica serovar Typhi
cucacugccgacgcccuc

SEQ ID NO: 3655844 - RNA, 13 nt, Salmonella enterica enterica serovar Typhi
cucacuguugaua

SEQ ID NO: 3655845 - RNA, 18 nt, Salmonella enterica enterica serovar Typhi
cucacuuuucuuuccugc

SEQ ID NO: 3655846 - RNA, 20 nt, Salmonella enterica enterica serovar Typhi
cucagaaaauuauuuuaaau

SEQ ID NO: 3655847 - RNA, 17 nt, Salmonella enterica enterica serovar Typhi
cucagaucggcagacag

SEQ ID NO: 3655848 - RNA, 22 nt, Salmonella enterica enterica serovar Typhi
cucagcaggcgggcuuuuuuug

SEQ ID NO: 3655849 - RNA, 18 nt, Salmonella enterica enterica serovar Typhi
cucagcauuggugagaga

SEQ ID NO: 3655850 - RNA, 16 nt, Salmonella enterica enterica serovar Typhi
cucagccagaaacggu

SEQ ID NO: 3655851 - RNA, 12 nt, Salmonella enterica enterica serovar Typhi
cucagcggccca

SEQ ID NO: 3655852 - RNA, 19 nt, Salmonella enterica enterica serovar Typhi
cucaggaaaacaaauugca

SEQ ID NO: 3655853 - RNA, 21 nt, Salmonella enterica enterica serovar Typhi
cucaggaagcguccagaugca

SEQ ID NO: 3655854 - RNA, 13 nt, Salmonella enterica enterica serovar Typhi
cucaggacgccag

SEQ ID NO: 3655855 - RNA, 15 nt, Salmonella enterica enterica serovar Typhi
cucaggacgccagug

SEQ ID NO: 3655856 - RNA, 23 nt, Salmonella enterica enterica serovar Typhi
cucaggcgcgaauaaugcguccg

SEQ ID NO: 3655857 - RNA, 21 nt, Salmonella enterica enterica serovar Typhi
cucaggguuuuacgcuggaca

SEQ ID NO: 3655858 - RNA, 22 nt, Salmonella enterica enterica serovar Typhi
cucagguuauacugugacgaca

SEQ ID NO: 3655859 - RNA, 19 nt, Salmonella enterica enterica serovar Typhi
cucagguuauauuccgccu

SEQ ID NO: 3655860 - RNA, 14 nt, Salmonella enterica enterica serovar Typhi
cucagucagucccg

SEQ ID NO: 3655861 - RNA, 16 nt, Salmonella enterica enterica serovar Typhi
cucaguccagccgccg

SEQ ID NO: 3655862 - RNA, 17 nt, Salmonella enterica enterica serovar Typhi
cucauaaaacauuccug

SEQ ID NO: 3655863 - RNA, 18 nt, Salmonella enterica enterica serovar Typhi
cucauaaauugcagcgac

SEQ ID NO: 3655864 - RNA, 14 nt, Salmonella enterica enterica serovar Typhi
cucauaaccgcgau

SEQ ID NO: 3655865 - RNA, 16 nt, Salmonella enterica enterica serovar Typhi
cucauaaugauggggu

SEQ ID NO: 3655866 - RNA, 19 nt, Salmonella enterica enterica serovar Typhi
cucauacagcccgcgcaga

SEQ ID NO: 3655867 - RNA, 20 nt, Salmonella enterica enterica serovar Typhi
cucauacagcccgcgcagaa

SEQ ID NO: 3655868 - RNA, 21 nt, Salmonella enterica enterica serovar Typhi
cucauacccacaagcgggaua

SEQ ID NO: 3655869 - RNA, 13 nt, Salmonella enterica enterica serovar Typhi
cucauacccuucc

SEQ ID NO: 3655870 - RNA, 16 nt, Salmonella enterica enterica serovar Typhi
cucauagccgcuuucc

SEQ ID NO: 3655871 - RNA, 14 nt, Salmonella enterica enterica serovar Typhi
cucauauacccugc

SEQ ID NO: 3655872 - RNA, 15 nt, Salmonella enterica enterica serovar Typhi
cucauauacccugcg

SEQ ID NO: 3655873 - RNA, 20 nt, Salmonella enterica enterica serovar Typhi
cucauauacccugcggcgaa

SEQ ID NO: 3655874 - RNA, 17 nt, Salmonella enterica enterica serovar Typhi
cucaucaaacagggcgu

SEQ ID NO: 3655875 - RNA, 22 nt, Salmonella enterica enterica serovar Typhi
cucaucaauucuuuaauuugug

SEQ ID NO: 3655876 - RNA, 15 nt, Salmonella enterica enterica serovar Typhi
cucaucacccagucg

SEQ ID NO: 3655877 - RNA, 13 nt, Salmonella enterica enterica serovar Typhi
cucaucagaccgu

SEQ ID NO: 3655878 - RNA, 22 nt, Salmonella enterica enterica serovar Typhi
cucaucagccugaaagauuauu

SEQ ID NO: 3655879 - RNA, 14 nt, Salmonella enterica enterica serovar Typhi
cucaucagcgccau

SEQ ID NO: 3655880 - RNA, 23 nt, Salmonella enterica enterica serovar Typhi
cucaucagguaauacaggguuug

SEQ ID NO: 3655881 - RNA, 21 nt, Salmonella enterica enterica serovar Typhi
cucaucaguuugcgauaagcg

SEQ ID NO: 3655882 - RNA, 20 nt, Salmonella enterica enterica serovar Typhi
cucauccaacugcgccugaa

SEQ ID NO: 3655883 - RNA, 21 nt, Salmonella enterica enterica serovar Typhi
cucauccagauguuauaaacu

SEQ ID NO: 3655884 - RNA, 18 nt, Salmonella enterica enterica serovar Typhi
cucauccccagcaucaug

SEQ ID NO: 3655885 - RNA, 13 nt, Salmonella enterica enterica serovar Typhi
cucauccggcagc

SEQ ID NO: 3655886 - RNA, 21 nt, Salmonella enterica enterica serovar Typhi
cucaucggcaaacauagccuc

SEQ ID NO: 3655887 - RNA, 14 nt, Salmonella enterica enterica serovar Typhi
cucaucggucgcau

SEQ ID NO: 3655888 - RNA, 17 nt, Salmonella enterica enterica serovar Typhi
cucaucggucgcaucca

SEQ ID NO: 3655889 - RNA, 20 nt, Salmonella enterica enterica serovar Typhi
cucaucggucgcauccauau

SEQ ID NO: 3655890 - RNA, 19 nt, Salmonella enterica enterica serovar Typhi
cucaucgguuaacacauau

SEQ ID NO: 3655891 - RNA, 18 nt, Salmonella enterica enterica serovar Typhi
cucaucugaugauuaauu

SEQ ID NO: 3655892 - RNA, 17 nt, Salmonella enterica enterica serovar Typhi
cucaucuucuuuuuccg

SEQ ID NO: 3655893 - RNA, 13 nt, Salmonella enterica enterica serovar Typhi
cucaucuuuuaca

SEQ ID NO: 3655894 - RNA, 18 nt, Salmonella enterica enterica serovar Typhi
cucaugauagggcagcag

SEQ ID NO: 3655895 - RNA, 19 nt, Salmonella enterica enterica serovar Typhi
cucaugccguagaacagca

SEQ ID NO: 3655896 - RNA, 11 nt, Salmonella enterica enterica serovar Typhi
cucaugccucg

SEQ ID NO: 3655897 - RNA, 18 nt, Salmonella enterica enterica serovar Typhi
cucauguaaaggcgugug

SEQ ID NO: 3655898 - RNA, 16 nt, Salmonella enterica enterica serovar Typhi
cucaugugcagcaucc

SEQ ID NO: 3655899 - RNA, 15 nt, Salmonella enterica enterica serovar Typhi
cucauguucgcuucu

SEQ ID NO: 3655900 - RNA, 19 nt, Salmonella enterica enterica serovar Typhi
cucauuaccgaccuguacc

SEQ ID NO: 3655901 - RNA, 23 nt, Salmonella enterica enterica serovar Typhi
cucauuaccggcugccgauagca

SEQ ID NO: 3655902 - RNA, 19 nt, Salmonella enterica enterica serovar Typhi
cucauucugauuuuacuaa

SEQ ID NO: 3655903 - RNA, 14 nt, Salmonella enterica enterica serovar Typhi
cucauugaucaguu

SEQ ID NO: 3655904 - RNA, 16 nt, Salmonella enterica enterica serovar Typhi
cucauuucacuauaaa

SEQ ID NO: 3655905 - RNA, 14 nt, Salmonella enterica enterica serovar Typhi
cuccgcgcuggcaa

SEQ ID NO: 3655906 - RNA, 19 nt, Salmonella enterica enterica serovar Typhi
cuccgcguaccucagcaug

SEQ ID NO: 3655907 - RNA, 18 nt, Salmonella enterica enterica serovar Typhi
cuccgcguagcccagcgc

SEQ ID NO: 3655908 - RNA, 13 nt, Salmonella enterica enterica serovar Typhi
cuccggacgcacc

SEQ ID NO: 3655909 - RNA, 17 nt, Salmonella enterica enterica serovar Typhi
cuccggcagaaaugacc

SEQ ID NO: 3655910 - RNA, 14 nt, Salmonella enterica enterica serovar Typhi
cuccggcagcgaau

SEQ ID NO: 3655911 - RNA, 20 nt, Salmonella enterica enterica serovar Typhi
cuccggcagcguauugagcu

SEQ ID NO: 3655912 - RNA, 16 nt, Salmonella enterica enterica serovar Typhi
cuccggcaguccaugc

SEQ ID NO: 3655913 - RNA, 14 nt, Salmonella enterica enterica serovar Typhi
cuccggcgcgcgcg

SEQ ID NO: 3655914 - RNA, 17 nt, Salmonella enterica enterica serovar Typhi
cuccggcgcgcgcgcca

SEQ ID NO: 3655915 - RNA, 13 nt, Salmonella enterica enterica serovar Typhi
cuccggcggguaa

SEQ ID NO: 3655916 - RNA, 15 nt, Salmonella enterica enterica serovar Typhi
cuccggcguaaaggc

SEQ ID NO: 3655917 - RNA, 20 nt, Salmonella enterica enterica serovar Typhi
cuccggcuaugccggaggau

SEQ ID NO: 3655918 - RNA, 14 nt, Salmonella enterica enterica serovar Typhi
cuccggcugcacca

SEQ ID NO: 3655919 - RNA, 21 nt, Salmonella enterica enterica serovar Typhi
cuccggcuuaaugcauggcag

SEQ ID NO: 3655920 - RNA, 23 nt, Salmonella enterica enterica serovar Typhi
cuccgggauagcaaucucgccaa

SEQ ID NO: 3655921 - RNA, 23 nt, Salmonella enterica enterica serovar Typhi
cuccggguaacggacucaggccu

SEQ ID NO: 3655922 - RNA, 23 nt, Salmonella enterica enterica serovar Typhi
cuccgguaaucaccagaucggca

SEQ ID NO: 3655923 - RNA, 22 nt, Salmonella enterica enterica serovar Typhi
cuccgucucuuuauugaaaagc

SEQ ID NO: 3655924 - RNA, 15 nt, Salmonella enterica enterica serovar Typhi
cuccucaacagacau

SEQ ID NO: 3655925 - RNA, 14 nt, Salmonella enterica enterica serovar Typhi
cuccuccagcgcgu

SEQ ID NO: 3655926 - RNA, 13 nt, Salmonella enterica enterica serovar Typhi
cuccuccggcuuc

SEQ ID NO: 3655927 - RNA, 22 nt, Salmonella enterica enterica serovar Typhi
cuccuccgguuucaacugucga

SEQ ID NO: 3655928 - RNA, 22 nt, Salmonella enterica enterica serovar Typhi
cuccugaaucgccgucagugag

SEQ ID NO: 3655929 - RNA, 20 nt, Salmonella enterica enterica serovar Typhi
cuccugacauagcucacgca

SEQ ID NO: 3655930 - RNA, 20 nt, Salmonella enterica enterica serovar Typhi
cuccugcaucgauuccccac

SEQ ID NO: 3655931 - RNA, 20 nt, Salmonella enterica enterica serovar Typhi
cuccugccagauuuucuuua

SEQ ID NO: 3655932 - RNA, 18 nt, Salmonella enterica enterica serovar Typhi
cuccugccgaugccgccg

SEQ ID NO: 3655933 - RNA, 15 nt, Salmonella enterica enterica serovar Typhi
cuccugcgauagcug

SEQ ID NO: 3655934 - RNA, 21 nt, Salmonella enterica enterica serovar Typhi
cuccugcgauagcugcugacg

SEQ ID NO: 3655935 - RNA, 15 nt, Salmonella enterica enterica serovar Typhi
cuccugcgccagccg

SEQ ID NO: 3655936 - RNA, 11 nt, Salmonella enterica enterica serovar Typhi
cuccugcuccu

SEQ ID NO: 3655937 - RNA, 16 nt, Salmonella enterica enterica serovar Typhi
cuccuggauuuuaccu

SEQ ID NO: 3655938 - RNA, 16 nt, Salmonella enterica enterica serovar Typhi
cuccuucuucgccguc

SEQ ID NO: 3655939 - RNA, 17 nt, Salmonella enterica enterica serovar Typhi
cuccuuuuaccggcgaa

SEQ ID NO: 3655940 - RNA, 12 nt, Salmonella enterica enterica serovar Typhi
cucgaagaugag

SEQ ID NO: 3655941 - RNA, 18 nt, Salmonella enterica enterica serovar Typhi
cucgacacacucaucuuc

SEQ ID NO: 3655942 - RNA, 17 nt, Salmonella enterica enterica serovar Typhi
cucgaccaguuuuuccg

SEQ ID NO: 3655943 - RNA, 15 nt, Salmonella enterica enterica serovar Typhi
cucgaccuggcgcuc

SEQ ID NO: 3655944 - RNA, 16 nt, Salmonella enterica enterica serovar Typhi
cucgacguccagcgcg

SEQ ID NO: 3655945 - RNA, 21 nt, Salmonella enterica enterica serovar Typhi
cucgacguuuuccaucaccau

SEQ ID NO: 3655946 - RNA, 15 nt, Salmonella enterica enterica serovar Typhi
cucgaggaacuguuc

SEQ ID NO: 3655947 - RNA, 16 nt, Salmonella enterica enterica serovar Typhi
cucgauaacuuucggg

SEQ ID NO: 3655948 - RNA, 13 nt, Salmonella enterica enterica serovar Typhi
cucgauauauuuu

SEQ ID NO: 3655949 - RNA, 23 nt, Salmonella enterica enterica serovar Typhi
cucgauaucagggcuuuuuucuc

SEQ ID NO: 3655950 - RNA, 17 nt, Salmonella enterica enterica serovar Typhi
cucgauuccugacgcac

SEQ ID NO: 3655951 - RNA, 23 nt, Salmonella enterica enterica serovar Typhi
cucgauuugcccuuccagcagcc

SEQ ID NO: 3655952 - RNA, 13 nt, Salmonella enterica enterica serovar Typhi
cucgcaaaacaug

SEQ ID NO: 3655953 - RNA, 20 nt, Salmonella enterica enterica serovar Typhi
cucgcacugauagccgccag

SEQ ID NO: 3655954 - RNA, 17 nt, Salmonella enterica enterica serovar Typhi
cucgcacuggcgagcgg

SEQ ID NO: 3655955 - RNA, 14 nt, Salmonella enterica enterica serovar Typhi
cucgcauccuccau

SEQ ID NO: 3655956 - RNA, 18 nt, Salmonella enterica enterica serovar Typhi
cucgccaauauccccagc

SEQ ID NO: 3655957 - RNA, 17 nt, Salmonella enterica enterica serovar Typhi
cucgccaaugccgcagc

SEQ ID NO: 3655958 - RNA, 19 nt, Salmonella enterica enterica serovar Typhi
cucgccaccggcacaucca

SEQ ID NO: 3655959 - RNA, 13 nt, Salmonella enterica enterica serovar Typhi
cucgccagcccga

SEQ ID NO: 3655960 - RNA, 11 nt, Salmonella enterica enterica serovar Typhi
cucgccagcgc

SEQ ID NO: 3655961 - RNA, 12 nt, Salmonella enterica enterica serovar Typhi
cucgccagugcg

SEQ ID NO: 3655962 - RNA, 20 nt, Salmonella enterica enterica serovar Typhi
cucgccauaucuucuacaau

SEQ ID NO: 3655963 - RNA, 18 nt, Salmonella enterica enterica serovar Typhi
cucgcccgugcauccccu

SEQ ID NO: 3655964 - RNA, 22 nt, Salmonella enterica enterica serovar Typhi
cucgcccuucgggccgccgcaa

SEQ ID NO: 3655965 - RNA, 15 nt, Salmonella enterica enterica serovar Typhi
cucgcccuugccgcu

SEQ ID NO: 3655966 - RNA, 17 nt, Salmonella enterica enterica serovar Typhi
cucgccgaccggcgcgc

SEQ ID NO: 3655967 - RNA, 20 nt, Salmonella enterica enterica serovar Typhi
cucgccgacggucaaacuga

SEQ ID NO: 3655968 - RNA, 11 nt, Salmonella enterica enterica serovar Typhi
cucgccgauag

SEQ ID NO: 3655969 - RNA, 11 nt, Salmonella enterica enterica serovar Typhi
cucgccgccgg

SEQ ID NO: 3655970 - RNA, 15 nt, Salmonella enterica enterica serovar Typhi
cucgccgccuccccc

SEQ ID NO: 3655971 - RNA, 17 nt, Salmonella enterica enterica serovar Typhi
cucgccgccucccccuc

SEQ ID NO: 3655972 - RNA, 18 nt, Salmonella enterica enterica serovar Typhi
cucgccgccucccccuca

SEQ ID NO: 3655973 - RNA, 18 nt, Salmonella enterica enterica serovar Typhi
cucgccgguagccagcca

SEQ ID NO: 3655974 - RNA, 19 nt, Salmonella enterica enterica serovar Typhi
cucgccguuuuaucgcccg

SEQ ID NO: 3655975 - RNA, 15 nt, Salmonella enterica enterica serovar Typhi
cucgccuucggccug

SEQ ID NO: 3655976 - RNA, 21 nt, Salmonella enterica enterica serovar Typhi
cucgccuuucuccauggucag

SEQ ID NO: 3655977 - RNA, 19 nt, Salmonella enterica enterica serovar Typhi
cucgcgcagaaucagcgug

SEQ ID NO: 3655978 - RNA, 22 nt, Salmonella enterica enterica serovar Typhi
cucgcgcaucaggaucuucauc

SEQ ID NO: 3655979 - RNA, 18 nt, Salmonella enterica enterica serovar Typhi
cucgcgguugacgcugcu

SEQ ID NO: 3655980 - RNA, 18 nt, Salmonella enterica enterica serovar Typhi
cucgcguaccagaaacag

SEQ ID NO: 3655981 - RNA, 14 nt, Salmonella enterica enterica serovar Typhi
cucgcguccccagc

SEQ ID NO: 3655982 - RNA, 23 nt, Salmonella enterica enterica serovar Typhi
cucgcguccccagccgaugaccc

SEQ ID NO: 3655983 - RNA, 12 nt, Salmonella enterica enterica serovar Typhi
cucgcuaaugcc

SEQ ID NO: 3655984 - RNA, 13 nt, Salmonella enterica enterica serovar Typhi
cucgcuaaugccc

SEQ ID NO: 3655985 - RNA, 20 nt, Salmonella enterica enterica serovar Typhi
cucgcuaauuggcuuaccuu

SEQ ID NO: 3655986 - RNA, 15 nt, Salmonella enterica enterica serovar Typhi
cucgcuaccggcgaa

SEQ ID NO: 3655987 - RNA, 23 nt, Salmonella enterica enterica serovar Typhi
cucgcucaucacaucgcgcagca

SEQ ID NO: 3655988 - RNA, 13 nt, Salmonella enterica enterica serovar Typhi
cucgcucccuucc

SEQ ID NO: 3655989 - RNA, 16 nt, Salmonella enterica enterica serovar Typhi
cucgcucccuuccccc

SEQ ID NO: 3655990 - RNA, 17 nt, Salmonella enterica enterica serovar Typhi
cucgcucgcccaucacu

SEQ ID NO: 3655991 - RNA, 15 nt, Salmonella enterica enterica serovar Typhi
cucuuccagcgccaa

SEQ ID NO: 3655992 - RNA, 16 nt, Salmonella enterica enterica serovar Typhi
cucuuccccgacaaaa

SEQ ID NO: 3655993 - RNA, 20 nt, Salmonella enterica enterica serovar Typhi
cucuuccccggucaguccca

SEQ ID NO: 3655994 - RNA, 17 nt, Salmonella enterica enterica serovar Typhi
cucuucccgucgcagca

SEQ ID NO: 3655995 - RNA, 12 nt, Salmonella enterica enterica serovar Typhi
cucuuccgccag

SEQ ID NO: 3655996 - RNA, 13 nt, Salmonella enterica enterica serovar Typhi
cucuuccgccagc

SEQ ID NO: 3655997 - RNA, 14 nt, Salmonella enterica enterica serovar Typhi
cucuuccugcugcg

SEQ ID NO: 3655998 - RNA, 14 nt, Salmonella enterica enterica serovar Typhi
cucuucgacacauu

SEQ ID NO: 3655999 - RNA, 12 nt, Salmonella enterica enterica serovar Typhi
cucuucgccaau

SEQ ID NO: 3656000 - RNA, 21 nt, Salmonella enterica enterica serovar Typhi
cucuucgccauuacaggacag

SEQ ID NO: 3656001 - RNA, 20 nt, Salmonella enterica enterica serovar Typhi
cucuucgugacccgccagca

SEQ ID NO: 3656002 - RNA, 21 nt, Salmonella enterica enterica serovar Typhi
cucuucguucauccgucuggc

SEQ ID NO: 3656003 - RNA, 16 nt, Salmonella enterica enterica serovar Typhi
cucuucugaccaucuu

SEQ ID NO: 3656004 - RNA, 11 nt, Salmonella enterica enterica serovar Typhi
cucuucugcug

SEQ ID NO: 3656005 - RNA, 20 nt, Salmonella enterica enterica serovar Typhi
cucuucuuugagcucccggu

SEQ ID NO: 3656006 - RNA, 17 nt, Salmonella enterica enterica serovar Typhi
cucuucuuuuacaagaa

SEQ ID NO: 3656007 - RNA, 22 nt, Salmonella enterica enterica serovar Typhi
cucuugcauaauauccaggagc

SEQ ID NO: 3656008 - RNA, 15 nt, Salmonella enterica enterica serovar Typhi
cucuuggucauaaua

SEQ ID NO: 3656009 - RNA, 20 nt, Salmonella enterica enterica serovar Typhi
cucuugugcuuccagcucca

SEQ ID NO: 3656010 - RNA, 21 nt, Salmonella enterica enterica serovar Typhi
cucuuuaaugauguccagaau

SEQ ID NO: 3656011 - RNA, 16 nt, Salmonella enterica enterica serovar Typhi
cucuuuauugcuggug

SEQ ID NO: 3656012 - RNA, 20 nt, Salmonella enterica enterica serovar Typhi
cucuuucagccgacuaucuu

SEQ ID NO: 3656013 - RNA, 22 nt, Salmonella enterica enterica serovar Typhi
cucuuucagccgacuaucuucu

SEQ ID NO: 3656014 - RNA, 23 nt, Salmonella enterica enterica serovar Typhi
cucuuucagccgacuaucuucuu

SEQ ID NO: 3656015 - RNA, 17 nt, Salmonella enterica enterica serovar Typhi
cucuuucauuucugccu

SEQ ID NO: 3656016 - RNA, 17 nt, Salmonella enterica enterica serovar Typhi
cucuuucgguagccaca

SEQ ID NO: 3656017 - RNA, 20 nt, Salmonella enterica enterica serovar Typhi
cucuuucgguagccacagau

SEQ ID NO: 3656018 - RNA, 15 nt, Salmonella enterica enterica serovar Typhi
cucuuuguuggcugc

SEQ ID NO: 3656019 - RNA, 17 nt, Salmonella enterica enterica serovar Typhi
cucuuuuaauuuucugu

SEQ ID NO: 3656020 - RNA, 11 nt, Salmonella enterica enterica serovar Typhi
cucuuuuucau

SEQ ID NO: 3656021 - RNA, 20 nt, Salmonella enterica enterica serovar Typhi
cucuuuuucauagaaccacu

SEQ ID NO: 3656022 - RNA, 12 nt, Salmonella enterica enterica serovar Typhi
cugaaaaagaac

SEQ ID NO: 3656023 - RNA, 20 nt, Salmonella enterica enterica serovar Typhi
cugaaaaaggguaacgggac

SEQ ID NO: 3656024 - RNA, 13 nt, Salmonella enterica enterica serovar Typhi
cugaaaaaucccc

SEQ ID NO: 3656025 - RNA, 15 nt, Salmonella enterica enterica serovar Typhi
cugaaaacaggccug

SEQ ID NO: 3656026 - RNA, 22 nt, Salmonella enterica enterica serovar Typhi
cugaaaacggcaucaagcccau

SEQ ID NO: 3656027 - RNA, 21 nt, Salmonella enterica enterica serovar Typhi
cugaaaauaauugauaauaac

SEQ ID NO: 3656028 - RNA, 14 nt, Salmonella enterica enterica serovar Typhi
cugaaaaucaaaaa

SEQ ID NO: 3656029 - RNA, 13 nt, Salmonella enterica enterica serovar Typhi
cugaaaaugcccg

SEQ ID NO: 3656030 - RNA, 18 nt, Salmonella enterica enterica serovar Typhi
cugaaacgcuucaccggc

SEQ ID NO: 3656031 - RNA, 17 nt, Salmonella enterica enterica serovar Typhi
cugaaacggaucaaaaa

SEQ ID NO: 3656032 - RNA, 21 nt, Salmonella enterica enterica serovar Typhi
cugaaagagcgugcggcugac

SEQ ID NO: 3656033 - RNA, 13 nt, Salmonella enterica enterica serovar Typhi
cugaaauaacucu

SEQ ID NO: 3656034 - RNA, 15 nt, Salmonella enterica enterica serovar Typhi
cugaaaucagccugc

SEQ ID NO: 3656035 - RNA, 15 nt, Salmonella enterica enterica serovar Typhi
cugaaauuucuuuuc

SEQ ID NO: 3656036 - RNA, 20 nt, Salmonella enterica enterica serovar Typhi
cugaacaauacguuucucgc

SEQ ID NO: 3656037 - RNA, 13 nt, Salmonella enterica enterica serovar Typhi
cugaaccaacagc

SEQ ID NO: 3656038 - RNA, 14 nt, Salmonella enterica enterica serovar Typhi
cugaaccugccuuu

SEQ ID NO: 3656039 - RNA, 15 nt, Salmonella enterica enterica serovar Typhi
cugaaccugccuuug

SEQ ID NO: 3656040 - RNA, 18 nt, Salmonella enterica enterica serovar Typhi
cugaacgcccggcgcgac

SEQ ID NO: 3656041 - RNA, 11 nt, Salmonella enterica enterica serovar Typhi
cugaacgcugc

SEQ ID NO: 3656042 - RNA, 13 nt, Salmonella enterica enterica serovar Typhi
cugaacucccggc

SEQ ID NO: 3656043 - RNA, 13 nt, Salmonella enterica enterica serovar Typhi
cugaacuguaacc

SEQ ID NO: 3656044 - RNA, 21 nt, Salmonella enterica enterica serovar Typhi
cugaacuuccguaaaaagaac

SEQ ID NO: 3656045 - RNA, 16 nt, Salmonella enterica enterica serovar Typhi
cugaagauaaaauugu

SEQ ID NO: 3656046 - RNA, 17 nt, Salmonella enterica enterica serovar Typhi
cugaagauaaacagcag

SEQ ID NO: 3656047 - RNA, 22 nt, Salmonella enterica enterica serovar Typhi
cugaagccagcaaucagcccau

SEQ ID NO: 3656048 - RNA, 13 nt, Salmonella enterica enterica serovar Typhi
cugaagccauccu

SEQ ID NO: 3656049 - RNA, 16 nt, Salmonella enterica enterica serovar Typhi
cugaagcccuuuagug

SEQ ID NO: 3656050 - RNA, 13 nt, Salmonella enterica enterica serovar Typhi
cugaagccugcuu

SEQ ID NO: 3656051 - RNA, 20 nt, Salmonella enterica enterica serovar Typhi
cugaagcgcgacgggaagga

SEQ ID NO: 3656052 - RNA, 14 nt, Salmonella enterica enterica serovar Typhi
cugaagcguaaaaa

SEQ ID NO: 3656053 - RNA, 22 nt, Salmonella enterica enterica serovar Typhi
cugaagcugccgucccagcgga

SEQ ID NO: 3656054 - RNA, 15 nt, Salmonella enterica enterica serovar Typhi
cugaaggacaagcug

SEQ ID NO: 3656055 - RNA, 17 nt, Salmonella enterica enterica serovar Typhi
cugaaggacaagcugcg

SEQ ID NO: 3656056 - RNA, 16 nt, Salmonella enterica enterica serovar Typhi
cugaaggcguaugaau

SEQ ID NO: 3656057 - RNA, 15 nt, Salmonella enterica enterica serovar Typhi
cugaagguuuuuccc

SEQ ID NO: 3656058 - RNA, 15 nt, Salmonella enterica enterica serovar Typhi
cugaauaaauugaau

SEQ ID NO: 3656059 - RNA, 18 nt, Salmonella enterica enterica serovar Typhi
cugaauaacccgcagccc

SEQ ID NO: 3656060 - RNA, 13 nt, Salmonella enterica enterica serovar Typhi
cugaauagccagc

SEQ ID NO: 3656061 - RNA, 15 nt, Salmonella enterica enterica serovar Typhi
cugaauagccagccc

SEQ ID NO: 3656062 - RNA, 17 nt, Salmonella enterica enterica serovar Typhi
cugaauagcuuucaccg

SEQ ID NO: 3656063 - RNA, 17 nt, Salmonella enterica enterica serovar Typhi
cugaauagucggcugcu

SEQ ID NO: 3656064 - RNA, 13 nt, Salmonella enterica enterica serovar Typhi
cugaauaucuucg

SEQ ID NO: 3656065 - RNA, 20 nt, Salmonella enterica enterica serovar Typhi
cugaauaugcgucagauguu

SEQ ID NO: 3656066 - RNA, 17 nt, Salmonella enterica enterica serovar Typhi
cugaauauuaaaguuca

SEQ ID NO: 3656067 - RNA, 24 nt, Salmonella enterica enterica serovar Typhi
cugaauauuagaguggccgcgcaa

SEQ ID NO: 3656068 - RNA, 23 nt, Salmonella enterica enterica serovar Typhi
cugaaucagauacggcuccagca

SEQ ID NO: 3656069 - RNA, 16 nt, Salmonella enterica enterica serovar Typhi
cugaaucagcaucuua

SEQ ID NO: 3656070 - RNA, 14 nt, Salmonella enterica enterica serovar Typhi
cugaaucaguaucc

SEQ ID NO: 3656071 - RNA, 22 nt, Salmonella enterica enterica serovar Typhi
cugaaucagugcaucuucacug

SEQ ID NO: 3656072 - RNA, 14 nt, Salmonella enterica enterica serovar Typhi
cugaaucugcuccg

SEQ ID NO: 3656073 - RNA, 19 nt, Salmonella enterica enterica serovar Typhi
cugaaugcccuuuuccaga

SEQ ID NO: 3656074 - RNA, 22 nt, Salmonella enterica enterica serovar Typhi
cugaaugcugacgcguuuuuuc

SEQ ID NO: 3656075 - RNA, 12 nt, Salmonella enterica enterica serovar Typhi
cugaaugguucc

SEQ ID NO: 3656076 - RNA, 16 nt, Salmonella enterica enterica serovar Typhi
cugaauuaucaggguu

SEQ ID NO: 3656077 - RNA, 16 nt, Salmonella enterica enterica serovar Typhi
cugauaagguaaagcc

SEQ ID NO: 3656078 - RNA, 12 nt, Salmonella enterica enterica serovar Typhi
cugauaauaaga

SEQ ID NO: 3656079 - RNA, 20 nt, Salmonella enterica enterica serovar Typhi
cugauaccgcguuugcgcaa

SEQ ID NO: 3656080 - RNA, 20 nt, Salmonella enterica enterica serovar Typhi
cugauacgcaccagcucuac

SEQ ID NO: 3656081 - RNA, 14 nt, Salmonella enterica enterica serovar Typhi
cugauacugcuccg

SEQ ID NO: 3656082 - RNA, 23 nt, Salmonella enterica enterica serovar Typhi
cugauacuuauuacgguaucagc

SEQ ID NO: 3656083 - RNA, 16 nt, Salmonella enterica enterica serovar Typhi
cugauagcaaucaucc

SEQ ID NO: 3656084 - RNA, 17 nt, Salmonella enterica enterica serovar Typhi
cugauagcauuguaucc

SEQ ID NO: 3656085 - RNA, 21 nt, Salmonella enterica enterica serovar Typhi
cugauagcauuguauccagcc

SEQ ID NO: 3656086 - RNA, 16 nt, Salmonella enterica enterica serovar Typhi
cugauagccgccagug

SEQ ID NO: 3656087 - RNA, 14 nt, Salmonella enterica enterica serovar Typhi
cugauaguuuaaau

SEQ ID NO: 3656088 - RNA, 20 nt, Salmonella enterica enterica serovar Typhi
cugauaguuuaaauccagcg

SEQ ID NO: 3656089 - RNA, 15 nt, Salmonella enterica enterica serovar Typhi
cugauauaacccuca

SEQ ID NO: 3656090 - RNA, 20 nt, Salmonella enterica enterica serovar Typhi
cugauauuacuaauaaaauu

SEQ ID NO: 3656091 - RNA, 22 nt, Salmonella enterica enterica serovar Typhi
cugauauuacuaauaaaauuca

SEQ ID NO: 3656092 - RNA, 21 nt, Salmonella enterica enterica serovar Typhi
cugauauucccguuccagcuu

SEQ ID NO: 3656093 - RNA, 17 nt, Salmonella enterica enterica serovar Typhi
cugauauuuuacuuuuu

SEQ ID NO: 3656094 - RNA, 13 nt, Salmonella enterica enterica serovar Typhi
cugaucaaggcgc

SEQ ID NO: 3656095 - RNA, 18 nt, Salmonella enterica enterica serovar Typhi
cugaucaucggcgcgucg

SEQ ID NO: 3656096 - RNA, 17 nt, Salmonella enterica enterica serovar Typhi
cugauccagcucuucuu

SEQ ID NO: 3656097 - RNA, 17 nt, Salmonella enterica enterica serovar Typhi
cugaucccacuuaggca

SEQ ID NO: 3656098 - RNA, 20 nt, Salmonella enterica enterica serovar Typhi
cugauccggaauagagauag

SEQ ID NO: 3656099 - RNA, 23 nt, Salmonella enterica enterica serovar Typhi
cugaucgaggacggccugacggu

SEQ ID NO: 3656100 - RNA, 17 nt, Salmonella enterica enterica serovar Typhi
cugaucgauccacuucc

SEQ ID NO: 3656101 - RNA, 19 nt, Salmonella enterica enterica serovar Typhi
cugaucgccaacgaccggc

SEQ ID NO: 3656102 - RNA, 20 nt, Salmonella enterica enterica serovar Typhi
cugaucgccaacgaccggcg

SEQ ID NO: 3656103 - RNA, 16 nt, Salmonella enterica enterica serovar Typhi
cugaucgcgcagacag

SEQ ID NO: 3656104 - RNA, 22 nt, Salmonella enterica enterica serovar Typhi
cugaucgcgcagacaguggcca

SEQ ID NO: 3656105 - RNA, 13 nt, Salmonella enterica enterica serovar Typhi
cugaucggccagc

SEQ ID NO: 3656106 - RNA, 19 nt, Salmonella enterica enterica serovar Typhi
cugaucggccagcgucgcu

SEQ ID NO: 3656107 - RNA, 14 nt, Salmonella enterica enterica serovar Typhi
cugaucgugcccac

SEQ ID NO: 3656108 - RNA, 17 nt, Salmonella enterica enterica serovar Typhi
cugaucguuuuugucca

SEQ ID NO: 3656109 - RNA, 22 nt, Salmonella enterica enterica serovar Typhi
cugaucuggcugcguaaaauca

SEQ ID NO: 3656110 - RNA, 13 nt, Salmonella enterica enterica serovar Typhi
cugaugaccgccg

SEQ ID NO: 3656111 - RNA, 22 nt, Salmonella enterica enterica serovar Typhi
cugaugaccgccgucauagcag

SEQ ID NO: 3656112 - RNA, 16 nt, Salmonella enterica enterica serovar Typhi
cugaugauagcgccau

SEQ ID NO: 3656113 - RNA, 13 nt, Salmonella enterica enterica serovar Typhi
cugaugcaggcaa

SEQ ID NO: 3656114 - RNA, 22 nt, Salmonella enterica enterica serovar Typhi
cugaugccauaaaaugcugggc

SEQ ID NO: 3656115 - RNA, 22 nt, Salmonella enterica enterica serovar Typhi
cugaugcccagguuagcagcca

SEQ ID NO: 3656116 - RNA, 17 nt, Salmonella enterica enterica serovar Typhi
cugaugccugaaggcgc

SEQ ID NO: 3656117 - RNA, 19 nt, Salmonella enterica enterica serovar Typhi
cugaugccugaaggcgcua

SEQ ID NO: 3656118 - RNA, 15 nt, Salmonella enterica enterica serovar Typhi
cugaugcgaacgccc

SEQ ID NO: 3656119 - RNA, 11 nt, Salmonella enterica enterica serovar Typhi
cugaugcguau

SEQ ID NO: 3656120 - RNA, 17 nt, Salmonella enterica enterica serovar Typhi
cugaugcguauccagcg

SEQ ID NO: 3656121 - RNA, 13 nt, Salmonella enterica enterica serovar Typhi
cugaugcucgccg

SEQ ID NO: 3656122 - RNA, 13 nt, Salmonella enterica enterica serovar Typhi
cugaugcugcgca

SEQ ID NO: 3656123 - RNA, 19 nt, Salmonella enterica enterica serovar Typhi
cugaugcuggcagaaggca

SEQ ID NO: 3656124 - RNA, 13 nt, Salmonella enterica enterica serovar Typhi
cugaugcugugca

SEQ ID NO: 3656125 - RNA, 21 nt, Salmonella enterica enterica serovar Typhi
cugauggcgaaaaugguuuug

SEQ ID NO: 3656126 - RNA, 18 nt, Salmonella enterica enterica serovar Typhi
cugauggcgcuacguuua

SEQ ID NO: 3656127 - RNA, 23 nt, Salmonella enterica enterica serovar Typhi
cugauggcgcugcgcuuaucagg

SEQ ID NO: 3656128 - RNA, 17 nt, Salmonella enterica enterica serovar Typhi
cugauggcguggcgcag

SEQ ID NO: 3656129 - RNA, 17 nt, Salmonella enterica enterica serovar Typhi
cugauggcuuugcuguc

SEQ ID NO: 3656130 - RNA, 20 nt, Salmonella enterica enterica serovar Typhi
cugauggucgcucuggucga

SEQ ID NO: 3656131 - RNA, 22 nt, Salmonella enterica enterica serovar Typhi
cugaugguuucggcaugccacu

SEQ ID NO: 3656132 - RNA, 19 nt, Salmonella enterica enterica serovar Typhi
cugauguaccugcguuaaa

SEQ ID NO: 3656133 - RNA, 16 nt, Salmonella enterica enterica serovar Typhi
cugauguagcucuuca

SEQ ID NO: 3656134 - RNA, 21 nt, Salmonella enterica enterica serovar Typhi
cugauguuugcgcucuuuuuu

SEQ ID NO: 3656135 - RNA, 21 nt, Salmonella enterica enterica serovar Typhi
cugauuaaugauuugcuuuau

SEQ ID NO: 3656136 - RNA, 22 nt, Salmonella enterica enterica serovar Typhi
cugauuauucaguaccgccuuc

SEQ ID NO: 3656137 - RNA, 15 nt, Salmonella enterica enterica serovar Typhi
cugauucguuuuuac

SEQ ID NO: 3656138 - RNA, 17 nt, Salmonella enterica enterica serovar Typhi
cugauugccggaugucg

SEQ ID NO: 3656139 - RNA, 13 nt, Salmonella enterica enterica serovar Typhi
cugauugucagca

SEQ ID NO: 3656140 - RNA, 14 nt, Salmonella enterica enterica serovar Typhi
cugauugucagcag

SEQ ID NO: 3656141 - RNA, 19 nt, Salmonella enterica enterica serovar Typhi
cugauuuaaucgcuucaau

SEQ ID NO: 3656142 - RNA, 19 nt, Salmonella enterica enterica serovar Typhi
cugauuucgacgauaaaaa

SEQ ID NO: 3656143 - RNA, 17 nt, Salmonella enterica enterica serovar Typhi
cugauuucgccccacug

SEQ ID NO: 3656144 - RNA, 19 nt, Salmonella enterica enterica serovar Typhi
cugauuucgccccacuggc

SEQ ID NO: 3656145 - RNA, 13 nt, Salmonella enterica enterica serovar Typhi
cugcaaaagagga

SEQ ID NO: 3656146 - RNA, 16 nt, Salmonella enterica enterica serovar Typhi
cugcaaaauauauaau

SEQ ID NO: 3656147 - RNA, 16 nt, Salmonella enterica enterica serovar Typhi
cugcaaauacugcuuu

SEQ ID NO: 3656148 - RNA, 20 nt, Salmonella enterica enterica serovar Typhi
cugcaacagaagaguuaacu

SEQ ID NO: 3656149 - RNA, 16 nt, Salmonella enterica enterica serovar Typhi
cugcaacagcaccagc

SEQ ID NO: 3656150 - RNA, 18 nt, Salmonella enterica enterica serovar Typhi
cugcaacagcaccagcag

SEQ ID NO: 3656151 - RNA, 14 nt, Salmonella enterica enterica serovar Typhi
cugcaacgccagau

SEQ ID NO: 3656152 - RNA, 18 nt, Salmonella enterica enterica serovar Typhi
cugcaacggcgaggugcu

SEQ ID NO: 3656153 - RNA, 19 nt, Salmonella enterica enterica serovar Typhi
cugcaacuccacaaauagc

SEQ ID NO: 3656154 - RNA, 12 nt, Salmonella enterica enterica serovar Typhi
cugcaacuccug

SEQ ID NO: 3656155 - RNA, 14 nt, Salmonella enterica enterica serovar Typhi
cugcaacucuccca

SEQ ID NO: 3656156 - RNA, 20 nt, Salmonella enterica enterica serovar Typhi
cugcaagagaaauaacaccu

SEQ ID NO: 3656157 - RNA, 20 nt, Salmonella enterica enterica serovar Typhi
cugcaaugguaaaacgcugg

SEQ ID NO: 3656158 - RNA, 20 nt, Salmonella enterica enterica serovar Typhi
cugcacaacauuccgcuucc

SEQ ID NO: 3656159 - RNA, 16 nt, Salmonella enterica enterica serovar Typhi
cugcacaaucgccagc

SEQ ID NO: 3656160 - RNA, 19 nt, Salmonella enterica enterica serovar Typhi
cugcacaaucgccagcccc

SEQ ID NO: 3656161 - RNA, 12 nt, Salmonella enterica enterica serovar Typhi
cugcacaucccg

SEQ ID NO: 3656162 - RNA, 20 nt, Salmonella enterica enterica serovar Typhi
cugcacauucagguggcuga

SEQ ID NO: 3656163 - RNA, 22 nt, Salmonella enterica enterica serovar Typhi
cugcaccagaacucccuguucc

SEQ ID NO: 3656164 - RNA, 23 nt, Salmonella enterica enterica serovar Typhi
cugcaccaggagcaaaccgaccc

SEQ ID NO: 3656165 - RNA, 15 nt, Salmonella enterica enterica serovar Typhi
cugcacccaucuuua

SEQ ID NO: 3656166 - RNA, 17 nt, Salmonella enterica enterica serovar Typhi
cugcacccggagagaaa

SEQ ID NO: 3656167 - RNA, 12 nt, Salmonella enterica enterica serovar Typhi
cugcaccgccug

SEQ ID NO: 3656168 - RNA, 14 nt, Salmonella enterica enterica serovar Typhi
cugcaccucagacc

SEQ ID NO: 3656169 - RNA, 14 nt, Salmonella enterica enterica serovar Typhi
cugcaccuggucga

SEQ ID NO: 3656170 - RNA, 15 nt, Salmonella enterica enterica serovar Typhi
cugcacggcauacuc

SEQ ID NO: 3656171 - RNA, 23 nt, Salmonella enterica enterica serovar Typhi
cugcacgucgcgcucgcucauca

SEQ ID NO: 3656172 - RNA, 15 nt, Salmonella enterica enterica serovar Typhi
cugcacuaaaccaga

SEQ ID NO: 3656173 - RNA, 14 nt, Salmonella enterica enterica serovar Typhi
cugcacucggaugu

SEQ ID NO: 3656174 - RNA, 13 nt, Salmonella enterica enterica serovar Typhi
cugcacuuccagc

SEQ ID NO: 3656175 - RNA, 14 nt, Salmonella enterica enterica serovar Typhi
cugcacuuccugcg

SEQ ID NO: 3656176 - RNA, 19 nt, Salmonella enterica enterica serovar Typhi
cugcacuuuaagcggcagc

SEQ ID NO: 3656177 - RNA, 20 nt, Salmonella enterica enterica serovar Typhi
cugcagacccacuuucagcu

SEQ ID NO: 3656178 - RNA, 22 nt, Salmonella enterica enterica serovar Typhi
cugcagagcggcaaauucagcg

SEQ ID NO: 3656179 - RNA, 16 nt, Salmonella enterica enterica serovar Typhi
cugcagccauacauug

SEQ ID NO: 3656180 - RNA, 11 nt, Salmonella enterica enterica serovar Typhi
cugcaggccaa

SEQ ID NO: 3656181 - RNA, 20 nt, Salmonella enterica enterica serovar Typhi
cugcaggccaaauagaacgc

SEQ ID NO: 3656182 - RNA, 23 nt, Salmonella enterica enterica serovar Typhi
cugcaggcgggugcgcagcccca

SEQ ID NO: 3656183 - RNA, 16 nt, Salmonella enterica enterica serovar Typhi
cugcagggaauaagcg

SEQ ID NO: 3656184 - RNA, 17 nt, Salmonella enterica enterica serovar Typhi
cugcagggaauaagcgc

SEQ ID NO: 3656185 - RNA, 18 nt, Salmonella enterica enterica serovar Typhi
cugcagggauaugcugau

SEQ ID NO: 3656186 - RNA, 22 nt, Salmonella enterica enterica serovar Typhi
cugcaggguuugcgcagacugc

SEQ ID NO: 3656187 - RNA, 14 nt, Salmonella enterica enterica serovar Typhi
cugcaggucacgau

SEQ ID NO: 3656188 - RNA, 15 nt, Salmonella enterica enterica serovar Typhi
cugcauaauccaacg

SEQ ID NO: 3656189 - RNA, 12 nt, Salmonella enterica enterica serovar Typhi
cugcauauuuuu

SEQ ID NO: 3656190 - RNA, 16 nt, Salmonella enterica enterica serovar Typhi
cugcaucaccucagaa

SEQ ID NO: 3656191 - RNA, 21 nt, Salmonella enterica enterica serovar Typhi
cugcaucugcggucuccugaa

SEQ ID NO: 3656192 - RNA, 16 nt, Salmonella enterica enterica serovar Typhi
cugcaucuuacugacc

SEQ ID NO: 3656193 - RNA, 17 nt, Salmonella enterica enterica serovar Typhi
cugcauuacauucauaa

SEQ ID NO: 3656194 - RNA, 20 nt, Salmonella enterica enterica serovar Typhi
cugcauuauccacgaucccg

SEQ ID NO: 3656195 - RNA, 20 nt, Salmonella enterica enterica serovar Typhi
cugcauucaggccucugcuu

SEQ ID NO: 3656196 - RNA, 23 nt, Salmonella enterica enterica serovar Typhi
cugcauucuuucaauaauggcgc

SEQ ID NO: 3656197 - RNA, 22 nt, Salmonella enterica enterica serovar Typhi
cugcauuguuccugcuggcaaa

SEQ ID NO: 3656198 - RNA, 15 nt, Salmonella enterica enterica serovar Typhi
cugcauuugcugccg

SEQ ID NO: 3656199 - RNA, 16 nt, Salmonella enterica enterica serovar Typhi
cugccaacauggggag

SEQ ID NO: 3656200 - RNA, 22 nt, Salmonella enterica enterica serovar Typhi
cugccaaccggccccaucgccg

SEQ ID NO: 3656201 - RNA, 23 nt, Salmonella enterica enterica serovar Typhi
cugccacaacggcaauuuuuaca

SEQ ID NO: 3656202 - RNA, 17 nt, Salmonella enterica enterica serovar Typhi
cugccacacucucucca

SEQ ID NO: 3656203 - RNA, 14 nt, Salmonella enterica enterica serovar Typhi
cugccacaucgcca

SEQ ID NO: 3656204 - RNA, 16 nt, Salmonella enterica enterica serovar Typhi
cugccaccgucgcggc

SEQ ID NO: 3656205 - RNA, 22 nt, Salmonella enterica enterica serovar Typhi
cugccacgcuuuuccuuccagc

SEQ ID NO: 3656206 - RNA, 20 nt, Salmonella enterica enterica serovar Typhi
cugccagaacgcuguugccg

SEQ ID NO: 3656207 - RNA, 15 nt, Salmonella enterica enterica serovar Typhi
cugccagaccggcga

SEQ ID NO: 3656208 - RNA, 20 nt, Salmonella enterica enterica serovar Typhi
cugccagcaacggcgggaua

SEQ ID NO: 3656209 - RNA, 22 nt, Salmonella enterica enterica serovar Typhi
cugccagcagaagacggaaacc

SEQ ID NO: 3656210 - RNA, 13 nt, Salmonella enterica enterica serovar Typhi
cugccagccgcuc

SEQ ID NO: 3656211 - RNA, 15 nt, Salmonella enterica enterica serovar Typhi
cugccagcgaaccgc

SEQ ID NO: 3656212 - RNA, 19 nt, Salmonella enterica enterica serovar Typhi
cugccagggugcaaagaaa

SEQ ID NO: 3656213 - RNA, 18 nt, Salmonella enterica enterica serovar Typhi
cugccaguccgcccgccu

SEQ ID NO: 3656214 - RNA, 16 nt, Salmonella enterica enterica serovar Typhi
cugccagucugcccgg

SEQ ID NO: 3656215 - RNA, 18 nt, Salmonella enterica enterica serovar Typhi
cugccauagcaucaccag

SEQ ID NO: 3656216 - RNA, 12 nt, Salmonella enterica enterica serovar Typhi
cugccaucaucc

SEQ ID NO: 3656217 - RNA, 13 nt, Salmonella enterica enterica serovar Typhi
cugccaucaucca

SEQ ID NO: 3656218 - RNA, 20 nt, Salmonella enterica enterica serovar Typhi
cugccaucgcuucuacagcc

SEQ ID NO: 3656219 - RNA, 15 nt, Salmonella enterica enterica serovar Typhi
cugccaugccugaug

SEQ ID NO: 3656220 - RNA, 19 nt, Salmonella enterica enterica serovar Typhi
cugccaugccuuugacucu

SEQ ID NO: 3656221 - RNA, 16 nt, Salmonella enterica enterica serovar Typhi
cugccauuaucaccau

SEQ ID NO: 3656222 - RNA, 17 nt, Salmonella enterica enterica serovar Typhi
cugccauuaucaccauu

SEQ ID NO: 3656223 - RNA, 23 nt, Salmonella enterica enterica serovar Typhi
cugccauuaucaccauucccagc

SEQ ID NO: 3656224 - RNA, 13 nt, Salmonella enterica enterica serovar Typhi
cugccauucccag

SEQ ID NO: 3656225 - RNA, 13 nt, Salmonella enterica enterica serovar Typhi
cugcccacccggg

SEQ ID NO: 3656226 - RNA, 16 nt, Salmonella enterica enterica serovar Typhi
cugcccacccgggccg

SEQ ID NO: 3656227 - RNA, 14 nt, Salmonella enterica enterica serovar Typhi
cugccccggcgccu

SEQ ID NO: 3656228 - RNA, 18 nt, Salmonella enterica enterica serovar Typhi
cugccccggugagcgccg

SEQ ID NO: 3656229 - RNA, 13 nt, Salmonella enterica enterica serovar Typhi
cugcccgccaggg

SEQ ID NO: 3656230 - RNA, 11 nt, Salmonella enterica enterica serovar Typhi
cugcccgccgc

SEQ ID NO: 3656231 - RNA, 13 nt, Salmonella enterica enterica serovar Typhi
cugcccgccgccg

SEQ ID NO: 3656232 - RNA, 16 nt, Salmonella enterica enterica serovar Typhi
cugcccggcaaccuga

SEQ ID NO: 3656233 - RNA, 14 nt, Salmonella enterica enterica serovar Typhi
cugcccguuacgca

SEQ ID NO: 3656234 - RNA, 19 nt, Salmonella enterica enterica serovar Typhi
cugcccugcggcaggcaaa

SEQ ID NO: 3656235 - RNA, 17 nt, Salmonella enterica enterica serovar Typhi
cugcccuggugagcucc

SEQ ID NO: 3656236 - RNA, 21 nt, Salmonella enterica enterica serovar Typhi
cugcccuggugagcuccagcc

SEQ ID NO: 3656237 - RNA, 23 nt, Salmonella enterica enterica serovar Typhi
cugcccuguucggcgcggaaggu

SEQ ID NO: 3656238 - RNA, 18 nt, Salmonella enterica enterica serovar Typhi
cugcccuuucagagcguc

SEQ ID NO: 3656239 - RNA, 17 nt, Salmonella enterica enterica serovar Typhi
cugcccuuuuagcacuu

SEQ ID NO: 3656240 - RNA, 19 nt, Salmonella enterica enterica serovar Typhi
cugccgacaaagagcuccc

SEQ ID NO: 3656241 - RNA, 12 nt, Salmonella enterica enterica serovar Typhi
cugccgacaacg

SEQ ID NO: 3656242 - RNA, 23 nt, Salmonella enterica enterica serovar Typhi
cugccgacaagguugaucaggaa

SEQ ID NO: 3656243 - RNA, 14 nt, Salmonella enterica enterica serovar Typhi
cugccgacaggcag

SEQ ID NO: 3656244 - RNA, 15 nt, Salmonella enterica enterica serovar Typhi
cugccgauacguccc

SEQ ID NO: 3656245 - RNA, 23 nt, Salmonella enterica enterica serovar Typhi
cugccgauuuugaacaugcgcag

SEQ ID NO: 3656246 - RNA, 14 nt, Salmonella enterica enterica serovar Typhi
cugccgcaaacgcc

SEQ ID NO: 3656247 - RNA, 17 nt, Salmonella enterica enterica serovar Typhi
cugccgcaaacgccugc

SEQ ID NO: 3656248 - RNA, 17 nt, Salmonella enterica enterica serovar Typhi
cugcuuagcucaucagc

SEQ ID NO: 3656249 - RNA, 21 nt, Salmonella enterica enterica serovar Typhi
cugcuuaucgauaucugccug

SEQ ID NO: 3656250 - RNA, 20 nt, Salmonella enterica enterica serovar Typhi
cugcuuaugaucgcccagcc

SEQ ID NO: 3656251 - RNA, 14 nt, Salmonella enterica enterica serovar Typhi
cugcuucaccgcgc

SEQ ID NO: 3656252 - RNA, 13 nt, Salmonella enterica enterica serovar Typhi
cugcuucuggcuu

SEQ ID NO: 3656253 - RNA, 16 nt, Salmonella enterica enterica serovar Typhi
cugcuugccugugccc

SEQ ID NO: 3656254 - RNA, 20 nt, Salmonella enterica enterica serovar Typhi
cugcuuguuuaauggcagaa

SEQ ID NO: 3656255 - RNA, 19 nt, Salmonella enterica enterica serovar Typhi
cugcuuucuuacaccucgc

SEQ ID NO: 3656256 - RNA, 16 nt, Salmonella enterica enterica serovar Typhi
cugcuuuuccggcagc

SEQ ID NO: 3656257 - RNA, 15 nt, Salmonella enterica enterica serovar Typhi
cugcuuuuugauaca

SEQ ID NO: 3656258 - RNA, 23 nt, Salmonella enterica enterica serovar Typhi
cugcuuuuugauacagcagcacc

SEQ ID NO: 3656259 - RNA, 17 nt, Salmonella enterica enterica serovar Typhi
cuggaaaauuucaguga

SEQ ID NO: 3656260 - RNA, 20 nt, Salmonella enterica enterica serovar Typhi
cuggaaaauuucagugaaaa

SEQ ID NO: 3656261 - RNA, 16 nt, Salmonella enterica enterica serovar Typhi
cuggaacaaaccgacu

SEQ ID NO: 3656262 - RNA, 17 nt, Salmonella enterica enterica serovar Typhi
cuggaacagauguuuac

SEQ ID NO: 3656263 - RNA, 18 nt, Salmonella enterica enterica serovar Typhi
cuggaacaggccaaaccc

SEQ ID NO: 3656264 - RNA, 22 nt, Salmonella enterica enterica serovar Typhi
cuggaagaaaucguugccuuug

SEQ ID NO: 3656265 - RNA, 15 nt, Salmonella enterica enterica serovar Typhi
cuggaagaacuggau

SEQ ID NO: 3656266 - RNA, 14 nt, Salmonella enterica enterica serovar Typhi
cuggaagccuucaa

SEQ ID NO: 3656267 - RNA, 20 nt, Salmonella enterica enterica serovar Typhi
cuggaagcgaucaagacaaa

SEQ ID NO: 3656268 - RNA, 15 nt, Salmonella enterica enterica serovar Typhi
cuggaauuuuuccag

SEQ ID NO: 3656269 - RNA, 22 nt, Salmonella enterica enterica serovar Typhi
cuggaauuuuuccagcucagaa

SEQ ID NO: 3656270 - RNA, 19 nt, Salmonella enterica enterica serovar Typhi
cuggacaaagcguuugccg

SEQ ID NO: 3656271 - RNA, 18 nt, Salmonella enterica enterica serovar Typhi
cuggacaugauaauaauu

SEQ ID NO: 3656272 - RNA, 16 nt, Salmonella enterica enterica serovar Typhi
cuggacauguccgacg

SEQ ID NO: 3656273 - RNA, 21 nt, Salmonella enterica enterica serovar Typhi
cuggaccccagauaauagcug

SEQ ID NO: 3656274 - RNA, 14 nt, Salmonella enterica enterica serovar Typhi
cuggagcaggaaau

SEQ ID NO: 3656275 - RNA, 16 nt, Salmonella enterica enterica serovar Typhi
cuggagggguuucccc

SEQ ID NO: 3656276 - RNA, 20 nt, Salmonella enterica enterica serovar Typhi
cuggagguuauccugaaagg

SEQ ID NO: 3656277 - RNA, 20 nt, Salmonella enterica enterica serovar Typhi
cuggagugacuaaaagacgc

SEQ ID NO: 3656278 - RNA, 23 nt, Salmonella enterica enterica serovar Typhi
cuggagugacuaaaagacgccau

SEQ ID NO: 3656279 - RNA, 21 nt, Salmonella enterica enterica serovar Typhi
cuggaguuuaaacacucucca

SEQ ID NO: 3656280 - RNA, 20 nt, Salmonella enterica enterica serovar Typhi
cuggauaauaagacgccagu

SEQ ID NO: 3656281 - RNA, 17 nt, Salmonella enterica enterica serovar Typhi
cuggauaccgcgccagc

SEQ ID NO: 3656282 - RNA, 19 nt, Salmonella enterica enterica serovar Typhi
cuggauaccgcgccagcga

SEQ ID NO: 3656283 - RNA, 19 nt, Salmonella enterica enterica serovar Typhi
cuggauagcaccauaaacg

SEQ ID NO: 3656284 - RNA, 23 nt, Salmonella enterica enterica serovar Typhi
cuggauagcaccauaaacggcac

SEQ ID NO: 3656285 - RNA, 16 nt, Salmonella enterica enterica serovar Typhi
cuggauagucuucaag

SEQ ID NO: 3656286 - RNA, 23 nt, Salmonella enterica enterica serovar Typhi
cuggaucaccugaaugcaaagaa

SEQ ID NO: 3656287 - RNA, 16 nt, Salmonella enterica enterica serovar Typhi
cuggaucagauucccc

SEQ ID NO: 3656288 - RNA, 18 nt, Salmonella enterica enterica serovar Typhi
cuggaucauacauaaccg

SEQ ID NO: 3656289 - RNA, 22 nt, Salmonella enterica enterica serovar Typhi
cuggaucgugcggcgaagcauc

SEQ ID NO: 3656290 - RNA, 15 nt, Salmonella enterica enterica serovar Typhi
cuggaugcugccugc

SEQ ID NO: 3656291 - RNA, 17 nt, Salmonella enterica enterica serovar Typhi
cuggauggacuguuucg

SEQ ID NO: 3656292 - RNA, 18 nt, Salmonella enterica enterica serovar Typhi
cuggauuacaaaaauaga

SEQ ID NO: 3656293 - RNA, 13 nt, Salmonella enterica enterica serovar Typhi
cuggauuccucca

SEQ ID NO: 3656294 - RNA, 23 nt, Salmonella enterica enterica serovar Typhi
cuggauucucucccaggcauccu

SEQ ID NO: 3656295 - RNA, 17 nt, Salmonella enterica enterica serovar Typhi
cuggcaaaacgcaucca

SEQ ID NO: 3656296 - RNA, 18 nt, Salmonella enterica enterica serovar Typhi
cuggcaacaugaccagcg

SEQ ID NO: 3656297 - RNA, 22 nt, Salmonella enterica enterica serovar Typhi
cuggcaagaccgauagagacug

SEQ ID NO: 3656298 - RNA, 14 nt, Salmonella enterica enterica serovar Typhi
cuggcaagcgccag

SEQ ID NO: 3656299 - RNA, 21 nt, Salmonella enterica enterica serovar Typhi
cuggcaagcgccagcauggcg

SEQ ID NO: 3656300 - RNA, 19 nt, Salmonella enterica enterica serovar Typhi
cuggcaauaaagcagggcg

SEQ ID NO: 3656301 - RNA, 15 nt, Salmonella enterica enterica serovar Typhi
cuggcagaaggcaug

SEQ ID NO: 3656302 - RNA, 16 nt, Salmonella enterica enterica serovar Typhi
cuggcagaugaacaua

SEQ ID NO: 3656303 - RNA, 23 nt, Salmonella enterica enterica serovar Typhi
cuggcagcagugacauuuaucuu

SEQ ID NO: 3656304 - RNA, 22 nt, Salmonella enterica enterica serovar Typhi
cuggcagccucguccugcaauu

SEQ ID NO: 3656305 - RNA, 18 nt, Salmonella enterica enterica serovar Typhi
cuggcagcgccugacggc

SEQ ID NO: 3656306 - RNA, 19 nt, Salmonella enterica enterica serovar Typhi
cuggcagcgccugacggcg

SEQ ID NO: 3656307 - RNA, 16 nt, Salmonella enterica enterica serovar Typhi
cuggcagcggcaguaa

SEQ ID NO: 3656308 - RNA, 14 nt, Salmonella enterica enterica serovar Typhi
cuggcaguucaucu

SEQ ID NO: 3656309 - RNA, 23 nt, Salmonella enterica enterica serovar Typhi
cuggcaguucaucuucccgcaga

SEQ ID NO: 3656310 - RNA, 19 nt, Salmonella enterica enterica serovar Typhi
cuggcauaaccgcagcgcg

SEQ ID NO: 3656311 - RNA, 17 nt, Salmonella enterica enterica serovar Typhi
cuggcauggugcagccg

SEQ ID NO: 3656312 - RNA, 19 nt, Salmonella enterica enterica serovar Typhi
cuggcauuacgcuggcccc

SEQ ID NO: 3656313 - RNA, 13 nt, Salmonella enterica enterica serovar Typhi
cuggccacgccga

SEQ ID NO: 3656314 - RNA, 23 nt, Salmonella enterica enterica serovar Typhi
cuggccaggcauugauaaagcgc

SEQ ID NO: 3656315 - RNA, 23 nt, Salmonella enterica enterica serovar Typhi
cuggccaguucgucuuccggaua

SEQ ID NO: 3656316 - RNA, 21 nt, Salmonella enterica enterica serovar Typhi
cuggccaguuucaaugcccag

SEQ ID NO: 3656317 - RNA, 20 nt, Salmonella enterica enterica serovar Typhi
cuggcccccuguuccagggc

SEQ ID NO: 3656318 - RNA, 22 nt, Salmonella enterica enterica serovar Typhi
cuggccccgcauuuuaccucac

SEQ ID NO: 3656319 - RNA, 23 nt, Salmonella enterica enterica serovar Typhi
cuggccggaaaggauauaagcgc

SEQ ID NO: 3656320 - RNA, 19 nt, Salmonella enterica enterica serovar Typhi
cuggccguuuucccggcaa

SEQ ID NO: 3656321 - RNA, 20 nt, Salmonella enterica enterica serovar Typhi
cuggccguuuucccggcaau

SEQ ID NO: 3656322 - RNA, 20 nt, Salmonella enterica enterica serovar Typhi
cuggccuacggaaagcuguu

SEQ ID NO: 3656323 - RNA, 18 nt, Salmonella enterica enterica serovar Typhi
cuggccugcagaccuaua

SEQ ID NO: 3656324 - RNA, 21 nt, Salmonella enterica enterica serovar Typhi
cuggcgaaagcgaccggcacu

SEQ ID NO: 3656325 - RNA, 17 nt, Salmonella enterica enterica serovar Typhi
cuggcgaaccaccagcc

SEQ ID NO: 3656326 - RNA, 22 nt, Salmonella enterica enterica serovar Typhi
cuggcgaauaaaauucagcgca

SEQ ID NO: 3656327 - RNA, 15 nt, Salmonella enterica enterica serovar Typhi
cuggcgaauccggga

SEQ ID NO: 3656328 - RNA, 19 nt, Salmonella enterica enterica serovar Typhi
cuggcgaccagccugccgu

SEQ ID NO: 3656329 - RNA, 18 nt, Salmonella enterica enterica serovar Typhi
cuggcgagaaaguggugg

SEQ ID NO: 3656330 - RNA, 18 nt, Salmonella enterica enterica serovar Typhi
cuggcgagaauagaagcc

SEQ ID NO: 3656331 - RNA, 19 nt, Salmonella enterica enterica serovar Typhi
cuggcgaucguucgauagu

SEQ ID NO: 3656332 - RNA, 21 nt, Salmonella enterica enterica serovar Typhi
cuggcgaugugcccgagugac

SEQ ID NO: 3656333 - RNA, 15 nt, Salmonella enterica enterica serovar Typhi
cugguaggccugaua

SEQ ID NO: 3656334 - RNA, 18 nt, Salmonella enterica enterica serovar Typhi
cugguauaggccaggcua

SEQ ID NO: 3656335 - RNA, 15 nt, Salmonella enterica enterica serovar Typhi
cugguauugaauauu

SEQ ID NO: 3656336 - RNA, 17 nt, Salmonella enterica enterica serovar Typhi
cuggucaaguauuucug

SEQ ID NO: 3656337 - RNA, 15 nt, Salmonella enterica enterica serovar Typhi
cuggucagcgcgcca

SEQ ID NO: 3656338 - RNA, 17 nt, Salmonella enterica enterica serovar Typhi
cuggucaggugauugcc

SEQ ID NO: 3656339 - RNA, 18 nt, Salmonella enterica enterica serovar Typhi
cuggucauaacgcuuugu

SEQ ID NO: 3656340 - RNA, 22 nt, Salmonella enterica enterica serovar Typhi
cuggucgcgguuuacuucuuca

SEQ ID NO: 3656341 - RNA, 16 nt, Salmonella enterica enterica serovar Typhi
cuggucgucugaaagc

SEQ ID NO: 3656342 - RNA, 18 nt, Salmonella enterica enterica serovar Typhi
cuggucugaaucugcucc

SEQ ID NO: 3656343 - RNA, 18 nt, Salmonella enterica enterica serovar Typhi
cuggugaagacgcugcaa

SEQ ID NO: 3656344 - RNA, 20 nt, Salmonella enterica enterica serovar Typhi
cuggugagguuucagcaccu

SEQ ID NO: 3656345 - RNA, 23 nt, Salmonella enterica enterica serovar Typhi
cuggugcagcaagcggcugucau

SEQ ID NO: 3656346 - RNA, 18 nt, Salmonella enterica enterica serovar Typhi
cuggugccaaucuccagc

SEQ ID NO: 3656347 - RNA, 12 nt, Salmonella enterica enterica serovar Typhi
cuggugcccggu

SEQ ID NO: 3656348 - RNA, 15 nt, Salmonella enterica enterica serovar Typhi
cuggugcgaauaagc

SEQ ID NO: 3656349 - RNA, 17 nt, Salmonella enterica enterica serovar Typhi
cuggugcgaauaagcuc

SEQ ID NO: 3656350 - RNA, 19 nt, Salmonella enterica enterica serovar Typhi
cuggugcgacaccacgcag

SEQ ID NO: 3656351 - RNA, 22 nt, Salmonella enterica enterica serovar Typhi
cuggugcgacaccacgcaggcg

SEQ ID NO: 3656352 - RNA, 19 nt, Salmonella enterica enterica serovar Typhi
cugguggcgagauaagccg

SEQ ID NO: 3656353 - RNA, 22 nt, Salmonella enterica enterica serovar Typhi
cugguggucuaugguacacaua

SEQ ID NO: 3656354 - RNA, 20 nt, Salmonella enterica enterica serovar Typhi
cugguggugccgacgccagc

SEQ ID NO: 3656355 - RNA, 16 nt, Salmonella enterica enterica serovar Typhi
cugguggugggcggca

SEQ ID NO: 3656356 - RNA, 14 nt, Salmonella enterica enterica serovar Typhi
cuggugucuuuuuc

SEQ ID NO: 3656357 - RNA, 18 nt, Salmonella enterica enterica serovar Typhi
cuggugugguuauuucug

SEQ ID NO: 3656358 - RNA, 15 nt, Salmonella enterica enterica serovar Typhi
cugguuaauaauuuu

SEQ ID NO: 3656359 - RNA, 22 nt, Salmonella enterica enterica serovar Typhi
cugguuaaugccuucgccgccg

SEQ ID NO: 3656360 - RNA, 21 nt, Salmonella enterica enterica serovar Typhi
cugguuauccaccagcgccau

SEQ ID NO: 3656361 - RNA, 14 nt, Salmonella enterica enterica serovar Typhi
cugguucgaaucca

SEQ ID NO: 3656362 - RNA, 17 nt, Salmonella enterica enterica serovar Typhi
cugguucgaauccaggu

SEQ ID NO: 3656363 - RNA, 14 nt, Salmonella enterica enterica serovar Typhi
cugguugaccggaa

SEQ ID NO: 3656364 - RNA, 16 nt, Salmonella enterica enterica serovar Typhi
cugguugcagcgccag

SEQ ID NO: 3656365 - RNA, 14 nt, Salmonella enterica enterica serovar Typhi
cugguuggcgcgcu

SEQ ID NO: 3656366 - RNA, 15 nt, Salmonella enterica enterica serovar Typhi
cugguuguuucuuaa

SEQ ID NO: 3656367 - RNA, 16 nt, Salmonella enterica enterica serovar Typhi
cugguuucccugccuc

SEQ ID NO: 3656368 - RNA, 21 nt, Salmonella enterica enterica serovar Typhi
cugguuucggcaucccaggcg

SEQ ID NO: 3656369 - RNA, 22 nt, Salmonella enterica enterica serovar Typhi
cugguuucuccggccagucugg

SEQ ID NO: 3656370 - RNA, 23 nt, Salmonella enterica enterica serovar Typhi
cuguaaaagggauacgguuuuuu

SEQ ID NO: 3656371 - RNA, 20 nt, Salmonella enterica enterica serovar Typhi
cuguaaacgcuucugcgccg

SEQ ID NO: 3656372 - RNA, 17 nt, Salmonella enterica enterica serovar Typhi
cuguaaacguuccugcc

SEQ ID NO: 3656373 - RNA, 20 nt, Salmonella enterica enterica serovar Typhi
cuguaaacguuccugccagc

SEQ ID NO: 3656374 - RNA, 23 nt, Salmonella enterica enterica serovar Typhi
cuguaaaucgcgcccgacauggc

SEQ ID NO: 3656375 - RNA, 18 nt, Salmonella enterica enterica serovar Typhi
cuguaacaacuguuuuuc

SEQ ID NO: 3656376 - RNA, 15 nt, Salmonella enterica enterica serovar Typhi
cuguaacacacuggu

SEQ ID NO: 3656377 - RNA, 14 nt, Salmonella enterica enterica serovar Typhi
cuguaacacugccg

SEQ ID NO: 3656378 - RNA, 20 nt, Salmonella enterica enterica serovar Typhi
cuguaaccccagcaucugca

SEQ ID NO: 3656379 - RNA, 16 nt, Salmonella enterica enterica serovar Typhi
cuguaaccgcuaucau

SEQ ID NO: 3656380 - RNA, 17 nt, Salmonella enterica enterica serovar Typhi
cuguaacuucacgccau

SEQ ID NO: 3656381 - RNA, 20 nt, Salmonella enterica enterica serovar Typhi
cuguaacuucggccagcgag

SEQ ID NO: 3656382 - RNA, 14 nt, Salmonella enterica enterica serovar Typhi
cuguaauacgcugu

SEQ ID NO: 3656383 - RNA, 22 nt, Salmonella enterica enterica serovar Typhi
cuguaauggcgcucuuuuccag

SEQ ID NO: 3656384 - RNA, 17 nt, Salmonella enterica enterica serovar Typhi
cuguaaugucuggugca

SEQ ID NO: 3656385 - RNA, 23 nt, Salmonella enterica enterica serovar Typhi
cuguaauucucccaaauuuuuuu

SEQ ID NO: 3656386 - RNA, 13 nt, Salmonella enterica enterica serovar Typhi
cuguaauuuauaa

SEQ ID NO: 3656387 - RNA, 16 nt, Salmonella enterica enterica serovar Typhi
cuguaccaccacgccc

SEQ ID NO: 3656388 - RNA, 12 nt, Salmonella enterica enterica serovar Typhi
cuguaccaccag

SEQ ID NO: 3656389 - RNA, 21 nt, Salmonella enterica enterica serovar Typhi
cuguaccaccagaaucgccag

SEQ ID NO: 3656390 - RNA, 22 nt, Salmonella enterica enterica serovar Typhi
cuguaccaccagaaucgccagc

SEQ ID NO: 3656391 - RNA, 19 nt, Salmonella enterica enterica serovar Typhi
cuguaccagacgcgaacgu

SEQ ID NO: 3656392 - RNA, 15 nt, Salmonella enterica enterica serovar Typhi
cuguaccaggacgca

SEQ ID NO: 3656393 - RNA, 22 nt, Salmonella enterica enterica serovar Typhi
cuguaccugauggacaauccgc

SEQ ID NO: 3656394 - RNA, 16 nt, Salmonella enterica enterica serovar Typhi
cuguaccuuaaccggg

SEQ ID NO: 3656395 - RNA, 21 nt, Salmonella enterica enterica serovar Typhi
cuguacgccacggcuuaaauc

SEQ ID NO: 3656396 - RNA, 16 nt, Salmonella enterica enterica serovar Typhi
cuguacggaauaagcg

SEQ ID NO: 3656397 - RNA, 18 nt, Salmonella enterica enterica serovar Typhi
cuguagauaccuacuuua

SEQ ID NO: 3656398 - RNA, 23 nt, Salmonella enterica enterica serovar Typhi
cuguagauagcuauccacgcaga

SEQ ID NO: 3656399 - RNA, 16 nt, Salmonella enterica enterica serovar Typhi
cuguagcagcgccagc

SEQ ID NO: 3656400 - RNA, 14 nt, Salmonella enterica enterica serovar Typhi
cuguagccagccug

SEQ ID NO: 3656401 - RNA, 20 nt, Salmonella enterica enterica serovar Typhi
cuguagcgcuuuggagguca

SEQ ID NO: 3656402 - RNA, 20 nt, Salmonella enterica enterica serovar Typhi
cuguagcgucucaucaaaaa

SEQ ID NO: 3656403 - RNA, 15 nt, Salmonella enterica enterica serovar Typhi
cuguauaaaauauuu

SEQ ID NO: 3656404 - RNA, 15 nt, Salmonella enterica enterica serovar Typhi
cuguauaaauaaccg

SEQ ID NO: 3656405 - RNA, 16 nt, Salmonella enterica enterica serovar Typhi
cuguauacacuuucca

SEQ ID NO: 3656406 - RNA, 15 nt, Salmonella enterica enterica serovar Typhi
cuguaucaaaccaac

SEQ ID NO: 3656407 - RNA, 21 nt, Salmonella enterica enterica serovar Typhi
cuguaucuucgccguauucuu

SEQ ID NO: 3656408 - RNA, 17 nt, Salmonella enterica enterica serovar Typhi
cuguauucgguggaaac

SEQ ID NO: 3656409 - RNA, 14 nt, Salmonella enterica enterica serovar Typhi
cugucaaaaauaac

SEQ ID NO: 3656410 - RNA, 18 nt, Salmonella enterica enterica serovar Typhi
cugucaaaacccagccca

SEQ ID NO: 3656411 - RNA, 16 nt, Salmonella enterica enterica serovar Typhi
cugucaucaaugagcg

SEQ ID NO: 3656412 - RNA, 12 nt, Salmonella enterica enterica serovar Typhi
cugucaucauca

SEQ ID NO: 3656413 - RNA, 21 nt, Salmonella enterica enterica serovar Typhi
cugucaucaucaaguaccgug

SEQ ID NO: 3656414 - RNA, 18 nt, Salmonella enterica enterica serovar Typhi
cuguccaugacgaccaca

SEQ ID NO: 3656415 - RNA, 17 nt, Salmonella enterica enterica serovar Typhi
cugucccagccuuccug

SEQ ID NO: 3656416 - RNA, 19 nt, Salmonella enterica enterica serovar Typhi
cugucccagccuuccuggu

SEQ ID NO: 3656417 - RNA, 16 nt, Salmonella enterica enterica serovar Typhi
cugucccugccagcgu

SEQ ID NO: 3656418 - RNA, 20 nt, Salmonella enterica enterica serovar Typhi
cuguugccuuugcgcgcgau

SEQ ID NO: 3656419 - RNA, 18 nt, Salmonella enterica enterica serovar Typhi
cuguugcgcauucaggcg

SEQ ID NO: 3656420 - RNA, 14 nt, Salmonella enterica enterica serovar Typhi
cuguugcugugcau

SEQ ID NO: 3656421 - RNA, 19 nt, Salmonella enterica enterica serovar Typhi
cuguuggacugucuuguuu

SEQ ID NO: 3656422 - RNA, 19 nt, Salmonella enterica enterica serovar Typhi
cuguuuaagcgccuccaca

SEQ ID NO: 3656423 - RNA, 21 nt, Salmonella enterica enterica serovar Typhi
cuguuuaagcgccuccacaaa

SEQ ID NO: 3656424 - RNA, 17 nt, Salmonella enterica enterica serovar Typhi
cuguuuaagcuuuuucu

SEQ ID NO: 3656425 - RNA, 22 nt, Salmonella enterica enterica serovar Typhi
cuguuuaaugcuuucaauacuc

SEQ ID NO: 3656426 - RNA, 19 nt, Salmonella enterica enterica serovar Typhi
cuguuuacccacuucuucc

SEQ ID NO: 3656427 - RNA, 16 nt, Salmonella enterica enterica serovar Typhi
cuguuucaacgcaucc

SEQ ID NO: 3656428 - RNA, 14 nt, Salmonella enterica enterica serovar Typhi
cuguuuccaguuac

SEQ ID NO: 3656429 - RNA, 16 nt, Salmonella enterica enterica serovar Typhi
cuguuuccaguuaccg

SEQ ID NO: 3656430 - RNA, 23 nt, Salmonella enterica enterica serovar Typhi
cuguuucuccguuguugcaccac

SEQ ID NO: 3656431 - RNA, 21 nt, Salmonella enterica enterica serovar Typhi
cuguuucugauagcccuauuc

SEQ ID NO: 3656432 - RNA, 22 nt, Salmonella enterica enterica serovar Typhi
cuguuugcugacaaucugcugg

SEQ ID NO: 3656433 - RNA, 13 nt, Salmonella enterica enterica serovar Typhi
cuguuuuaauucc

SEQ ID NO: 3656434 - RNA, 15 nt, Salmonella enterica enterica serovar Typhi
cuguuuucacucuuu

SEQ ID NO: 3656435 - RNA, 13 nt, Salmonella enterica enterica serovar Typhi
cuuaaaaaauccu

SEQ ID NO: 3656436 - RNA, 19 nt, Salmonella enterica enterica serovar Typhi
cuuaaaagggaguauuuac

SEQ ID NO: 3656437 - RNA, 14 nt, Salmonella enterica enterica serovar Typhi
cuuaaaauugaauu

SEQ ID NO: 3656438 - RNA, 20 nt, Salmonella enterica enterica serovar Typhi
cuuaaacagcgaucacgccg

SEQ ID NO: 3656439 - RNA, 16 nt, Salmonella enterica enterica serovar Typhi
cuuaaacaguauuuau

SEQ ID NO: 3656440 - RNA, 21 nt, Salmonella enterica enterica serovar Typhi
cuuaaacaucgcccuccagcu

SEQ ID NO: 3656441 - RNA, 13 nt, Salmonella enterica enterica serovar Typhi
cuuaaacgccgga

SEQ ID NO: 3656442 - RNA, 21 nt, Salmonella enterica enterica serovar Typhi
cuuaaacgccggauuccagaa

SEQ ID NO: 3656443 - RNA, 13 nt, Salmonella enterica enterica serovar Typhi
cuuaaauaugaaa

SEQ ID NO: 3656444 - RNA, 21 nt, Salmonella enterica enterica serovar Typhi
cuuaaauggcgcuguaaggca

SEQ ID NO: 3656445 - RNA, 18 nt, Salmonella enterica enterica serovar Typhi
cuuaaauuaaugauuaaa

SEQ ID NO: 3656446 - RNA, 13 nt, Salmonella enterica enterica serovar Typhi
cuuaaauuuuuaa

SEQ ID NO: 3656447 - RNA, 14 nt, Salmonella enterica enterica serovar Typhi
cuuaacccacaaga

SEQ ID NO: 3656448 - RNA, 20 nt, Salmonella enterica enterica serovar Typhi
cuuaacccugccguuugcgc

SEQ ID NO: 3656449 - RNA, 21 nt, Salmonella enterica enterica serovar Typhi
cuuaaccgggaucgggacaug

SEQ ID NO: 3656450 - RNA, 16 nt, Salmonella enterica enterica serovar Typhi
cuuaacgauaacguca

SEQ ID NO: 3656451 - RNA, 21 nt, Salmonella enterica enterica serovar Typhi
cuuaacgcucucaucgacgau

SEQ ID NO: 3656452 - RNA, 20 nt, Salmonella enterica enterica serovar Typhi
cuuaacggcccaggcaucga

SEQ ID NO: 3656453 - RNA, 18 nt, Salmonella enterica enterica serovar Typhi
cuuaagaauguccaucuc

SEQ ID NO: 3656454 - RNA, 16 nt, Salmonella enterica enterica serovar Typhi
cuuaagggccauguuu

SEQ ID NO: 3656455 - RNA, 13 nt, Salmonella enterica enterica serovar Typhi
cuuaauaacagcg

SEQ ID NO: 3656456 - RNA, 18 nt, Salmonella enterica enterica serovar Typhi
cuuaauacccauuucuuc

SEQ ID NO: 3656457 - RNA, 21 nt, Salmonella enterica enterica serovar Typhi
cuuaauacccauuucuucuuc

SEQ ID NO: 3656458 - RNA, 23 nt, Salmonella enterica enterica serovar Typhi
cuuaauacccauuucuucuucaa

SEQ ID NO: 3656459 - RNA, 17 nt, Salmonella enterica enterica serovar Typhi
cuuaauacgcagaucuu

SEQ ID NO: 3656460 - RNA, 18 nt, Salmonella enterica enterica serovar Typhi
cuuaauacucgccccguu

SEQ ID NO: 3656461 - RNA, 14 nt, Salmonella enterica enterica serovar Typhi
cuuaauaucaauau

SEQ ID NO: 3656462 - RNA, 17 nt, Salmonella enterica enterica serovar Typhi
cuuaauaucaauauaau

SEQ ID NO: 3656463 - RNA, 18 nt, Salmonella enterica enterica serovar Typhi
cuuaauaucaauauaauu

SEQ ID NO: 3656464 - RNA, 13 nt, Salmonella enterica enterica serovar Typhi
cuuaaucaccagc

SEQ ID NO: 3656465 - RNA, 21 nt, Salmonella enterica enterica serovar Typhi
cuuaaugaguacggguauucc

SEQ ID NO: 3656466 - RNA, 16 nt, Salmonella enterica enterica serovar Typhi
cuuaaugcucugcugu

SEQ ID NO: 3656467 - RNA, 18 nt, Salmonella enterica enterica serovar Typhi
cuuaauggcuucaccguu

SEQ ID NO: 3656468 - RNA, 19 nt, Salmonella enterica enterica serovar Typhi
cuuaauuugcuguuuuuug

SEQ ID NO: 3656469 - RNA, 13 nt, Salmonella enterica enterica serovar Typhi
cuuacaaaaaaua

SEQ ID NO: 3656470 - RNA, 23 nt, Salmonella enterica enterica serovar Typhi
cuuacagcuucgguccggcgcua

SEQ ID NO: 3656471 - RNA, 17 nt, Salmonella enterica enterica serovar Typhi
cuuacaggcgcaucaga

SEQ ID NO: 3656472 - RNA, 19 nt, Salmonella enterica enterica serovar Typhi
cuuacaggcgcaucagaaa

SEQ ID NO: 3656473 - RNA, 17 nt, Salmonella enterica enterica serovar Typhi
cuuacaggcuggaaaua

SEQ ID NO: 3656474 - RNA, 19 nt, Salmonella enterica enterica serovar Typhi
cuuaccagguauuaaauac

SEQ ID NO: 3656475 - RNA, 14 nt, Salmonella enterica enterica serovar Typhi
cuuaccaucuggcc

SEQ ID NO: 3656476 - RNA, 20 nt, Salmonella enterica enterica serovar Typhi
cuuaccgggcaggauacggc

SEQ ID NO: 3656477 - RNA, 15 nt, Salmonella enterica enterica serovar Typhi
cuuaccgggcaucug

SEQ ID NO: 3656478 - RNA, 15 nt, Salmonella enterica enterica serovar Typhi
cuuaccuaagucagu

SEQ ID NO: 3656479 - RNA, 23 nt, Salmonella enterica enterica serovar Typhi
cuuaccuauuuuaaauucccagc

SEQ ID NO: 3656480 - RNA, 17 nt, Salmonella enterica enterica serovar Typhi
cuuaccuugaguaacug

SEQ ID NO: 3656481 - RNA, 20 nt, Salmonella enterica enterica serovar Typhi
cuuacgaagaucgucgauca

SEQ ID NO: 3656482 - RNA, 18 nt, Salmonella enterica enterica serovar Typhi
cuuacgaauuuuaucuuc

SEQ ID NO: 3656483 - RNA, 11 nt, Salmonella enterica enterica serovar Typhi
cuuacgcagcu

SEQ ID NO: 3656484 - RNA, 23 nt, Salmonella enterica enterica serovar Typhi
cuuacgcaguugggcgcgcgacu

SEQ ID NO: 3656485 - RNA, 15 nt, Salmonella enterica enterica serovar Typhi
cuuacgcggcgcgcu

SEQ ID NO: 3656486 - RNA, 14 nt, Salmonella enterica enterica serovar Typhi
cuuacgcuccugcg

SEQ ID NO: 3656487 - RNA, 21 nt, Salmonella enterica enterica serovar Typhi
cuuacggacugcggccugcaa

SEQ ID NO: 3656488 - RNA, 22 nt, Salmonella enterica enterica serovar Typhi
cuuacggacugcggccugcaaa

SEQ ID NO: 3656489 - RNA, 21 nt, Salmonella enterica enterica serovar Typhi
cuuacguucgaugacuuguuc

SEQ ID NO: 3656490 - RNA, 14 nt, Salmonella enterica enterica serovar Typhi
cuuacuuguaggcc

SEQ ID NO: 3656491 - RNA, 18 nt, Salmonella enterica enterica serovar Typhi
cuuacuuguaggccuggu

SEQ ID NO: 3656492 - RNA, 18 nt, Salmonella enterica enterica serovar Typhi
cuuacuuuccaaaaucca

SEQ ID NO: 3656493 - RNA, 20 nt, Salmonella enterica enterica serovar Typhi
cuuacuuucuugccacuggc

SEQ ID NO: 3656494 - RNA, 19 nt, Salmonella enterica enterica serovar Typhi
cuuagaucguaucggcugg

SEQ ID NO: 3656495 - RNA, 17 nt, Salmonella enterica enterica serovar Typhi
cuuagcaacugccggcu

SEQ ID NO: 3656496 - RNA, 17 nt, Salmonella enterica enterica serovar Typhi
cuuagcgccagcagaaa

SEQ ID NO: 3656497 - RNA, 19 nt, Salmonella enterica enterica serovar Typhi
cuuagcgcccgguuuuuuu

SEQ ID NO: 3656498 - RNA, 19 nt, Salmonella enterica enterica serovar Typhi
cuuagcuggccaaucagcg

SEQ ID NO: 3656499 - RNA, 20 nt, Salmonella enterica enterica serovar Typhi
cuuaggcaggggauuagacu

SEQ ID NO: 3656500 - RNA, 15 nt, Salmonella enterica enterica serovar Typhi
cuuaguccucagcga

SEQ ID NO: 3656501 - RNA, 23 nt, Salmonella enterica enterica serovar Typhi
cuuauaaaggucaaacaccugaa

SEQ ID NO: 3656502 - RNA, 16 nt, Salmonella enterica enterica serovar Typhi
cuuauacaggcgcagg

SEQ ID NO: 3656503 - RNA, 12 nt, Salmonella enterica enterica serovar Typhi
cuucaguaacca

SEQ ID NO: 3656504 - RNA, 15 nt, Salmonella enterica enterica serovar Typhi
cuucaguaagcgagu

SEQ ID NO: 3656505 - RNA, 18 nt, Salmonella enterica enterica serovar Typhi
cuucaguucagccgccag

SEQ ID NO: 3656506 - RNA, 12 nt, Salmonella enterica enterica serovar Typhi
cuucauaaauac

SEQ ID NO: 3656507 - RNA, 20 nt, Salmonella enterica enterica serovar Typhi
cuucauaaauagccagcauc

SEQ ID NO: 3656508 - RNA, 17 nt, Salmonella enterica enterica serovar Typhi
cuucauacuccgaaugu

SEQ ID NO: 3656509 - RNA, 17 nt, Salmonella enterica enterica serovar Typhi
cuucauaggugaacaug

SEQ ID NO: 3656510 - RNA, 23 nt, Salmonella enterica enterica serovar Typhi
cuucauauuaaauuccggcucgc

SEQ ID NO: 3656511 - RNA, 13 nt, Salmonella enterica enterica serovar Typhi
cuucaucagccag

SEQ ID NO: 3656512 - RNA, 19 nt, Salmonella enterica enterica serovar Typhi
cuucaucaguaacugacga

SEQ ID NO: 3656513 - RNA, 14 nt, Salmonella enterica enterica serovar Typhi
cuucauccacgccg

SEQ ID NO: 3656514 - RNA, 17 nt, Salmonella enterica enterica serovar Typhi
cuucauccgcucccgcu

SEQ ID NO: 3656515 - RNA, 16 nt, Salmonella enterica enterica serovar Typhi
cuucaucgauggcgcc

SEQ ID NO: 3656516 - RNA, 14 nt, Salmonella enterica enterica serovar Typhi
cuucaucgcgccuc

SEQ ID NO: 3656517 - RNA, 18 nt, Salmonella enterica enterica serovar Typhi
cuucaucgcgccuccccu

SEQ ID NO: 3656518 - RNA, 18 nt, Salmonella enterica enterica serovar Typhi
cuucaucggauagaugaa

SEQ ID NO: 3656519 - RNA, 22 nt, Salmonella enterica enterica serovar Typhi
cuucaucggauagaugaagaca

SEQ ID NO: 3656520 - RNA, 14 nt, Salmonella enterica enterica serovar Typhi
cuucaucuucaccu

SEQ ID NO: 3656521 - RNA, 16 nt, Salmonella enterica enterica serovar Typhi
cuucaucuuccaguac

SEQ ID NO: 3656522 - RNA, 19 nt, Salmonella enterica enterica serovar Typhi
cuucaugaguaaaugaacg

SEQ ID NO: 3656523 - RNA, 20 nt, Salmonella enterica enterica serovar Typhi
cuucaugguaaaauccuuuu

SEQ ID NO: 3656524 - RNA, 22 nt, Salmonella enterica enterica serovar Typhi
cuucaugugguaggcuucaacc

SEQ ID NO: 3656525 - RNA, 22 nt, Salmonella enterica enterica serovar Typhi
cuucauuggcgucugcuggcca

SEQ ID NO: 3656526 - RNA, 24 nt, Salmonella enterica enterica serovar Typhi
cuucauuuauggguuccaguugca

SEQ ID NO: 3656527 - RNA, 23 nt, Salmonella enterica enterica serovar Typhi
cuuccaccauccgcgcauacucu

SEQ ID NO: 3656528 - RNA, 21 nt, Salmonella enterica enterica serovar Typhi
cuuccacccgcgcgcuuucca

SEQ ID NO: 3656529 - RNA, 14 nt, Salmonella enterica enterica serovar Typhi
cuuccacucguaac

SEQ ID NO: 3656530 - RNA, 12 nt, Salmonella enterica enterica serovar Typhi
cuuccacugcgg

SEQ ID NO: 3656531 - RNA, 19 nt, Salmonella enterica enterica serovar Typhi
cuuccagaauggaacaaua

SEQ ID NO: 3656532 - RNA, 23 nt, Salmonella enterica enterica serovar Typhi
cuuccagaauucguacguuuuuc

SEQ ID NO: 3656533 - RNA, 13 nt, Salmonella enterica enterica serovar Typhi
cuuccagcaaacc

SEQ ID NO: 3656534 - RNA, 15 nt, Salmonella enterica enterica serovar Typhi
cuuccagcaauucgu

SEQ ID NO: 3656535 - RNA, 14 nt, Salmonella enterica enterica serovar Typhi
cuuccagcagaucc

SEQ ID NO: 3656536 - RNA, 15 nt, Salmonella enterica enterica serovar Typhi
cuuccagcagccagc

SEQ ID NO: 3656537 - RNA, 17 nt, Salmonella enterica enterica serovar Typhi
cuuccagcgacuccgga

SEQ ID NO: 3656538 - RNA, 12 nt, Salmonella enterica enterica serovar Typhi
cuuccagcgcca

SEQ ID NO: 3656539 - RNA, 24 nt, Salmonella enterica enterica serovar Typhi
cuuccagcgcgccgucaucgcuca

SEQ ID NO: 3656540 - RNA, 18 nt, Salmonella enterica enterica serovar Typhi
cuuccagcgcguccagcc

SEQ ID NO: 3656541 - RNA, 20 nt, Salmonella enterica enterica serovar Typhi
cuuccagcgcguccagcccg

SEQ ID NO: 3656542 - RNA, 22 nt, Salmonella enterica enterica serovar Typhi
cuuccagcgcgucggccggcac

SEQ ID NO: 3656543 - RNA, 12 nt, Salmonella enterica enterica serovar Typhi
cuuccagcucca

SEQ ID NO: 3656544 - RNA, 10 nt, Salmonella enterica enterica serovar Typhi
cuuccaguac

SEQ ID NO: 3656545 - RNA, 16 nt, Salmonella enterica enterica serovar Typhi
cuuccaguccagcgcg

SEQ ID NO: 3656546 - RNA, 22 nt, Salmonella enterica enterica serovar Typhi
cuuccaguucgcugaggcguug

SEQ ID NO: 3656547 - RNA, 14 nt, Salmonella enterica enterica serovar Typhi
cuuccaguugcguc

SEQ ID NO: 3656548 - RNA, 16 nt, Salmonella enterica enterica serovar Typhi
cuuccaguuuugccag

SEQ ID NO: 3656549 - RNA, 23 nt, Salmonella enterica enterica serovar Typhi
cuuccaugcuauccgccgccagc

SEQ ID NO: 3656550 - RNA, 22 nt, Salmonella enterica enterica serovar Typhi
cuucccauauuuuuucugccag

SEQ ID NO: 3656551 - RNA, 23 nt, Salmonella enterica enterica serovar Typhi
cuucccauauuuuuucugccagu

SEQ ID NO: 3656552 - RNA, 23 nt, Salmonella enterica enterica serovar Typhi
cuucccccagaaugccgcccauc

SEQ ID NO: 3656553 - RNA, 23 nt, Salmonella enterica enterica serovar Typhi
cuuccccggcagccucaggccug

SEQ ID NO: 3656554 - RNA, 20 nt, Salmonella enterica enterica serovar Typhi
cuuccccuguaacugcaccu

SEQ ID NO: 3656555 - RNA, 20 nt, Salmonella enterica enterica serovar Typhi
cuuccccuucacucuucgac

SEQ ID NO: 3656556 - RNA, 15 nt, Salmonella enterica enterica serovar Typhi
cuucccgacgcuggc

SEQ ID NO: 3656557 - RNA, 23 nt, Salmonella enterica enterica serovar Typhi
cuucccgcaaacuggccacagca

SEQ ID NO: 3656558 - RNA, 19 nt, Salmonella enterica enterica serovar Typhi
cuucccgcgcagugcagcg

SEQ ID NO: 3656559 - RNA, 20 nt, Salmonella enterica enterica serovar Typhi
cuuccgacaaaccuuuaucg

SEQ ID NO: 3656560 - RNA, 19 nt, Salmonella enterica enterica serovar Typhi
cuuccgacacugaaacucc

SEQ ID NO: 3656561 - RNA, 17 nt, Salmonella enterica enterica serovar Typhi
cuuccgccaccacgccc

SEQ ID NO: 3656562 - RNA, 11 nt, Salmonella enterica enterica serovar Typhi
cuuccgccagc

SEQ ID NO: 3656563 - RNA, 21 nt, Salmonella enterica enterica serovar Typhi
cuuccgccaggcgggugguga

SEQ ID NO: 3656564 - RNA, 19 nt, Salmonella enterica enterica serovar Typhi
cuuccgccauacccggcuc

SEQ ID NO: 3656565 - RNA, 22 nt, Salmonella enterica enterica serovar Typhi
cuuccgccauacccggcuccca

SEQ ID NO: 3656566 - RNA, 21 nt, Salmonella enterica enterica serovar Typhi
cuuccgcgguacgaaucgccg

SEQ ID NO: 3656567 - RNA, 19 nt, Salmonella enterica enterica serovar Typhi
cuuccgcuuuaagcgcugc

SEQ ID NO: 3656568 - RNA, 20 nt, Salmonella enterica enterica serovar Typhi
cuuccggauaacgcgcuggc

SEQ ID NO: 3656569 - RNA, 18 nt, Salmonella enterica enterica serovar Typhi
cuuccggauuaaagacgc

SEQ ID NO: 3656570 - RNA, 16 nt, Salmonella enterica enterica serovar Typhi
cuuccggcgagagaau

SEQ ID NO: 3656571 - RNA, 15 nt, Salmonella enterica enterica serovar Typhi
cuuccgggcgggcgc

SEQ ID NO: 3656572 - RNA, 20 nt, Salmonella enterica enterica serovar Typhi
cuuccggugugaccagcgcg

SEQ ID NO: 3656573 - RNA, 16 nt, Salmonella enterica enterica serovar Typhi
cuuccguaaaaagaac

SEQ ID NO: 3656574 - RNA, 23 nt, Salmonella enterica enterica serovar Typhi
cuuccgucaaaaaaucgaccaac

SEQ ID NO: 3656575 - RNA, 22 nt, Salmonella enterica enterica serovar Typhi
cuuccucaauauugucuucguc

SEQ ID NO: 3656576 - RNA, 18 nt, Salmonella enterica enterica serovar Typhi
cuuccucacagccuugcc

SEQ ID NO: 3656577 - RNA, 19 nt, Salmonella enterica enterica serovar Typhi
cuuccucaccguagcucca

SEQ ID NO: 3656578 - RNA, 21 nt, Salmonella enterica enterica serovar Typhi
cuuccuccccaggcgcuauuc

SEQ ID NO: 3656579 - RNA, 15 nt, Salmonella enterica enterica serovar Typhi
cuuccugccaggccg

SEQ ID NO: 3656580 - RNA, 23 nt, Salmonella enterica enterica serovar Typhi
cuuccugccgcgaucgcggcaac

SEQ ID NO: 3656581 - RNA, 15 nt, Salmonella enterica enterica serovar Typhi
cuuccugcgucaggc

SEQ ID NO: 3656582 - RNA, 17 nt, Salmonella enterica enterica serovar Typhi
cuuccuguaucccaaac

SEQ ID NO: 3656583 - RNA, 18 nt, Salmonella enterica enterica serovar Typhi
cuuccuucguuacuuuca

SEQ ID NO: 3656584 - RNA, 16 nt, Salmonella enterica enterica serovar Typhi
cuuccuuuucaucugg

SEQ ID NO: 3656585 - RNA, 14 nt, Salmonella enterica enterica serovar Typhi
cuucgaaacgaucg

SEQ ID NO: 3656586 - RNA, 15 nt, Salmonella enterica enterica serovar Typhi
cuucgaacagcucau

SEQ ID NO: 3656587 - RNA, 18 nt, Salmonella enterica enterica serovar Typhi
cuucgaaugucucaauau

SEQ ID NO: 3656588 - RNA, 22 nt, Salmonella enterica enterica serovar Typhi
cuugcagccagaacucaucuuc

SEQ ID NO: 3656589 - RNA, 17 nt, Salmonella enterica enterica serovar Typhi
cuugcauggcagccccg

SEQ ID NO: 3656590 - RNA, 23 nt, Salmonella enterica enterica serovar Typhi
cuugcauuuuacguagccgcaga

SEQ ID NO: 3656591 - RNA, 19 nt, Salmonella enterica enterica serovar Typhi
cuugccacuacgcagcucc

SEQ ID NO: 3656592 - RNA, 14 nt, Salmonella enterica enterica serovar Typhi
cuugccacuggccu

SEQ ID NO: 3656593 - RNA, 17 nt, Salmonella enterica enterica serovar Typhi
cuugccagagccccaau

SEQ ID NO: 3656594 - RNA, 13 nt, Salmonella enterica enterica serovar Typhi
cuugccagcgaga

SEQ ID NO: 3656595 - RNA, 17 nt, Salmonella enterica enterica serovar Typhi
cuugccgaauuuacugu

SEQ ID NO: 3656596 - RNA, 21 nt, Salmonella enterica enterica serovar Typhi
cuugccgcaucuucgcccggc

SEQ ID NO: 3656597 - RNA, 15 nt, Salmonella enterica enterica serovar Typhi
cuugccgccagcgcg

SEQ ID NO: 3656598 - RNA, 20 nt, Salmonella enterica enterica serovar Typhi
cuugccgcgccagacgccau

SEQ ID NO: 3656599 - RNA, 15 nt, Salmonella enterica enterica serovar Typhi
cuugccggcgcagcg

SEQ ID NO: 3656600 - RNA, 17 nt, Salmonella enterica enterica serovar Typhi
cuugccgggccuggcau

SEQ ID NO: 3656601 - RNA, 15 nt, Salmonella enterica enterica serovar Typhi
cuugccgggggcgcu

SEQ ID NO: 3656602 - RNA, 23 nt, Salmonella enterica enterica serovar Typhi
cuugccgucaacacgcagaccca

SEQ ID NO: 3656603 - RNA, 18 nt, Salmonella enterica enterica serovar Typhi
cuugccguuuuucucauc

SEQ ID NO: 3656604 - RNA, 20 nt, Salmonella enterica enterica serovar Typhi
cuugccucacccugaaaucc

SEQ ID NO: 3656605 - RNA, 17 nt, Salmonella enterica enterica serovar Typhi
cuugcgcaucgcaucag

SEQ ID NO: 3656606 - RNA, 15 nt, Salmonella enterica enterica serovar Typhi
cuugcgccaucaucc

SEQ ID NO: 3656607 - RNA, 13 nt, Salmonella enterica enterica serovar Typhi
cuugcgccauucu

SEQ ID NO: 3656608 - RNA, 13 nt, Salmonella enterica enterica serovar Typhi
cuugcgccgccau

SEQ ID NO: 3656609 - RNA, 21 nt, Salmonella enterica enterica serovar Typhi
cuugcgccgccauccggccug

SEQ ID NO: 3656610 - RNA, 22 nt, Salmonella enterica enterica serovar Typhi
cuugcgccgccauccggccugu

SEQ ID NO: 3656611 - RNA, 14 nt, Salmonella enterica enterica serovar Typhi
cuugcgccucuggu

SEQ ID NO: 3656612 - RNA, 18 nt, Salmonella enterica enterica serovar Typhi
cuugcggcgccaggacaa

SEQ ID NO: 3656613 - RNA, 16 nt, Salmonella enterica enterica serovar Typhi
cuugcggugagaaacg

SEQ ID NO: 3656614 - RNA, 14 nt, Salmonella enterica enterica serovar Typhi
cuugcucucaggca

SEQ ID NO: 3656615 - RNA, 15 nt, Salmonella enterica enterica serovar Typhi
cuugcugcugcugau

SEQ ID NO: 3656616 - RNA, 20 nt, Salmonella enterica enterica serovar Typhi
cuugcuggccuguucaagug

SEQ ID NO: 3656617 - RNA, 23 nt, Salmonella enterica enterica serovar Typhi
cuugcuuaacagaauugcgccac

SEQ ID NO: 3656618 - RNA, 18 nt, Salmonella enterica enterica serovar Typhi
cuugcuuuagcuugugau

SEQ ID NO: 3656619 - RNA, 11 nt, Salmonella enterica enterica serovar Typhi
cuugcuuuauu

SEQ ID NO: 3656620 - RNA, 18 nt, Salmonella enterica enterica serovar Typhi
cuugcuuuucaucaccau

SEQ ID NO: 3656621 - RNA, 22 nt, Salmonella enterica enterica serovar Typhi
cuuggcagccccugaaauaaca

SEQ ID NO: 3656622 - RNA, 17 nt, Salmonella enterica enterica serovar Typhi
cuuggcguauagccgcc

SEQ ID NO: 3656623 - RNA, 19 nt, Salmonella enterica enterica serovar Typhi
cuuggcguauagccgcccc

SEQ ID NO: 3656624 - RNA, 18 nt, Salmonella enterica enterica serovar Typhi
cuugguaccaaacagcag

SEQ ID NO: 3656625 - RNA, 22 nt, Salmonella enterica enterica serovar Typhi
cuuguaaaaaugccugugccag

SEQ ID NO: 3656626 - RNA, 14 nt, Salmonella enterica enterica serovar Typhi
cuuguaagggaggu

SEQ ID NO: 3656627 - RNA, 19 nt, Salmonella enterica enterica serovar Typhi
cuuguaagggaggugcucu

SEQ ID NO: 3656628 - RNA, 23 nt, Salmonella enterica enterica serovar Typhi
cuuguaagggaggugcucuccca

SEQ ID NO: 3656629 - RNA, 20 nt, Salmonella enterica enterica serovar Typhi
cuuguaggccugauagcaca

SEQ ID NO: 3656630 - RNA, 20 nt, Salmonella enterica enterica serovar Typhi
cuugucacaauaacgccgga

SEQ ID NO: 3656631 - RNA, 14 nt, Salmonella enterica enterica serovar Typhi
cuugucagcuuucu

SEQ ID NO: 3656632 - RNA, 15 nt, Salmonella enterica enterica serovar Typhi
cuugucauccugcuc

SEQ ID NO: 3656633 - RNA, 16 nt, Salmonella enterica enterica serovar Typhi
cuuguccgaugcagac

SEQ ID NO: 3656634 - RNA, 18 nt, Salmonella enterica enterica serovar Typhi
cuugucgccaaccuccca

SEQ ID NO: 3656635 - RNA, 13 nt, Salmonella enterica enterica serovar Typhi
cuugugacugaua

SEQ ID NO: 3656636 - RNA, 22 nt, Salmonella enterica enterica serovar Typhi
cuuguguggagguuucuucauc

SEQ ID NO: 3656637 - RNA, 16 nt, Salmonella enterica enterica serovar Typhi
cuuguuacucaauaaa

SEQ ID NO: 3656638 - RNA, 20 nt, Salmonella enterica enterica serovar Typhi
cuuguuauccaucagccagg

SEQ ID NO: 3656639 - RNA, 16 nt, Salmonella enterica enterica serovar Typhi
cuuguucgcaggucaa

SEQ ID NO: 3656640 - RNA, 19 nt, Salmonella enterica enterica serovar Typhi
cuuguuucaucgucagcuc

SEQ ID NO: 3656641 - RNA, 16 nt, Salmonella enterica enterica serovar Typhi
cuuuaaagcccagcac

SEQ ID NO: 3656642 - RNA, 21 nt, Salmonella enterica enterica serovar Typhi
cuuuaaagcgcugcguggcgg

SEQ ID NO: 3656643 - RNA, 14 nt, Salmonella enterica enterica serovar Typhi
cuuuaaauucagca

SEQ ID NO: 3656644 - RNA, 13 nt, Salmonella enterica enterica serovar Typhi
cuuuaaccucuuu

SEQ ID NO: 3656645 - RNA, 16 nt, Salmonella enterica enterica serovar Typhi
cuuuaaccucuuuuuc

SEQ ID NO: 3656646 - RNA, 17 nt, Salmonella enterica enterica serovar Typhi
cuuuaacgcugcaaagu

SEQ ID NO: 3656647 - RNA, 13 nt, Salmonella enterica enterica serovar Typhi
cuuuaacgcuggc

SEQ ID NO: 3656648 - RNA, 14 nt, Salmonella enterica enterica serovar Typhi
cuuuaaucaccaug

SEQ ID NO: 3656649 - RNA, 20 nt, Salmonella enterica enterica serovar Typhi
cuuuaaucacccgcgccagc

SEQ ID NO: 3656650 - RNA, 18 nt, Salmonella enterica enterica serovar Typhi
cuuuaaucaccugccagg

SEQ ID NO: 3656651 - RNA, 22 nt, Salmonella enterica enterica serovar Typhi
cuuuaaugcccgguauuuuuuc

SEQ ID NO: 3656652 - RNA, 16 nt, Salmonella enterica enterica serovar Typhi
cuuuaccaaugugcaa

SEQ ID NO: 3656653 - RNA, 19 nt, Salmonella enterica enterica serovar Typhi
cuuuacccuuacggccacu

SEQ ID NO: 3656654 - RNA, 23 nt, Salmonella enterica enterica serovar Typhi
cuuuacgcagauaacuuccuuug

SEQ ID NO: 3656655 - RNA, 15 nt, Salmonella enterica enterica serovar Typhi
cuuuacgcagcaaga

SEQ ID NO: 3656656 - RNA, 16 nt, Salmonella enterica enterica serovar Typhi
cuuuacugaaucucag

SEQ ID NO: 3656657 - RNA, 19 nt, Salmonella enterica enterica serovar Typhi
cuuuacugcgccagccugc

SEQ ID NO: 3656658 - RNA, 22 nt, Salmonella enterica enterica serovar Typhi
cuuuacuguugccuuugcgcgc

SEQ ID NO: 3656659 - RNA, 20 nt, Salmonella enterica enterica serovar Typhi
cuuuagaaaaagaaaccucc

SEQ ID NO: 3656660 - RNA, 21 nt, Salmonella enterica enterica serovar Typhi
cuuuagauaauuucgcauaau

SEQ ID NO: 3656661 - RNA, 14 nt, Salmonella enterica enterica serovar Typhi
cuuuaggcaggaaa

SEQ ID NO: 3656662 - RNA, 13 nt, Salmonella enterica enterica serovar Typhi
cuuuauauaaaaa

SEQ ID NO: 3656663 - RNA, 16 nt, Salmonella enterica enterica serovar Typhi
cuuuauauaaaaaaug

SEQ ID NO: 3656664 - RNA, 23 nt, Salmonella enterica enterica serovar Typhi
cuuuaucaaacaaaccaaacuga

SEQ ID NO: 3656665 - RNA, 21 nt, Salmonella enterica enterica serovar Typhi
cuuuaucacuccuuaggccgu

SEQ ID NO: 3656666 - RNA, 17 nt, Salmonella enterica enterica serovar Typhi
cuuuaucguaaccgaug

SEQ ID NO: 3656667 - RNA, 20 nt, Salmonella enterica enterica serovar Typhi
cuuuaucuucugcugcuccc

SEQ ID NO: 3656668 - RNA, 20 nt, Salmonella enterica enterica serovar Typhi
cuuuaucuuuuagcgcgccg

SEQ ID NO: 3656669 - RNA, 14 nt, Salmonella enterica enterica serovar Typhi
cuuuaugucaguaa

SEQ ID NO: 3656670 - RNA, 15 nt, Salmonella enterica enterica serovar Typhi
cuuuaugucaguaau

SEQ ID NO: 3656671 - RNA, 21 nt, Salmonella enterica enterica serovar Typhi
cuuuaugucaguaauauauua

SEQ ID NO: 3656672 - RNA, 19 nt, Salmonella enterica enterica serovar Typhi
cuuuauuuuacaacuacuc

SEQ ID NO: 3656673 - RNA, 18 nt, Salmonella enterica enterica serovar Typhi
cuuuuaauuuuuauguca

SEQ ID NO: 3656674 - RNA, 22 nt, Salmonella enterica enterica serovar Typhi
cuuuuaauuuuuaugucauuua

SEQ ID NO: 3656675 - RNA, 22 nt, Salmonella enterica enterica serovar Typhi
cuuuuacaagaauaugcagugc

SEQ ID NO: 3656676 - RNA, 16 nt, Salmonella enterica enterica serovar Typhi
cuuuuacccuucaugu

SEQ ID NO: 3656677 - RNA, 19 nt, Salmonella enterica enterica serovar Typhi
cuuuuaccuuacggacugc

SEQ ID NO: 3656678 - RNA, 12 nt, Salmonella enterica enterica serovar Typhi
cuuuuacugccc

SEQ ID NO: 3656679 - RNA, 14 nt, Salmonella enterica enterica serovar Typhi
cuuuuagcgcgccg

SEQ ID NO: 3656680 - RNA, 14 nt, Salmonella enterica enterica serovar Typhi
cuuuuaguauuuac

SEQ ID NO: 3656681 - RNA, 16 nt, Salmonella enterica enterica serovar Typhi
cuuuuaguauuuacaa

SEQ ID NO: 3656682 - RNA, 19 nt, Salmonella enterica enterica serovar Typhi
cuuuuaguuacgcacgcca

SEQ ID NO: 3656683 - RNA, 19 nt, Salmonella enterica enterica serovar Typhi
cuuuuaguucaaccugcgc

SEQ ID NO: 3656684 - RNA, 16 nt, Salmonella enterica enterica serovar Typhi
cuuuuauccccaccac

SEQ ID NO: 3656685 - RNA, 22 nt, Salmonella enterica enterica serovar Typhi
cuuuuauuauuuugauacucau

SEQ ID NO: 3656686 - RNA, 21 nt, Salmonella enterica enterica serovar Typhi
cuuuucaagaauuacaucaau

SEQ ID NO: 3656687 - RNA, 18 nt, Salmonella enterica enterica serovar Typhi
cuuuucacgcauugccac

SEQ ID NO: 3656688 - RNA, 21 nt, Salmonella enterica enterica serovar Typhi
cuuuucagcccaggcuuuagu

SEQ ID NO: 3656689 - RNA, 14 nt, Salmonella enterica enterica serovar Typhi
cuuuucagcgccag

SEQ ID NO: 3656690 - RNA, 18 nt, Salmonella enterica enterica serovar Typhi
cuuuucaggcgcugucug

SEQ ID NO: 3656691 - RNA, 19 nt, Salmonella enterica enterica serovar Typhi
cuuuucauccacagcgcca

SEQ ID NO: 3656692 - RNA, 17 nt, Salmonella enterica enterica serovar Typhi
cuuuuccagcacgccca

SEQ ID NO: 3656693 - RNA, 11 nt, Salmonella enterica enterica serovar Typhi
cuuuuccagcc

SEQ ID NO: 3656694 - RNA, 17 nt, Salmonella enterica enterica serovar Typhi
cuuuuccaggcgaccag

SEQ ID NO: 3656695 - RNA, 23 nt, Salmonella enterica enterica serovar Typhi
cuuuuccaguaagaucaccuucu

SEQ ID NO: 3656696 - RNA, 14 nt, Salmonella enterica enterica serovar Typhi
cuuuuccugccagc

SEQ ID NO: 3656697 - RNA, 15 nt, Salmonella enterica enterica serovar Typhi
cuuuuccugcugcca

SEQ ID NO: 3656698 - RNA, 12 nt, Salmonella enterica enterica serovar Typhi
cuuuuccuucca

SEQ ID NO: 3656699 - RNA, 14 nt, Salmonella enterica enterica serovar Typhi
cuuuucgaacgccg

SEQ ID NO: 3656700 - RNA, 18 nt, Salmonella enterica enterica serovar Typhi
cuuuucggcgcuuaucca

SEQ ID NO: 3656701 - RNA, 14 nt, Salmonella enterica enterica serovar Typhi
cuuuucuagccaau

SEQ ID NO: 3656702 - RNA, 23 nt, Salmonella enterica enterica serovar Typhi
cuuuucucucucguucccgccug

SEQ ID NO: 3656703 - RNA, 15 nt, Salmonella enterica enterica serovar Typhi
cuuuucuggcuucag

SEQ ID NO: 3656704 - RNA, 18 nt, Salmonella enterica enterica serovar Typhi
cuuuucuuucagcucuuc

SEQ ID NO: 3656705 - RNA, 15 nt, Salmonella enterica enterica serovar Typhi
cuuuucuuuccugca

SEQ ID NO: 3656706 - RNA, 14 nt, Salmonella enterica enterica serovar Typhi
cuuuugauacucug

SEQ ID NO: 3656707 - RNA, 11 nt, Salmonella enterica enterica serovar Typhi
cuuuugcagcg

SEQ ID NO: 3656708 - RNA, 22 nt, Salmonella enterica enterica serovar Typhi
cuuuugcccgguggcgcugcgc

SEQ ID NO: 3656709 - RNA, 23 nt, Salmonella enterica enterica serovar Typhi
cuuuugccgcgacuuccgucucc

SEQ ID NO: 3656710 - RNA, 13 nt, Salmonella enterica enterica serovar Typhi
cuuuugccgcgcc

SEQ ID NO: 3656711 - RNA, 18 nt, Salmonella enterica enterica serovar Typhi
cuuuugccgucaggucau

SEQ ID NO: 3656712 - RNA, 19 nt, Salmonella enterica enterica serovar Typhi
cuuuugcgccuuccaguuc

SEQ ID NO: 3656713 - RNA, 19 nt, Salmonella enterica enterica serovar Typhi
cuuuugcgcguuccccaac

SEQ ID NO: 3656714 - RNA, 20 nt, Salmonella enterica enterica serovar Typhi
cuuuugcgcguuccccaaca

SEQ ID NO: 3656715 - RNA, 19 nt, Salmonella enterica enterica serovar Typhi
cuuuugcuaacagugaaau

SEQ ID NO: 3656716 - RNA, 14 nt, Salmonella enterica enterica serovar Typhi
cuuuugcuuccagu

SEQ ID NO: 3656717 - RNA, 18 nt, Salmonella enterica enterica serovar Typhi
cuuuugcuuucuggauga

SEQ ID NO: 3656718 - RNA, 14 nt, Salmonella enterica enterica serovar Typhi
cuuuugguggcaac

SEQ ID NO: 3656719 - RNA, 15 nt, Salmonella enterica enterica serovar Typhi
cuuuugguuuuucaa

SEQ ID NO: 3656720 - RNA, 19 nt, Salmonella enterica enterica serovar Typhi
cuuuugguuuuucaaccac

SEQ ID NO: 3656721 - RNA, 19 nt, Salmonella enterica enterica serovar Typhi
cuuuugucguccccuggac

SEQ ID NO: 3656722 - RNA, 15 nt, Salmonella enterica enterica serovar Typhi
cuuuuuaaaaugacc

SEQ ID NO: 3656723 - RNA, 22 nt, Salmonella enterica enterica serovar Typhi
cuuuuuagcacagcucuaauug

SEQ ID NO: 3656724 - RNA, 16 nt, Salmonella enterica enterica serovar Typhi
cuuuuuauauaagcau

SEQ ID NO: 3656725 - RNA, 22 nt, Salmonella enterica enterica serovar Typhi
cuuuuucaacagcacccaggca

SEQ ID NO: 3656726 - RNA, 12 nt, Salmonella enterica enterica serovar Typhi
cuuuuucaggca

SEQ ID NO: 3656727 - RNA, 17 nt, Salmonella enterica enterica serovar Typhi
cuuuuucauauuuuccu

SEQ ID NO: 3656728 - RNA, 15 nt, Salmonella enterica enterica serovar Typhi
cuuuuucccacugcg

SEQ ID NO: 3656729 - RNA, 17 nt, Salmonella enterica enterica serovar Typhi
cuuuuuccuccugcgga

SEQ ID NO: 3656730 - RNA, 20 nt, Salmonella enterica enterica serovar Typhi
cuuuuugcauucgcuccuca

SEQ ID NO: 3656731 - RNA, 17 nt, Salmonella enterica enterica serovar Typhi
cuuuuugugcaaucaca

SEQ ID NO: 3656732 - RNA, 12 nt, Salmonella enterica enterica serovar Typhi
cuuuuuuaaacg

SEQ ID NO: 3656733 - RNA, 19 nt, Salmonella enterica enterica serovar Typhi
cuuuuuuaacgauuucccc

SEQ ID NO: 3656734 - RNA, 21 nt, Salmonella enterica enterica serovar Typhi
cuuuuuuaccggaugggcaga

SEQ ID NO: 3656735 - RNA, 15 nt, Salmonella enterica enterica serovar Typhi
cuuuuuuauugccug

SEQ ID NO: 3656736 - RNA, 14 nt, Salmonella enterica enterica serovar Typhi
cuuuuuuauuguuu

SEQ ID NO: 3656737 - RNA, 16 nt, Salmonella enterica enterica serovar Typhi
cuuuuuuggucagaaa

SEQ ID NO: 3656738 - RNA, 21 nt, Salmonella enterica enterica serovar Typhi
cuuuuuuguauuaacggcgcu

SEQ ID NO: 3656739 - RNA, 17 nt, Salmonella enterica enterica serovar Typhi
cuuuuuuuaugccuggg

SEQ ID NO: 3656740 - RNA, 11 nt, Salmonella enterica enterica serovar Typhi
cuuuuuuucaa

SEQ ID NO: 3656741 - RNA, 16 nt, Salmonella enterica enterica serovar Typhi
cuuuuuuuccagcguc

SEQ ID NO: 3656742 - RNA, 18 nt, Salmonella enterica enterica serovar Typhi
cuuuuuuuuaugccucuu

SEQ ID NO: 3656743 - RNA, 20 nt, Salmonella enterica enterica serovar Typhi
gaaaaaaacgcauugcagca

SEQ ID NO: 3656744 - RNA, 14 nt, Salmonella enterica enterica serovar Typhi
gaaaaaaauccagu

SEQ ID NO: 3656745 - RNA, 20 nt, Salmonella enterica enterica serovar Typhi
gaaaaaaauuucugccgaca

SEQ ID NO: 3656746 - RNA, 17 nt, Salmonella enterica enterica serovar Typhi
gaaaaaacucaggaaau

SEQ ID NO: 3656747 - RNA, 15 nt, Salmonella enterica enterica serovar Typhi
gaaaaaagcagcauc

SEQ ID NO: 3656748 - RNA, 13 nt, Salmonella enterica enterica serovar Typhi
gaaaaaauacuga

SEQ ID NO: 3656749 - RNA, 13 nt, Salmonella enterica enterica serovar Typhi
gaaaaaauuacag

SEQ ID NO: 3656750 - RNA, 18 nt, Salmonella enterica enterica serovar Typhi
gaaaaaauuacagccgcg

SEQ ID NO: 3656751 - RNA, 12 nt, Salmonella enterica enterica serovar Typhi
gaaaaaauuccc

SEQ ID NO: 3656752 - RNA, 12 nt, Salmonella enterica enterica serovar Typhi
gaaaaagaagcc

SEQ ID NO: 3656753 - RNA, 21 nt, Salmonella enterica enterica serovar Typhi
gaaaaagaccgacaucgccag

SEQ ID NO: 3656754 - RNA, 14 nt, Salmonella enterica enterica serovar Typhi
gaaaaagcaauaau

SEQ ID NO: 3656755 - RNA, 19 nt, Salmonella enterica enterica serovar Typhi
gaaaaagccaaaaggcgcc

SEQ ID NO: 3656756 - RNA, 14 nt, Salmonella enterica enterica serovar Typhi
gaaaaagggaaaag

SEQ ID NO: 3656757 - RNA, 16 nt, Salmonella enterica enterica serovar Typhi
gaaaaagggaauaaua

SEQ ID NO: 3656758 - RNA, 19 nt, Salmonella enterica enterica serovar Typhi
gaaaaaucagucauuugca

SEQ ID NO: 3656759 - RNA, 22 nt, Salmonella enterica enterica serovar Typhi
gaaacucgccaugccaucggcc

SEQ ID NO: 3656760 - RNA, 22 nt, Salmonella enterica enterica serovar Typhi
gaaacucgcuguggccaggcac

SEQ ID NO: 3656761 - RNA, 23 nt, Salmonella enterica enterica serovar Typhi
gaaacugauaguuuaaauccagc

SEQ ID NO: 3656762 - RNA, 18 nt, Salmonella enterica enterica serovar Typhi
gaaacugcauaucgccgc

SEQ ID NO: 3656763 - RNA, 15 nt, Salmonella enterica enterica serovar Typhi
gaaacugccuaaauu

SEQ ID NO: 3656764 - RNA, 18 nt, Salmonella enterica enterica serovar Typhi
gaaacugcuguagcacau

SEQ ID NO: 3656765 - RNA, 17 nt, Salmonella enterica enterica serovar Typhi
gaaacuggcgucauguu

SEQ ID NO: 3656766 - RNA, 18 nt, Salmonella enterica enterica serovar Typhi
gaaagaaaacuuuccaac

SEQ ID NO: 3656767 - RNA, 12 nt, Salmonella enterica enterica serovar Typhi
gaaagaagaggc

SEQ ID NO: 3656768 - RNA, 17 nt, Salmonella enterica enterica serovar Typhi
gaaagaccugccgaccu

SEQ ID NO: 3656769 - RNA, 21 nt, Salmonella enterica enterica serovar Typhi
gaaagacggcagcgccauccg

SEQ ID NO: 3656770 - RNA, 13 nt, Salmonella enterica enterica serovar Typhi
gaaagagcaaaua

SEQ ID NO: 3656771 - RNA, 15 nt, Salmonella enterica enterica serovar Typhi
gaaagagcgugcggc

SEQ ID NO: 3656772 - RNA, 23 nt, Salmonella enterica enterica serovar Typhi
gaaagaucagcagaacaaaggcu

SEQ ID NO: 3656773 - RNA, 20 nt, Salmonella enterica enterica serovar Typhi
gaaagauuucaucaggcuga

SEQ ID NO: 3656774 - RNA, 21 nt, Salmonella enterica enterica serovar Typhi
gaaagauuucaucaggcugac

SEQ ID NO: 3656775 - RNA, 14 nt, Salmonella enterica enterica serovar Typhi
gaaagcaacagcaa

SEQ ID NO: 3656776 - RNA, 14 nt, Salmonella enterica enterica serovar Typhi
gaaagcaauacugu

SEQ ID NO: 3656777 - RNA, 15 nt, Salmonella enterica enterica serovar Typhi
gaaagcaauacugua

SEQ ID NO: 3656778 - RNA, 14 nt, Salmonella enterica enterica serovar Typhi
gaaagcagguuuug

SEQ ID NO: 3656779 - RNA, 16 nt, Salmonella enterica enterica serovar Typhi
gaaagcauucgcagca

SEQ ID NO: 3656780 - RNA, 18 nt, Salmonella enterica enterica serovar Typhi
gaaagcauucgcagcaga

SEQ ID NO: 3656781 - RNA, 17 nt, Salmonella enterica enterica serovar Typhi
gaaagccauaaaacugg

SEQ ID NO: 3656782 - RNA, 21 nt, Salmonella enterica enterica serovar Typhi
gaaagccauaaaacuggcgcu

SEQ ID NO: 3656783 - RNA, 18 nt, Salmonella enterica enterica serovar Typhi
gaaagccccggcucaagc

SEQ ID NO: 3656784 - RNA, 16 nt, Salmonella enterica enterica serovar Typhi
gaaagccccugcgcca

SEQ ID NO: 3656785 - RNA, 16 nt, Salmonella enterica enterica serovar Typhi
gaaagccgcgacggca

SEQ ID NO: 3656786 - RNA, 15 nt, Salmonella enterica enterica serovar Typhi
gaaagccucuuccgc

SEQ ID NO: 3656787 - RNA, 18 nt, Salmonella enterica enterica serovar Typhi
gaaagccucuuccgccug

SEQ ID NO: 3656788 - RNA, 22 nt, Salmonella enterica enterica serovar Typhi
gaaagcgacucauccacauacu

SEQ ID NO: 3656789 - RNA, 17 nt, Salmonella enterica enterica serovar Typhi
gaaagcggcgaauauag

SEQ ID NO: 3656790 - RNA, 13 nt, Salmonella enterica enterica serovar Typhi
gaaagcugccuuu

SEQ ID NO: 3656791 - RNA, 20 nt, Salmonella enterica enterica serovar Typhi
gaaagcuguacuuugccggg

SEQ ID NO: 3656792 - RNA, 13 nt, Salmonella enterica enterica serovar Typhi
gaaaggcuugcag

SEQ ID NO: 3656793 - RNA, 16 nt, Salmonella enterica enterica serovar Typhi
gaaagggaucaaugua

SEQ ID NO: 3656794 - RNA, 23 nt, Salmonella enterica enterica serovar Typhi
gaaaggggagggcaacaaacaua

SEQ ID NO: 3656795 - RNA, 17 nt, Salmonella enterica enterica serovar Typhi
gaaagggugcccgccug

SEQ ID NO: 3656796 - RNA, 15 nt, Salmonella enterica enterica serovar Typhi
gaaagguaaaugcca

SEQ ID NO: 3656797 - RNA, 22 nt, Salmonella enterica enterica serovar Typhi
gaaaguaccaaaacagaaaaga

SEQ ID NO: 3656798 - RNA, 23 nt, Salmonella enterica enterica serovar Typhi
gaaaguaccaaaacagaaaagau

SEQ ID NO: 3656799 - RNA, 21 nt, Salmonella enterica enterica serovar Typhi
gaaaguaggcgguuucaucga

SEQ ID NO: 3656800 - RNA, 20 nt, Salmonella enterica enterica serovar Typhi
gaaagucuuuuguuuuucuc

SEQ ID NO: 3656801 - RNA, 18 nt, Salmonella enterica enterica serovar Typhi
gaaagugcugaaauuucc

SEQ ID NO: 3656802 - RNA, 21 nt, Salmonella enterica enterica serovar Typhi
gaaagugggcgcuuuguuacu

SEQ ID NO: 3656803 - RNA, 16 nt, Salmonella enterica enterica serovar Typhi
gaaaguggugggugau

SEQ ID NO: 3656804 - RNA, 19 nt, Salmonella enterica enterica serovar Typhi
gaaaguuacuuuccauaua

SEQ ID NO: 3656805 - RNA, 19 nt, Salmonella enterica enterica serovar Typhi
gaaaguugcgccgugccug

SEQ ID NO: 3656806 - RNA, 22 nt, Salmonella enterica enterica serovar Typhi
gaaauaaauauguuauuuacaa

SEQ ID NO: 3656807 - RNA, 13 nt, Salmonella enterica enterica serovar Typhi
gaaauaacagacu

SEQ ID NO: 3656808 - RNA, 18 nt, Salmonella enterica enterica serovar Typhi
gaaauaacgcacuaccag

SEQ ID NO: 3656809 - RNA, 23 nt, Salmonella enterica enterica serovar Typhi
gaaauagacgagcgaaaaacugu

SEQ ID NO: 3656810 - RNA, 15 nt, Salmonella enterica enterica serovar Typhi
gaaauaggggagacu

SEQ ID NO: 3656811 - RNA, 20 nt, Salmonella enterica enterica serovar Typhi
gaaauaucgcgcggcaugga

SEQ ID NO: 3656812 - RNA, 16 nt, Salmonella enterica enterica serovar Typhi
gaaauaugacgaggau

SEQ ID NO: 3656813 - RNA, 18 nt, Salmonella enterica enterica serovar Typhi
gaaauauggcacagcacu

SEQ ID NO: 3656814 - RNA, 20 nt, Salmonella enterica enterica serovar Typhi
gaaauauuucacguuucauc

SEQ ID NO: 3656815 - RNA, 15 nt, Salmonella enterica enterica serovar Typhi
gaaaucaagcgguuu

SEQ ID NO: 3656816 - RNA, 19 nt, Salmonella enterica enterica serovar Typhi
gaaaucacaaacaccacca

SEQ ID NO: 3656817 - RNA, 15 nt, Salmonella enterica enterica serovar Typhi
gaaaucauagcccug

SEQ ID NO: 3656818 - RNA, 23 nt, Salmonella enterica enterica serovar Typhi
gaaaucaugccagaauugcacgc

SEQ ID NO: 3656819 - RNA, 22 nt, Salmonella enterica enterica serovar Typhi
gaaaucgccgggcuauccggcu

SEQ ID NO: 3656820 - RNA, 16 nt, Salmonella enterica enterica serovar Typhi
gaaaucggcagcaccc

SEQ ID NO: 3656821 - RNA, 14 nt, Salmonella enterica enterica serovar Typhi
gaaaucuaucugua

SEQ ID NO: 3656822 - RNA, 21 nt, Salmonella enterica enterica serovar Typhi
gaaaucucgcuaaccaucagc

SEQ ID NO: 3656823 - RNA, 15 nt, Salmonella enterica enterica serovar Typhi
gaaaucuguuccagc

SEQ ID NO: 3656824 - RNA, 16 nt, Salmonella enterica enterica serovar Typhi
gaaaucuguuccagcg

SEQ ID NO: 3656825 - RNA, 22 nt, Salmonella enterica enterica serovar Typhi
gaaaucuguuccagcgagcagg

SEQ ID NO: 3656826 - RNA, 16 nt, Salmonella enterica enterica serovar Typhi
gaaaugaaaaagauag

SEQ ID NO: 3656827 - RNA, 11 nt, Salmonella enterica enterica serovar Typhi
gaaaugagaaa

SEQ ID NO: 3656828 - RNA, 22 nt, Salmonella enterica enterica serovar Typhi
gaaaugagcgcgccaaccugcu

SEQ ID NO: 3656829 - RNA, 16 nt, Salmonella enterica enterica serovar Typhi
gaaaugauaagugaua

SEQ ID NO: 3656830 - RNA, 17 nt, Salmonella enterica enterica serovar Typhi
gaaaugcccauaaagaa

SEQ ID NO: 3656831 - RNA, 21 nt, Salmonella enterica enterica serovar Typhi
gaaaugcccauaaagaaauau

SEQ ID NO: 3656832 - RNA, 17 nt, Salmonella enterica enterica serovar Typhi
gaaaugccggauggcgu

SEQ ID NO: 3656833 - RNA, 18 nt, Salmonella enterica enterica serovar Typhi
gaaaugccgggcaaaaaa

SEQ ID NO: 3656834 - RNA, 22 nt, Salmonella enterica enterica serovar Typhi
gaaaugcgacaucucaggcaag

SEQ ID NO: 3656835 - RNA, 17 nt, Salmonella enterica enterica serovar Typhi
gaaauggguaucuucau

SEQ ID NO: 3656836 - RNA, 15 nt, Salmonella enterica enterica serovar Typhi
gaaaugguugcguuu

SEQ ID NO: 3656837 - RNA, 17 nt, Salmonella enterica enterica serovar Typhi
gaaauguaggccggaua

SEQ ID NO: 3656838 - RNA, 15 nt, Salmonella enterica enterica serovar Typhi
gaaaugucuggcgcu

SEQ ID NO: 3656839 - RNA, 18 nt, Salmonella enterica enterica serovar Typhi
gaaauuaaacugccuucg

SEQ ID NO: 3656840 - RNA, 13 nt, Salmonella enterica enterica serovar Typhi
gaaauuaaucagg

SEQ ID NO: 3656841 - RNA, 16 nt, Salmonella enterica enterica serovar Typhi
gaaauuagagccgaua

SEQ ID NO: 3656842 - RNA, 20 nt, Salmonella enterica enterica serovar Typhi
gaaauuauuccuuaucacau

SEQ ID NO: 3656843 - RNA, 15 nt, Salmonella enterica enterica serovar Typhi
gaaauucgcagcgca

SEQ ID NO: 3656844 - RNA, 19 nt, Salmonella enterica enterica serovar Typhi
gaacucccuguuccuguau

SEQ ID NO: 3656845 - RNA, 16 nt, Salmonella enterica enterica serovar Typhi
gaacucgucuuauccg

SEQ ID NO: 3656846 - RNA, 21 nt, Salmonella enterica enterica serovar Typhi
gaacucuaugcaaaagaaaaa

SEQ ID NO: 3656847 - RNA, 20 nt, Salmonella enterica enterica serovar Typhi
gaacucugcgacgccaggcg

SEQ ID NO: 3656848 - RNA, 20 nt, Salmonella enterica enterica serovar Typhi
gaacugaauagucggcugcu

SEQ ID NO: 3656849 - RNA, 16 nt, Salmonella enterica enterica serovar Typhi
gaacugauaaaagaga

SEQ ID NO: 3656850 - RNA, 20 nt, Salmonella enterica enterica serovar Typhi
gaacugauggcgcuaagcca

SEQ ID NO: 3656851 - RNA, 21 nt, Salmonella enterica enterica serovar Typhi
gaacugcaaauaccacaucag

SEQ ID NO: 3656852 - RNA, 15 nt, Salmonella enterica enterica serovar Typhi
gaacuggaugacgaa

SEQ ID NO: 3656853 - RNA, 18 nt, Salmonella enterica enterica serovar Typhi
gaacuggguaugcagugg

SEQ ID NO: 3656854 - RNA, 19 nt, Salmonella enterica enterica serovar Typhi
gaacuggguaugcaguggg

SEQ ID NO: 3656855 - RNA, 13 nt, Salmonella enterica enterica serovar Typhi
gaacugggugccg

SEQ ID NO: 3656856 - RNA, 17 nt, Salmonella enterica enterica serovar Typhi
gaacugggugccgugaa

SEQ ID NO: 3656857 - RNA, 15 nt, Salmonella enterica enterica serovar Typhi
gaacuguucagccag

SEQ ID NO: 3656858 - RNA, 23 nt, Salmonella enterica enterica serovar Typhi
gaacuuacacuuaccugauuaua

SEQ ID NO: 3656859 - RNA, 15 nt, Salmonella enterica enterica serovar Typhi
gaacuuacccagcaa

SEQ ID NO: 3656860 - RNA, 13 nt, Salmonella enterica enterica serovar Typhi
gaagaaaaagaag

SEQ ID NO: 3656861 - RNA, 20 nt, Salmonella enterica enterica serovar Typhi
gaagaaaaaggcaauaaagu

SEQ ID NO: 3656862 - RNA, 16 nt, Salmonella enterica enterica serovar Typhi
gaagaaaagccggaug

SEQ ID NO: 3656863 - RNA, 12 nt, Salmonella enterica enterica serovar Typhi
gaagaaaccgca

SEQ ID NO: 3656864 - RNA, 16 nt, Salmonella enterica enterica serovar Typhi
gaagaaaccgcagaaa

SEQ ID NO: 3656865 - RNA, 19 nt, Salmonella enterica enterica serovar Typhi
gaagaaaccgcagaaaaag

SEQ ID NO: 3656866 - RNA, 14 nt, Salmonella enterica enterica serovar Typhi
gaagaacuggauga

SEQ ID NO: 3656867 - RNA, 17 nt, Salmonella enterica enterica serovar Typhi
gaagaaggcuccggcac

SEQ ID NO: 3656868 - RNA, 14 nt, Salmonella enterica enterica serovar Typhi
gaagaauccaggga

SEQ ID NO: 3656869 - RNA, 20 nt, Salmonella enterica enterica serovar Typhi
gaagaaucuguauaaaauau

SEQ ID NO: 3656870 - RNA, 17 nt, Salmonella enterica enterica serovar Typhi
gaagaauucgcaaugug

SEQ ID NO: 3656871 - RNA, 22 nt, Salmonella enterica enterica serovar Typhi
gaagacaacgucgcucuuuuca

SEQ ID NO: 3656872 - RNA, 17 nt, Salmonella enterica enterica serovar Typhi
gaagacacaacgugcca

SEQ ID NO: 3656873 - RNA, 20 nt, Salmonella enterica enterica serovar Typhi
gaagacauucacauauauuu

SEQ ID NO: 3656874 - RNA, 21 nt, Salmonella enterica enterica serovar Typhi
gaagaccgcaucacggcagca

SEQ ID NO: 3656875 - RNA, 22 nt, Salmonella enterica enterica serovar Typhi
gaagacgaugauguagccgcgu

SEQ ID NO: 3656876 - RNA, 14 nt, Salmonella enterica enterica serovar Typhi
gaagagaccugugu

SEQ ID NO: 3656877 - RNA, 18 nt, Salmonella enterica enterica serovar Typhi
gaagagagauaguugagc

SEQ ID NO: 3656878 - RNA, 19 nt, Salmonella enterica enterica serovar Typhi
gaagagugaauaacaaccg

SEQ ID NO: 3656879 - RNA, 17 nt, Salmonella enterica enterica serovar Typhi
gaagauaaacagcagcg

SEQ ID NO: 3656880 - RNA, 16 nt, Salmonella enterica enterica serovar Typhi
gaagauaaagauauuc

SEQ ID NO: 3656881 - RNA, 18 nt, Salmonella enterica enterica serovar Typhi
gaagauccgcucacgcca

SEQ ID NO: 3656882 - RNA, 19 nt, Salmonella enterica enterica serovar Typhi
gaagaucgcguacagcgcc

SEQ ID NO: 3656883 - RNA, 20 nt, Salmonella enterica enterica serovar Typhi
gaagaucgcguacagcgcca

SEQ ID NO: 3656884 - RNA, 16 nt, Salmonella enterica enterica serovar Typhi
gaagaucguuauccag

SEQ ID NO: 3656885 - RNA, 22 nt, Salmonella enterica enterica serovar Typhi
gaagaucguuauccagcagcca

SEQ ID NO: 3656886 - RNA, 20 nt, Salmonella enterica enterica serovar Typhi
gaagaugaggagcuggagca

SEQ ID NO: 3656887 - RNA, 22 nt, Salmonella enterica enterica serovar Typhi
gaagauuaacccggucauccag

SEQ ID NO: 3656888 - RNA, 16 nt, Salmonella enterica enterica serovar Typhi
gaagauuagcagagcg

SEQ ID NO: 3656889 - RNA, 18 nt, Salmonella enterica enterica serovar Typhi
gaagauuucuuaauuccu

SEQ ID NO: 3656890 - RNA, 22 nt, Salmonella enterica enterica serovar Typhi
gaagauuucuuaauuccucaga

SEQ ID NO: 3656891 - RNA, 14 nt, Salmonella enterica enterica serovar Typhi
gaagcacauccaug

SEQ ID NO: 3656892 - RNA, 15 nt, Salmonella enterica enterica serovar Typhi
gaagcacgacacaaa

SEQ ID NO: 3656893 - RNA, 17 nt, Salmonella enterica enterica serovar Typhi
gaagcacgacacaaaag

SEQ ID NO: 3656894 - RNA, 18 nt, Salmonella enterica enterica serovar Typhi
gaagcacgacacaaaagc

SEQ ID NO: 3656895 - RNA, 17 nt, Salmonella enterica enterica serovar Typhi
gaagcaggcggagaagg

SEQ ID NO: 3656896 - RNA, 19 nt, Salmonella enterica enterica serovar Typhi
gaagcaucuuuccggaacg

SEQ ID NO: 3656897 - RNA, 14 nt, Salmonella enterica enterica serovar Typhi
gaagccagcgcagu

SEQ ID NO: 3656898 - RNA, 14 nt, Salmonella enterica enterica serovar Typhi
gaagccaucaaauu

SEQ ID NO: 3656899 - RNA, 20 nt, Salmonella enterica enterica serovar Typhi
gaagcccaacuacacucuua

SEQ ID NO: 3656900 - RNA, 17 nt, Salmonella enterica enterica serovar Typhi
gaagcccggccacagcg

SEQ ID NO: 3656901 - RNA, 23 nt, Salmonella enterica enterica serovar Typhi
gaagcccggccacagcgccagac

SEQ ID NO: 3656902 - RNA, 21 nt, Salmonella enterica enterica serovar Typhi
gaagcccucggcgaacaggcg

SEQ ID NO: 3656903 - RNA, 13 nt, Salmonella enterica enterica serovar Typhi
gaagccugcuuca

SEQ ID NO: 3656904 - RNA, 18 nt, Salmonella enterica enterica serovar Typhi
gaagccuggugcccaacc

SEQ ID NO: 3656905 - RNA, 17 nt, Salmonella enterica enterica serovar Typhi
gaagcgaauagcguauu

SEQ ID NO: 3656906 - RNA, 13 nt, Salmonella enterica enterica serovar Typhi
gaagcgaccggcg

SEQ ID NO: 3656907 - RNA, 17 nt, Salmonella enterica enterica serovar Typhi
gaagcgacgacacggcg

SEQ ID NO: 3656908 - RNA, 17 nt, Salmonella enterica enterica serovar Typhi
gaagcgaucaagacaaa

SEQ ID NO: 3656909 - RNA, 19 nt, Salmonella enterica enterica serovar Typhi
gaagcgauguauuuaucca

SEQ ID NO: 3656910 - RNA, 20 nt, Salmonella enterica enterica serovar Typhi
gaagcgauguauuuauccac

SEQ ID NO: 3656911 - RNA, 22 nt, Salmonella enterica enterica serovar Typhi
gaagcgauguauuuauccacgc

SEQ ID NO: 3656912 - RNA, 22 nt, Salmonella enterica enterica serovar Typhi
gaagcgauguuuacugcggcgc

SEQ ID NO: 3656913 - RNA, 17 nt, Salmonella enterica enterica serovar Typhi
gaagcgauuuauccacc

SEQ ID NO: 3656914 - RNA, 22 nt, Salmonella enterica enterica serovar Typhi
gaagcgcaaacggaucuuccac

SEQ ID NO: 3656915 - RNA, 21 nt, Salmonella enterica enterica serovar Typhi
gaagcgccuguuaucaggacg

SEQ ID NO: 3656916 - RNA, 21 nt, Salmonella enterica enterica serovar Typhi
gaagcgcgcgcacaacgugca

SEQ ID NO: 3656917 - RNA, 20 nt, Salmonella enterica enterica serovar Typhi
gaagcgcguuggcguuaccu

SEQ ID NO: 3656918 - RNA, 21 nt, Salmonella enterica enterica serovar Typhi
gaagcggaaaggacguucuuc

SEQ ID NO: 3656919 - RNA, 19 nt, Salmonella enterica enterica serovar Typhi
gaagcggcgcuauccggca

SEQ ID NO: 3656920 - RNA, 22 nt, Salmonella enterica enterica serovar Typhi
gaagcgggccaguauuaagcau

SEQ ID NO: 3656921 - RNA, 17 nt, Salmonella enterica enterica serovar Typhi
gaagcgguaguuaagcg

SEQ ID NO: 3656922 - RNA, 14 nt, Salmonella enterica enterica serovar Typhi
gaagcguaacagcg

SEQ ID NO: 3656923 - RNA, 17 nt, Salmonella enterica enterica serovar Typhi
gaagcguaacagcgcua

SEQ ID NO: 3656924 - RNA, 16 nt, Salmonella enterica enterica serovar Typhi
gaagcguuccgccacu

SEQ ID NO: 3656925 - RNA, 20 nt, Salmonella enterica enterica serovar Typhi
gaagcuacuugaucggcugg

SEQ ID NO: 3656926 - RNA, 21 nt, Salmonella enterica enterica serovar Typhi
gaagcuacuugaucggcuggc

SEQ ID NO: 3656927 - RNA, 22 nt, Salmonella enterica enterica serovar Typhi
gaagcucaugugcagcauccag

SEQ ID NO: 3656928 - RNA, 23 nt, Salmonella enterica enterica serovar Typhi
gaagcucaugugcagcauccagc

SEQ ID NO: 3656929 - RNA, 20 nt, Salmonella enterica enterica serovar Typhi
gaauagcggcuaaucaccac

SEQ ID NO: 3656930 - RNA, 15 nt, Salmonella enterica enterica serovar Typhi
gaauagcguauuuuu

SEQ ID NO: 3656931 - RNA, 17 nt, Salmonella enterica enterica serovar Typhi
gaauagcuuacuuucag

SEQ ID NO: 3656932 - RNA, 19 nt, Salmonella enterica enterica serovar Typhi
gaauaguuacggacaugcg

SEQ ID NO: 3656933 - RNA, 15 nt, Salmonella enterica enterica serovar Typhi
gaauaguuucaccuu

SEQ ID NO: 3656934 - RNA, 18 nt, Salmonella enterica enterica serovar Typhi
gaauauaguuagaaaaua

SEQ ID NO: 3656935 - RNA, 19 nt, Salmonella enterica enterica serovar Typhi
gaauauccccugacagagc

SEQ ID NO: 3656936 - RNA, 15 nt, Salmonella enterica enterica serovar Typhi
gaauauccgccgccc

SEQ ID NO: 3656937 - RNA, 17 nt, Salmonella enterica enterica serovar Typhi
gaauauccgguacacca

SEQ ID NO: 3656938 - RNA, 20 nt, Salmonella enterica enterica serovar Typhi
gaauauccgguacaccaacu

SEQ ID NO: 3656939 - RNA, 12 nt, Salmonella enterica enterica serovar Typhi
gaauaucgccaa

SEQ ID NO: 3656940 - RNA, 21 nt, Salmonella enterica enterica serovar Typhi
gaauaucggguauccauugcc

SEQ ID NO: 3656941 - RNA, 15 nt, Salmonella enterica enterica serovar Typhi
gaauaucuucccgac

SEQ ID NO: 3656942 - RNA, 15 nt, Salmonella enterica enterica serovar Typhi
gaauaucuuuguccu

SEQ ID NO: 3656943 - RNA, 23 nt, Salmonella enterica enterica serovar Typhi
gaauaugagauugugcuuuagcu

SEQ ID NO: 3656944 - RNA, 16 nt, Salmonella enterica enterica serovar Typhi
gaauaugauuuaaaaa

SEQ ID NO: 3656945 - RNA, 18 nt, Salmonella enterica enterica serovar Typhi
gaauaugauuuaaaaaag

SEQ ID NO: 3656946 - RNA, 13 nt, Salmonella enterica enterica serovar Typhi
gaauaugcagugc

SEQ ID NO: 3656947 - RNA, 22 nt, Salmonella enterica enterica serovar Typhi
gaauaugcagugcugcugccau

SEQ ID NO: 3656948 - RNA, 20 nt, Salmonella enterica enterica serovar Typhi
gaauaugccaggggaagccg

SEQ ID NO: 3656949 - RNA, 23 nt, Salmonella enterica enterica serovar Typhi
gaauauggaaaggaugcagcauc

SEQ ID NO: 3656950 - RNA, 15 nt, Salmonella enterica enterica serovar Typhi
gaauauuaaaguuca

SEQ ID NO: 3656951 - RNA, 16 nt, Salmonella enterica enterica serovar Typhi
gaauauucauuuccag

SEQ ID NO: 3656952 - RNA, 13 nt, Salmonella enterica enterica serovar Typhi
gaauauuuugcug

SEQ ID NO: 3656953 - RNA, 15 nt, Salmonella enterica enterica serovar Typhi
gaaucacauccgcca

SEQ ID NO: 3656954 - RNA, 17 nt, Salmonella enterica enterica serovar Typhi
gaaucacauccgccagc

SEQ ID NO: 3656955 - RNA, 20 nt, Salmonella enterica enterica serovar Typhi
gaaucacauccgccagcgcc

SEQ ID NO: 3656956 - RNA, 21 nt, Salmonella enterica enterica serovar Typhi
gaaucacauccgccagcgccu

SEQ ID NO: 3656957 - RNA, 11 nt, Salmonella enterica enterica serovar Typhi
gaaucagccag

SEQ ID NO: 3656958 - RNA, 18 nt, Salmonella enterica enterica serovar Typhi
gaaucaguaacacaauca

SEQ ID NO: 3656959 - RNA, 14 nt, Salmonella enterica enterica serovar Typhi
gaaucaguauccac

SEQ ID NO: 3656960 - RNA, 16 nt, Salmonella enterica enterica serovar Typhi
gaaucagugcaucuuc

SEQ ID NO: 3656961 - RNA, 20 nt, Salmonella enterica enterica serovar Typhi
gaaucagugcaucuucacug

SEQ ID NO: 3656962 - RNA, 14 nt, Salmonella enterica enterica serovar Typhi
gaaucaucacaauu

SEQ ID NO: 3656963 - RNA, 22 nt, Salmonella enterica enterica serovar Typhi
gaauccacuccguguugcugcc

SEQ ID NO: 3656964 - RNA, 12 nt, Salmonella enterica enterica serovar Typhi
gaauccagcagg

SEQ ID NO: 3656965 - RNA, 11 nt, Salmonella enterica enterica serovar Typhi
gaauccaggua

SEQ ID NO: 3656966 - RNA, 19 nt, Salmonella enterica enterica serovar Typhi
gaaucccauuagccacccc

SEQ ID NO: 3656967 - RNA, 14 nt, Salmonella enterica enterica serovar Typhi
gaauccccaucucc

SEQ ID NO: 3656968 - RNA, 21 nt, Salmonella enterica enterica serovar Typhi
gaaucccccugccacaaccgc

SEQ ID NO: 3656969 - RNA, 18 nt, Salmonella enterica enterica serovar Typhi
gaauccccggcuuccagc

SEQ ID NO: 3656970 - RNA, 20 nt, Salmonella enterica enterica serovar Typhi
gaaucccgucguagccacca

SEQ ID NO: 3656971 - RNA, 14 nt, Salmonella enterica enterica serovar Typhi
gaauccgucagguu

SEQ ID NO: 3656972 - RNA, 19 nt, Salmonella enterica enterica serovar Typhi
gaauccguugaucguccau

SEQ ID NO: 3656973 - RNA, 18 nt, Salmonella enterica enterica serovar Typhi
gaauccucccggaugcac

SEQ ID NO: 3656974 - RNA, 14 nt, Salmonella enterica enterica serovar Typhi
gaaucgccagcauc

SEQ ID NO: 3656975 - RNA, 16 nt, Salmonella enterica enterica serovar Typhi
gaaucgccagcaucgg

SEQ ID NO: 3656976 - RNA, 15 nt, Salmonella enterica enterica serovar Typhi
gaaucgccagucgca

SEQ ID NO: 3656977 - RNA, 19 nt, Salmonella enterica enterica serovar Typhi
gaaucgccagucgcagcaa

SEQ ID NO: 3656978 - RNA, 15 nt, Salmonella enterica enterica serovar Typhi
gaaucgccgucagug

SEQ ID NO: 3656979 - RNA, 15 nt, Salmonella enterica enterica serovar Typhi
gaaucgcgauaacgu

SEQ ID NO: 3656980 - RNA, 15 nt, Salmonella enterica enterica serovar Typhi
gaaucgcgauccagc

SEQ ID NO: 3656981 - RNA, 23 nt, Salmonella enterica enterica serovar Typhi
gaaucgcgguuucguggcgcugu

SEQ ID NO: 3656982 - RNA, 16 nt, Salmonella enterica enterica serovar Typhi
gaaucgcucacccgau

SEQ ID NO: 3656983 - RNA, 14 nt, Salmonella enterica enterica serovar Typhi
gaaucgcuuccugg

SEQ ID NO: 3656984 - RNA, 22 nt, Salmonella enterica enterica serovar Typhi
gaaucgugcaagcccaacuauu

SEQ ID NO: 3656985 - RNA, 15 nt, Salmonella enterica enterica serovar Typhi
gaaucguucgccagu

SEQ ID NO: 3656986 - RNA, 19 nt, Salmonella enterica enterica serovar Typhi
gaaucguucgccagugaca

SEQ ID NO: 3656987 - RNA, 18 nt, Salmonella enterica enterica serovar Typhi
gaaucuauuauuaaucug

SEQ ID NO: 3656988 - RNA, 12 nt, Salmonella enterica enterica serovar Typhi
gaaugaaacagu

SEQ ID NO: 3656989 - RNA, 21 nt, Salmonella enterica enterica serovar Typhi
gaaugacaaacgccaccgcca

SEQ ID NO: 3656990 - RNA, 17 nt, Salmonella enterica enterica serovar Typhi
gaaugacacauuucuau

SEQ ID NO: 3656991 - RNA, 23 nt, Salmonella enterica enterica serovar Typhi
gaaugacacauuucuauagagag

SEQ ID NO: 3656992 - RNA, 20 nt, Salmonella enterica enterica serovar Typhi
gaaugagggcgcgaauacuc

SEQ ID NO: 3656993 - RNA, 14 nt, Salmonella enterica enterica serovar Typhi
gaaugaggugcggu

SEQ ID NO: 3656994 - RNA, 15 nt, Salmonella enterica enterica serovar Typhi
gaaugcacuguuucu

SEQ ID NO: 3656995 - RNA, 23 nt, Salmonella enterica enterica serovar Typhi
gaaugccauauuuuuccagcgcc

SEQ ID NO: 3656996 - RNA, 18 nt, Salmonella enterica enterica serovar Typhi
gaaugcccacuccggcgu

SEQ ID NO: 3656997 - RNA, 24 nt, Salmonella enterica enterica serovar Typhi
gaaugccccagguuauagaccugc

SEQ ID NO: 3656998 - RNA, 18 nt, Salmonella enterica enterica serovar Typhi
gaaugcccggcggcgcga

SEQ ID NO: 3656999 - RNA, 17 nt, Salmonella enterica enterica serovar Typhi
gaaugcccuuuuccaga

SEQ ID NO: 3657000 - RNA, 18 nt, Salmonella enterica enterica serovar Typhi
gaaugccggauggcggcg

SEQ ID NO: 3657001 - RNA, 11 nt, Salmonella enterica enterica serovar Typhi
gaaugcgaaua

SEQ ID NO: 3657002 - RNA, 19 nt, Salmonella enterica enterica serovar Typhi
gaaugcgaauaaucgccgg

SEQ ID NO: 3657003 - RNA, 15 nt, Salmonella enterica enterica serovar Typhi
gaaugcgccgucagg

SEQ ID NO: 3657004 - RNA, 23 nt, Salmonella enterica enterica serovar Typhi
gaaugcgcgcgugaccccaggca

SEQ ID NO: 3657005 - RNA, 21 nt, Salmonella enterica enterica serovar Typhi
gaaugcgcgucaggccagggu

SEQ ID NO: 3657006 - RNA, 17 nt, Salmonella enterica enterica serovar Typhi
gaaugcguuuuuucacc

SEQ ID NO: 3657007 - RNA, 14 nt, Salmonella enterica enterica serovar Typhi
gaaugcuauaugca

SEQ ID NO: 3657008 - RNA, 17 nt, Salmonella enterica enterica serovar Typhi
gaaugcuauaugcaggc

SEQ ID NO: 3657009 - RNA, 17 nt, Salmonella enterica enterica serovar Typhi
gaaugcugacgcguuuu

SEQ ID NO: 3657010 - RNA, 23 nt, Salmonella enterica enterica serovar Typhi
gaaugcuucgccacgaccuacac

SEQ ID NO: 3657011 - RNA, 21 nt, Salmonella enterica enterica serovar Typhi
gaaugcuucuucgccagcuuc

SEQ ID NO: 3657012 - RNA, 12 nt, Salmonella enterica enterica serovar Typhi
gaauggagaagc

SEQ ID NO: 3657013 - RNA, 19 nt, Salmonella enterica enterica serovar Typhi
gaauggauaacgaaaaggg

SEQ ID NO: 3657014 - RNA, 18 nt, Salmonella enterica enterica serovar Typhi
gaauggcgauuaacgcau

SEQ ID NO: 3657015 - RNA, 18 nt, Salmonella enterica enterica serovar Typhi
gacacuugcaacucgcac

SEQ ID NO: 3657016 - RNA, 13 nt, Salmonella enterica enterica serovar Typhi
gacagaacaggau

SEQ ID NO: 3657017 - RNA, 18 nt, Salmonella enterica enterica serovar Typhi
gacagaagcugagaaaag

SEQ ID NO: 3657018 - RNA, 17 nt, Salmonella enterica enterica serovar Typhi
gacagauaacaccagcg

SEQ ID NO: 3657019 - RNA, 19 nt, Salmonella enterica enterica serovar Typhi
gacagaucgguuuaucccc

SEQ ID NO: 3657020 - RNA, 24 nt, Salmonella enterica enterica serovar Typhi
gacagaugcagguucccgcccugc

SEQ ID NO: 3657021 - RNA, 17 nt, Salmonella enterica enterica serovar Typhi
gacagauuaucagcgag

SEQ ID NO: 3657022 - RNA, 16 nt, Salmonella enterica enterica serovar Typhi
gacagcaagauuucaa

SEQ ID NO: 3657023 - RNA, 18 nt, Salmonella enterica enterica serovar Typhi
gacagcaaguugcgccac

SEQ ID NO: 3657024 - RNA, 17 nt, Salmonella enterica enterica serovar Typhi
gacagcaauaucagcca

SEQ ID NO: 3657025 - RNA, 14 nt, Salmonella enterica enterica serovar Typhi
gacagcaaugagca

SEQ ID NO: 3657026 - RNA, 17 nt, Salmonella enterica enterica serovar Typhi
gacagcaccgccgggaa

SEQ ID NO: 3657027 - RNA, 18 nt, Salmonella enterica enterica serovar Typhi
gacagcauuuuucacagu

SEQ ID NO: 3657028 - RNA, 19 nt, Salmonella enterica enterica serovar Typhi
gacagcccccauaaauaau

SEQ ID NO: 3657029 - RNA, 20 nt, Salmonella enterica enterica serovar Typhi
gacagcccggcguguuucag

SEQ ID NO: 3657030 - RNA, 15 nt, Salmonella enterica enterica serovar Typhi
gacagccgacggcaa

SEQ ID NO: 3657031 - RNA, 22 nt, Salmonella enterica enterica serovar Typhi
gacagcgcccaacgcuucacaa

SEQ ID NO: 3657032 - RNA, 21 nt, Salmonella enterica enterica serovar Typhi
gacagcgccugaaaagagcga

SEQ ID NO: 3657033 - RNA, 22 nt, Salmonella enterica enterica serovar Typhi
gacagcgcgcgcgacggcagcc

SEQ ID NO: 3657034 - RNA, 18 nt, Salmonella enterica enterica serovar Typhi
gacagcggggugugaagu

SEQ ID NO: 3657035 - RNA, 16 nt, Salmonella enterica enterica serovar Typhi
gacagcguaaugcgcc

SEQ ID NO: 3657036 - RNA, 14 nt, Salmonella enterica enterica serovar Typhi
gacaggacgccagc

SEQ ID NO: 3657037 - RNA, 16 nt, Salmonella enterica enterica serovar Typhi
gacaggcgcagaguga

SEQ ID NO: 3657038 - RNA, 20 nt, Salmonella enterica enterica serovar Typhi
gacaggcggccgcuuacugu

SEQ ID NO: 3657039 - RNA, 20 nt, Salmonella enterica enterica serovar Typhi
gacagggcgugaaccagcau

SEQ ID NO: 3657040 - RNA, 22 nt, Salmonella enterica enterica serovar Typhi
gacagggcgugaaccagcaucc

SEQ ID NO: 3657041 - RNA, 20 nt, Salmonella enterica enterica serovar Typhi
gacaggguuugccagcacca

SEQ ID NO: 3657042 - RNA, 14 nt, Salmonella enterica enterica serovar Typhi
gacaggugaccagg

SEQ ID NO: 3657043 - RNA, 20 nt, Salmonella enterica enterica serovar Typhi
gacaggugcgcuguggucgu

SEQ ID NO: 3657044 - RNA, 13 nt, Salmonella enterica enterica serovar Typhi
gacagugaugaau

SEQ ID NO: 3657045 - RNA, 14 nt, Salmonella enterica enterica serovar Typhi
gacagugcgccaua

SEQ ID NO: 3657046 - RNA, 13 nt, Salmonella enterica enterica serovar Typhi
gacaguggcuuua

SEQ ID NO: 3657047 - RNA, 13 nt, Salmonella enterica enterica serovar Typhi
gacaguucccggc

SEQ ID NO: 3657048 - RNA, 18 nt, Salmonella enterica enterica serovar Typhi
gacauaaacgccucaucc

SEQ ID NO: 3657049 - RNA, 15 nt, Salmonella enterica enterica serovar Typhi
gacauaagaguccau

SEQ ID NO: 3657050 - RNA, 15 nt, Salmonella enterica enterica serovar Typhi
gacauaaucaugaac

SEQ ID NO: 3657051 - RNA, 13 nt, Salmonella enterica enterica serovar Typhi
gacauacaggaau

SEQ ID NO: 3657052 - RNA, 17 nt, Salmonella enterica enterica serovar Typhi
gacauagcauaauaaug

SEQ ID NO: 3657053 - RNA, 22 nt, Salmonella enterica enterica serovar Typhi
gacauagucgucuauuuccgcu

SEQ ID NO: 3657054 - RNA, 17 nt, Salmonella enterica enterica serovar Typhi
gacaucagccagccgcc

SEQ ID NO: 3657055 - RNA, 20 nt, Salmonella enterica enterica serovar Typhi
gacaucauccccggcaggcu

SEQ ID NO: 3657056 - RNA, 13 nt, Salmonella enterica enterica serovar Typhi
gacauccccgccg

SEQ ID NO: 3657057 - RNA, 23 nt, Salmonella enterica enterica serovar Typhi
gacauccucuucauaacgacauu

SEQ ID NO: 3657058 - RNA, 21 nt, Salmonella enterica enterica serovar Typhi
gacaucgcucccggcaccagg

SEQ ID NO: 3657059 - RNA, 13 nt, Salmonella enterica enterica serovar Typhi
gacaucggcacgc

SEQ ID NO: 3657060 - RNA, 16 nt, Salmonella enterica enterica serovar Typhi
gacaucguguauacca

SEQ ID NO: 3657061 - RNA, 17 nt, Salmonella enterica enterica serovar Typhi
gacaucucaucggcuuu

SEQ ID NO: 3657062 - RNA, 14 nt, Salmonella enterica enterica serovar Typhi
gacaugaccgcaca

SEQ ID NO: 3657063 - RNA, 12 nt, Salmonella enterica enterica serovar Typhi
gacaugcagauc

SEQ ID NO: 3657064 - RNA, 23 nt, Salmonella enterica enterica serovar Typhi
gacaugcuguugaaacgccguuu

SEQ ID NO: 3657065 - RNA, 17 nt, Salmonella enterica enterica serovar Typhi
gacauggcaauggcuuc

SEQ ID NO: 3657066 - RNA, 18 nt, Salmonella enterica enterica serovar Typhi
gacauggcggucgccaua

SEQ ID NO: 3657067 - RNA, 23 nt, Salmonella enterica enterica serovar Typhi
gacauguccgacgacaagcagaa

SEQ ID NO: 3657068 - RNA, 21 nt, Salmonella enterica enterica serovar Typhi
gacauguccgauagcauuauu

SEQ ID NO: 3657069 - RNA, 19 nt, Salmonella enterica enterica serovar Typhi
gacauuaacaaugccuuau

SEQ ID NO: 3657070 - RNA, 12 nt, Salmonella enterica enterica serovar Typhi
gacauuacccau

SEQ ID NO: 3657071 - RNA, 12 nt, Salmonella enterica enterica serovar Typhi
gacauucccugc

SEQ ID NO: 3657072 - RNA, 16 nt, Salmonella enterica enterica serovar Typhi
gacauucugacggccc

SEQ ID NO: 3657073 - RNA, 19 nt, Salmonella enterica enterica serovar Typhi
gacauuguucuaaacguuc

SEQ ID NO: 3657074 - RNA, 20 nt, Salmonella enterica enterica serovar Typhi
gacauuuaucuuccggcauc

SEQ ID NO: 3657075 - RNA, 23 nt, Salmonella enterica enterica serovar Typhi
gaccaaaauggcaaguaaaauag

SEQ ID NO: 3657076 - RNA, 20 nt, Salmonella enterica enterica serovar Typhi
gaccaaaugguugguauugc

SEQ ID NO: 3657077 - RNA, 15 nt, Salmonella enterica enterica serovar Typhi
gaccaacaacagaua

SEQ ID NO: 3657078 - RNA, 18 nt, Salmonella enterica enterica serovar Typhi
gaccaacaccagccgcau

SEQ ID NO: 3657079 - RNA, 15 nt, Salmonella enterica enterica serovar Typhi
gaccaacguuuuucc

SEQ ID NO: 3657080 - RNA, 17 nt, Salmonella enterica enterica serovar Typhi
gaccaacguuuuuccuu

SEQ ID NO: 3657081 - RNA, 18 nt, Salmonella enterica enterica serovar Typhi
gaccaacuuuuguagaga

SEQ ID NO: 3657082 - RNA, 13 nt, Salmonella enterica enterica serovar Typhi
gaccaagcgucag

SEQ ID NO: 3657083 - RNA, 22 nt, Salmonella enterica enterica serovar Typhi
gaccaauaaaggucggcugccc

SEQ ID NO: 3657084 - RNA, 12 nt, Salmonella enterica enterica serovar Typhi
gaccaauauccg

SEQ ID NO: 3657085 - RNA, 16 nt, Salmonella enterica enterica serovar Typhi
gaccaauauccgcagg

SEQ ID NO: 3657086 - RNA, 20 nt, Salmonella enterica enterica serovar Typhi
gaccaaugacgcuauccgca

SEQ ID NO: 3657087 - RNA, 20 nt, Salmonella enterica enterica serovar Typhi
gaccaaugcuggcaggcgcg

SEQ ID NO: 3657088 - RNA, 22 nt, Salmonella enterica enterica serovar Typhi
gaccacaccgucaacaucaucc

SEQ ID NO: 3657089 - RNA, 15 nt, Salmonella enterica enterica serovar Typhi
gaccaccauauucgc

SEQ ID NO: 3657090 - RNA, 13 nt, Salmonella enterica enterica serovar Typhi
gaccacccgcgac

SEQ ID NO: 3657091 - RNA, 16 nt, Salmonella enterica enterica serovar Typhi
gaccaccgcaucggca

SEQ ID NO: 3657092 - RNA, 13 nt, Salmonella enterica enterica serovar Typhi
gaccaccgcgcua

SEQ ID NO: 3657093 - RNA, 15 nt, Salmonella enterica enterica serovar Typhi
gaccacgaaucagga

SEQ ID NO: 3657094 - RNA, 16 nt, Salmonella enterica enterica serovar Typhi
gaccacgaaucaggau

SEQ ID NO: 3657095 - RNA, 18 nt, Salmonella enterica enterica serovar Typhi
gaccacgacgccggagac

SEQ ID NO: 3657096 - RNA, 21 nt, Salmonella enterica enterica serovar Typhi
gaccacggccacagccauccg

SEQ ID NO: 3657097 - RNA, 14 nt, Salmonella enterica enterica serovar Typhi
gaccagauacuuca

SEQ ID NO: 3657098 - RNA, 17 nt, Salmonella enterica enterica serovar Typhi
gaccagaugcagcaacg

SEQ ID NO: 3657099 - RNA, 17 nt, Salmonella enterica enterica serovar Typhi
gaccagcaguuccggcg

SEQ ID NO: 3657100 - RNA, 14 nt, Salmonella enterica enterica serovar Typhi
gaccagcaucagaa

SEQ ID NO: 3657101 - RNA, 21 nt, Salmonella enterica enterica serovar Typhi
gaccguggaucucgucgccgg

SEQ ID NO: 3657102 - RNA, 15 nt, Salmonella enterica enterica serovar Typhi
gaccguuucaaagaa

SEQ ID NO: 3657103 - RNA, 20 nt, Salmonella enterica enterica serovar Typhi
gaccguuuucaacgccgcgc

SEQ ID NO: 3657104 - RNA, 14 nt, Salmonella enterica enterica serovar Typhi
gaccuacaggccga

SEQ ID NO: 3657105 - RNA, 12 nt, Salmonella enterica enterica serovar Typhi
gaccucaagaau

SEQ ID NO: 3657106 - RNA, 21 nt, Salmonella enterica enterica serovar Typhi
gaccucauccaucagcgcggg

SEQ ID NO: 3657107 - RNA, 13 nt, Salmonella enterica enterica serovar Typhi
gaccuccgcguac

SEQ ID NO: 3657108 - RNA, 18 nt, Salmonella enterica enterica serovar Typhi
gaccucuuuaucuuuuag

SEQ ID NO: 3657109 - RNA, 13 nt, Salmonella enterica enterica serovar Typhi
gaccugaucggcc

SEQ ID NO: 3657110 - RNA, 20 nt, Salmonella enterica enterica serovar Typhi
gaccugcagcuccgcaauuu

SEQ ID NO: 3657111 - RNA, 16 nt, Salmonella enterica enterica serovar Typhi
gaccuguagaugaaac

SEQ ID NO: 3657112 - RNA, 18 nt, Salmonella enterica enterica serovar Typhi
gaccuucaacccagcagc

SEQ ID NO: 3657113 - RNA, 22 nt, Salmonella enterica enterica serovar Typhi
gaccuucaacccagcagcagau

SEQ ID NO: 3657114 - RNA, 17 nt, Salmonella enterica enterica serovar Typhi
gaccuucaucucuuugc

SEQ ID NO: 3657115 - RNA, 13 nt, Salmonella enterica enterica serovar Typhi
gacgaacaacauc

SEQ ID NO: 3657116 - RNA, 15 nt, Salmonella enterica enterica serovar Typhi
gacgaacggccugau

SEQ ID NO: 3657117 - RNA, 13 nt, Salmonella enterica enterica serovar Typhi
gacgaauaaggaa

SEQ ID NO: 3657118 - RNA, 18 nt, Salmonella enterica enterica serovar Typhi
gacgaauaccugaaagag

SEQ ID NO: 3657119 - RNA, 13 nt, Salmonella enterica enterica serovar Typhi
gacgaaucagcga

SEQ ID NO: 3657120 - RNA, 18 nt, Salmonella enterica enterica serovar Typhi
gacgaauccuauacccaa

SEQ ID NO: 3657121 - RNA, 17 nt, Salmonella enterica enterica serovar Typhi
gacgacaucuuuuccug

SEQ ID NO: 3657122 - RNA, 21 nt, Salmonella enterica enterica serovar Typhi
gacgacgcagcuucgccgcgu

SEQ ID NO: 3657123 - RNA, 17 nt, Salmonella enterica enterica serovar Typhi
gacgacgccaggcgguc

SEQ ID NO: 3657124 - RNA, 18 nt, Salmonella enterica enterica serovar Typhi
gacgacgguuaaaaagua

SEQ ID NO: 3657125 - RNA, 18 nt, Salmonella enterica enterica serovar Typhi
gacgacuucacccgcggg

SEQ ID NO: 3657126 - RNA, 19 nt, Salmonella enterica enterica serovar Typhi
gacgagcagguuacucuuc

SEQ ID NO: 3657127 - RNA, 14 nt, Salmonella enterica enterica serovar Typhi
gacgagcgaaaaac

SEQ ID NO: 3657128 - RNA, 16 nt, Salmonella enterica enterica serovar Typhi
gacgagcgaaaaacug

SEQ ID NO: 3657129 - RNA, 21 nt, Salmonella enterica enterica serovar Typhi
gacgagcgcgucagcgccucc

SEQ ID NO: 3657130 - RNA, 14 nt, Salmonella enterica enterica serovar Typhi
gacgauaaaaaaag

SEQ ID NO: 3657131 - RNA, 13 nt, Salmonella enterica enterica serovar Typhi
gacgauaaccgga

SEQ ID NO: 3657132 - RNA, 15 nt, Salmonella enterica enterica serovar Typhi
gacgaucagcgccac

SEQ ID NO: 3657133 - RNA, 16 nt, Salmonella enterica enterica serovar Typhi
gacgauucguaccauc

SEQ ID NO: 3657134 - RNA, 16 nt, Salmonella enterica enterica serovar Typhi
gacgcacaaucgccgu

SEQ ID NO: 3657135 - RNA, 14 nt, Salmonella enterica enterica serovar Typhi
gacgcacaggcgcg

SEQ ID NO: 3657136 - RNA, 13 nt, Salmonella enterica enterica serovar Typhi
gacgcaccagcca

SEQ ID NO: 3657137 - RNA, 21 nt, Salmonella enterica enterica serovar Typhi
gacgcagcaguuccccgccgc

SEQ ID NO: 3657138 - RNA, 12 nt, Salmonella enterica enterica serovar Typhi
gacgcaggccgg

SEQ ID NO: 3657139 - RNA, 17 nt, Salmonella enterica enterica serovar Typhi
gacgcaucuuuuucccg

SEQ ID NO: 3657140 - RNA, 22 nt, Salmonella enterica enterica serovar Typhi
gacgcauugagacaugccgcca

SEQ ID NO: 3657141 - RNA, 23 nt, Salmonella enterica enterica serovar Typhi
gacgccaccggguuaaagcccug

SEQ ID NO: 3657142 - RNA, 13 nt, Salmonella enterica enterica serovar Typhi
gacgccagccagc

SEQ ID NO: 3657143 - RNA, 12 nt, Salmonella enterica enterica serovar Typhi
gacgccagccga

SEQ ID NO: 3657144 - RNA, 14 nt, Salmonella enterica enterica serovar Typhi
gacgccagcgggug

SEQ ID NO: 3657145 - RNA, 12 nt, Salmonella enterica enterica serovar Typhi
gacgccaggcag

SEQ ID NO: 3657146 - RNA, 12 nt, Salmonella enterica enterica serovar Typhi
gacgccaggcgc

SEQ ID NO: 3657147 - RNA, 14 nt, Salmonella enterica enterica serovar Typhi
gacgcccaaccagu

SEQ ID NO: 3657148 - RNA, 14 nt, Salmonella enterica enterica serovar Typhi
gacgcccaucagca

SEQ ID NO: 3657149 - RNA, 22 nt, Salmonella enterica enterica serovar Typhi
gacgccgaaccuggcgggcagc

SEQ ID NO: 3657150 - RNA, 17 nt, Salmonella enterica enterica serovar Typhi
gacgccgacauaagcug

SEQ ID NO: 3657151 - RNA, 14 nt, Salmonella enterica enterica serovar Typhi
gacgccgccauccg

SEQ ID NO: 3657152 - RNA, 18 nt, Salmonella enterica enterica serovar Typhi
gacgccgggaaauuuuuc

SEQ ID NO: 3657153 - RNA, 12 nt, Salmonella enterica enterica serovar Typhi
gacgccugcaua

SEQ ID NO: 3657154 - RNA, 22 nt, Salmonella enterica enterica serovar Typhi
gacgccugcauaaugccggauc

SEQ ID NO: 3657155 - RNA, 13 nt, Salmonella enterica enterica serovar Typhi
gacgccuuccacu

SEQ ID NO: 3657156 - RNA, 14 nt, Salmonella enterica enterica serovar Typhi
gacgcgcaggccgu

SEQ ID NO: 3657157 - RNA, 17 nt, Salmonella enterica enterica serovar Typhi
gacgcgccacuuccagc

SEQ ID NO: 3657158 - RNA, 15 nt, Salmonella enterica enterica serovar Typhi
gacgcgccagcggau

SEQ ID NO: 3657159 - RNA, 21 nt, Salmonella enterica enterica serovar Typhi
gacgcgcgagaacugcugcau

SEQ ID NO: 3657160 - RNA, 22 nt, Salmonella enterica enterica serovar Typhi
gacgcggaacuggugaaacagg

SEQ ID NO: 3657161 - RNA, 15 nt, Salmonella enterica enterica serovar Typhi
gacgcggcuuauccg

SEQ ID NO: 3657162 - RNA, 22 nt, Salmonella enterica enterica serovar Typhi
gacgcggugaaaggcuugcagg

SEQ ID NO: 3657163 - RNA, 16 nt, Salmonella enterica enterica serovar Typhi
gacgcgguuaucucua

SEQ ID NO: 3657164 - RNA, 20 nt, Salmonella enterica enterica serovar Typhi
gacgcgguuaucucuauuga

SEQ ID NO: 3657165 - RNA, 23 nt, Salmonella enterica enterica serovar Typhi
gacgcguagcgucuuauccggcc

SEQ ID NO: 3657166 - RNA, 17 nt, Salmonella enterica enterica serovar Typhi
gacgcguaggccggaua

SEQ ID NO: 3657167 - RNA, 23 nt, Salmonella enterica enterica serovar Typhi
gacgcgucauaaugcccagcgcc

SEQ ID NO: 3657168 - RNA, 19 nt, Salmonella enterica enterica serovar Typhi
gacgcguguugccggacca

SEQ ID NO: 3657169 - RNA, 14 nt, Salmonella enterica enterica serovar Typhi
gacgcguuaauauc

SEQ ID NO: 3657170 - RNA, 19 nt, Salmonella enterica enterica serovar Typhi
gacgcguuucacaucgcca

SEQ ID NO: 3657171 - RNA, 17 nt, Salmonella enterica enterica serovar Typhi
gacgcguuuuccagcac

SEQ ID NO: 3657172 - RNA, 18 nt, Salmonella enterica enterica serovar Typhi
gacgcuaacgcuuauccg

SEQ ID NO: 3657173 - RNA, 15 nt, Salmonella enterica enterica serovar Typhi
gacgcuacgcgucgc

SEQ ID NO: 3657174 - RNA, 20 nt, Salmonella enterica enterica serovar Typhi
gacgcuacugugggccguuc

SEQ ID NO: 3657175 - RNA, 13 nt, Salmonella enterica enterica serovar Typhi
gacgcuauuuuuc

SEQ ID NO: 3657176 - RNA, 14 nt, Salmonella enterica enterica serovar Typhi
gacgcuauuuuuca

SEQ ID NO: 3657177 - RNA, 15 nt, Salmonella enterica enterica serovar Typhi
gacgcuccaucacgg

SEQ ID NO: 3657178 - RNA, 20 nt, Salmonella enterica enterica serovar Typhi
gacgcucgacgaagccuucg

SEQ ID NO: 3657179 - RNA, 20 nt, Salmonella enterica enterica serovar Typhi
gacgcucgacguccagcgcg

SEQ ID NO: 3657180 - RNA, 15 nt, Salmonella enterica enterica serovar Typhi
gacgcucuuccucaa

SEQ ID NO: 3657181 - RNA, 12 nt, Salmonella enterica enterica serovar Typhi
gacgcugccaca

SEQ ID NO: 3657182 - RNA, 19 nt, Salmonella enterica enterica serovar Typhi
gacgcugcgccuggaugaa

SEQ ID NO: 3657183 - RNA, 19 nt, Salmonella enterica enterica serovar Typhi
gacgcugcgcuuauccggc

SEQ ID NO: 3657184 - RNA, 20 nt, Salmonella enterica enterica serovar Typhi
gacgcugcgcuuauccggcc

SEQ ID NO: 3657185 - RNA, 16 nt, Salmonella enterica enterica serovar Typhi
gacgcuguucaaagcc

SEQ ID NO: 3657186 - RNA, 20 nt, Salmonella enterica enterica serovar Typhi
gacgcuguucaaagccgcca

SEQ ID NO: 3657187 - RNA, 10 nt, Salmonella enterica enterica serovar Typhi
gacuccguca

SEQ ID NO: 3657188 - RNA, 18 nt, Salmonella enterica enterica serovar Typhi
gacuccuuuuaccggcga

SEQ ID NO: 3657189 - RNA, 22 nt, Salmonella enterica enterica serovar Typhi
gacucgccguuuuaucgcccgg

SEQ ID NO: 3657190 - RNA, 23 nt, Salmonella enterica enterica serovar Typhi
gacucgcuggacauuaagcguaa

SEQ ID NO: 3657191 - RNA, 18 nt, Salmonella enterica enterica serovar Typhi
gacucucaaugcccaucu

SEQ ID NO: 3657192 - RNA, 19 nt, Salmonella enterica enterica serovar Typhi
gacucugaagcgggaaagc

SEQ ID NO: 3657193 - RNA, 15 nt, Salmonella enterica enterica serovar Typhi
gacucugacgccggu

SEQ ID NO: 3657194 - RNA, 19 nt, Salmonella enterica enterica serovar Typhi
gacucuguggccgcgcaug

SEQ ID NO: 3657195 - RNA, 13 nt, Salmonella enterica enterica serovar Typhi
gacucuuguuucu

SEQ ID NO: 3657196 - RNA, 14 nt, Salmonella enterica enterica serovar Typhi
gacugaaaaucaaa

SEQ ID NO: 3657197 - RNA, 11 nt, Salmonella enterica enterica serovar Typhi
gacugaacaua

SEQ ID NO: 3657198 - RNA, 23 nt, Salmonella enterica enterica serovar Typhi
gacugauaaagcuuucaucuuua

SEQ ID NO: 3657199 - RNA, 16 nt, Salmonella enterica enterica serovar Typhi
gacugaugcuggcgcc

SEQ ID NO: 3657200 - RNA, 17 nt, Salmonella enterica enterica serovar Typhi
gacugauuuaucaccca

SEQ ID NO: 3657201 - RNA, 15 nt, Salmonella enterica enterica serovar Typhi
gacugcacuuccugc

SEQ ID NO: 3657202 - RNA, 14 nt, Salmonella enterica enterica serovar Typhi
gacugccagguaau

SEQ ID NO: 3657203 - RNA, 14 nt, Salmonella enterica enterica serovar Typhi
gacugccgcagacc

SEQ ID NO: 3657204 - RNA, 20 nt, Salmonella enterica enterica serovar Typhi
gacugccguauaauccagcu

SEQ ID NO: 3657205 - RNA, 23 nt, Salmonella enterica enterica serovar Typhi
gacuggcaccacgaccagacugg

SEQ ID NO: 3657206 - RNA, 18 nt, Salmonella enterica enterica serovar Typhi
gacuggcgaccgccacca

SEQ ID NO: 3657207 - RNA, 21 nt, Salmonella enterica enterica serovar Typhi
gacuggcgccgucacguucgg

SEQ ID NO: 3657208 - RNA, 10 nt, Salmonella enterica enterica serovar Typhi
gacuggcuga

SEQ ID NO: 3657209 - RNA, 14 nt, Salmonella enterica enterica serovar Typhi
gacuggucgcccgg

SEQ ID NO: 3657210 - RNA, 22 nt, Salmonella enterica enterica serovar Typhi
gacugguuuuucgccgaccauc

SEQ ID NO: 3657211 - RNA, 18 nt, Salmonella enterica enterica serovar Typhi
gacuguaaaucugccguc

SEQ ID NO: 3657212 - RNA, 21 nt, Salmonella enterica enterica serovar Typhi
gacuguaaaucugccgucauc

SEQ ID NO: 3657213 - RNA, 20 nt, Salmonella enterica enterica serovar Typhi
gacuguagauaccuacuuua

SEQ ID NO: 3657214 - RNA, 19 nt, Salmonella enterica enterica serovar Typhi
gacugucgaaaccagcaua

SEQ ID NO: 3657215 - RNA, 22 nt, Salmonella enterica enterica serovar Typhi
gacugucugaaggcguaugaau

SEQ ID NO: 3657216 - RNA, 18 nt, Salmonella enterica enterica serovar Typhi
gacugucuuaucaggccu

SEQ ID NO: 3657217 - RNA, 18 nt, Salmonella enterica enterica serovar Typhi
gacugucuuguuuuucug

SEQ ID NO: 3657218 - RNA, 16 nt, Salmonella enterica enterica serovar Typhi
gacugugauggcgguc

SEQ ID NO: 3657219 - RNA, 17 nt, Salmonella enterica enterica serovar Typhi
gacuguucacauccagc

SEQ ID NO: 3657220 - RNA, 17 nt, Salmonella enterica enterica serovar Typhi
gacuguucagcugacaa

SEQ ID NO: 3657221 - RNA, 17 nt, Salmonella enterica enterica serovar Typhi
gacuuacggaaaaaugu

SEQ ID NO: 3657222 - RNA, 17 nt, Salmonella enterica enterica serovar Typhi
gacuuagcccuggccaa

SEQ ID NO: 3657223 - RNA, 18 nt, Salmonella enterica enterica serovar Typhi
gacuuaucgaccuuuucc

SEQ ID NO: 3657224 - RNA, 16 nt, Salmonella enterica enterica serovar Typhi
gacuuauugcaccauu

SEQ ID NO: 3657225 - RNA, 19 nt, Salmonella enterica enterica serovar Typhi
gacuuauuugcucaguuca

SEQ ID NO: 3657226 - RNA, 12 nt, Salmonella enterica enterica serovar Typhi
gacuucaacgcc

SEQ ID NO: 3657227 - RNA, 20 nt, Salmonella enterica enterica serovar Typhi
gacuucacacugugguuucu

SEQ ID NO: 3657228 - RNA, 11 nt, Salmonella enterica enterica serovar Typhi
gacuucaccuc

SEQ ID NO: 3657229 - RNA, 12 nt, Salmonella enterica enterica serovar Typhi
gacuucucccuc

SEQ ID NO: 3657230 - RNA, 21 nt, Salmonella enterica enterica serovar Typhi
gacuucugcucgguaaaaagu

SEQ ID NO: 3657231 - RNA, 11 nt, Salmonella enterica enterica serovar Typhi
gacuucuucag

SEQ ID NO: 3657232 - RNA, 20 nt, Salmonella enterica enterica serovar Typhi
gacuuuaaacgucaugcugu

SEQ ID NO: 3657233 - RNA, 22 nt, Salmonella enterica enterica serovar Typhi
gacuuuaucuuuaccagggaau

SEQ ID NO: 3657234 - RNA, 21 nt, Salmonella enterica enterica serovar Typhi
gacuuugcccuuuuugcauuc

SEQ ID NO: 3657235 - RNA, 17 nt, Salmonella enterica enterica serovar Typhi
gacuuuuugaaaucacg

SEQ ID NO: 3657236 - RNA, 20 nt, Salmonella enterica enterica serovar Typhi
gacuuuuuugccuuucagau

SEQ ID NO: 3657237 - RNA, 17 nt, Salmonella enterica enterica serovar Typhi
gagaaaaaaauccagua

SEQ ID NO: 3657238 - RNA, 22 nt, Salmonella enterica enterica serovar Typhi
gagaaaaacgaccaggaucaga

SEQ ID NO: 3657239 - RNA, 20 nt, Salmonella enterica enterica serovar Typhi
gagaaaaagcaauaauccgc

SEQ ID NO: 3657240 - RNA, 19 nt, Salmonella enterica enterica serovar Typhi
gagaaaagggcgcaccaaa

SEQ ID NO: 3657241 - RNA, 21 nt, Salmonella enterica enterica serovar Typhi
gagaaaauaacaauauuaaau

SEQ ID NO: 3657242 - RNA, 12 nt, Salmonella enterica enterica serovar Typhi
gagaaaauaccg

SEQ ID NO: 3657243 - RNA, 19 nt, Salmonella enterica enterica serovar Typhi
gagaaaauaccgcacauca

SEQ ID NO: 3657244 - RNA, 15 nt, Salmonella enterica enterica serovar Typhi
gagaaaauagaggaa

SEQ ID NO: 3657245 - RNA, 22 nt, Salmonella enterica enterica serovar Typhi
gagaaaauuacgcccaucagcc

SEQ ID NO: 3657246 - RNA, 13 nt, Salmonella enterica enterica serovar Typhi
gagaaacauacug

SEQ ID NO: 3657247 - RNA, 23 nt, Salmonella enterica enterica serovar Typhi
gagaaagcguugccguaggcaac

SEQ ID NO: 3657248 - RNA, 11 nt, Salmonella enterica enterica serovar Typhi
gagaaaucaac

SEQ ID NO: 3657249 - RNA, 20 nt, Salmonella enterica enterica serovar Typhi
gagaaaucaacgaaaucaga

SEQ ID NO: 3657250 - RNA, 23 nt, Salmonella enterica enterica serovar Typhi
gagaaaucaacgaaaucagagac

SEQ ID NO: 3657251 - RNA, 23 nt, Salmonella enterica enterica serovar Typhi
gagaaauuuaggucaaaaaagcg

SEQ ID NO: 3657252 - RNA, 16 nt, Salmonella enterica enterica serovar Typhi
gagaacagguaguuac

SEQ ID NO: 3657253 - RNA, 14 nt, Salmonella enterica enterica serovar Typhi
gagaaccugaacaa

SEQ ID NO: 3657254 - RNA, 20 nt, Salmonella enterica enterica serovar Typhi
gagaacgccgggccugccag

SEQ ID NO: 3657255 - RNA, 21 nt, Salmonella enterica enterica serovar Typhi
gagaacguugccgcaggcaac

SEQ ID NO: 3657256 - RNA, 17 nt, Salmonella enterica enterica serovar Typhi
gagaacugcugcauccg

SEQ ID NO: 3657257 - RNA, 17 nt, Salmonella enterica enterica serovar Typhi
gagaagaauuccgauga

SEQ ID NO: 3657258 - RNA, 16 nt, Salmonella enterica enterica serovar Typhi
gagaagcgcgccugcc

SEQ ID NO: 3657259 - RNA, 18 nt, Salmonella enterica enterica serovar Typhi
gagaauaacgaugaugaa

SEQ ID NO: 3657260 - RNA, 19 nt, Salmonella enterica enterica serovar Typhi
gagaaucaccuggcagccg

SEQ ID NO: 3657261 - RNA, 16 nt, Salmonella enterica enterica serovar Typhi
gagaauuauucguguu

SEQ ID NO: 3657262 - RNA, 22 nt, Salmonella enterica enterica serovar Typhi
gagaauuauucguguuucgacc

SEQ ID NO: 3657263 - RNA, 13 nt, Salmonella enterica enterica serovar Typhi
gagaauucugcgc

SEQ ID NO: 3657264 - RNA, 13 nt, Salmonella enterica enterica serovar Typhi
gagaauuuccagu

SEQ ID NO: 3657265 - RNA, 13 nt, Salmonella enterica enterica serovar Typhi
gagaauuuuuagc

SEQ ID NO: 3657266 - RNA, 21 nt, Salmonella enterica enterica serovar Typhi
gagaauuuuuagcgugccgac

SEQ ID NO: 3657267 - RNA, 22 nt, Salmonella enterica enterica serovar Typhi
gagacaaauaacuuuccugccu

SEQ ID NO: 3657268 - RNA, 16 nt, Salmonella enterica enterica serovar Typhi
gagacagagaaccuga

SEQ ID NO: 3657269 - RNA, 17 nt, Salmonella enterica enterica serovar Typhi
gagacagagaaccugaa

SEQ ID NO: 3657270 - RNA, 17 nt, Salmonella enterica enterica serovar Typhi
gagacaugccgccagac

SEQ ID NO: 3657271 - RNA, 17 nt, Salmonella enterica enterica serovar Typhi
gagacauuaguggcgac

SEQ ID NO: 3657272 - RNA, 21 nt, Salmonella enterica enterica serovar Typhi
gagccuaaaacauuaaucgcc

SEQ ID NO: 3657273 - RNA, 22 nt, Salmonella enterica enterica serovar Typhi
gagccuuacaggcgcaucagaa

SEQ ID NO: 3657274 - RNA, 15 nt, Salmonella enterica enterica serovar Typhi
gagccuugcgggaua

SEQ ID NO: 3657275 - RNA, 20 nt, Salmonella enterica enterica serovar Typhi
gagcgaaaaggccuggcuga

SEQ ID NO: 3657276 - RNA, 23 nt, Salmonella enterica enterica serovar Typhi
gagcgaacggcuuuccagcagcc

SEQ ID NO: 3657277 - RNA, 13 nt, Salmonella enterica enterica serovar Typhi
gagcgaaggggcg

SEQ ID NO: 3657278 - RNA, 12 nt, Salmonella enterica enterica serovar Typhi
gagcgacaauga

SEQ ID NO: 3657279 - RNA, 20 nt, Salmonella enterica enterica serovar Typhi
gagcgaguacguaaugugaa

SEQ ID NO: 3657280 - RNA, 23 nt, Salmonella enterica enterica serovar Typhi
gagcgaguacguaaugugaaaaa

SEQ ID NO: 3657281 - RNA, 16 nt, Salmonella enterica enterica serovar Typhi
gagcgaucauaaggga

SEQ ID NO: 3657282 - RNA, 21 nt, Salmonella enterica enterica serovar Typhi
gagcgaucauaagggagcuga

SEQ ID NO: 3657283 - RNA, 13 nt, Salmonella enterica enterica serovar Typhi
gagcgcaggcgag

SEQ ID NO: 3657284 - RNA, 22 nt, Salmonella enterica enterica serovar Typhi
gagcgcauacgcuguccaguca

SEQ ID NO: 3657285 - RNA, 14 nt, Salmonella enterica enterica serovar Typhi
gagcgcauccggca

SEQ ID NO: 3657286 - RNA, 15 nt, Salmonella enterica enterica serovar Typhi
gagcgcauccggcca

SEQ ID NO: 3657287 - RNA, 16 nt, Salmonella enterica enterica serovar Typhi
gagcgccaaaaagaaa

SEQ ID NO: 3657288 - RNA, 22 nt, Salmonella enterica enterica serovar Typhi
gagcgccgcgccuaccagcgcu

SEQ ID NO: 3657289 - RNA, 15 nt, Salmonella enterica enterica serovar Typhi
gagcgccggcaaagc

SEQ ID NO: 3657290 - RNA, 17 nt, Salmonella enterica enterica serovar Typhi
gagcgcgaggcauaccg

SEQ ID NO: 3657291 - RNA, 15 nt, Salmonella enterica enterica serovar Typhi
gagcgcgauaaccgg

SEQ ID NO: 3657292 - RNA, 14 nt, Salmonella enterica enterica serovar Typhi
gagcgcgccgcaca

SEQ ID NO: 3657293 - RNA, 17 nt, Salmonella enterica enterica serovar Typhi
gagcgcgcucugccuuu

SEQ ID NO: 3657294 - RNA, 19 nt, Salmonella enterica enterica serovar Typhi
gagcgcggagaacgguuca

SEQ ID NO: 3657295 - RNA, 15 nt, Salmonella enterica enterica serovar Typhi
gagcgcgucagcgcc

SEQ ID NO: 3657296 - RNA, 13 nt, Salmonella enterica enterica serovar Typhi
gagcgcguccaga

SEQ ID NO: 3657297 - RNA, 13 nt, Salmonella enterica enterica serovar Typhi
gagcgcuugcugc

SEQ ID NO: 3657298 - RNA, 15 nt, Salmonella enterica enterica serovar Typhi
gagcggccaaaggga

SEQ ID NO: 3657299 - RNA, 21 nt, Salmonella enterica enterica serovar Typhi
gagcggcuacgccugauaagc

SEQ ID NO: 3657300 - RNA, 14 nt, Salmonella enterica enterica serovar Typhi
gagcggcucaucca

SEQ ID NO: 3657301 - RNA, 14 nt, Salmonella enterica enterica serovar Typhi
gagcgggccgucag

SEQ ID NO: 3657302 - RNA, 20 nt, Salmonella enterica enterica serovar Typhi
gagcgggccguggccaggaa

SEQ ID NO: 3657303 - RNA, 21 nt, Salmonella enterica enterica serovar Typhi
gagcgguuuuuuuguggccug

SEQ ID NO: 3657304 - RNA, 19 nt, Salmonella enterica enterica serovar Typhi
gagcguagaccgcccagga

SEQ ID NO: 3657305 - RNA, 13 nt, Salmonella enterica enterica serovar Typhi
gagcguauccagc

SEQ ID NO: 3657306 - RNA, 17 nt, Salmonella enterica enterica serovar Typhi
gagcguccagucgggcg

SEQ ID NO: 3657307 - RNA, 17 nt, Salmonella enterica enterica serovar Typhi
gagcgucucauccggca

SEQ ID NO: 3657308 - RNA, 18 nt, Salmonella enterica enterica serovar Typhi
gagcgucuuuuaucccca

SEQ ID NO: 3657309 - RNA, 18 nt, Salmonella enterica enterica serovar Typhi
gagcgugaucucauugga

SEQ ID NO: 3657310 - RNA, 16 nt, Salmonella enterica enterica serovar Typhi
gagcgugcggcugacg

SEQ ID NO: 3657311 - RNA, 21 nt, Salmonella enterica enterica serovar Typhi
gagcguuacgggaacagaauu

SEQ ID NO: 3657312 - RNA, 14 nt, Salmonella enterica enterica serovar Typhi
gagcucauccagcg

SEQ ID NO: 3657313 - RNA, 18 nt, Salmonella enterica enterica serovar Typhi
gagcucccgguucgccgc

SEQ ID NO: 3657314 - RNA, 16 nt, Salmonella enterica enterica serovar Typhi
gagcucuaccagacca

SEQ ID NO: 3657315 - RNA, 17 nt, Salmonella enterica enterica serovar Typhi
gagcugcgauaauccgg

SEQ ID NO: 3657316 - RNA, 14 nt, Salmonella enterica enterica serovar Typhi
gagcugcgcuucga

SEQ ID NO: 3657317 - RNA, 12 nt, Salmonella enterica enterica serovar Typhi
gagcugcugcuu

SEQ ID NO: 3657318 - RNA, 18 nt, Salmonella enterica enterica serovar Typhi
gagcugugguucguucaa

SEQ ID NO: 3657319 - RNA, 14 nt, Salmonella enterica enterica serovar Typhi
gagcuuuuuuuugc

SEQ ID NO: 3657320 - RNA, 16 nt, Salmonella enterica enterica serovar Typhi
gagcuuuuuuuugcau

SEQ ID NO: 3657321 - RNA, 18 nt, Salmonella enterica enterica serovar Typhi
gaggaaaaagccgccgug

SEQ ID NO: 3657322 - RNA, 17 nt, Salmonella enterica enterica serovar Typhi
gaggaacuguucagcca

SEQ ID NO: 3657323 - RNA, 19 nt, Salmonella enterica enterica serovar Typhi
gaggaacuguucagccagc

SEQ ID NO: 3657324 - RNA, 14 nt, Salmonella enterica enterica serovar Typhi
gaggaauucuccac

SEQ ID NO: 3657325 - RNA, 12 nt, Salmonella enterica enterica serovar Typhi
gaggagcuggag

SEQ ID NO: 3657326 - RNA, 16 nt, Salmonella enterica enterica serovar Typhi
gaggagcuggagcagg

SEQ ID NO: 3657327 - RNA, 20 nt, Salmonella enterica enterica serovar Typhi
gaggaguaguuaaaaaaggu

SEQ ID NO: 3657328 - RNA, 18 nt, Salmonella enterica enterica serovar Typhi
gaggaucgcccagaugaa

SEQ ID NO: 3657329 - RNA, 12 nt, Salmonella enterica enterica serovar Typhi
gaggaucgccgc

SEQ ID NO: 3657330 - RNA, 21 nt, Salmonella enterica enterica serovar Typhi
gaggaugaaaaguauggcggu

SEQ ID NO: 3657331 - RNA, 15 nt, Salmonella enterica enterica serovar Typhi
gaggaugccugcgca

SEQ ID NO: 3657332 - RNA, 12 nt, Salmonella enterica enterica serovar Typhi
gaggcagcagga

SEQ ID NO: 3657333 - RNA, 21 nt, Salmonella enterica enterica serovar Typhi
gaggcaggggcucuaaaaagg

SEQ ID NO: 3657334 - RNA, 23 nt, Salmonella enterica enterica serovar Typhi
gaggcaucgcccuguaagaggca

SEQ ID NO: 3657335 - RNA, 15 nt, Salmonella enterica enterica serovar Typhi
gaggccaccagcgcc

SEQ ID NO: 3657336 - RNA, 14 nt, Salmonella enterica enterica serovar Typhi
gaggccuuuugcag

SEQ ID NO: 3657337 - RNA, 16 nt, Salmonella enterica enterica serovar Typhi
gaggcgcagccgccau

SEQ ID NO: 3657338 - RNA, 23 nt, Salmonella enterica enterica serovar Typhi
gaggcgcagccgccauccggcaa

SEQ ID NO: 3657339 - RNA, 22 nt, Salmonella enterica enterica serovar Typhi
gaggcggaguuauacagugcca

SEQ ID NO: 3657340 - RNA, 18 nt, Salmonella enterica enterica serovar Typhi
gaggcgugagcgaacagg

SEQ ID NO: 3657341 - RNA, 20 nt, Salmonella enterica enterica serovar Typhi
gaggcguucccgaaaugggc

SEQ ID NO: 3657342 - RNA, 22 nt, Salmonella enterica enterica serovar Typhi
gaggcguugcuccagcagcgcc

SEQ ID NO: 3657343 - RNA, 13 nt, Salmonella enterica enterica serovar Typhi
gaggcguuuccag

SEQ ID NO: 3657344 - RNA, 20 nt, Salmonella enterica enterica serovar Typhi
gaggcuaauuaucugccagc

SEQ ID NO: 3657345 - RNA, 14 nt, Salmonella enterica enterica serovar Typhi
gaggcuacccagac

SEQ ID NO: 3657346 - RNA, 15 nt, Salmonella enterica enterica serovar Typhi
gagggaaauagccua

SEQ ID NO: 3657347 - RNA, 21 nt, Salmonella enterica enterica serovar Typhi
gagggagguucgccucccuca

SEQ ID NO: 3657348 - RNA, 17 nt, Salmonella enterica enterica serovar Typhi
gagggcgaacuggcggu

SEQ ID NO: 3657349 - RNA, 20 nt, Salmonella enterica enterica serovar Typhi
gagggcgcgccguugaaauc

SEQ ID NO: 3657350 - RNA, 20 nt, Salmonella enterica enterica serovar Typhi
gagggggaggugcugguggu

SEQ ID NO: 3657351 - RNA, 13 nt, Salmonella enterica enterica serovar Typhi
gaggguguucacg

SEQ ID NO: 3657352 - RNA, 15 nt, Salmonella enterica enterica serovar Typhi
gaggguguucacgcg

SEQ ID NO: 3657353 - RNA, 16 nt, Salmonella enterica enterica serovar Typhi
gaggugaauaaauccu

SEQ ID NO: 3657354 - RNA, 20 nt, Salmonella enterica enterica serovar Typhi
gaggugcucucccagcugag

SEQ ID NO: 3657355 - RNA, 18 nt, Salmonella enterica enterica serovar Typhi
gagguuucagcaccucca

SEQ ID NO: 3657356 - RNA, 17 nt, Salmonella enterica enterica serovar Typhi
gagguuuccggcgggag

SEQ ID NO: 3657357 - RNA, 13 nt, Salmonella enterica enterica serovar Typhi
gagguuucuucau

SEQ ID NO: 3657358 - RNA, 16 nt, Salmonella enterica enterica serovar Typhi
gauaagcaagcgccau

SEQ ID NO: 3657359 - RNA, 18 nt, Salmonella enterica enterica serovar Typhi
gauaagcaagcgccaucg

SEQ ID NO: 3657360 - RNA, 14 nt, Salmonella enterica enterica serovar Typhi
gauaagcacaugac

SEQ ID NO: 3657361 - RNA, 20 nt, Salmonella enterica enterica serovar Typhi
gauaagcauagcgccaucag

SEQ ID NO: 3657362 - RNA, 24 nt, Salmonella enterica enterica serovar Typhi
gauaagcauagcgccaucaggcau

SEQ ID NO: 3657363 - RNA, 17 nt, Salmonella enterica enterica serovar Typhi
gauaagccgcguccggc

SEQ ID NO: 3657364 - RNA, 20 nt, Salmonella enterica enterica serovar Typhi
gauaagcgaagcgccaucag

SEQ ID NO: 3657365 - RNA, 21 nt, Salmonella enterica enterica serovar Typhi
gauaagcgcagcgccaucagg

SEQ ID NO: 3657366 - RNA, 20 nt, Salmonella enterica enterica serovar Typhi
gauaagcgcagcgccauccg

SEQ ID NO: 3657367 - RNA, 23 nt, Salmonella enterica enterica serovar Typhi
gauaagcgcagcgccauccggca

SEQ ID NO: 3657368 - RNA, 20 nt, Salmonella enterica enterica serovar Typhi
gauaagcgccacgucggcga

SEQ ID NO: 3657369 - RNA, 21 nt, Salmonella enterica enterica serovar Typhi
gauaagcggcagcgccauccg

SEQ ID NO: 3657370 - RNA, 19 nt, Salmonella enterica enterica serovar Typhi
gauaagcguagcgcauccg

SEQ ID NO: 3657371 - RNA, 22 nt, Salmonella enterica enterica serovar Typhi
gauaagcguagcgcauccggca

SEQ ID NO: 3657372 - RNA, 16 nt, Salmonella enterica enterica serovar Typhi
gauaagcguagcgcca

SEQ ID NO: 3657373 - RNA, 23 nt, Salmonella enterica enterica serovar Typhi
gauaagcguagcgccaucaggcu

SEQ ID NO: 3657374 - RNA, 20 nt, Salmonella enterica enterica serovar Typhi
gauaagcguagcgccauccg

SEQ ID NO: 3657375 - RNA, 20 nt, Salmonella enterica enterica serovar Typhi
gauaagcgugagcgcauccg

SEQ ID NO: 3657376 - RNA, 23 nt, Salmonella enterica enterica serovar Typhi
gauaagcgugagcgcauccggca

SEQ ID NO: 3657377 - RNA, 19 nt, Salmonella enterica enterica serovar Typhi
gauaagcgugcgccauccg

SEQ ID NO: 3657378 - RNA, 21 nt, Salmonella enterica enterica serovar Typhi
gauaagcguuagcgucauccg

SEQ ID NO: 3657379 - RNA, 13 nt, Salmonella enterica enterica serovar Typhi
gauaaggcagcaa

SEQ ID NO: 3657380 - RNA, 12 nt, Salmonella enterica enterica serovar Typhi
gauaaggcauuc

SEQ ID NO: 3657381 - RNA, 14 nt, Salmonella enterica enterica serovar Typhi
gauaaggccacgcc

SEQ ID NO: 3657382 - RNA, 22 nt, Salmonella enterica enterica serovar Typhi
gauaaggccacgccgccauccg

SEQ ID NO: 3657383 - RNA, 23 nt, Salmonella enterica enterica serovar Typhi
gauaaggccacgccgccauccgg

SEQ ID NO: 3657384 - RNA, 22 nt, Salmonella enterica enterica serovar Typhi
gauaaggcgcagccgccauccg

SEQ ID NO: 3657385 - RNA, 22 nt, Salmonella enterica enterica serovar Typhi
gauaaggcggagccgccauccg

SEQ ID NO: 3657386 - RNA, 16 nt, Salmonella enterica enterica serovar Typhi
gauaaggcgugagcca

SEQ ID NO: 3657387 - RNA, 16 nt, Salmonella enterica enterica serovar Typhi
gauaaggcguucacgc

SEQ ID NO: 3657388 - RNA, 17 nt, Salmonella enterica enterica serovar Typhi
gauaaggcguucacgcc

SEQ ID NO: 3657389 - RNA, 21 nt, Salmonella enterica enterica serovar Typhi
gauaaggcguucacgccgcca

SEQ ID NO: 3657390 - RNA, 22 nt, Salmonella enterica enterica serovar Typhi
gauaagguaaagccgccauccg

SEQ ID NO: 3657391 - RNA, 22 nt, Salmonella enterica enterica serovar Typhi
gauaagguaacgcgaaaaaaga

SEQ ID NO: 3657392 - RNA, 22 nt, Salmonella enterica enterica serovar Typhi
gauaaggucgcuauccagcagu

SEQ ID NO: 3657393 - RNA, 23 nt, Salmonella enterica enterica serovar Typhi
gauaagucccggaccgauugacu

SEQ ID NO: 3657394 - RNA, 16 nt, Salmonella enterica enterica serovar Typhi
gauaaguccuaacacc

SEQ ID NO: 3657395 - RNA, 11 nt, Salmonella enterica enterica serovar Typhi
gauaauaauga

SEQ ID NO: 3657396 - RNA, 14 nt, Salmonella enterica enterica serovar Typhi
gauaauacgcgcga

SEQ ID NO: 3657397 - RNA, 17 nt, Salmonella enterica enterica serovar Typhi
gauaauagccucauccc

SEQ ID NO: 3657398 - RNA, 12 nt, Salmonella enterica enterica serovar Typhi
gauaauccagcg

SEQ ID NO: 3657399 - RNA, 21 nt, Salmonella enterica enterica serovar Typhi
gauaaucgguagcacuuuaaa

SEQ ID NO: 3657400 - RNA, 20 nt, Salmonella enterica enterica serovar Typhi
gauaaugaagcauaaaaaga

SEQ ID NO: 3657401 - RNA, 15 nt, Salmonella enterica enterica serovar Typhi
gauaaugacauccag

SEQ ID NO: 3657402 - RNA, 18 nt, Salmonella enterica enterica serovar Typhi
gauaauguugguaaauuu

SEQ ID NO: 3657403 - RNA, 15 nt, Salmonella enterica enterica serovar Typhi
gauaauucccccagu

SEQ ID NO: 3657404 - RNA, 23 nt, Salmonella enterica enterica serovar Typhi
gauaauucccccaguaguugacc

SEQ ID NO: 3657405 - RNA, 13 nt, Salmonella enterica enterica serovar Typhi
gauaauucugacu

SEQ ID NO: 3657406 - RNA, 19 nt, Salmonella enterica enterica serovar Typhi
gauaauucugacuugcugu

SEQ ID NO: 3657407 - RNA, 13 nt, Salmonella enterica enterica serovar Typhi
gauaauuuaucca

SEQ ID NO: 3657408 - RNA, 18 nt, Salmonella enterica enterica serovar Typhi
gauaauuuauccaguaac

SEQ ID NO: 3657409 - RNA, 19 nt, Salmonella enterica enterica serovar Typhi
gauaauuuuaccuucgcgu

SEQ ID NO: 3657410 - RNA, 18 nt, Salmonella enterica enterica serovar Typhi
gauacaagguauccgcca

SEQ ID NO: 3657411 - RNA, 21 nt, Salmonella enterica enterica serovar Typhi
gauacaagguauccgccauau

SEQ ID NO: 3657412 - RNA, 15 nt, Salmonella enterica enterica serovar Typhi
gauacaccuucacau

SEQ ID NO: 3657413 - RNA, 15 nt, Salmonella enterica enterica serovar Typhi
gauacagaaaaccgg

SEQ ID NO: 3657414 - RNA, 15 nt, Salmonella enterica enterica serovar Typhi
gauacagccaaauca

SEQ ID NO: 3657415 - RNA, 20 nt, Salmonella enterica enterica serovar Typhi
gauacaggacugacugcugu

SEQ ID NO: 3657416 - RNA, 21 nt, Salmonella enterica enterica serovar Typhi
gauacaggacugacugcuguc

SEQ ID NO: 3657417 - RNA, 15 nt, Salmonella enterica enterica serovar Typhi
gauacauggcuauuc

SEQ ID NO: 3657418 - RNA, 13 nt, Salmonella enterica enterica serovar Typhi
gauacauuuuuug

SEQ ID NO: 3657419 - RNA, 12 nt, Salmonella enterica enterica serovar Typhi
gauaccagauua

SEQ ID NO: 3657420 - RNA, 14 nt, Salmonella enterica enterica serovar Typhi
gauaccagauuaau

SEQ ID NO: 3657421 - RNA, 22 nt, Salmonella enterica enterica serovar Typhi
gauaccagccuucggacugcug

SEQ ID NO: 3657422 - RNA, 21 nt, Salmonella enterica enterica serovar Typhi
gauaccccagcgaucccaguu

SEQ ID NO: 3657423 - RNA, 14 nt, Salmonella enterica enterica serovar Typhi
gauaccgccagccc

SEQ ID NO: 3657424 - RNA, 14 nt, Salmonella enterica enterica serovar Typhi
gauaccgcgccagc

SEQ ID NO: 3657425 - RNA, 15 nt, Salmonella enterica enterica serovar Typhi
gauaccggcaacgcc

SEQ ID NO: 3657426 - RNA, 21 nt, Salmonella enterica enterica serovar Typhi
gauaccggcgcagcaucugcg

SEQ ID NO: 3657427 - RNA, 22 nt, Salmonella enterica enterica serovar Typhi
gauacgcagcaccgccgcgaua

SEQ ID NO: 3657428 - RNA, 15 nt, Salmonella enterica enterica serovar Typhi
gauacgccagcagac

SEQ ID NO: 3657429 - RNA, 18 nt, Salmonella enterica enterica serovar Typhi
gauacgccagcagacagg

SEQ ID NO: 3657430 - RNA, 19 nt, Salmonella enterica enterica serovar Typhi
gauacgcugcgucaggcga

SEQ ID NO: 3657431 - RNA, 16 nt, Salmonella enterica enterica serovar Typhi
gauacgcuggcacagg

SEQ ID NO: 3657432 - RNA, 20 nt, Salmonella enterica enterica serovar Typhi
gauacgcuguaguuccugua

SEQ ID NO: 3657433 - RNA, 18 nt, Salmonella enterica enterica serovar Typhi
gauacggaaauagcgcca

SEQ ID NO: 3657434 - RNA, 18 nt, Salmonella enterica enterica serovar Typhi
gauacggcgagaccauau

SEQ ID NO: 3657435 - RNA, 15 nt, Salmonella enterica enterica serovar Typhi
gauacggcuccagca

SEQ ID NO: 3657436 - RNA, 17 nt, Salmonella enterica enterica serovar Typhi
gauacggcuccagcaca

SEQ ID NO: 3657437 - RNA, 23 nt, Salmonella enterica enterica serovar Typhi
gauacggcugucaggagccaccg

SEQ ID NO: 3657438 - RNA, 17 nt, Salmonella enterica enterica serovar Typhi
gauacgggaucgauaau

SEQ ID NO: 3657439 - RNA, 20 nt, Salmonella enterica enterica serovar Typhi
gauacgucauaucauccagc

SEQ ID NO: 3657440 - RNA, 14 nt, Salmonella enterica enterica serovar Typhi
gauacgucaucaug

SEQ ID NO: 3657441 - RNA, 14 nt, Salmonella enterica enterica serovar Typhi
gauacguucauccu

SEQ ID NO: 3657442 - RNA, 13 nt, Salmonella enterica enterica serovar Typhi
gauacguuccagc

SEQ ID NO: 3657443 - RNA, 20 nt, Salmonella enterica enterica serovar Typhi
gauauuguguuuaccucaua

SEQ ID NO: 3657444 - RNA, 14 nt, Salmonella enterica enterica serovar Typhi
gauauuuugcugca

SEQ ID NO: 3657445 - RNA, 18 nt, Salmonella enterica enterica serovar Typhi
gaucaacgccgcgccauc

SEQ ID NO: 3657446 - RNA, 14 nt, Salmonella enterica enterica serovar Typhi
gaucaagcgggggc

SEQ ID NO: 3657447 - RNA, 18 nt, Salmonella enterica enterica serovar Typhi
gaucaauaaaauuaucca

SEQ ID NO: 3657448 - RNA, 21 nt, Salmonella enterica enterica serovar Typhi
gaucaauaaaauuauccaguu

SEQ ID NO: 3657449 - RNA, 17 nt, Salmonella enterica enterica serovar Typhi
gaucacaaaaucauugc

SEQ ID NO: 3657450 - RNA, 21 nt, Salmonella enterica enterica serovar Typhi
gaucaccugaaugcaaagaag

SEQ ID NO: 3657451 - RNA, 19 nt, Salmonella enterica enterica serovar Typhi
gaucacgccguccagcacc

SEQ ID NO: 3657452 - RNA, 14 nt, Salmonella enterica enterica serovar Typhi
gaucacggugguga

SEQ ID NO: 3657453 - RNA, 23 nt, Salmonella enterica enterica serovar Typhi
gaucacuaccgccaucaaacgca

SEQ ID NO: 3657454 - RNA, 12 nt, Salmonella enterica enterica serovar Typhi
gaucagaaaacc

SEQ ID NO: 3657455 - RNA, 21 nt, Salmonella enterica enterica serovar Typhi
gaucagaaauucgcagcgcag

SEQ ID NO: 3657456 - RNA, 15 nt, Salmonella enterica enterica serovar Typhi
gaucagaccaucggc

SEQ ID NO: 3657457 - RNA, 21 nt, Salmonella enterica enterica serovar Typhi
gaucagaccaucggccgcuau

SEQ ID NO: 3657458 - RNA, 19 nt, Salmonella enterica enterica serovar Typhi
gaucagacgcaucaggaac

SEQ ID NO: 3657459 - RNA, 19 nt, Salmonella enterica enterica serovar Typhi
gaucagacuuuggauaaag

SEQ ID NO: 3657460 - RNA, 20 nt, Salmonella enterica enterica serovar Typhi
gaucagauauuccagcgaca

SEQ ID NO: 3657461 - RNA, 13 nt, Salmonella enterica enterica serovar Typhi
gaucagcaaaaua

SEQ ID NO: 3657462 - RNA, 21 nt, Salmonella enterica enterica serovar Typhi
gaucagcaccacgcccggauc

SEQ ID NO: 3657463 - RNA, 15 nt, Salmonella enterica enterica serovar Typhi
gaucagcacgcgccg

SEQ ID NO: 3657464 - RNA, 15 nt, Salmonella enterica enterica serovar Typhi
gaucagcagaacaaa

SEQ ID NO: 3657465 - RNA, 13 nt, Salmonella enterica enterica serovar Typhi
gaucagcagaucc

SEQ ID NO: 3657466 - RNA, 15 nt, Salmonella enterica enterica serovar Typhi
gaucagcgccacgca

SEQ ID NO: 3657467 - RNA, 18 nt, Salmonella enterica enterica serovar Typhi
gaucagcgcgcuccagac

SEQ ID NO: 3657468 - RNA, 18 nt, Salmonella enterica enterica serovar Typhi
gaucaggaaaucuuccag

SEQ ID NO: 3657469 - RNA, 20 nt, Salmonella enterica enterica serovar Typhi
gaucaggccgcagacggaga

SEQ ID NO: 3657470 - RNA, 16 nt, Salmonella enterica enterica serovar Typhi
gaucaggcgucagcgg

SEQ ID NO: 3657471 - RNA, 14 nt, Salmonella enterica enterica serovar Typhi
gaucaggucugaga

SEQ ID NO: 3657472 - RNA, 18 nt, Salmonella enterica enterica serovar Typhi
gaucaguggcgccgcaau

SEQ ID NO: 3657473 - RNA, 14 nt, Salmonella enterica enterica serovar Typhi
gaucaguuccggau

SEQ ID NO: 3657474 - RNA, 19 nt, Salmonella enterica enterica serovar Typhi
gaucauaagggagcugacu

SEQ ID NO: 3657475 - RNA, 13 nt, Salmonella enterica enterica serovar Typhi
gaucauaaugacg

SEQ ID NO: 3657476 - RNA, 15 nt, Salmonella enterica enterica serovar Typhi
gaucaucauggcuga

SEQ ID NO: 3657477 - RNA, 19 nt, Salmonella enterica enterica serovar Typhi
gaucaucccgagauuguca

SEQ ID NO: 3657478 - RNA, 22 nt, Salmonella enterica enterica serovar Typhi
gaucauccggguuaaaccagcu

SEQ ID NO: 3657479 - RNA, 13 nt, Salmonella enterica enterica serovar Typhi
gaucaucuucacu

SEQ ID NO: 3657480 - RNA, 12 nt, Salmonella enterica enterica serovar Typhi
gaucaucuuuua

SEQ ID NO: 3657481 - RNA, 17 nt, Salmonella enterica enterica serovar Typhi
gaucaugaaaaauauaa

SEQ ID NO: 3657482 - RNA, 20 nt, Salmonella enterica enterica serovar Typhi
gaucaugaggaugagcguuu

SEQ ID NO: 3657483 - RNA, 21 nt, Salmonella enterica enterica serovar Typhi
gaucaugagucgcgcgcgcca

SEQ ID NO: 3657484 - RNA, 20 nt, Salmonella enterica enterica serovar Typhi
gaucaugccgcccaggccau

SEQ ID NO: 3657485 - RNA, 19 nt, Salmonella enterica enterica serovar Typhi
gaucaugcguccgcccaga

SEQ ID NO: 3657486 - RNA, 14 nt, Salmonella enterica enterica serovar Typhi
gaucauggcucaga

SEQ ID NO: 3657487 - RNA, 19 nt, Salmonella enterica enterica serovar Typhi
gaucauuaccugucgccca

SEQ ID NO: 3657488 - RNA, 19 nt, Salmonella enterica enterica serovar Typhi
gaucauuggggaaccuggc

SEQ ID NO: 3657489 - RNA, 20 nt, Salmonella enterica enterica serovar Typhi
gauccagaacugcgaaauca

SEQ ID NO: 3657490 - RNA, 18 nt, Salmonella enterica enterica serovar Typhi
gauccagcgauugacggu

SEQ ID NO: 3657491 - RNA, 22 nt, Salmonella enterica enterica serovar Typhi
gauccagcgauugacgguuugu

SEQ ID NO: 3657492 - RNA, 13 nt, Salmonella enterica enterica serovar Typhi
gauccagcgggcc

SEQ ID NO: 3657493 - RNA, 13 nt, Salmonella enterica enterica serovar Typhi
gauccagcucuuc

SEQ ID NO: 3657494 - RNA, 16 nt, Salmonella enterica enterica serovar Typhi
gauccaggucuuccgc

SEQ ID NO: 3657495 - RNA, 21 nt, Salmonella enterica enterica serovar Typhi
gauccaucgguucucugccau

SEQ ID NO: 3657496 - RNA, 11 nt, Salmonella enterica enterica serovar Typhi
gaucccaccag

SEQ ID NO: 3657497 - RNA, 22 nt, Salmonella enterica enterica serovar Typhi
gaucccagcgaacugauaaaag

SEQ ID NO: 3657498 - RNA, 23 nt, Salmonella enterica enterica serovar Typhi
gaucccagggcggcgucgccaga

SEQ ID NO: 3657499 - RNA, 19 nt, Salmonella enterica enterica serovar Typhi
gauccccaacgacagcacu

SEQ ID NO: 3657500 - RNA, 16 nt, Salmonella enterica enterica serovar Typhi
gaucccggccuucgaa

SEQ ID NO: 3657501 - RNA, 19 nt, Salmonella enterica enterica serovar Typhi
gauccgacaugaugccaaa

SEQ ID NO: 3657502 - RNA, 18 nt, Salmonella enterica enterica serovar Typhi
gauccgcgagacgccugg

SEQ ID NO: 3657503 - RNA, 21 nt, Salmonella enterica enterica serovar Typhi
gauccggcauccaaccgaaca

SEQ ID NO: 3657504 - RNA, 22 nt, Salmonella enterica enterica serovar Typhi
gauccguaaccagucguuaucu

SEQ ID NO: 3657505 - RNA, 20 nt, Salmonella enterica enterica serovar Typhi
gauccguucgaucagcuggc

SEQ ID NO: 3657506 - RNA, 14 nt, Salmonella enterica enterica serovar Typhi
gauccguuucagaa

SEQ ID NO: 3657507 - RNA, 18 nt, Salmonella enterica enterica serovar Typhi
gauccugcggcauuagca

SEQ ID NO: 3657508 - RNA, 19 nt, Salmonella enterica enterica serovar Typhi
gauccuguucaaacaucag

SEQ ID NO: 3657509 - RNA, 15 nt, Salmonella enterica enterica serovar Typhi
gauccuucauucaga

SEQ ID NO: 3657510 - RNA, 18 nt, Salmonella enterica enterica serovar Typhi
gaucgaaugaaaauguau

SEQ ID NO: 3657511 - RNA, 18 nt, Salmonella enterica enterica serovar Typhi
gaucgacaaaccacugcu

SEQ ID NO: 3657512 - RNA, 17 nt, Salmonella enterica enterica serovar Typhi
gaucgacaaugaucaga

SEQ ID NO: 3657513 - RNA, 21 nt, Salmonella enterica enterica serovar Typhi
gaucgacaaugaucagacgca

SEQ ID NO: 3657514 - RNA, 13 nt, Salmonella enterica enterica serovar Typhi
gaucgacagcgcg

SEQ ID NO: 3657515 - RNA, 20 nt, Salmonella enterica enterica serovar Typhi
gaucgacuaauuuuaggaag

SEQ ID NO: 3657516 - RNA, 14 nt, Salmonella enterica enterica serovar Typhi
gaucgaggucagca

SEQ ID NO: 3657517 - RNA, 20 nt, Salmonella enterica enterica serovar Typhi
gaucgauagcgacggcgcgc

SEQ ID NO: 3657518 - RNA, 18 nt, Salmonella enterica enterica serovar Typhi
gaucgauauaucgcguca

SEQ ID NO: 3657519 - RNA, 20 nt, Salmonella enterica enterica serovar Typhi
gaucgauauccgugcgcaau

SEQ ID NO: 3657520 - RNA, 20 nt, Salmonella enterica enterica serovar Typhi
gaucgaucucgauauucaca

SEQ ID NO: 3657521 - RNA, 17 nt, Salmonella enterica enterica serovar Typhi
gaucgccauccugcacc

SEQ ID NO: 3657522 - RNA, 23 nt, Salmonella enterica enterica serovar Typhi
gaucgccgccgcgagcagcgaaa

SEQ ID NO: 3657523 - RNA, 12 nt, Salmonella enterica enterica serovar Typhi
gaucgccgguuu

SEQ ID NO: 3657524 - RNA, 22 nt, Salmonella enterica enterica serovar Typhi
gaucgccgguuuugguaucuuc

SEQ ID NO: 3657525 - RNA, 20 nt, Salmonella enterica enterica serovar Typhi
gaucgcgccggucgccagca

SEQ ID NO: 3657526 - RNA, 21 nt, Salmonella enterica enterica serovar Typhi
gaucgcgcucccggccaauca

SEQ ID NO: 3657527 - RNA, 22 nt, Salmonella enterica enterica serovar Typhi
gaucgcgcugcgcaggcguuuc

SEQ ID NO: 3657528 - RNA, 18 nt, Salmonella enterica enterica serovar Typhi
gaugcgccccgcuucccg

SEQ ID NO: 3657529 - RNA, 22 nt, Salmonella enterica enterica serovar Typhi
gaugcgccgacugaacauagcc

SEQ ID NO: 3657530 - RNA, 13 nt, Salmonella enterica enterica serovar Typhi
gaugcgccuguaa

SEQ ID NO: 3657531 - RNA, 21 nt, Salmonella enterica enterica serovar Typhi
gaugcgccugucuccagcgcc

SEQ ID NO: 3657532 - RNA, 22 nt, Salmonella enterica enterica serovar Typhi
gaugcgcguuuagcgccagcag

SEQ ID NO: 3657533 - RNA, 13 nt, Salmonella enterica enterica serovar Typhi
gaugcgcuuuacu

SEQ ID NO: 3657534 - RNA, 14 nt, Salmonella enterica enterica serovar Typhi
gaugcggaagagaa

SEQ ID NO: 3657535 - RNA, 14 nt, Salmonella enterica enterica serovar Typhi
gaugcggacgcuga

SEQ ID NO: 3657536 - RNA, 21 nt, Salmonella enterica enterica serovar Typhi
gaugcggacgcugacgccagg

SEQ ID NO: 3657537 - RNA, 18 nt, Salmonella enterica enterica serovar Typhi
gaugcgggccgacaaaaa

SEQ ID NO: 3657538 - RNA, 20 nt, Salmonella enterica enterica serovar Typhi
gaugcguaccgcuaucgcca

SEQ ID NO: 3657539 - RNA, 17 nt, Salmonella enterica enterica serovar Typhi
gaugcguauccagcgcg

SEQ ID NO: 3657540 - RNA, 22 nt, Salmonella enterica enterica serovar Typhi
gaugcguucuagcuuaucgcca

SEQ ID NO: 3657541 - RNA, 23 nt, Salmonella enterica enterica serovar Typhi
gaugcuaaccucuauaguaaauu

SEQ ID NO: 3657542 - RNA, 16 nt, Salmonella enterica enterica serovar Typhi
gaugcuauaccgcccg

SEQ ID NO: 3657543 - RNA, 20 nt, Salmonella enterica enterica serovar Typhi
gaugcuaucgcggauaagcc

SEQ ID NO: 3657544 - RNA, 17 nt, Salmonella enterica enterica serovar Typhi
gaugcucagggcauccg

SEQ ID NO: 3657545 - RNA, 17 nt, Salmonella enterica enterica serovar Typhi
gaugcucgccgucggca

SEQ ID NO: 3657546 - RNA, 18 nt, Salmonella enterica enterica serovar Typhi
gaugcugaauagccagcc

SEQ ID NO: 3657547 - RNA, 18 nt, Salmonella enterica enterica serovar Typhi
gaugcugauuaaugauuu

SEQ ID NO: 3657548 - RNA, 21 nt, Salmonella enterica enterica serovar Typhi
gaugcugcgcauccgcggcgc

SEQ ID NO: 3657549 - RNA, 19 nt, Salmonella enterica enterica serovar Typhi
gaugcugcucuccacgccg

SEQ ID NO: 3657550 - RNA, 22 nt, Salmonella enterica enterica serovar Typhi
gaugcugguuuuagcuuauccc

SEQ ID NO: 3657551 - RNA, 21 nt, Salmonella enterica enterica serovar Typhi
gaugcugucuuagugaaagac

SEQ ID NO: 3657552 - RNA, 22 nt, Salmonella enterica enterica serovar Typhi
gaugcuugccauauugccgcac

SEQ ID NO: 3657553 - RNA, 21 nt, Salmonella enterica enterica serovar Typhi
gauggaacgcauccagccacg

SEQ ID NO: 3657554 - RNA, 18 nt, Salmonella enterica enterica serovar Typhi
gauggacaauccgcgaau

SEQ ID NO: 3657555 - RNA, 19 nt, Salmonella enterica enterica serovar Typhi
gauggacggauuggcgcuc

SEQ ID NO: 3657556 - RNA, 17 nt, Salmonella enterica enterica serovar Typhi
gauggacuugugcagug

SEQ ID NO: 3657557 - RNA, 15 nt, Salmonella enterica enterica serovar Typhi
gauggauaaccugcc

SEQ ID NO: 3657558 - RNA, 13 nt, Salmonella enterica enterica serovar Typhi
gauggcaaauaau

SEQ ID NO: 3657559 - RNA, 20 nt, Salmonella enterica enterica serovar Typhi
gauggcacugcgcuuauccg

SEQ ID NO: 3657560 - RNA, 23 nt, Salmonella enterica enterica serovar Typhi
gauggcacugcgcuuauccggcc

SEQ ID NO: 3657561 - RNA, 17 nt, Salmonella enterica enterica serovar Typhi
gauggccaaauaaccca

SEQ ID NO: 3657562 - RNA, 17 nt, Salmonella enterica enterica serovar Typhi
gauggccaaugaugcgc

SEQ ID NO: 3657563 - RNA, 18 nt, Salmonella enterica enterica serovar Typhi
gauggccagcaccagcau

SEQ ID NO: 3657564 - RNA, 18 nt, Salmonella enterica enterica serovar Typhi
gauggccgccgagcugug

SEQ ID NO: 3657565 - RNA, 13 nt, Salmonella enterica enterica serovar Typhi
gauggccucauca

SEQ ID NO: 3657566 - RNA, 22 nt, Salmonella enterica enterica serovar Typhi
gauggcgacuaccucuuauccg

SEQ ID NO: 3657567 - RNA, 19 nt, Salmonella enterica enterica serovar Typhi
gauggcgagaagcugggcg

SEQ ID NO: 3657568 - RNA, 17 nt, Salmonella enterica enterica serovar Typhi
gauggcgaucagcgcca

SEQ ID NO: 3657569 - RNA, 21 nt, Salmonella enterica enterica serovar Typhi
gauggcgauucauaugcgcca

SEQ ID NO: 3657570 - RNA, 22 nt, Salmonella enterica enterica serovar Typhi
gauggcgccagccauagcagca

SEQ ID NO: 3657571 - RNA, 19 nt, Salmonella enterica enterica serovar Typhi
gauggcgcgacgcuuauca

SEQ ID NO: 3657572 - RNA, 20 nt, Salmonella enterica enterica serovar Typhi
gauggcgcgacgcuuaucag

SEQ ID NO: 3657573 - RNA, 13 nt, Salmonella enterica enterica serovar Typhi
gauggcgcgcuua

SEQ ID NO: 3657574 - RNA, 17 nt, Salmonella enterica enterica serovar Typhi
gauggcgcgcuuaucug

SEQ ID NO: 3657575 - RNA, 18 nt, Salmonella enterica enterica serovar Typhi
gauggcgcuaagccagcc

SEQ ID NO: 3657576 - RNA, 19 nt, Salmonella enterica enterica serovar Typhi
gauggcgcuacgcuuauca

SEQ ID NO: 3657577 - RNA, 20 nt, Salmonella enterica enterica serovar Typhi
gauggcgcuacgcuuaucag

SEQ ID NO: 3657578 - RNA, 19 nt, Salmonella enterica enterica serovar Typhi
gauggcgcuacgcuuaucg

SEQ ID NO: 3657579 - RNA, 15 nt, Salmonella enterica enterica serovar Typhi
gauggcgcuacguuu

SEQ ID NO: 3657580 - RNA, 14 nt, Salmonella enterica enterica serovar Typhi
gauggcgcuccuga

SEQ ID NO: 3657581 - RNA, 17 nt, Salmonella enterica enterica serovar Typhi
gauggcgcuccugaauc

SEQ ID NO: 3657582 - RNA, 19 nt, Salmonella enterica enterica serovar Typhi
gauggcgcugcgcuuauca

SEQ ID NO: 3657583 - RNA, 20 nt, Salmonella enterica enterica serovar Typhi
gauggcgcugcgcuuauccg

SEQ ID NO: 3657584 - RNA, 20 nt, Salmonella enterica enterica serovar Typhi
gauggcgcugcguuuccugu

SEQ ID NO: 3657585 - RNA, 18 nt, Salmonella enterica enterica serovar Typhi
gauggcggcgucgccugu

SEQ ID NO: 3657586 - RNA, 23 nt, Salmonella enterica enterica serovar Typhi
gauggcggcuaacgccugauccg

SEQ ID NO: 3657587 - RNA, 22 nt, Salmonella enterica enterica serovar Typhi
gauggcggcuacgccuuauccg

SEQ ID NO: 3657588 - RNA, 15 nt, Salmonella enterica enterica serovar Typhi
gauggcggcugcgcc

SEQ ID NO: 3657589 - RNA, 22 nt, Salmonella enterica enterica serovar Typhi
gauggcggcugcgccuuauccg

SEQ ID NO: 3657590 - RNA, 22 nt, Salmonella enterica enterica serovar Typhi
gauggcggcuucgccuuauccg

SEQ ID NO: 3657591 - RNA, 17 nt, Salmonella enterica enterica serovar Typhi
gauggcgucacauggcg

SEQ ID NO: 3657592 - RNA, 20 nt, Salmonella enterica enterica serovar Typhi
gauggcuaugaagcuggagc

SEQ ID NO: 3657593 - RNA, 19 nt, Salmonella enterica enterica serovar Typhi
gauggcuuugcugucagaa

SEQ ID NO: 3657594 - RNA, 14 nt, Salmonella enterica enterica serovar Typhi
gaugggcaaugcca

SEQ ID NO: 3657595 - RNA, 20 nt, Salmonella enterica enterica serovar Typhi
gaugguaggccugauaagcg

SEQ ID NO: 3657596 - RNA, 19 nt, Salmonella enterica enterica serovar Typhi
gaugguauaaaucacgcug

SEQ ID NO: 3657597 - RNA, 16 nt, Salmonella enterica enterica serovar Typhi
gauggucaauaacagc

SEQ ID NO: 3657598 - RNA, 13 nt, Salmonella enterica enterica serovar Typhi
gauggucgcgcca

SEQ ID NO: 3657599 - RNA, 20 nt, Salmonella enterica enterica serovar Typhi
gauggugcggcgcacugccu

SEQ ID NO: 3657600 - RNA, 17 nt, Salmonella enterica enterica serovar Typhi
gaugguggugcaagcac

SEQ ID NO: 3657601 - RNA, 16 nt, Salmonella enterica enterica serovar Typhi
gauggugucaaucgcc

SEQ ID NO: 3657602 - RNA, 16 nt, Salmonella enterica enterica serovar Typhi
gaugguguuaccgcca

SEQ ID NO: 3657603 - RNA, 23 nt, Salmonella enterica enterica serovar Typhi
gaugguuaaauucauauuuaaau

SEQ ID NO: 3657604 - RNA, 17 nt, Salmonella enterica enterica serovar Typhi
gauguaaaaccuggcac

SEQ ID NO: 3657605 - RNA, 14 nt, Salmonella enterica enterica serovar Typhi
gauguaaucugaca

SEQ ID NO: 3657606 - RNA, 18 nt, Salmonella enterica enterica serovar Typhi
gauguaugaacugcauca

SEQ ID NO: 3657607 - RNA, 14 nt, Salmonella enterica enterica serovar Typhi
gauguauuuaucca

SEQ ID NO: 3657608 - RNA, 17 nt, Salmonella enterica enterica serovar Typhi
gaugucagauccuucau

SEQ ID NO: 3657609 - RNA, 11 nt, Salmonella enterica enterica serovar Typhi
gaugucauccg

SEQ ID NO: 3657610 - RNA, 13 nt, Salmonella enterica enterica serovar Typhi
gaugucauccggu

SEQ ID NO: 3657611 - RNA, 22 nt, Salmonella enterica enterica serovar Typhi
gaugucauccgguucacccacu

SEQ ID NO: 3657612 - RNA, 21 nt, Salmonella enterica enterica serovar Typhi
gauguccaccgauuucaucgc

SEQ ID NO: 3657613 - RNA, 20 nt, Salmonella enterica enterica serovar Typhi
gauuuccggaaugguauaaa

SEQ ID NO: 3657614 - RNA, 22 nt, Salmonella enterica enterica serovar Typhi
gauuucggcgcuguuuuccgcu

SEQ ID NO: 3657615 - RNA, 19 nt, Salmonella enterica enterica serovar Typhi
gauuucuucuggcugcuga

SEQ ID NO: 3657616 - RNA, 17 nt, Salmonella enterica enterica serovar Typhi
gauuucuugagcggcau

SEQ ID NO: 3657617 - RNA, 21 nt, Salmonella enterica enterica serovar Typhi
gauuucuugagcggcaucacu

SEQ ID NO: 3657618 - RNA, 17 nt, Salmonella enterica enterica serovar Typhi
gauuugacaucaggauu

SEQ ID NO: 3657619 - RNA, 18 nt, Salmonella enterica enterica serovar Typhi
gauuugcaaccgcucuuu

SEQ ID NO: 3657620 - RNA, 14 nt, Salmonella enterica enterica serovar Typhi
gauuugcccuucca

SEQ ID NO: 3657621 - RNA, 21 nt, Salmonella enterica enterica serovar Typhi
gauuugcccuuccagcagcca

SEQ ID NO: 3657622 - RNA, 19 nt, Salmonella enterica enterica serovar Typhi
gauuugcgaaucauguuuu

SEQ ID NO: 3657623 - RNA, 17 nt, Salmonella enterica enterica serovar Typhi
gauuugcgcucgcgcca

SEQ ID NO: 3657624 - RNA, 13 nt, Salmonella enterica enterica serovar Typhi
gauuugcggcaau

SEQ ID NO: 3657625 - RNA, 23 nt, Salmonella enterica enterica serovar Typhi
gauuugcugcugcucgcuaugaa

SEQ ID NO: 3657626 - RNA, 21 nt, Salmonella enterica enterica serovar Typhi
gauuuggucagucggauaaac

SEQ ID NO: 3657627 - RNA, 23 nt, Salmonella enterica enterica serovar Typhi
gauuuguacguauuuacaaauga

SEQ ID NO: 3657628 - RNA, 18 nt, Salmonella enterica enterica serovar Typhi
gauuuguaggccugauaa

SEQ ID NO: 3657629 - RNA, 12 nt, Salmonella enterica enterica serovar Typhi
gauuuguuaucu

SEQ ID NO: 3657630 - RNA, 15 nt, Salmonella enterica enterica serovar Typhi
gauuuguuucaucgc

SEQ ID NO: 3657631 - RNA, 12 nt, Salmonella enterica enterica serovar Typhi
gauuuuaaauug

SEQ ID NO: 3657632 - RNA, 19 nt, Salmonella enterica enterica serovar Typhi
gauuuuagcgcaucgcucc

SEQ ID NO: 3657633 - RNA, 17 nt, Salmonella enterica enterica serovar Typhi
gauuuuaucaagucgcg

SEQ ID NO: 3657634 - RNA, 19 nt, Salmonella enterica enterica serovar Typhi
gauuuuaucaagucgcguu

SEQ ID NO: 3657635 - RNA, 18 nt, Salmonella enterica enterica serovar Typhi
gauuuucauuuagcgccu

SEQ ID NO: 3657636 - RNA, 20 nt, Salmonella enterica enterica serovar Typhi
gauuuucccuucugaaauga

SEQ ID NO: 3657637 - RNA, 21 nt, Salmonella enterica enterica serovar Typhi
gauuuucuuauuacaagaaag

SEQ ID NO: 3657638 - RNA, 15 nt, Salmonella enterica enterica serovar Typhi
gauuuugagcacugu

SEQ ID NO: 3657639 - RNA, 15 nt, Salmonella enterica enterica serovar Typhi
gauuuugcguuacug

SEQ ID NO: 3657640 - RNA, 23 nt, Salmonella enterica enterica serovar Typhi
gauuuuuaccgccgguuuauccc

SEQ ID NO: 3657641 - RNA, 20 nt, Salmonella enterica enterica serovar Typhi
gauuuuucaucuucaguaag

SEQ ID NO: 3657642 - RNA, 19 nt, Salmonella enterica enterica serovar Typhi
gcaaaaacaccuaacccac

SEQ ID NO: 3657643 - RNA, 15 nt, Salmonella enterica enterica serovar Typhi
gcaaaaauaggcuuu

SEQ ID NO: 3657644 - RNA, 14 nt, Salmonella enterica enterica serovar Typhi
gcaaaaaucagccc

SEQ ID NO: 3657645 - RNA, 18 nt, Salmonella enterica enterica serovar Typhi
gcaaaaccagacgccgau

SEQ ID NO: 3657646 - RNA, 19 nt, Salmonella enterica enterica serovar Typhi
gcaaaacgcauccagcgca

SEQ ID NO: 3657647 - RNA, 21 nt, Salmonella enterica enterica serovar Typhi
gcaaaacucucaccgaccugc

SEQ ID NO: 3657648 - RNA, 12 nt, Salmonella enterica enterica serovar Typhi
gcaaaagaaaaa

SEQ ID NO: 3657649 - RNA, 13 nt, Salmonella enterica enterica serovar Typhi
gcaaaagaaaaaa

SEQ ID NO: 3657650 - RNA, 18 nt, Salmonella enterica enterica serovar Typhi
gcaaaagcgguaauaacu

SEQ ID NO: 3657651 - RNA, 23 nt, Salmonella enterica enterica serovar Typhi
gcaaaauaguucagcgcagagug

SEQ ID NO: 3657652 - RNA, 15 nt, Salmonella enterica enterica serovar Typhi
gcaaaauauauaauu

SEQ ID NO: 3657653 - RNA, 15 nt, Salmonella enterica enterica serovar Typhi
gcaaaauucacacca

SEQ ID NO: 3657654 - RNA, 15 nt, Salmonella enterica enterica serovar Typhi
gcaaacaacccggcu

SEQ ID NO: 3657655 - RNA, 21 nt, Salmonella enterica enterica serovar Typhi
gcaaacacaaucacgcccagc

SEQ ID NO: 3657656 - RNA, 16 nt, Salmonella enterica enterica serovar Typhi
gcaaacaccucagcca

SEQ ID NO: 3657657 - RNA, 18 nt, Salmonella enterica enterica serovar Typhi
gcaaacaccucagccacc

SEQ ID NO: 3657658 - RNA, 13 nt, Salmonella enterica enterica serovar Typhi
gcaaacagcacgc

SEQ ID NO: 3657659 - RNA, 17 nt, Salmonella enterica enterica serovar Typhi
gcaaacaguacgcccgc

SEQ ID NO: 3657660 - RNA, 22 nt, Salmonella enterica enterica serovar Typhi
gcaaacagugggaagcacaucc

SEQ ID NO: 3657661 - RNA, 20 nt, Salmonella enterica enterica serovar Typhi
gcaaacauagccucaagaga

SEQ ID NO: 3657662 - RNA, 12 nt, Salmonella enterica enterica serovar Typhi
gcaaacaucccc

SEQ ID NO: 3657663 - RNA, 22 nt, Salmonella enterica enterica serovar Typhi
gcaaaccaucgucggacaacgu

SEQ ID NO: 3657664 - RNA, 18 nt, Salmonella enterica enterica serovar Typhi
gcaaacccacccgguaau

SEQ ID NO: 3657665 - RNA, 12 nt, Salmonella enterica enterica serovar Typhi
gcaaacccucau

SEQ ID NO: 3657666 - RNA, 19 nt, Salmonella enterica enterica serovar Typhi
gcaaaccgauaaucaccag

SEQ ID NO: 3657667 - RNA, 20 nt, Salmonella enterica enterica serovar Typhi
gcaaaccggguaacaacauu

SEQ ID NO: 3657668 - RNA, 13 nt, Salmonella enterica enterica serovar Typhi
gcaaaccucuccc

SEQ ID NO: 3657669 - RNA, 15 nt, Salmonella enterica enterica serovar Typhi
gcaaaccuuccgcca

SEQ ID NO: 3657670 - RNA, 15 nt, Salmonella enterica enterica serovar Typhi
gcaaacgauaaaagc

SEQ ID NO: 3657671 - RNA, 18 nt, Salmonella enterica enterica serovar Typhi
gcaaacgauaaaagcucu

SEQ ID NO: 3657672 - RNA, 13 nt, Salmonella enterica enterica serovar Typhi
gcaaacgcgauac

SEQ ID NO: 3657673 - RNA, 14 nt, Salmonella enterica enterica serovar Typhi
gcaaacgggauucc

SEQ ID NO: 3657674 - RNA, 14 nt, Salmonella enterica enterica serovar Typhi
gcaaacucagcggc

SEQ ID NO: 3657675 - RNA, 18 nt, Salmonella enterica enterica serovar Typhi
gcaaacucagcggcucug

SEQ ID NO: 3657676 - RNA, 15 nt, Salmonella enterica enterica serovar Typhi
gcaaacugccaggca

SEQ ID NO: 3657677 - RNA, 21 nt, Salmonella enterica enterica serovar Typhi
gcaaacugcucauuauggacg

SEQ ID NO: 3657678 - RNA, 23 nt, Salmonella enterica enterica serovar Typhi
gcaaacuucacauuuuuaucagc

SEQ ID NO: 3657679 - RNA, 14 nt, Salmonella enterica enterica serovar Typhi
gcaaacuuugcgcc

SEQ ID NO: 3657680 - RNA, 16 nt, Salmonella enterica enterica serovar Typhi
gcaaagacaggugacc

SEQ ID NO: 3657681 - RNA, 16 nt, Salmonella enterica enterica serovar Typhi
gcaaagcacugcugcu

SEQ ID NO: 3657682 - RNA, 22 nt, Salmonella enterica enterica serovar Typhi
gcaaagcacugcugcugaaaga

SEQ ID NO: 3657683 - RNA, 22 nt, Salmonella enterica enterica serovar Typhi
gcaaagcccacgcccugcaaug

SEQ ID NO: 3657684 - RNA, 18 nt, Salmonella enterica enterica serovar Typhi
gcaaagcccaucagcgcc

SEQ ID NO: 3657685 - RNA, 19 nt, Salmonella enterica enterica serovar Typhi
gcaaagcccaucagcgcca

SEQ ID NO: 3657686 - RNA, 22 nt, Salmonella enterica enterica serovar Typhi
gcaaagcccaucagcgccagcc

SEQ ID NO: 3657687 - RNA, 13 nt, Salmonella enterica enterica serovar Typhi
gcaaagccccagu

SEQ ID NO: 3657688 - RNA, 16 nt, Salmonella enterica enterica serovar Typhi
gcaaagcgucgcguca

SEQ ID NO: 3657689 - RNA, 16 nt, Salmonella enterica enterica serovar Typhi
gcaaagcguugcaacc

SEQ ID NO: 3657690 - RNA, 15 nt, Salmonella enterica enterica serovar Typhi
gcaaagcucaacgca

SEQ ID NO: 3657691 - RNA, 18 nt, Salmonella enterica enterica serovar Typhi
gcaaaggaucaucggcca

SEQ ID NO: 3657692 - RNA, 15 nt, Salmonella enterica enterica serovar Typhi
gcaaagguugccgca

SEQ ID NO: 3657693 - RNA, 22 nt, Salmonella enterica enterica serovar Typhi
gcaaagucgaacgacugaguau

SEQ ID NO: 3657694 - RNA, 20 nt, Salmonella enterica enterica serovar Typhi
gcaaagucuuuuguauugcg

SEQ ID NO: 3657695 - RNA, 16 nt, Salmonella enterica enterica serovar Typhi
gcaaauacaucgccac

SEQ ID NO: 3657696 - RNA, 15 nt, Salmonella enterica enterica serovar Typhi
gcaaauaccacauca

SEQ ID NO: 3657697 - RNA, 19 nt, Salmonella enterica enterica serovar Typhi
gcaaauaccacaucagacc

SEQ ID NO: 3657698 - RNA, 19 nt, Salmonella enterica enterica serovar Typhi
gcaaauaccggacagacuu

SEQ ID NO: 3657699 - RNA, 19 nt, Salmonella enterica enterica serovar Typhi
gcaaauacugcuuuuccgg

SEQ ID NO: 3657700 - RNA, 19 nt, Salmonella enterica enterica serovar Typhi
gcaaauagguuuuaugcau

SEQ ID NO: 3657701 - RNA, 15 nt, Salmonella enterica enterica serovar Typhi
gcaaaucaacauuau

SEQ ID NO: 3657702 - RNA, 20 nt, Salmonella enterica enterica serovar Typhi
gcaaaucaacauuauuaaaa

SEQ ID NO: 3657703 - RNA, 20 nt, Salmonella enterica enterica serovar Typhi
gcaaaucccugaucggccag

SEQ ID NO: 3657704 - RNA, 17 nt, Salmonella enterica enterica serovar Typhi
gcaaaucgcgguaaaaa

SEQ ID NO: 3657705 - RNA, 17 nt, Salmonella enterica enterica serovar Typhi
gcaaaucugccgucauc

SEQ ID NO: 3657706 - RNA, 19 nt, Salmonella enterica enterica serovar Typhi
gcaaaugaccagaucaaca

SEQ ID NO: 3657707 - RNA, 16 nt, Salmonella enterica enterica serovar Typhi
gcaaaugccaucccau

SEQ ID NO: 3657708 - RNA, 22 nt, Salmonella enterica enterica serovar Typhi
gcaaaugucagaucguaugcgc

SEQ ID NO: 3657709 - RNA, 22 nt, Salmonella enterica enterica serovar Typhi
gcaaauuccaacauauuugccc

SEQ ID NO: 3657710 - RNA, 19 nt, Salmonella enterica enterica serovar Typhi
gcaaauucgucgccgccaa

SEQ ID NO: 3657711 - RNA, 23 nt, Salmonella enterica enterica serovar Typhi
gcaaauucuguaucgcuuauuuu

SEQ ID NO: 3657712 - RNA, 13 nt, Salmonella enterica enterica serovar Typhi
gcaaauucuuuuc

SEQ ID NO: 3657713 - RNA, 14 nt, Salmonella enterica enterica serovar Typhi
gcaaauucuuuuca

SEQ ID NO: 3657714 - RNA, 15 nt, Salmonella enterica enterica serovar Typhi
gcaaauuuaagccag

SEQ ID NO: 3657715 - RNA, 11 nt, Salmonella enterica enterica serovar Typhi
gcaacaacagu

SEQ ID NO: 3657716 - RNA, 12 nt, Salmonella enterica enterica serovar Typhi
gcaacacacgcu

SEQ ID NO: 3657717 - RNA, 14 nt, Salmonella enterica enterica serovar Typhi
gcaacacagccagc

SEQ ID NO: 3657718 - RNA, 13 nt, Salmonella enterica enterica serovar Typhi
gcaacaccauccc

SEQ ID NO: 3657719 - RNA, 21 nt, Salmonella enterica enterica serovar Typhi
gcaacacgacaaaagcaucaa

SEQ ID NO: 3657720 - RNA, 20 nt, Salmonella enterica enterica serovar Typhi
gcaacagauacggcgcgucg

SEQ ID NO: 3657721 - RNA, 12 nt, Salmonella enterica enterica serovar Typhi
gcaacagcacca

SEQ ID NO: 3657722 - RNA, 16 nt, Salmonella enterica enterica serovar Typhi
gcaacagcaccagcag

SEQ ID NO: 3657723 - RNA, 22 nt, Salmonella enterica enterica serovar Typhi
gcaacagccauuuuaaaaauau

SEQ ID NO: 3657724 - RNA, 13 nt, Salmonella enterica enterica serovar Typhi
gcaacagcguacc

SEQ ID NO: 3657725 - RNA, 22 nt, Salmonella enterica enterica serovar Typhi
gcaacagggugauuucgcccgc

SEQ ID NO: 3657726 - RNA, 23 nt, Salmonella enterica enterica serovar Typhi
gcaacaguaccugauaaaauucc

SEQ ID NO: 3657727 - RNA, 13 nt, Salmonella enterica enterica serovar Typhi
gcaacagucagcu

SEQ ID NO: 3657728 - RNA, 16 nt, Salmonella enterica enterica serovar Typhi
gcaacagucagcuccu

SEQ ID NO: 3657729 - RNA, 20 nt, Salmonella enterica enterica serovar Typhi
gcaacagugggcuaugaaga

SEQ ID NO: 3657730 - RNA, 21 nt, Salmonella enterica enterica serovar Typhi
gcaacagugggcuaugaagag

SEQ ID NO: 3657731 - RNA, 15 nt, Salmonella enterica enterica serovar Typhi
gcaacaguugcugga

SEQ ID NO: 3657732 - RNA, 21 nt, Salmonella enterica enterica serovar Typhi
gcaacauaaauaaacagcgcc

SEQ ID NO: 3657733 - RNA, 14 nt, Salmonella enterica enterica serovar Typhi
gcaacauagcaucg

SEQ ID NO: 3657734 - RNA, 16 nt, Salmonella enterica enterica serovar Typhi
gcaacaugcccaccgg

SEQ ID NO: 3657735 - RNA, 14 nt, Salmonella enterica enterica serovar Typhi
gcaacauggacacc

SEQ ID NO: 3657736 - RNA, 15 nt, Salmonella enterica enterica serovar Typhi
gcaacauuacugacc

SEQ ID NO: 3657737 - RNA, 19 nt, Salmonella enterica enterica serovar Typhi
gcaacauucugcuuccaga

SEQ ID NO: 3657738 - RNA, 13 nt, Salmonella enterica enterica serovar Typhi
gcaaccaggucac

SEQ ID NO: 3657739 - RNA, 13 nt, Salmonella enterica enterica serovar Typhi
gcaacccauacag

SEQ ID NO: 3657740 - RNA, 20 nt, Salmonella enterica enterica serovar Typhi
gcaacccauacagcccauac

SEQ ID NO: 3657741 - RNA, 21 nt, Salmonella enterica enterica serovar Typhi
gcaaccccuugcggugcagca

SEQ ID NO: 3657742 - RNA, 15 nt, Salmonella enterica enterica serovar Typhi
gcaacccgcuccaga

SEQ ID NO: 3657743 - RNA, 21 nt, Salmonella enterica enterica serovar Typhi
gcaacccguaccuccagcgac

SEQ ID NO: 3657744 - RNA, 21 nt, Salmonella enterica enterica serovar Typhi
gcaacccugccgucucaacca

SEQ ID NO: 3657745 - RNA, 15 nt, Salmonella enterica enterica serovar Typhi
gcaacccuuuuucaa

SEQ ID NO: 3657746 - RNA, 19 nt, Salmonella enterica enterica serovar Typhi
gcaaccgacgggcgcuggu

SEQ ID NO: 3657747 - RNA, 14 nt, Salmonella enterica enterica serovar Typhi
gcaaccggcguggu

SEQ ID NO: 3657748 - RNA, 14 nt, Salmonella enterica enterica serovar Typhi
gcaaccuuacguuu

SEQ ID NO: 3657749 - RNA, 17 nt, Salmonella enterica enterica serovar Typhi
gcaacgaaaaucauccg

SEQ ID NO: 3657750 - RNA, 17 nt, Salmonella enterica enterica serovar Typhi
gcaacgacgucuuucuu

SEQ ID NO: 3657751 - RNA, 19 nt, Salmonella enterica enterica serovar Typhi
gcaacgaucccuaauaaaa

SEQ ID NO: 3657752 - RNA, 14 nt, Salmonella enterica enterica serovar Typhi
gcaacgccgccagc

SEQ ID NO: 3657753 - RNA, 13 nt, Salmonella enterica enterica serovar Typhi
gcaacgccgccga

SEQ ID NO: 3657754 - RNA, 15 nt, Salmonella enterica enterica serovar Typhi
gcaacgccggugccu

SEQ ID NO: 3657755 - RNA, 11 nt, Salmonella enterica enterica serovar Typhi
gcaacgcgcac

SEQ ID NO: 3657756 - RNA, 14 nt, Salmonella enterica enterica serovar Typhi
gcaacgcgcaucaa

SEQ ID NO: 3657757 - RNA, 17 nt, Salmonella enterica enterica serovar Typhi
gcaacgcgccauccggc

SEQ ID NO: 3657758 - RNA, 15 nt, Salmonella enterica enterica serovar Typhi
gcaacgcuuccaccu

SEQ ID NO: 3657759 - RNA, 19 nt, Salmonella enterica enterica serovar Typhi
gcaacggcauuccgcuggu

SEQ ID NO: 3657760 - RNA, 15 nt, Salmonella enterica enterica serovar Typhi
gcaacggccagcgca

SEQ ID NO: 3657761 - RNA, 17 nt, Salmonella enterica enterica serovar Typhi
gcaacggccagcgcagg

SEQ ID NO: 3657762 - RNA, 19 nt, Salmonella enterica enterica serovar Typhi
gcaacggccagcgcaggcu

SEQ ID NO: 3657763 - RNA, 19 nt, Salmonella enterica enterica serovar Typhi
gcaacggcgaggugcuggu

SEQ ID NO: 3657764 - RNA, 15 nt, Salmonella enterica enterica serovar Typhi
gcaacgggcagucug

SEQ ID NO: 3657765 - RNA, 23 nt, Salmonella enterica enterica serovar Typhi
gcaacgggcagucuggcggcagc

SEQ ID NO: 3657766 - RNA, 21 nt, Salmonella enterica enterica serovar Typhi
gcaacggguuagacucagcga

SEQ ID NO: 3657767 - RNA, 20 nt, Salmonella enterica enterica serovar Typhi
gcaacggugagaccauugca

SEQ ID NO: 3657768 - RNA, 15 nt, Salmonella enterica enterica serovar Typhi
gcaacguaaucccgc

SEQ ID NO: 3657769 - RNA, 22 nt, Salmonella enterica enterica serovar Typhi
gcaacguaaucccgccagccuu

SEQ ID NO: 3657770 - RNA, 15 nt, Salmonella enterica enterica serovar Typhi
gcaacguccgcagcc

SEQ ID NO: 3657771 - RNA, 21 nt, Salmonella enterica enterica serovar Typhi
gcaacgugaacugcgccugca

SEQ ID NO: 3657772 - RNA, 20 nt, Salmonella enterica enterica serovar Typhi
gcaacguuucuuucaucaga

SEQ ID NO: 3657773 - RNA, 18 nt, Salmonella enterica enterica serovar Typhi
gcaacguuuguaacagca

SEQ ID NO: 3657774 - RNA, 12 nt, Salmonella enterica enterica serovar Typhi
gcaacugaaacc

SEQ ID NO: 3657775 - RNA, 17 nt, Salmonella enterica enterica serovar Typhi
gcaacugauuaaucugc

SEQ ID NO: 3657776 - RNA, 18 nt, Salmonella enterica enterica serovar Typhi
gcaacugauuaaucugcc

SEQ ID NO: 3657777 - RNA, 17 nt, Salmonella enterica enterica serovar Typhi
gcaacugccggcuuacc

SEQ ID NO: 3657778 - RNA, 13 nt, Salmonella enterica enterica serovar Typhi
gcaacuggcaaua

SEQ ID NO: 3657779 - RNA, 21 nt, Salmonella enterica enterica serovar Typhi
gcaacuguuuuaccaaaucaa

SEQ ID NO: 3657780 - RNA, 14 nt, Salmonella enterica enterica serovar Typhi
gcaacuuaauaaua

SEQ ID NO: 3657781 - RNA, 21 nt, Salmonella enterica enterica serovar Typhi
gcaacuuacgcccuauccggc

SEQ ID NO: 3657782 - RNA, 17 nt, Salmonella enterica enterica serovar Typhi
gcaacuucaccucaguc

SEQ ID NO: 3657783 - RNA, 19 nt, Salmonella enterica enterica serovar Typhi
gcaacuucagaauccaggu

SEQ ID NO: 3657784 - RNA, 15 nt, Salmonella enterica enterica serovar Typhi
gcaauuccugacugc

SEQ ID NO: 3657785 - RNA, 18 nt, Salmonella enterica enterica serovar Typhi
gcaauugguaauuaaagg

SEQ ID NO: 3657786 - RNA, 21 nt, Salmonella enterica enterica serovar Typhi
gcaauugguaauuaaaggcag

SEQ ID NO: 3657787 - RNA, 18 nt, Salmonella enterica enterica serovar Typhi
gcaauuuaccuauuucga

SEQ ID NO: 3657788 - RNA, 12 nt, Salmonella enterica enterica serovar Typhi
gcaauuucucgc

SEQ ID NO: 3657789 - RNA, 21 nt, Salmonella enterica enterica serovar Typhi
gcaauuucucgcucgcccauc

SEQ ID NO: 3657790 - RNA, 23 nt, Salmonella enterica enterica serovar Typhi
gcaauuugguuagggaucaucuu

SEQ ID NO: 3657791 - RNA, 17 nt, Salmonella enterica enterica serovar Typhi
gcaauuuuaacgcaacc

SEQ ID NO: 3657792 - RNA, 17 nt, Salmonella enterica enterica serovar Typhi
gcacaaaaaaaccgcuc

SEQ ID NO: 3657793 - RNA, 15 nt, Salmonella enterica enterica serovar Typhi
gcacaaccuggcuug

SEQ ID NO: 3657794 - RNA, 16 nt, Salmonella enterica enterica serovar Typhi
gcacaacgaguccccu

SEQ ID NO: 3657795 - RNA, 18 nt, Salmonella enterica enterica serovar Typhi
gcacaacgaguccccuca

SEQ ID NO: 3657796 - RNA, 18 nt, Salmonella enterica enterica serovar Typhi
gcacaagaaacauguugu

SEQ ID NO: 3657797 - RNA, 23 nt, Salmonella enterica enterica serovar Typhi
gcacaauaacgucacgauagcgc

SEQ ID NO: 3657798 - RNA, 12 nt, Salmonella enterica enterica serovar Typhi
gcacaauaccaa

SEQ ID NO: 3657799 - RNA, 14 nt, Salmonella enterica enterica serovar Typhi
gcacaauaccaaua

SEQ ID NO: 3657800 - RNA, 17 nt, Salmonella enterica enterica serovar Typhi
gcacaauaccaauaaga

SEQ ID NO: 3657801 - RNA, 22 nt, Salmonella enterica enterica serovar Typhi
gcacaauaccgagaauguguuc

SEQ ID NO: 3657802 - RNA, 20 nt, Salmonella enterica enterica serovar Typhi
gcacaauaccuucugcgccc

SEQ ID NO: 3657803 - RNA, 23 nt, Salmonella enterica enterica serovar Typhi
gcacaauagcgcuaaacagcgcc

SEQ ID NO: 3657804 - RNA, 13 nt, Salmonella enterica enterica serovar Typhi
gcacaauuccggc

SEQ ID NO: 3657805 - RNA, 19 nt, Salmonella enterica enterica serovar Typhi
gcacaccgccguaaaggga

SEQ ID NO: 3657806 - RNA, 20 nt, Salmonella enterica enterica serovar Typhi
gcacaccggccauugccgcg

SEQ ID NO: 3657807 - RNA, 18 nt, Salmonella enterica enterica serovar Typhi
gcacacgaaauccaaaca

SEQ ID NO: 3657808 - RNA, 18 nt, Salmonella enterica enterica serovar Typhi
gcacacgccaaaaucgcc

SEQ ID NO: 3657809 - RNA, 19 nt, Salmonella enterica enterica serovar Typhi
gcacacgcuggaagagaac

SEQ ID NO: 3657810 - RNA, 15 nt, Salmonella enterica enterica serovar Typhi
gcacacuuucaucag

SEQ ID NO: 3657811 - RNA, 17 nt, Salmonella enterica enterica serovar Typhi
gcacacuuucaucagcc

SEQ ID NO: 3657812 - RNA, 18 nt, Salmonella enterica enterica serovar Typhi
gcacacuuucaucagccg

SEQ ID NO: 3657813 - RNA, 14 nt, Salmonella enterica enterica serovar Typhi
gcacagaagcgccu

SEQ ID NO: 3657814 - RNA, 15 nt, Salmonella enterica enterica serovar Typhi
gcacagccccagcac

SEQ ID NO: 3657815 - RNA, 16 nt, Salmonella enterica enterica serovar Typhi
gcacagccccagcacc

SEQ ID NO: 3657816 - RNA, 19 nt, Salmonella enterica enterica serovar Typhi
gcacagccccagcaccaac

SEQ ID NO: 3657817 - RNA, 20 nt, Salmonella enterica enterica serovar Typhi
gcacagcccuaccgccacca

SEQ ID NO: 3657818 - RNA, 16 nt, Salmonella enterica enterica serovar Typhi
gcacagcgcagcaacg

SEQ ID NO: 3657819 - RNA, 17 nt, Salmonella enterica enterica serovar Typhi
gcacagcgcuaucaggc

SEQ ID NO: 3657820 - RNA, 20 nt, Salmonella enterica enterica serovar Typhi
gcacagcgcuaucaggcacu

SEQ ID NO: 3657821 - RNA, 18 nt, Salmonella enterica enterica serovar Typhi
gcacaguacgcccggcgg

SEQ ID NO: 3657822 - RNA, 16 nt, Salmonella enterica enterica serovar Typhi
gcacaguauuaccgcu

SEQ ID NO: 3657823 - RNA, 14 nt, Salmonella enterica enterica serovar Typhi
gcacauaacgugcc

SEQ ID NO: 3657824 - RNA, 21 nt, Salmonella enterica enterica serovar Typhi
gcacauaggcaaacaccucag

SEQ ID NO: 3657825 - RNA, 12 nt, Salmonella enterica enterica serovar Typhi
gcacaucagccg

SEQ ID NO: 3657826 - RNA, 22 nt, Salmonella enterica enterica serovar Typhi
gcacaucaugaugaucuucagc

SEQ ID NO: 3657827 - RNA, 23 nt, Salmonella enterica enterica serovar Typhi
gcacauccucaaugguuucacgc

SEQ ID NO: 3657828 - RNA, 19 nt, Salmonella enterica enterica serovar Typhi
gcacaugacggcugacgca

SEQ ID NO: 3657829 - RNA, 19 nt, Salmonella enterica enterica serovar Typhi
gcacauguuucagcaccuc

SEQ ID NO: 3657830 - RNA, 14 nt, Salmonella enterica enterica serovar Typhi
gcacauucagagcg

SEQ ID NO: 3657831 - RNA, 13 nt, Salmonella enterica enterica serovar Typhi
gcacauucagcag

SEQ ID NO: 3657832 - RNA, 18 nt, Salmonella enterica enterica serovar Typhi
gcacauucagguggcuga

SEQ ID NO: 3657833 - RNA, 17 nt, Salmonella enterica enterica serovar Typhi
gcacauucgauaaccgc

SEQ ID NO: 3657834 - RNA, 17 nt, Salmonella enterica enterica serovar Typhi
gcacauuggcgagcagg

SEQ ID NO: 3657835 - RNA, 18 nt, Salmonella enterica enterica serovar Typhi
gcacauuggcgagcagga

SEQ ID NO: 3657836 - RNA, 20 nt, Salmonella enterica enterica serovar Typhi
gcacauuggcgagcaggaac

SEQ ID NO: 3657837 - RNA, 19 nt, Salmonella enterica enterica serovar Typhi
gcaccaacgauaaauuuuc

SEQ ID NO: 3657838 - RNA, 15 nt, Salmonella enterica enterica serovar Typhi
gcaccaacgccgcuu

SEQ ID NO: 3657839 - RNA, 14 nt, Salmonella enterica enterica serovar Typhi
gcaccaccugguua

SEQ ID NO: 3657840 - RNA, 16 nt, Salmonella enterica enterica serovar Typhi
gcaccagaaucauuaa

SEQ ID NO: 3657841 - RNA, 12 nt, Salmonella enterica enterica serovar Typhi
gcaccagaccga

SEQ ID NO: 3657842 - RNA, 17 nt, Salmonella enterica enterica serovar Typhi
gcaccagaccgacaagc

SEQ ID NO: 3657843 - RNA, 17 nt, Salmonella enterica enterica serovar Typhi
gcaccagcaggugguac

SEQ ID NO: 3657844 - RNA, 16 nt, Salmonella enterica enterica serovar Typhi
gcaccaguucacuccu

SEQ ID NO: 3657845 - RNA, 15 nt, Salmonella enterica enterica serovar Typhi
gcaccaguuccccau

SEQ ID NO: 3657846 - RNA, 16 nt, Salmonella enterica enterica serovar Typhi
gcaccaguuccccaua

SEQ ID NO: 3657847 - RNA, 13 nt, Salmonella enterica enterica serovar Typhi
gcaccaguugcgu

SEQ ID NO: 3657848 - RNA, 17 nt, Salmonella enterica enterica serovar Typhi
gcaccauguggcgcggc

SEQ ID NO: 3657849 - RNA, 18 nt, Salmonella enterica enterica serovar Typhi
gcaccauguggcgcggcc

SEQ ID NO: 3657850 - RNA, 14 nt, Salmonella enterica enterica serovar Typhi
gcaccauucuucaa

SEQ ID NO: 3657851 - RNA, 22 nt, Salmonella enterica enterica serovar Typhi
gcacccaccaucacuuccaucc

SEQ ID NO: 3657852 - RNA, 17 nt, Salmonella enterica enterica serovar Typhi
gcacccaucuuuaccaa

SEQ ID NO: 3657853 - RNA, 21 nt, Salmonella enterica enterica serovar Typhi
gcaccccucuucuuuaagaac

SEQ ID NO: 3657854 - RNA, 16 nt, Salmonella enterica enterica serovar Typhi
gcacccggagagaaac

SEQ ID NO: 3657855 - RNA, 16 nt, Salmonella enterica enterica serovar Typhi
gcaccgaaacagcacg

SEQ ID NO: 3657856 - RNA, 13 nt, Salmonella enterica enterica serovar Typhi
gcaccgaauguuc

SEQ ID NO: 3657857 - RNA, 15 nt, Salmonella enterica enterica serovar Typhi
gcaccgaauguuccg

SEQ ID NO: 3657858 - RNA, 20 nt, Salmonella enterica enterica serovar Typhi
gcaccgccaaacgcggucag

SEQ ID NO: 3657859 - RNA, 19 nt, Salmonella enterica enterica serovar Typhi
gcaccgccuugcccguauu

SEQ ID NO: 3657860 - RNA, 20 nt, Salmonella enterica enterica serovar Typhi
gcaccgcgaccaguucaccg

SEQ ID NO: 3657861 - RNA, 20 nt, Salmonella enterica enterica serovar Typhi
gcaccgcuaaaaaacaggcg

SEQ ID NO: 3657862 - RNA, 15 nt, Salmonella enterica enterica serovar Typhi
gcaccggaacagaag

SEQ ID NO: 3657863 - RNA, 17 nt, Salmonella enterica enterica serovar Typhi
gcaccggaaccggcauc

SEQ ID NO: 3657864 - RNA, 18 nt, Salmonella enterica enterica serovar Typhi
gcaccguaggccugauaa

SEQ ID NO: 3657865 - RNA, 19 nt, Salmonella enterica enterica serovar Typhi
gcaccguaucggcagucac

SEQ ID NO: 3657866 - RNA, 19 nt, Salmonella enterica enterica serovar Typhi
gcaccgucgagaaaccgcu

SEQ ID NO: 3657867 - RNA, 21 nt, Salmonella enterica enterica serovar Typhi
gcaccucagaccguuagccgg

SEQ ID NO: 3657868 - RNA, 14 nt, Salmonella enterica enterica serovar Typhi
gcaccuccagcgcc

SEQ ID NO: 3657869 - RNA, 16 nt, Salmonella enterica enterica serovar Typhi
gcaccucgcaauauuc

SEQ ID NO: 3657870 - RNA, 17 nt, Salmonella enterica enterica serovar Typhi
gcagaccggaugauggc

SEQ ID NO: 3657871 - RNA, 17 nt, Salmonella enterica enterica serovar Typhi
gcagaccggcagccugc

SEQ ID NO: 3657872 - RNA, 19 nt, Salmonella enterica enterica serovar Typhi
gcagaccggcagccugccg

SEQ ID NO: 3657873 - RNA, 19 nt, Salmonella enterica enterica serovar Typhi
gcagaccuauauggcgcaa

SEQ ID NO: 3657874 - RNA, 16 nt, Salmonella enterica enterica serovar Typhi
gcagacggagaugauc

SEQ ID NO: 3657875 - RNA, 13 nt, Salmonella enterica enterica serovar Typhi
gcagacuauaggu

SEQ ID NO: 3657876 - RNA, 19 nt, Salmonella enterica enterica serovar Typhi
gcagacugguaaccuguuc

SEQ ID NO: 3657877 - RNA, 21 nt, Salmonella enterica enterica serovar Typhi
gcagacugguaaccuguuccu

SEQ ID NO: 3657878 - RNA, 18 nt, Salmonella enterica enterica serovar Typhi
gcagacuuuaaccauucc

SEQ ID NO: 3657879 - RNA, 15 nt, Salmonella enterica enterica serovar Typhi
gcagacuuucugaca

SEQ ID NO: 3657880 - RNA, 18 nt, Salmonella enterica enterica serovar Typhi
gcagacuuucugacaggu

SEQ ID NO: 3657881 - RNA, 13 nt, Salmonella enterica enterica serovar Typhi
gcagagcccagcg

SEQ ID NO: 3657882 - RNA, 14 nt, Salmonella enterica enterica serovar Typhi
gcagagccggaacc

SEQ ID NO: 3657883 - RNA, 20 nt, Salmonella enterica enterica serovar Typhi
gcagagcgcgcucugccuuu

SEQ ID NO: 3657884 - RNA, 17 nt, Salmonella enterica enterica serovar Typhi
gcagaggccugaaugca

SEQ ID NO: 3657885 - RNA, 22 nt, Salmonella enterica enterica serovar Typhi
gcagaguaugcugcuaaagcac

SEQ ID NO: 3657886 - RNA, 16 nt, Salmonella enterica enterica serovar Typhi
gcagaguccagcggca

SEQ ID NO: 3657887 - RNA, 16 nt, Salmonella enterica enterica serovar Typhi
gcagagucgcagcggc

SEQ ID NO: 3657888 - RNA, 19 nt, Salmonella enterica enterica serovar Typhi
gcagagucgcagcggcggu

SEQ ID NO: 3657889 - RNA, 15 nt, Salmonella enterica enterica serovar Typhi
gcagauaacuuccuu

SEQ ID NO: 3657890 - RNA, 23 nt, Salmonella enterica enterica serovar Typhi
gcagauagcccgccagcaccagc

SEQ ID NO: 3657891 - RNA, 22 nt, Salmonella enterica enterica serovar Typhi
gcagauaucuuccagcgcgucc

SEQ ID NO: 3657892 - RNA, 21 nt, Salmonella enterica enterica serovar Typhi
gcagaucaagcgggggcgccu

SEQ ID NO: 3657893 - RNA, 16 nt, Salmonella enterica enterica serovar Typhi
gcagauccaucgccug

SEQ ID NO: 3657894 - RNA, 22 nt, Salmonella enterica enterica serovar Typhi
gcagaucccagguaaccgcuaa

SEQ ID NO: 3657895 - RNA, 13 nt, Salmonella enterica enterica serovar Typhi
gcagauccgcgau

SEQ ID NO: 3657896 - RNA, 20 nt, Salmonella enterica enterica serovar Typhi
gcagauccgcgauaucaauc

SEQ ID NO: 3657897 - RNA, 18 nt, Salmonella enterica enterica serovar Typhi
gcagaucgcgggcaauca

SEQ ID NO: 3657898 - RNA, 21 nt, Salmonella enterica enterica serovar Typhi
gcagaucggccuguuuuucug

SEQ ID NO: 3657899 - RNA, 15 nt, Salmonella enterica enterica serovar Typhi
gcagaucugucgcca

SEQ ID NO: 3657900 - RNA, 22 nt, Salmonella enterica enterica serovar Typhi
gcagaucuuuuugcuccugcgc

SEQ ID NO: 3657901 - RNA, 20 nt, Salmonella enterica enterica serovar Typhi
gcagaugaacggcaagaccu

SEQ ID NO: 3657902 - RNA, 22 nt, Salmonella enterica enterica serovar Typhi
gcagaugcccgcagaucugucg

SEQ ID NO: 3657903 - RNA, 17 nt, Salmonella enterica enterica serovar Typhi
gcagaugcucaggcaac

SEQ ID NO: 3657904 - RNA, 22 nt, Salmonella enterica enterica serovar Typhi
gcagaugguauaaaucacgcug

SEQ ID NO: 3657905 - RNA, 13 nt, Salmonella enterica enterica serovar Typhi
gcagauugaggcu

SEQ ID NO: 3657906 - RNA, 23 nt, Salmonella enterica enterica serovar Typhi
gcagcaaaccgauaaucaccagc

SEQ ID NO: 3657907 - RNA, 18 nt, Salmonella enterica enterica serovar Typhi
gcagcaaaucagcuacuu

SEQ ID NO: 3657908 - RNA, 22 nt, Salmonella enterica enterica serovar Typhi
gcagcaaaucagcuacuuuaaa

SEQ ID NO: 3657909 - RNA, 15 nt, Salmonella enterica enterica serovar Typhi
gcagcaacccugccg

SEQ ID NO: 3657910 - RNA, 17 nt, Salmonella enterica enterica serovar Typhi
gcagcaacgucucgaca

SEQ ID NO: 3657911 - RNA, 20 nt, Salmonella enterica enterica serovar Typhi
gcagcaacugauucaaaagg

SEQ ID NO: 3657912 - RNA, 14 nt, Salmonella enterica enterica serovar Typhi
gcagcaagaacaga

SEQ ID NO: 3657913 - RNA, 15 nt, Salmonella enterica enterica serovar Typhi
gcagcaagaacagag

SEQ ID NO: 3657914 - RNA, 16 nt, Salmonella enterica enterica serovar Typhi
gcagcaagcggcuguc

SEQ ID NO: 3657915 - RNA, 22 nt, Salmonella enterica enterica serovar Typhi
gcagcaauaguugucagaccuu

SEQ ID NO: 3657916 - RNA, 17 nt, Salmonella enterica enterica serovar Typhi
gcagcacaugcaauuug

SEQ ID NO: 3657917 - RNA, 20 nt, Salmonella enterica enterica serovar Typhi
gcagcaccagauauuuuucc

SEQ ID NO: 3657918 - RNA, 18 nt, Salmonella enterica enterica serovar Typhi
gcagcaccgguuuuuccg

SEQ ID NO: 3657919 - RNA, 18 nt, Salmonella enterica enterica serovar Typhi
gcagcaccucaauaugaa

SEQ ID NO: 3657920 - RNA, 20 nt, Salmonella enterica enterica serovar Typhi
gcagcaccucaauaugaaau

SEQ ID NO: 3657921 - RNA, 20 nt, Salmonella enterica enterica serovar Typhi
gcagcacuucagaacggcua

SEQ ID NO: 3657922 - RNA, 15 nt, Salmonella enterica enterica serovar Typhi
gcagcagagaucagg

SEQ ID NO: 3657923 - RNA, 16 nt, Salmonella enterica enterica serovar Typhi
gcagcagagaucagga

SEQ ID NO: 3657924 - RNA, 22 nt, Salmonella enterica enterica serovar Typhi
gcagcagcgcuuucuucuucac

SEQ ID NO: 3657925 - RNA, 14 nt, Salmonella enterica enterica serovar Typhi
gcagcagcggaauc

SEQ ID NO: 3657926 - RNA, 12 nt, Salmonella enterica enterica serovar Typhi
gcagcagcuuca

SEQ ID NO: 3657927 - RNA, 15 nt, Salmonella enterica enterica serovar Typhi
gcagcaguucuucgc

SEQ ID NO: 3657928 - RNA, 17 nt, Salmonella enterica enterica serovar Typhi
gcagcauaaacaucagc

SEQ ID NO: 3657929 - RNA, 14 nt, Salmonella enterica enterica serovar Typhi
gcagcauaucgccg

SEQ ID NO: 3657930 - RNA, 18 nt, Salmonella enterica enterica serovar Typhi
gcagcauaucgccguuca

SEQ ID NO: 3657931 - RNA, 15 nt, Salmonella enterica enterica serovar Typhi
gcagcaucccggcaa

SEQ ID NO: 3657932 - RNA, 19 nt, Salmonella enterica enterica serovar Typhi
gcagcaucccggcaaaaau

SEQ ID NO: 3657933 - RNA, 14 nt, Salmonella enterica enterica serovar Typhi
gcagccaacaacag

SEQ ID NO: 3657934 - RNA, 20 nt, Salmonella enterica enterica serovar Typhi
gcagccaacaacaggccgcc

SEQ ID NO: 3657935 - RNA, 17 nt, Salmonella enterica enterica serovar Typhi
gcagccaacgccgccau

SEQ ID NO: 3657936 - RNA, 22 nt, Salmonella enterica enterica serovar Typhi
gcagccagaaaaagggaaaagc

SEQ ID NO: 3657937 - RNA, 16 nt, Salmonella enterica enterica serovar Typhi
gcagccagaacucauc

SEQ ID NO: 3657938 - RNA, 14 nt, Salmonella enterica enterica serovar Typhi
gcagccagcaauaa

SEQ ID NO: 3657939 - RNA, 17 nt, Salmonella enterica enterica serovar Typhi
gcagccaggcaaagccc

SEQ ID NO: 3657940 - RNA, 19 nt, Salmonella enterica enterica serovar Typhi
gcagccaggccauuuuuuc

SEQ ID NO: 3657941 - RNA, 13 nt, Salmonella enterica enterica serovar Typhi
gcagccccggcau

SEQ ID NO: 3657942 - RNA, 18 nt, Salmonella enterica enterica serovar Typhi
gcagccccggcauccagu

SEQ ID NO: 3657943 - RNA, 18 nt, Salmonella enterica enterica serovar Typhi
gcagcccgcccacaggcu

SEQ ID NO: 3657944 - RNA, 23 nt, Salmonella enterica enterica serovar Typhi
gcagcccugcgucgcguaccagc

SEQ ID NO: 3657945 - RNA, 14 nt, Salmonella enterica enterica serovar Typhi
gcagccgacagcgu

SEQ ID NO: 3657946 - RNA, 17 nt, Salmonella enterica enterica serovar Typhi
gcagccgccauccggca

SEQ ID NO: 3657947 - RNA, 12 nt, Salmonella enterica enterica serovar Typhi
gcagccggauag

SEQ ID NO: 3657948 - RNA, 15 nt, Salmonella enterica enterica serovar Typhi
gcagccgggccagac

SEQ ID NO: 3657949 - RNA, 18 nt, Salmonella enterica enterica serovar Typhi
gcagccgggccagacgcu

SEQ ID NO: 3657950 - RNA, 19 nt, Salmonella enterica enterica serovar Typhi
gcagccgguauccagcgcg

SEQ ID NO: 3657951 - RNA, 14 nt, Salmonella enterica enterica serovar Typhi
gcagccucguccug

SEQ ID NO: 3657952 - RNA, 17 nt, Salmonella enterica enterica serovar Typhi
gcagccucguccugcaa

SEQ ID NO: 3657953 - RNA, 13 nt, Salmonella enterica enterica serovar Typhi
gcagccugccgca

SEQ ID NO: 3657954 - RNA, 17 nt, Salmonella enterica enterica serovar Typhi
gcagcgacgcauugaga

SEQ ID NO: 3657955 - RNA, 20 nt, Salmonella enterica enterica serovar Typhi
gcaggcuuccacgcacgccg

SEQ ID NO: 3657956 - RNA, 22 nt, Salmonella enterica enterica serovar Typhi
gcaggcuuccacgcacgccggc

SEQ ID NO: 3657957 - RNA, 16 nt, Salmonella enterica enterica serovar Typhi
gcaggcuuugcugcug

SEQ ID NO: 3657958 - RNA, 18 nt, Salmonella enterica enterica serovar Typhi
gcagggacgcugcugacg

SEQ ID NO: 3657959 - RNA, 17 nt, Salmonella enterica enterica serovar Typhi
gcagggacuuauuaaaa

SEQ ID NO: 3657960 - RNA, 14 nt, Salmonella enterica enterica serovar Typhi
gcagggauccugua

SEQ ID NO: 3657961 - RNA, 17 nt, Salmonella enterica enterica serovar Typhi
gcagggaugacagaaag

SEQ ID NO: 3657962 - RNA, 15 nt, Salmonella enterica enterica serovar Typhi
gcagggcaugauuac

SEQ ID NO: 3657963 - RNA, 17 nt, Salmonella enterica enterica serovar Typhi
gcaggggcuccugcgcc

SEQ ID NO: 3657964 - RNA, 22 nt, Salmonella enterica enterica serovar Typhi
gcaggggcuccugcgccggacg

SEQ ID NO: 3657965 - RNA, 20 nt, Salmonella enterica enterica serovar Typhi
gcaggggcucuaaaaaggaa

SEQ ID NO: 3657966 - RNA, 20 nt, Salmonella enterica enterica serovar Typhi
gcaggguauuugugcccgcg

SEQ ID NO: 3657967 - RNA, 21 nt, Salmonella enterica enterica serovar Typhi
gcagguaacgacuacuuccag

SEQ ID NO: 3657968 - RNA, 22 nt, Salmonella enterica enterica serovar Typhi
gcagguaguaaccccaguagcc

SEQ ID NO: 3657969 - RNA, 18 nt, Salmonella enterica enterica serovar Typhi
gcagguaguccaaauaag

SEQ ID NO: 3657970 - RNA, 17 nt, Salmonella enterica enterica serovar Typhi
gcaggucaaagacgaaa

SEQ ID NO: 3657971 - RNA, 18 nt, Salmonella enterica enterica serovar Typhi
gcaggucgcguagcuuuu

SEQ ID NO: 3657972 - RNA, 19 nt, Salmonella enterica enterica serovar Typhi
gcaggucuucgucagcgca

SEQ ID NO: 3657973 - RNA, 19 nt, Salmonella enterica enterica serovar Typhi
gcaggugcggcugggcgag

SEQ ID NO: 3657974 - RNA, 16 nt, Salmonella enterica enterica serovar Typhi
gcagguggaucugaau

SEQ ID NO: 3657975 - RNA, 12 nt, Salmonella enterica enterica serovar Typhi
gcagguggccca

SEQ ID NO: 3657976 - RNA, 16 nt, Salmonella enterica enterica serovar Typhi
gcaggugguacaucaa

SEQ ID NO: 3657977 - RNA, 18 nt, Salmonella enterica enterica serovar Typhi
gcagguugagucugcucg

SEQ ID NO: 3657978 - RNA, 20 nt, Salmonella enterica enterica serovar Typhi
gcagguugccgaugacuccc

SEQ ID NO: 3657979 - RNA, 20 nt, Salmonella enterica enterica serovar Typhi
gcagguuuuacuucuucagg

SEQ ID NO: 3657980 - RNA, 20 nt, Salmonella enterica enterica serovar Typhi
gcaguaacgcacuuuuccag

SEQ ID NO: 3657981 - RNA, 14 nt, Salmonella enterica enterica serovar Typhi
gcaguaacgcauac

SEQ ID NO: 3657982 - RNA, 17 nt, Salmonella enterica enterica serovar Typhi
gcaguacacgcaucggg

SEQ ID NO: 3657983 - RNA, 19 nt, Salmonella enterica enterica serovar Typhi
gcaguagauucuaucuguu

SEQ ID NO: 3657984 - RNA, 21 nt, Salmonella enterica enterica serovar Typhi
gcaguagccacgguaacagcu

SEQ ID NO: 3657985 - RNA, 22 nt, Salmonella enterica enterica serovar Typhi
gcaguagcgcuuugacaucggg

SEQ ID NO: 3657986 - RNA, 22 nt, Salmonella enterica enterica serovar Typhi
gcaguauccgugccgagguggu

SEQ ID NO: 3657987 - RNA, 18 nt, Salmonella enterica enterica serovar Typhi
gcaguaugaccccuccgg

SEQ ID NO: 3657988 - RNA, 17 nt, Salmonella enterica enterica serovar Typhi
gcaguauugcaccagga

SEQ ID NO: 3657989 - RNA, 20 nt, Salmonella enterica enterica serovar Typhi
gcaguauugcaccaggaaga

SEQ ID NO: 3657990 - RNA, 22 nt, Salmonella enterica enterica serovar Typhi
gcagucaaaacgacauaaccgg

SEQ ID NO: 3657991 - RNA, 21 nt, Salmonella enterica enterica serovar Typhi
gcagucacuuucagauuuuua

SEQ ID NO: 3657992 - RNA, 15 nt, Salmonella enterica enterica serovar Typhi
gcagucccgccggga

SEQ ID NO: 3657993 - RNA, 17 nt, Salmonella enterica enterica serovar Typhi
gcaguccuugcagccag

SEQ ID NO: 3657994 - RNA, 18 nt, Salmonella enterica enterica serovar Typhi
gcagucguuuacgcgcuu

SEQ ID NO: 3657995 - RNA, 16 nt, Salmonella enterica enterica serovar Typhi
gcagucguuucuauua

SEQ ID NO: 3657996 - RNA, 15 nt, Salmonella enterica enterica serovar Typhi
gcagucuggcggcag

SEQ ID NO: 3657997 - RNA, 16 nt, Salmonella enterica enterica serovar Typhi
gcagugacauuuaucu

SEQ ID NO: 3657998 - RNA, 15 nt, Salmonella enterica enterica serovar Typhi
gcagugaccagcauc

SEQ ID NO: 3657999 - RNA, 19 nt, Salmonella enterica enterica serovar Typhi
gcagugaggauaaggcaag

SEQ ID NO: 3658000 - RNA, 18 nt, Salmonella enterica enterica serovar Typhi
gcagugauuaugcucccg

SEQ ID NO: 3658001 - RNA, 18 nt, Salmonella enterica enterica serovar Typhi
gcagugauucguaguaag

SEQ ID NO: 3658002 - RNA, 12 nt, Salmonella enterica enterica serovar Typhi
gcagugauuuua

SEQ ID NO: 3658003 - RNA, 18 nt, Salmonella enterica enterica serovar Typhi
gcaguggcauguucccau

SEQ ID NO: 3658004 - RNA, 20 nt, Salmonella enterica enterica serovar Typhi
gcaguggcauguucccaugu

SEQ ID NO: 3658005 - RNA, 17 nt, Salmonella enterica enterica serovar Typhi
gcaguguaucgaagauc

SEQ ID NO: 3658006 - RNA, 12 nt, Salmonella enterica enterica serovar Typhi
gcaguucaauau

SEQ ID NO: 3658007 - RNA, 12 nt, Salmonella enterica enterica serovar Typhi
gcaguucaucca

SEQ ID NO: 3658008 - RNA, 20 nt, Salmonella enterica enterica serovar Typhi
gcaguucuucgccguuaucg

SEQ ID NO: 3658009 - RNA, 17 nt, Salmonella enterica enterica serovar Typhi
gcaguugcagcguacgg

SEQ ID NO: 3658010 - RNA, 14 nt, Salmonella enterica enterica serovar Typhi
gcaguuggcggagg

SEQ ID NO: 3658011 - RNA, 18 nt, Salmonella enterica enterica serovar Typhi
gcaguugggcgcgcgacu

SEQ ID NO: 3658012 - RNA, 15 nt, Salmonella enterica enterica serovar Typhi
gcaguuuaaaucaca

SEQ ID NO: 3658013 - RNA, 18 nt, Salmonella enterica enterica serovar Typhi
gcaguuuacgcagcgccu

SEQ ID NO: 3658014 - RNA, 18 nt, Salmonella enterica enterica serovar Typhi
gcaguuuauccggcgcca

SEQ ID NO: 3658015 - RNA, 17 nt, Salmonella enterica enterica serovar Typhi
gcaguuugguaauacua

SEQ ID NO: 3658016 - RNA, 15 nt, Salmonella enterica enterica serovar Typhi
gcaguuuuuauccuc

SEQ ID NO: 3658017 - RNA, 12 nt, Salmonella enterica enterica serovar Typhi
gcauaaaaaaac

SEQ ID NO: 3658018 - RNA, 17 nt, Salmonella enterica enterica serovar Typhi
gcauaaaaaacaucaug

SEQ ID NO: 3658019 - RNA, 15 nt, Salmonella enterica enterica serovar Typhi
gcauaaaaaaggcuc

SEQ ID NO: 3658020 - RNA, 15 nt, Salmonella enterica enterica serovar Typhi
gcauaaaaaaugaga

SEQ ID NO: 3658021 - RNA, 15 nt, Salmonella enterica enterica serovar Typhi
gcauaaaaagccauc

SEQ ID NO: 3658022 - RNA, 19 nt, Salmonella enterica enterica serovar Typhi
gcauaaaaccgccgcccau

SEQ ID NO: 3658023 - RNA, 15 nt, Salmonella enterica enterica serovar Typhi
gcauaaagaacgugu

SEQ ID NO: 3658024 - RNA, 23 nt, Salmonella enterica enterica serovar Typhi
gcauaaaugccuuauccggccug

SEQ ID NO: 3658025 - RNA, 17 nt, Salmonella enterica enterica serovar Typhi
gcauaaauuggcucaga

SEQ ID NO: 3658026 - RNA, 13 nt, Salmonella enterica enterica serovar Typhi
gcauaacguacca

SEQ ID NO: 3658027 - RNA, 12 nt, Salmonella enterica enterica serovar Typhi
gcauaagccuca

SEQ ID NO: 3658028 - RNA, 23 nt, Salmonella enterica enterica serovar Typhi
gcauaauacggggccauuauuua

SEQ ID NO: 3658029 - RNA, 22 nt, Salmonella enterica enterica serovar Typhi
gcauaauaugaugcagacgggc

SEQ ID NO: 3658030 - RNA, 13 nt, Salmonella enterica enterica serovar Typhi
gcauaauaugcaa

SEQ ID NO: 3658031 - RNA, 16 nt, Salmonella enterica enterica serovar Typhi
gcauaauaugcaacac

SEQ ID NO: 3658032 - RNA, 19 nt, Salmonella enterica enterica serovar Typhi
gcauaaugacguccaggcc

SEQ ID NO: 3658033 - RNA, 18 nt, Salmonella enterica enterica serovar Typhi
gcauacacaucuucuaca

SEQ ID NO: 3658034 - RNA, 15 nt, Salmonella enterica enterica serovar Typhi
gcauacaccgccagc

SEQ ID NO: 3658035 - RNA, 15 nt, Salmonella enterica enterica serovar Typhi
gcauacagcuuuuac

SEQ ID NO: 3658036 - RNA, 14 nt, Salmonella enterica enterica serovar Typhi
gcauacgccccggu

SEQ ID NO: 3658037 - RNA, 20 nt, Salmonella enterica enterica serovar Typhi
gcauacucuccuccauaccu

SEQ ID NO: 3658038 - RNA, 23 nt, Salmonella enterica enterica serovar Typhi
gcauacucuuggagagcaucauc

SEQ ID NO: 3658039 - RNA, 16 nt, Salmonella enterica enterica serovar Typhi
gcauacugcgaugcgc

SEQ ID NO: 3658040 - RNA, 17 nt, Salmonella enterica enterica serovar Typhi
gcauacugcgaugcgcu

SEQ ID NO: 3658041 - RNA, 14 nt, Salmonella enterica enterica serovar Typhi
gcaucuuuaaccgc

SEQ ID NO: 3658042 - RNA, 17 nt, Salmonella enterica enterica serovar Typhi
gcaucuuuaaccgccug

SEQ ID NO: 3658043 - RNA, 20 nt, Salmonella enterica enterica serovar Typhi
gcaugaauaaccucccgccg

SEQ ID NO: 3658044 - RNA, 19 nt, Salmonella enterica enterica serovar Typhi
gcaugacaauaacggccuc

SEQ ID NO: 3658045 - RNA, 14 nt, Salmonella enterica enterica serovar Typhi
gcaugaccauccac

SEQ ID NO: 3658046 - RNA, 14 nt, Salmonella enterica enterica serovar Typhi
gcaugagcacgcgg

SEQ ID NO: 3658047 - RNA, 14 nt, Salmonella enterica enterica serovar Typhi
gcaugagccagccc

SEQ ID NO: 3658048 - RNA, 16 nt, Salmonella enterica enterica serovar Typhi
gcaugagccagcccuc

SEQ ID NO: 3658049 - RNA, 18 nt, Salmonella enterica enterica serovar Typhi
gcaugagguuaguaaugc

SEQ ID NO: 3658050 - RNA, 15 nt, Salmonella enterica enterica serovar Typhi
gcaugaucggcuggg

SEQ ID NO: 3658051 - RNA, 14 nt, Salmonella enterica enterica serovar Typhi
gcaugaugccacga

SEQ ID NO: 3658052 - RNA, 18 nt, Salmonella enterica enterica serovar Typhi
gcaugauguccagcgcgc

SEQ ID NO: 3658053 - RNA, 16 nt, Salmonella enterica enterica serovar Typhi
gcaugauuaagcuggg

SEQ ID NO: 3658054 - RNA, 16 nt, Salmonella enterica enterica serovar Typhi
gcaugcaucucuucaa

SEQ ID NO: 3658055 - RNA, 22 nt, Salmonella enterica enterica serovar Typhi
gcaugcgccccguuuccgcgac

SEQ ID NO: 3658056 - RNA, 12 nt, Salmonella enterica enterica serovar Typhi
gcaugcgcugga

SEQ ID NO: 3658057 - RNA, 16 nt, Salmonella enterica enterica serovar Typhi
gcaugcggggggcaac

SEQ ID NO: 3658058 - RNA, 22 nt, Salmonella enterica enterica serovar Typhi
gcauggacuauggucugaaaga

SEQ ID NO: 3658059 - RNA, 15 nt, Salmonella enterica enterica serovar Typhi
gcauggagcaucagc

SEQ ID NO: 3658060 - RNA, 23 nt, Salmonella enterica enterica serovar Typhi
gcauggcagccccggcauccagu

SEQ ID NO: 3658061 - RNA, 17 nt, Salmonella enterica enterica serovar Typhi
gcauggcggucagcuuu

SEQ ID NO: 3658062 - RNA, 20 nt, Salmonella enterica enterica serovar Typhi
gcauggcgucguaccguuaa

SEQ ID NO: 3658063 - RNA, 16 nt, Salmonella enterica enterica serovar Typhi
gcauggcguugcugca

SEQ ID NO: 3658064 - RNA, 14 nt, Salmonella enterica enterica serovar Typhi
gcaugggaaauaac

SEQ ID NO: 3658065 - RNA, 22 nt, Salmonella enterica enterica serovar Typhi
gcauggggagaccccacacuac

SEQ ID NO: 3658066 - RNA, 17 nt, Salmonella enterica enterica serovar Typhi
gcauggguaaagcccau

SEQ ID NO: 3658067 - RNA, 18 nt, Salmonella enterica enterica serovar Typhi
gcauggucagcauaauau

SEQ ID NO: 3658068 - RNA, 18 nt, Salmonella enterica enterica serovar Typhi
gcaugucguauccccagu

SEQ ID NO: 3658069 - RNA, 20 nt, Salmonella enterica enterica serovar Typhi
gcauuaaaucaucauaauca

SEQ ID NO: 3658070 - RNA, 15 nt, Salmonella enterica enterica serovar Typhi
gcauuaacguccaua

SEQ ID NO: 3658071 - RNA, 13 nt, Salmonella enterica enterica serovar Typhi
gcauuaauuucuu

SEQ ID NO: 3658072 - RNA, 15 nt, Salmonella enterica enterica serovar Typhi
gcauuaauuucuugc

SEQ ID NO: 3658073 - RNA, 13 nt, Salmonella enterica enterica serovar Typhi
gcauuacauucau

SEQ ID NO: 3658074 - RNA, 18 nt, Salmonella enterica enterica serovar Typhi
gcauuacccccgccauaa

SEQ ID NO: 3658075 - RNA, 15 nt, Salmonella enterica enterica serovar Typhi
gcauuaccgcuauuc

SEQ ID NO: 3658076 - RNA, 14 nt, Salmonella enterica enterica serovar Typhi
gcauuacgcuggcc

SEQ ID NO: 3658077 - RNA, 19 nt, Salmonella enterica enterica serovar Typhi
gcauuacgcuggccccuuu

SEQ ID NO: 3658078 - RNA, 14 nt, Salmonella enterica enterica serovar Typhi
gcauuaggcuuuuc

SEQ ID NO: 3658079 - RNA, 18 nt, Salmonella enterica enterica serovar Typhi
gcauuaugggcgugcuga

SEQ ID NO: 3658080 - RNA, 14 nt, Salmonella enterica enterica serovar Typhi
gcauucacgccacc

SEQ ID NO: 3658081 - RNA, 13 nt, Salmonella enterica enterica serovar Typhi
gcauucagccagc

SEQ ID NO: 3658082 - RNA, 17 nt, Salmonella enterica enterica serovar Typhi
gcauucucgccgugacu

SEQ ID NO: 3658083 - RNA, 20 nt, Salmonella enterica enterica serovar Typhi
gcauugagacaugccgccag

SEQ ID NO: 3658084 - RNA, 16 nt, Salmonella enterica enterica serovar Typhi
gcauugauaaagcgcu

SEQ ID NO: 3658085 - RNA, 21 nt, Salmonella enterica enterica serovar Typhi
gcauugccaugaugagcgcca

SEQ ID NO: 3658086 - RNA, 16 nt, Salmonella enterica enterica serovar Typhi
gcauugccggaaacca

SEQ ID NO: 3658087 - RNA, 19 nt, Salmonella enterica enterica serovar Typhi
gcauuggcguuaccggcag

SEQ ID NO: 3658088 - RNA, 21 nt, Salmonella enterica enterica serovar Typhi
gcauuggcguuaccggcaggc

SEQ ID NO: 3658089 - RNA, 18 nt, Salmonella enterica enterica serovar Typhi
gcauugggauggauaaau

SEQ ID NO: 3658090 - RNA, 22 nt, Salmonella enterica enterica serovar Typhi
gcauugguggggcuaagugagc

SEQ ID NO: 3658091 - RNA, 16 nt, Salmonella enterica enterica serovar Typhi
gcauuguuaauccaga

SEQ ID NO: 3658092 - RNA, 13 nt, Salmonella enterica enterica serovar Typhi
gcauuuaucaauc

SEQ ID NO: 3658093 - RNA, 24 nt, Salmonella enterica enterica serovar Typhi
gcauuucaaagcguucugaacugu

SEQ ID NO: 3658094 - RNA, 13 nt, Salmonella enterica enterica serovar Typhi
gcauuuccagcug

SEQ ID NO: 3658095 - RNA, 22 nt, Salmonella enterica enterica serovar Typhi
gcauuugcgucguuaacugcau

SEQ ID NO: 3658096 - RNA, 20 nt, Salmonella enterica enterica serovar Typhi
gcauuugucgcuguuaaucu

SEQ ID NO: 3658097 - RNA, 23 nt, Salmonella enterica enterica serovar Typhi
gcauuuguugagcgcauuugcgg

SEQ ID NO: 3658098 - RNA, 17 nt, Salmonella enterica enterica serovar Typhi
gcauuuuaucuuuuguu

SEQ ID NO: 3658099 - RNA, 17 nt, Salmonella enterica enterica serovar Typhi
gcauuuucuuauuuauu

SEQ ID NO: 3658100 - RNA, 19 nt, Salmonella enterica enterica serovar Typhi
gcauuuuuaucaucugcau

SEQ ID NO: 3658101 - RNA, 14 nt, Salmonella enterica enterica serovar Typhi
gcauuuuuucuuca

SEQ ID NO: 3658102 - RNA, 15 nt, Salmonella enterica enterica serovar Typhi
gccaaaaaaucgcug

SEQ ID NO: 3658103 - RNA, 17 nt, Salmonella enterica enterica serovar Typhi
gccaaaagaggcagcaa

SEQ ID NO: 3658104 - RNA, 20 nt, Salmonella enterica enterica serovar Typhi
gccaaaaggcgccgcuuccc

SEQ ID NO: 3658105 - RNA, 17 nt, Salmonella enterica enterica serovar Typhi
gccaaaaucgauagcgg

SEQ ID NO: 3658106 - RNA, 12 nt, Salmonella enterica enterica serovar Typhi
gccaaaauggcg

SEQ ID NO: 3658107 - RNA, 14 nt, Salmonella enterica enterica serovar Typhi
gccaaaccacugau

SEQ ID NO: 3658108 - RNA, 14 nt, Salmonella enterica enterica serovar Typhi
gccaaaccagaccc

SEQ ID NO: 3658109 - RNA, 16 nt, Salmonella enterica enterica serovar Typhi
gccaaaccggcgaaua

SEQ ID NO: 3658110 - RNA, 15 nt, Salmonella enterica enterica serovar Typhi
gccaaacguggcggc

SEQ ID NO: 3658111 - RNA, 13 nt, Salmonella enterica enterica serovar Typhi
gccaaacuccuca

SEQ ID NO: 3658112 - RNA, 19 nt, Salmonella enterica enterica serovar Typhi
gccaaacuccucacugcgu

SEQ ID NO: 3658113 - RNA, 14 nt, Salmonella enterica enterica serovar Typhi
gccaaacugcggaa

SEQ ID NO: 3658114 - RNA, 12 nt, Salmonella enterica enterica serovar Typhi
gccaaacugcug

SEQ ID NO: 3658115 - RNA, 22 nt, Salmonella enterica enterica serovar Typhi
gccaaacuggcaaauaaaauag

SEQ ID NO: 3658116 - RNA, 13 nt, Salmonella enterica enterica serovar Typhi
gccaaagauuagc

SEQ ID NO: 3658117 - RNA, 23 nt, Salmonella enterica enterica serovar Typhi
gccaaagauuagccccagcgcca

SEQ ID NO: 3658118 - RNA, 17 nt, Salmonella enterica enterica serovar Typhi
gccaaagggagcagacu

SEQ ID NO: 3658119 - RNA, 18 nt, Salmonella enterica enterica serovar Typhi
gccaaagucauugcugcc

SEQ ID NO: 3658120 - RNA, 18 nt, Salmonella enterica enterica serovar Typhi
gccaaaguuaaucagcgc

SEQ ID NO: 3658121 - RNA, 20 nt, Salmonella enterica enterica serovar Typhi
gccaaauacgucgcacggau

SEQ ID NO: 3658122 - RNA, 14 nt, Salmonella enterica enterica serovar Typhi
gccaaauagcgcca

SEQ ID NO: 3658123 - RNA, 16 nt, Salmonella enterica enterica serovar Typhi
gccaaauagcgccaga

SEQ ID NO: 3658124 - RNA, 22 nt, Salmonella enterica enterica serovar Typhi
gccaaauagcgccagacagaua

SEQ ID NO: 3658125 - RNA, 15 nt, Salmonella enterica enterica serovar Typhi
gccaaaucagcagga

SEQ ID NO: 3658126 - RNA, 18 nt, Salmonella enterica enterica serovar Typhi
gccaaaucuguucugucc

SEQ ID NO: 3658127 - RNA, 13 nt, Salmonella enterica enterica serovar Typhi
gccacccggcuuu

SEQ ID NO: 3658128 - RNA, 21 nt, Salmonella enterica enterica serovar Typhi
gccacccggcuuuuuauuuac

SEQ ID NO: 3658129 - RNA, 15 nt, Salmonella enterica enterica serovar Typhi
gccaccgccagcagu

SEQ ID NO: 3658130 - RNA, 13 nt, Salmonella enterica enterica serovar Typhi
gccaccgccagcc

SEQ ID NO: 3658131 - RNA, 16 nt, Salmonella enterica enterica serovar Typhi
gccaccgccagccaug

SEQ ID NO: 3658132 - RNA, 15 nt, Salmonella enterica enterica serovar Typhi
gccaccgcccagaga

SEQ ID NO: 3658133 - RNA, 17 nt, Salmonella enterica enterica serovar Typhi
gccaccgcuauucuuca

SEQ ID NO: 3658134 - RNA, 17 nt, Salmonella enterica enterica serovar Typhi
gccaccggcacauccag

SEQ ID NO: 3658135 - RNA, 21 nt, Salmonella enterica enterica serovar Typhi
gccaccgggcaacacacgcuu

SEQ ID NO: 3658136 - RNA, 17 nt, Salmonella enterica enterica serovar Typhi
gccaccgggcaacccgg

SEQ ID NO: 3658137 - RNA, 20 nt, Salmonella enterica enterica serovar Typhi
gccaccuguuucgccaggcc

SEQ ID NO: 3658138 - RNA, 22 nt, Salmonella enterica enterica serovar Typhi
gccaccuuaaucgacuucaugc

SEQ ID NO: 3658139 - RNA, 15 nt, Salmonella enterica enterica serovar Typhi
gccaccuuucugcuc

SEQ ID NO: 3658140 - RNA, 16 nt, Salmonella enterica enterica serovar Typhi
gccacgcaagcagcac

SEQ ID NO: 3658141 - RNA, 20 nt, Salmonella enterica enterica serovar Typhi
gccacgcagauaucuuccag

SEQ ID NO: 3658142 - RNA, 11 nt, Salmonella enterica enterica serovar Typhi
gccacgccaau

SEQ ID NO: 3658143 - RNA, 21 nt, Salmonella enterica enterica serovar Typhi
gccacgccaucggcuaagcca

SEQ ID NO: 3658144 - RNA, 15 nt, Salmonella enterica enterica serovar Typhi
gccacgcccacgcug

SEQ ID NO: 3658145 - RNA, 22 nt, Salmonella enterica enterica serovar Typhi
gccacgccccuaaggcagcaag

SEQ ID NO: 3658146 - RNA, 23 nt, Salmonella enterica enterica serovar Typhi
gccacgccccuaaggcagcaagg

SEQ ID NO: 3658147 - RNA, 14 nt, Salmonella enterica enterica serovar Typhi
gccacgcccgccgc

SEQ ID NO: 3658148 - RNA, 22 nt, Salmonella enterica enterica serovar Typhi
gccacgccgaggcauucagcca

SEQ ID NO: 3658149 - RNA, 13 nt, Salmonella enterica enterica serovar Typhi
gccacgccgccau

SEQ ID NO: 3658150 - RNA, 14 nt, Salmonella enterica enterica serovar Typhi
gccacgccgccauc

SEQ ID NO: 3658151 - RNA, 18 nt, Salmonella enterica enterica serovar Typhi
gccacgccgccauccggc

SEQ ID NO: 3658152 - RNA, 12 nt, Salmonella enterica enterica serovar Typhi
gccacgccgccc

SEQ ID NO: 3658153 - RNA, 14 nt, Salmonella enterica enterica serovar Typhi
gccacgccgcccgc

SEQ ID NO: 3658154 - RNA, 16 nt, Salmonella enterica enterica serovar Typhi
gccacgccgcccgcgu

SEQ ID NO: 3658155 - RNA, 16 nt, Salmonella enterica enterica serovar Typhi
gccacgccgcuccaca

SEQ ID NO: 3658156 - RNA, 13 nt, Salmonella enterica enterica serovar Typhi
gccacgcgacgcc

SEQ ID NO: 3658157 - RNA, 22 nt, Salmonella enterica enterica serovar Typhi
gccacgcgaugcaaccccugac

SEQ ID NO: 3658158 - RNA, 14 nt, Salmonella enterica enterica serovar Typhi
gccacgcgccagcc

SEQ ID NO: 3658159 - RNA, 16 nt, Salmonella enterica enterica serovar Typhi
gccacgcgccagccgu

SEQ ID NO: 3658160 - RNA, 13 nt, Salmonella enterica enterica serovar Typhi
gccacgcgcguca

SEQ ID NO: 3658161 - RNA, 19 nt, Salmonella enterica enterica serovar Typhi
gccacgcucgcuggugcca

SEQ ID NO: 3658162 - RNA, 20 nt, Salmonella enterica enterica serovar Typhi
gccacggagcauaauuuucc

SEQ ID NO: 3658163 - RNA, 22 nt, Salmonella enterica enterica serovar Typhi
gccacggauggccucugccagu

SEQ ID NO: 3658164 - RNA, 16 nt, Salmonella enterica enterica serovar Typhi
gccacgguacggcuuu

SEQ ID NO: 3658165 - RNA, 19 nt, Salmonella enterica enterica serovar Typhi
gccacgguguggcccagcg

SEQ ID NO: 3658166 - RNA, 15 nt, Salmonella enterica enterica serovar Typhi
gccacgguuggccca

SEQ ID NO: 3658167 - RNA, 16 nt, Salmonella enterica enterica serovar Typhi
gccacgguuggcccag

SEQ ID NO: 3658168 - RNA, 23 nt, Salmonella enterica enterica serovar Typhi
gccacgucugaugcguggcugaa

SEQ ID NO: 3658169 - RNA, 14 nt, Salmonella enterica enterica serovar Typhi
gccacguucuucca

SEQ ID NO: 3658170 - RNA, 16 nt, Salmonella enterica enterica serovar Typhi
gccacguuuuccugcg

SEQ ID NO: 3658171 - RNA, 19 nt, Salmonella enterica enterica serovar Typhi
gccacucacggcaaguaua

SEQ ID NO: 3658172 - RNA, 14 nt, Salmonella enterica enterica serovar Typhi
gccacuccgccagu

SEQ ID NO: 3658173 - RNA, 12 nt, Salmonella enterica enterica serovar Typhi
gccacucuccag

SEQ ID NO: 3658174 - RNA, 18 nt, Salmonella enterica enterica serovar Typhi
gccacucuggcgacgcca

SEQ ID NO: 3658175 - RNA, 19 nt, Salmonella enterica enterica serovar Typhi
gccacucuggcgacgccaa

SEQ ID NO: 3658176 - RNA, 16 nt, Salmonella enterica enterica serovar Typhi
gccacugcccuggaag

SEQ ID NO: 3658177 - RNA, 20 nt, Salmonella enterica enterica serovar Typhi
gccacugcccuggaagaacu

SEQ ID NO: 3658178 - RNA, 22 nt, Salmonella enterica enterica serovar Typhi
gccacugcugaaagccgcgacg

SEQ ID NO: 3658179 - RNA, 15 nt, Salmonella enterica enterica serovar Typhi
gccacugcuggccca

SEQ ID NO: 3658180 - RNA, 11 nt, Salmonella enterica enterica serovar Typhi
gccacuggccu

SEQ ID NO: 3658181 - RNA, 14 nt, Salmonella enterica enterica serovar Typhi
gccacuuccagcgc

SEQ ID NO: 3658182 - RNA, 18 nt, Salmonella enterica enterica serovar Typhi
gccacuuccagcgcgccg

SEQ ID NO: 3658183 - RNA, 21 nt, Salmonella enterica enterica serovar Typhi
gccacuuccagcgcgccguca

SEQ ID NO: 3658184 - RNA, 23 nt, Salmonella enterica enterica serovar Typhi
gccacuuccagcgcgccgucauc

SEQ ID NO: 3658185 - RNA, 14 nt, Salmonella enterica enterica serovar Typhi
gccacuucuuccag

SEQ ID NO: 3658186 - RNA, 20 nt, Salmonella enterica enterica serovar Typhi
gccacuucuuccagcggcag

SEQ ID NO: 3658187 - RNA, 16 nt, Salmonella enterica enterica serovar Typhi
gccacuugaaguauga

SEQ ID NO: 3658188 - RNA, 17 nt, Salmonella enterica enterica serovar Typhi
gccagaaaucgcucaug

SEQ ID NO: 3658189 - RNA, 15 nt, Salmonella enterica enterica serovar Typhi
gccagaacgcuguug

SEQ ID NO: 3658190 - RNA, 22 nt, Salmonella enterica enterica serovar Typhi
gccagaagagaauggccagcac

SEQ ID NO: 3658191 - RNA, 17 nt, Salmonella enterica enterica serovar Typhi
gccagaaucaccucuuu

SEQ ID NO: 3658192 - RNA, 18 nt, Salmonella enterica enterica serovar Typhi
gccagaaugccagcgccg

SEQ ID NO: 3658193 - RNA, 14 nt, Salmonella enterica enterica serovar Typhi
gccagaccaauaga

SEQ ID NO: 3658194 - RNA, 22 nt, Salmonella enterica enterica serovar Typhi
gccagaccaauagagagcgaca

SEQ ID NO: 3658195 - RNA, 17 nt, Salmonella enterica enterica serovar Typhi
gccagacccagcgcuaa

SEQ ID NO: 3658196 - RNA, 16 nt, Salmonella enterica enterica serovar Typhi
gccagacgccagccac

SEQ ID NO: 3658197 - RNA, 14 nt, Salmonella enterica enterica serovar Typhi
gccagacgcgcagc

SEQ ID NO: 3658198 - RNA, 20 nt, Salmonella enterica enterica serovar Typhi
gccagacggcgcccagccug

SEQ ID NO: 3658199 - RNA, 17 nt, Salmonella enterica enterica serovar Typhi
gccagacgggccaggcg

SEQ ID NO: 3658200 - RNA, 16 nt, Salmonella enterica enterica serovar Typhi
gccagacucgcuucac

SEQ ID NO: 3658201 - RNA, 18 nt, Salmonella enterica enterica serovar Typhi
gccagacucgcuucacgc

SEQ ID NO: 3658202 - RNA, 19 nt, Salmonella enterica enterica serovar Typhi
gccagagagaugccgccgg

SEQ ID NO: 3658203 - RNA, 14 nt, Salmonella enterica enterica serovar Typhi
gccagagagcguuu

SEQ ID NO: 3658204 - RNA, 16 nt, Salmonella enterica enterica serovar Typhi
gccagagcgcgcuggc

SEQ ID NO: 3658205 - RNA, 22 nt, Salmonella enterica enterica serovar Typhi
gccagaggcgugcaugggcagc

SEQ ID NO: 3658206 - RNA, 14 nt, Salmonella enterica enterica serovar Typhi
gccagauaaagcag

SEQ ID NO: 3658207 - RNA, 18 nt, Salmonella enterica enterica serovar Typhi
gccagauaaagcagcgac

SEQ ID NO: 3658208 - RNA, 20 nt, Salmonella enterica enterica serovar Typhi
gccagauaaagcagcgacaa

SEQ ID NO: 3658209 - RNA, 21 nt, Salmonella enterica enterica serovar Typhi
gccagauaaucgccgccagcu

SEQ ID NO: 3658210 - RNA, 18 nt, Salmonella enterica enterica serovar Typhi
gccagauaccgugaugcg

SEQ ID NO: 3658211 - RNA, 15 nt, Salmonella enterica enterica serovar Typhi
gccagauagcgucuu

SEQ ID NO: 3658212 - RNA, 20 nt, Salmonella enterica enterica serovar Typhi
gccagauauuuucggcauac

SEQ ID NO: 3658213 - RNA, 18 nt, Salmonella enterica enterica serovar Typhi
gccagcuaccgcucaggc

SEQ ID NO: 3658214 - RNA, 20 nt, Salmonella enterica enterica serovar Typhi
gccagcuacgacaagcuguu

SEQ ID NO: 3658215 - RNA, 18 nt, Salmonella enterica enterica serovar Typhi
gccagcucaugcgcggcg

SEQ ID NO: 3658216 - RNA, 20 nt, Salmonella enterica enterica serovar Typhi
gccagcucaugcgcggcggg

SEQ ID NO: 3658217 - RNA, 13 nt, Salmonella enterica enterica serovar Typhi
gccagcuccgcgc

SEQ ID NO: 3658218 - RNA, 17 nt, Salmonella enterica enterica serovar Typhi
gccagcuccugcgggcu

SEQ ID NO: 3658219 - RNA, 14 nt, Salmonella enterica enterica serovar Typhi
gccagcucuuuucu

SEQ ID NO: 3658220 - RNA, 16 nt, Salmonella enterica enterica serovar Typhi
gccagcucuuuucugg

SEQ ID NO: 3658221 - RNA, 22 nt, Salmonella enterica enterica serovar Typhi
gccaggaaccgccgaugcacaa

SEQ ID NO: 3658222 - RNA, 23 nt, Salmonella enterica enterica serovar Typhi
gccaggaaccgcggucggcaggc

SEQ ID NO: 3658223 - RNA, 13 nt, Salmonella enterica enterica serovar Typhi
gccaggaauaaag

SEQ ID NO: 3658224 - RNA, 21 nt, Salmonella enterica enterica serovar Typhi
gccaggacugacggaagagcu

SEQ ID NO: 3658225 - RNA, 15 nt, Salmonella enterica enterica serovar Typhi
gccaggauaauaaug

SEQ ID NO: 3658226 - RNA, 14 nt, Salmonella enterica enterica serovar Typhi
gccaggauaucgcc

SEQ ID NO: 3658227 - RNA, 16 nt, Salmonella enterica enterica serovar Typhi
gccaggauaucgcccg

SEQ ID NO: 3658228 - RNA, 16 nt, Salmonella enterica enterica serovar Typhi
gccaggaucgccgccg

SEQ ID NO: 3658229 - RNA, 16 nt, Salmonella enterica enterica serovar Typhi
gccaggcaaucagcag

SEQ ID NO: 3658230 - RNA, 14 nt, Salmonella enterica enterica serovar Typhi
gccaggcauccggc

SEQ ID NO: 3658231 - RNA, 19 nt, Salmonella enterica enterica serovar Typhi
gccaggccagauggcuuua

SEQ ID NO: 3658232 - RNA, 19 nt, Salmonella enterica enterica serovar Typhi
gccaggccauugcugagga

SEQ ID NO: 3658233 - RNA, 16 nt, Salmonella enterica enterica serovar Typhi
gccaggcccaugauca

SEQ ID NO: 3658234 - RNA, 15 nt, Salmonella enterica enterica serovar Typhi
gccaggcgauuguca

SEQ ID NO: 3658235 - RNA, 18 nt, Salmonella enterica enterica serovar Typhi
gccaggcguuacgcgcca

SEQ ID NO: 3658236 - RNA, 14 nt, Salmonella enterica enterica serovar Typhi
gccaggcuuccugc

SEQ ID NO: 3658237 - RNA, 20 nt, Salmonella enterica enterica serovar Typhi
gccagggaaauggcgaacag

SEQ ID NO: 3658238 - RNA, 15 nt, Salmonella enterica enterica serovar Typhi
gccagggcggaagca

SEQ ID NO: 3658239 - RNA, 18 nt, Salmonella enterica enterica serovar Typhi
gccagggcggaagcagau

SEQ ID NO: 3658240 - RNA, 12 nt, Salmonella enterica enterica serovar Typhi
gccagggcggca

SEQ ID NO: 3658241 - RNA, 21 nt, Salmonella enterica enterica serovar Typhi
gccaggggaugauuuucaggc

SEQ ID NO: 3658242 - RNA, 15 nt, Salmonella enterica enterica serovar Typhi
gccaggguucaaccu

SEQ ID NO: 3658243 - RNA, 16 nt, Salmonella enterica enterica serovar Typhi
gccagguacaucgcgc

SEQ ID NO: 3658244 - RNA, 16 nt, Salmonella enterica enterica serovar Typhi
gccaggugccgagguu

SEQ ID NO: 3658245 - RNA, 18 nt, Salmonella enterica enterica serovar Typhi
gccagguugcgcccggcg

SEQ ID NO: 3658246 - RNA, 20 nt, Salmonella enterica enterica serovar Typhi
gccagguugcgcccggcgca

SEQ ID NO: 3658247 - RNA, 22 nt, Salmonella enterica enterica serovar Typhi
gccagguugcgcccggcgcauc

SEQ ID NO: 3658248 - RNA, 17 nt, Salmonella enterica enterica serovar Typhi
gccagguuuucaggccg

SEQ ID NO: 3658249 - RNA, 14 nt, Salmonella enterica enterica serovar Typhi
gccaguacagcacg

SEQ ID NO: 3658250 - RNA, 17 nt, Salmonella enterica enterica serovar Typhi
gccaguaccgccgccgg

SEQ ID NO: 3658251 - RNA, 18 nt, Salmonella enterica enterica serovar Typhi
gccaguagauggcgcuaa

SEQ ID NO: 3658252 - RNA, 20 nt, Salmonella enterica enterica serovar Typhi
gccaguagauggcgcuaaaa

SEQ ID NO: 3658253 - RNA, 22 nt, Salmonella enterica enterica serovar Typhi
gccaguagcggaauaucuuccc

SEQ ID NO: 3658254 - RNA, 15 nt, Salmonella enterica enterica serovar Typhi
gccaguagcucgccg

SEQ ID NO: 3658255 - RNA, 17 nt, Salmonella enterica enterica serovar Typhi
gccaguagcucgccgcu

SEQ ID NO: 3658256 - RNA, 14 nt, Salmonella enterica enterica serovar Typhi
gccaguagcugcuc

SEQ ID NO: 3658257 - RNA, 23 nt, Salmonella enterica enterica serovar Typhi
gccagucaauaagcuugcuuucc

SEQ ID NO: 3658258 - RNA, 13 nt, Salmonella enterica enterica serovar Typhi
gccagucaucgcc

SEQ ID NO: 3658259 - RNA, 22 nt, Salmonella enterica enterica serovar Typhi
gccagucauuaauucccgcagc

SEQ ID NO: 3658260 - RNA, 13 nt, Salmonella enterica enterica serovar Typhi
gccaguccagguu

SEQ ID NO: 3658261 - RNA, 19 nt, Salmonella enterica enterica serovar Typhi
gccaguccugccaccagcg

SEQ ID NO: 3658262 - RNA, 23 nt, Salmonella enterica enterica serovar Typhi
gccagucgauguggccuuccucg

SEQ ID NO: 3658263 - RNA, 14 nt, Salmonella enterica enterica serovar Typhi
gccagucgcagaug

SEQ ID NO: 3658264 - RNA, 15 nt, Salmonella enterica enterica serovar Typhi
gccagucgccaggca

SEQ ID NO: 3658265 - RNA, 17 nt, Salmonella enterica enterica serovar Typhi
gccagucgccaggcaag

SEQ ID NO: 3658266 - RNA, 21 nt, Salmonella enterica enterica serovar Typhi
gccagucguaguggaucagca

SEQ ID NO: 3658267 - RNA, 18 nt, Salmonella enterica enterica serovar Typhi
gccagucuuccauuacaa

SEQ ID NO: 3658268 - RNA, 21 nt, Salmonella enterica enterica serovar Typhi
gccagugcgauaccggccgcc

SEQ ID NO: 3658269 - RNA, 22 nt, Salmonella enterica enterica serovar Typhi
gccagugcgauaccggccgccc

SEQ ID NO: 3658270 - RNA, 20 nt, Salmonella enterica enterica serovar Typhi
gccagugggcgucaaaaucc

SEQ ID NO: 3658271 - RNA, 18 nt, Salmonella enterica enterica serovar Typhi
gccaguuagcgaucgcgc

SEQ ID NO: 3658272 - RNA, 17 nt, Salmonella enterica enterica serovar Typhi
gccaguuaucaggacau

SEQ ID NO: 3658273 - RNA, 14 nt, Salmonella enterica enterica serovar Typhi
gccaguucacgccg

SEQ ID NO: 3658274 - RNA, 16 nt, Salmonella enterica enterica serovar Typhi
gccaguucacgccgcc

SEQ ID NO: 3658275 - RNA, 19 nt, Salmonella enterica enterica serovar Typhi
gccaguucauuccgcccug

SEQ ID NO: 3658276 - RNA, 21 nt, Salmonella enterica enterica serovar Typhi
gccaguucauugauuaacagg

SEQ ID NO: 3658277 - RNA, 18 nt, Salmonella enterica enterica serovar Typhi
gccaguugcgcaggguau

SEQ ID NO: 3658278 - RNA, 20 nt, Salmonella enterica enterica serovar Typhi
gccaguuguccgcuggucag

SEQ ID NO: 3658279 - RNA, 21 nt, Salmonella enterica enterica serovar Typhi
gccaguuguccgcuggucagc

SEQ ID NO: 3658280 - RNA, 19 nt, Salmonella enterica enterica serovar Typhi
gccaguuuacgcguacucg

SEQ ID NO: 3658281 - RNA, 17 nt, Salmonella enterica enterica serovar Typhi
gccaguuuagggaucau

SEQ ID NO: 3658282 - RNA, 20 nt, Salmonella enterica enterica serovar Typhi
gccaguuuccugacccgcuc

SEQ ID NO: 3658283 - RNA, 21 nt, Salmonella enterica enterica serovar Typhi
gccaguuucucgucauaguga

SEQ ID NO: 3658284 - RNA, 15 nt, Salmonella enterica enterica serovar Typhi
gccaguuuguaacca

SEQ ID NO: 3658285 - RNA, 14 nt, Salmonella enterica enterica serovar Typhi
gccaguuuuccgcc

SEQ ID NO: 3658286 - RNA, 19 nt, Salmonella enterica enterica serovar Typhi
gccauaaaaacaauaaaua

SEQ ID NO: 3658287 - RNA, 18 nt, Salmonella enterica enterica serovar Typhi
gccauaaaacgggcaaac

SEQ ID NO: 3658288 - RNA, 21 nt, Salmonella enterica enterica serovar Typhi
gccauaaaccccgauaaacca

SEQ ID NO: 3658289 - RNA, 18 nt, Salmonella enterica enterica serovar Typhi
gccauaaagcuguaccug

SEQ ID NO: 3658290 - RNA, 21 nt, Salmonella enterica enterica serovar Typhi
gccauaaaucagauccacgcc

SEQ ID NO: 3658291 - RNA, 23 nt, Salmonella enterica enterica serovar Typhi
gccauaaucaguacugcgcccgc

SEQ ID NO: 3658292 - RNA, 19 nt, Salmonella enterica enterica serovar Typhi
gccauaaucgcuuuuuccu

SEQ ID NO: 3658293 - RNA, 16 nt, Salmonella enterica enterica serovar Typhi
gccauaaugcacaaua

SEQ ID NO: 3658294 - RNA, 17 nt, Salmonella enterica enterica serovar Typhi
gccauaauggauuaggu

SEQ ID NO: 3658295 - RNA, 14 nt, Salmonella enterica enterica serovar Typhi
gccauacacgcggc

SEQ ID NO: 3658296 - RNA, 22 nt, Salmonella enterica enterica serovar Typhi
gccauacacgcggcgaaccggc

SEQ ID NO: 3658297 - RNA, 17 nt, Salmonella enterica enterica serovar Typhi
gccauacuuacugcugu

SEQ ID NO: 3658298 - RNA, 18 nt, Salmonella enterica enterica serovar Typhi
gccauuccgcuucuucca

SEQ ID NO: 3658299 - RNA, 19 nt, Salmonella enterica enterica serovar Typhi
gccauucgcccagucauca

SEQ ID NO: 3658300 - RNA, 15 nt, Salmonella enterica enterica serovar Typhi
gccauucgcuuccgc

SEQ ID NO: 3658301 - RNA, 23 nt, Salmonella enterica enterica serovar Typhi
gccauucucuucuaccacgcugc

SEQ ID NO: 3658302 - RNA, 13 nt, Salmonella enterica enterica serovar Typhi
gccauugaagucc

SEQ ID NO: 3658303 - RNA, 21 nt, Salmonella enterica enterica serovar Typhi
gccauugccaggacugacgga

SEQ ID NO: 3658304 - RNA, 12 nt, Salmonella enterica enterica serovar Typhi
gccauugccgcg

SEQ ID NO: 3658305 - RNA, 19 nt, Salmonella enterica enterica serovar Typhi
gccauugcugucgacaaua

SEQ ID NO: 3658306 - RNA, 22 nt, Salmonella enterica enterica serovar Typhi
gccauugcuuuuggcaacggca

SEQ ID NO: 3658307 - RNA, 15 nt, Salmonella enterica enterica serovar Typhi
gccauuggcaaucag

SEQ ID NO: 3658308 - RNA, 22 nt, Salmonella enterica enterica serovar Typhi
gccauuggcuauuuuuugcugg

SEQ ID NO: 3658309 - RNA, 19 nt, Salmonella enterica enterica serovar Typhi
gccauuggcucggcgucau

SEQ ID NO: 3658310 - RNA, 19 nt, Salmonella enterica enterica serovar Typhi
gccauuguucgcgcgucca

SEQ ID NO: 3658311 - RNA, 13 nt, Salmonella enterica enterica serovar Typhi
gccauuuacgcca

SEQ ID NO: 3658312 - RNA, 13 nt, Salmonella enterica enterica serovar Typhi
gccauuuuugcca

SEQ ID NO: 3658313 - RNA, 22 nt, Salmonella enterica enterica serovar Typhi
gcccaaaauagcguccagccgc

SEQ ID NO: 3658314 - RNA, 20 nt, Salmonella enterica enterica serovar Typhi
gcccaaauaaaagccgccgu

SEQ ID NO: 3658315 - RNA, 16 nt, Salmonella enterica enterica serovar Typhi
gcccaaauaguccagc

SEQ ID NO: 3658316 - RNA, 19 nt, Salmonella enterica enterica serovar Typhi
gcccaaauaguccagcauc

SEQ ID NO: 3658317 - RNA, 14 nt, Salmonella enterica enterica serovar Typhi
gcccaacgcaauac

SEQ ID NO: 3658318 - RNA, 23 nt, Salmonella enterica enterica serovar Typhi
gcccaacgcggcuuuaaguuuuu

SEQ ID NO: 3658319 - RNA, 14 nt, Salmonella enterica enterica serovar Typhi
gcccaaugccccca

SEQ ID NO: 3658320 - RNA, 15 nt, Salmonella enterica enterica serovar Typhi
gcccaaugcccccau

SEQ ID NO: 3658321 - RNA, 20 nt, Salmonella enterica enterica serovar Typhi
gcccaaugcuuagucagccu

SEQ ID NO: 3658322 - RNA, 18 nt, Salmonella enterica enterica serovar Typhi
gcccaauggucaucgucg

SEQ ID NO: 3658323 - RNA, 19 nt, Salmonella enterica enterica serovar Typhi
gcccaauguuuuaccggca

SEQ ID NO: 3658324 - RNA, 17 nt, Salmonella enterica enterica serovar Typhi
gcccacaaccgacgcac

SEQ ID NO: 3658325 - RNA, 19 nt, Salmonella enterica enterica serovar Typhi
gcccacaaugacagaaaug

SEQ ID NO: 3658326 - RNA, 14 nt, Salmonella enterica enterica serovar Typhi
gcccacaggcaggg

SEQ ID NO: 3658327 - RNA, 15 nt, Salmonella enterica enterica serovar Typhi
gcccaccaucagacc

SEQ ID NO: 3658328 - RNA, 12 nt, Salmonella enterica enterica serovar Typhi
gcccaccgcaua

SEQ ID NO: 3658329 - RNA, 12 nt, Salmonella enterica enterica serovar Typhi
gcccaccgccaa

SEQ ID NO: 3658330 - RNA, 18 nt, Salmonella enterica enterica serovar Typhi
gcccaccgcgcgcgcggc

SEQ ID NO: 3658331 - RNA, 22 nt, Salmonella enterica enterica serovar Typhi
gcccaccggagcggcguccgcc

SEQ ID NO: 3658332 - RNA, 15 nt, Salmonella enterica enterica serovar Typhi
gcccaccuucgcgga

SEQ ID NO: 3658333 - RNA, 17 nt, Salmonella enterica enterica serovar Typhi
gcccacuguggcgccac

SEQ ID NO: 3658334 - RNA, 14 nt, Salmonella enterica enterica serovar Typhi
gcccagaacggcag

SEQ ID NO: 3658335 - RNA, 21 nt, Salmonella enterica enterica serovar Typhi
gcccagacaaagggcacaccg

SEQ ID NO: 3658336 - RNA, 18 nt, Salmonella enterica enterica serovar Typhi
gcccagagcgacaaugaa

SEQ ID NO: 3658337 - RNA, 18 nt, Salmonella enterica enterica serovar Typhi
gcccagaggugaaccauu

SEQ ID NO: 3658338 - RNA, 22 nt, Salmonella enterica enterica serovar Typhi
gcccagauaacgcaucagacug

SEQ ID NO: 3658339 - RNA, 23 nt, Salmonella enterica enterica serovar Typhi
gcccagauaaugccgcuggcgua

SEQ ID NO: 3658340 - RNA, 18 nt, Salmonella enterica enterica serovar Typhi
gcccagcacuaacagcag

SEQ ID NO: 3658341 - RNA, 20 nt, Salmonella enterica enterica serovar Typhi
gcccagcacuaacagcagca

SEQ ID NO: 3658342 - RNA, 14 nt, Salmonella enterica enterica serovar Typhi
gcccagcagcagaa

SEQ ID NO: 3658343 - RNA, 13 nt, Salmonella enterica enterica serovar Typhi
gcccagcauuacu

SEQ ID NO: 3658344 - RNA, 17 nt, Salmonella enterica enterica serovar Typhi
gcccagccauaauggau

SEQ ID NO: 3658345 - RNA, 16 nt, Salmonella enterica enterica serovar Typhi
gcccagccugccugcc

SEQ ID NO: 3658346 - RNA, 13 nt, Salmonella enterica enterica serovar Typhi
gcccagcgcaauc

SEQ ID NO: 3658347 - RNA, 14 nt, Salmonella enterica enterica serovar Typhi
gcccagcgccgaga

SEQ ID NO: 3658348 - RNA, 13 nt, Salmonella enterica enterica serovar Typhi
gcccagcgccgga

SEQ ID NO: 3658349 - RNA, 16 nt, Salmonella enterica enterica serovar Typhi
gcccagcgccgucaua

SEQ ID NO: 3658350 - RNA, 21 nt, Salmonella enterica enterica serovar Typhi
gcccagcgcgauacgcagcac

SEQ ID NO: 3658351 - RNA, 23 nt, Salmonella enterica enterica serovar Typhi
gcccagcgcgauacgcagcaccg

SEQ ID NO: 3658352 - RNA, 13 nt, Salmonella enterica enterica serovar Typhi
gcccagcgcggcc

SEQ ID NO: 3658353 - RNA, 15 nt, Salmonella enterica enterica serovar Typhi
gcccagcgcgguggc

SEQ ID NO: 3658354 - RNA, 20 nt, Salmonella enterica enterica serovar Typhi
gcccagcuaaaccacggaau

SEQ ID NO: 3658355 - RNA, 22 nt, Salmonella enterica enterica serovar Typhi
gcccagcucaugauagggcagc

SEQ ID NO: 3658356 - RNA, 19 nt, Salmonella enterica enterica serovar Typhi
gcccagcucuuuaggcagg

SEQ ID NO: 3658357 - RNA, 17 nt, Salmonella enterica enterica serovar Typhi
gcccagcuuaguaaccc

SEQ ID NO: 3658358 - RNA, 18 nt, Salmonella enterica enterica serovar Typhi
gcccaggccaugcgccgc

SEQ ID NO: 3658359 - RNA, 22 nt, Salmonella enterica enterica serovar Typhi
gcccaggccugaugagcgcagc

SEQ ID NO: 3658360 - RNA, 14 nt, Salmonella enterica enterica serovar Typhi
gcccaggcggcggg

SEQ ID NO: 3658361 - RNA, 23 nt, Salmonella enterica enterica serovar Typhi
gcccaggcggguagucccaggau

SEQ ID NO: 3658362 - RNA, 12 nt, Salmonella enterica enterica serovar Typhi
gcccaggucgcc

SEQ ID NO: 3658363 - RNA, 16 nt, Salmonella enterica enterica serovar Typhi
gcccagguuagcagcc

SEQ ID NO: 3658364 - RNA, 21 nt, Salmonella enterica enterica serovar Typhi
gcccagguuagcagccacaca

SEQ ID NO: 3658365 - RNA, 13 nt, Salmonella enterica enterica serovar Typhi
gcccagugcccga

SEQ ID NO: 3658366 - RNA, 20 nt, Salmonella enterica enterica serovar Typhi
gcccaguuucaucaucgccg

SEQ ID NO: 3658367 - RNA, 19 nt, Salmonella enterica enterica serovar Typhi
gcccauaccacaacagaau

SEQ ID NO: 3658368 - RNA, 20 nt, Salmonella enterica enterica serovar Typhi
gcccauaccccacgccauaa

SEQ ID NO: 3658369 - RNA, 14 nt, Salmonella enterica enterica serovar Typhi
gcccauauccagcu

SEQ ID NO: 3658370 - RNA, 17 nt, Salmonella enterica enterica serovar Typhi
gcccaucagcaucccac

SEQ ID NO: 3658371 - RNA, 14 nt, Salmonella enterica enterica serovar Typhi
gcccaucagcgcca

SEQ ID NO: 3658372 - RNA, 18 nt, Salmonella enterica enterica serovar Typhi
gcccaucagcgccagccc

SEQ ID NO: 3658373 - RNA, 17 nt, Salmonella enterica enterica serovar Typhi
gcccaucaucaucggca

SEQ ID NO: 3658374 - RNA, 13 nt, Salmonella enterica enterica serovar Typhi
gcccauccagcac

SEQ ID NO: 3658375 - RNA, 13 nt, Salmonella enterica enterica serovar Typhi
gcccauccgucag

SEQ ID NO: 3658376 - RNA, 21 nt, Salmonella enterica enterica serovar Typhi
gcccaucgccacagcggaaua

SEQ ID NO: 3658377 - RNA, 16 nt, Salmonella enterica enterica serovar Typhi
gcccaucgcgccauga

SEQ ID NO: 3658378 - RNA, 19 nt, Salmonella enterica enterica serovar Typhi
gcccaugauggugaacaga

SEQ ID NO: 3658379 - RNA, 21 nt, Salmonella enterica enterica serovar Typhi
gcccaugauggugaacagaau

SEQ ID NO: 3658380 - RNA, 17 nt, Salmonella enterica enterica serovar Typhi
gcccauuaauaucagcc

SEQ ID NO: 3658381 - RNA, 16 nt, Salmonella enterica enterica serovar Typhi
gcccauuauugaucuc

SEQ ID NO: 3658382 - RNA, 19 nt, Salmonella enterica enterica serovar Typhi
gcccauuauugaucucuuc

SEQ ID NO: 3658383 - RNA, 18 nt, Salmonella enterica enterica serovar Typhi
gcccauuccgccaacggu

SEQ ID NO: 3658384 - RNA, 14 nt, Salmonella enterica enterica serovar Typhi
gcccggcaggcugg

SEQ ID NO: 3658385 - RNA, 14 nt, Salmonella enterica enterica serovar Typhi
gcccggccggugcu

SEQ ID NO: 3658386 - RNA, 17 nt, Salmonella enterica enterica serovar Typhi
gcccggcgcgacgccgc

SEQ ID NO: 3658387 - RNA, 13 nt, Salmonella enterica enterica serovar Typhi
gcccggcgcggca

SEQ ID NO: 3658388 - RNA, 16 nt, Salmonella enterica enterica serovar Typhi
gcccggcgcggcauca

SEQ ID NO: 3658389 - RNA, 18 nt, Salmonella enterica enterica serovar Typhi
gcccggcggcacggcgcu

SEQ ID NO: 3658390 - RNA, 11 nt, Salmonella enterica enterica serovar Typhi
gcccggcggcg

SEQ ID NO: 3658391 - RNA, 21 nt, Salmonella enterica enterica serovar Typhi
gcccggcggcgcgaugccugc

SEQ ID NO: 3658392 - RNA, 15 nt, Salmonella enterica enterica serovar Typhi
gcccggcuuucuguu

SEQ ID NO: 3658393 - RNA, 19 nt, Salmonella enterica enterica serovar Typhi
gcccgggacugacugagcc

SEQ ID NO: 3658394 - RNA, 21 nt, Salmonella enterica enterica serovar Typhi
gcccgggagaacgccgggccu

SEQ ID NO: 3658395 - RNA, 22 nt, Salmonella enterica enterica serovar Typhi
gcccgggagaacgccgggccug

SEQ ID NO: 3658396 - RNA, 14 nt, Salmonella enterica enterica serovar Typhi
gcccgggcaauuuc

SEQ ID NO: 3658397 - RNA, 19 nt, Salmonella enterica enterica serovar Typhi
gcccgggcacgauggccug

SEQ ID NO: 3658398 - RNA, 21 nt, Salmonella enterica enterica serovar Typhi
gcccgguaagaaugcgcguca

SEQ ID NO: 3658399 - RNA, 16 nt, Salmonella enterica enterica serovar Typhi
gcccgguaagcgcagc

SEQ ID NO: 3658400 - RNA, 20 nt, Salmonella enterica enterica serovar Typhi
gcccgguaagcgcagcgcca

SEQ ID NO: 3658401 - RNA, 21 nt, Salmonella enterica enterica serovar Typhi
gcccgguaagcgcuagcgcca

SEQ ID NO: 3658402 - RNA, 14 nt, Salmonella enterica enterica serovar Typhi
gcccgguauuuuuu

SEQ ID NO: 3658403 - RNA, 19 nt, Salmonella enterica enterica serovar Typhi
gcccgguggcgccacgcca

SEQ ID NO: 3658404 - RNA, 14 nt, Salmonella enterica enterica serovar Typhi
gcccgguggcgcug

SEQ ID NO: 3658405 - RNA, 22 nt, Salmonella enterica enterica serovar Typhi
gcccgguggcggcuggcgccuu

SEQ ID NO: 3658406 - RNA, 19 nt, Salmonella enterica enterica serovar Typhi
gcccgguggcguggcgcca

SEQ ID NO: 3658407 - RNA, 20 nt, Salmonella enterica enterica serovar Typhi
gcccgguucgaacgacagaa

SEQ ID NO: 3658408 - RNA, 20 nt, Salmonella enterica enterica serovar Typhi
gcccgguuuuuuuaugccgg

SEQ ID NO: 3658409 - RNA, 18 nt, Salmonella enterica enterica serovar Typhi
gcccguagauaagcgcca

SEQ ID NO: 3658410 - RNA, 17 nt, Salmonella enterica enterica serovar Typhi
gcccguagcgacgccau

SEQ ID NO: 3658411 - RNA, 15 nt, Salmonella enterica enterica serovar Typhi
gcccguaucacugau

SEQ ID NO: 3658412 - RNA, 14 nt, Salmonella enterica enterica serovar Typhi
gcccgugacgccag

SEQ ID NO: 3658413 - RNA, 18 nt, Salmonella enterica enterica serovar Typhi
gcccgugguuuuacugca

SEQ ID NO: 3658414 - RNA, 15 nt, Salmonella enterica enterica serovar Typhi
gcccguuuuuuccag

SEQ ID NO: 3658415 - RNA, 13 nt, Salmonella enterica enterica serovar Typhi
gcccuauccagcg

SEQ ID NO: 3658416 - RNA, 12 nt, Salmonella enterica enterica serovar Typhi
gcccucugucca

SEQ ID NO: 3658417 - RNA, 19 nt, Salmonella enterica enterica serovar Typhi
gcccucuuccagcgccaaa

SEQ ID NO: 3658418 - RNA, 16 nt, Salmonella enterica enterica serovar Typhi
gcccugaagggcggcu

SEQ ID NO: 3658419 - RNA, 19 nt, Salmonella enterica enterica serovar Typhi
gcccugaagggcggcugga

SEQ ID NO: 3658420 - RNA, 22 nt, Salmonella enterica enterica serovar Typhi
gcccugacgccgcuguuuucac

SEQ ID NO: 3658421 - RNA, 20 nt, Salmonella enterica enterica serovar Typhi
gcccugcgccagcauggcgu

SEQ ID NO: 3658422 - RNA, 17 nt, Salmonella enterica enterica serovar Typhi
gcccugcgccucaagcg

SEQ ID NO: 3658423 - RNA, 22 nt, Salmonella enterica enterica serovar Typhi
gcccugcgguagcuccagacag

SEQ ID NO: 3658424 - RNA, 17 nt, Salmonella enterica enterica serovar Typhi
gcccuggcgggaaacag

SEQ ID NO: 3658425 - RNA, 22 nt, Salmonella enterica enterica serovar Typhi
gcccuggugagcuccagcccgc

SEQ ID NO: 3658426 - RNA, 21 nt, Salmonella enterica enterica serovar Typhi
gcccuguaaaggauugccgcc

SEQ ID NO: 3658427 - RNA, 18 nt, Salmonella enterica enterica serovar Typhi
gcccuguaacagaauuaa

SEQ ID NO: 3658428 - RNA, 14 nt, Salmonella enterica enterica serovar Typhi
gcccuguccuccau

SEQ ID NO: 3658429 - RNA, 13 nt, Salmonella enterica enterica serovar Typhi
gcccugugccgcu

SEQ ID NO: 3658430 - RNA, 22 nt, Salmonella enterica enterica serovar Typhi
gcccuguggaaacuccagcggc

SEQ ID NO: 3658431 - RNA, 23 nt, Salmonella enterica enterica serovar Typhi
gcccuguggaaacuccagcggca

SEQ ID NO: 3658432 - RNA, 14 nt, Salmonella enterica enterica serovar Typhi
gcccuguuauucag

SEQ ID NO: 3658433 - RNA, 14 nt, Salmonella enterica enterica serovar Typhi
gcccuuaucuggau

SEQ ID NO: 3658434 - RNA, 19 nt, Salmonella enterica enterica serovar Typhi
gcccuucacaaccaucguc

SEQ ID NO: 3658435 - RNA, 16 nt, Salmonella enterica enterica serovar Typhi
gcccuucaucuuccag

SEQ ID NO: 3658436 - RNA, 14 nt, Salmonella enterica enterica serovar Typhi
gcccuuccagcagc

SEQ ID NO: 3658437 - RNA, 19 nt, Salmonella enterica enterica serovar Typhi
gcccuuccagcagccagcc

SEQ ID NO: 3658438 - RNA, 20 nt, Salmonella enterica enterica serovar Typhi
gcccuucgaccgucagcagc

SEQ ID NO: 3658439 - RNA, 22 nt, Salmonella enterica enterica serovar Typhi
gcccuucgucaggaggccugaa

SEQ ID NO: 3658440 - RNA, 13 nt, Salmonella enterica enterica serovar Typhi
gcccuuucuucaa

SEQ ID NO: 3658441 - RNA, 12 nt, Salmonella enterica enterica serovar Typhi
gcccuuugcccu

SEQ ID NO: 3658442 - RNA, 18 nt, Salmonella enterica enterica serovar Typhi
gcccuuuuccagaaaacc

SEQ ID NO: 3658443 - RNA, 16 nt, Salmonella enterica enterica serovar Typhi
gcccuuuuguuuuugc

SEQ ID NO: 3658444 - RNA, 19 nt, Salmonella enterica enterica serovar Typhi
gcccuuuuuuguugugaua

SEQ ID NO: 3658445 - RNA, 12 nt, Salmonella enterica enterica serovar Typhi
gccgaaagcgau

SEQ ID NO: 3658446 - RNA, 19 nt, Salmonella enterica enterica serovar Typhi
gccgaaauccaccagcgga

SEQ ID NO: 3658447 - RNA, 19 nt, Salmonella enterica enterica serovar Typhi
gccgaacaacacggcggcc

SEQ ID NO: 3658448 - RNA, 21 nt, Salmonella enterica enterica serovar Typhi
gccgaacaacacggcggccau

SEQ ID NO: 3658449 - RNA, 12 nt, Salmonella enterica enterica serovar Typhi
gccgaacagacg

SEQ ID NO: 3658450 - RNA, 17 nt, Salmonella enterica enterica serovar Typhi
gccgaacaguuucucgc

SEQ ID NO: 3658451 - RNA, 15 nt, Salmonella enterica enterica serovar Typhi
gccgaagcaggcgga

SEQ ID NO: 3658452 - RNA, 14 nt, Salmonella enterica enterica serovar Typhi
gccgaagugcgcgc

SEQ ID NO: 3658453 - RNA, 20 nt, Salmonella enterica enterica serovar Typhi
gccgaagugugccagcagau

SEQ ID NO: 3658454 - RNA, 20 nt, Salmonella enterica enterica serovar Typhi
gccgaaguucauaaauguac

SEQ ID NO: 3658455 - RNA, 16 nt, Salmonella enterica enterica serovar Typhi
gccgaauggcgggccu

SEQ ID NO: 3658456 - RNA, 20 nt, Salmonella enterica enterica serovar Typhi
gccgaauggcgggccuacgc

SEQ ID NO: 3658457 - RNA, 23 nt, Salmonella enterica enterica serovar Typhi
gccgaauuuacugugauccacca

SEQ ID NO: 3658458 - RNA, 21 nt, Salmonella enterica enterica serovar Typhi
gccgacaggcagguugccgau

SEQ ID NO: 3658459 - RNA, 22 nt, Salmonella enterica enterica serovar Typhi
gccgacauaagugcaggcugag

SEQ ID NO: 3658460 - RNA, 13 nt, Salmonella enterica enterica serovar Typhi
gccgacaucacgc

SEQ ID NO: 3658461 - RNA, 18 nt, Salmonella enterica enterica serovar Typhi
gccgacaucgccaccgca

SEQ ID NO: 3658462 - RNA, 20 nt, Salmonella enterica enterica serovar Typhi
gccgacaucgcucccggcac

SEQ ID NO: 3658463 - RNA, 19 nt, Salmonella enterica enterica serovar Typhi
gccgacaugcuccugcauc

SEQ ID NO: 3658464 - RNA, 15 nt, Salmonella enterica enterica serovar Typhi
gccgacauucccugc

SEQ ID NO: 3658465 - RNA, 19 nt, Salmonella enterica enterica serovar Typhi
gccgaccaauugcaggcag

SEQ ID NO: 3658466 - RNA, 15 nt, Salmonella enterica enterica serovar Typhi
gccgaccagcgucuu

SEQ ID NO: 3658467 - RNA, 14 nt, Salmonella enterica enterica serovar Typhi
gccgaccaucgcgc

SEQ ID NO: 3658468 - RNA, 23 nt, Salmonella enterica enterica serovar Typhi
gccgaccccaugacggccugcgc

SEQ ID NO: 3658469 - RNA, 18 nt, Salmonella enterica enterica serovar Typhi
gccgccaucgucgccacc

SEQ ID NO: 3658470 - RNA, 16 nt, Salmonella enterica enterica serovar Typhi
gccgccaucuccggca

SEQ ID NO: 3658471 - RNA, 15 nt, Salmonella enterica enterica serovar Typhi
gccgccauggcgaau

SEQ ID NO: 3658472 - RNA, 21 nt, Salmonella enterica enterica serovar Typhi
gccgccauucgcuuccgccgg

SEQ ID NO: 3658473 - RNA, 23 nt, Salmonella enterica enterica serovar Typhi
gccgccauucgcuuccgccggga

SEQ ID NO: 3658474 - RNA, 16 nt, Salmonella enterica enterica serovar Typhi
gccgccauugccagua

SEQ ID NO: 3658475 - RNA, 20 nt, Salmonella enterica enterica serovar Typhi
gccgccauuuuauccaggcc

SEQ ID NO: 3658476 - RNA, 14 nt, Salmonella enterica enterica serovar Typhi
gccgcccaaccagc

SEQ ID NO: 3658477 - RNA, 18 nt, Salmonella enterica enterica serovar Typhi
gccgcccaaccagcccag

SEQ ID NO: 3658478 - RNA, 11 nt, Salmonella enterica enterica serovar Typhi
gccgcccaggc

SEQ ID NO: 3658479 - RNA, 16 nt, Salmonella enterica enterica serovar Typhi
gccgcccaggccaugc

SEQ ID NO: 3658480 - RNA, 20 nt, Salmonella enterica enterica serovar Typhi
gccgcccaggccaugcgccg

SEQ ID NO: 3658481 - RNA, 15 nt, Salmonella enterica enterica serovar Typhi
gccgcccaucgccac

SEQ ID NO: 3658482 - RNA, 19 nt, Salmonella enterica enterica serovar Typhi
gccgcccaucgccacagcg

SEQ ID NO: 3658483 - RNA, 22 nt, Salmonella enterica enterica serovar Typhi
gccgcccauuaauaucagcccc

SEQ ID NO: 3658484 - RNA, 13 nt, Salmonella enterica enterica serovar Typhi
gccgccccccguc

SEQ ID NO: 3658485 - RNA, 15 nt, Salmonella enterica enterica serovar Typhi
gccgcccgccugagc

SEQ ID NO: 3658486 - RNA, 14 nt, Salmonella enterica enterica serovar Typhi
gccgcccugcauca

SEQ ID NO: 3658487 - RNA, 16 nt, Salmonella enterica enterica serovar Typhi
gccgccgacaaccagc

SEQ ID NO: 3658488 - RNA, 19 nt, Salmonella enterica enterica serovar Typhi
gccgccgcaacgcgcacgg

SEQ ID NO: 3658489 - RNA, 18 nt, Salmonella enterica enterica serovar Typhi
gccgccgcaccacugcug

SEQ ID NO: 3658490 - RNA, 11 nt, Salmonella enterica enterica serovar Typhi
gccgccgcagg

SEQ ID NO: 3658491 - RNA, 14 nt, Salmonella enterica enterica serovar Typhi
gccgccgcaggaca

SEQ ID NO: 3658492 - RNA, 21 nt, Salmonella enterica enterica serovar Typhi
gccgccgccuaccauaaugau

SEQ ID NO: 3658493 - RNA, 14 nt, Salmonella enterica enterica serovar Typhi
gccgccgccugcca

SEQ ID NO: 3658494 - RNA, 16 nt, Salmonella enterica enterica serovar Typhi
gccgccgcgcggaccg

SEQ ID NO: 3658495 - RNA, 19 nt, Salmonella enterica enterica serovar Typhi
gccgccgguguuuccguca

SEQ ID NO: 3658496 - RNA, 18 nt, Salmonella enterica enterica serovar Typhi
gccgccgucaucugcgcc

SEQ ID NO: 3658497 - RNA, 16 nt, Salmonella enterica enterica serovar Typhi
gccgccguuuuauuug

SEQ ID NO: 3658498 - RNA, 15 nt, Salmonella enterica enterica serovar Typhi
gccgccuaucgccag

SEQ ID NO: 3658499 - RNA, 17 nt, Salmonella enterica enterica serovar Typhi
gccgccuaucgccagca

SEQ ID NO: 3658500 - RNA, 18 nt, Salmonella enterica enterica serovar Typhi
gccgccuccagcauacug

SEQ ID NO: 3658501 - RNA, 23 nt, Salmonella enterica enterica serovar Typhi
gccgccuccggggaagcgcgcgc

SEQ ID NO: 3658502 - RNA, 15 nt, Salmonella enterica enterica serovar Typhi
gccgccugaugcugg

SEQ ID NO: 3658503 - RNA, 17 nt, Salmonella enterica enterica serovar Typhi
gccgccugaugcuggca

SEQ ID NO: 3658504 - RNA, 12 nt, Salmonella enterica enterica serovar Typhi
gccgccugcgcc

SEQ ID NO: 3658505 - RNA, 15 nt, Salmonella enterica enterica serovar Typhi
gccgccugcgccaac

SEQ ID NO: 3658506 - RNA, 16 nt, Salmonella enterica enterica serovar Typhi
gccgccuuggcgaccu

SEQ ID NO: 3658507 - RNA, 20 nt, Salmonella enterica enterica serovar Typhi
gccgcgaacguucaaaauca

SEQ ID NO: 3658508 - RNA, 22 nt, Salmonella enterica enterica serovar Typhi
gccgcgaagcguuccgccacua

SEQ ID NO: 3658509 - RNA, 14 nt, Salmonella enterica enterica serovar Typhi
gccgcgaccagcag

SEQ ID NO: 3658510 - RNA, 14 nt, Salmonella enterica enterica serovar Typhi
gccgcgacgcgcga

SEQ ID NO: 3658511 - RNA, 19 nt, Salmonella enterica enterica serovar Typhi
gccgcgagagucgccagga

SEQ ID NO: 3658512 - RNA, 24 nt, Salmonella enterica enterica serovar Typhi
gccgcgauacauugucgcagcgcu

SEQ ID NO: 3658513 - RNA, 14 nt, Salmonella enterica enterica serovar Typhi
gccgcgauacggau

SEQ ID NO: 3658514 - RNA, 14 nt, Salmonella enterica enterica serovar Typhi
gccgcgcaagcgau

SEQ ID NO: 3658515 - RNA, 20 nt, Salmonella enterica enterica serovar Typhi
gccgcgcaguuucuuaccua

SEQ ID NO: 3658516 - RNA, 16 nt, Salmonella enterica enterica serovar Typhi
gccgcgccagacgcca

SEQ ID NO: 3658517 - RNA, 16 nt, Salmonella enterica enterica serovar Typhi
gccgcgcccagcgccg

SEQ ID NO: 3658518 - RNA, 17 nt, Salmonella enterica enterica serovar Typhi
gccgcgcccuaacaggc

SEQ ID NO: 3658519 - RNA, 18 nt, Salmonella enterica enterica serovar Typhi
gccgcgcccuaacaggcg

SEQ ID NO: 3658520 - RNA, 14 nt, Salmonella enterica enterica serovar Typhi
gccgcgcccugcgg

SEQ ID NO: 3658521 - RNA, 17 nt, Salmonella enterica enterica serovar Typhi
gccgcgccgacauagcu

SEQ ID NO: 3658522 - RNA, 17 nt, Salmonella enterica enterica serovar Typhi
gccgcgccggacuccag

SEQ ID NO: 3658523 - RNA, 13 nt, Salmonella enterica enterica serovar Typhi
gccgcgcgccgcc

SEQ ID NO: 3658524 - RNA, 14 nt, Salmonella enterica enterica serovar Typhi
gccgcgcgccgccu

SEQ ID NO: 3658525 - RNA, 20 nt, Salmonella enterica enterica serovar Typhi
gccgcgcgguauuucgcaac

SEQ ID NO: 3658526 - RNA, 22 nt, Salmonella enterica enterica serovar Typhi
gccgcgcuaucaaaaugcaccg

SEQ ID NO: 3658527 - RNA, 22 nt, Salmonella enterica enterica serovar Typhi
gccgcgcuccaucauaucgcgc

SEQ ID NO: 3658528 - RNA, 13 nt, Salmonella enterica enterica serovar Typhi
gccgcgcuggaua

SEQ ID NO: 3658529 - RNA, 24 nt, Salmonella enterica enterica serovar Typhi
gccgcggaccuuuugccgcccagu

SEQ ID NO: 3658530 - RNA, 15 nt, Salmonella enterica enterica serovar Typhi
gccgcggcgcuggcc

SEQ ID NO: 3658531 - RNA, 15 nt, Salmonella enterica enterica serovar Typhi
gccgcggucgagcau

SEQ ID NO: 3658532 - RNA, 23 nt, Salmonella enterica enterica serovar Typhi
gccgcguuuaagucccuggcgcg

SEQ ID NO: 3658533 - RNA, 16 nt, Salmonella enterica enterica serovar Typhi
gccgcguuuugccgcu

SEQ ID NO: 3658534 - RNA, 19 nt, Salmonella enterica enterica serovar Typhi
gccgcuaaaacacccgcaa

SEQ ID NO: 3658535 - RNA, 18 nt, Salmonella enterica enterica serovar Typhi
gccgcuacugccgccauc

SEQ ID NO: 3658536 - RNA, 18 nt, Salmonella enterica enterica serovar Typhi
gccgcuagcugcagcgcu

SEQ ID NO: 3658537 - RNA, 14 nt, Salmonella enterica enterica serovar Typhi
gccgcuauccucgc

SEQ ID NO: 3658538 - RNA, 21 nt, Salmonella enterica enterica serovar Typhi
gccgcuaucgaccagcaccug

SEQ ID NO: 3658539 - RNA, 23 nt, Salmonella enterica enterica serovar Typhi
gccgcuaugacgaagcugaguau

SEQ ID NO: 3658540 - RNA, 19 nt, Salmonella enterica enterica serovar Typhi
gccgcucaggguaaucacc

SEQ ID NO: 3658541 - RNA, 19 nt, Salmonella enterica enterica serovar Typhi
gccgcucaucaccagcagc

SEQ ID NO: 3658542 - RNA, 20 nt, Salmonella enterica enterica serovar Typhi
gccgcucaucaccagcagca

SEQ ID NO: 3658543 - RNA, 14 nt, Salmonella enterica enterica serovar Typhi
gccgcuccagggau

SEQ ID NO: 3658544 - RNA, 23 nt, Salmonella enterica enterica serovar Typhi
gccgcucccgcauggacaaggau

SEQ ID NO: 3658545 - RNA, 23 nt, Salmonella enterica enterica serovar Typhi
gccgcuccggguuuucaauaauc

SEQ ID NO: 3658546 - RNA, 13 nt, Salmonella enterica enterica serovar Typhi
gccgcucgccugc

SEQ ID NO: 3658547 - RNA, 23 nt, Salmonella enterica enterica serovar Typhi
gccgcucucuucgugacccgcca

SEQ ID NO: 3658548 - RNA, 20 nt, Salmonella enterica enterica serovar Typhi
gccgcugauguuuugcgccg

SEQ ID NO: 3658549 - RNA, 14 nt, Salmonella enterica enterica serovar Typhi
gccgcuggcgucuu

SEQ ID NO: 3658550 - RNA, 13 nt, Salmonella enterica enterica serovar Typhi
gccgcuggcuggc

SEQ ID NO: 3658551 - RNA, 18 nt, Salmonella enterica enterica serovar Typhi
gccgcugggauucggcaa

SEQ ID NO: 3658552 - RNA, 17 nt, Salmonella enterica enterica serovar Typhi
gccgcugucgccagaau

SEQ ID NO: 3658553 - RNA, 19 nt, Salmonella enterica enterica serovar Typhi
gccgcuuacugugccgccg

SEQ ID NO: 3658554 - RNA, 15 nt, Salmonella enterica enterica serovar Typhi
gccgcuuauccggcc

SEQ ID NO: 3658555 - RNA, 14 nt, Salmonella enterica enterica serovar Typhi
gccgguaucaucag

SEQ ID NO: 3658556 - RNA, 13 nt, Salmonella enterica enterica serovar Typhi
gccgguauccagc

SEQ ID NO: 3658557 - RNA, 15 nt, Salmonella enterica enterica serovar Typhi
gccgguauccagcgc

SEQ ID NO: 3658558 - RNA, 19 nt, Salmonella enterica enterica serovar Typhi
gccggucaugccaucccgc

SEQ ID NO: 3658559 - RNA, 17 nt, Salmonella enterica enterica serovar Typhi
gccgguccguucucuca

SEQ ID NO: 3658560 - RNA, 16 nt, Salmonella enterica enterica serovar Typhi
gccggucgccagcaua

SEQ ID NO: 3658561 - RNA, 17 nt, Salmonella enterica enterica serovar Typhi
gccggugccauuccagc

SEQ ID NO: 3658562 - RNA, 13 nt, Salmonella enterica enterica serovar Typhi
gccggugccgcaa

SEQ ID NO: 3658563 - RNA, 16 nt, Salmonella enterica enterica serovar Typhi
gccggugccugccgcc

SEQ ID NO: 3658564 - RNA, 16 nt, Salmonella enterica enterica serovar Typhi
gccgguuauaccgcca

SEQ ID NO: 3658565 - RNA, 18 nt, Salmonella enterica enterica serovar Typhi
gccgguuauaccgccauc

SEQ ID NO: 3658566 - RNA, 21 nt, Salmonella enterica enterica serovar Typhi
gccgguucggccagucgcaga

SEQ ID NO: 3658567 - RNA, 16 nt, Salmonella enterica enterica serovar Typhi
gccgguuuauccccgc

SEQ ID NO: 3658568 - RNA, 20 nt, Salmonella enterica enterica serovar Typhi
gccgguuucuccagccucgc

SEQ ID NO: 3658569 - RNA, 22 nt, Salmonella enterica enterica serovar Typhi
gccgguuuuagcguauccggca

SEQ ID NO: 3658570 - RNA, 17 nt, Salmonella enterica enterica serovar Typhi
gccguaaacaggcaggc

SEQ ID NO: 3658571 - RNA, 17 nt, Salmonella enterica enterica serovar Typhi
gccguaaauugagugga

SEQ ID NO: 3658572 - RNA, 20 nt, Salmonella enterica enterica serovar Typhi
gccguaacgaacgcggauca

SEQ ID NO: 3658573 - RNA, 17 nt, Salmonella enterica enterica serovar Typhi
gccguaaggcguaccgc

SEQ ID NO: 3658574 - RNA, 18 nt, Salmonella enterica enterica serovar Typhi
gccguagcccgcuuuacc

SEQ ID NO: 3658575 - RNA, 16 nt, Salmonella enterica enterica serovar Typhi
gccguauaauccagcu

SEQ ID NO: 3658576 - RNA, 19 nt, Salmonella enterica enterica serovar Typhi
gccguaucagcaagcgcca

SEQ ID NO: 3658577 - RNA, 16 nt, Salmonella enterica enterica serovar Typhi
gccguauucuuaccca

SEQ ID NO: 3658578 - RNA, 18 nt, Salmonella enterica enterica serovar Typhi
gccguauucuuacccacc

SEQ ID NO: 3658579 - RNA, 19 nt, Salmonella enterica enterica serovar Typhi
gccgucaaugccuggcaga

SEQ ID NO: 3658580 - RNA, 15 nt, Salmonella enterica enterica serovar Typhi
gccgucacaggcggc

SEQ ID NO: 3658581 - RNA, 21 nt, Salmonella enterica enterica serovar Typhi
gccgucagacaggccugguua

SEQ ID NO: 3658582 - RNA, 21 nt, Salmonella enterica enterica serovar Typhi
gccgucaggcuacccgcaaua

SEQ ID NO: 3658583 - RNA, 23 nt, Salmonella enterica enterica serovar Typhi
gccgucaggcuugccgcgccaga

SEQ ID NO: 3658584 - RNA, 17 nt, Salmonella enterica enterica serovar Typhi
gccgucagugagcccuc

SEQ ID NO: 3658585 - RNA, 18 nt, Salmonella enterica enterica serovar Typhi
gccgucauaccgcccaug

SEQ ID NO: 3658586 - RNA, 22 nt, Salmonella enterica enterica serovar Typhi
gccgucauggcaaacgaaccca

SEQ ID NO: 3658587 - RNA, 14 nt, Salmonella enterica enterica serovar Typhi
gccguccauccggc

SEQ ID NO: 3658588 - RNA, 20 nt, Salmonella enterica enterica serovar Typhi
gccgucgaugauggcggcua

SEQ ID NO: 3658589 - RNA, 18 nt, Salmonella enterica enterica serovar Typhi
gccgucggcaauaaacuc

SEQ ID NO: 3658590 - RNA, 13 nt, Salmonella enterica enterica serovar Typhi
gccgucggcgcca

SEQ ID NO: 3658591 - RNA, 15 nt, Salmonella enterica enterica serovar Typhi
gccgucggcgccagc

SEQ ID NO: 3658592 - RNA, 17 nt, Salmonella enterica enterica serovar Typhi
gccgucgucaccgccgc

SEQ ID NO: 3658593 - RNA, 23 nt, Salmonella enterica enterica serovar Typhi
gccgucguuaacaucaucaggcc

SEQ ID NO: 3658594 - RNA, 17 nt, Salmonella enterica enterica serovar Typhi
gccgucguucagccagc

SEQ ID NO: 3658595 - RNA, 18 nt, Salmonella enterica enterica serovar Typhi
gccgucucuuucauggaa

SEQ ID NO: 3658596 - RNA, 13 nt, Salmonella enterica enterica serovar Typhi
gccgucuucuucu

SEQ ID NO: 3658597 - RNA, 16 nt, Salmonella enterica enterica serovar Typhi
gccgugaaauauccuc

SEQ ID NO: 3658598 - RNA, 18 nt, Salmonella enterica enterica serovar Typhi
gccgugaaauauccuccg

SEQ ID NO: 3658599 - RNA, 19 nt, Salmonella enterica enterica serovar Typhi
gccgugaauaaaaccggca

SEQ ID NO: 3658600 - RNA, 17 nt, Salmonella enterica enterica serovar Typhi
gccgugaauuucugcug

SEQ ID NO: 3658601 - RNA, 22 nt, Salmonella enterica enterica serovar Typhi
gccgugacuguucacauccagc

SEQ ID NO: 3658602 - RNA, 13 nt, Salmonella enterica enterica serovar Typhi
gccgugaucccaa

SEQ ID NO: 3658603 - RNA, 12 nt, Salmonella enterica enterica serovar Typhi
gccgugauucau

SEQ ID NO: 3658604 - RNA, 18 nt, Salmonella enterica enterica serovar Typhi
gccgugcacuucugcggu

SEQ ID NO: 3658605 - RNA, 15 nt, Salmonella enterica enterica serovar Typhi
gccgugccuggcgcu

SEQ ID NO: 3658606 - RNA, 18 nt, Salmonella enterica enterica serovar Typhi
gccgugccuggcgcuggg

SEQ ID NO: 3658607 - RNA, 22 nt, Salmonella enterica enterica serovar Typhi
gccgugccugggcggcaacccg

SEQ ID NO: 3658608 - RNA, 20 nt, Salmonella enterica enterica serovar Typhi
gccgugcgccgacaucgcca

SEQ ID NO: 3658609 - RNA, 15 nt, Salmonella enterica enterica serovar Typhi
gccguggaacgugcc

SEQ ID NO: 3658610 - RNA, 22 nt, Salmonella enterica enterica serovar Typhi
gccguggaccguauagcccaga

SEQ ID NO: 3658611 - RNA, 12 nt, Salmonella enterica enterica serovar Typhi
gccguggcuggc

SEQ ID NO: 3658612 - RNA, 23 nt, Salmonella enterica enterica serovar Typhi
gccguguauuuuaccucgccagu

SEQ ID NO: 3658613 - RNA, 20 nt, Salmonella enterica enterica serovar Typhi
gccgugucgaccggcaccau

SEQ ID NO: 3658614 - RNA, 18 nt, Salmonella enterica enterica serovar Typhi
gccguguucuuacccacu

SEQ ID NO: 3658615 - RNA, 23 nt, Salmonella enterica enterica serovar Typhi
gccguuaacuggcgcaucugguc

SEQ ID NO: 3658616 - RNA, 19 nt, Salmonella enterica enterica serovar Typhi
gccguuaaucuggccuacg

SEQ ID NO: 3658617 - RNA, 20 nt, Salmonella enterica enterica serovar Typhi
gccguuaaucuggccuacgg

SEQ ID NO: 3658618 - RNA, 15 nt, Salmonella enterica enterica serovar Typhi
gccguuaccgccgag

SEQ ID NO: 3658619 - RNA, 17 nt, Salmonella enterica enterica serovar Typhi
gccguuaccgccgagca

SEQ ID NO: 3658620 - RNA, 13 nt, Salmonella enterica enterica serovar Typhi
gccguuacuguuu

SEQ ID NO: 3658621 - RNA, 16 nt, Salmonella enterica enterica serovar Typhi
gccguuaucggccugc

SEQ ID NO: 3658622 - RNA, 17 nt, Salmonella enterica enterica serovar Typhi
gccguuaucggccugcu

SEQ ID NO: 3658623 - RNA, 23 nt, Salmonella enterica enterica serovar Typhi
gccguucaccagccacugcgcca

SEQ ID NO: 3658624 - RNA, 14 nt, Salmonella enterica enterica serovar Typhi
gccguuccauucca

SEQ ID NO: 3658625 - RNA, 13 nt, Salmonella enterica enterica serovar Typhi
gccguuccgcaac

SEQ ID NO: 3658626 - RNA, 21 nt, Salmonella enterica enterica serovar Typhi
gccguuccgcaacaagcauca

SEQ ID NO: 3658627 - RNA, 16 nt, Salmonella enterica enterica serovar Typhi
gccguuccguucgcgu

SEQ ID NO: 3658628 - RNA, 18 nt, Salmonella enterica enterica serovar Typhi
gccguuccguucgcguca

SEQ ID NO: 3658629 - RNA, 22 nt, Salmonella enterica enterica serovar Typhi
gccguugaguuugacugccaga

SEQ ID NO: 3658630 - RNA, 22 nt, Salmonella enterica enterica serovar Typhi
gccguugcgauaauacacggua

SEQ ID NO: 3658631 - RNA, 17 nt, Salmonella enterica enterica serovar Typhi
gccguugugcugguuga

SEQ ID NO: 3658632 - RNA, 18 nt, Salmonella enterica enterica serovar Typhi
gccguuuuagguucuuca

SEQ ID NO: 3658633 - RNA, 19 nt, Salmonella enterica enterica serovar Typhi
gccguuuuagguucuucaa

SEQ ID NO: 3658634 - RNA, 16 nt, Salmonella enterica enterica serovar Typhi
gccguuuuaucgcccg

SEQ ID NO: 3658635 - RNA, 13 nt, Salmonella enterica enterica serovar Typhi
gccguuuuccggu

SEQ ID NO: 3658636 - RNA, 18 nt, Salmonella enterica enterica serovar Typhi
gccguuuuggcagcgccc

SEQ ID NO: 3658637 - RNA, 22 nt, Salmonella enterica enterica serovar Typhi
gccguuuuuaauuugcuccaga

SEQ ID NO: 3658638 - RNA, 12 nt, Salmonella enterica enterica serovar Typhi
gccuaaagaaaa

SEQ ID NO: 3658639 - RNA, 14 nt, Salmonella enterica enterica serovar Typhi
gccuaaaucgcugc

SEQ ID NO: 3658640 - RNA, 19 nt, Salmonella enterica enterica serovar Typhi
gccugauaagcacaggcca

SEQ ID NO: 3658641 - RNA, 22 nt, Salmonella enterica enterica serovar Typhi
gccugauaagcauagcgccauc

SEQ ID NO: 3658642 - RNA, 20 nt, Salmonella enterica enterica serovar Typhi
gccugauaagcguagcgcca

SEQ ID NO: 3658643 - RNA, 18 nt, Salmonella enterica enterica serovar Typhi
gccugauagcacagcgcu

SEQ ID NO: 3658644 - RNA, 12 nt, Salmonella enterica enterica serovar Typhi
gccugaucuuuc

SEQ ID NO: 3658645 - RNA, 15 nt, Salmonella enterica enterica serovar Typhi
gccugaucuuucugg

SEQ ID NO: 3658646 - RNA, 13 nt, Salmonella enterica enterica serovar Typhi
gccugaugaccgc

SEQ ID NO: 3658647 - RNA, 17 nt, Salmonella enterica enterica serovar Typhi
gccugaugacgcugcgc

SEQ ID NO: 3658648 - RNA, 16 nt, Salmonella enterica enterica serovar Typhi
gccugaugagcgcagc

SEQ ID NO: 3658649 - RNA, 23 nt, Salmonella enterica enterica serovar Typhi
gccugaugagguuacguucauca

SEQ ID NO: 3658650 - RNA, 22 nt, Salmonella enterica enterica serovar Typhi
gccugaugcgcguuuagcgcca

SEQ ID NO: 3658651 - RNA, 20 nt, Salmonella enterica enterica serovar Typhi
gccugaugcugcgcauccgc

SEQ ID NO: 3658652 - RNA, 23 nt, Salmonella enterica enterica serovar Typhi
gccugaugcugcgcauccgcggc

SEQ ID NO: 3658653 - RNA, 22 nt, Salmonella enterica enterica serovar Typhi
gccugauggcgacguuagcgca

SEQ ID NO: 3658654 - RNA, 23 nt, Salmonella enterica enterica serovar Typhi
gccugauggcgacguuagcgcau

SEQ ID NO: 3658655 - RNA, 13 nt, Salmonella enterica enterica serovar Typhi
gccugauggcgcu

SEQ ID NO: 3658656 - RNA, 17 nt, Salmonella enterica enterica serovar Typhi
gccugauggcgcuacgc

SEQ ID NO: 3658657 - RNA, 15 nt, Salmonella enterica enterica serovar Typhi
gccugauggcgcugc

SEQ ID NO: 3658658 - RNA, 17 nt, Salmonella enterica enterica serovar Typhi
gccugauggcgcugcgc

SEQ ID NO: 3658659 - RNA, 22 nt, Salmonella enterica enterica serovar Typhi
gccugauggucgcucuggucga

SEQ ID NO: 3658660 - RNA, 16 nt, Salmonella enterica enterica serovar Typhi
gccugauucauuccca

SEQ ID NO: 3658661 - RNA, 21 nt, Salmonella enterica enterica serovar Typhi
gccugauucgugacaucaagc

SEQ ID NO: 3658662 - RNA, 22 nt, Salmonella enterica enterica serovar Typhi
gccugauucgugacaucaagcc

SEQ ID NO: 3658663 - RNA, 13 nt, Salmonella enterica enterica serovar Typhi
gccugauuucuga

SEQ ID NO: 3658664 - RNA, 14 nt, Salmonella enterica enterica serovar Typhi
gccugcacauugca

SEQ ID NO: 3658665 - RNA, 22 nt, Salmonella enterica enterica serovar Typhi
gccugcacggcgucauucacau

SEQ ID NO: 3658666 - RNA, 22 nt, Salmonella enterica enterica serovar Typhi
gccugcauaaaggaguaacaga

SEQ ID NO: 3658667 - RNA, 15 nt, Salmonella enterica enterica serovar Typhi
gccugcauacguuuc

SEQ ID NO: 3658668 - RNA, 16 nt, Salmonella enterica enterica serovar Typhi
gccugcauacguuuca

SEQ ID NO: 3658669 - RNA, 21 nt, Salmonella enterica enterica serovar Typhi
gccugcauacguuucaccagc

SEQ ID NO: 3658670 - RNA, 19 nt, Salmonella enterica enterica serovar Typhi
gccugcaucaccucagaau

SEQ ID NO: 3658671 - RNA, 17 nt, Salmonella enterica enterica serovar Typhi
gccugcauuugcuggcg

SEQ ID NO: 3658672 - RNA, 14 nt, Salmonella enterica enterica serovar Typhi
gccugccaaccggc

SEQ ID NO: 3658673 - RNA, 20 nt, Salmonella enterica enterica serovar Typhi
gccugccagcaacccaccug

SEQ ID NO: 3658674 - RNA, 13 nt, Salmonella enterica enterica serovar Typhi
gccugccauagca

SEQ ID NO: 3658675 - RNA, 18 nt, Salmonella enterica enterica serovar Typhi
gccugccauagcaucacc

SEQ ID NO: 3658676 - RNA, 19 nt, Salmonella enterica enterica serovar Typhi
gccugccgcauguccccag

SEQ ID NO: 3658677 - RNA, 23 nt, Salmonella enterica enterica serovar Typhi
gccugccgccagcaguugcagcg

SEQ ID NO: 3658678 - RNA, 13 nt, Salmonella enterica enterica serovar Typhi
gccugccgggccu

SEQ ID NO: 3658679 - RNA, 18 nt, Salmonella enterica enterica serovar Typhi
gccugccgggccugcggc

SEQ ID NO: 3658680 - RNA, 15 nt, Salmonella enterica enterica serovar Typhi
gccugccguccugau

SEQ ID NO: 3658681 - RNA, 16 nt, Salmonella enterica enterica serovar Typhi
gccugccgucgcggcu

SEQ ID NO: 3658682 - RNA, 22 nt, Salmonella enterica enterica serovar Typhi
gccugccgucuuuuagcaucag

SEQ ID NO: 3658683 - RNA, 14 nt, Salmonella enterica enterica serovar Typhi
gccugccugacgcc

SEQ ID NO: 3658684 - RNA, 16 nt, Salmonella enterica enterica serovar Typhi
gccugcgaucuguguc

SEQ ID NO: 3658685 - RNA, 16 nt, Salmonella enterica enterica serovar Typhi
gccugcgccagcgccg

SEQ ID NO: 3658686 - RNA, 21 nt, Salmonella enterica enterica serovar Typhi
gccugcgcgccugacgcggac

SEQ ID NO: 3658687 - RNA, 22 nt, Salmonella enterica enterica serovar Typhi
gccugcgcguaaauuucacuua

SEQ ID NO: 3658688 - RNA, 20 nt, Salmonella enterica enterica serovar Typhi
gccugcgguaaucgccgcga

SEQ ID NO: 3658689 - RNA, 18 nt, Salmonella enterica enterica serovar Typhi
gccugcguugcuauggca

SEQ ID NO: 3658690 - RNA, 14 nt, Salmonella enterica enterica serovar Typhi
gccugcucaucagg

SEQ ID NO: 3658691 - RNA, 15 nt, Salmonella enterica enterica serovar Typhi
gccugcuccgccagg

SEQ ID NO: 3658692 - RNA, 16 nt, Salmonella enterica enterica serovar Typhi
gccugcucuugcggca

SEQ ID NO: 3658693 - RNA, 14 nt, Salmonella enterica enterica serovar Typhi
gccugcugccugca

SEQ ID NO: 3658694 - RNA, 14 nt, Salmonella enterica enterica serovar Typhi
gccugcugcgcaac

SEQ ID NO: 3658695 - RNA, 18 nt, Salmonella enterica enterica serovar Typhi
gccugcuggaaaggccgc

SEQ ID NO: 3658696 - RNA, 14 nt, Salmonella enterica enterica serovar Typhi
gccugcuggagccg

SEQ ID NO: 3658697 - RNA, 15 nt, Salmonella enterica enterica serovar Typhi
gccugcuguaaaaua

SEQ ID NO: 3658698 - RNA, 20 nt, Salmonella enterica enterica serovar Typhi
gccugcuguaaccccugcgc

SEQ ID NO: 3658699 - RNA, 22 nt, Salmonella enterica enterica serovar Typhi
gccugcuguacuuuugcuucca

SEQ ID NO: 3658700 - RNA, 18 nt, Salmonella enterica enterica serovar Typhi
gccuggagaucagcaugg

SEQ ID NO: 3658701 - RNA, 16 nt, Salmonella enterica enterica serovar Typhi
gccuggcaacaugacc

SEQ ID NO: 3658702 - RNA, 22 nt, Salmonella enterica enterica serovar Typhi
gccuggcaacaugaccagcgca

SEQ ID NO: 3658703 - RNA, 15 nt, Salmonella enterica enterica serovar Typhi
gccuggcauggugca

SEQ ID NO: 3658704 - RNA, 22 nt, Salmonella enterica enterica serovar Typhi
gccuggcauggugcagccgcca

SEQ ID NO: 3658705 - RNA, 15 nt, Salmonella enterica enterica serovar Typhi
gccuggcauuuuacu

SEQ ID NO: 3658706 - RNA, 21 nt, Salmonella enterica enterica serovar Typhi
gccuggcccggcaguugcugg

SEQ ID NO: 3658707 - RNA, 14 nt, Salmonella enterica enterica serovar Typhi
gccuggcgcagcgc

SEQ ID NO: 3658708 - RNA, 14 nt, Salmonella enterica enterica serovar Typhi
gccuggcgcugggu

SEQ ID NO: 3658709 - RNA, 21 nt, Salmonella enterica enterica serovar Typhi
gccuggcgguaugaaagccau

SEQ ID NO: 3658710 - RNA, 16 nt, Salmonella enterica enterica serovar Typhi
gccuggcugagaaaaa

SEQ ID NO: 3658711 - RNA, 18 nt, Salmonella enterica enterica serovar Typhi
gccuggcuuguuacugca

SEQ ID NO: 3658712 - RNA, 20 nt, Salmonella enterica enterica serovar Typhi
gccugguaagcguagcgcca

SEQ ID NO: 3658713 - RNA, 21 nt, Salmonella enterica enterica serovar Typhi
gccugguggcgacgcguggca

SEQ ID NO: 3658714 - RNA, 21 nt, Salmonella enterica enterica serovar Typhi
gccugguuaacaauauugcgc

SEQ ID NO: 3658715 - RNA, 16 nt, Salmonella enterica enterica serovar Typhi
gccuguaaacguuccu

SEQ ID NO: 3658716 - RNA, 17 nt, Salmonella enterica enterica serovar Typhi
gccuguaaggcucucuu

SEQ ID NO: 3658717 - RNA, 20 nt, Salmonella enterica enterica serovar Typhi
gccuguaaggucucagcgac

SEQ ID NO: 3658718 - RNA, 17 nt, Salmonella enterica enterica serovar Typhi
gccuguaauggcgcucu

SEQ ID NO: 3658719 - RNA, 22 nt, Salmonella enterica enterica serovar Typhi
gccuguaauggcgcucuuuucc

SEQ ID NO: 3658720 - RNA, 16 nt, Salmonella enterica enterica serovar Typhi
gccuguacuugcgccg

SEQ ID NO: 3658721 - RNA, 16 nt, Salmonella enterica enterica serovar Typhi
gccuguagcagcgcca

SEQ ID NO: 3658722 - RNA, 17 nt, Salmonella enterica enterica serovar Typhi
gccuguaguacaugcca

SEQ ID NO: 3658723 - RNA, 13 nt, Salmonella enterica enterica serovar Typhi
gccugucaggccu

SEQ ID NO: 3658724 - RNA, 17 nt, Salmonella enterica enterica serovar Typhi
gccugucgggccuacag

SEQ ID NO: 3658725 - RNA, 18 nt, Salmonella enterica enterica serovar Typhi
gcgaaaagcgugcgccuu

SEQ ID NO: 3658726 - RNA, 15 nt, Salmonella enterica enterica serovar Typhi
gcgaaaaggccuggc

SEQ ID NO: 3658727 - RNA, 12 nt, Salmonella enterica enterica serovar Typhi
gcgaaaauaaac

SEQ ID NO: 3658728 - RNA, 22 nt, Salmonella enterica enterica serovar Typhi
gcgaaaauaccccagcgcgccg

SEQ ID NO: 3658729 - RNA, 23 nt, Salmonella enterica enterica serovar Typhi
gcgaaacaggucggcaugcaucu

SEQ ID NO: 3658730 - RNA, 20 nt, Salmonella enterica enterica serovar Typhi
gcgaaaccgcuacccggcac

SEQ ID NO: 3658731 - RNA, 17 nt, Salmonella enterica enterica serovar Typhi
gcgaaacuccagcgaua

SEQ ID NO: 3658732 - RNA, 20 nt, Salmonella enterica enterica serovar Typhi
gcgaaagaagcgcuggagaa

SEQ ID NO: 3658733 - RNA, 20 nt, Salmonella enterica enterica serovar Typhi
gcgaaagcacucggcgccuu

SEQ ID NO: 3658734 - RNA, 21 nt, Salmonella enterica enterica serovar Typhi
gcgaaagcacuucucgcgcau

SEQ ID NO: 3658735 - RNA, 23 nt, Salmonella enterica enterica serovar Typhi
gcgaaagcacuucucgcgcauca

SEQ ID NO: 3658736 - RNA, 21 nt, Salmonella enterica enterica serovar Typhi
gcgaaaucaaagaccuccgcc

SEQ ID NO: 3658737 - RNA, 21 nt, Salmonella enterica enterica serovar Typhi
gcgaaaugcgaauccggcggc

SEQ ID NO: 3658738 - RNA, 20 nt, Salmonella enterica enterica serovar Typhi
gcgaaauuuaauauaugaac

SEQ ID NO: 3658739 - RNA, 19 nt, Salmonella enterica enterica serovar Typhi
gcgaacaaagccccgggcg

SEQ ID NO: 3658740 - RNA, 13 nt, Salmonella enterica enterica serovar Typhi
gcgaacagcgcac

SEQ ID NO: 3658741 - RNA, 14 nt, Salmonella enterica enterica serovar Typhi
gcgaacaggcguaa

SEQ ID NO: 3658742 - RNA, 19 nt, Salmonella enterica enterica serovar Typhi
gcgaacaggcucagcgcca

SEQ ID NO: 3658743 - RNA, 20 nt, Salmonella enterica enterica serovar Typhi
gcgaacaguguaaacgccag

SEQ ID NO: 3658744 - RNA, 22 nt, Salmonella enterica enterica serovar Typhi
gcgaaccaccguuuaaucgccc

SEQ ID NO: 3658745 - RNA, 13 nt, Salmonella enterica enterica serovar Typhi
gcgaaccggacca

SEQ ID NO: 3658746 - RNA, 13 nt, Salmonella enterica enterica serovar Typhi
gcgaaccggcauc

SEQ ID NO: 3658747 - RNA, 14 nt, Salmonella enterica enterica serovar Typhi
gcgaacguccagcg

SEQ ID NO: 3658748 - RNA, 13 nt, Salmonella enterica enterica serovar Typhi
gcgaacuacaggc

SEQ ID NO: 3658749 - RNA, 22 nt, Salmonella enterica enterica serovar Typhi
gcgaagaucguuauccagcagc

SEQ ID NO: 3658750 - RNA, 19 nt, Salmonella enterica enterica serovar Typhi
gcgaagcgccgucggcauc

SEQ ID NO: 3658751 - RNA, 16 nt, Salmonella enterica enterica serovar Typhi
gcgaagcgcuccggca

SEQ ID NO: 3658752 - RNA, 14 nt, Salmonella enterica enterica serovar Typhi
gcgaaggcggcggc

SEQ ID NO: 3658753 - RNA, 20 nt, Salmonella enterica enterica serovar Typhi
gcgaaggggcgggcagcagc

SEQ ID NO: 3658754 - RNA, 23 nt, Salmonella enterica enterica serovar Typhi
gcgaagugcagcguuuccagcca

SEQ ID NO: 3658755 - RNA, 22 nt, Salmonella enterica enterica serovar Typhi
gcgaauaaaauucagcgcagua

SEQ ID NO: 3658756 - RNA, 14 nt, Salmonella enterica enterica serovar Typhi
gcgaauaaacacau

SEQ ID NO: 3658757 - RNA, 18 nt, Salmonella enterica enterica serovar Typhi
gcgaauaacauaauauuc

SEQ ID NO: 3658758 - RNA, 16 nt, Salmonella enterica enterica serovar Typhi
gcgaauaacaucaucc

SEQ ID NO: 3658759 - RNA, 14 nt, Salmonella enterica enterica serovar Typhi
gcgaauaagcuccg

SEQ ID NO: 3658760 - RNA, 20 nt, Salmonella enterica enterica serovar Typhi
gcgaauaaucaaccauacau

SEQ ID NO: 3658761 - RNA, 16 nt, Salmonella enterica enterica serovar Typhi
gcgaauaaucccggcg

SEQ ID NO: 3658762 - RNA, 14 nt, Salmonella enterica enterica serovar Typhi
gcgaauaaucgccg

SEQ ID NO: 3658763 - RNA, 20 nt, Salmonella enterica enterica serovar Typhi
gcgaauacuguuccaggcga

SEQ ID NO: 3658764 - RNA, 15 nt, Salmonella enterica enterica serovar Typhi
gcgaauagccagaca

SEQ ID NO: 3658765 - RNA, 18 nt, Salmonella enterica enterica serovar Typhi
gcgaauagccagacagcc

SEQ ID NO: 3658766 - RNA, 15 nt, Salmonella enterica enterica serovar Typhi
gcgaauagcgcgcua

SEQ ID NO: 3658767 - RNA, 15 nt, Salmonella enterica enterica serovar Typhi
gcgaauauacgcacc

SEQ ID NO: 3658768 - RNA, 23 nt, Salmonella enterica enterica serovar Typhi
gcgaaucacauccgccagcgccu

SEQ ID NO: 3658769 - RNA, 21 nt, Salmonella enterica enterica serovar Typhi
gcgaauccauaccugacgcac

SEQ ID NO: 3658770 - RNA, 20 nt, Salmonella enterica enterica serovar Typhi
gcgaauccgccauagccggc

SEQ ID NO: 3658771 - RNA, 23 nt, Salmonella enterica enterica serovar Typhi
gcgaauccgugcguaaaauauac

SEQ ID NO: 3658772 - RNA, 20 nt, Salmonella enterica enterica serovar Typhi
gcgaaucgacaauccgccac

SEQ ID NO: 3658773 - RNA, 18 nt, Salmonella enterica enterica serovar Typhi
gcgaaucgccucuucgac

SEQ ID NO: 3658774 - RNA, 15 nt, Salmonella enterica enterica serovar Typhi
gcgaaucuaccagau

SEQ ID NO: 3658775 - RNA, 16 nt, Salmonella enterica enterica serovar Typhi
gcgaaucuaccagauc

SEQ ID NO: 3658776 - RNA, 20 nt, Salmonella enterica enterica serovar Typhi
gcgaaugcaaccggaacuca

SEQ ID NO: 3658777 - RNA, 14 nt, Salmonella enterica enterica serovar Typhi
gcgaaugcgcgcca

SEQ ID NO: 3658778 - RNA, 13 nt, Salmonella enterica enterica serovar Typhi
gcgaauggcggca

SEQ ID NO: 3658779 - RNA, 17 nt, Salmonella enterica enterica serovar Typhi
gcgaauuacuaaucugu

SEQ ID NO: 3658780 - RNA, 20 nt, Salmonella enterica enterica serovar Typhi
gcgaauugccgucgccggaa

SEQ ID NO: 3658781 - RNA, 14 nt, Salmonella enterica enterica serovar Typhi
gcgaauuucaacgc

SEQ ID NO: 3658782 - RNA, 17 nt, Salmonella enterica enterica serovar Typhi
gcgaauuucaaucgcca

SEQ ID NO: 3658783 - RNA, 18 nt, Salmonella enterica enterica serovar Typhi
gcgaauuucaaucgccag

SEQ ID NO: 3658784 - RNA, 16 nt, Salmonella enterica enterica serovar Typhi
gcgaauuucaccaccg

SEQ ID NO: 3658785 - RNA, 16 nt, Salmonella enterica enterica serovar Typhi
gcgaauuucacgcagc

SEQ ID NO: 3658786 - RNA, 19 nt, Salmonella enterica enterica serovar Typhi
gcgaauuucacgcagcacg

SEQ ID NO: 3658787 - RNA, 21 nt, Salmonella enterica enterica serovar Typhi
gcgaauuucggcaaugacggu

SEQ ID NO: 3658788 - RNA, 20 nt, Salmonella enterica enterica serovar Typhi
gcgaauuuuauuaagcaggc

SEQ ID NO: 3658789 - RNA, 22 nt, Salmonella enterica enterica serovar Typhi
gcgaauuuuauuaagcaggccg

SEQ ID NO: 3658790 - RNA, 19 nt, Salmonella enterica enterica serovar Typhi
gcgacaacaaguccaagua

SEQ ID NO: 3658791 - RNA, 20 nt, Salmonella enterica enterica serovar Typhi
gcgacaaugaaccagcccau

SEQ ID NO: 3658792 - RNA, 19 nt, Salmonella enterica enterica serovar Typhi
gcgacaaugcucucuucgc

SEQ ID NO: 3658793 - RNA, 14 nt, Salmonella enterica enterica serovar Typhi
gcgacacaacggca

SEQ ID NO: 3658794 - RNA, 22 nt, Salmonella enterica enterica serovar Typhi
gcgacaccagcgucgcaugggu

SEQ ID NO: 3658795 - RNA, 23 nt, Salmonella enterica enterica serovar Typhi
gcgacacgcgcgcugcgccugga

SEQ ID NO: 3658796 - RNA, 14 nt, Salmonella enterica enterica serovar Typhi
gcgacacuccgcgc

SEQ ID NO: 3658797 - RNA, 16 nt, Salmonella enterica enterica serovar Typhi
gcgacacuccgcgcau

SEQ ID NO: 3658798 - RNA, 21 nt, Salmonella enterica enterica serovar Typhi
gcgacagagaaugcgccgccc

SEQ ID NO: 3658799 - RNA, 13 nt, Salmonella enterica enterica serovar Typhi
gcgacagcgcgcc

SEQ ID NO: 3658800 - RNA, 13 nt, Salmonella enterica enterica serovar Typhi
gcgacaggcgcuu

SEQ ID NO: 3658801 - RNA, 17 nt, Salmonella enterica enterica serovar Typhi
gcgacagucgcagagcc

SEQ ID NO: 3658802 - RNA, 16 nt, Salmonella enterica enterica serovar Typhi
gcgacaucagccagcc

SEQ ID NO: 3658803 - RNA, 21 nt, Salmonella enterica enterica serovar Typhi
gcgacauggcgguaaucgcgc

SEQ ID NO: 3658804 - RNA, 21 nt, Salmonella enterica enterica serovar Typhi
gcgaccaauauccgcaggcga

SEQ ID NO: 3658805 - RNA, 18 nt, Salmonella enterica enterica serovar Typhi
gcgaccaccgucccagua

SEQ ID NO: 3658806 - RNA, 17 nt, Salmonella enterica enterica serovar Typhi
gcgaccacuccggcaua

SEQ ID NO: 3658807 - RNA, 16 nt, Salmonella enterica enterica serovar Typhi
gcgaccagcagcauca

SEQ ID NO: 3658808 - RNA, 15 nt, Salmonella enterica enterica serovar Typhi
gcgaccagcgcgcca

SEQ ID NO: 3658809 - RNA, 18 nt, Salmonella enterica enterica serovar Typhi
gcgaccagcgucagccag

SEQ ID NO: 3658810 - RNA, 20 nt, Salmonella enterica enterica serovar Typhi
gcgcaccauaauauaaggau

SEQ ID NO: 3658811 - RNA, 17 nt, Salmonella enterica enterica serovar Typhi
gcgcacggcgcguccuc

SEQ ID NO: 3658812 - RNA, 15 nt, Salmonella enterica enterica serovar Typhi
gcgcacucagaaaau

SEQ ID NO: 3658813 - RNA, 16 nt, Salmonella enterica enterica serovar Typhi
gcgcacucagaaaauu

SEQ ID NO: 3658814 - RNA, 15 nt, Salmonella enterica enterica serovar Typhi
gcgcagaagcuacuu

SEQ ID NO: 3658815 - RNA, 14 nt, Salmonella enterica enterica serovar Typhi
gcgcagacacugcc

SEQ ID NO: 3658816 - RNA, 16 nt, Salmonella enterica enterica serovar Typhi
gcgcagagugagcagg

SEQ ID NO: 3658817 - RNA, 16 nt, Salmonella enterica enterica serovar Typhi
gcgcagcacuucagaa

SEQ ID NO: 3658818 - RNA, 18 nt, Salmonella enterica enterica serovar Typhi
gcgcagcaucucauccac

SEQ ID NO: 3658819 - RNA, 18 nt, Salmonella enterica enterica serovar Typhi
gcgcagcaugaucggcug

SEQ ID NO: 3658820 - RNA, 13 nt, Salmonella enterica enterica serovar Typhi
gcgcagccccagc

SEQ ID NO: 3658821 - RNA, 15 nt, Salmonella enterica enterica serovar Typhi
gcgcagccccagcgc

SEQ ID NO: 3658822 - RNA, 17 nt, Salmonella enterica enterica serovar Typhi
gcgcagccccagcgcca

SEQ ID NO: 3658823 - RNA, 16 nt, Salmonella enterica enterica serovar Typhi
gcgcagcgcaucaggc

SEQ ID NO: 3658824 - RNA, 13 nt, Salmonella enterica enterica serovar Typhi
gcgcagcgccacc

SEQ ID NO: 3658825 - RNA, 14 nt, Salmonella enterica enterica serovar Typhi
gcgcagcgccauca

SEQ ID NO: 3658826 - RNA, 18 nt, Salmonella enterica enterica serovar Typhi
gcgcagcgccaucaggca

SEQ ID NO: 3658827 - RNA, 19 nt, Salmonella enterica enterica serovar Typhi
gcgcagcgccaucaggccc

SEQ ID NO: 3658828 - RNA, 18 nt, Salmonella enterica enterica serovar Typhi
gcgcagcgccauccggca

SEQ ID NO: 3658829 - RNA, 12 nt, Salmonella enterica enterica serovar Typhi
gcgcagcgccca

SEQ ID NO: 3658830 - RNA, 17 nt, Salmonella enterica enterica serovar Typhi
gcgcagcgcccagcagc

SEQ ID NO: 3658831 - RNA, 15 nt, Salmonella enterica enterica serovar Typhi
gcgcagcgcgcgacc

SEQ ID NO: 3658832 - RNA, 13 nt, Salmonella enterica enterica serovar Typhi
gcgcaggccguca

SEQ ID NO: 3658833 - RNA, 20 nt, Salmonella enterica enterica serovar Typhi
gcgcaggccgucaaaccggc

SEQ ID NO: 3658834 - RNA, 14 nt, Salmonella enterica enterica serovar Typhi
gcgcaggcgagcgg

SEQ ID NO: 3658835 - RNA, 15 nt, Salmonella enterica enterica serovar Typhi
gcgcaggcgagcggc

SEQ ID NO: 3658836 - RNA, 23 nt, Salmonella enterica enterica serovar Typhi
gcgcaggcucucggugguggcag

SEQ ID NO: 3658837 - RNA, 17 nt, Salmonella enterica enterica serovar Typhi
gcgcagggucugguggu

SEQ ID NO: 3658838 - RNA, 15 nt, Salmonella enterica enterica serovar Typhi
gcgcaggucuucguc

SEQ ID NO: 3658839 - RNA, 13 nt, Salmonella enterica enterica serovar Typhi
gcgcagucacaga

SEQ ID NO: 3658840 - RNA, 17 nt, Salmonella enterica enterica serovar Typhi
gcgcagugaccagcauc

SEQ ID NO: 3658841 - RNA, 14 nt, Salmonella enterica enterica serovar Typhi
gcgcaguggcgggu

SEQ ID NO: 3658842 - RNA, 19 nt, Salmonella enterica enterica serovar Typhi
gcgcaguucgccgccagga

SEQ ID NO: 3658843 - RNA, 20 nt, Salmonella enterica enterica serovar Typhi
gcgcauaaaaaaggccgcuu

SEQ ID NO: 3658844 - RNA, 23 nt, Salmonella enterica enterica serovar Typhi
gcgcauaauccggaauaagaaua

SEQ ID NO: 3658845 - RNA, 16 nt, Salmonella enterica enterica serovar Typhi
gcgcauaccggccacg

SEQ ID NO: 3658846 - RNA, 19 nt, Salmonella enterica enterica serovar Typhi
gcgcauaccggccacgagc

SEQ ID NO: 3658847 - RNA, 23 nt, Salmonella enterica enterica serovar Typhi
gcgcauacucauuaccggcugcc

SEQ ID NO: 3658848 - RNA, 18 nt, Salmonella enterica enterica serovar Typhi
gcgcauacucuuccguca

SEQ ID NO: 3658849 - RNA, 15 nt, Salmonella enterica enterica serovar Typhi
gcgcauacuuauaca

SEQ ID NO: 3658850 - RNA, 19 nt, Salmonella enterica enterica serovar Typhi
gcgcauagauauaacccag

SEQ ID NO: 3658851 - RNA, 15 nt, Salmonella enterica enterica serovar Typhi
gcgcauauuccggcg

SEQ ID NO: 3658852 - RNA, 14 nt, Salmonella enterica enterica serovar Typhi
gcgcaucaacgcca

SEQ ID NO: 3658853 - RNA, 19 nt, Salmonella enterica enterica serovar Typhi
gcgcaucaacgccaggcag

SEQ ID NO: 3658854 - RNA, 12 nt, Salmonella enterica enterica serovar Typhi
gcgcaucaguac

SEQ ID NO: 3658855 - RNA, 15 nt, Salmonella enterica enterica serovar Typhi
gcgcaucauggucgu

SEQ ID NO: 3658856 - RNA, 19 nt, Salmonella enterica enterica serovar Typhi
gcgcaucccacaccacacg

SEQ ID NO: 3658857 - RNA, 17 nt, Salmonella enterica enterica serovar Typhi
gcgcauccgcggcgcuu

SEQ ID NO: 3658858 - RNA, 12 nt, Salmonella enterica enterica serovar Typhi
gcgcauccggca

SEQ ID NO: 3658859 - RNA, 13 nt, Salmonella enterica enterica serovar Typhi
gcgcauccggcau

SEQ ID NO: 3658860 - RNA, 22 nt, Salmonella enterica enterica serovar Typhi
gcgcauccgggccgcuagcugc

SEQ ID NO: 3658861 - RNA, 17 nt, Salmonella enterica enterica serovar Typhi
gcgcauccgucaggccc

SEQ ID NO: 3658862 - RNA, 18 nt, Salmonella enterica enterica serovar Typhi
gcgcaugagcaaacugcu

SEQ ID NO: 3658863 - RNA, 12 nt, Salmonella enterica enterica serovar Typhi
gcgcauggaaga

SEQ ID NO: 3658864 - RNA, 15 nt, Salmonella enterica enterica serovar Typhi
gcgcauguaaccaaa

SEQ ID NO: 3658865 - RNA, 21 nt, Salmonella enterica enterica serovar Typhi
gcgcauguaaccaaagcacca

SEQ ID NO: 3658866 - RNA, 21 nt, Salmonella enterica enterica serovar Typhi
gcgcaugugagcaucggcgau

SEQ ID NO: 3658867 - RNA, 17 nt, Salmonella enterica enterica serovar Typhi
gcgcauuaacgccaugc

SEQ ID NO: 3658868 - RNA, 21 nt, Salmonella enterica enterica serovar Typhi
gcgcauuaacgccaugcucau

SEQ ID NO: 3658869 - RNA, 14 nt, Salmonella enterica enterica serovar Typhi
gcgcauucaggcga

SEQ ID NO: 3658870 - RNA, 15 nt, Salmonella enterica enterica serovar Typhi
gcgcauuccagaccc

SEQ ID NO: 3658871 - RNA, 16 nt, Salmonella enterica enterica serovar Typhi
gcgcauuccagacccg

SEQ ID NO: 3658872 - RNA, 21 nt, Salmonella enterica enterica serovar Typhi
gcgcauucucugucgccgccc

SEQ ID NO: 3658873 - RNA, 19 nt, Salmonella enterica enterica serovar Typhi
gcgcauugccugaaccggu

SEQ ID NO: 3658874 - RNA, 18 nt, Salmonella enterica enterica serovar Typhi
gcgcauugcgccccagca

SEQ ID NO: 3658875 - RNA, 20 nt, Salmonella enterica enterica serovar Typhi
gcgcauuuuauuuaaaaagg

SEQ ID NO: 3658876 - RNA, 19 nt, Salmonella enterica enterica serovar Typhi
gcgccaaaagaggcagcaa

SEQ ID NO: 3658877 - RNA, 21 nt, Salmonella enterica enterica serovar Typhi
gcgccaaacgggcaagccagc

SEQ ID NO: 3658878 - RNA, 19 nt, Salmonella enterica enterica serovar Typhi
gcgccaaccgugagcgcgc

SEQ ID NO: 3658879 - RNA, 19 nt, Salmonella enterica enterica serovar Typhi
gcgccaacggccucccagc

SEQ ID NO: 3658880 - RNA, 13 nt, Salmonella enterica enterica serovar Typhi
gcgccaagaccgc

SEQ ID NO: 3658881 - RNA, 21 nt, Salmonella enterica enterica serovar Typhi
gcgccaaucaccgccagcaac

SEQ ID NO: 3658882 - RNA, 19 nt, Salmonella enterica enterica serovar Typhi
gcgccaauccaugccggcu

SEQ ID NO: 3658883 - RNA, 22 nt, Salmonella enterica enterica serovar Typhi
gcgccaaugcgaaaauacuccc

SEQ ID NO: 3658884 - RNA, 15 nt, Salmonella enterica enterica serovar Typhi
gcgccaccaucgucg

SEQ ID NO: 3658885 - RNA, 21 nt, Salmonella enterica enterica serovar Typhi
gcgccaccgggcaacacacgc

SEQ ID NO: 3658886 - RNA, 13 nt, Salmonella enterica enterica serovar Typhi
gcgccacgccacc

SEQ ID NO: 3658887 - RNA, 15 nt, Salmonella enterica enterica serovar Typhi
gcgccacgcccacgc

SEQ ID NO: 3658888 - RNA, 21 nt, Salmonella enterica enterica serovar Typhi
gcgccacgcgaugcaaccccu

SEQ ID NO: 3658889 - RNA, 16 nt, Salmonella enterica enterica serovar Typhi
gcgccacgcgccaggu

SEQ ID NO: 3658890 - RNA, 16 nt, Salmonella enterica enterica serovar Typhi
gcgccacuucacuggc

SEQ ID NO: 3658891 - RNA, 15 nt, Salmonella enterica enterica serovar Typhi
gcgccacuuccagcg

SEQ ID NO: 3658892 - RNA, 22 nt, Salmonella enterica enterica serovar Typhi
gcgccagaaagguauuaaguga

SEQ ID NO: 3658893 - RNA, 14 nt, Salmonella enterica enterica serovar Typhi
gcgccagacgccau

SEQ ID NO: 3658894 - RNA, 14 nt, Salmonella enterica enterica serovar Typhi
gcgccagacgcgca

SEQ ID NO: 3658895 - RNA, 18 nt, Salmonella enterica enterica serovar Typhi
gcgccagagaucgcacua

SEQ ID NO: 3658896 - RNA, 21 nt, Salmonella enterica enterica serovar Typhi
gcgccgccaacgauacagcac

SEQ ID NO: 3658897 - RNA, 13 nt, Salmonella enterica enterica serovar Typhi
gcgccgccagcga

SEQ ID NO: 3658898 - RNA, 22 nt, Salmonella enterica enterica serovar Typhi
gcgccgccagcgacauggcggu

SEQ ID NO: 3658899 - RNA, 15 nt, Salmonella enterica enterica serovar Typhi
gcgccgccagcgacu

SEQ ID NO: 3658900 - RNA, 19 nt, Salmonella enterica enterica serovar Typhi
gcgccgccauccggcacaa

SEQ ID NO: 3658901 - RNA, 12 nt, Salmonella enterica enterica serovar Typhi
gcgccgccgccu

SEQ ID NO: 3658902 - RNA, 21 nt, Salmonella enterica enterica serovar Typhi
gcgccgccucgcgauccgcca

SEQ ID NO: 3658903 - RNA, 15 nt, Salmonella enterica enterica serovar Typhi
gcgccgcgauaaaga

SEQ ID NO: 3658904 - RNA, 15 nt, Salmonella enterica enterica serovar Typhi
gcgccgcgauacgga

SEQ ID NO: 3658905 - RNA, 21 nt, Salmonella enterica enterica serovar Typhi
gcgccgcuacguaccgcuucc

SEQ ID NO: 3658906 - RNA, 12 nt, Salmonella enterica enterica serovar Typhi
gcgccgcucaca

SEQ ID NO: 3658907 - RNA, 21 nt, Salmonella enterica enterica serovar Typhi
gcgccgcucaucaccagcagc

SEQ ID NO: 3658908 - RNA, 14 nt, Salmonella enterica enterica serovar Typhi
gcgccgcuccaggg

SEQ ID NO: 3658909 - RNA, 15 nt, Salmonella enterica enterica serovar Typhi
gcgccgcuuccggca

SEQ ID NO: 3658910 - RNA, 14 nt, Salmonella enterica enterica serovar Typhi
gcgccggacagcag

SEQ ID NO: 3658911 - RNA, 12 nt, Salmonella enterica enterica serovar Typhi
gcgccggcagca

SEQ ID NO: 3658912 - RNA, 15 nt, Salmonella enterica enterica serovar Typhi
gcgccggcagcaguu

SEQ ID NO: 3658913 - RNA, 20 nt, Salmonella enterica enterica serovar Typhi
gcgccggccgguuucaccau

SEQ ID NO: 3658914 - RNA, 23 nt, Salmonella enterica enterica serovar Typhi
gcgccggcugcgcugccagcugc

SEQ ID NO: 3658915 - RNA, 14 nt, Salmonella enterica enterica serovar Typhi
gcgccggggugcug

SEQ ID NO: 3658916 - RNA, 19 nt, Salmonella enterica enterica serovar Typhi
gcgccggguuuggcgggcu

SEQ ID NO: 3658917 - RNA, 16 nt, Salmonella enterica enterica serovar Typhi
gcgccggucgccagca

SEQ ID NO: 3658918 - RNA, 22 nt, Salmonella enterica enterica serovar Typhi
gcgccguaacgcgaugccuggc

SEQ ID NO: 3658919 - RNA, 17 nt, Salmonella enterica enterica serovar Typhi
gcgccguaaggcgccuu

SEQ ID NO: 3658920 - RNA, 15 nt, Salmonella enterica enterica serovar Typhi
gcgccgucagcgguu

SEQ ID NO: 3658921 - RNA, 21 nt, Salmonella enterica enterica serovar Typhi
gcgccgucaggcuugccgcgc

SEQ ID NO: 3658922 - RNA, 20 nt, Salmonella enterica enterica serovar Typhi
gcgccguccauaaugacgcu

SEQ ID NO: 3658923 - RNA, 15 nt, Salmonella enterica enterica serovar Typhi
gcgccgugcccagca

SEQ ID NO: 3658924 - RNA, 23 nt, Salmonella enterica enterica serovar Typhi
gcgccgugucaucauuacaggcg

SEQ ID NO: 3658925 - RNA, 21 nt, Salmonella enterica enterica serovar Typhi
gcgccguucgggguugauggu

SEQ ID NO: 3658926 - RNA, 23 nt, Salmonella enterica enterica serovar Typhi
gcgccuaccagcgcuauccaggc

SEQ ID NO: 3658927 - RNA, 17 nt, Salmonella enterica enterica serovar Typhi
gcgccuaccgccauaga

SEQ ID NO: 3658928 - RNA, 19 nt, Salmonella enterica enterica serovar Typhi
gcgccuccacaaagcgcga

SEQ ID NO: 3658929 - RNA, 17 nt, Salmonella enterica enterica serovar Typhi
gcgccuccccugccggc

SEQ ID NO: 3658930 - RNA, 14 nt, Salmonella enterica enterica serovar Typhi
gcgccucgcgcggc

SEQ ID NO: 3658931 - RNA, 18 nt, Salmonella enterica enterica serovar Typhi
gcgccugaagauacgcca

SEQ ID NO: 3658932 - RNA, 19 nt, Salmonella enterica enterica serovar Typhi
gcgccugaauguacgcaua

SEQ ID NO: 3658933 - RNA, 14 nt, Salmonella enterica enterica serovar Typhi
gcgccugccauagc

SEQ ID NO: 3658934 - RNA, 14 nt, Salmonella enterica enterica serovar Typhi
gcgccugcgcugca

SEQ ID NO: 3658935 - RNA, 16 nt, Salmonella enterica enterica serovar Typhi
gcgccugcucagcauu

SEQ ID NO: 3658936 - RNA, 14 nt, Salmonella enterica enterica serovar Typhi
gcgccugcucccgc

SEQ ID NO: 3658937 - RNA, 18 nt, Salmonella enterica enterica serovar Typhi
gcgccugcugccagccgc

SEQ ID NO: 3658938 - RNA, 12 nt, Salmonella enterica enterica serovar Typhi
gcgccugcugcg

SEQ ID NO: 3658939 - RNA, 14 nt, Salmonella enterica enterica serovar Typhi
gcgccuggcgguau

SEQ ID NO: 3658940 - RNA, 21 nt, Salmonella enterica enterica serovar Typhi
gcgccuguaaacguuccugcc

SEQ ID NO: 3658941 - RNA, 23 nt, Salmonella enterica enterica serovar Typhi
gcgccuguaaggcucucuuacca

SEQ ID NO: 3658942 - RNA, 22 nt, Salmonella enterica enterica serovar Typhi
gcgccugucuccagcgccgcuu

SEQ ID NO: 3658943 - RNA, 21 nt, Salmonella enterica enterica serovar Typhi
gcgccugugaaacggcggacg

SEQ ID NO: 3658944 - RNA, 16 nt, Salmonella enterica enterica serovar Typhi
gcgccuguuagggcgc

SEQ ID NO: 3658945 - RNA, 17 nt, Salmonella enterica enterica serovar Typhi
gcgccuguuagggcgcg

SEQ ID NO: 3658946 - RNA, 18 nt, Salmonella enterica enterica serovar Typhi
gcgccuguuagggcgcgg

SEQ ID NO: 3658947 - RNA, 19 nt, Salmonella enterica enterica serovar Typhi
gcgccuguuagggcgcggc

SEQ ID NO: 3658948 - RNA, 21 nt, Salmonella enterica enterica serovar Typhi
gcgccuguuagggcgcggcug

SEQ ID NO: 3658949 - RNA, 23 nt, Salmonella enterica enterica serovar Typhi
gcgccuguuagggcgcggcuggu

SEQ ID NO: 3658950 - RNA, 13 nt, Salmonella enterica enterica serovar Typhi
gcgccuuccagca

SEQ ID NO: 3658951 - RNA, 14 nt, Salmonella enterica enterica serovar Typhi
gcgccuuccggcca

SEQ ID NO: 3658952 - RNA, 19 nt, Salmonella enterica enterica serovar Typhi
gcgccuuuaauuccgccgg

SEQ ID NO: 3658953 - RNA, 17 nt, Salmonella enterica enterica serovar Typhi
gcgcgaaaaauaggaug

SEQ ID NO: 3658954 - RNA, 14 nt, Salmonella enterica enterica serovar Typhi
gcgcgaaaacagcu

SEQ ID NO: 3658955 - RNA, 23 nt, Salmonella enterica enterica serovar Typhi
gcgcgaaaucaaagaccuccgcc

SEQ ID NO: 3658956 - RNA, 17 nt, Salmonella enterica enterica serovar Typhi
gcgcgaagucgagcuca

SEQ ID NO: 3658957 - RNA, 21 nt, Salmonella enterica enterica serovar Typhi
gcgcgaauaaugcguccgcca

SEQ ID NO: 3658958 - RNA, 19 nt, Salmonella enterica enterica serovar Typhi
gcgcgaaucgacaauccgc

SEQ ID NO: 3658959 - RNA, 22 nt, Salmonella enterica enterica serovar Typhi
gcgcgaaucgccucuucgaccg

SEQ ID NO: 3658960 - RNA, 18 nt, Salmonella enterica enterica serovar Typhi
gcgcgaauuugccccaga

SEQ ID NO: 3658961 - RNA, 15 nt, Salmonella enterica enterica serovar Typhi
gcgcgacaauauuca

SEQ ID NO: 3658962 - RNA, 13 nt, Salmonella enterica enterica serovar Typhi
gcgcgacauccgc

SEQ ID NO: 3658963 - RNA, 16 nt, Salmonella enterica enterica serovar Typhi
gcgcgaccaggaaacc

SEQ ID NO: 3658964 - RNA, 15 nt, Salmonella enterica enterica serovar Typhi
gcgcgacgacgccag

SEQ ID NO: 3658965 - RNA, 14 nt, Salmonella enterica enterica serovar Typhi
gcgcgacggcggcg

SEQ ID NO: 3658966 - RNA, 22 nt, Salmonella enterica enterica serovar Typhi
gcgcgagaacugcugcauccgc

SEQ ID NO: 3658967 - RNA, 23 nt, Salmonella enterica enterica serovar Typhi
gcgcgagccacgcggcaucaggc

SEQ ID NO: 3658968 - RNA, 18 nt, Salmonella enterica enterica serovar Typhi
gcgcgaggcauaccgccc

SEQ ID NO: 3658969 - RNA, 15 nt, Salmonella enterica enterica serovar Typhi
gcgcgauacgcagca

SEQ ID NO: 3658970 - RNA, 18 nt, Salmonella enterica enterica serovar Typhi
gcgcgauacgcagcaccg

SEQ ID NO: 3658971 - RNA, 16 nt, Salmonella enterica enterica serovar Typhi
gcgcgaucaaucacgc

SEQ ID NO: 3658972 - RNA, 20 nt, Salmonella enterica enterica serovar Typhi
gcgcgaucgccccgaccagg

SEQ ID NO: 3658973 - RNA, 16 nt, Salmonella enterica enterica serovar Typhi
gcgcgaucuguuggug

SEQ ID NO: 3658974 - RNA, 20 nt, Salmonella enterica enterica serovar Typhi
gcgcgaugccugccgggccu

SEQ ID NO: 3658975 - RNA, 17 nt, Salmonella enterica enterica serovar Typhi
gcgcgauuuucucgcua

SEQ ID NO: 3658976 - RNA, 17 nt, Salmonella enterica enterica serovar Typhi
gcgcgcacacaauagca

SEQ ID NO: 3658977 - RNA, 15 nt, Salmonella enterica enterica serovar Typhi
gcgcgcacguucagg

SEQ ID NO: 3658978 - RNA, 22 nt, Salmonella enterica enterica serovar Typhi
gcgcgcaucgggccguccggca

SEQ ID NO: 3658979 - RNA, 19 nt, Salmonella enterica enterica serovar Typhi
gcgcgccaauggccgcccc

SEQ ID NO: 3658980 - RNA, 20 nt, Salmonella enterica enterica serovar Typhi
gcgcgccagcgauuccguca

SEQ ID NO: 3658981 - RNA, 22 nt, Salmonella enterica enterica serovar Typhi
gcgcuccagaccaccagcgaca

SEQ ID NO: 3658982 - RNA, 22 nt, Salmonella enterica enterica serovar Typhi
gcgcuccaucauaucgcgcagc

SEQ ID NO: 3658983 - RNA, 22 nt, Salmonella enterica enterica serovar Typhi
gcgcuccgacugaaccuucacg

SEQ ID NO: 3658984 - RNA, 16 nt, Salmonella enterica enterica serovar Typhi
gcgcuccggcgcuggc

SEQ ID NO: 3658985 - RNA, 12 nt, Salmonella enterica enterica serovar Typhi
gcgcucgccuga

SEQ ID NO: 3658986 - RNA, 15 nt, Salmonella enterica enterica serovar Typhi
gcgcucgcucaucac

SEQ ID NO: 3658987 - RNA, 24 nt, Salmonella enterica enterica serovar Typhi
gcgcucgcucaucacaucgcgcag

SEQ ID NO: 3658988 - RNA, 19 nt, Salmonella enterica enterica serovar Typhi
gcgcucuaucaccgcccgc

SEQ ID NO: 3658989 - RNA, 16 nt, Salmonella enterica enterica serovar Typhi
gcgcucuuccgccagc

SEQ ID NO: 3658990 - RNA, 21 nt, Salmonella enterica enterica serovar Typhi
gcgcucuuuuucuuuucuccg

SEQ ID NO: 3658991 - RNA, 18 nt, Salmonella enterica enterica serovar Typhi
gcgcugaauagcgaccuu

SEQ ID NO: 3658992 - RNA, 12 nt, Salmonella enterica enterica serovar Typhi
gcgcugaccuca

SEQ ID NO: 3658993 - RNA, 19 nt, Salmonella enterica enterica serovar Typhi
gcgcugauauuuuuacuga

SEQ ID NO: 3658994 - RNA, 14 nt, Salmonella enterica enterica serovar Typhi
gcgcugaucgccac

SEQ ID NO: 3658995 - RNA, 16 nt, Salmonella enterica enterica serovar Typhi
gcgcugaugugcggcc

SEQ ID NO: 3658996 - RNA, 21 nt, Salmonella enterica enterica serovar Typhi
gcgcugauuuucuccagcaga

SEQ ID NO: 3658997 - RNA, 21 nt, Salmonella enterica enterica serovar Typhi
gcgcugcgccagaucaggcgu

SEQ ID NO: 3658998 - RNA, 11 nt, Salmonella enterica enterica serovar Typhi
gcgcugcgccg

SEQ ID NO: 3658999 - RNA, 13 nt, Salmonella enterica enterica serovar Typhi
gcgcugcgcggcg

SEQ ID NO: 3659000 - RNA, 15 nt, Salmonella enterica enterica serovar Typhi
gcgcugcgcggcgug

SEQ ID NO: 3659001 - RNA, 18 nt, Salmonella enterica enterica serovar Typhi
gcgcugcgcuuacccagu

SEQ ID NO: 3659002 - RNA, 22 nt, Salmonella enterica enterica serovar Typhi
gcgcugcgcuuaccgggccuac

SEQ ID NO: 3659003 - RNA, 20 nt, Salmonella enterica enterica serovar Typhi
gcgcugcgcuuaucaggccu

SEQ ID NO: 3659004 - RNA, 17 nt, Salmonella enterica enterica serovar Typhi
gcgcugcggucagggcu

SEQ ID NO: 3659005 - RNA, 13 nt, Salmonella enterica enterica serovar Typhi
gcgcuggaggcgg

SEQ ID NO: 3659006 - RNA, 19 nt, Salmonella enterica enterica serovar Typhi
gcgcuggcaagcgccagca

SEQ ID NO: 3659007 - RNA, 14 nt, Salmonella enterica enterica serovar Typhi
gcgcuggcgagcga

SEQ ID NO: 3659008 - RNA, 20 nt, Salmonella enterica enterica serovar Typhi
gcgcuggcgccgcaaaccag

SEQ ID NO: 3659009 - RNA, 14 nt, Salmonella enterica enterica serovar Typhi
gcgcuggcgcgucu

SEQ ID NO: 3659010 - RNA, 15 nt, Salmonella enterica enterica serovar Typhi
gcgcuggcgcgucug

SEQ ID NO: 3659011 - RNA, 13 nt, Salmonella enterica enterica serovar Typhi
gcgcuggcggcga

SEQ ID NO: 3659012 - RNA, 12 nt, Salmonella enterica enterica serovar Typhi
gcgcuggcguga

SEQ ID NO: 3659013 - RNA, 14 nt, Salmonella enterica enterica serovar Typhi
gcgcuggcgugguu

SEQ ID NO: 3659014 - RNA, 14 nt, Salmonella enterica enterica serovar Typhi
gcgcugggccgggc

SEQ ID NO: 3659015 - RNA, 20 nt, Salmonella enterica enterica serovar Typhi
gcgcuggggguaggauaaaa

SEQ ID NO: 3659016 - RNA, 22 nt, Salmonella enterica enterica serovar Typhi
gcgcuggguacguucggacugg

SEQ ID NO: 3659017 - RNA, 18 nt, Salmonella enterica enterica serovar Typhi
gcgcugguggccgggggc

SEQ ID NO: 3659018 - RNA, 15 nt, Salmonella enterica enterica serovar Typhi
gcgcugguggcgguc

SEQ ID NO: 3659019 - RNA, 14 nt, Salmonella enterica enterica serovar Typhi
gcgcuguaacuuca

SEQ ID NO: 3659020 - RNA, 17 nt, Salmonella enterica enterica serovar Typhi
gcgcuguaacuucacgc

SEQ ID NO: 3659021 - RNA, 16 nt, Salmonella enterica enterica serovar Typhi
gcgcuguacgccucuu

SEQ ID NO: 3659022 - RNA, 23 nt, Salmonella enterica enterica serovar Typhi
gcgcuguauaaucccgcggcgga

SEQ ID NO: 3659023 - RNA, 15 nt, Salmonella enterica enterica serovar Typhi
gcgcugucugccggc

SEQ ID NO: 3659024 - RNA, 14 nt, Salmonella enterica enterica serovar Typhi
gcgcugugacggca

SEQ ID NO: 3659025 - RNA, 18 nt, Salmonella enterica enterica serovar Typhi
gcgcugugcuaucaggcc

SEQ ID NO: 3659026 - RNA, 17 nt, Salmonella enterica enterica serovar Typhi
gcgcuguggucgucugg

SEQ ID NO: 3659027 - RNA, 15 nt, Salmonella enterica enterica serovar Typhi
gcgcuguguccgccu

SEQ ID NO: 3659028 - RNA, 18 nt, Salmonella enterica enterica serovar Typhi
gcgcuguucuugcugcug

SEQ ID NO: 3659029 - RNA, 19 nt, Salmonella enterica enterica serovar Typhi
gcgcuguuggcauccugcg

SEQ ID NO: 3659030 - RNA, 13 nt, Salmonella enterica enterica serovar Typhi
gcgcuguuguucc

SEQ ID NO: 3659031 - RNA, 14 nt, Salmonella enterica enterica serovar Typhi
gcgcuuaacgcgcu

SEQ ID NO: 3659032 - RNA, 19 nt, Salmonella enterica enterica serovar Typhi
gcgcuuacacacccggccu

SEQ ID NO: 3659033 - RNA, 19 nt, Salmonella enterica enterica serovar Typhi
gcgcuuaccgggccuacaa

SEQ ID NO: 3659034 - RNA, 20 nt, Salmonella enterica enterica serovar Typhi
gcgcuuaccgggccuacacg

SEQ ID NO: 3659035 - RNA, 19 nt, Salmonella enterica enterica serovar Typhi
gcgcuuaccgggccuacag

SEQ ID NO: 3659036 - RNA, 20 nt, Salmonella enterica enterica serovar Typhi
gcgcuuaccgggccuacagg

SEQ ID NO: 3659037 - RNA, 22 nt, Salmonella enterica enterica serovar Typhi
gcgcuuagccugaucgaucagc

SEQ ID NO: 3659038 - RNA, 15 nt, Salmonella enterica enterica serovar Typhi
gcgcuuauccggccu

SEQ ID NO: 3659039 - RNA, 13 nt, Salmonella enterica enterica serovar Typhi
gcgcuuaucgccg

SEQ ID NO: 3659040 - RNA, 14 nt, Salmonella enterica enterica serovar Typhi
gcgcuuaucgccgu

SEQ ID NO: 3659041 - RNA, 14 nt, Salmonella enterica enterica serovar Typhi
gcgcuuccagcaug

SEQ ID NO: 3659042 - RNA, 12 nt, Salmonella enterica enterica serovar Typhi
gcgcuuccugca

SEQ ID NO: 3659043 - RNA, 13 nt, Salmonella enterica enterica serovar Typhi
gcgcuucgccugc

SEQ ID NO: 3659044 - RNA, 15 nt, Salmonella enterica enterica serovar Typhi
gcgcuucgccugccg

SEQ ID NO: 3659045 - RNA, 20 nt, Salmonella enterica enterica serovar Typhi
gcgcuucgcuugcccggccu

SEQ ID NO: 3659046 - RNA, 21 nt, Salmonella enterica enterica serovar Typhi
gcgcuucguugagcuuaucgg

SEQ ID NO: 3659047 - RNA, 17 nt, Salmonella enterica enterica serovar Typhi
gcgcuucguuuuccgca

SEQ ID NO: 3659048 - RNA, 22 nt, Salmonella enterica enterica serovar Typhi
gcgcuugccuuuacuguugccu

SEQ ID NO: 3659049 - RNA, 23 nt, Salmonella enterica enterica serovar Typhi
gcgcuugcgccgccauccggccu

SEQ ID NO: 3659050 - RNA, 13 nt, Salmonella enterica enterica serovar Typhi
gcgcuugcggccg

SEQ ID NO: 3659051 - RNA, 16 nt, Salmonella enterica enterica serovar Typhi
gcgcuuuacaugacgc

SEQ ID NO: 3659052 - RNA, 16 nt, Salmonella enterica enterica serovar Typhi
gcgcuuuagggcuucc

SEQ ID NO: 3659053 - RNA, 17 nt, Salmonella enterica enterica serovar Typhi
gcgcuuucaaucgucag

SEQ ID NO: 3659054 - RNA, 20 nt, Salmonella enterica enterica serovar Typhi
gcgcuuuggguuaaugccag

SEQ ID NO: 3659055 - RNA, 12 nt, Salmonella enterica enterica serovar Typhi
gcgcuuuguuuc

SEQ ID NO: 3659056 - RNA, 20 nt, Salmonella enterica enterica serovar Typhi
gcgcuuuuagccaguuggca

SEQ ID NO: 3659057 - RNA, 16 nt, Salmonella enterica enterica serovar Typhi
gcgcuuuuccagcacg

SEQ ID NO: 3659058 - RNA, 14 nt, Salmonella enterica enterica serovar Typhi
gcgcuuuugccgcg

SEQ ID NO: 3659059 - RNA, 17 nt, Salmonella enterica enterica serovar Typhi
gcgcuuuugccgcgccc

SEQ ID NO: 3659060 - RNA, 24 nt, Salmonella enterica enterica serovar Typhi
gcgcuuuuggcggccagcguguca

SEQ ID NO: 3659061 - RNA, 12 nt, Salmonella enterica enterica serovar Typhi
gcgcuuuuucac

SEQ ID NO: 3659062 - RNA, 14 nt, Salmonella enterica enterica serovar Typhi
gcgcuuuuucacga

SEQ ID NO: 3659063 - RNA, 18 nt, Salmonella enterica enterica serovar Typhi
gcggaaaaaagcagcauc

SEQ ID NO: 3659064 - RNA, 23 nt, Salmonella enterica enterica serovar Typhi
gcggaaaaaagcagcaucccggc

SEQ ID NO: 3659065 - RNA, 19 nt, Salmonella enterica enterica serovar Typhi
gcggaaaauauucagcaca

SEQ ID NO: 3659066 - RNA, 17 nt, Salmonella enterica enterica serovar Typhi
gcggaaaaucugcgcca

SEQ ID NO: 3659067 - RNA, 19 nt, Salmonella enterica enterica serovar Typhi
gcggcauggguaaagccca

SEQ ID NO: 3659068 - RNA, 17 nt, Salmonella enterica enterica serovar Typhi
gcggcauuaaagccgcc

SEQ ID NO: 3659069 - RNA, 15 nt, Salmonella enterica enterica serovar Typhi
gcggcauuacgcgcc

SEQ ID NO: 3659070 - RNA, 21 nt, Salmonella enterica enterica serovar Typhi
gcggcauuggcguuaccggca

SEQ ID NO: 3659071 - RNA, 12 nt, Salmonella enterica enterica serovar Typhi
gcggccagcaug

SEQ ID NO: 3659072 - RNA, 13 nt, Salmonella enterica enterica serovar Typhi
gcggccagcgggc

SEQ ID NO: 3659073 - RNA, 16 nt, Salmonella enterica enterica serovar Typhi
gcggccagcgggcguc

SEQ ID NO: 3659074 - RNA, 20 nt, Salmonella enterica enterica serovar Typhi
gcggccaguuguucuuucac

SEQ ID NO: 3659075 - RNA, 13 nt, Salmonella enterica enterica serovar Typhi
gcggccauccugc

SEQ ID NO: 3659076 - RNA, 21 nt, Salmonella enterica enterica serovar Typhi
gcggccaugaucgccgccauc

SEQ ID NO: 3659077 - RNA, 11 nt, Salmonella enterica enterica serovar Typhi
gcggcccaaug

SEQ ID NO: 3659078 - RNA, 15 nt, Salmonella enterica enterica serovar Typhi
gcggcccgcgcugaa

SEQ ID NO: 3659079 - RNA, 23 nt, Salmonella enterica enterica serovar Typhi
gcggcccgggagaacgccgggcc

SEQ ID NO: 3659080 - RNA, 23 nt, Salmonella enterica enterica serovar Typhi
gcggcccgugguuuuacugcaag

SEQ ID NO: 3659081 - RNA, 16 nt, Salmonella enterica enterica serovar Typhi
gcggccgcuccgggcc

SEQ ID NO: 3659082 - RNA, 21 nt, Salmonella enterica enterica serovar Typhi
gcggccuaaaucgcugcugau

SEQ ID NO: 3659083 - RNA, 14 nt, Salmonella enterica enterica serovar Typhi
gcggccugcaaaga

SEQ ID NO: 3659084 - RNA, 13 nt, Salmonella enterica enterica serovar Typhi
gcggccugcgcca

SEQ ID NO: 3659085 - RNA, 14 nt, Salmonella enterica enterica serovar Typhi
gcggccugcgugcg

SEQ ID NO: 3659086 - RNA, 19 nt, Salmonella enterica enterica serovar Typhi
gcggccuugccgccagcgc

SEQ ID NO: 3659087 - RNA, 21 nt, Salmonella enterica enterica serovar Typhi
gcggccuuuauccagcggcgc

SEQ ID NO: 3659088 - RNA, 22 nt, Salmonella enterica enterica serovar Typhi
gcggcgaaaugccuuauccggc

SEQ ID NO: 3659089 - RNA, 14 nt, Salmonella enterica enterica serovar Typhi
gcggcgaaccggca

SEQ ID NO: 3659090 - RNA, 14 nt, Salmonella enterica enterica serovar Typhi
gcggcgacaccagc

SEQ ID NO: 3659091 - RNA, 20 nt, Salmonella enterica enterica serovar Typhi
gcggcgaugguugccagcgc

SEQ ID NO: 3659092 - RNA, 20 nt, Salmonella enterica enterica serovar Typhi
gcggcgauuuauagagcagc

SEQ ID NO: 3659093 - RNA, 21 nt, Salmonella enterica enterica serovar Typhi
gcggcgauuuauagagcagca

SEQ ID NO: 3659094 - RNA, 17 nt, Salmonella enterica enterica serovar Typhi
gcggcgcaaaucgccau

SEQ ID NO: 3659095 - RNA, 16 nt, Salmonella enterica enterica serovar Typhi
gcggcgcagcgcgcga

SEQ ID NO: 3659096 - RNA, 18 nt, Salmonella enterica enterica serovar Typhi
gcggcgcaucgcuuaccg

SEQ ID NO: 3659097 - RNA, 17 nt, Salmonella enterica enterica serovar Typhi
gcggcgccaacgcgcua

SEQ ID NO: 3659098 - RNA, 14 nt, Salmonella enterica enterica serovar Typhi
gcggcgccaguacu

SEQ ID NO: 3659099 - RNA, 16 nt, Salmonella enterica enterica serovar Typhi
gcggcgccaucaccau

SEQ ID NO: 3659100 - RNA, 15 nt, Salmonella enterica enterica serovar Typhi
gcggcgccaucgccu

SEQ ID NO: 3659101 - RNA, 19 nt, Salmonella enterica enterica serovar Typhi
gcggcgcgauaugucucuc

SEQ ID NO: 3659102 - RNA, 14 nt, Salmonella enterica enterica serovar Typhi
gcggcgcgcccggc

SEQ ID NO: 3659103 - RNA, 22 nt, Salmonella enterica enterica serovar Typhi
gcggcgcgucuucccggcgcuc

SEQ ID NO: 3659104 - RNA, 17 nt, Salmonella enterica enterica serovar Typhi
gcggcgcuauccggcau

SEQ ID NO: 3659105 - RNA, 20 nt, Salmonella enterica enterica serovar Typhi
gcggcggacaacgcuccagc

SEQ ID NO: 3659106 - RNA, 22 nt, Salmonella enterica enterica serovar Typhi
gcggcggacaugguaauaacgc

SEQ ID NO: 3659107 - RNA, 18 nt, Salmonella enterica enterica serovar Typhi
gcggcggcaagcuggcga

SEQ ID NO: 3659108 - RNA, 17 nt, Salmonella enterica enterica serovar Typhi
gcggcggcccgaagggc

SEQ ID NO: 3659109 - RNA, 16 nt, Salmonella enterica enterica serovar Typhi
gcggcggguaaauaga

SEQ ID NO: 3659110 - RNA, 21 nt, Salmonella enterica enterica serovar Typhi
gcggcgguaacgccuucgcaa

SEQ ID NO: 3659111 - RNA, 18 nt, Salmonella enterica enterica serovar Typhi
gcggcggucugcgccugc

SEQ ID NO: 3659112 - RNA, 14 nt, Salmonella enterica enterica serovar Typhi
gcggcgguuauccg

SEQ ID NO: 3659113 - RNA, 16 nt, Salmonella enterica enterica serovar Typhi
gcggcgguuauccgcc

SEQ ID NO: 3659114 - RNA, 15 nt, Salmonella enterica enterica serovar Typhi
gcggcgguucauccu

SEQ ID NO: 3659115 - RNA, 21 nt, Salmonella enterica enterica serovar Typhi
gcggcguaaaagcgauaaaga

SEQ ID NO: 3659116 - RNA, 22 nt, Salmonella enterica enterica serovar Typhi
gcggcguaaacacguuaucuga

SEQ ID NO: 3659117 - RNA, 14 nt, Salmonella enterica enterica serovar Typhi
gcggcguaacggcu

SEQ ID NO: 3659118 - RNA, 17 nt, Salmonella enterica enterica serovar Typhi
gcggcguaccgcgcgcc

SEQ ID NO: 3659119 - RNA, 18 nt, Salmonella enterica enterica serovar Typhi
gcggcguaccgcgcgccc

SEQ ID NO: 3659120 - RNA, 16 nt, Salmonella enterica enterica serovar Typhi
gcggcguagccgccga

SEQ ID NO: 3659121 - RNA, 20 nt, Salmonella enterica enterica serovar Typhi
gcggcguaucauagcggcua

SEQ ID NO: 3659122 - RNA, 15 nt, Salmonella enterica enterica serovar Typhi
gcggcguccgccagc

SEQ ID NO: 3659123 - RNA, 20 nt, Salmonella enterica enterica serovar Typhi
gcggcguggaaccgccggag

SEQ ID NO: 3659124 - RNA, 16 nt, Salmonella enterica enterica serovar Typhi
gcggcguggggcgggc

SEQ ID NO: 3659125 - RNA, 16 nt, Salmonella enterica enterica serovar Typhi
gcggcguguggcugug

SEQ ID NO: 3659126 - RNA, 14 nt, Salmonella enterica enterica serovar Typhi
gcggcguucaaaac

SEQ ID NO: 3659127 - RNA, 16 nt, Salmonella enterica enterica serovar Typhi
gcggcguucugcgcca

SEQ ID NO: 3659128 - RNA, 15 nt, Salmonella enterica enterica serovar Typhi
gcggcguuggcgauu

SEQ ID NO: 3659129 - RNA, 21 nt, Salmonella enterica enterica serovar Typhi
gcggcuauugucugauggcgc

SEQ ID NO: 3659130 - RNA, 14 nt, Salmonella enterica enterica serovar Typhi
gcggcucaccagcu

SEQ ID NO: 3659131 - RNA, 15 nt, Salmonella enterica enterica serovar Typhi
gcggcucaccagcug

SEQ ID NO: 3659132 - RNA, 22 nt, Salmonella enterica enterica serovar Typhi
gcggcucaccagcugacgcagc

SEQ ID NO: 3659133 - RNA, 23 nt, Salmonella enterica enterica serovar Typhi
gcggcucaccagcugacgcagca

SEQ ID NO: 3659134 - RNA, 16 nt, Salmonella enterica enterica serovar Typhi
gcggcucauccagcaa

SEQ ID NO: 3659135 - RNA, 22 nt, Salmonella enterica enterica serovar Typhi
gcggcugaaccacccugaaaag

SEQ ID NO: 3659136 - RNA, 22 nt, Salmonella enterica enterica serovar Typhi
gcggcugacgcgaugacggcgc

SEQ ID NO: 3659137 - RNA, 22 nt, Salmonella enterica enterica serovar Typhi
gcggcugcgccuuauccggcgu

SEQ ID NO: 3659138 - RNA, 16 nt, Salmonella enterica enterica serovar Typhi
gcggcuguguccgcca

SEQ ID NO: 3659139 - RNA, 18 nt, Salmonella enterica enterica serovar Typhi
gcggcuguguccgccaug

SEQ ID NO: 3659140 - RNA, 15 nt, Salmonella enterica enterica serovar Typhi
gcggcuucacgccau

SEQ ID NO: 3659141 - RNA, 15 nt, Salmonella enterica enterica serovar Typhi
gcggcuucagcgaca

SEQ ID NO: 3659142 - RNA, 17 nt, Salmonella enterica enterica serovar Typhi
gcggcuucagcgacauc

SEQ ID NO: 3659143 - RNA, 19 nt, Salmonella enterica enterica serovar Typhi
gcggcuucgccagauccgg

SEQ ID NO: 3659144 - RNA, 19 nt, Salmonella enterica enterica serovar Typhi
gcggcuuuaaugccgccgu

SEQ ID NO: 3659145 - RNA, 13 nt, Salmonella enterica enterica serovar Typhi
gcggcuuucagca

SEQ ID NO: 3659146 - RNA, 22 nt, Salmonella enterica enterica serovar Typhi
gcggcuuugcgccggcaguccu

SEQ ID NO: 3659147 - RNA, 17 nt, Salmonella enterica enterica serovar Typhi
gcggcuuuuucaucauc

SEQ ID NO: 3659148 - RNA, 18 nt, Salmonella enterica enterica serovar Typhi
gcgggaaauaccauccgc

SEQ ID NO: 3659149 - RNA, 14 nt, Salmonella enterica enterica serovar Typhi
gcgggacugcugcu

SEQ ID NO: 3659150 - RNA, 20 nt, Salmonella enterica enterica serovar Typhi
gcgggauaacgcaacaacag

SEQ ID NO: 3659151 - RNA, 20 nt, Salmonella enterica enterica serovar Typhi
gcgggauaucccacucuuca

SEQ ID NO: 3659152 - RNA, 17 nt, Salmonella enterica enterica serovar Typhi
gcgggcaaaagggccau

SEQ ID NO: 3659153 - RNA, 23 nt, Salmonella enterica enterica serovar Typhi
gcgggcaaaagggccauggcugg

SEQ ID NO: 3659154 - RNA, 22 nt, Salmonella enterica enterica serovar Typhi
gcgggcaaugccaccagcgcca

SEQ ID NO: 3659155 - RNA, 23 nt, Salmonella enterica enterica serovar Typhi
gcgggcaaugccaccagcgccau

SEQ ID NO: 3659156 - RNA, 16 nt, Salmonella enterica enterica serovar Typhi
gcgggcaauggcgcuc

SEQ ID NO: 3659157 - RNA, 20 nt, Salmonella enterica enterica serovar Typhi
gcgggcaggucgucuucuug

SEQ ID NO: 3659158 - RNA, 21 nt, Salmonella enterica enterica serovar Typhi
gcgggcauacucuccuccaua

SEQ ID NO: 3659159 - RNA, 15 nt, Salmonella enterica enterica serovar Typhi
gcgggccaauccagc

SEQ ID NO: 3659160 - RNA, 20 nt, Salmonella enterica enterica serovar Typhi
gcgggccaguuuccugaccc

SEQ ID NO: 3659161 - RNA, 20 nt, Salmonella enterica enterica serovar Typhi
gcgggcgauagagaccgcuu

SEQ ID NO: 3659162 - RNA, 16 nt, Salmonella enterica enterica serovar Typhi
gcgggcgaucggcugu

SEQ ID NO: 3659163 - RNA, 18 nt, Salmonella enterica enterica serovar Typhi
gcgggcggaaagcauucg

SEQ ID NO: 3659164 - RNA, 23 nt, Salmonella enterica enterica serovar Typhi
gcgggcguugcugcacgucgcgc

SEQ ID NO: 3659165 - RNA, 19 nt, Salmonella enterica enterica serovar Typhi
gcgggcguuugcgcgcgcc

SEQ ID NO: 3659166 - RNA, 19 nt, Salmonella enterica enterica serovar Typhi
gcgggcugccccagacgcc

SEQ ID NO: 3659167 - RNA, 21 nt, Salmonella enterica enterica serovar Typhi
gcgggcuuuuuuugcccgcuc

SEQ ID NO: 3659168 - RNA, 19 nt, Salmonella enterica enterica serovar Typhi
gcggggauaaucagcagcg

SEQ ID NO: 3659169 - RNA, 22 nt, Salmonella enterica enterica serovar Typhi
gcggggcaacagauacggcgcg

SEQ ID NO: 3659170 - RNA, 17 nt, Salmonella enterica enterica serovar Typhi
gcgggggacgcgacgcc

SEQ ID NO: 3659171 - RNA, 17 nt, Salmonella enterica enterica serovar Typhi
gcgggguaaacgguaau

SEQ ID NO: 3659172 - RNA, 23 nt, Salmonella enterica enterica serovar Typhi
gcggguaaacucacccaggcgau

SEQ ID NO: 3659173 - RNA, 14 nt, Salmonella enterica enterica serovar Typhi
gcgggugaugacgc

SEQ ID NO: 3659174 - RNA, 17 nt, Salmonella enterica enterica serovar Typhi
gcgggugcgcagcccca

SEQ ID NO: 3659175 - RNA, 23 nt, Salmonella enterica enterica serovar Typhi
gcgggugcgcagccccagcgcca

SEQ ID NO: 3659176 - RNA, 15 nt, Salmonella enterica enterica serovar Typhi
gcggguucaucgcca

SEQ ID NO: 3659177 - RNA, 18 nt, Salmonella enterica enterica serovar Typhi
gcggguucccccacucuu

SEQ ID NO: 3659178 - RNA, 14 nt, Salmonella enterica enterica serovar Typhi
gcgguaacaggcac

SEQ ID NO: 3659179 - RNA, 12 nt, Salmonella enterica enterica serovar Typhi
gcgguaacgccu

SEQ ID NO: 3659180 - RNA, 16 nt, Salmonella enterica enterica serovar Typhi
gcgguaagagagugag

SEQ ID NO: 3659181 - RNA, 13 nt, Salmonella enterica enterica serovar Typhi
gcgguaagcuguu

SEQ ID NO: 3659182 - RNA, 17 nt, Salmonella enterica enterica serovar Typhi
gcgguaaggcaccgguu

SEQ ID NO: 3659183 - RNA, 14 nt, Salmonella enterica enterica serovar Typhi
gcgguaauaacuga

SEQ ID NO: 3659184 - RNA, 16 nt, Salmonella enterica enterica serovar Typhi
gcgguacgaccggauu

SEQ ID NO: 3659185 - RNA, 16 nt, Salmonella enterica enterica serovar Typhi
gcgguacgccgccauc

SEQ ID NO: 3659186 - RNA, 18 nt, Salmonella enterica enterica serovar Typhi
gcgguacgccgccauccg

SEQ ID NO: 3659187 - RNA, 20 nt, Salmonella enterica enterica serovar Typhi
gcgguacucuuuuuccgcga

SEQ ID NO: 3659188 - RNA, 17 nt, Salmonella enterica enterica serovar Typhi
gcgguagagcgcgguca

SEQ ID NO: 3659189 - RNA, 15 nt, Salmonella enterica enterica serovar Typhi
gcgguagcugcgcca

SEQ ID NO: 3659190 - RNA, 23 nt, Salmonella enterica enterica serovar Typhi
gcgguauaacugccuuauccggc

SEQ ID NO: 3659191 - RNA, 14 nt, Salmonella enterica enterica serovar Typhi
gcgguauacaccag

SEQ ID NO: 3659192 - RNA, 23 nt, Salmonella enterica enterica serovar Typhi
gcgguauacaccagcucccgcgu

SEQ ID NO: 3659193 - RNA, 17 nt, Salmonella enterica enterica serovar Typhi
gcgguauagcaucccgc

SEQ ID NO: 3659194 - RNA, 14 nt, Salmonella enterica enterica serovar Typhi
gcgguauaucacgc

SEQ ID NO: 3659195 - RNA, 16 nt, Salmonella enterica enterica serovar Typhi
gcgguauaucacgcca

SEQ ID NO: 3659196 - RNA, 13 nt, Salmonella enterica enterica serovar Typhi
gcgguaucaaugc

SEQ ID NO: 3659197 - RNA, 23 nt, Salmonella enterica enterica serovar Typhi
gcgguaucaaugcgacagcgaca

SEQ ID NO: 3659198 - RNA, 19 nt, Salmonella enterica enterica serovar Typhi
gcgguaugaaagccaucgc

SEQ ID NO: 3659199 - RNA, 15 nt, Salmonella enterica enterica serovar Typhi
gcgguauuauccgcc

SEQ ID NO: 3659200 - RNA, 16 nt, Salmonella enterica enterica serovar Typhi
gcgguauuucgccgcc

SEQ ID NO: 3659201 - RNA, 16 nt, Salmonella enterica enterica serovar Typhi
gcggucaaaagcugca

SEQ ID NO: 3659202 - RNA, 13 nt, Salmonella enterica enterica serovar Typhi
gcggucagccaca

SEQ ID NO: 3659203 - RNA, 14 nt, Salmonella enterica enterica serovar Typhi
gcggucagcggcgc

SEQ ID NO: 3659204 - RNA, 12 nt, Salmonella enterica enterica serovar Typhi
gcggucaggaau

SEQ ID NO: 3659205 - RNA, 12 nt, Salmonella enterica enterica serovar Typhi
gcggucaggcca

SEQ ID NO: 3659206 - RNA, 21 nt, Salmonella enterica enterica serovar Typhi
gcggucagggugaaucccgcc

SEQ ID NO: 3659207 - RNA, 15 nt, Salmonella enterica enterica serovar Typhi
gcggucaucgcccau

SEQ ID NO: 3659208 - RNA, 21 nt, Salmonella enterica enterica serovar Typhi
gcgguccaauaaacgccaggu

SEQ ID NO: 3659209 - RNA, 19 nt, Salmonella enterica enterica serovar Typhi
gcggucgccugccgcaugu

SEQ ID NO: 3659210 - RNA, 15 nt, Salmonella enterica enterica serovar Typhi
gcggugaaacuguuu

SEQ ID NO: 3659211 - RNA, 20 nt, Salmonella enterica enterica serovar Typhi
gcggugaaaggcuugcagga

SEQ ID NO: 3659212 - RNA, 14 nt, Salmonella enterica enterica serovar Typhi
gcggugaagcagaa

SEQ ID NO: 3659213 - RNA, 18 nt, Salmonella enterica enterica serovar Typhi
gcggugagaaacgcgcca

SEQ ID NO: 3659214 - RNA, 19 nt, Salmonella enterica enterica serovar Typhi
gcggugaggcugacguuac

SEQ ID NO: 3659215 - RNA, 22 nt, Salmonella enterica enterica serovar Typhi
gcggugcaugaauaucaaacca

SEQ ID NO: 3659216 - RNA, 15 nt, Salmonella enterica enterica serovar Typhi
gcgguggcgcacagu

SEQ ID NO: 3659217 - RNA, 17 nt, Salmonella enterica enterica serovar Typhi
gcgguggguagcggcaa

SEQ ID NO: 3659218 - RNA, 23 nt, Salmonella enterica enterica serovar Typhi
gcgguuacagucuuuggaguaga

SEQ ID NO: 3659219 - RNA, 15 nt, Salmonella enterica enterica serovar Typhi
gcgguuacguccggc

SEQ ID NO: 3659220 - RNA, 18 nt, Salmonella enterica enterica serovar Typhi
gcgguucauccugcgcca

SEQ ID NO: 3659221 - RNA, 15 nt, Salmonella enterica enterica serovar Typhi
gcgguucucccggca

SEQ ID NO: 3659222 - RNA, 17 nt, Salmonella enterica enterica serovar Typhi
gcgguugucggcgcgau

SEQ ID NO: 3659223 - RNA, 23 nt, Salmonella enterica enterica serovar Typhi
gcgguuuaaugcuaucccaggcg

SEQ ID NO: 3659224 - RNA, 18 nt, Salmonella enterica enterica serovar Typhi
gcgguuuacuucuucagu

SEQ ID NO: 3659225 - RNA, 20 nt, Salmonella enterica enterica serovar Typhi
gcgguuuauccccgcuggcg

SEQ ID NO: 3659226 - RNA, 15 nt, Salmonella enterica enterica serovar Typhi
gcgguuucaucgagc

SEQ ID NO: 3659227 - RNA, 21 nt, Salmonella enterica enterica serovar Typhi
gcgguuucaucgagcguguca

SEQ ID NO: 3659228 - RNA, 23 nt, Salmonella enterica enterica serovar Typhi
gcgguuucuaccacccagccaga

SEQ ID NO: 3659229 - RNA, 19 nt, Salmonella enterica enterica serovar Typhi
gcgguuuucaauaauaaaa

SEQ ID NO: 3659230 - RNA, 20 nt, Salmonella enterica enterica serovar Typhi
gcguaaaaaguuucaguggu

SEQ ID NO: 3659231 - RNA, 22 nt, Salmonella enterica enterica serovar Typhi
gcguaaaagcgauaaagacagg

SEQ ID NO: 3659232 - RNA, 19 nt, Salmonella enterica enterica serovar Typhi
gcguaaacgcaacaccauc

SEQ ID NO: 3659233 - RNA, 14 nt, Salmonella enterica enterica serovar Typhi
gcguaaagauuguu

SEQ ID NO: 3659234 - RNA, 19 nt, Salmonella enterica enterica serovar Typhi
gcguaaauacggcuuccac

SEQ ID NO: 3659235 - RNA, 15 nt, Salmonella enterica enterica serovar Typhi
gcguaaaucaggcca

SEQ ID NO: 3659236 - RNA, 14 nt, Salmonella enterica enterica serovar Typhi
gcguaacgccacau

SEQ ID NO: 3659237 - RNA, 18 nt, Salmonella enterica enterica serovar Typhi
gcgucucaucaaaaaggc

SEQ ID NO: 3659238 - RNA, 15 nt, Salmonella enterica enterica serovar Typhi
gcgucucauccggca

SEQ ID NO: 3659239 - RNA, 16 nt, Salmonella enterica enterica serovar Typhi
gcgucucauccggcag

SEQ ID NO: 3659240 - RNA, 20 nt, Salmonella enterica enterica serovar Typhi
gcgucugagcaucccgguaa

SEQ ID NO: 3659241 - RNA, 13 nt, Salmonella enterica enterica serovar Typhi
gcgucugaguuaa

SEQ ID NO: 3659242 - RNA, 15 nt, Salmonella enterica enterica serovar Typhi
gcgucugcaccggua

SEQ ID NO: 3659243 - RNA, 18 nt, Salmonella enterica enterica serovar Typhi
gcgucugccccaaacgcu

SEQ ID NO: 3659244 - RNA, 21 nt, Salmonella enterica enterica serovar Typhi
gcgucugcuggccaaacugcg

SEQ ID NO: 3659245 - RNA, 15 nt, Salmonella enterica enterica serovar Typhi
gcgucuggagcgugc

SEQ ID NO: 3659246 - RNA, 19 nt, Salmonella enterica enterica serovar Typhi
gcgucuggguuugcagcag

SEQ ID NO: 3659247 - RNA, 15 nt, Salmonella enterica enterica serovar Typhi
gcgucuuauccggcc

SEQ ID NO: 3659248 - RNA, 19 nt, Salmonella enterica enterica serovar Typhi
gcgucuucaucagccagca

SEQ ID NO: 3659249 - RNA, 20 nt, Salmonella enterica enterica serovar Typhi
gcgucuucauuuucggcagg

SEQ ID NO: 3659250 - RNA, 23 nt, Salmonella enterica enterica serovar Typhi
gcgugaacgucuuauccggccug

SEQ ID NO: 3659251 - RNA, 14 nt, Salmonella enterica enterica serovar Typhi
gcgugaauaaaaua

SEQ ID NO: 3659252 - RNA, 18 nt, Salmonella enterica enterica serovar Typhi
gcgugacgacuaccgccg

SEQ ID NO: 3659253 - RNA, 20 nt, Salmonella enterica enterica serovar Typhi
gcgugacgccaagcagcggc

SEQ ID NO: 3659254 - RNA, 17 nt, Salmonella enterica enterica serovar Typhi
gcgugagcgcauccggc

SEQ ID NO: 3659255 - RNA, 18 nt, Salmonella enterica enterica serovar Typhi
gcgugauaaaggccggca

SEQ ID NO: 3659256 - RNA, 21 nt, Salmonella enterica enterica serovar Typhi
gcgugauccacagcguaggcc

SEQ ID NO: 3659257 - RNA, 17 nt, Salmonella enterica enterica serovar Typhi
gcgugaugcgauccagc

SEQ ID NO: 3659258 - RNA, 21 nt, Salmonella enterica enterica serovar Typhi
gcgugaugcgauccagcgggc

SEQ ID NO: 3659259 - RNA, 22 nt, Salmonella enterica enterica serovar Typhi
gcgugauuuuggccucauccgc

SEQ ID NO: 3659260 - RNA, 15 nt, Salmonella enterica enterica serovar Typhi
gcgugcaugggcagc

SEQ ID NO: 3659261 - RNA, 15 nt, Salmonella enterica enterica serovar Typhi
gcgugccgggcuggc

SEQ ID NO: 3659262 - RNA, 18 nt, Salmonella enterica enterica serovar Typhi
gcgugccgggcuggcgga

SEQ ID NO: 3659263 - RNA, 13 nt, Salmonella enterica enterica serovar Typhi
gcgugcggcugac

SEQ ID NO: 3659264 - RNA, 16 nt, Salmonella enterica enterica serovar Typhi
gcgugcgguuuuccug

SEQ ID NO: 3659265 - RNA, 21 nt, Salmonella enterica enterica serovar Typhi
gcgugcuaagcuggauaccgc

SEQ ID NO: 3659266 - RNA, 15 nt, Salmonella enterica enterica serovar Typhi
gcgugcuggcggccg

SEQ ID NO: 3659267 - RNA, 18 nt, Salmonella enterica enterica serovar Typhi
gcgugcuucaacggugcu

SEQ ID NO: 3659268 - RNA, 21 nt, Salmonella enterica enterica serovar Typhi
gcguggcaucuuaucaggccu

SEQ ID NO: 3659269 - RNA, 15 nt, Salmonella enterica enterica serovar Typhi
gcguggcauuaacaa

SEQ ID NO: 3659270 - RNA, 17 nt, Salmonella enterica enterica serovar Typhi
gcgugggguugcuucug

SEQ ID NO: 3659271 - RNA, 21 nt, Salmonella enterica enterica serovar Typhi
gcgugguauuacaagcaguua

SEQ ID NO: 3659272 - RNA, 20 nt, Salmonella enterica enterica serovar Typhi
gcguggucauuaggcguaau

SEQ ID NO: 3659273 - RNA, 21 nt, Salmonella enterica enterica serovar Typhi
gcgugguggauauccagcaua

SEQ ID NO: 3659274 - RNA, 18 nt, Salmonella enterica enterica serovar Typhi
gcgugguuuccggcagcu

SEQ ID NO: 3659275 - RNA, 15 nt, Salmonella enterica enterica serovar Typhi
gcguguaaucgccgu

SEQ ID NO: 3659276 - RNA, 18 nt, Salmonella enterica enterica serovar Typhi
gcguguagccaaucagcc

SEQ ID NO: 3659277 - RNA, 21 nt, Salmonella enterica enterica serovar Typhi
gcguguagccaaucagcccca

SEQ ID NO: 3659278 - RNA, 20 nt, Salmonella enterica enterica serovar Typhi
gcgugucagggcggaacagc

SEQ ID NO: 3659279 - RNA, 17 nt, Salmonella enterica enterica serovar Typhi
gcgugucaucaaaauca

SEQ ID NO: 3659280 - RNA, 18 nt, Salmonella enterica enterica serovar Typhi
gcguguugaaauccucua

SEQ ID NO: 3659281 - RNA, 20 nt, Salmonella enterica enterica serovar Typhi
gcguuaacggcuucguuuca

SEQ ID NO: 3659282 - RNA, 20 nt, Salmonella enterica enterica serovar Typhi
gcguuaauauccuucagcgu

SEQ ID NO: 3659283 - RNA, 22 nt, Salmonella enterica enterica serovar Typhi
gcguuaccuauuuguuccggca

SEQ ID NO: 3659284 - RNA, 20 nt, Salmonella enterica enterica serovar Typhi
gcguuacuggcgaccggcag

SEQ ID NO: 3659285 - RNA, 14 nt, Salmonella enterica enterica serovar Typhi
gcguuagccgccau

SEQ ID NO: 3659286 - RNA, 13 nt, Salmonella enterica enterica serovar Typhi
gcguuagcgucau

SEQ ID NO: 3659287 - RNA, 16 nt, Salmonella enterica enterica serovar Typhi
gcguuauccgccugcu

SEQ ID NO: 3659288 - RNA, 22 nt, Salmonella enterica enterica serovar Typhi
gcguuaugugaguuagcggcaa

SEQ ID NO: 3659289 - RNA, 23 nt, Salmonella enterica enterica serovar Typhi
gcguuauguuguugagacgguga

SEQ ID NO: 3659290 - RNA, 23 nt, Salmonella enterica enterica serovar Typhi
gcguucaaagaucucgucaaggu

SEQ ID NO: 3659291 - RNA, 21 nt, Salmonella enterica enterica serovar Typhi
gcguucacaccgccgccagcc

SEQ ID NO: 3659292 - RNA, 15 nt, Salmonella enterica enterica serovar Typhi
gcguucacgccgcca

SEQ ID NO: 3659293 - RNA, 14 nt, Salmonella enterica enterica serovar Typhi
gcguucagcgccug

SEQ ID NO: 3659294 - RNA, 23 nt, Salmonella enterica enterica serovar Typhi
gcguucauggcgcgacauggcga

SEQ ID NO: 3659295 - RNA, 19 nt, Salmonella enterica enterica serovar Typhi
gcguuccaucacuuccugu

SEQ ID NO: 3659296 - RNA, 15 nt, Salmonella enterica enterica serovar Typhi
gcguuccuuaucagc

SEQ ID NO: 3659297 - RNA, 20 nt, Salmonella enterica enterica serovar Typhi
gcguucgcgcaauucuucua

SEQ ID NO: 3659298 - RNA, 20 nt, Salmonella enterica enterica serovar Typhi
gcguucgcgcaguucaucca

SEQ ID NO: 3659299 - RNA, 17 nt, Salmonella enterica enterica serovar Typhi
gcguucgcguagcgccc

SEQ ID NO: 3659300 - RNA, 22 nt, Salmonella enterica enterica serovar Typhi
gcguucggaagacugcuccggc

SEQ ID NO: 3659301 - RNA, 20 nt, Salmonella enterica enterica serovar Typhi
gcguucuagcuuaucgccaa

SEQ ID NO: 3659302 - RNA, 14 nt, Salmonella enterica enterica serovar Typhi
gcguucuuuccagu

SEQ ID NO: 3659303 - RNA, 14 nt, Salmonella enterica enterica serovar Typhi
gcguugaccgcuuc

SEQ ID NO: 3659304 - RNA, 13 nt, Salmonella enterica enterica serovar Typhi
gcguugauggcgu

SEQ ID NO: 3659305 - RNA, 12 nt, Salmonella enterica enterica serovar Typhi
gcguugcagcca

SEQ ID NO: 3659306 - RNA, 16 nt, Salmonella enterica enterica serovar Typhi
gcguugccuggccucc

SEQ ID NO: 3659307 - RNA, 12 nt, Salmonella enterica enterica serovar Typhi
gcguuggcggcu

SEQ ID NO: 3659308 - RNA, 16 nt, Salmonella enterica enterica serovar Typhi
gcguugggcgugacgg

SEQ ID NO: 3659309 - RNA, 21 nt, Salmonella enterica enterica serovar Typhi
gcguuguaauaaugucggaug

SEQ ID NO: 3659310 - RNA, 17 nt, Salmonella enterica enterica serovar Typhi
gcguuguaaucgccuga

SEQ ID NO: 3659311 - RNA, 13 nt, Salmonella enterica enterica serovar Typhi
gcguuguaccguu

SEQ ID NO: 3659312 - RNA, 18 nt, Salmonella enterica enterica serovar Typhi
gcguuguacggauggggu

SEQ ID NO: 3659313 - RNA, 15 nt, Salmonella enterica enterica serovar Typhi
gcguugucgcugauu

SEQ ID NO: 3659314 - RNA, 14 nt, Salmonella enterica enterica serovar Typhi
gcguuuacuggcga

SEQ ID NO: 3659315 - RNA, 13 nt, Salmonella enterica enterica serovar Typhi
gcguuuagcgcca

SEQ ID NO: 3659316 - RNA, 14 nt, Salmonella enterica enterica serovar Typhi
gcguuuaucaccaa

SEQ ID NO: 3659317 - RNA, 20 nt, Salmonella enterica enterica serovar Typhi
gcguuuauguuugcugauaa

SEQ ID NO: 3659318 - RNA, 20 nt, Salmonella enterica enterica serovar Typhi
gcguuucaacaaacucagcc

SEQ ID NO: 3659319 - RNA, 17 nt, Salmonella enterica enterica serovar Typhi
gcguuucacaucgccag

SEQ ID NO: 3659320 - RNA, 18 nt, Salmonella enterica enterica serovar Typhi
gcguuucacaucgccagu

SEQ ID NO: 3659321 - RNA, 19 nt, Salmonella enterica enterica serovar Typhi
gcguuuccacgcugacugc

SEQ ID NO: 3659322 - RNA, 17 nt, Salmonella enterica enterica serovar Typhi
gcuccacgggcgccacg

SEQ ID NO: 3659323 - RNA, 19 nt, Salmonella enterica enterica serovar Typhi
gcuccagacaggacgccag

SEQ ID NO: 3659324 - RNA, 20 nt, Salmonella enterica enterica serovar Typhi
gcuccagacaggacgccagc

SEQ ID NO: 3659325 - RNA, 20 nt, Salmonella enterica enterica serovar Typhi
gcuccagaccaccagcgaca

SEQ ID NO: 3659326 - RNA, 21 nt, Salmonella enterica enterica serovar Typhi
gcuccagaccaccagcgacau

SEQ ID NO: 3659327 - RNA, 12 nt, Salmonella enterica enterica serovar Typhi
gcuccagcaguu

SEQ ID NO: 3659328 - RNA, 14 nt, Salmonella enterica enterica serovar Typhi
gcuccagcaucaca

SEQ ID NO: 3659329 - RNA, 15 nt, Salmonella enterica enterica serovar Typhi
gcuccagcccgccgc

SEQ ID NO: 3659330 - RNA, 22 nt, Salmonella enterica enterica serovar Typhi
gcuccagggauugauggccagc

SEQ ID NO: 3659331 - RNA, 23 nt, Salmonella enterica enterica serovar Typhi
gcuccaguggucguuagccagau

SEQ ID NO: 3659332 - RNA, 16 nt, Salmonella enterica enterica serovar Typhi
gcuccaguuguuccag

SEQ ID NO: 3659333 - RNA, 21 nt, Salmonella enterica enterica serovar Typhi
gcuccaguuguuccagcagcu

SEQ ID NO: 3659334 - RNA, 19 nt, Salmonella enterica enterica serovar Typhi
gcuccaucacgguaaaccu

SEQ ID NO: 3659335 - RNA, 20 nt, Salmonella enterica enterica serovar Typhi
gcuccaucacgguaaaccug

SEQ ID NO: 3659336 - RNA, 22 nt, Salmonella enterica enterica serovar Typhi
gcuccaucacgguaaaccuguu

SEQ ID NO: 3659337 - RNA, 15 nt, Salmonella enterica enterica serovar Typhi
gcuccauccaccagc

SEQ ID NO: 3659338 - RNA, 20 nt, Salmonella enterica enterica serovar Typhi
gcuccaugcugucgucgaca

SEQ ID NO: 3659339 - RNA, 18 nt, Salmonella enterica enterica serovar Typhi
gcucccagaaucguggcu

SEQ ID NO: 3659340 - RNA, 17 nt, Salmonella enterica enterica serovar Typhi
gcuccccaaccgccagc

SEQ ID NO: 3659341 - RNA, 20 nt, Salmonella enterica enterica serovar Typhi
gcucccgcagccacucccga

SEQ ID NO: 3659342 - RNA, 21 nt, Salmonella enterica enterica serovar Typhi
gcucccuuauacaggcgcagg

SEQ ID NO: 3659343 - RNA, 21 nt, Salmonella enterica enterica serovar Typhi
gcucccuucccccagaaugcc

SEQ ID NO: 3659344 - RNA, 13 nt, Salmonella enterica enterica serovar Typhi
gcuccgaauaauc

SEQ ID NO: 3659345 - RNA, 19 nt, Salmonella enterica enterica serovar Typhi
gcuccgaauaauccuuccc

SEQ ID NO: 3659346 - RNA, 23 nt, Salmonella enterica enterica serovar Typhi
gcuccgaauaauccuucccgcua

SEQ ID NO: 3659347 - RNA, 22 nt, Salmonella enterica enterica serovar Typhi
gcuccgccagcaaugccgccgc

SEQ ID NO: 3659348 - RNA, 19 nt, Salmonella enterica enterica serovar Typhi
gcuccgccagggcggcaaa

SEQ ID NO: 3659349 - RNA, 23 nt, Salmonella enterica enterica serovar Typhi
gcuccggcgcuggcgcuggcugc

SEQ ID NO: 3659350 - RNA, 16 nt, Salmonella enterica enterica serovar Typhi
gcuccgggccaugauc

SEQ ID NO: 3659351 - RNA, 16 nt, Salmonella enterica enterica serovar Typhi
gcuccugcgccggacg

SEQ ID NO: 3659352 - RNA, 22 nt, Salmonella enterica enterica serovar Typhi
gcuccugcgguacggccagcgc

SEQ ID NO: 3659353 - RNA, 18 nt, Salmonella enterica enterica serovar Typhi
gcuccugcuccugcggcg

SEQ ID NO: 3659354 - RNA, 20 nt, Salmonella enterica enterica serovar Typhi
gcuccuucuucgccgucaua

SEQ ID NO: 3659355 - RNA, 20 nt, Salmonella enterica enterica serovar Typhi
gcucgacguccagcgcguga

SEQ ID NO: 3659356 - RNA, 22 nt, Salmonella enterica enterica serovar Typhi
gcucgaguucuucacgcugaug

SEQ ID NO: 3659357 - RNA, 18 nt, Salmonella enterica enterica serovar Typhi
gcucgcaggccauaaaac

SEQ ID NO: 3659358 - RNA, 16 nt, Salmonella enterica enterica serovar Typhi
gcucgcauucgcgagc

SEQ ID NO: 3659359 - RNA, 13 nt, Salmonella enterica enterica serovar Typhi
gcucgccagcgcu

SEQ ID NO: 3659360 - RNA, 16 nt, Salmonella enterica enterica serovar Typhi
gcucgcccagaauuuc

SEQ ID NO: 3659361 - RNA, 21 nt, Salmonella enterica enterica serovar Typhi
gcucgcccagcacuaacagca

SEQ ID NO: 3659362 - RNA, 16 nt, Salmonella enterica enterica serovar Typhi
gcucgcccaucacuac

SEQ ID NO: 3659363 - RNA, 14 nt, Salmonella enterica enterica serovar Typhi
gcucgcccgccgca

SEQ ID NO: 3659364 - RNA, 23 nt, Salmonella enterica enterica serovar Typhi
gcucgcccgccgcaaaaaauacc

SEQ ID NO: 3659365 - RNA, 20 nt, Salmonella enterica enterica serovar Typhi
gcucgccgaccggcgcgccg

SEQ ID NO: 3659366 - RNA, 19 nt, Salmonella enterica enterica serovar Typhi
gcucgccguuuuuuaaccg

SEQ ID NO: 3659367 - RNA, 23 nt, Salmonella enterica enterica serovar Typhi
gcucgcggcagauaucgcugacc

SEQ ID NO: 3659368 - RNA, 12 nt, Salmonella enterica enterica serovar Typhi
gcucgcggcgga

SEQ ID NO: 3659369 - RNA, 13 nt, Salmonella enterica enterica serovar Typhi
gcucgcggcggac

SEQ ID NO: 3659370 - RNA, 21 nt, Salmonella enterica enterica serovar Typhi
gcucgcucaucaguuugcgau

SEQ ID NO: 3659371 - RNA, 21 nt, Salmonella enterica enterica serovar Typhi
gcucgcuguagcgccaaccgg

SEQ ID NO: 3659372 - RNA, 20 nt, Salmonella enterica enterica serovar Typhi
gcucgcuuuuacucuuccug

SEQ ID NO: 3659373 - RNA, 20 nt, Salmonella enterica enterica serovar Typhi
gcucggcauacaccgccagc

SEQ ID NO: 3659374 - RNA, 20 nt, Salmonella enterica enterica serovar Typhi
gcucgggaauaaaaauaaau

SEQ ID NO: 3659375 - RNA, 13 nt, Salmonella enterica enterica serovar Typhi
gcucgguggcggu

SEQ ID NO: 3659376 - RNA, 19 nt, Salmonella enterica enterica serovar Typhi
gcucguaaagcaucagacu

SEQ ID NO: 3659377 - RNA, 17 nt, Salmonella enterica enterica serovar Typhi
gcucguauuagauaagc

SEQ ID NO: 3659378 - RNA, 14 nt, Salmonella enterica enterica serovar Typhi
gcucgucggcggaa

SEQ ID NO: 3659379 - RNA, 18 nt, Salmonella enterica enterica serovar Typhi
gcucguuaaauccuccca

SEQ ID NO: 3659380 - RNA, 14 nt, Salmonella enterica enterica serovar Typhi
gcucuaaaaaggaa

SEQ ID NO: 3659381 - RNA, 22 nt, Salmonella enterica enterica serovar Typhi
gcucuacguugaccucaucacc

SEQ ID NO: 3659382 - RNA, 14 nt, Salmonella enterica enterica serovar Typhi
gcucuaucaccgcc

SEQ ID NO: 3659383 - RNA, 20 nt, Salmonella enterica enterica serovar Typhi
gcucuaucaccgcccgccgg

SEQ ID NO: 3659384 - RNA, 19 nt, Salmonella enterica enterica serovar Typhi
gcucucccagcugagcuaa

SEQ ID NO: 3659385 - RNA, 15 nt, Salmonella enterica enterica serovar Typhi
gcucucccgccacug

SEQ ID NO: 3659386 - RNA, 22 nt, Salmonella enterica enterica serovar Typhi
gcucuccggcacauucaccacg

SEQ ID NO: 3659387 - RNA, 22 nt, Salmonella enterica enterica serovar Typhi
gcucuccuccaaagguauggag

SEQ ID NO: 3659388 - RNA, 21 nt, Salmonella enterica enterica serovar Typhi
gcucuccuggaugcgcugaau

SEQ ID NO: 3659389 - RNA, 13 nt, Salmonella enterica enterica serovar Typhi
gcucuccuggcau

SEQ ID NO: 3659390 - RNA, 16 nt, Salmonella enterica enterica serovar Typhi
gcucuccuggcauggc

SEQ ID NO: 3659391 - RNA, 19 nt, Salmonella enterica enterica serovar Typhi
gcucuccuggcauggcucg

SEQ ID NO: 3659392 - RNA, 21 nt, Salmonella enterica enterica serovar Typhi
gcucucgccgcgcuccaucau

SEQ ID NO: 3659393 - RNA, 22 nt, Salmonella enterica enterica serovar Typhi
gcucucgccgcgcuccaucaua

SEQ ID NO: 3659394 - RNA, 21 nt, Salmonella enterica enterica serovar Typhi
gcucucuucgugacccgccag

SEQ ID NO: 3659395 - RNA, 19 nt, Salmonella enterica enterica serovar Typhi
gcucugaaucucuucccag

SEQ ID NO: 3659396 - RNA, 19 nt, Salmonella enterica enterica serovar Typhi
gcucugccaguagcugcuc

SEQ ID NO: 3659397 - RNA, 15 nt, Salmonella enterica enterica serovar Typhi
gcucugcuguuccuu

SEQ ID NO: 3659398 - RNA, 23 nt, Salmonella enterica enterica serovar Typhi
gcucuggacguugagcguuacgg

SEQ ID NO: 3659399 - RNA, 18 nt, Salmonella enterica enterica serovar Typhi
gcucugguugcagcgcca

SEQ ID NO: 3659400 - RNA, 15 nt, Salmonella enterica enterica serovar Typhi
gcucuguggggggaa

SEQ ID NO: 3659401 - RNA, 20 nt, Salmonella enterica enterica serovar Typhi
gcucuucaauuuccaucugu

SEQ ID NO: 3659402 - RNA, 19 nt, Salmonella enterica enterica serovar Typhi
gcucuucuccgccugcggu

SEQ ID NO: 3659403 - RNA, 17 nt, Salmonella enterica enterica serovar Typhi
gcucuucuucgcucucg

SEQ ID NO: 3659404 - RNA, 16 nt, Salmonella enterica enterica serovar Typhi
gcucuuuacauaaugu

SEQ ID NO: 3659405 - RNA, 13 nt, Salmonella enterica enterica serovar Typhi
gcugaaagaagac

SEQ ID NO: 3659406 - RNA, 14 nt, Salmonella enterica enterica serovar Typhi
gcugaaagaagacg

SEQ ID NO: 3659407 - RNA, 17 nt, Salmonella enterica enterica serovar Typhi
gcugcgcuuauccgcuc

SEQ ID NO: 3659408 - RNA, 17 nt, Salmonella enterica enterica serovar Typhi
gcugcgcuucugauuau

SEQ ID NO: 3659409 - RNA, 19 nt, Salmonella enterica enterica serovar Typhi
gcugcggaacaccagcgcc

SEQ ID NO: 3659410 - RNA, 13 nt, Salmonella enterica enterica serovar Typhi
gcugcggcgugga

SEQ ID NO: 3659411 - RNA, 18 nt, Salmonella enterica enterica serovar Typhi
gcugcguucggaagacug

SEQ ID NO: 3659412 - RNA, 21 nt, Salmonella enterica enterica serovar Typhi
gcugcuauguaaaauccggca

SEQ ID NO: 3659413 - RNA, 18 nt, Salmonella enterica enterica serovar Typhi
gcugcuauuucaguggcu

SEQ ID NO: 3659414 - RNA, 17 nt, Salmonella enterica enterica serovar Typhi
gcugcuauuuugcgcuu

SEQ ID NO: 3659415 - RNA, 12 nt, Salmonella enterica enterica serovar Typhi
gcugcucccuca

SEQ ID NO: 3659416 - RNA, 18 nt, Salmonella enterica enterica serovar Typhi
gcugcucggguaaggcau

SEQ ID NO: 3659417 - RNA, 22 nt, Salmonella enterica enterica serovar Typhi
gcugcugaccuuaauccagcag

SEQ ID NO: 3659418 - RNA, 23 nt, Salmonella enterica enterica serovar Typhi
gcugcugaccuuaauccagcagu

SEQ ID NO: 3659419 - RNA, 19 nt, Salmonella enterica enterica serovar Typhi
gcugcuggccuuccagaua

SEQ ID NO: 3659420 - RNA, 16 nt, Salmonella enterica enterica serovar Typhi
gcugcuggugcgccug

SEQ ID NO: 3659421 - RNA, 14 nt, Salmonella enterica enterica serovar Typhi
gcugcuguaacaga

SEQ ID NO: 3659422 - RNA, 21 nt, Salmonella enterica enterica serovar Typhi
gcugcuguuuuugaaaaugug

SEQ ID NO: 3659423 - RNA, 12 nt, Salmonella enterica enterica serovar Typhi
gcugcuucacgg

SEQ ID NO: 3659424 - RNA, 19 nt, Salmonella enterica enterica serovar Typhi
gcugcuuuuugagcggcac

SEQ ID NO: 3659425 - RNA, 17 nt, Salmonella enterica enterica serovar Typhi
gcuggaaugcccacucc

SEQ ID NO: 3659426 - RNA, 19 nt, Salmonella enterica enterica serovar Typhi
gcuggacauguuccgcccc

SEQ ID NO: 3659427 - RNA, 23 nt, Salmonella enterica enterica serovar Typhi
gcuggacauguuccgccccgccu

SEQ ID NO: 3659428 - RNA, 14 nt, Salmonella enterica enterica serovar Typhi
gcuggagccacauc

SEQ ID NO: 3659429 - RNA, 16 nt, Salmonella enterica enterica serovar Typhi
gcuggauaccgcgcca

SEQ ID NO: 3659430 - RNA, 14 nt, Salmonella enterica enterica serovar Typhi
gcuggaugaggcgc

SEQ ID NO: 3659431 - RNA, 16 nt, Salmonella enterica enterica serovar Typhi
gcuggauucucuccca

SEQ ID NO: 3659432 - RNA, 22 nt, Salmonella enterica enterica serovar Typhi
gcuggauucucucccaggcauc

SEQ ID NO: 3659433 - RNA, 23 nt, Salmonella enterica enterica serovar Typhi
gcuggcaacauuaaucuuaucca

SEQ ID NO: 3659434 - RNA, 14 nt, Salmonella enterica enterica serovar Typhi
gcuggcacuggcag

SEQ ID NO: 3659435 - RNA, 14 nt, Salmonella enterica enterica serovar Typhi
gcuggcaggcgcga

SEQ ID NO: 3659436 - RNA, 16 nt, Salmonella enterica enterica serovar Typhi
gcuggcauaaccgcag

SEQ ID NO: 3659437 - RNA, 19 nt, Salmonella enterica enterica serovar Typhi
gcuggccaaacugcggaau

SEQ ID NO: 3659438 - RNA, 16 nt, Salmonella enterica enterica serovar Typhi
gcuggccuucuccacu

SEQ ID NO: 3659439 - RNA, 15 nt, Salmonella enterica enterica serovar Typhi
gcuggcgaaucgcau

SEQ ID NO: 3659440 - RNA, 15 nt, Salmonella enterica enterica serovar Typhi
gcuggcgacggcggu

SEQ ID NO: 3659441 - RNA, 14 nt, Salmonella enterica enterica serovar Typhi
gcuggcgagcagga

SEQ ID NO: 3659442 - RNA, 19 nt, Salmonella enterica enterica serovar Typhi
gcuggcgauaaugccguga

SEQ ID NO: 3659443 - RNA, 15 nt, Salmonella enterica enterica serovar Typhi
gcuggcgcaacuggc

SEQ ID NO: 3659444 - RNA, 15 nt, Salmonella enterica enterica serovar Typhi
gcuggcgcaugaucu

SEQ ID NO: 3659445 - RNA, 13 nt, Salmonella enterica enterica serovar Typhi
gcuggcgccgcaa

SEQ ID NO: 3659446 - RNA, 19 nt, Salmonella enterica enterica serovar Typhi
gcuggcgcggggaacacuc

SEQ ID NO: 3659447 - RNA, 21 nt, Salmonella enterica enterica serovar Typhi
gcuggcgcgucacaacagccg

SEQ ID NO: 3659448 - RNA, 23 nt, Salmonella enterica enterica serovar Typhi
gcuggcgcgucuguguuuauccg

SEQ ID NO: 3659449 - RNA, 18 nt, Salmonella enterica enterica serovar Typhi
gcuggcgcugacgacacu

SEQ ID NO: 3659450 - RNA, 14 nt, Salmonella enterica enterica serovar Typhi
gcuggcgcuguccu

SEQ ID NO: 3659451 - RNA, 16 nt, Salmonella enterica enterica serovar Typhi
gcuggcggcgauggcc

SEQ ID NO: 3659452 - RNA, 14 nt, Salmonella enterica enterica serovar Typhi
gcuggcggucggga

SEQ ID NO: 3659453 - RNA, 21 nt, Salmonella enterica enterica serovar Typhi
gcuggcguacaguuucgccgu

SEQ ID NO: 3659454 - RNA, 15 nt, Salmonella enterica enterica serovar Typhi
gcuggcguacgccau

SEQ ID NO: 3659455 - RNA, 21 nt, Salmonella enterica enterica serovar Typhi
gcuggcgucuguccggcgcuc

SEQ ID NO: 3659456 - RNA, 22 nt, Salmonella enterica enterica serovar Typhi
gcuggcgugacguguggcgcug

SEQ ID NO: 3659457 - RNA, 15 nt, Salmonella enterica enterica serovar Typhi
gcuggcguugagcgu

SEQ ID NO: 3659458 - RNA, 9 nt, Salmonella enterica enterica serovar Typhi
gcuggcugu

SEQ ID NO: 3659459 - RNA, 17 nt, Salmonella enterica enterica serovar Typhi
gcugggauauuacagau

SEQ ID NO: 3659460 - RNA, 17 nt, Salmonella enterica enterica serovar Typhi
gcugggaugaccugaaa

SEQ ID NO: 3659461 - RNA, 14 nt, Salmonella enterica enterica serovar Typhi
gcugggcgaggcca

SEQ ID NO: 3659462 - RNA, 23 nt, Salmonella enterica enterica serovar Typhi
gcuggggcgcguuucauuaagcc

SEQ ID NO: 3659463 - RNA, 17 nt, Salmonella enterica enterica serovar Typhi
gcuggguuaacgcgcca

SEQ ID NO: 3659464 - RNA, 22 nt, Salmonella enterica enterica serovar Typhi
gcugguaagagagccuuacagg

SEQ ID NO: 3659465 - RNA, 18 nt, Salmonella enterica enterica serovar Typhi
gcugguagacaaacagcg

SEQ ID NO: 3659466 - RNA, 22 nt, Salmonella enterica enterica serovar Typhi
gcuggucaacacgcggucguca

SEQ ID NO: 3659467 - RNA, 13 nt, Salmonella enterica enterica serovar Typhi
gcuggucgagaua

SEQ ID NO: 3659468 - RNA, 18 nt, Salmonella enterica enterica serovar Typhi
gcuggucgagauacugca

SEQ ID NO: 3659469 - RNA, 15 nt, Salmonella enterica enterica serovar Typhi
gcuggucgccagcgc

SEQ ID NO: 3659470 - RNA, 16 nt, Salmonella enterica enterica serovar Typhi
gcuggucgccagcgcc

SEQ ID NO: 3659471 - RNA, 15 nt, Salmonella enterica enterica serovar Typhi
gcuggugaagacgcu

SEQ ID NO: 3659472 - RNA, 13 nt, Salmonella enterica enterica serovar Typhi
gcuggugcagccc

SEQ ID NO: 3659473 - RNA, 21 nt, Salmonella enterica enterica serovar Typhi
gcuggugcagcccgucggcgu

SEQ ID NO: 3659474 - RNA, 19 nt, Salmonella enterica enterica serovar Typhi
gcuggugccaaucuccagc

SEQ ID NO: 3659475 - RNA, 13 nt, Salmonella enterica enterica serovar Typhi
gcugguggccggg

SEQ ID NO: 3659476 - RNA, 13 nt, Salmonella enterica enterica serovar Typhi
gcugguggugggc

SEQ ID NO: 3659477 - RNA, 19 nt, Salmonella enterica enterica serovar Typhi
gcugguuaacgccgccauc

SEQ ID NO: 3659478 - RNA, 16 nt, Salmonella enterica enterica serovar Typhi
gcugguuggcgcgcuu

SEQ ID NO: 3659479 - RNA, 19 nt, Salmonella enterica enterica serovar Typhi
gcugguuuuagcuuauccc

SEQ ID NO: 3659480 - RNA, 18 nt, Salmonella enterica enterica serovar Typhi
gcuguaaaucgcgcccga

SEQ ID NO: 3659481 - RNA, 23 nt, Salmonella enterica enterica serovar Typhi
gcuguaaauguuguuccagagug

SEQ ID NO: 3659482 - RNA, 17 nt, Salmonella enterica enterica serovar Typhi
gcuguaacagacgcagg

SEQ ID NO: 3659483 - RNA, 19 nt, Salmonella enterica enterica serovar Typhi
gcuguaacuucacgccauc

SEQ ID NO: 3659484 - RNA, 23 nt, Salmonella enterica enterica serovar Typhi
gcuguaauuaaggauugccgccu

SEQ ID NO: 3659485 - RNA, 22 nt, Salmonella enterica enterica serovar Typhi
gcuguaccaucaccugaugucc

SEQ ID NO: 3659486 - RNA, 22 nt, Salmonella enterica enterica serovar Typhi
gcuguagcguuucacgcgcgcc

SEQ ID NO: 3659487 - RNA, 13 nt, Salmonella enterica enterica serovar Typhi
gcuguagcugccc

SEQ ID NO: 3659488 - RNA, 22 nt, Salmonella enterica enterica serovar Typhi
gcuguaguuucagcccaaaagc

SEQ ID NO: 3659489 - RNA, 15 nt, Salmonella enterica enterica serovar Typhi
gcuguauuucccucu

SEQ ID NO: 3659490 - RNA, 15 nt, Salmonella enterica enterica serovar Typhi
gcugucaccagcagc

SEQ ID NO: 3659491 - RNA, 21 nt, Salmonella enterica enterica serovar Typhi
gcuguccagauagggccaggc

SEQ ID NO: 3659492 - RNA, 22 nt, Salmonella enterica enterica serovar Typhi
gcuguccagauagggccaggcg

SEQ ID NO: 3659493 - RNA, 15 nt, Salmonella enterica enterica serovar Typhi
gcuuaucgauaucug

SEQ ID NO: 3659494 - RNA, 23 nt, Salmonella enterica enterica serovar Typhi
gcuuaucgauaucugccugcaga

SEQ ID NO: 3659495 - RNA, 19 nt, Salmonella enterica enterica serovar Typhi
gcuuaucucuacuuuccug

SEQ ID NO: 3659496 - RNA, 20 nt, Salmonella enterica enterica serovar Typhi
gcuuaucugaguaucgcuuu

SEQ ID NO: 3659497 - RNA, 18 nt, Salmonella enterica enterica serovar Typhi
gcuuaucugcugcugggu

SEQ ID NO: 3659498 - RNA, 21 nt, Salmonella enterica enterica serovar Typhi
gcuuaucugcugcuggguuga

SEQ ID NO: 3659499 - RNA, 16 nt, Salmonella enterica enterica serovar Typhi
gcuuaucuuuacgcuu

SEQ ID NO: 3659500 - RNA, 16 nt, Salmonella enterica enterica serovar Typhi
gcuuauuuucgucguu

SEQ ID NO: 3659501 - RNA, 14 nt, Salmonella enterica enterica serovar Typhi
gcuucaacagcggc

SEQ ID NO: 3659502 - RNA, 18 nt, Salmonella enterica enterica serovar Typhi
gcuucaacagcggcggca

SEQ ID NO: 3659503 - RNA, 19 nt, Salmonella enterica enterica serovar Typhi
gcuucaaccguuucuuuuu

SEQ ID NO: 3659504 - RNA, 19 nt, Salmonella enterica enterica serovar Typhi
gcuucaauaagaaacugcu

SEQ ID NO: 3659505 - RNA, 22 nt, Salmonella enterica enterica serovar Typhi
gcuucaauaaguuagcuuuuuu

SEQ ID NO: 3659506 - RNA, 14 nt, Salmonella enterica enterica serovar Typhi
gcuucaccgccaga

SEQ ID NO: 3659507 - RNA, 16 nt, Salmonella enterica enterica serovar Typhi
gcuucaccgccagagc

SEQ ID NO: 3659508 - RNA, 19 nt, Salmonella enterica enterica serovar Typhi
gcuucaccgccagagcacg

SEQ ID NO: 3659509 - RNA, 20 nt, Salmonella enterica enterica serovar Typhi
gcuucaccggcgugcgcuua

SEQ ID NO: 3659510 - RNA, 22 nt, Salmonella enterica enterica serovar Typhi
gcuucaccguugugcuccagcg

SEQ ID NO: 3659511 - RNA, 20 nt, Salmonella enterica enterica serovar Typhi
gcuucaccuuucgccgccag

SEQ ID NO: 3659512 - RNA, 17 nt, Salmonella enterica enterica serovar Typhi
gcuucacgagcggucag

SEQ ID NO: 3659513 - RNA, 11 nt, Salmonella enterica enterica serovar Typhi
gcuucacgcca

SEQ ID NO: 3659514 - RNA, 23 nt, Salmonella enterica enterica serovar Typhi
gcuucacgcggauugccgcccgu

SEQ ID NO: 3659515 - RNA, 18 nt, Salmonella enterica enterica serovar Typhi
gcuucacguuuuccaggu

SEQ ID NO: 3659516 - RNA, 17 nt, Salmonella enterica enterica serovar Typhi
gcuucacuaacugguac

SEQ ID NO: 3659517 - RNA, 21 nt, Salmonella enterica enterica serovar Typhi
gcuucagaaagcagguuuuga

SEQ ID NO: 3659518 - RNA, 22 nt, Salmonella enterica enterica serovar Typhi
gcuucagcaaacggcuggauaa

SEQ ID NO: 3659519 - RNA, 17 nt, Salmonella enterica enterica serovar Typhi
gcuucagcaucaucucc

SEQ ID NO: 3659520 - RNA, 12 nt, Salmonella enterica enterica serovar Typhi
gcuucagcgaca

SEQ ID NO: 3659521 - RNA, 14 nt, Salmonella enterica enterica serovar Typhi
gcuucagcgacauc

SEQ ID NO: 3659522 - RNA, 21 nt, Salmonella enterica enterica serovar Typhi
gcuucaggauuuacugagcgc

SEQ ID NO: 3659523 - RNA, 22 nt, Salmonella enterica enterica serovar Typhi
gcuucaggauuuacugagcgcc

SEQ ID NO: 3659524 - RNA, 22 nt, Salmonella enterica enterica serovar Typhi
gcuucaggugugguacggcuuu

SEQ ID NO: 3659525 - RNA, 12 nt, Salmonella enterica enterica serovar Typhi
gcuucaugcugg

SEQ ID NO: 3659526 - RNA, 19 nt, Salmonella enterica enterica serovar Typhi
gcuucauugguuaauucaa

SEQ ID NO: 3659527 - RNA, 19 nt, Salmonella enterica enterica serovar Typhi
gcuuccacgcacgccggcc

SEQ ID NO: 3659528 - RNA, 20 nt, Salmonella enterica enterica serovar Typhi
gcuuccacgcacgccggccc

SEQ ID NO: 3659529 - RNA, 22 nt, Salmonella enterica enterica serovar Typhi
gcuuccagcaaaccuuccgcca

SEQ ID NO: 3659530 - RNA, 12 nt, Salmonella enterica enterica serovar Typhi
gcuuccagcaug

SEQ ID NO: 3659531 - RNA, 13 nt, Salmonella enterica enterica serovar Typhi
gcuuccagcucca

SEQ ID NO: 3659532 - RNA, 15 nt, Salmonella enterica enterica serovar Typhi
gcuuccaguugaaaa

SEQ ID NO: 3659533 - RNA, 22 nt, Salmonella enterica enterica serovar Typhi
gcuuccaguugaaaaccacaau

SEQ ID NO: 3659534 - RNA, 13 nt, Salmonella enterica enterica serovar Typhi
gcuucccacaguc

SEQ ID NO: 3659535 - RNA, 15 nt, Salmonella enterica enterica serovar Typhi
gcuucccccggcgcc

SEQ ID NO: 3659536 - RNA, 14 nt, Salmonella enterica enterica serovar Typhi
gcuucccgaaagga

SEQ ID NO: 3659537 - RNA, 16 nt, Salmonella enterica enterica serovar Typhi
gcuucccgaaaggaag

SEQ ID NO: 3659538 - RNA, 17 nt, Salmonella enterica enterica serovar Typhi
gcuucccgaaaggaagc

SEQ ID NO: 3659539 - RNA, 16 nt, Salmonella enterica enterica serovar Typhi
gcuucccgaugccagc

SEQ ID NO: 3659540 - RNA, 15 nt, Salmonella enterica enterica serovar Typhi
gcuuccgaccgcagc

SEQ ID NO: 3659541 - RNA, 17 nt, Salmonella enterica enterica serovar Typhi
gcuuccggcacuuucag

SEQ ID NO: 3659542 - RNA, 15 nt, Salmonella enterica enterica serovar Typhi
gcuuccguccccagc

SEQ ID NO: 3659543 - RNA, 23 nt, Salmonella enterica enterica serovar Typhi
gcuuccguuuuguugccgcccgu

SEQ ID NO: 3659544 - RNA, 13 nt, Salmonella enterica enterica serovar Typhi
gcuuccuggaugu

SEQ ID NO: 3659545 - RNA, 15 nt, Salmonella enterica enterica serovar Typhi
gcuuccuguuuauga

SEQ ID NO: 3659546 - RNA, 20 nt, Salmonella enterica enterica serovar Typhi
gcuuccuguuuaugacccug

SEQ ID NO: 3659547 - RNA, 20 nt, Salmonella enterica enterica serovar Typhi
gcuucgauuuuguuaugcgc

SEQ ID NO: 3659548 - RNA, 13 nt, Salmonella enterica enterica serovar Typhi
gcuucgccaauaa

SEQ ID NO: 3659549 - RNA, 18 nt, Salmonella enterica enterica serovar Typhi
gcuucgccaucuccauca

SEQ ID NO: 3659550 - RNA, 17 nt, Salmonella enterica enterica serovar Typhi
gcuucgcucucgugcca

SEQ ID NO: 3659551 - RNA, 15 nt, Salmonella enterica enterica serovar Typhi
gcuucggacuccuga

SEQ ID NO: 3659552 - RNA, 16 nt, Salmonella enterica enterica serovar Typhi
gcuucgguccggcgcu

SEQ ID NO: 3659553 - RNA, 18 nt, Salmonella enterica enterica serovar Typhi
gcuucgucaggcggcugc

SEQ ID NO: 3659554 - RNA, 22 nt, Salmonella enterica enterica serovar Typhi
gcuucgucccugcauuauccac

SEQ ID NO: 3659555 - RNA, 15 nt, Salmonella enterica enterica serovar Typhi
gcuucgugagaagua

SEQ ID NO: 3659556 - RNA, 20 nt, Salmonella enterica enterica serovar Typhi
gcuucguuaccgccuuuuuu

SEQ ID NO: 3659557 - RNA, 17 nt, Salmonella enterica enterica serovar Typhi
gcuucguuucagauaac

SEQ ID NO: 3659558 - RNA, 20 nt, Salmonella enterica enterica serovar Typhi
gcuucuccaccauaucgcag

SEQ ID NO: 3659559 - RNA, 11 nt, Salmonella enterica enterica serovar Typhi
gcuucucccaa

SEQ ID NO: 3659560 - RNA, 22 nt, Salmonella enterica enterica serovar Typhi
gcuucucuauacggcgcgcagu

SEQ ID NO: 3659561 - RNA, 19 nt, Salmonella enterica enterica serovar Typhi
gcuucucuucaaacucgcu

SEQ ID NO: 3659562 - RNA, 17 nt, Salmonella enterica enterica serovar Typhi
gcuucugauacugcucc

SEQ ID NO: 3659563 - RNA, 12 nt, Salmonella enterica enterica serovar Typhi
gcuucugcgccg

SEQ ID NO: 3659564 - RNA, 16 nt, Salmonella enterica enterica serovar Typhi
gcuucugucugcguga

SEQ ID NO: 3659565 - RNA, 21 nt, Salmonella enterica enterica serovar Typhi
gcuucuuaaaauagccaucgu

SEQ ID NO: 3659566 - RNA, 22 nt, Salmonella enterica enterica serovar Typhi
gcuucuucacuaauuugaugcc

SEQ ID NO: 3659567 - RNA, 23 nt, Salmonella enterica enterica serovar Typhi
gcuucuucacuaauuugaugccu

SEQ ID NO: 3659568 - RNA, 16 nt, Salmonella enterica enterica serovar Typhi
gcuucuuguucacgug

SEQ ID NO: 3659569 - RNA, 17 nt, Salmonella enterica enterica serovar Typhi
gcuugaauaacauaaag

SEQ ID NO: 3659570 - RNA, 14 nt, Salmonella enterica enterica serovar Typhi
gcuugacucugaag

SEQ ID NO: 3659571 - RNA, 17 nt, Salmonella enterica enterica serovar Typhi
gcuugagacagaccaca

SEQ ID NO: 3659572 - RNA, 20 nt, Salmonella enterica enterica serovar Typhi
gcuugaucucucccuggcag

SEQ ID NO: 3659573 - RNA, 17 nt, Salmonella enterica enterica serovar Typhi
gcuugcacuaucgggca

SEQ ID NO: 3659574 - RNA, 23 nt, Salmonella enterica enterica serovar Typhi
gcuugcagcguaauagucugcuc

SEQ ID NO: 3659575 - RNA, 20 nt, Salmonella enterica enterica serovar Typhi
gcuugcaggaugucgauaau

SEQ ID NO: 3659576 - RNA, 20 nt, Salmonella enterica enterica serovar Typhi
gcuugccacuacgcagcucc

SEQ ID NO: 3659577 - RNA, 16 nt, Salmonella enterica enterica serovar Typhi
gcuugcccagcauauu

SEQ ID NO: 3659578 - RNA, 20 nt, Salmonella enterica enterica serovar Typhi
ggaaaacgcgcugauaccgu

SEQ ID NO: 3659579 - RNA, 13 nt, Salmonella enterica enterica serovar Typhi
ggaaaacgcuucu

SEQ ID NO: 3659580 - RNA, 21 nt, Salmonella enterica enterica serovar Typhi
ggaaaaguuguugaccaacaa

SEQ ID NO: 3659581 - RNA, 13 nt, Salmonella enterica enterica serovar Typhi
ggaaaauaauaau

SEQ ID NO: 3659582 - RNA, 18 nt, Salmonella enterica enterica serovar Typhi
ggaaaauauucagcacau

SEQ ID NO: 3659583 - RNA, 13 nt, Salmonella enterica enterica serovar Typhi
ggaaaccgcagaa

SEQ ID NO: 3659584 - RNA, 20 nt, Salmonella enterica enterica serovar Typhi
ggaaacgcuauuuaacccug

SEQ ID NO: 3659585 - RNA, 17 nt, Salmonella enterica enterica serovar Typhi
ggaaacuaugcaaaacg

SEQ ID NO: 3659586 - RNA, 24 nt, Salmonella enterica enterica serovar Typhi
ggaaagaaacgccgcgcaaagcaa

SEQ ID NO: 3659587 - RNA, 15 nt, Salmonella enterica enterica serovar Typhi
ggaaagacggcagcg

SEQ ID NO: 3659588 - RNA, 19 nt, Salmonella enterica enterica serovar Typhi
ggaaagacggcagcgccau

SEQ ID NO: 3659589 - RNA, 22 nt, Salmonella enterica enterica serovar Typhi
ggaaaguaccaaaacagaaaag

SEQ ID NO: 3659590 - RNA, 17 nt, Salmonella enterica enterica serovar Typhi
ggaaagugaaggccaga

SEQ ID NO: 3659591 - RNA, 20 nt, Salmonella enterica enterica serovar Typhi
ggaaaucaaaccaucccagg

SEQ ID NO: 3659592 - RNA, 19 nt, Salmonella enterica enterica serovar Typhi
ggaaaucaacaaucccuua

SEQ ID NO: 3659593 - RNA, 22 nt, Salmonella enterica enterica serovar Typhi
ggaaaucuguuccagcgagcag

SEQ ID NO: 3659594 - RNA, 19 nt, Salmonella enterica enterica serovar Typhi
ggaaaugccgggcaaaaaa

SEQ ID NO: 3659595 - RNA, 19 nt, Salmonella enterica enterica serovar Typhi
ggaaauguagccccaggcc

SEQ ID NO: 3659596 - RNA, 17 nt, Salmonella enterica enterica serovar Typhi
ggaaauuaaacugccuu

SEQ ID NO: 3659597 - RNA, 13 nt, Salmonella enterica enterica serovar Typhi
ggaacaaaacgga

SEQ ID NO: 3659598 - RNA, 23 nt, Salmonella enterica enterica serovar Typhi
ggaacaaaccgacuuucaaaucg

SEQ ID NO: 3659599 - RNA, 17 nt, Salmonella enterica enterica serovar Typhi
ggaacaagcaaaccuau

SEQ ID NO: 3659600 - RNA, 22 nt, Salmonella enterica enterica serovar Typhi
ggaacaccagucgaccgcagac

SEQ ID NO: 3659601 - RNA, 13 nt, Salmonella enterica enterica serovar Typhi
ggaacacucuaaa

SEQ ID NO: 3659602 - RNA, 15 nt, Salmonella enterica enterica serovar Typhi
ggaacacucuaaauc

SEQ ID NO: 3659603 - RNA, 12 nt, Salmonella enterica enterica serovar Typhi
ggaacagauaaa

SEQ ID NO: 3659604 - RNA, 16 nt, Salmonella enterica enterica serovar Typhi
ggaacaggccaaaccc

SEQ ID NO: 3659605 - RNA, 16 nt, Salmonella enterica enterica serovar Typhi
ggaacaucagccagca

SEQ ID NO: 3659606 - RNA, 19 nt, Salmonella enterica enterica serovar Typhi
ggaacaucuuuuaccugug

SEQ ID NO: 3659607 - RNA, 16 nt, Salmonella enterica enterica serovar Typhi
ggaaccaaaugcccag

SEQ ID NO: 3659608 - RNA, 13 nt, Salmonella enterica enterica serovar Typhi
ggaaccaggcgcg

SEQ ID NO: 3659609 - RNA, 13 nt, Salmonella enterica enterica serovar Typhi
ggaacccagcaaa

SEQ ID NO: 3659610 - RNA, 19 nt, Salmonella enterica enterica serovar Typhi
ggaaccggguugcggaagc

SEQ ID NO: 3659611 - RNA, 10 nt, Salmonella enterica enterica serovar Typhi
ggaacgcugu

SEQ ID NO: 3659612 - RNA, 24 nt, Salmonella enterica enterica serovar Typhi
ggaacggcauacugucgcgcggcg

SEQ ID NO: 3659613 - RNA, 14 nt, Salmonella enterica enterica serovar Typhi
ggaacgugccguuu

SEQ ID NO: 3659614 - RNA, 15 nt, Salmonella enterica enterica serovar Typhi
ggaacguugcgccau

SEQ ID NO: 3659615 - RNA, 22 nt, Salmonella enterica enterica serovar Typhi
ggaacuaacccgcagccggaau

SEQ ID NO: 3659616 - RNA, 17 nt, Salmonella enterica enterica serovar Typhi
ggaacugacuccagcug

SEQ ID NO: 3659617 - RNA, 23 nt, Salmonella enterica enterica serovar Typhi
ggaacugccuggcucauucuccg

SEQ ID NO: 3659618 - RNA, 14 nt, Salmonella enterica enterica serovar Typhi
ggaacugcggccag

SEQ ID NO: 3659619 - RNA, 19 nt, Salmonella enterica enterica serovar Typhi
ggaacuggcagcagugaca

SEQ ID NO: 3659620 - RNA, 23 nt, Salmonella enterica enterica serovar Typhi
ggaagaaacgcuuaaagcguucc

SEQ ID NO: 3659621 - RNA, 15 nt, Salmonella enterica enterica serovar Typhi
ggaagacguuuacac

SEQ ID NO: 3659622 - RNA, 18 nt, Salmonella enterica enterica serovar Typhi
ggaagacuauccagccag

SEQ ID NO: 3659623 - RNA, 19 nt, Salmonella enterica enterica serovar Typhi
ggaagacuggcgcagcaaa

SEQ ID NO: 3659624 - RNA, 20 nt, Salmonella enterica enterica serovar Typhi
ggaagauaagaaaaaacugg

SEQ ID NO: 3659625 - RNA, 23 nt, Salmonella enterica enterica serovar Typhi
ggaagcccucggcgaacaggcgu

SEQ ID NO: 3659626 - RNA, 18 nt, Salmonella enterica enterica serovar Typhi
ggaagccguauaugaaua

SEQ ID NO: 3659627 - RNA, 17 nt, Salmonella enterica enterica serovar Typhi
ggaagcgauguuuacug

SEQ ID NO: 3659628 - RNA, 17 nt, Salmonella enterica enterica serovar Typhi
ggaagcgcgaaucgccu

SEQ ID NO: 3659629 - RNA, 18 nt, Salmonella enterica enterica serovar Typhi
ggaagcugcgcagcacuu

SEQ ID NO: 3659630 - RNA, 22 nt, Salmonella enterica enterica serovar Typhi
ggaagcugcgcagcacuucaga

SEQ ID NO: 3659631 - RNA, 16 nt, Salmonella enterica enterica serovar Typhi
ggaaggaagggcgcug

SEQ ID NO: 3659632 - RNA, 18 nt, Salmonella enterica enterica serovar Typhi
ggaaggauagccguauga

SEQ ID NO: 3659633 - RNA, 17 nt, Salmonella enterica enterica serovar Typhi
ggaaggcuaccgcuggg

SEQ ID NO: 3659634 - RNA, 21 nt, Salmonella enterica enterica serovar Typhi
ggaaguaugccucgcgcacca

SEQ ID NO: 3659635 - RNA, 15 nt, Salmonella enterica enterica serovar Typhi
ggaagucagcuuccu

SEQ ID NO: 3659636 - RNA, 20 nt, Salmonella enterica enterica serovar Typhi
ggaagucagcuuccugcacg

SEQ ID NO: 3659637 - RNA, 15 nt, Salmonella enterica enterica serovar Typhi
ggaaguccuucuccu

SEQ ID NO: 3659638 - RNA, 22 nt, Salmonella enterica enterica serovar Typhi
ggaagucggaaaucuguuccag

SEQ ID NO: 3659639 - RNA, 14 nt, Salmonella enterica enterica serovar Typhi
ggaauaaacgguaa

SEQ ID NO: 3659640 - RNA, 21 nt, Salmonella enterica enterica serovar Typhi
ggaauaacaucguaaaucaaa

SEQ ID NO: 3659641 - RNA, 15 nt, Salmonella enterica enterica serovar Typhi
ggaauaacuccagug

SEQ ID NO: 3659642 - RNA, 13 nt, Salmonella enterica enterica serovar Typhi
ggaauaagcgccc

SEQ ID NO: 3659643 - RNA, 20 nt, Salmonella enterica enterica serovar Typhi
ggaauaagggugagagggga

SEQ ID NO: 3659644 - RNA, 23 nt, Salmonella enterica enterica serovar Typhi
ggaauaagggugagaggggaucu

SEQ ID NO: 3659645 - RNA, 14 nt, Salmonella enterica enterica serovar Typhi
ggaauacauuaacg

SEQ ID NO: 3659646 - RNA, 18 nt, Salmonella enterica enterica serovar Typhi
ggaauagauaaguccuaa

SEQ ID NO: 3659647 - RNA, 15 nt, Salmonella enterica enterica serovar Typhi
ggaauaugauuuaaa

SEQ ID NO: 3659648 - RNA, 22 nt, Salmonella enterica enterica serovar Typhi
ggaaucacgcauaucccacugc

SEQ ID NO: 3659649 - RNA, 14 nt, Salmonella enterica enterica serovar Typhi
ggaauccccgccgc

SEQ ID NO: 3659650 - RNA, 14 nt, Salmonella enterica enterica serovar Typhi
ggaaucgcgaucca

SEQ ID NO: 3659651 - RNA, 23 nt, Salmonella enterica enterica serovar Typhi
ggaaugaauguuagcgucugcgg

SEQ ID NO: 3659652 - RNA, 20 nt, Salmonella enterica enterica serovar Typhi
ggaaugccccagguuauaga

SEQ ID NO: 3659653 - RNA, 22 nt, Salmonella enterica enterica serovar Typhi
ggaaugccgugauaggagagca

SEQ ID NO: 3659654 - RNA, 19 nt, Salmonella enterica enterica serovar Typhi
ggaauggcacagcgcagca

SEQ ID NO: 3659655 - RNA, 23 nt, Salmonella enterica enterica serovar Typhi
ggaauguuccccguugagaaugg

SEQ ID NO: 3659656 - RNA, 17 nt, Salmonella enterica enterica serovar Typhi
ggaauguuuggcgccau

SEQ ID NO: 3659657 - RNA, 17 nt, Salmonella enterica enterica serovar Typhi
ggaauugguagacacgc

SEQ ID NO: 3659658 - RNA, 16 nt, Salmonella enterica enterica serovar Typhi
ggaauuuguugguuua

SEQ ID NO: 3659659 - RNA, 16 nt, Salmonella enterica enterica serovar Typhi
ggacaacgcuccagca

SEQ ID NO: 3659660 - RNA, 22 nt, Salmonella enterica enterica serovar Typhi
ggacaaggcgguacgccgccau

SEQ ID NO: 3659661 - RNA, 20 nt, Salmonella enterica enterica serovar Typhi
ggacagcgacacuccgcgca

SEQ ID NO: 3659662 - RNA, 16 nt, Salmonella enterica enterica serovar Typhi
ggacaggcgaaauaag

SEQ ID NO: 3659663 - RNA, 20 nt, Salmonella enterica enterica serovar Typhi
ggauaaggcggagccgccau

SEQ ID NO: 3659664 - RNA, 20 nt, Salmonella enterica enterica serovar Typhi
ggauaaggcguaaccgccau

SEQ ID NO: 3659665 - RNA, 14 nt, Salmonella enterica enterica serovar Typhi
ggauaaggcgugag

SEQ ID NO: 3659666 - RNA, 23 nt, Salmonella enterica enterica serovar Typhi
ggauaaggcguucacgccgccau

SEQ ID NO: 3659667 - RNA, 17 nt, Salmonella enterica enterica serovar Typhi
ggauaaggcguuuacgc

SEQ ID NO: 3659668 - RNA, 17 nt, Salmonella enterica enterica serovar Typhi
ggauaagguguuuacgc

SEQ ID NO: 3659669 - RNA, 13 nt, Salmonella enterica enterica serovar Typhi
ggauacagcgccg

SEQ ID NO: 3659670 - RNA, 16 nt, Salmonella enterica enterica serovar Typhi
ggauacccagccacau

SEQ ID NO: 3659671 - RNA, 15 nt, Salmonella enterica enterica serovar Typhi
ggauaccuucgauga

SEQ ID NO: 3659672 - RNA, 17 nt, Salmonella enterica enterica serovar Typhi
ggauacgccagcagaca

SEQ ID NO: 3659673 - RNA, 18 nt, Salmonella enterica enterica serovar Typhi
ggauacguucauccuccu

SEQ ID NO: 3659674 - RNA, 23 nt, Salmonella enterica enterica serovar Typhi
ggauacguuccagcagcgcauca

SEQ ID NO: 3659675 - RNA, 18 nt, Salmonella enterica enterica serovar Typhi
ggauacuguuuuugcuuu

SEQ ID NO: 3659676 - RNA, 16 nt, Salmonella enterica enterica serovar Typhi
ggauagagaucuuccg

SEQ ID NO: 3659677 - RNA, 17 nt, Salmonella enterica enterica serovar Typhi
ggauagagaucuuccgc

SEQ ID NO: 3659678 - RNA, 15 nt, Salmonella enterica enterica serovar Typhi
ggauagaugaagaca

SEQ ID NO: 3659679 - RNA, 17 nt, Salmonella enterica enterica serovar Typhi
ggauagaugaagacaac

SEQ ID NO: 3659680 - RNA, 12 nt, Salmonella enterica enterica serovar Typhi
ggauagcaaucu

SEQ ID NO: 3659681 - RNA, 23 nt, Salmonella enterica enterica serovar Typhi
ggauagcacuacccagaucgccc

SEQ ID NO: 3659682 - RNA, 18 nt, Salmonella enterica enterica serovar Typhi
ggauagcgacggggcgca

SEQ ID NO: 3659683 - RNA, 17 nt, Salmonella enterica enterica serovar Typhi
ggauagcguagcgccau

SEQ ID NO: 3659684 - RNA, 20 nt, Salmonella enterica enterica serovar Typhi
ggauaguacugaccagacag

SEQ ID NO: 3659685 - RNA, 12 nt, Salmonella enterica enterica serovar Typhi
ggauagucuuca

SEQ ID NO: 3659686 - RNA, 20 nt, Salmonella enterica enterica serovar Typhi
ggauagugauauagcgccau

SEQ ID NO: 3659687 - RNA, 19 nt, Salmonella enterica enterica serovar Typhi
ggauagugccugccgucgc

SEQ ID NO: 3659688 - RNA, 19 nt, Salmonella enterica enterica serovar Typhi
ggauaugcgacgaaagcgg

SEQ ID NO: 3659689 - RNA, 16 nt, Salmonella enterica enterica serovar Typhi
ggauauguuugacaag

SEQ ID NO: 3659690 - RNA, 18 nt, Salmonella enterica enterica serovar Typhi
ggauauuacccggccagu

SEQ ID NO: 3659691 - RNA, 20 nt, Salmonella enterica enterica serovar Typhi
ggauauucaucaguuuaacc

SEQ ID NO: 3659692 - RNA, 21 nt, Salmonella enterica enterica serovar Typhi
ggauauucugcacgcacgaca

SEQ ID NO: 3659693 - RNA, 21 nt, Salmonella enterica enterica serovar Typhi
ggaucaaaaaggugagcauug

SEQ ID NO: 3659694 - RNA, 19 nt, Salmonella enterica enterica serovar Typhi
ggaucaaacgugccuggau

SEQ ID NO: 3659695 - RNA, 23 nt, Salmonella enterica enterica serovar Typhi
ggaucaaccaccuucaccggaua

SEQ ID NO: 3659696 - RNA, 15 nt, Salmonella enterica enterica serovar Typhi
ggaucaauaugccag

SEQ ID NO: 3659697 - RNA, 16 nt, Salmonella enterica enterica serovar Typhi
ggaucaauuuuucgcc

SEQ ID NO: 3659698 - RNA, 20 nt, Salmonella enterica enterica serovar Typhi
ggaucaccugaaugcaaaga

SEQ ID NO: 3659699 - RNA, 22 nt, Salmonella enterica enterica serovar Typhi
ggaucaccugaaugcaaagaag

SEQ ID NO: 3659700 - RNA, 22 nt, Salmonella enterica enterica serovar Typhi
ggaucagaaauucgcagcgcag

SEQ ID NO: 3659701 - RNA, 15 nt, Salmonella enterica enterica serovar Typhi
ggaucaucggccaga

SEQ ID NO: 3659702 - RNA, 13 nt, Salmonella enterica enterica serovar Typhi
ggaucaucuuuua

SEQ ID NO: 3659703 - RNA, 19 nt, Salmonella enterica enterica serovar Typhi
ggaucaucuuuuaccgccu

SEQ ID NO: 3659704 - RNA, 16 nt, Salmonella enterica enterica serovar Typhi
ggaucaugguugaaaa

SEQ ID NO: 3659705 - RNA, 13 nt, Salmonella enterica enterica serovar Typhi
ggaucgccggauu

SEQ ID NO: 3659706 - RNA, 14 nt, Salmonella enterica enterica serovar Typhi
ggaucggccauauc

SEQ ID NO: 3659707 - RNA, 15 nt, Salmonella enterica enterica serovar Typhi
ggaucgggcuuccag

SEQ ID NO: 3659708 - RNA, 21 nt, Salmonella enterica enterica serovar Typhi
ggaucggucuggcgcauaaug

SEQ ID NO: 3659709 - RNA, 14 nt, Salmonella enterica enterica serovar Typhi
ggaucgguuuaucc

SEQ ID NO: 3659710 - RNA, 16 nt, Salmonella enterica enterica serovar Typhi
ggaucguacaacggau

SEQ ID NO: 3659711 - RNA, 22 nt, Salmonella enterica enterica serovar Typhi
ggaucgucucugagaucaaaca

SEQ ID NO: 3659712 - RNA, 20 nt, Salmonella enterica enterica serovar Typhi
ggaucugauacggaaauagc

SEQ ID NO: 3659713 - RNA, 20 nt, Salmonella enterica enterica serovar Typhi
ggaucugcuuaugaucgccc

SEQ ID NO: 3659714 - RNA, 22 nt, Salmonella enterica enterica serovar Typhi
ggaucugcuuaugaucgcccag

SEQ ID NO: 3659715 - RNA, 23 nt, Salmonella enterica enterica serovar Typhi
ggaucugcuuaugaucgcccagc

SEQ ID NO: 3659716 - RNA, 22 nt, Salmonella enterica enterica serovar Typhi
ggaugaacucuaugcaaaagaa

SEQ ID NO: 3659717 - RNA, 20 nt, Salmonella enterica enterica serovar Typhi
ggaugaagcagacaucgcgc

SEQ ID NO: 3659718 - RNA, 15 nt, Salmonella enterica enterica serovar Typhi
ggaugacagaaagcg

SEQ ID NO: 3659719 - RNA, 17 nt, Salmonella enterica enterica serovar Typhi
ggaugaccaguuaagca

SEQ ID NO: 3659720 - RNA, 22 nt, Salmonella enterica enterica serovar Typhi
ggaugacgaauaccugaaagag

SEQ ID NO: 3659721 - RNA, 23 nt, Salmonella enterica enterica serovar Typhi
ggaugacggcgaacggggagaca

SEQ ID NO: 3659722 - RNA, 13 nt, Salmonella enterica enterica serovar Typhi
ggaugcagucugg

SEQ ID NO: 3659723 - RNA, 16 nt, Salmonella enterica enterica serovar Typhi
ggaugcauaaaaaaac

SEQ ID NO: 3659724 - RNA, 16 nt, Salmonella enterica enterica serovar Typhi
ggaugccccaucacgg

SEQ ID NO: 3659725 - RNA, 21 nt, Salmonella enterica enterica serovar Typhi
ggaugcccguagugauagcaa

SEQ ID NO: 3659726 - RNA, 20 nt, Salmonella enterica enterica serovar Typhi
ggaugcgagaaugucgccau

SEQ ID NO: 3659727 - RNA, 14 nt, Salmonella enterica enterica serovar Typhi
ggaugcgcuaucga

SEQ ID NO: 3659728 - RNA, 22 nt, Salmonella enterica enterica serovar Typhi
ggaugcguaauccggccuggcg

SEQ ID NO: 3659729 - RNA, 15 nt, Salmonella enterica enterica serovar Typhi
ggauggccucugcca

SEQ ID NO: 3659730 - RNA, 16 nt, Salmonella enterica enterica serovar Typhi
ggauggccucugccag

SEQ ID NO: 3659731 - RNA, 15 nt, Salmonella enterica enterica serovar Typhi
ggauggccugcucaa

SEQ ID NO: 3659732 - RNA, 12 nt, Salmonella enterica enterica serovar Typhi
ggauggcggcga

SEQ ID NO: 3659733 - RNA, 21 nt, Salmonella enterica enterica serovar Typhi
ggauggcgucgcuacgggcgc

SEQ ID NO: 3659734 - RNA, 20 nt, Salmonella enterica enterica serovar Typhi
ggauggcuggggaaguuaug

SEQ ID NO: 3659735 - RNA, 10 nt, Salmonella enterica enterica serovar Typhi
ggaugguggu

SEQ ID NO: 3659736 - RNA, 21 nt, Salmonella enterica enterica serovar Typhi
ggauguccugcggacgcagcu

SEQ ID NO: 3659737 - RNA, 21 nt, Salmonella enterica enterica serovar Typhi
ggaugugaccuuugugcagga

SEQ ID NO: 3659738 - RNA, 18 nt, Salmonella enterica enterica serovar Typhi
ggaugugcauugacuacu

SEQ ID NO: 3659739 - RNA, 16 nt, Salmonella enterica enterica serovar Typhi
ggauguggugcggcuu

SEQ ID NO: 3659740 - RNA, 17 nt, Salmonella enterica enterica serovar Typhi
ggauguugccacaggcu

SEQ ID NO: 3659741 - RNA, 19 nt, Salmonella enterica enterica serovar Typhi
ggauuacgcgccugccuga

SEQ ID NO: 3659742 - RNA, 18 nt, Salmonella enterica enterica serovar Typhi
ggauucgacugcggucgu

SEQ ID NO: 3659743 - RNA, 19 nt, Salmonella enterica enterica serovar Typhi
ggauucgccagcgugcuua

SEQ ID NO: 3659744 - RNA, 21 nt, Salmonella enterica enterica serovar Typhi
ggauucucuaacgucagcgcc

SEQ ID NO: 3659745 - RNA, 22 nt, Salmonella enterica enterica serovar Typhi
ggauucucuaacgucagcgcca

SEQ ID NO: 3659746 - RNA, 16 nt, Salmonella enterica enterica serovar Typhi
ggauucugccaucgac

SEQ ID NO: 3659747 - RNA, 22 nt, Salmonella enterica enterica serovar Typhi
ggauugaaccuaaaaaccagaa

SEQ ID NO: 3659748 - RNA, 15 nt, Salmonella enterica enterica serovar Typhi
ggcagacaugaccgc

SEQ ID NO: 3659749 - RNA, 15 nt, Salmonella enterica enterica serovar Typhi
ggcagaccggcagcc

SEQ ID NO: 3659750 - RNA, 12 nt, Salmonella enterica enterica serovar Typhi
ggcagacgauag

SEQ ID NO: 3659751 - RNA, 14 nt, Salmonella enterica enterica serovar Typhi
ggcagacggcuggg

SEQ ID NO: 3659752 - RNA, 12 nt, Salmonella enterica enterica serovar Typhi
ggcagagcgcgc

SEQ ID NO: 3659753 - RNA, 19 nt, Salmonella enterica enterica serovar Typhi
ggcagagcgcgcucugccu

SEQ ID NO: 3659754 - RNA, 17 nt, Salmonella enterica enterica serovar Typhi
ggcagaguccagcggca

SEQ ID NO: 3659755 - RNA, 18 nt, Salmonella enterica enterica serovar Typhi
ggcagauaucgcugacca

SEQ ID NO: 3659756 - RNA, 14 nt, Salmonella enterica enterica serovar Typhi
ggcagauaugcggg

SEQ ID NO: 3659757 - RNA, 13 nt, Salmonella enterica enterica serovar Typhi
ggcagauucuucu

SEQ ID NO: 3659758 - RNA, 16 nt, Salmonella enterica enterica serovar Typhi
ggcagcaauacgcccg

SEQ ID NO: 3659759 - RNA, 20 nt, Salmonella enterica enterica serovar Typhi
ggcagcaauacgcccgcccg

SEQ ID NO: 3659760 - RNA, 19 nt, Salmonella enterica enterica serovar Typhi
ggcagcacaaucagcgcgg

SEQ ID NO: 3659761 - RNA, 23 nt, Salmonella enterica enterica serovar Typhi
ggcagcaccggaacagaagccug

SEQ ID NO: 3659762 - RNA, 14 nt, Salmonella enterica enterica serovar Typhi
ggcagcagcuucau

SEQ ID NO: 3659763 - RNA, 17 nt, Salmonella enterica enterica serovar Typhi
ggcagcauuguauuuca

SEQ ID NO: 3659764 - RNA, 12 nt, Salmonella enterica enterica serovar Typhi
ggcagccaggca

SEQ ID NO: 3659765 - RNA, 16 nt, Salmonella enterica enterica serovar Typhi
ggcagccaggcaaagc

SEQ ID NO: 3659766 - RNA, 19 nt, Salmonella enterica enterica serovar Typhi
ggcagcccggcguugaaau

SEQ ID NO: 3659767 - RNA, 15 nt, Salmonella enterica enterica serovar Typhi
ggcagccgacagcgu

SEQ ID NO: 3659768 - RNA, 22 nt, Salmonella enterica enterica serovar Typhi
ggcagccggauuuuaaauuggu

SEQ ID NO: 3659769 - RNA, 16 nt, Salmonella enterica enterica serovar Typhi
ggcagccguuuuccgg

SEQ ID NO: 3659770 - RNA, 15 nt, Salmonella enterica enterica serovar Typhi
ggcagccucaggccu

SEQ ID NO: 3659771 - RNA, 15 nt, Salmonella enterica enterica serovar Typhi
ggcagcggcaagaca

SEQ ID NO: 3659772 - RNA, 12 nt, Salmonella enterica enterica serovar Typhi
ggcagcgucagg

SEQ ID NO: 3659773 - RNA, 14 nt, Salmonella enterica enterica serovar Typhi
ggcagcguccgcca

SEQ ID NO: 3659774 - RNA, 16 nt, Salmonella enterica enterica serovar Typhi
ggcagcguggcgagcu

SEQ ID NO: 3659775 - RNA, 11 nt, Salmonella enterica enterica serovar Typhi
ggcagcucucc

SEQ ID NO: 3659776 - RNA, 16 nt, Salmonella enterica enterica serovar Typhi
ggcagcucucccgcca

SEQ ID NO: 3659777 - RNA, 15 nt, Salmonella enterica enterica serovar Typhi
ggcagcucuuucaac

SEQ ID NO: 3659778 - RNA, 13 nt, Salmonella enterica enterica serovar Typhi
ggcaggcaaaucu

SEQ ID NO: 3659779 - RNA, 14 nt, Salmonella enterica enterica serovar Typhi
ggcaggcagcgcca

SEQ ID NO: 3659780 - RNA, 19 nt, Salmonella enterica enterica serovar Typhi
ggcaggccuuucggcagcg

SEQ ID NO: 3659781 - RNA, 11 nt, Salmonella enterica enterica serovar Typhi
ggcaggcuggu

SEQ ID NO: 3659782 - RNA, 23 nt, Salmonella enterica enterica serovar Typhi
ggcagggaauacccgcccgguuu

SEQ ID NO: 3659783 - RNA, 18 nt, Salmonella enterica enterica serovar Typhi
ggcagggaugacagaaag

SEQ ID NO: 3659784 - RNA, 14 nt, Salmonella enterica enterica serovar Typhi
ggcaggggaaagcu

SEQ ID NO: 3659785 - RNA, 18 nt, Salmonella enterica enterica serovar Typhi
ggcagguaguaaccccag

SEQ ID NO: 3659786 - RNA, 23 nt, Salmonella enterica enterica serovar Typhi
ggcagguuuuuuuauaacauaaa

SEQ ID NO: 3659787 - RNA, 17 nt, Salmonella enterica enterica serovar Typhi
ggcaguaaagaucuggc

SEQ ID NO: 3659788 - RNA, 19 nt, Salmonella enterica enterica serovar Typhi
ggcaguaaagaucuggccg

SEQ ID NO: 3659789 - RNA, 18 nt, Salmonella enterica enterica serovar Typhi
ggcaguaauugagcaguc

SEQ ID NO: 3659790 - RNA, 16 nt, Salmonella enterica enterica serovar Typhi
ggcaguacgcacguuu

SEQ ID NO: 3659791 - RNA, 24 nt, Salmonella enterica enterica serovar Typhi
ggcagugaguaacguuaauacauc

SEQ ID NO: 3659792 - RNA, 15 nt, Salmonella enterica enterica serovar Typhi
ggcaguguuucccaa

SEQ ID NO: 3659793 - RNA, 18 nt, Salmonella enterica enterica serovar Typhi
ggcaguuuauccggcgcc

SEQ ID NO: 3659794 - RNA, 13 nt, Salmonella enterica enterica serovar Typhi
ggcauaaaaaaag

SEQ ID NO: 3659795 - RNA, 17 nt, Salmonella enterica enterica serovar Typhi
ggcauaaaaagccaucc

SEQ ID NO: 3659796 - RNA, 19 nt, Salmonella enterica enterica serovar Typhi
ggcauaaacacagcaaaca

SEQ ID NO: 3659797 - RNA, 14 nt, Salmonella enterica enterica serovar Typhi
ggcauacacgccgg

SEQ ID NO: 3659798 - RNA, 17 nt, Salmonella enterica enterica serovar Typhi
ggcauacucuccuccau

SEQ ID NO: 3659799 - RNA, 13 nt, Salmonella enterica enterica serovar Typhi
ggcauagaaaaag

SEQ ID NO: 3659800 - RNA, 13 nt, Salmonella enterica enterica serovar Typhi
ggcauaucgccau

SEQ ID NO: 3659801 - RNA, 19 nt, Salmonella enterica enterica serovar Typhi
ggcaucagacgguggccga

SEQ ID NO: 3659802 - RNA, 17 nt, Salmonella enterica enterica serovar Typhi
ggcauccaguuucuucg

SEQ ID NO: 3659803 - RNA, 18 nt, Salmonella enterica enterica serovar Typhi
ggcauccaguuucuucgg

SEQ ID NO: 3659804 - RNA, 14 nt, Salmonella enterica enterica serovar Typhi
ggcaucgucggcga

SEQ ID NO: 3659805 - RNA, 11 nt, Salmonella enterica enterica serovar Typhi
ggcaucucaag

SEQ ID NO: 3659806 - RNA, 12 nt, Salmonella enterica enterica serovar Typhi
ggcaucucgcca

SEQ ID NO: 3659807 - RNA, 15 nt, Salmonella enterica enterica serovar Typhi
ggcaugaagaaaaua

SEQ ID NO: 3659808 - RNA, 22 nt, Salmonella enterica enterica serovar Typhi
ggcaugauguccagcgcgccgg

SEQ ID NO: 3659809 - RNA, 16 nt, Salmonella enterica enterica serovar Typhi
ggcaugauuaaagcca

SEQ ID NO: 3659810 - RNA, 20 nt, Salmonella enterica enterica serovar Typhi
ggcauggaugcaugagcacg

SEQ ID NO: 3659811 - RNA, 15 nt, Salmonella enterica enterica serovar Typhi
ggcauggcagcaggg

SEQ ID NO: 3659812 - RNA, 17 nt, Salmonella enterica enterica serovar Typhi
ggcauggcucgccgcug

SEQ ID NO: 3659813 - RNA, 17 nt, Salmonella enterica enterica serovar Typhi
ggcaugucugucuaugc

SEQ ID NO: 3659814 - RNA, 13 nt, Salmonella enterica enterica serovar Typhi
ggcauuaaaugcg

SEQ ID NO: 3659815 - RNA, 18 nt, Salmonella enterica enterica serovar Typhi
ggcauuaagucauaccug

SEQ ID NO: 3659816 - RNA, 17 nt, Salmonella enterica enterica serovar Typhi
ggcauuaauauccagug

SEQ ID NO: 3659817 - RNA, 17 nt, Salmonella enterica enterica serovar Typhi
ggcauuagccgccaucc

SEQ ID NO: 3659818 - RNA, 14 nt, Salmonella enterica enterica serovar Typhi
ggcauucacgccac

SEQ ID NO: 3659819 - RNA, 18 nt, Salmonella enterica enterica serovar Typhi
ggcauuccccaucgcgac

SEQ ID NO: 3659820 - RNA, 19 nt, Salmonella enterica enterica serovar Typhi
ggcauucgaauccuccugu

SEQ ID NO: 3659821 - RNA, 22 nt, Salmonella enterica enterica serovar Typhi
ggcauucgcagaggacauuaaa

SEQ ID NO: 3659822 - RNA, 17 nt, Salmonella enterica enterica serovar Typhi
ggcauuggcguuaccgg

SEQ ID NO: 3659823 - RNA, 16 nt, Salmonella enterica enterica serovar Typhi
ggcauuuaugccgcca

SEQ ID NO: 3659824 - RNA, 22 nt, Salmonella enterica enterica serovar Typhi
ggcauuucaccgucaauaacgg

SEQ ID NO: 3659825 - RNA, 23 nt, Salmonella enterica enterica serovar Typhi
ggcauuucacuuaauacucgccc

SEQ ID NO: 3659826 - RNA, 17 nt, Salmonella enterica enterica serovar Typhi
ggcauuucgccgccauc

SEQ ID NO: 3659827 - RNA, 19 nt, Salmonella enterica enterica serovar Typhi
ggccaaaaccacagugacc

SEQ ID NO: 3659828 - RNA, 13 nt, Salmonella enterica enterica serovar Typhi
ggccaaauaaccc

SEQ ID NO: 3659829 - RNA, 14 nt, Salmonella enterica enterica serovar Typhi
ggccaaauaaccca

SEQ ID NO: 3659830 - RNA, 21 nt, Salmonella enterica enterica serovar Typhi
ggccaacauagcggcaaggaa

SEQ ID NO: 3659831 - RNA, 22 nt, Salmonella enterica enterica serovar Typhi
ggccaacgcgcccucugagcug

SEQ ID NO: 3659832 - RNA, 15 nt, Salmonella enterica enterica serovar Typhi
ggccaagcagcgcca

SEQ ID NO: 3659833 - RNA, 13 nt, Salmonella enterica enterica serovar Typhi
ggccaagcgccug

SEQ ID NO: 3659834 - RNA, 14 nt, Salmonella enterica enterica serovar Typhi
ggccggauaaggcc

SEQ ID NO: 3659835 - RNA, 21 nt, Salmonella enterica enterica serovar Typhi
ggccggauaaggcgcuagccg

SEQ ID NO: 3659836 - RNA, 18 nt, Salmonella enterica enterica serovar Typhi
ggccggauaaggcgcuug

SEQ ID NO: 3659837 - RNA, 16 nt, Salmonella enterica enterica serovar Typhi
ggccggauaaggcguu

SEQ ID NO: 3659838 - RNA, 19 nt, Salmonella enterica enterica serovar Typhi
ggccggcaccagccaggaa

SEQ ID NO: 3659839 - RNA, 23 nt, Salmonella enterica enterica serovar Typhi
ggccgggccugagcgcgcagcug

SEQ ID NO: 3659840 - RNA, 22 nt, Salmonella enterica enterica serovar Typhi
ggccgucacuuuaucacuccuu

SEQ ID NO: 3659841 - RNA, 21 nt, Salmonella enterica enterica serovar Typhi
ggccgucccacgcgccgccga

SEQ ID NO: 3659842 - RNA, 23 nt, Salmonella enterica enterica serovar Typhi
ggccguucauucgccccagcaua

SEQ ID NO: 3659843 - RNA, 15 nt, Salmonella enterica enterica serovar Typhi
ggccguuuucaugca

SEQ ID NO: 3659844 - RNA, 23 nt, Salmonella enterica enterica serovar Typhi
ggccuacaaaaucgcccaggccu

SEQ ID NO: 3659845 - RNA, 18 nt, Salmonella enterica enterica serovar Typhi
ggccuacaaggcauucag

SEQ ID NO: 3659846 - RNA, 20 nt, Salmonella enterica enterica serovar Typhi
ggccuacacucugcgcgcga

SEQ ID NO: 3659847 - RNA, 17 nt, Salmonella enterica enterica serovar Typhi
ggccuacagaugaacgu

SEQ ID NO: 3659848 - RNA, 14 nt, Salmonella enterica enterica serovar Typhi
ggccucauccgcau

SEQ ID NO: 3659849 - RNA, 19 nt, Salmonella enterica enterica serovar Typhi
ggccuccggaucgacagca

SEQ ID NO: 3659850 - RNA, 14 nt, Salmonella enterica enterica serovar Typhi
ggccuccggcgggu

SEQ ID NO: 3659851 - RNA, 17 nt, Salmonella enterica enterica serovar Typhi
ggccucuucacgcagcg

SEQ ID NO: 3659852 - RNA, 20 nt, Salmonella enterica enterica serovar Typhi
ggccucuucacgcagcgccu

SEQ ID NO: 3659853 - RNA, 20 nt, Salmonella enterica enterica serovar Typhi
ggccugaauaaugaccucca

SEQ ID NO: 3659854 - RNA, 23 nt, Salmonella enterica enterica serovar Typhi
ggccugaaucagcaucuuaugcg

SEQ ID NO: 3659855 - RNA, 22 nt, Salmonella enterica enterica serovar Typhi
ggccugaaugcagaccucugcu

SEQ ID NO: 3659856 - RNA, 22 nt, Salmonella enterica enterica serovar Typhi
ggccugauaagacgcaucgcgu

SEQ ID NO: 3659857 - RNA, 19 nt, Salmonella enterica enterica serovar Typhi
ggccugauaagcacaggcc

SEQ ID NO: 3659858 - RNA, 20 nt, Salmonella enterica enterica serovar Typhi
ggccugauaagcacaggcca

SEQ ID NO: 3659859 - RNA, 21 nt, Salmonella enterica enterica serovar Typhi
ggccugauaagcauagcgcca

SEQ ID NO: 3659860 - RNA, 21 nt, Salmonella enterica enterica serovar Typhi
ggccugauaagcgcagcgcca

SEQ ID NO: 3659861 - RNA, 22 nt, Salmonella enterica enterica serovar Typhi
ggccugauaagcgcagcgccau

SEQ ID NO: 3659862 - RNA, 23 nt, Salmonella enterica enterica serovar Typhi
ggccugauaagcgcagcgccauc

SEQ ID NO: 3659863 - RNA, 23 nt, Salmonella enterica enterica serovar Typhi
ggccugaugcgcguuuagcgcca

SEQ ID NO: 3659864 - RNA, 19 nt, Salmonella enterica enterica serovar Typhi
ggccugcacaagaaacaug

SEQ ID NO: 3659865 - RNA, 16 nt, Salmonella enterica enterica serovar Typhi
ggccugcagagcggca

SEQ ID NO: 3659866 - RNA, 22 nt, Salmonella enterica enterica serovar Typhi
ggccugcagagcggcaaauuca

SEQ ID NO: 3659867 - RNA, 14 nt, Salmonella enterica enterica serovar Typhi
ggccugcaucaaca

SEQ ID NO: 3659868 - RNA, 17 nt, Salmonella enterica enterica serovar Typhi
ggccugccggguuuaau

SEQ ID NO: 3659869 - RNA, 15 nt, Salmonella enterica enterica serovar Typhi
ggccugcggaaaaag

SEQ ID NO: 3659870 - RNA, 12 nt, Salmonella enterica enterica serovar Typhi
ggccuggagauc

SEQ ID NO: 3659871 - RNA, 16 nt, Salmonella enterica enterica serovar Typhi
ggccuggagaucagca

SEQ ID NO: 3659872 - RNA, 18 nt, Salmonella enterica enterica serovar Typhi
ggccuggcugagaaaaau

SEQ ID NO: 3659873 - RNA, 16 nt, Salmonella enterica enterica serovar Typhi
ggccugucacguaaaa

SEQ ID NO: 3659874 - RNA, 15 nt, Salmonella enterica enterica serovar Typhi
ggccugucaggccug

SEQ ID NO: 3659875 - RNA, 23 nt, Salmonella enterica enterica serovar Typhi
ggccugucccuucgcccggcgcg

SEQ ID NO: 3659876 - RNA, 14 nt, Salmonella enterica enterica serovar Typhi
ggccuuauuuuuca

SEQ ID NO: 3659877 - RNA, 15 nt, Salmonella enterica enterica serovar Typhi
ggccuucaaucagca

SEQ ID NO: 3659878 - RNA, 12 nt, Salmonella enterica enterica serovar Typhi
ggccuucugcua

SEQ ID NO: 3659879 - RNA, 18 nt, Salmonella enterica enterica serovar Typhi
ggccuugaaguuauccag

SEQ ID NO: 3659880 - RNA, 22 nt, Salmonella enterica enterica serovar Typhi
ggccuugaaguuauccagcgcc

SEQ ID NO: 3659881 - RNA, 17 nt, Salmonella enterica enterica serovar Typhi
ggcgaaaaaguucacgc

SEQ ID NO: 3659882 - RNA, 15 nt, Salmonella enterica enterica serovar Typhi
ggcgaaaauccuuuu

SEQ ID NO: 3659883 - RNA, 14 nt, Salmonella enterica enterica serovar Typhi
ggcgaaagaaaauu

SEQ ID NO: 3659884 - RNA, 13 nt, Salmonella enterica enterica serovar Typhi
ggcgaaagaagcg

SEQ ID NO: 3659885 - RNA, 21 nt, Salmonella enterica enterica serovar Typhi
ggcgaaagcacuucucgcgca

SEQ ID NO: 3659886 - RNA, 13 nt, Salmonella enterica enterica serovar Typhi
ggcgaaauagcgu

SEQ ID NO: 3659887 - RNA, 23 nt, Salmonella enterica enterica serovar Typhi
ggcgaacagccccaccgccagaa

SEQ ID NO: 3659888 - RNA, 15 nt, Salmonella enterica enterica serovar Typhi
ggcgaacaggcucag

SEQ ID NO: 3659889 - RNA, 20 nt, Salmonella enterica enterica serovar Typhi
ggcgaacaggcucagcgcca

SEQ ID NO: 3659890 - RNA, 21 nt, Salmonella enterica enterica serovar Typhi
ggcgaacaggcucagcgccac

SEQ ID NO: 3659891 - RNA, 12 nt, Salmonella enterica enterica serovar Typhi
ggcgaacauaag

SEQ ID NO: 3659892 - RNA, 17 nt, Salmonella enterica enterica serovar Typhi
ggcgaaccggcaucggc

SEQ ID NO: 3659893 - RNA, 21 nt, Salmonella enterica enterica serovar Typhi
ggcgaaccggcaucggcagcg

SEQ ID NO: 3659894 - RNA, 23 nt, Salmonella enterica enterica serovar Typhi
ggcgaacguuuuuucgcacgccu

SEQ ID NO: 3659895 - RNA, 15 nt, Salmonella enterica enterica serovar Typhi
ggcgaacuccagcgc

SEQ ID NO: 3659896 - RNA, 16 nt, Salmonella enterica enterica serovar Typhi
ggcgaacucggucagg

SEQ ID NO: 3659897 - RNA, 20 nt, Salmonella enterica enterica serovar Typhi
ggcgaauaaaauucagcgca

SEQ ID NO: 3659898 - RNA, 21 nt, Salmonella enterica enterica serovar Typhi
ggcgaauauagcuaaugcaau

SEQ ID NO: 3659899 - RNA, 23 nt, Salmonella enterica enterica serovar Typhi
ggcgaauccccaucuccagacga

SEQ ID NO: 3659900 - RNA, 14 nt, Salmonella enterica enterica serovar Typhi
ggcgaaucgccugu

SEQ ID NO: 3659901 - RNA, 22 nt, Salmonella enterica enterica serovar Typhi
ggcgaaucucgugaucgccaaa

SEQ ID NO: 3659902 - RNA, 16 nt, Salmonella enterica enterica serovar Typhi
ggcgacaaacagcgcc

SEQ ID NO: 3659903 - RNA, 15 nt, Salmonella enterica enterica serovar Typhi
ggcgacaagaauaug

SEQ ID NO: 3659904 - RNA, 20 nt, Salmonella enterica enterica serovar Typhi
ggcgacaagaauaugggugu

SEQ ID NO: 3659905 - RNA, 16 nt, Salmonella enterica enterica serovar Typhi
ggcgacaaucucaccg

SEQ ID NO: 3659906 - RNA, 14 nt, Salmonella enterica enterica serovar Typhi
ggcgacagccgcgu

SEQ ID NO: 3659907 - RNA, 17 nt, Salmonella enterica enterica serovar Typhi
ggcgaccgggcagacau

SEQ ID NO: 3659908 - RNA, 20 nt, Salmonella enterica enterica serovar Typhi
ggcgaccuucacgccgccaa

SEQ ID NO: 3659909 - RNA, 16 nt, Salmonella enterica enterica serovar Typhi
ggcgacgaucagcgcc

SEQ ID NO: 3659910 - RNA, 17 nt, Salmonella enterica enterica serovar Typhi
ggcgacgaucagcgcca

SEQ ID NO: 3659911 - RNA, 19 nt, Salmonella enterica enterica serovar Typhi
ggcgacgcgauagcgcagc

SEQ ID NO: 3659912 - RNA, 16 nt, Salmonella enterica enterica serovar Typhi
ggcgacgcuuucaccu

SEQ ID NO: 3659913 - RNA, 17 nt, Salmonella enterica enterica serovar Typhi
ggcgacgucagacgagg

SEQ ID NO: 3659914 - RNA, 20 nt, Salmonella enterica enterica serovar Typhi
ggcgacuaccucuuauccgg

SEQ ID NO: 3659915 - RNA, 17 nt, Salmonella enterica enterica serovar Typhi
ggcgacuggaacaggcc

SEQ ID NO: 3659916 - RNA, 19 nt, Salmonella enterica enterica serovar Typhi
ggcgacuggaacaggccaa

SEQ ID NO: 3659917 - RNA, 20 nt, Salmonella enterica enterica serovar Typhi
ggcgacuucauucaggcagg

SEQ ID NO: 3659918 - RNA, 20 nt, Salmonella enterica enterica serovar Typhi
ggcgagauguuuuaccagua

SEQ ID NO: 3659919 - RNA, 13 nt, Salmonella enterica enterica serovar Typhi
ggcgcuaaugcuu

SEQ ID NO: 3659920 - RNA, 19 nt, Salmonella enterica enterica serovar Typhi
ggcgcuaaugcuuauccgg

SEQ ID NO: 3659921 - RNA, 19 nt, Salmonella enterica enterica serovar Typhi
ggcgcuacgccaucaggca

SEQ ID NO: 3659922 - RNA, 18 nt, Salmonella enterica enterica serovar Typhi
ggcgcuacgcuuaucagg

SEQ ID NO: 3659923 - RNA, 17 nt, Salmonella enterica enterica serovar Typhi
ggcgcuacgcuuauccg

SEQ ID NO: 3659924 - RNA, 18 nt, Salmonella enterica enterica serovar Typhi
ggcgcuacguuuaucugg

SEQ ID NO: 3659925 - RNA, 14 nt, Salmonella enterica enterica serovar Typhi
ggcgcuauucccag

SEQ ID NO: 3659926 - RNA, 17 nt, Salmonella enterica enterica serovar Typhi
ggcgcucaauagccaga

SEQ ID NO: 3659927 - RNA, 14 nt, Salmonella enterica enterica serovar Typhi
ggcgcucagccaga

SEQ ID NO: 3659928 - RNA, 18 nt, Salmonella enterica enterica serovar Typhi
ggcgcuccugucaggcga

SEQ ID NO: 3659929 - RNA, 21 nt, Salmonella enterica enterica serovar Typhi
ggcgcugaacgcauacaggcu

SEQ ID NO: 3659930 - RNA, 14 nt, Salmonella enterica enterica serovar Typhi
ggcgcugaagccug

SEQ ID NO: 3659931 - RNA, 19 nt, Salmonella enterica enterica serovar Typhi
ggcgcugccgcuuauccgg

SEQ ID NO: 3659932 - RNA, 21 nt, Salmonella enterica enterica serovar Typhi
ggcgcugccgcuuauccggcc

SEQ ID NO: 3659933 - RNA, 15 nt, Salmonella enterica enterica serovar Typhi
ggcgcugcgcgcauc

SEQ ID NO: 3659934 - RNA, 20 nt, Salmonella enterica enterica serovar Typhi
ggcgcugcgcgcaucgggcc

SEQ ID NO: 3659935 - RNA, 17 nt, Salmonella enterica enterica serovar Typhi
ggcgcugcgcuuaccgg

SEQ ID NO: 3659936 - RNA, 23 nt, Salmonella enterica enterica serovar Typhi
ggcgcugcgcuuaccgggccuac

SEQ ID NO: 3659937 - RNA, 20 nt, Salmonella enterica enterica serovar Typhi
ggcgcuggcagggacgcugc

SEQ ID NO: 3659938 - RNA, 22 nt, Salmonella enterica enterica serovar Typhi
ggcgcuguacgccucuuucagc

SEQ ID NO: 3659939 - RNA, 18 nt, Salmonella enterica enterica serovar Typhi
ggcgcugucgccgcgcac

SEQ ID NO: 3659940 - RNA, 13 nt, Salmonella enterica enterica serovar Typhi
ggcgcuguucuug

SEQ ID NO: 3659941 - RNA, 17 nt, Salmonella enterica enterica serovar Typhi
ggcgcuuaccuaaguca

SEQ ID NO: 3659942 - RNA, 14 nt, Salmonella enterica enterica serovar Typhi
ggcgcuuaucgccg

SEQ ID NO: 3659943 - RNA, 14 nt, Salmonella enterica enterica serovar Typhi
ggcgcuuccugcag

SEQ ID NO: 3659944 - RNA, 15 nt, Salmonella enterica enterica serovar Typhi
ggcgcuuccugcagu

SEQ ID NO: 3659945 - RNA, 20 nt, Salmonella enterica enterica serovar Typhi
ggcgcuucgcuuaucaggcc

SEQ ID NO: 3659946 - RNA, 21 nt, Salmonella enterica enterica serovar Typhi
ggcgcuugcgccaucauccgg

SEQ ID NO: 3659947 - RNA, 13 nt, Salmonella enterica enterica serovar Typhi
ggcgcuuuaccgg

SEQ ID NO: 3659948 - RNA, 15 nt, Salmonella enterica enterica serovar Typhi
ggcgcuuugccguuc

SEQ ID NO: 3659949 - RNA, 17 nt, Salmonella enterica enterica serovar Typhi
ggcgcuuuuccagcacg

SEQ ID NO: 3659950 - RNA, 23 nt, Salmonella enterica enterica serovar Typhi
ggcggaaagcauucgcagcagac

SEQ ID NO: 3659951 - RNA, 18 nt, Salmonella enterica enterica serovar Typhi
ggcggaaaugcggguccu

SEQ ID NO: 3659952 - RNA, 12 nt, Salmonella enterica enterica serovar Typhi
ggcggaagaggc

SEQ ID NO: 3659953 - RNA, 16 nt, Salmonella enterica enterica serovar Typhi
ggcggaagguuuccgc

SEQ ID NO: 3659954 - RNA, 22 nt, Salmonella enterica enterica serovar Typhi
ggcggaagucaaagguaauauc

SEQ ID NO: 3659955 - RNA, 19 nt, Salmonella enterica enterica serovar Typhi
ggcggacaacgcuccagca

SEQ ID NO: 3659956 - RNA, 13 nt, Salmonella enterica enterica serovar Typhi
ggcggacagcggc

SEQ ID NO: 3659957 - RNA, 16 nt, Salmonella enterica enterica serovar Typhi
ggcggagggauuuuaa

SEQ ID NO: 3659958 - RNA, 21 nt, Salmonella enterica enterica serovar Typhi
ggcggauacagcggcgcgcca

SEQ ID NO: 3659959 - RNA, 14 nt, Salmonella enterica enterica serovar Typhi
ggcggauacgcuuc

SEQ ID NO: 3659960 - RNA, 22 nt, Salmonella enterica enterica serovar Typhi
ggcggaugaaacaguccggcga

SEQ ID NO: 3659961 - RNA, 22 nt, Salmonella enterica enterica serovar Typhi
ggcggauuccaguagcgcgccc

SEQ ID NO: 3659962 - RNA, 12 nt, Salmonella enterica enterica serovar Typhi
ggcggcaaaaaa

SEQ ID NO: 3659963 - RNA, 18 nt, Salmonella enterica enterica serovar Typhi
ggcggcaaggucugcgcc

SEQ ID NO: 3659964 - RNA, 12 nt, Salmonella enterica enterica serovar Typhi
ggcggcacgcca

SEQ ID NO: 3659965 - RNA, 23 nt, Salmonella enterica enterica serovar Typhi
ggcggcauaaaugccuuauccgg

SEQ ID NO: 3659966 - RNA, 21 nt, Salmonella enterica enterica serovar Typhi
ggcggcgaaaugccuuauccg

SEQ ID NO: 3659967 - RNA, 20 nt, Salmonella enterica enterica serovar Typhi
ggcggcgacuggcuaaacaa

SEQ ID NO: 3659968 - RNA, 23 nt, Salmonella enterica enterica serovar Typhi
ggcggcgcgaacgccuuauccgg

SEQ ID NO: 3659969 - RNA, 14 nt, Salmonella enterica enterica serovar Typhi
ggcggcgcgcaggc

SEQ ID NO: 3659970 - RNA, 14 nt, Salmonella enterica enterica serovar Typhi
ggcggcgcgcugcc

SEQ ID NO: 3659971 - RNA, 14 nt, Salmonella enterica enterica serovar Typhi
ggcggcggcgggaa

SEQ ID NO: 3659972 - RNA, 11 nt, Salmonella enterica enterica serovar Typhi
ggcggcgggaa

SEQ ID NO: 3659973 - RNA, 14 nt, Salmonella enterica enterica serovar Typhi
ggcggcguaaacac

SEQ ID NO: 3659974 - RNA, 14 nt, Salmonella enterica enterica serovar Typhi
ggcggcguccggca

SEQ ID NO: 3659975 - RNA, 23 nt, Salmonella enterica enterica serovar Typhi
ggcggcgugaccgccuuauccgg

SEQ ID NO: 3659976 - RNA, 14 nt, Salmonella enterica enterica serovar Typhi
ggcggcgugcgccc

SEQ ID NO: 3659977 - RNA, 15 nt, Salmonella enterica enterica serovar Typhi
ggcggcguuuuccgg

SEQ ID NO: 3659978 - RNA, 20 nt, Salmonella enterica enterica serovar Typhi
ggcggcuacgccuuauccgg

SEQ ID NO: 3659979 - RNA, 19 nt, Salmonella enterica enterica serovar Typhi
ggcggcugcgccuuauccg

SEQ ID NO: 3659980 - RNA, 20 nt, Salmonella enterica enterica serovar Typhi
ggcggcugcgccuuauccgg

SEQ ID NO: 3659981 - RNA, 20 nt, Salmonella enterica enterica serovar Typhi
ggcggcuucgccuuauccgg

SEQ ID NO: 3659982 - RNA, 14 nt, Salmonella enterica enterica serovar Typhi
ggcggcuuggcugu

SEQ ID NO: 3659983 - RNA, 15 nt, Salmonella enterica enterica serovar Typhi
ggcggcuuuacccgg

SEQ ID NO: 3659984 - RNA, 19 nt, Salmonella enterica enterica serovar Typhi
ggcgggauacucggcacca

SEQ ID NO: 3659985 - RNA, 15 nt, Salmonella enterica enterica serovar Typhi
ggcgggaucggggcg

SEQ ID NO: 3659986 - RNA, 17 nt, Salmonella enterica enterica serovar Typhi
ggcgggcagcagcaggc

SEQ ID NO: 3659987 - RNA, 20 nt, Salmonella enterica enterica serovar Typhi
ggcgggcagcagcaggcugg

SEQ ID NO: 3659988 - RNA, 20 nt, Salmonella enterica enterica serovar Typhi
ggcgggcgauagagaccgcu

SEQ ID NO: 3659989 - RNA, 16 nt, Salmonella enterica enterica serovar Typhi
ggcgggcgucaccguc

SEQ ID NO: 3659990 - RNA, 15 nt, Salmonella enterica enterica serovar Typhi
ggcgggugccgggaa

SEQ ID NO: 3659991 - RNA, 18 nt, Salmonella enterica enterica serovar Typhi
ggcgggugcgcagcccca

SEQ ID NO: 3659992 - RNA, 20 nt, Salmonella enterica enterica serovar Typhi
ggcgguaaauacgcggcacg

SEQ ID NO: 3659993 - RNA, 15 nt, Salmonella enterica enterica serovar Typhi
ggcgguauuauccgc

SEQ ID NO: 3659994 - RNA, 13 nt, Salmonella enterica enterica serovar Typhi
ggcggucagccag

SEQ ID NO: 3659995 - RNA, 23 nt, Salmonella enterica enterica serovar Typhi
ggcggucagcuuuucagcccagg

SEQ ID NO: 3659996 - RNA, 20 nt, Salmonella enterica enterica serovar Typhi
ggcggugaagacgacgggaa

SEQ ID NO: 3659997 - RNA, 18 nt, Salmonella enterica enterica serovar Typhi
ggcggugauuuaaggcug

SEQ ID NO: 3659998 - RNA, 12 nt, Salmonella enterica enterica serovar Typhi
ggcgguuauccg

SEQ ID NO: 3659999 - RNA, 18 nt, Salmonella enterica enterica serovar Typhi
ggcgguuauccgccagcg

SEQ ID NO: 3660000 - RNA, 19 nt, Salmonella enterica enterica serovar Typhi
ggcgguucauccugcgcca

SEQ ID NO: 3660001 - RNA, 22 nt, Salmonella enterica enterica serovar Typhi
ggcgguucccgggcgcucgcuu

SEQ ID NO: 3660002 - RNA, 18 nt, Salmonella enterica enterica serovar Typhi
ggcgguuugacggcugca

SEQ ID NO: 3660003 - RNA, 17 nt, Salmonella enterica enterica serovar Typhi
ggcguaaaaaggcgcau

SEQ ID NO: 3660004 - RNA, 13 nt, Salmonella enterica enterica serovar Typhi
ggcguaaaacugg

SEQ ID NO: 3660005 - RNA, 18 nt, Salmonella enterica enterica serovar Typhi
ggcuguagccagccugaa

SEQ ID NO: 3660006 - RNA, 11 nt, Salmonella enterica enterica serovar Typhi
ggcuguauaca

SEQ ID NO: 3660007 - RNA, 21 nt, Salmonella enterica enterica serovar Typhi
ggcuguccuugcgccaucggc

SEQ ID NO: 3660008 - RNA, 18 nt, Salmonella enterica enterica serovar Typhi
ggcugucggcagaaccug

SEQ ID NO: 3660009 - RNA, 12 nt, Salmonella enterica enterica serovar Typhi
ggcuguggcugu

SEQ ID NO: 3660010 - RNA, 15 nt, Salmonella enterica enterica serovar Typhi
ggcugugggcguguc

SEQ ID NO: 3660011 - RNA, 15 nt, Salmonella enterica enterica serovar Typhi
ggcuguguucauccc

SEQ ID NO: 3660012 - RNA, 18 nt, Salmonella enterica enterica serovar Typhi
ggcuuaacacccggauau

SEQ ID NO: 3660013 - RNA, 13 nt, Salmonella enterica enterica serovar Typhi
ggcuuaccugcuc

SEQ ID NO: 3660014 - RNA, 16 nt, Salmonella enterica enterica serovar Typhi
ggcuuaccuucggccu

SEQ ID NO: 3660015 - RNA, 15 nt, Salmonella enterica enterica serovar Typhi
ggcuuagcgccagau

SEQ ID NO: 3660016 - RNA, 14 nt, Salmonella enterica enterica serovar Typhi
ggcuuauaccgaca

SEQ ID NO: 3660017 - RNA, 16 nt, Salmonella enterica enterica serovar Typhi
ggcuucaaccuccugc

SEQ ID NO: 3660018 - RNA, 22 nt, Salmonella enterica enterica serovar Typhi
ggcuucaaucgucguuccgcca

SEQ ID NO: 3660019 - RNA, 22 nt, Salmonella enterica enterica serovar Typhi
ggcuuccaguugaaaaccacaa

SEQ ID NO: 3660020 - RNA, 23 nt, Salmonella enterica enterica serovar Typhi
ggcuuccauugcagaauauguuc

SEQ ID NO: 3660021 - RNA, 19 nt, Salmonella enterica enterica serovar Typhi
ggcuuccggcacuuucaga

SEQ ID NO: 3660022 - RNA, 16 nt, Salmonella enterica enterica serovar Typhi
ggcuucgauuacagga

SEQ ID NO: 3660023 - RNA, 20 nt, Salmonella enterica enterica serovar Typhi
ggcuucgccuuauccggccu

SEQ ID NO: 3660024 - RNA, 22 nt, Salmonella enterica enterica serovar Typhi
ggcuucguuaagcgguuuucaa

SEQ ID NO: 3660025 - RNA, 22 nt, Salmonella enterica enterica serovar Typhi
ggcuucugcugugcauaaauaa

SEQ ID NO: 3660026 - RNA, 20 nt, Salmonella enterica enterica serovar Typhi
ggcuugaguuuuccgccauu

SEQ ID NO: 3660027 - RNA, 17 nt, Salmonella enterica enterica serovar Typhi
ggcuugaucgcgcagca

SEQ ID NO: 3660028 - RNA, 20 nt, Salmonella enterica enterica serovar Typhi
ggcuugaucgcgcagcaaau

SEQ ID NO: 3660029 - RNA, 15 nt, Salmonella enterica enterica serovar Typhi
ggcuugcaggauguc

SEQ ID NO: 3660030 - RNA, 19 nt, Salmonella enterica enterica serovar Typhi
ggcuuuacgaccgcagaaa

SEQ ID NO: 3660031 - RNA, 13 nt, Salmonella enterica enterica serovar Typhi
ggcuuuauauaaa

SEQ ID NO: 3660032 - RNA, 23 nt, Salmonella enterica enterica serovar Typhi
ggcuuuauccugaccgcuccagu

SEQ ID NO: 3660033 - RNA, 21 nt, Salmonella enterica enterica serovar Typhi
ggcuuucacaccguuauccgg

SEQ ID NO: 3660034 - RNA, 11 nt, Salmonella enterica enterica serovar Typhi
ggcuuucacgc

SEQ ID NO: 3660035 - RNA, 15 nt, Salmonella enterica enterica serovar Typhi
ggcuuucauccaaua

SEQ ID NO: 3660036 - RNA, 11 nt, Salmonella enterica enterica serovar Typhi
ggcuuuccagc

SEQ ID NO: 3660037 - RNA, 22 nt, Salmonella enterica enterica serovar Typhi
ggcuuucccguuucagccccuu

SEQ ID NO: 3660038 - RNA, 12 nt, Salmonella enterica enterica serovar Typhi
ggcuuuuuucuc

SEQ ID NO: 3660039 - RNA, 18 nt, Salmonella enterica enterica serovar Typhi
ggcuuuuuucuccaguug

SEQ ID NO: 3660040 - RNA, 20 nt, Salmonella enterica enterica serovar Typhi
ggcuuuuuuuuaugccucuu

SEQ ID NO: 3660041 - RNA, 12 nt, Salmonella enterica enterica serovar Typhi
gggaaaagaagu

SEQ ID NO: 3660042 - RNA, 17 nt, Salmonella enterica enterica serovar Typhi
gggaaaccauguugauc

SEQ ID NO: 3660043 - RNA, 22 nt, Salmonella enterica enterica serovar Typhi
gggaaacgcuauuuaacccugg

SEQ ID NO: 3660044 - RNA, 15 nt, Salmonella enterica enterica serovar Typhi
gggaaagccccuacc

SEQ ID NO: 3660045 - RNA, 19 nt, Salmonella enterica enterica serovar Typhi
gggaaaucucccuggcagu

SEQ ID NO: 3660046 - RNA, 13 nt, Salmonella enterica enterica serovar Typhi
gggaacacucuaa

SEQ ID NO: 3660047 - RNA, 16 nt, Salmonella enterica enterica serovar Typhi
gggaacaugcauauua

SEQ ID NO: 3660048 - RNA, 22 nt, Salmonella enterica enterica serovar Typhi
gggaagacuauuaccaccguua

SEQ ID NO: 3660049 - RNA, 24 nt, Salmonella enterica enterica serovar Typhi
gggaagaucauuaucaauagcuuc

SEQ ID NO: 3660050 - RNA, 16 nt, Salmonella enterica enterica serovar Typhi
gggaagaugugccacu

SEQ ID NO: 3660051 - RNA, 22 nt, Salmonella enterica enterica serovar Typhi
gggaagaugugccacuccgcca

SEQ ID NO: 3660052 - RNA, 13 nt, Salmonella enterica enterica serovar Typhi
gggaagcuacgau

SEQ ID NO: 3660053 - RNA, 23 nt, Salmonella enterica enterica serovar Typhi
gggaaggggauucuccggcgcgg

SEQ ID NO: 3660054 - RNA, 17 nt, Salmonella enterica enterica serovar Typhi
gggacgcugcgcggcga

SEQ ID NO: 3660055 - RNA, 13 nt, Salmonella enterica enterica serovar Typhi
gggacgcugcuga

SEQ ID NO: 3660056 - RNA, 16 nt, Salmonella enterica enterica serovar Typhi
gggacggcggccagca

SEQ ID NO: 3660057 - RNA, 22 nt, Salmonella enterica enterica serovar Typhi
gggacuucaggcauccagaccc

SEQ ID NO: 3660058 - RNA, 22 nt, Salmonella enterica enterica serovar Typhi
gggagacuucuucagucagggc

SEQ ID NO: 3660059 - RNA, 16 nt, Salmonella enterica enterica serovar Typhi
gggaggcggcgagcgg

SEQ ID NO: 3660060 - RNA, 15 nt, Salmonella enterica enterica serovar Typhi
gggaggugcuggugg

SEQ ID NO: 3660061 - RNA, 19 nt, Salmonella enterica enterica serovar Typhi
gggauaaagaucuuuacgc

SEQ ID NO: 3660062 - RNA, 13 nt, Salmonella enterica enterica serovar Typhi
gggauauaaaauu

SEQ ID NO: 3660063 - RNA, 19 nt, Salmonella enterica enterica serovar Typhi
gggauaucuuccgggcggg

SEQ ID NO: 3660064 - RNA, 16 nt, Salmonella enterica enterica serovar Typhi
gggaucgguuuauccc

SEQ ID NO: 3660065 - RNA, 21 nt, Salmonella enterica enterica serovar Typhi
gggaucguucugcugauaaua

SEQ ID NO: 3660066 - RNA, 18 nt, Salmonella enterica enterica serovar Typhi
gggaucuuaucuuucagc

SEQ ID NO: 3660067 - RNA, 19 nt, Salmonella enterica enterica serovar Typhi
gggaucuuccugcgcgcca

SEQ ID NO: 3660068 - RNA, 15 nt, Salmonella enterica enterica serovar Typhi
gggaucuuuuucagc

SEQ ID NO: 3660069 - RNA, 16 nt, Salmonella enterica enterica serovar Typhi
gggaugguuaaauuca

SEQ ID NO: 3660070 - RNA, 17 nt, Salmonella enterica enterica serovar Typhi
gggauguugccacaggc

SEQ ID NO: 3660071 - RNA, 16 nt, Salmonella enterica enterica serovar Typhi
gggauuaucaggauga

SEQ ID NO: 3660072 - RNA, 24 nt, Salmonella enterica enterica serovar Typhi
gggcaacccggcuaaaugacgcgc

SEQ ID NO: 3660073 - RNA, 20 nt, Salmonella enterica enterica serovar Typhi
gggcaauccauuaauggcgc

SEQ ID NO: 3660074 - RNA, 20 nt, Salmonella enterica enterica serovar Typhi
gggcagaaacguaccugaga

SEQ ID NO: 3660075 - RNA, 20 nt, Salmonella enterica enterica serovar Typhi
gggcagacauucgcgcacgg

SEQ ID NO: 3660076 - RNA, 14 nt, Salmonella enterica enterica serovar Typhi
gggcagacuuucug

SEQ ID NO: 3660077 - RNA, 16 nt, Salmonella enterica enterica serovar Typhi
gggcagcagcaggcug

SEQ ID NO: 3660078 - RNA, 11 nt, Salmonella enterica enterica serovar Typhi
gggcagcaucu

SEQ ID NO: 3660079 - RNA, 14 nt, Salmonella enterica enterica serovar Typhi
gggcagcgagcacc

SEQ ID NO: 3660080 - RNA, 16 nt, Salmonella enterica enterica serovar Typhi
gggcauaaaugguacu

SEQ ID NO: 3660081 - RNA, 15 nt, Salmonella enterica enterica serovar Typhi
gggcauggcucuccg

SEQ ID NO: 3660082 - RNA, 17 nt, Salmonella enterica enterica serovar Typhi
gggcauuuuccggcgac

SEQ ID NO: 3660083 - RNA, 15 nt, Salmonella enterica enterica serovar Typhi
gggccagcagccagg

SEQ ID NO: 3660084 - RNA, 17 nt, Salmonella enterica enterica serovar Typhi
gggccagcagcgcauca

SEQ ID NO: 3660085 - RNA, 17 nt, Salmonella enterica enterica serovar Typhi
gggccagcucuuuucug

SEQ ID NO: 3660086 - RNA, 24 nt, Salmonella enterica enterica serovar Typhi
gggccaguuuccugacccgcucgu

SEQ ID NO: 3660087 - RNA, 20 nt, Salmonella enterica enterica serovar Typhi
gggccauacacucaaccaac

SEQ ID NO: 3660088 - RNA, 15 nt, Salmonella enterica enterica serovar Typhi
gggccauucgccaua

SEQ ID NO: 3660089 - RNA, 14 nt, Salmonella enterica enterica serovar Typhi
gggccgccgcagca

SEQ ID NO: 3660090 - RNA, 16 nt, Salmonella enterica enterica serovar Typhi
gggccgggccugagcg

SEQ ID NO: 3660091 - RNA, 12 nt, Salmonella enterica enterica serovar Typhi
ggguuuuccggu

SEQ ID NO: 3660092 - RNA, 18 nt, Salmonella enterica enterica serovar Typhi
ggguuuucuaccgcagcc

SEQ ID NO: 3660093 - RNA, 12 nt, Salmonella enterica enterica serovar Typhi
gguaaaauccuu

SEQ ID NO: 3660094 - RNA, 16 nt, Salmonella enterica enterica serovar Typhi
gguaaacacgacgcug

SEQ ID NO: 3660095 - RNA, 15 nt, Salmonella enterica enterica serovar Typhi
gguaaaccaggccag

SEQ ID NO: 3660096 - RNA, 15 nt, Salmonella enterica enterica serovar Typhi
gguaaacgcgccauc

SEQ ID NO: 3660097 - RNA, 21 nt, Salmonella enterica enterica serovar Typhi
gguaaacgcuccggcaggcaa

SEQ ID NO: 3660098 - RNA, 12 nt, Salmonella enterica enterica serovar Typhi
gguaaacgugcu

SEQ ID NO: 3660099 - RNA, 17 nt, Salmonella enterica enterica serovar Typhi
gguaaacucacccaggc

SEQ ID NO: 3660100 - RNA, 21 nt, Salmonella enterica enterica serovar Typhi
gguaaacucacccaggcgaug

SEQ ID NO: 3660101 - RNA, 14 nt, Salmonella enterica enterica serovar Typhi
gguaaauccacaac

SEQ ID NO: 3660102 - RNA, 14 nt, Salmonella enterica enterica serovar Typhi
gguaacgcgaaaaa

SEQ ID NO: 3660103 - RNA, 22 nt, Salmonella enterica enterica serovar Typhi
gguaagacguuuaugccgccau

SEQ ID NO: 3660104 - RNA, 23 nt, Salmonella enterica enterica serovar Typhi
gguaagacguuuaugccgccauc

SEQ ID NO: 3660105 - RNA, 13 nt, Salmonella enterica enterica serovar Typhi
gguaagauguucu

SEQ ID NO: 3660106 - RNA, 17 nt, Salmonella enterica enterica serovar Typhi
gguaagcgcagcgccau

SEQ ID NO: 3660107 - RNA, 13 nt, Salmonella enterica enterica serovar Typhi
gguaaguugaaag

SEQ ID NO: 3660108 - RNA, 19 nt, Salmonella enterica enterica serovar Typhi
gguaauaacugacagacuc

SEQ ID NO: 3660109 - RNA, 18 nt, Salmonella enterica enterica serovar Typhi
gguaaucacugccgccac

SEQ ID NO: 3660110 - RNA, 15 nt, Salmonella enterica enterica serovar Typhi
gguaaucagacuggc

SEQ ID NO: 3660111 - RNA, 15 nt, Salmonella enterica enterica serovar Typhi
gguaaugacuuuuaa

SEQ ID NO: 3660112 - RNA, 16 nt, Salmonella enterica enterica serovar Typhi
gguaauggcgacugug

SEQ ID NO: 3660113 - RNA, 16 nt, Salmonella enterica enterica serovar Typhi
gguaaugucauccagc

SEQ ID NO: 3660114 - RNA, 17 nt, Salmonella enterica enterica serovar Typhi
gguaauuaaaggcagcg

SEQ ID NO: 3660115 - RNA, 16 nt, Salmonella enterica enterica serovar Typhi
gguaauuagaucggca

SEQ ID NO: 3660116 - RNA, 17 nt, Salmonella enterica enterica serovar Typhi
gguaauuagaucggcaa

SEQ ID NO: 3660117 - RNA, 19 nt, Salmonella enterica enterica serovar Typhi
gguaauucaauuucaauga

SEQ ID NO: 3660118 - RNA, 16 nt, Salmonella enterica enterica serovar Typhi
gguaauuugcgccauc

SEQ ID NO: 3660119 - RNA, 21 nt, Salmonella enterica enterica serovar Typhi
gguaauuuucaccuccgggug

SEQ ID NO: 3660120 - RNA, 20 nt, Salmonella enterica enterica serovar Typhi
gguaauuuugccaucgcgca

SEQ ID NO: 3660121 - RNA, 22 nt, Salmonella enterica enterica serovar Typhi
gguacacaaucaaggcagcgaa

SEQ ID NO: 3660122 - RNA, 19 nt, Salmonella enterica enterica serovar Typhi
gguacaccaggaguuaaac

SEQ ID NO: 3660123 - RNA, 14 nt, Salmonella enterica enterica serovar Typhi
gguacaggccgccg

SEQ ID NO: 3660124 - RNA, 17 nt, Salmonella enterica enterica serovar Typhi
gguacaggccgccgccu

SEQ ID NO: 3660125 - RNA, 17 nt, Salmonella enterica enterica serovar Typhi
gguacauccaugccauc

SEQ ID NO: 3660126 - RNA, 14 nt, Salmonella enterica enterica serovar Typhi
gguaccccagccau

SEQ ID NO: 3660127 - RNA, 13 nt, Salmonella enterica enterica serovar Typhi
gguacgcuccagg

SEQ ID NO: 3660128 - RNA, 15 nt, Salmonella enterica enterica serovar Typhi
gguacggccagcgcg

SEQ ID NO: 3660129 - RNA, 15 nt, Salmonella enterica enterica serovar Typhi
gguacucaacaucau

SEQ ID NO: 3660130 - RNA, 21 nt, Salmonella enterica enterica serovar Typhi
gguacucgucccgauauaaag

SEQ ID NO: 3660131 - RNA, 23 nt, Salmonella enterica enterica serovar Typhi
gguacucuuccagcugcucuccu

SEQ ID NO: 3660132 - RNA, 16 nt, Salmonella enterica enterica serovar Typhi
gguacuggagaccggc

SEQ ID NO: 3660133 - RNA, 23 nt, Salmonella enterica enterica serovar Typhi
gguacuugacgucgccauaucca

SEQ ID NO: 3660134 - RNA, 15 nt, Salmonella enterica enterica serovar Typhi
gguagacgcaccaga

SEQ ID NO: 3660135 - RNA, 16 nt, Salmonella enterica enterica serovar Typhi
gguagagcaucgcggc

SEQ ID NO: 3660136 - RNA, 12 nt, Salmonella enterica enterica serovar Typhi
gguagaggcgcc

SEQ ID NO: 3660137 - RNA, 12 nt, Salmonella enterica enterica serovar Typhi
gguagcagaccg

SEQ ID NO: 3660138 - RNA, 23 nt, Salmonella enterica enterica serovar Typhi
gguagcccggacaaggcgcgcca

SEQ ID NO: 3660139 - RNA, 21 nt, Salmonella enterica enterica serovar Typhi
gguagcgcuuguuaucuggca

SEQ ID NO: 3660140 - RNA, 21 nt, Salmonella enterica enterica serovar Typhi
gguagcgucagguagcccggc

SEQ ID NO: 3660141 - RNA, 15 nt, Salmonella enterica enterica serovar Typhi
gguagcguuauccag

SEQ ID NO: 3660142 - RNA, 19 nt, Salmonella enterica enterica serovar Typhi
gguaggguuaugauuucag

SEQ ID NO: 3660143 - RNA, 21 nt, Salmonella enterica enterica serovar Typhi
gguagucaaauuccagcaaug

SEQ ID NO: 3660144 - RNA, 14 nt, Salmonella enterica enterica serovar Typhi
gguagucacggaga

SEQ ID NO: 3660145 - RNA, 21 nt, Salmonella enterica enterica serovar Typhi
gguaguccgccagcaccugau

SEQ ID NO: 3660146 - RNA, 15 nt, Salmonella enterica enterica serovar Typhi
gguaguccugcucau

SEQ ID NO: 3660147 - RNA, 21 nt, Salmonella enterica enterica serovar Typhi
gguauaaauuuccgcagccag

SEQ ID NO: 3660148 - RNA, 15 nt, Salmonella enterica enterica serovar Typhi
gguauaggccaggcu

SEQ ID NO: 3660149 - RNA, 20 nt, Salmonella enterica enterica serovar Typhi
gguaucauuaugggcagcac

SEQ ID NO: 3660150 - RNA, 16 nt, Salmonella enterica enterica serovar Typhi
gguauccagauagcga

SEQ ID NO: 3660151 - RNA, 14 nt, Salmonella enterica enterica serovar Typhi
gguauccagcagaa

SEQ ID NO: 3660152 - RNA, 12 nt, Salmonella enterica enterica serovar Typhi
gguauccuccug

SEQ ID NO: 3660153 - RNA, 12 nt, Salmonella enterica enterica serovar Typhi
gguaugaaacau

SEQ ID NO: 3660154 - RNA, 16 nt, Salmonella enterica enterica serovar Typhi
gguaugaaacauauau

SEQ ID NO: 3660155 - RNA, 12 nt, Salmonella enterica enterica serovar Typhi
gguauuaacagg

SEQ ID NO: 3660156 - RNA, 21 nt, Salmonella enterica enterica serovar Typhi
gguauuagcaccguuucugaa

SEQ ID NO: 3660157 - RNA, 14 nt, Salmonella enterica enterica serovar Typhi
gguauuauccgccg

SEQ ID NO: 3660158 - RNA, 21 nt, Salmonella enterica enterica serovar Typhi
gguauucaacgccaucuuccu

SEQ ID NO: 3660159 - RNA, 18 nt, Salmonella enterica enterica serovar Typhi
gguauucaccaaaaggca

SEQ ID NO: 3660160 - RNA, 19 nt, Salmonella enterica enterica serovar Typhi
gguauucgcggccagauaa

SEQ ID NO: 3660161 - RNA, 19 nt, Salmonella enterica enterica serovar Typhi
gguauucguuaccagcauc

SEQ ID NO: 3660162 - RNA, 15 nt, Salmonella enterica enterica serovar Typhi
gguauugcuuucaau

SEQ ID NO: 3660163 - RNA, 15 nt, Salmonella enterica enterica serovar Typhi
gguauuuauccagca

SEQ ID NO: 3660164 - RNA, 17 nt, Salmonella enterica enterica serovar Typhi
gguauuuauccagcagg

SEQ ID NO: 3660165 - RNA, 18 nt, Salmonella enterica enterica serovar Typhi
gguauuucugaaaaaccg

SEQ ID NO: 3660166 - RNA, 19 nt, Salmonella enterica enterica serovar Typhi
ggucaaaaaagcgacgcug

SEQ ID NO: 3660167 - RNA, 21 nt, Salmonella enterica enterica serovar Typhi
ggucaaacaccugaaccagcg

SEQ ID NO: 3660168 - RNA, 19 nt, Salmonella enterica enterica serovar Typhi
ggucaaaugcgaaaaaaag

SEQ ID NO: 3660169 - RNA, 17 nt, Salmonella enterica enterica serovar Typhi
ggucaacgcgccgccaa

SEQ ID NO: 3660170 - RNA, 16 nt, Salmonella enterica enterica serovar Typhi
ggucaauacaucacgc

SEQ ID NO: 3660171 - RNA, 19 nt, Salmonella enterica enterica serovar Typhi
ggucacaaaggccagcagc

SEQ ID NO: 3660172 - RNA, 20 nt, Salmonella enterica enterica serovar Typhi
ggucacaaaggccagcagca

SEQ ID NO: 3660173 - RNA, 23 nt, Salmonella enterica enterica serovar Typhi
ggucacacuuaccgggcaucuga

SEQ ID NO: 3660174 - RNA, 21 nt, Salmonella enterica enterica serovar Typhi
ggucacaucgcccugauggcg

SEQ ID NO: 3660175 - RNA, 12 nt, Salmonella enterica enterica serovar Typhi
ggucagauccuu

SEQ ID NO: 3660176 - RNA, 21 nt, Salmonella enterica enterica serovar Typhi
ggucagcauuucauccauuaa

SEQ ID NO: 3660177 - RNA, 19 nt, Salmonella enterica enterica serovar Typhi
gguggggcuaagugagcau

SEQ ID NO: 3660178 - RNA, 17 nt, Salmonella enterica enterica serovar Typhi
ggugggguucccgagcg

SEQ ID NO: 3660179 - RNA, 15 nt, Salmonella enterica enterica serovar Typhi
ggugggugaugacgg

SEQ ID NO: 3660180 - RNA, 20 nt, Salmonella enterica enterica serovar Typhi
gguggucaucgcggccagca

SEQ ID NO: 3660181 - RNA, 14 nt, Salmonella enterica enterica serovar Typhi
gguggugggcggca

SEQ ID NO: 3660182 - RNA, 16 nt, Salmonella enterica enterica serovar Typhi
gguguagcucauaacu

SEQ ID NO: 3660183 - RNA, 14 nt, Salmonella enterica enterica serovar Typhi
ggugucaaagcgcc

SEQ ID NO: 3660184 - RNA, 12 nt, Salmonella enterica enterica serovar Typhi
gguguccagaug

SEQ ID NO: 3660185 - RNA, 15 nt, Salmonella enterica enterica serovar Typhi
ggugugccugcgcuu

SEQ ID NO: 3660186 - RNA, 18 nt, Salmonella enterica enterica serovar Typhi
gguguuuacgccgccauc

SEQ ID NO: 3660187 - RNA, 16 nt, Salmonella enterica enterica serovar Typhi
gguguuugcggcacac

SEQ ID NO: 3660188 - RNA, 18 nt, Salmonella enterica enterica serovar Typhi
gguuaaaaacagccagca

SEQ ID NO: 3660189 - RNA, 21 nt, Salmonella enterica enterica serovar Typhi
gguuaaacacauccggcggcg

SEQ ID NO: 3660190 - RNA, 23 nt, Salmonella enterica enterica serovar Typhi
gguuaaagcccugacagaaauag

SEQ ID NO: 3660191 - RNA, 17 nt, Salmonella enterica enterica serovar Typhi
gguuaaauagcaggcaa

SEQ ID NO: 3660192 - RNA, 23 nt, Salmonella enterica enterica serovar Typhi
gguuaaauuaaauaacaaaugaa

SEQ ID NO: 3660193 - RNA, 12 nt, Salmonella enterica enterica serovar Typhi
gguuaacucuuu

SEQ ID NO: 3660194 - RNA, 13 nt, Salmonella enterica enterica serovar Typhi
gguuaaggaugua

SEQ ID NO: 3660195 - RNA, 13 nt, Salmonella enterica enterica serovar Typhi
gguuaauggcagc

SEQ ID NO: 3660196 - RNA, 15 nt, Salmonella enterica enterica serovar Typhi
gguuacaacccgacc

SEQ ID NO: 3660197 - RNA, 20 nt, Salmonella enterica enterica serovar Typhi
gguuacaacugcgaggucac

SEQ ID NO: 3660198 - RNA, 17 nt, Salmonella enterica enterica serovar Typhi
gguuacaggugccuggg

SEQ ID NO: 3660199 - RNA, 17 nt, Salmonella enterica enterica serovar Typhi
gguuacuauuuuucacc

SEQ ID NO: 3660200 - RNA, 22 nt, Salmonella enterica enterica serovar Typhi
gguuauaaacccccuggccgga

SEQ ID NO: 3660201 - RNA, 20 nt, Salmonella enterica enterica serovar Typhi
gguuauacaguucaggaucg

SEQ ID NO: 3660202 - RNA, 14 nt, Salmonella enterica enterica serovar Typhi
gguuauccagcagg

SEQ ID NO: 3660203 - RNA, 19 nt, Salmonella enterica enterica serovar Typhi
gguucaaccgaaagaagaa

SEQ ID NO: 3660204 - RNA, 19 nt, Salmonella enterica enterica serovar Typhi
gguucaauacccuuuucuu

SEQ ID NO: 3660205 - RNA, 18 nt, Salmonella enterica enterica serovar Typhi
gguucaauaugccaggca

SEQ ID NO: 3660206 - RNA, 16 nt, Salmonella enterica enterica serovar Typhi
gguucaccaccaccca

SEQ ID NO: 3660207 - RNA, 21 nt, Salmonella enterica enterica serovar Typhi
gguucaccaccacccagugcc

SEQ ID NO: 3660208 - RNA, 13 nt, Salmonella enterica enterica serovar Typhi
gguucauccagca

SEQ ID NO: 3660209 - RNA, 18 nt, Salmonella enterica enterica serovar Typhi
gguucccugcgccaggcc

SEQ ID NO: 3660210 - RNA, 22 nt, Salmonella enterica enterica serovar Typhi
gguuccguucccaaugcuuucg

SEQ ID NO: 3660211 - RNA, 21 nt, Salmonella enterica enterica serovar Typhi
gguucgaacgacagaauaugc

SEQ ID NO: 3660212 - RNA, 19 nt, Salmonella enterica enterica serovar Typhi
gguucgcgaagugucuucc

SEQ ID NO: 3660213 - RNA, 13 nt, Salmonella enterica enterica serovar Typhi
gguucucccggca

SEQ ID NO: 3660214 - RNA, 14 nt, Salmonella enterica enterica serovar Typhi
gguucugccagaac

SEQ ID NO: 3660215 - RNA, 12 nt, Salmonella enterica enterica serovar Typhi
gguugacgcugc

SEQ ID NO: 3660216 - RNA, 18 nt, Salmonella enterica enterica serovar Typhi
gguugacuuacaaaaaau

SEQ ID NO: 3660217 - RNA, 16 nt, Salmonella enterica enterica serovar Typhi
gguugcaauuccgcca

SEQ ID NO: 3660218 - RNA, 15 nt, Salmonella enterica enterica serovar Typhi
gguugcccgcaggcu

SEQ ID NO: 3660219 - RNA, 17 nt, Salmonella enterica enterica serovar Typhi
gguugcccgcaggcuuc

SEQ ID NO: 3660220 - RNA, 23 nt, Salmonella enterica enterica serovar Typhi
gguugcccgguggcgcugcgcuu

SEQ ID NO: 3660221 - RNA, 14 nt, Salmonella enterica enterica serovar Typhi
gguugcgcaaccuc

SEQ ID NO: 3660222 - RNA, 23 nt, Salmonella enterica enterica serovar Typhi
gguugcggcggggauaaucagca

SEQ ID NO: 3660223 - RNA, 13 nt, Salmonella enterica enterica serovar Typhi
gguuggccagcau

SEQ ID NO: 3660224 - RNA, 19 nt, Salmonella enterica enterica serovar Typhi
gguuggcgacauacgcgcu

SEQ ID NO: 3660225 - RNA, 20 nt, Salmonella enterica enterica serovar Typhi
gguugucaaaaaaucagcaa

SEQ ID NO: 3660226 - RNA, 15 nt, Salmonella enterica enterica serovar Typhi
gguugucucaaaaaa

SEQ ID NO: 3660227 - RNA, 22 nt, Salmonella enterica enterica serovar Typhi
gguuuaccauuacgcuauaaag

SEQ ID NO: 3660228 - RNA, 10 nt, Salmonella enterica enterica serovar Typhi
gguuuauccc

SEQ ID NO: 3660229 - RNA, 18 nt, Salmonella enterica enterica serovar Typhi
gguuucaccauuaagcaa

SEQ ID NO: 3660230 - RNA, 13 nt, Salmonella enterica enterica serovar Typhi
gguuucccaguca

SEQ ID NO: 3660231 - RNA, 18 nt, Salmonella enterica enterica serovar Typhi
gguuucgauagcaggcac

SEQ ID NO: 3660232 - RNA, 20 nt, Salmonella enterica enterica serovar Typhi
gguuucugaauagaaagucg

SEQ ID NO: 3660233 - RNA, 15 nt, Salmonella enterica enterica serovar Typhi
gguuucuggcaacag

SEQ ID NO: 3660234 - RNA, 15 nt, Salmonella enterica enterica serovar Typhi
gguuugaccagauaa

SEQ ID NO: 3660235 - RNA, 14 nt, Salmonella enterica enterica serovar Typhi
gguuugcagcagag

SEQ ID NO: 3660236 - RNA, 17 nt, Salmonella enterica enterica serovar Typhi
gguuuggacuaccggua

SEQ ID NO: 3660237 - RNA, 15 nt, Salmonella enterica enterica serovar Typhi
gguuuuuuuacucug

SEQ ID NO: 3660238 - RNA, 19 nt, Salmonella enterica enterica serovar Typhi
gguuuuuuuauaacauaaa

SEQ ID NO: 3660239 - RNA, 21 nt, Salmonella enterica enterica serovar Typhi
gguuuuuuuguaucugcgcag

SEQ ID NO: 3660240 - RNA, 12 nt, Salmonella enterica enterica serovar Typhi
guaaaaagcuga

SEQ ID NO: 3660241 - RNA, 16 nt, Salmonella enterica enterica serovar Typhi
guaaaaccgacuauca

SEQ ID NO: 3660242 - RNA, 13 nt, Salmonella enterica enterica serovar Typhi
guaaaaccggcac

SEQ ID NO: 3660243 - RNA, 12 nt, Salmonella enterica enterica serovar Typhi
guaaaacgcugg

SEQ ID NO: 3660244 - RNA, 20 nt, Salmonella enterica enterica serovar Typhi
guaaaacuggcuaucgccgu

SEQ ID NO: 3660245 - RNA, 15 nt, Salmonella enterica enterica serovar Typhi
guaaaaucaacagca

SEQ ID NO: 3660246 - RNA, 16 nt, Salmonella enterica enterica serovar Typhi
guaaaaucaacagcaa

SEQ ID NO: 3660247 - RNA, 12 nt, Salmonella enterica enterica serovar Typhi
guaaaaucagcg

SEQ ID NO: 3660248 - RNA, 21 nt, Salmonella enterica enterica serovar Typhi
guaaaauccggcaggcagccg

SEQ ID NO: 3660249 - RNA, 14 nt, Salmonella enterica enterica serovar Typhi
guaaaauuagacaa

SEQ ID NO: 3660250 - RNA, 21 nt, Salmonella enterica enterica serovar Typhi
guaaacaauggaacuaucaau

SEQ ID NO: 3660251 - RNA, 16 nt, Salmonella enterica enterica serovar Typhi
guaaacacucaggcag

SEQ ID NO: 3660252 - RNA, 13 nt, Salmonella enterica enterica serovar Typhi
guaaacagaugcu

SEQ ID NO: 3660253 - RNA, 14 nt, Salmonella enterica enterica serovar Typhi
guaaaccaggccag

SEQ ID NO: 3660254 - RNA, 19 nt, Salmonella enterica enterica serovar Typhi
guaaaccauuucuccugca

SEQ ID NO: 3660255 - RNA, 21 nt, Salmonella enterica enterica serovar Typhi
guaaacccgauucugccaguu

SEQ ID NO: 3660256 - RNA, 21 nt, Salmonella enterica enterica serovar Typhi
guaaaccucuuuggcgcgaac

SEQ ID NO: 3660257 - RNA, 16 nt, Salmonella enterica enterica serovar Typhi
guaaacgccugcacca

SEQ ID NO: 3660258 - RNA, 12 nt, Salmonella enterica enterica serovar Typhi
guaaacgcgcca

SEQ ID NO: 3660259 - RNA, 15 nt, Salmonella enterica enterica serovar Typhi
guaaacgcgccaucg

SEQ ID NO: 3660260 - RNA, 15 nt, Salmonella enterica enterica serovar Typhi
guaaacggaaccaaa

SEQ ID NO: 3660261 - RNA, 12 nt, Salmonella enterica enterica serovar Typhi
guaaacgugcca

SEQ ID NO: 3660262 - RNA, 16 nt, Salmonella enterica enterica serovar Typhi
guaaacguuccugcca

SEQ ID NO: 3660263 - RNA, 21 nt, Salmonella enterica enterica serovar Typhi
guaauaaggcggguugcugau

SEQ ID NO: 3660264 - RNA, 15 nt, Salmonella enterica enterica serovar Typhi
guaauacaggguuug

SEQ ID NO: 3660265 - RNA, 19 nt, Salmonella enterica enterica serovar Typhi
guaauagucugcucgucgg

SEQ ID NO: 3660266 - RNA, 18 nt, Salmonella enterica enterica serovar Typhi
guaauauaaucuaccauu

SEQ ID NO: 3660267 - RNA, 17 nt, Salmonella enterica enterica serovar Typhi
guaauaugaauauccgc

SEQ ID NO: 3660268 - RNA, 23 nt, Salmonella enterica enterica serovar Typhi
guaaucaaacauacgccuuuacc

SEQ ID NO: 3660269 - RNA, 11 nt, Salmonella enterica enterica serovar Typhi
guaauccggca

SEQ ID NO: 3660270 - RNA, 20 nt, Salmonella enterica enterica serovar Typhi
guaaucgaucccgccgcauc

SEQ ID NO: 3660271 - RNA, 13 nt, Salmonella enterica enterica serovar Typhi
guaaucgccguau

SEQ ID NO: 3660272 - RNA, 20 nt, Salmonella enterica enterica serovar Typhi
guaaucggccuguuggccuu

SEQ ID NO: 3660273 - RNA, 17 nt, Salmonella enterica enterica serovar Typhi
guaaucuuccacccgcg

SEQ ID NO: 3660274 - RNA, 16 nt, Salmonella enterica enterica serovar Typhi
guaaucuuuucauauu

SEQ ID NO: 3660275 - RNA, 16 nt, Salmonella enterica enterica serovar Typhi
guaaugaacaccagca

SEQ ID NO: 3660276 - RNA, 19 nt, Salmonella enterica enterica serovar Typhi
guaaugaccacaccgucaa

SEQ ID NO: 3660277 - RNA, 19 nt, Salmonella enterica enterica serovar Typhi
guaaugagcacuuuccaca

SEQ ID NO: 3660278 - RNA, 20 nt, Salmonella enterica enterica serovar Typhi
guaaugaucagaacucacau

SEQ ID NO: 3660279 - RNA, 18 nt, Salmonella enterica enterica serovar Typhi
guaaugcgccaggcagca

SEQ ID NO: 3660280 - RNA, 19 nt, Salmonella enterica enterica serovar Typhi
guaaugcgccaggcagcac

SEQ ID NO: 3660281 - RNA, 15 nt, Salmonella enterica enterica serovar Typhi
guaauggcauaacgc

SEQ ID NO: 3660282 - RNA, 13 nt, Salmonella enterica enterica serovar Typhi
guaauggccuaca

SEQ ID NO: 3660283 - RNA, 20 nt, Salmonella enterica enterica serovar Typhi
guaauggcgggaaaagguuu

SEQ ID NO: 3660284 - RNA, 21 nt, Salmonella enterica enterica serovar Typhi
guaauggcgggaaaagguuuc

SEQ ID NO: 3660285 - RNA, 18 nt, Salmonella enterica enterica serovar Typhi
guaaugucuggugcagca

SEQ ID NO: 3660286 - RNA, 21 nt, Salmonella enterica enterica serovar Typhi
guaauguuuucugccagcaga

SEQ ID NO: 3660287 - RNA, 18 nt, Salmonella enterica enterica serovar Typhi
guaauuaaggauugccgc

SEQ ID NO: 3660288 - RNA, 19 nt, Salmonella enterica enterica serovar Typhi
guaauuaaggauugccgcc

SEQ ID NO: 3660289 - RNA, 15 nt, Salmonella enterica enterica serovar Typhi
guaauucagcucgcu

SEQ ID NO: 3660290 - RNA, 16 nt, Salmonella enterica enterica serovar Typhi
guaauucucacagaau

SEQ ID NO: 3660291 - RNA, 22 nt, Salmonella enterica enterica serovar Typhi
guaauucucacagaaucaucag

SEQ ID NO: 3660292 - RNA, 18 nt, Salmonella enterica enterica serovar Typhi
guaauucucccaaauuuu

SEQ ID NO: 3660293 - RNA, 17 nt, Salmonella enterica enterica serovar Typhi
guaauuucauagaccgc

SEQ ID NO: 3660294 - RNA, 14 nt, Salmonella enterica enterica serovar Typhi
guaauuugcuuucu

SEQ ID NO: 3660295 - RNA, 11 nt, Salmonella enterica enterica serovar Typhi
guaauuuucac

SEQ ID NO: 3660296 - RNA, 14 nt, Salmonella enterica enterica serovar Typhi
guaauuuuucuccc

SEQ ID NO: 3660297 - RNA, 17 nt, Salmonella enterica enterica serovar Typhi
guaauuuuucucccagc

SEQ ID NO: 3660298 - RNA, 21 nt, Salmonella enterica enterica serovar Typhi
guacaaacaaauaaauccaug

SEQ ID NO: 3660299 - RNA, 17 nt, Salmonella enterica enterica serovar Typhi
guacacauaugggaaga

SEQ ID NO: 3660300 - RNA, 20 nt, Salmonella enterica enterica serovar Typhi
guacacuucagccagacgcu

SEQ ID NO: 3660301 - RNA, 23 nt, Salmonella enterica enterica serovar Typhi
guacacuucauccggcguugcgc

SEQ ID NO: 3660302 - RNA, 21 nt, Salmonella enterica enterica serovar Typhi
guacagacaucaucgaacgcc

SEQ ID NO: 3660303 - RNA, 16 nt, Salmonella enterica enterica serovar Typhi
guacaggccgccgccu

SEQ ID NO: 3660304 - RNA, 23 nt, Salmonella enterica enterica serovar Typhi
guacauauacugucuuguggaac

SEQ ID NO: 3660305 - RNA, 16 nt, Salmonella enterica enterica serovar Typhi
guacaucgcgcugacc

SEQ ID NO: 3660306 - RNA, 18 nt, Salmonella enterica enterica serovar Typhi
guacaucuacuucagcac

SEQ ID NO: 3660307 - RNA, 13 nt, Salmonella enterica enterica serovar Typhi
guacaugaauaau

SEQ ID NO: 3660308 - RNA, 17 nt, Salmonella enterica enterica serovar Typhi
guacaugccauccggcg

SEQ ID NO: 3660309 - RNA, 20 nt, Salmonella enterica enterica serovar Typhi
guacauguccagaucuucac

SEQ ID NO: 3660310 - RNA, 16 nt, Salmonella enterica enterica serovar Typhi
guacauuauugcacau

SEQ ID NO: 3660311 - RNA, 17 nt, Salmonella enterica enterica serovar Typhi
guaccaaaacagaaaag

SEQ ID NO: 3660312 - RNA, 12 nt, Salmonella enterica enterica serovar Typhi
guaccaaacagc

SEQ ID NO: 3660313 - RNA, 15 nt, Salmonella enterica enterica serovar Typhi
guaccaauacccagc

SEQ ID NO: 3660314 - RNA, 20 nt, Salmonella enterica enterica serovar Typhi
guaccaccacgcccuucacg

SEQ ID NO: 3660315 - RNA, 15 nt, Salmonella enterica enterica serovar Typhi
guaccacgccgcaca

SEQ ID NO: 3660316 - RNA, 18 nt, Salmonella enterica enterica serovar Typhi
guaccacgccgcacacag

SEQ ID NO: 3660317 - RNA, 18 nt, Salmonella enterica enterica serovar Typhi
guaccagaaugcccugcu

SEQ ID NO: 3660318 - RNA, 15 nt, Salmonella enterica enterica serovar Typhi
guaccagcagcgcca

SEQ ID NO: 3660319 - RNA, 16 nt, Salmonella enterica enterica serovar Typhi
guaccagcgcccgagc

SEQ ID NO: 3660320 - RNA, 14 nt, Salmonella enterica enterica serovar Typhi
guaccagcgcgaac

SEQ ID NO: 3660321 - RNA, 22 nt, Salmonella enterica enterica serovar Typhi
guaccauaccggugcgccccag

SEQ ID NO: 3660322 - RNA, 18 nt, Salmonella enterica enterica serovar Typhi
guaccauugucaaaaaua

SEQ ID NO: 3660323 - RNA, 12 nt, Salmonella enterica enterica serovar Typhi
guacccaacgca

SEQ ID NO: 3660324 - RNA, 17 nt, Salmonella enterica enterica serovar Typhi
guacccgcaggccuggc

SEQ ID NO: 3660325 - RNA, 15 nt, Salmonella enterica enterica serovar Typhi
guacccgccgcuggc

SEQ ID NO: 3660326 - RNA, 17 nt, Salmonella enterica enterica serovar Typhi
guacccucuacauuuuc

SEQ ID NO: 3660327 - RNA, 16 nt, Salmonella enterica enterica serovar Typhi
guaccgaacagccagg

SEQ ID NO: 3660328 - RNA, 21 nt, Salmonella enterica enterica serovar Typhi
guaccgaagaacauaaacagc

SEQ ID NO: 3660329 - RNA, 23 nt, Salmonella enterica enterica serovar Typhi
guaccgauuguuuggugcugaaa

SEQ ID NO: 3660330 - RNA, 16 nt, Salmonella enterica enterica serovar Typhi
guaccgccgccgggcc

SEQ ID NO: 3660331 - RNA, 17 nt, Salmonella enterica enterica serovar Typhi
guaccgcuacgcaggcc

SEQ ID NO: 3660332 - RNA, 18 nt, Salmonella enterica enterica serovar Typhi
guaccgcuacgcaggcca

SEQ ID NO: 3660333 - RNA, 22 nt, Salmonella enterica enterica serovar Typhi
guaccgcuacgcaggccauuuc

SEQ ID NO: 3660334 - RNA, 19 nt, Salmonella enterica enterica serovar Typhi
guaccgcuaucgccaaacu

SEQ ID NO: 3660335 - RNA, 15 nt, Salmonella enterica enterica serovar Typhi
guaccggauuuagcg

SEQ ID NO: 3660336 - RNA, 14 nt, Salmonella enterica enterica serovar Typhi
guaccggcaaccgg

SEQ ID NO: 3660337 - RNA, 13 nt, Salmonella enterica enterica serovar Typhi
guaccgggcagac

SEQ ID NO: 3660338 - RNA, 21 nt, Salmonella enterica enterica serovar Typhi
guaccgggccuccuuuccugu

SEQ ID NO: 3660339 - RNA, 18 nt, Salmonella enterica enterica serovar Typhi
guaccucuugcuggguua

SEQ ID NO: 3660340 - RNA, 20 nt, Salmonella enterica enterica serovar Typhi
guaccugcggcaauggcuca

SEQ ID NO: 3660341 - RNA, 20 nt, Salmonella enterica enterica serovar Typhi
guaccuuuaucuugaccuga

SEQ ID NO: 3660342 - RNA, 22 nt, Salmonella enterica enterica serovar Typhi
guaccuuucucuuucccaggcc

SEQ ID NO: 3660343 - RNA, 16 nt, Salmonella enterica enterica serovar Typhi
guacgcagcaggcaga

SEQ ID NO: 3660344 - RNA, 16 nt, Salmonella enterica enterica serovar Typhi
guacgccaaguacgcc

SEQ ID NO: 3660345 - RNA, 21 nt, Salmonella enterica enterica serovar Typhi
guacgcccgugacgccaggca

SEQ ID NO: 3660346 - RNA, 18 nt, Salmonella enterica enterica serovar Typhi
guacgccgccauccggca

SEQ ID NO: 3660347 - RNA, 16 nt, Salmonella enterica enterica serovar Typhi
guacgccugucgcaac

SEQ ID NO: 3660348 - RNA, 20 nt, Salmonella enterica enterica serovar Typhi
guaggucgcgaauagcuuuu

SEQ ID NO: 3660349 - RNA, 18 nt, Salmonella enterica enterica serovar Typhi
guaguaaccccaguagcc

SEQ ID NO: 3660350 - RNA, 18 nt, Salmonella enterica enterica serovar Typhi
guaguacaugccauccgg

SEQ ID NO: 3660351 - RNA, 17 nt, Salmonella enterica enterica serovar Typhi
guagucucccuccugcu

SEQ ID NO: 3660352 - RNA, 17 nt, Salmonella enterica enterica serovar Typhi
guagucuuacacuuagc

SEQ ID NO: 3660353 - RNA, 19 nt, Salmonella enterica enterica serovar Typhi
guagugcuucucuucaaac

SEQ ID NO: 3660354 - RNA, 20 nt, Salmonella enterica enterica serovar Typhi
guaguguuuaagcgucaggc

SEQ ID NO: 3660355 - RNA, 15 nt, Salmonella enterica enterica serovar Typhi
guaguuaaaaaaggu

SEQ ID NO: 3660356 - RNA, 14 nt, Salmonella enterica enterica serovar Typhi
guaguuuauucauc

SEQ ID NO: 3660357 - RNA, 21 nt, Salmonella enterica enterica serovar Typhi
guauaaaaccccuuguuauuc

SEQ ID NO: 3660358 - RNA, 19 nt, Salmonella enterica enterica serovar Typhi
guauaaaauggcaaagucg

SEQ ID NO: 3660359 - RNA, 10 nt, Salmonella enterica enterica serovar Typhi
guauaaagcu

SEQ ID NO: 3660360 - RNA, 18 nt, Salmonella enterica enterica serovar Typhi
guauaaauuuccgcagcc

SEQ ID NO: 3660361 - RNA, 21 nt, Salmonella enterica enterica serovar Typhi
guauaaauuuccgcagccaga

SEQ ID NO: 3660362 - RNA, 14 nt, Salmonella enterica enterica serovar Typhi
guauacacuuucca

SEQ ID NO: 3660363 - RNA, 23 nt, Salmonella enterica enterica serovar Typhi
guauacauacauaccacgcagcg

SEQ ID NO: 3660364 - RNA, 19 nt, Salmonella enterica enterica serovar Typhi
guauagaauacuuccugcu

SEQ ID NO: 3660365 - RNA, 21 nt, Salmonella enterica enterica serovar Typhi
guauagcggcguuuauauaaa

SEQ ID NO: 3660366 - RNA, 13 nt, Salmonella enterica enterica serovar Typhi
guauaggaaaaug

SEQ ID NO: 3660367 - RNA, 16 nt, Salmonella enterica enterica serovar Typhi
guauaguggcgacaaa

SEQ ID NO: 3660368 - RNA, 20 nt, Salmonella enterica enterica serovar Typhi
guauaucuuucuuaucccac

SEQ ID NO: 3660369 - RNA, 15 nt, Salmonella enterica enterica serovar Typhi
guauaugaauauacg

SEQ ID NO: 3660370 - RNA, 15 nt, Salmonella enterica enterica serovar Typhi
guaucacaaucagcc

SEQ ID NO: 3660371 - RNA, 16 nt, Salmonella enterica enterica serovar Typhi
guaucacugaagagag

SEQ ID NO: 3660372 - RNA, 18 nt, Salmonella enterica enterica serovar Typhi
guaucacugauauaaccc

SEQ ID NO: 3660373 - RNA, 23 nt, Salmonella enterica enterica serovar Typhi
guaucauaucaauauguuccggc

SEQ ID NO: 3660374 - RNA, 18 nt, Salmonella enterica enterica serovar Typhi
guaucaucagauccugcg

SEQ ID NO: 3660375 - RNA, 15 nt, Salmonella enterica enterica serovar Typhi
guauccagcaacagu

SEQ ID NO: 3660376 - RNA, 16 nt, Salmonella enterica enterica serovar Typhi
guauccagcaacagug

SEQ ID NO: 3660377 - RNA, 21 nt, Salmonella enterica enterica serovar Typhi
guauccauucucaucagaccg

SEQ ID NO: 3660378 - RNA, 12 nt, Salmonella enterica enterica serovar Typhi
guaucccaaacg

SEQ ID NO: 3660379 - RNA, 19 nt, Salmonella enterica enterica serovar Typhi
guauccccagucuuccugc

SEQ ID NO: 3660380 - RNA, 12 nt, Salmonella enterica enterica serovar Typhi
guaucccgccag

SEQ ID NO: 3660381 - RNA, 16 nt, Salmonella enterica enterica serovar Typhi
guaucccgccagcggc

SEQ ID NO: 3660382 - RNA, 16 nt, Salmonella enterica enterica serovar Typhi
guauccggucaauaca

SEQ ID NO: 3660383 - RNA, 15 nt, Salmonella enterica enterica serovar Typhi
guauccguacuuucu

SEQ ID NO: 3660384 - RNA, 19 nt, Salmonella enterica enterica serovar Typhi
guauccuaaugccacggcu

SEQ ID NO: 3660385 - RNA, 16 nt, Salmonella enterica enterica serovar Typhi
guaucgcgacagcgcu

SEQ ID NO: 3660386 - RNA, 15 nt, Salmonella enterica enterica serovar Typhi
guaucgcgccgccaa

SEQ ID NO: 3660387 - RNA, 13 nt, Salmonella enterica enterica serovar Typhi
guaucgcucugcu

SEQ ID NO: 3660388 - RNA, 21 nt, Salmonella enterica enterica serovar Typhi
guaucgcugucggucagauuc

SEQ ID NO: 3660389 - RNA, 18 nt, Salmonella enterica enterica serovar Typhi
guaucguguuauuuucaa

SEQ ID NO: 3660390 - RNA, 22 nt, Salmonella enterica enterica serovar Typhi
guaucguuugcccaucauucaa

SEQ ID NO: 3660391 - RNA, 13 nt, Salmonella enterica enterica serovar Typhi
guaucuuccagcg

SEQ ID NO: 3660392 - RNA, 22 nt, Salmonella enterica enterica serovar Typhi
guaucuucgccguauucuuacc

SEQ ID NO: 3660393 - RNA, 17 nt, Salmonella enterica enterica serovar Typhi
guaugacguggccagca

SEQ ID NO: 3660394 - RNA, 20 nt, Salmonella enterica enterica serovar Typhi
guaugauuuucuuauuacaa

SEQ ID NO: 3660395 - RNA, 16 nt, Salmonella enterica enterica serovar Typhi
guaugcaccguuauuc

SEQ ID NO: 3660396 - RNA, 14 nt, Salmonella enterica enterica serovar Typhi
guaugcagccaggc

SEQ ID NO: 3660397 - RNA, 13 nt, Salmonella enterica enterica serovar Typhi
guaugccuuccag

SEQ ID NO: 3660398 - RNA, 15 nt, Salmonella enterica enterica serovar Typhi
guaugguggcggggu

SEQ ID NO: 3660399 - RNA, 19 nt, Salmonella enterica enterica serovar Typhi
guauguuaggguagaaaaa

SEQ ID NO: 3660400 - RNA, 17 nt, Salmonella enterica enterica serovar Typhi
guauuaacgcuuugcca

SEQ ID NO: 3660401 - RNA, 20 nt, Salmonella enterica enterica serovar Typhi
guauuacaaguaauaaaaua

SEQ ID NO: 3660402 - RNA, 21 nt, Salmonella enterica enterica serovar Typhi
guauuacaaguaauaaaauaa

SEQ ID NO: 3660403 - RNA, 22 nt, Salmonella enterica enterica serovar Typhi
guauuacaaguaauaaaauaau

SEQ ID NO: 3660404 - RNA, 23 nt, Salmonella enterica enterica serovar Typhi
guauuacaugccguuaauaaugu

SEQ ID NO: 3660405 - RNA, 19 nt, Salmonella enterica enterica serovar Typhi
guauuaccgcucguuaauc

SEQ ID NO: 3660406 - RNA, 15 nt, Salmonella enterica enterica serovar Typhi
guauucauaccuuua

SEQ ID NO: 3660407 - RNA, 17 nt, Salmonella enterica enterica serovar Typhi
guauuccguuccuucuu

SEQ ID NO: 3660408 - RNA, 16 nt, Salmonella enterica enterica serovar Typhi
guauucggaauaaugu

SEQ ID NO: 3660409 - RNA, 16 nt, Salmonella enterica enterica serovar Typhi
guauucggcuuaccca

SEQ ID NO: 3660410 - RNA, 14 nt, Salmonella enterica enterica serovar Typhi
guauucguuaccag

SEQ ID NO: 3660411 - RNA, 13 nt, Salmonella enterica enterica serovar Typhi
guauucuaacuga

SEQ ID NO: 3660412 - RNA, 14 nt, Salmonella enterica enterica serovar Typhi
guauucuuacccac

SEQ ID NO: 3660413 - RNA, 14 nt, Salmonella enterica enterica serovar Typhi
guauugaagcgaua

SEQ ID NO: 3660414 - RNA, 16 nt, Salmonella enterica enterica serovar Typhi
guauugauuuuuaaaa

SEQ ID NO: 3660415 - RNA, 14 nt, Salmonella enterica enterica serovar Typhi
guauugcaccuggg

SEQ ID NO: 3660416 - RNA, 15 nt, Salmonella enterica enterica serovar Typhi
guauugcaccuggga

SEQ ID NO: 3660417 - RNA, 22 nt, Salmonella enterica enterica serovar Typhi
guauugcuuucaauuuccgcac

SEQ ID NO: 3660418 - RNA, 12 nt, Salmonella enterica enterica serovar Typhi
guauugugcuua

SEQ ID NO: 3660419 - RNA, 13 nt, Salmonella enterica enterica serovar Typhi
guauuuauccagc

SEQ ID NO: 3660420 - RNA, 17 nt, Salmonella enterica enterica serovar Typhi
guauuuccauuuuucag

SEQ ID NO: 3660421 - RNA, 23 nt, Salmonella enterica enterica serovar Typhi
guauuucgacuuucuucggauua

SEQ ID NO: 3660422 - RNA, 18 nt, Salmonella enterica enterica serovar Typhi
guauuucgcagcggucag

SEQ ID NO: 3660423 - RNA, 11 nt, Salmonella enterica enterica serovar Typhi
guauuuuauuu

SEQ ID NO: 3660424 - RNA, 16 nt, Salmonella enterica enterica serovar Typhi
guauuuuauuuuucaa

SEQ ID NO: 3660425 - RNA, 16 nt, Salmonella enterica enterica serovar Typhi
guauuuuuuagcgcca

SEQ ID NO: 3660426 - RNA, 18 nt, Salmonella enterica enterica serovar Typhi
gucaaaaaaucagcaauc

SEQ ID NO: 3660427 - RNA, 22 nt, Salmonella enterica enterica serovar Typhi
gucaaaacuuauuuuauuuuua

SEQ ID NO: 3660428 - RNA, 12 nt, Salmonella enterica enterica serovar Typhi
gucaaaagcugc

SEQ ID NO: 3660429 - RNA, 19 nt, Salmonella enterica enterica serovar Typhi
gucaaacaccugaaccagc

SEQ ID NO: 3660430 - RNA, 18 nt, Salmonella enterica enterica serovar Typhi
gucaaacaucgcgcucca

SEQ ID NO: 3660431 - RNA, 16 nt, Salmonella enterica enterica serovar Typhi
gucaaacuuuuauaaa

SEQ ID NO: 3660432 - RNA, 12 nt, Salmonella enterica enterica serovar Typhi
gucaaagcgcca

SEQ ID NO: 3660433 - RNA, 18 nt, Salmonella enterica enterica serovar Typhi
gucaaauuaagaaaguag

SEQ ID NO: 3660434 - RNA, 13 nt, Salmonella enterica enterica serovar Typhi
gucauaauuaaaa

SEQ ID NO: 3660435 - RNA, 23 nt, Salmonella enterica enterica serovar Typhi
gucauacuucaaguugcaggugu

SEQ ID NO: 3660436 - RNA, 22 nt, Salmonella enterica enterica serovar Typhi
gucauagcaaugauuagggaca

SEQ ID NO: 3660437 - RNA, 19 nt, Salmonella enterica enterica serovar Typhi
gucauagucggcgccaaag

SEQ ID NO: 3660438 - RNA, 19 nt, Salmonella enterica enterica serovar Typhi
gucauaucgaugguaauaa

SEQ ID NO: 3660439 - RNA, 20 nt, Salmonella enterica enterica serovar Typhi
gucauaucugaugcucgccg

SEQ ID NO: 3660440 - RNA, 20 nt, Salmonella enterica enterica serovar Typhi
gucaucaaaaucaucgccac

SEQ ID NO: 3660441 - RNA, 16 nt, Salmonella enterica enterica serovar Typhi
gucaucaccuccagca

SEQ ID NO: 3660442 - RNA, 22 nt, Salmonella enterica enterica serovar Typhi
gucaucaggcgguguuguuuua

SEQ ID NO: 3660443 - RNA, 13 nt, Salmonella enterica enterica serovar Typhi
gucaucauaauuc

SEQ ID NO: 3660444 - RNA, 18 nt, Salmonella enterica enterica serovar Typhi
gucaucauuacaggcgaa

SEQ ID NO: 3660445 - RNA, 17 nt, Salmonella enterica enterica serovar Typhi
gucaucccgaaccuggu

SEQ ID NO: 3660446 - RNA, 11 nt, Salmonella enterica enterica serovar Typhi
gucauccgcgu

SEQ ID NO: 3660447 - RNA, 16 nt, Salmonella enterica enterica serovar Typhi
gucauccggcaagcgc

SEQ ID NO: 3660448 - RNA, 16 nt, Salmonella enterica enterica serovar Typhi
gucauccgguucaccc

SEQ ID NO: 3660449 - RNA, 17 nt, Salmonella enterica enterica serovar Typhi
gucauccgguucaccca

SEQ ID NO: 3660450 - RNA, 19 nt, Salmonella enterica enterica serovar Typhi
gucauccgguucauaaucc

SEQ ID NO: 3660451 - RNA, 18 nt, Salmonella enterica enterica serovar Typhi
gucauccugcaggcggca

SEQ ID NO: 3660452 - RNA, 12 nt, Salmonella enterica enterica serovar Typhi
gucauccuuccc

SEQ ID NO: 3660453 - RNA, 16 nt, Salmonella enterica enterica serovar Typhi
gucaucgcaaauucug

SEQ ID NO: 3660454 - RNA, 23 nt, Salmonella enterica enterica serovar Typhi
gucaucgcggaaagcaaugucgc

SEQ ID NO: 3660455 - RNA, 24 nt, Salmonella enterica enterica serovar Typhi
gucaucgcuucuauuaccgcagcg

SEQ ID NO: 3660456 - RNA, 13 nt, Salmonella enterica enterica serovar Typhi
gucaucggcguug

SEQ ID NO: 3660457 - RNA, 18 nt, Salmonella enterica enterica serovar Typhi
gucaucggcuuuuuucaa

SEQ ID NO: 3660458 - RNA, 21 nt, Salmonella enterica enterica serovar Typhi
gucaucggcuuuuuucaacca

SEQ ID NO: 3660459 - RNA, 14 nt, Salmonella enterica enterica serovar Typhi
gucaucugccaguu

SEQ ID NO: 3660460 - RNA, 22 nt, Salmonella enterica enterica serovar Typhi
gucaugaaaagcuauauuuaua

SEQ ID NO: 3660461 - RNA, 18 nt, Salmonella enterica enterica serovar Typhi
gucaugauguuugucuuu

SEQ ID NO: 3660462 - RNA, 23 nt, Salmonella enterica enterica serovar Typhi
gucaugauguuugucuuuuccag

SEQ ID NO: 3660463 - RNA, 17 nt, Salmonella enterica enterica serovar Typhi
gucaugcgggagcuugg

SEQ ID NO: 3660464 - RNA, 18 nt, Salmonella enterica enterica serovar Typhi
gucaugcuggcgaugagu

SEQ ID NO: 3660465 - RNA, 22 nt, Salmonella enterica enterica serovar Typhi
gucaugcuucaccucagcaaaa

SEQ ID NO: 3660466 - RNA, 13 nt, Salmonella enterica enterica serovar Typhi
gucauggcaaacg

SEQ ID NO: 3660467 - RNA, 17 nt, Salmonella enterica enterica serovar Typhi
gucauggcuuagcgcca

SEQ ID NO: 3660468 - RNA, 13 nt, Salmonella enterica enterica serovar Typhi
gucaugguaaaac

SEQ ID NO: 3660469 - RNA, 15 nt, Salmonella enterica enterica serovar Typhi
gucauguccagggca

SEQ ID NO: 3660470 - RNA, 23 nt, Salmonella enterica enterica serovar Typhi
gucauguccagggcauucauugu

SEQ ID NO: 3660471 - RNA, 20 nt, Salmonella enterica enterica serovar Typhi
gucauuaacgggaaacuguu

SEQ ID NO: 3660472 - RNA, 20 nt, Salmonella enterica enterica serovar Typhi
gucauuaauucccgcagcca

SEQ ID NO: 3660473 - RNA, 17 nt, Salmonella enterica enterica serovar Typhi
gucauugaccggaaaaa

SEQ ID NO: 3660474 - RNA, 13 nt, Salmonella enterica enterica serovar Typhi
gucauugagccgc

SEQ ID NO: 3660475 - RNA, 14 nt, Salmonella enterica enterica serovar Typhi
gucauuuauuuucg

SEQ ID NO: 3660476 - RNA, 18 nt, Salmonella enterica enterica serovar Typhi
gucauuugaaucugcggu

SEQ ID NO: 3660477 - RNA, 17 nt, Salmonella enterica enterica serovar Typhi
gucauuuucuuucauca

SEQ ID NO: 3660478 - RNA, 13 nt, Salmonella enterica enterica serovar Typhi
gucauuuuuucaa

SEQ ID NO: 3660479 - RNA, 23 nt, Salmonella enterica enterica serovar Typhi
guccaacaaggauauccgccagu

SEQ ID NO: 3660480 - RNA, 20 nt, Salmonella enterica enterica serovar Typhi
guccaacuggcuuucaucca

SEQ ID NO: 3660481 - RNA, 16 nt, Salmonella enterica enterica serovar Typhi
guccacacaggccugc

SEQ ID NO: 3660482 - RNA, 17 nt, Salmonella enterica enterica serovar Typhi
guccacaccguuacgac

SEQ ID NO: 3660483 - RNA, 21 nt, Salmonella enterica enterica serovar Typhi
guccacauccagcgccagcgc

SEQ ID NO: 3660484 - RNA, 15 nt, Salmonella enterica enterica serovar Typhi
guccacgacaauauc

SEQ ID NO: 3660485 - RNA, 16 nt, Salmonella enterica enterica serovar Typhi
guccacgcgagcugcc

SEQ ID NO: 3660486 - RNA, 22 nt, Salmonella enterica enterica serovar Typhi
guccagaggaucuggacgccaa

SEQ ID NO: 3660487 - RNA, 16 nt, Salmonella enterica enterica serovar Typhi
guccagccggugguuc

SEQ ID NO: 3660488 - RNA, 15 nt, Salmonella enterica enterica serovar Typhi
guccagcgcggguuc

SEQ ID NO: 3660489 - RNA, 22 nt, Salmonella enterica enterica serovar Typhi
guccaggccugauaagcacagg

SEQ ID NO: 3660490 - RNA, 16 nt, Salmonella enterica enterica serovar Typhi
guccaguucguucugc

SEQ ID NO: 3660491 - RNA, 19 nt, Salmonella enterica enterica serovar Typhi
guccauauucaguuuuacg

SEQ ID NO: 3660492 - RNA, 15 nt, Salmonella enterica enterica serovar Typhi
guccaucagauucaa

SEQ ID NO: 3660493 - RNA, 21 nt, Salmonella enterica enterica serovar Typhi
guccaucaggcuuugcgccau

SEQ ID NO: 3660494 - RNA, 21 nt, Salmonella enterica enterica serovar Typhi
guccauuacucucauguucaa

SEQ ID NO: 3660495 - RNA, 14 nt, Salmonella enterica enterica serovar Typhi
guccauuuuccuau

SEQ ID NO: 3660496 - RNA, 16 nt, Salmonella enterica enterica serovar Typhi
guccauuuuuuaucug

SEQ ID NO: 3660497 - RNA, 22 nt, Salmonella enterica enterica serovar Typhi
gucccagccccacauuggaaaa

SEQ ID NO: 3660498 - RNA, 12 nt, Salmonella enterica enterica serovar Typhi
gucccagccuuc

SEQ ID NO: 3660499 - RNA, 21 nt, Salmonella enterica enterica serovar Typhi
gucccaggauaguacugacca

SEQ ID NO: 3660500 - RNA, 12 nt, Salmonella enterica enterica serovar Typhi
gucccaggccag

SEQ ID NO: 3660501 - RNA, 16 nt, Salmonella enterica enterica serovar Typhi
gucccaggccagaugc

SEQ ID NO: 3660502 - RNA, 19 nt, Salmonella enterica enterica serovar Typhi
gucccaguaauaucgccuc

SEQ ID NO: 3660503 - RNA, 23 nt, Salmonella enterica enterica serovar Typhi
gucccaucguaacgccgucgaca

SEQ ID NO: 3660504 - RNA, 19 nt, Salmonella enterica enterica serovar Typhi
guccccagcguaccacgcc

SEQ ID NO: 3660505 - RNA, 18 nt, Salmonella enterica enterica serovar Typhi
guccccauaucccgcgcc

SEQ ID NO: 3660506 - RNA, 15 nt, Salmonella enterica enterica serovar Typhi
guccccuuuucaccc

SEQ ID NO: 3660507 - RNA, 13 nt, Salmonella enterica enterica serovar Typhi
gucccggcagugc

SEQ ID NO: 3660508 - RNA, 18 nt, Salmonella enterica enterica serovar Typhi
gucccggcagugcauaaa

SEQ ID NO: 3660509 - RNA, 17 nt, Salmonella enterica enterica serovar Typhi
gucccucuccagggcaa

SEQ ID NO: 3660510 - RNA, 14 nt, Salmonella enterica enterica serovar Typhi
gucccugaagaaaa

SEQ ID NO: 3660511 - RNA, 19 nt, Salmonella enterica enterica serovar Typhi
gucccugauguagcugggu

SEQ ID NO: 3660512 - RNA, 20 nt, Salmonella enterica enterica serovar Typhi
guccgcaaagacaacgacca

SEQ ID NO: 3660513 - RNA, 17 nt, Salmonella enterica enterica serovar Typhi
guccgccuaccagcaca

SEQ ID NO: 3660514 - RNA, 21 nt, Salmonella enterica enterica serovar Typhi
guccgccuaccagcacaugau

SEQ ID NO: 3660515 - RNA, 18 nt, Salmonella enterica enterica serovar Typhi
guccgcguugguuaaggc

SEQ ID NO: 3660516 - RNA, 18 nt, Salmonella enterica enterica serovar Typhi
guccgcuggcguccagcc

SEQ ID NO: 3660517 - RNA, 15 nt, Salmonella enterica enterica serovar Typhi
guccggaucucgcca

SEQ ID NO: 3660518 - RNA, 14 nt, Salmonella enterica enterica serovar Typhi
guccggauucgcgg

SEQ ID NO: 3660519 - RNA, 22 nt, Salmonella enterica enterica serovar Typhi
gucgcucuuuuuuuugcuuaaa

SEQ ID NO: 3660520 - RNA, 20 nt, Salmonella enterica enterica serovar Typhi
gucgcugcgcucaucaggcc

SEQ ID NO: 3660521 - RNA, 15 nt, Salmonella enterica enterica serovar Typhi
gucgcuggcggaauc

SEQ ID NO: 3660522 - RNA, 18 nt, Salmonella enterica enterica serovar Typhi
gucgcuucgcuuaucugg

SEQ ID NO: 3660523 - RNA, 22 nt, Salmonella enterica enterica serovar Typhi
gucgcuuuuugcgccagcgcca

SEQ ID NO: 3660524 - RNA, 22 nt, Salmonella enterica enterica serovar Typhi
gucggaaaucuguuccagcgag

SEQ ID NO: 3660525 - RNA, 14 nt, Salmonella enterica enterica serovar Typhi
gucggacagcgaca

SEQ ID NO: 3660526 - RNA, 17 nt, Salmonella enterica enterica serovar Typhi
gucggcaaucaccugca

SEQ ID NO: 3660527 - RNA, 23 nt, Salmonella enterica enterica serovar Typhi
gucggcaauuaacauuucacgau

SEQ ID NO: 3660528 - RNA, 19 nt, Salmonella enterica enterica serovar Typhi
gucggcaccgaauguuccg

SEQ ID NO: 3660529 - RNA, 13 nt, Salmonella enterica enterica serovar Typhi
gucggcagacugg

SEQ ID NO: 3660530 - RNA, 15 nt, Salmonella enterica enterica serovar Typhi
gucggcagcaccgga

SEQ ID NO: 3660531 - RNA, 12 nt, Salmonella enterica enterica serovar Typhi
gucggcagcgag

SEQ ID NO: 3660532 - RNA, 20 nt, Salmonella enterica enterica serovar Typhi
gucggcaucgugaaacucac

SEQ ID NO: 3660533 - RNA, 17 nt, Salmonella enterica enterica serovar Typhi
gucggccaggugccgag

SEQ ID NO: 3660534 - RNA, 18 nt, Salmonella enterica enterica serovar Typhi
gucggcgcaguucgccgc

SEQ ID NO: 3660535 - RNA, 18 nt, Salmonella enterica enterica serovar Typhi
gucggcgcccagcuuacg

SEQ ID NO: 3660536 - RNA, 20 nt, Salmonella enterica enterica serovar Typhi
gucggcgucugcgcgcuggu

SEQ ID NO: 3660537 - RNA, 21 nt, Salmonella enterica enterica serovar Typhi
gucggcguugcgcccaggcca

SEQ ID NO: 3660538 - RNA, 20 nt, Salmonella enterica enterica serovar Typhi
gucgggaaagggcggcagcg

SEQ ID NO: 3660539 - RNA, 15 nt, Salmonella enterica enterica serovar Typhi
gucgggaacgcuguc

SEQ ID NO: 3660540 - RNA, 23 nt, Salmonella enterica enterica serovar Typhi
gucgggaagagagaaaaucggcg

SEQ ID NO: 3660541 - RNA, 22 nt, Salmonella enterica enterica serovar Typhi
gucgggcagaaagugggucaca

SEQ ID NO: 3660542 - RNA, 17 nt, Salmonella enterica enterica serovar Typhi
gucgggccgcgcugcgc

SEQ ID NO: 3660543 - RNA, 16 nt, Salmonella enterica enterica serovar Typhi
gucgggugcagcguca

SEQ ID NO: 3660544 - RNA, 23 nt, Salmonella enterica enterica serovar Typhi
gucggguucgcgcgccgcuuccg

SEQ ID NO: 3660545 - RNA, 15 nt, Salmonella enterica enterica serovar Typhi
gucgguaaucgccug

SEQ ID NO: 3660546 - RNA, 17 nt, Salmonella enterica enterica serovar Typhi
gucguaaaacugcacca

SEQ ID NO: 3660547 - RNA, 16 nt, Salmonella enterica enterica serovar Typhi
gucguaaauuccugca

SEQ ID NO: 3660548 - RNA, 22 nt, Salmonella enterica enterica serovar Typhi
gucguaccguuaaucgauuuuc

SEQ ID NO: 3660549 - RNA, 22 nt, Salmonella enterica enterica serovar Typhi
gucguauccccagucuuccugc

SEQ ID NO: 3660550 - RNA, 18 nt, Salmonella enterica enterica serovar Typhi
gucguauucuugcuaccg

SEQ ID NO: 3660551 - RNA, 16 nt, Salmonella enterica enterica serovar Typhi
gucgucauaucgaugg

SEQ ID NO: 3660552 - RNA, 21 nt, Salmonella enterica enterica serovar Typhi
gucgucauuugaaucugcggu

SEQ ID NO: 3660553 - RNA, 13 nt, Salmonella enterica enterica serovar Typhi
gucguccacucuu

SEQ ID NO: 3660554 - RNA, 13 nt, Salmonella enterica enterica serovar Typhi
gucguccccugga

SEQ ID NO: 3660555 - RNA, 18 nt, Salmonella enterica enterica serovar Typhi
gucguccucaggccggau

SEQ ID NO: 3660556 - RNA, 14 nt, Salmonella enterica enterica serovar Typhi
gucgucgaucgcgc

SEQ ID NO: 3660557 - RNA, 21 nt, Salmonella enterica enterica serovar Typhi
gucgugaaucaucaucauccg

SEQ ID NO: 3660558 - RNA, 21 nt, Salmonella enterica enterica serovar Typhi
gucgugccugacguccacgga

SEQ ID NO: 3660559 - RNA, 14 nt, Salmonella enterica enterica serovar Typhi
gucguggcgaucag

SEQ ID NO: 3660560 - RNA, 19 nt, Salmonella enterica enterica serovar Typhi
gucgugugcggaugcgcca

SEQ ID NO: 3660561 - RNA, 15 nt, Salmonella enterica enterica serovar Typhi
gucguuaccgggcug

SEQ ID NO: 3660562 - RNA, 13 nt, Salmonella enterica enterica serovar Typhi
gucguucacguaa

SEQ ID NO: 3660563 - RNA, 21 nt, Salmonella enterica enterica serovar Typhi
gucguuccacacguccauccg

SEQ ID NO: 3660564 - RNA, 16 nt, Salmonella enterica enterica serovar Typhi
gucguuccgccaggcg

SEQ ID NO: 3660565 - RNA, 21 nt, Salmonella enterica enterica serovar Typhi
gucguugccuuugcguaccgc

SEQ ID NO: 3660566 - RNA, 20 nt, Salmonella enterica enterica serovar Typhi
gucguuguaguuaucgccga

SEQ ID NO: 3660567 - RNA, 14 nt, Salmonella enterica enterica serovar Typhi
gucguuucuacaau

SEQ ID NO: 3660568 - RNA, 20 nt, Salmonella enterica enterica serovar Typhi
gucuaauugacggccaccau

SEQ ID NO: 3660569 - RNA, 19 nt, Salmonella enterica enterica serovar Typhi
gucuacccgguguaaaaaa

SEQ ID NO: 3660570 - RNA, 20 nt, Salmonella enterica enterica serovar Typhi
gucuacccgguguaaaaaau

SEQ ID NO: 3660571 - RNA, 13 nt, Salmonella enterica enterica serovar Typhi
gucuauaggccug

SEQ ID NO: 3660572 - RNA, 14 nt, Salmonella enterica enterica serovar Typhi
gucuaugguacaca

SEQ ID NO: 3660573 - RNA, 15 nt, Salmonella enterica enterica serovar Typhi
gucuaugguacacau

SEQ ID NO: 3660574 - RNA, 15 nt, Salmonella enterica enterica serovar Typhi
gucuauugccuaaau

SEQ ID NO: 3660575 - RNA, 17 nt, Salmonella enterica enterica serovar Typhi
gucuauugccuaaauaa

SEQ ID NO: 3660576 - RNA, 16 nt, Salmonella enterica enterica serovar Typhi
gucucaaucgcaaauu

SEQ ID NO: 3660577 - RNA, 19 nt, Salmonella enterica enterica serovar Typhi
gucucagauggaaaaaaag

SEQ ID NO: 3660578 - RNA, 21 nt, Salmonella enterica enterica serovar Typhi
gucucauuguguacauccaga

SEQ ID NO: 3660579 - RNA, 13 nt, Salmonella enterica enterica serovar Typhi
gucucccuccugc

SEQ ID NO: 3660580 - RNA, 16 nt, Salmonella enterica enterica serovar Typhi
gucucccuccugcucc

SEQ ID NO: 3660581 - RNA, 14 nt, Salmonella enterica enterica serovar Typhi
gucuccgccuggaa

SEQ ID NO: 3660582 - RNA, 18 nt, Salmonella enterica enterica serovar Typhi
gucuccggcgcgccgcug

SEQ ID NO: 3660583 - RNA, 22 nt, Salmonella enterica enterica serovar Typhi
gucuccggcgcgccgcuggcga

SEQ ID NO: 3660584 - RNA, 15 nt, Salmonella enterica enterica serovar Typhi
gucuccucagcaggc

SEQ ID NO: 3660585 - RNA, 16 nt, Salmonella enterica enterica serovar Typhi
gucuccucagcaggcg

SEQ ID NO: 3660586 - RNA, 15 nt, Salmonella enterica enterica serovar Typhi
gucuccucaugccuc

SEQ ID NO: 3660587 - RNA, 18 nt, Salmonella enterica enterica serovar Typhi
gucuccucgccagcuacc

SEQ ID NO: 3660588 - RNA, 19 nt, Salmonella enterica enterica serovar Typhi
gucuccugaacuuuuugca

SEQ ID NO: 3660589 - RNA, 19 nt, Salmonella enterica enterica serovar Typhi
gucuccugccaaugaaaua

SEQ ID NO: 3660590 - RNA, 15 nt, Salmonella enterica enterica serovar Typhi
gucucuacuacauau

SEQ ID NO: 3660591 - RNA, 18 nt, Salmonella enterica enterica serovar Typhi
gucucucgugcaggccgg

SEQ ID NO: 3660592 - RNA, 19 nt, Salmonella enterica enterica serovar Typhi
gucucucgugcaggccgga

SEQ ID NO: 3660593 - RNA, 18 nt, Salmonella enterica enterica serovar Typhi
gucugaagaaguucuucu

SEQ ID NO: 3660594 - RNA, 19 nt, Salmonella enterica enterica serovar Typhi
gucugaagaaguucuucug

SEQ ID NO: 3660595 - RNA, 20 nt, Salmonella enterica enterica serovar Typhi
gucugaaggcguaugaauga

SEQ ID NO: 3660596 - RNA, 23 nt, Salmonella enterica enterica serovar Typhi
gucugaaucagugcaucuucacu

SEQ ID NO: 3660597 - RNA, 15 nt, Salmonella enterica enterica serovar Typhi
gucugaaucugcucc

SEQ ID NO: 3660598 - RNA, 13 nt, Salmonella enterica enterica serovar Typhi
gucugaccgggcg

SEQ ID NO: 3660599 - RNA, 14 nt, Salmonella enterica enterica serovar Typhi
gucugauaaacgca

SEQ ID NO: 3660600 - RNA, 23 nt, Salmonella enterica enterica serovar Typhi
gucugauugccggaugacgcuuc

SEQ ID NO: 3660601 - RNA, 16 nt, Salmonella enterica enterica serovar Typhi
gucugcaaaauuugug

SEQ ID NO: 3660602 - RNA, 22 nt, Salmonella enterica enterica serovar Typhi
gucugcaaaauuuguggugguc

SEQ ID NO: 3660603 - RNA, 18 nt, Salmonella enterica enterica serovar Typhi
gucugcgcccaccgggag

SEQ ID NO: 3660604 - RNA, 15 nt, Salmonella enterica enterica serovar Typhi
gugagaaacgcgcca

SEQ ID NO: 3660605 - RNA, 21 nt, Salmonella enterica enterica serovar Typhi
gugagacgcagccucucuucu

SEQ ID NO: 3660606 - RNA, 23 nt, Salmonella enterica enterica serovar Typhi
gugagaucguuauuaaacagaca

SEQ ID NO: 3660607 - RNA, 15 nt, Salmonella enterica enterica serovar Typhi
gugagcccuccucca

SEQ ID NO: 3660608 - RNA, 23 nt, Salmonella enterica enterica serovar Typhi
gugagcccuccuccagcgcgucc

SEQ ID NO: 3660609 - RNA, 15 nt, Salmonella enterica enterica serovar Typhi
gugagccuaaaacau

SEQ ID NO: 3660610 - RNA, 14 nt, Salmonella enterica enterica serovar Typhi
gugagcgaacaggu

SEQ ID NO: 3660611 - RNA, 20 nt, Salmonella enterica enterica serovar Typhi
gugagcgaacaggucgcuaa

SEQ ID NO: 3660612 - RNA, 15 nt, Salmonella enterica enterica serovar Typhi
gugagcucauccagc

SEQ ID NO: 3660613 - RNA, 16 nt, Salmonella enterica enterica serovar Typhi
gugaggagcuuuagcu

SEQ ID NO: 3660614 - RNA, 21 nt, Salmonella enterica enterica serovar Typhi
gugaggcaucgcccuguaaga

SEQ ID NO: 3660615 - RNA, 16 nt, Salmonella enterica enterica serovar Typhi
gugaguaaagagauca

SEQ ID NO: 3660616 - RNA, 18 nt, Salmonella enterica enterica serovar Typhi
gugaguaauaacaaaaaa

SEQ ID NO: 3660617 - RNA, 21 nt, Salmonella enterica enterica serovar Typhi
gugaguccccaggagcauaga

SEQ ID NO: 3660618 - RNA, 19 nt, Salmonella enterica enterica serovar Typhi
gugaguguuacucuuccuc

SEQ ID NO: 3660619 - RNA, 16 nt, Salmonella enterica enterica serovar Typhi
gugaguuucgcaucag

SEQ ID NO: 3660620 - RNA, 14 nt, Salmonella enterica enterica serovar Typhi
gugauaaagcccgu

SEQ ID NO: 3660621 - RNA, 18 nt, Salmonella enterica enterica serovar Typhi
gugauaaauacgcugcgg

SEQ ID NO: 3660622 - RNA, 19 nt, Salmonella enterica enterica serovar Typhi
gugauaagccccuuuacgc

SEQ ID NO: 3660623 - RNA, 12 nt, Salmonella enterica enterica serovar Typhi
gugauaauagug

SEQ ID NO: 3660624 - RNA, 21 nt, Salmonella enterica enterica serovar Typhi
gugauagcaggcacuguggug

SEQ ID NO: 3660625 - RNA, 14 nt, Salmonella enterica enterica serovar Typhi
gugauagcgcgcca

SEQ ID NO: 3660626 - RNA, 22 nt, Salmonella enterica enterica serovar Typhi
gugauaguggcgucgccauaaa

SEQ ID NO: 3660627 - RNA, 12 nt, Salmonella enterica enterica serovar Typhi
gugauauagcaa

SEQ ID NO: 3660628 - RNA, 14 nt, Salmonella enterica enterica serovar Typhi
gugauauagcgcca

SEQ ID NO: 3660629 - RNA, 17 nt, Salmonella enterica enterica serovar Typhi
gugauccaccaccagca

SEQ ID NO: 3660630 - RNA, 19 nt, Salmonella enterica enterica serovar Typhi
gugauccaccaccagcauc

SEQ ID NO: 3660631 - RNA, 23 nt, Salmonella enterica enterica serovar Typhi
gugauccaccaccagcaucacgu

SEQ ID NO: 3660632 - RNA, 13 nt, Salmonella enterica enterica serovar Typhi
gugauccguaauc

SEQ ID NO: 3660633 - RNA, 13 nt, Salmonella enterica enterica serovar Typhi
gugaucugcgccg

SEQ ID NO: 3660634 - RNA, 15 nt, Salmonella enterica enterica serovar Typhi
gugaucugguuuggu

SEQ ID NO: 3660635 - RNA, 15 nt, Salmonella enterica enterica serovar Typhi
gugaugacuaaauca

SEQ ID NO: 3660636 - RNA, 16 nt, Salmonella enterica enterica serovar Typhi
gugaugacuaaaucag

SEQ ID NO: 3660637 - RNA, 18 nt, Salmonella enterica enterica serovar Typhi
gugaugagcucaaauaug

SEQ ID NO: 3660638 - RNA, 16 nt, Salmonella enterica enterica serovar Typhi
gugaugcggacgcuga

SEQ ID NO: 3660639 - RNA, 19 nt, Salmonella enterica enterica serovar Typhi
gugaugcgggacugcugcu

SEQ ID NO: 3660640 - RNA, 14 nt, Salmonella enterica enterica serovar Typhi
gugauggcggucaa

SEQ ID NO: 3660641 - RNA, 15 nt, Salmonella enterica enterica serovar Typhi
gugauggguauuaga

SEQ ID NO: 3660642 - RNA, 16 nt, Salmonella enterica enterica serovar Typhi
gugauggguauuagaa

SEQ ID NO: 3660643 - RNA, 17 nt, Salmonella enterica enterica serovar Typhi
gugauggguauuagaau

SEQ ID NO: 3660644 - RNA, 13 nt, Salmonella enterica enterica serovar Typhi
gugauggugcagc

SEQ ID NO: 3660645 - RNA, 18 nt, Salmonella enterica enterica serovar Typhi
gugauggugcagccccgg

SEQ ID NO: 3660646 - RNA, 12 nt, Salmonella enterica enterica serovar Typhi
gugaugugcugg

SEQ ID NO: 3660647 - RNA, 12 nt, Salmonella enterica enterica serovar Typhi
gugauuacaaaa

SEQ ID NO: 3660648 - RNA, 14 nt, Salmonella enterica enterica serovar Typhi
gugauucaucacgu

SEQ ID NO: 3660649 - RNA, 16 nt, Salmonella enterica enterica serovar Typhi
gugauugcagauaauu

SEQ ID NO: 3660650 - RNA, 14 nt, Salmonella enterica enterica serovar Typhi
gugauuguccaacu

SEQ ID NO: 3660651 - RNA, 20 nt, Salmonella enterica enterica serovar Typhi
gugauuuuugacccgcagca

SEQ ID NO: 3660652 - RNA, 18 nt, Salmonella enterica enterica serovar Typhi
gugcaaacgauaaaagcu

SEQ ID NO: 3660653 - RNA, 21 nt, Salmonella enterica enterica serovar Typhi
gugcaaacgauaaaagcucug

SEQ ID NO: 3660654 - RNA, 12 nt, Salmonella enterica enterica serovar Typhi
gugcaagcaccu

SEQ ID NO: 3660655 - RNA, 18 nt, Salmonella enterica enterica serovar Typhi
gugcaagcccaacuauuu

SEQ ID NO: 3660656 - RNA, 24 nt, Salmonella enterica enterica serovar Typhi
gugcaaucccggaacagcggagcg

SEQ ID NO: 3660657 - RNA, 11 nt, Salmonella enterica enterica serovar Typhi
gugcacaggua

SEQ ID NO: 3660658 - RNA, 17 nt, Salmonella enterica enterica serovar Typhi
gugcaccguaucggcag

SEQ ID NO: 3660659 - RNA, 11 nt, Salmonella enterica enterica serovar Typhi
gugcagaacau

SEQ ID NO: 3660660 - RNA, 14 nt, Salmonella enterica enterica serovar Typhi
gugcagaacaucaa

SEQ ID NO: 3660661 - RNA, 15 nt, Salmonella enterica enterica serovar Typhi
gugcagacugcacuu

SEQ ID NO: 3660662 - RNA, 21 nt, Salmonella enterica enterica serovar Typhi
gugcagacugcacuuccugcg

SEQ ID NO: 3660663 - RNA, 14 nt, Salmonella enterica enterica serovar Typhi
gugcagcaaauaau

SEQ ID NO: 3660664 - RNA, 15 nt, Salmonella enterica enterica serovar Typhi
gugcaggagcaguga

SEQ ID NO: 3660665 - RNA, 13 nt, Salmonella enterica enterica serovar Typhi
gugcaggccggau

SEQ ID NO: 3660666 - RNA, 18 nt, Salmonella enterica enterica serovar Typhi
gugcaguauugcaccagg

SEQ ID NO: 3660667 - RNA, 13 nt, Salmonella enterica enterica serovar Typhi
gugcagugaacca

SEQ ID NO: 3660668 - RNA, 17 nt, Salmonella enterica enterica serovar Typhi
gugcagugacagaggaa

SEQ ID NO: 3660669 - RNA, 22 nt, Salmonella enterica enterica serovar Typhi
gugcauaaagauuggcaucugc

SEQ ID NO: 3660670 - RNA, 15 nt, Salmonella enterica enterica serovar Typhi
gugcauaaccgcgcc

SEQ ID NO: 3660671 - RNA, 20 nt, Salmonella enterica enterica serovar Typhi
gugcauccccugaaacaggu

SEQ ID NO: 3660672 - RNA, 14 nt, Salmonella enterica enterica serovar Typhi
gugcaucuccucgc

SEQ ID NO: 3660673 - RNA, 14 nt, Salmonella enterica enterica serovar Typhi
gugcaucuggggga

SEQ ID NO: 3660674 - RNA, 22 nt, Salmonella enterica enterica serovar Typhi
gugcaugggauacgccagcaga

SEQ ID NO: 3660675 - RNA, 11 nt, Salmonella enterica enterica serovar Typhi
gugcauggugu

SEQ ID NO: 3660676 - RNA, 22 nt, Salmonella enterica enterica serovar Typhi
gugcauguaaauaaggcugcgc

SEQ ID NO: 3660677 - RNA, 18 nt, Salmonella enterica enterica serovar Typhi
gugccaaucuccagcauc

SEQ ID NO: 3660678 - RNA, 14 nt, Salmonella enterica enterica serovar Typhi
gugccaauggcgau

SEQ ID NO: 3660679 - RNA, 21 nt, Salmonella enterica enterica serovar Typhi
gugccaauggcgauaaaaaua

SEQ ID NO: 3660680 - RNA, 17 nt, Salmonella enterica enterica serovar Typhi
gugccaccagccggagc

SEQ ID NO: 3660681 - RNA, 17 nt, Salmonella enterica enterica serovar Typhi
gugccacuccgccagua

SEQ ID NO: 3660682 - RNA, 22 nt, Salmonella enterica enterica serovar Typhi
gugccagaaacaagaagcacga

SEQ ID NO: 3660683 - RNA, 12 nt, Salmonella enterica enterica serovar Typhi
gugccagguuuu

SEQ ID NO: 3660684 - RNA, 19 nt, Salmonella enterica enterica serovar Typhi
gugccaguaacucaucgcc

SEQ ID NO: 3660685 - RNA, 20 nt, Salmonella enterica enterica serovar Typhi
gugccaguaacucaucgcca

SEQ ID NO: 3660686 - RNA, 23 nt, Salmonella enterica enterica serovar Typhi
gugccauccauauugagcgguag

SEQ ID NO: 3660687 - RNA, 12 nt, Salmonella enterica enterica serovar Typhi
gugcccagagcg

SEQ ID NO: 3660688 - RNA, 19 nt, Salmonella enterica enterica serovar Typhi
gugcccauaaaaaucccaa

SEQ ID NO: 3660689 - RNA, 18 nt, Salmonella enterica enterica serovar Typhi
gugcccgcgguuugacug

SEQ ID NO: 3660690 - RNA, 22 nt, Salmonella enterica enterica serovar Typhi
guggucauauugucgcgcccgu

SEQ ID NO: 3660691 - RNA, 21 nt, Salmonella enterica enterica serovar Typhi
guggucauuuuacugcguaau

SEQ ID NO: 3660692 - RNA, 22 nt, Salmonella enterica enterica serovar Typhi
guggucgacauauucaugguuc

SEQ ID NO: 3660693 - RNA, 14 nt, Salmonella enterica enterica serovar Typhi
guggucgcggcuca

SEQ ID NO: 3660694 - RNA, 19 nt, Salmonella enterica enterica serovar Typhi
guggucgucagccgugagc

SEQ ID NO: 3660695 - RNA, 16 nt, Salmonella enterica enterica serovar Typhi
guggugagcucaucca

SEQ ID NO: 3660696 - RNA, 23 nt, Salmonella enterica enterica serovar Typhi
guggugcaagcaccuuauccggc

SEQ ID NO: 3660697 - RNA, 16 nt, Salmonella enterica enterica serovar Typhi
guggugcgcauccgga

SEQ ID NO: 3660698 - RNA, 16 nt, Salmonella enterica enterica serovar Typhi
guggugcggcuuaucg

SEQ ID NO: 3660699 - RNA, 15 nt, Salmonella enterica enterica serovar Typhi
gugguggucaacguu

SEQ ID NO: 3660700 - RNA, 13 nt, Salmonella enterica enterica serovar Typhi
gugguggucaucc

SEQ ID NO: 3660701 - RNA, 21 nt, Salmonella enterica enterica serovar Typhi
guggugucucgucgccagggc

SEQ ID NO: 3660702 - RNA, 17 nt, Salmonella enterica enterica serovar Typhi
gugguuaacagcgcagg

SEQ ID NO: 3660703 - RNA, 18 nt, Salmonella enterica enterica serovar Typhi
gugguuaucgaauccagc

SEQ ID NO: 3660704 - RNA, 13 nt, Salmonella enterica enterica serovar Typhi
gugguuuauccgc

SEQ ID NO: 3660705 - RNA, 14 nt, Salmonella enterica enterica serovar Typhi
gugguuucuuuuaa

SEQ ID NO: 3660706 - RNA, 14 nt, Salmonella enterica enterica serovar Typhi
guguaaaaauuuuu

SEQ ID NO: 3660707 - RNA, 16 nt, Salmonella enterica enterica serovar Typhi
guguaaaagccagcaa

SEQ ID NO: 3660708 - RNA, 13 nt, Salmonella enterica enterica serovar Typhi
guguaaacgccag

SEQ ID NO: 3660709 - RNA, 12 nt, Salmonella enterica enterica serovar Typhi
guguaacagcaa

SEQ ID NO: 3660710 - RNA, 23 nt, Salmonella enterica enterica serovar Typhi
guguaaccaccugggugagcguc

SEQ ID NO: 3660711 - RNA, 19 nt, Salmonella enterica enterica serovar Typhi
guguaauaaccguggcggc

SEQ ID NO: 3660712 - RNA, 20 nt, Salmonella enterica enterica serovar Typhi
guguaaucgcgguagcgcac

SEQ ID NO: 3660713 - RNA, 15 nt, Salmonella enterica enterica serovar Typhi
guguaauguuuucug

SEQ ID NO: 3660714 - RNA, 12 nt, Salmonella enterica enterica serovar Typhi
guguacauccag

SEQ ID NO: 3660715 - RNA, 18 nt, Salmonella enterica enterica serovar Typhi
guguaccagcagcgccag

SEQ ID NO: 3660716 - RNA, 19 nt, Salmonella enterica enterica serovar Typhi
guguagaauguaggccggg

SEQ ID NO: 3660717 - RNA, 19 nt, Salmonella enterica enterica serovar Typhi
guguaggaaaggcagagaa

SEQ ID NO: 3660718 - RNA, 16 nt, Salmonella enterica enterica serovar Typhi
guguauauauugcauu

SEQ ID NO: 3660719 - RNA, 20 nt, Salmonella enterica enterica serovar Typhi
guguauauauugcauuuuau

SEQ ID NO: 3660720 - RNA, 11 nt, Salmonella enterica enterica serovar Typhi
guguauuuuuu

SEQ ID NO: 3660721 - RNA, 14 nt, Salmonella enterica enterica serovar Typhi
gugucacucaucgg

SEQ ID NO: 3660722 - RNA, 19 nt, Salmonella enterica enterica serovar Typhi
gugucauaacgaccaaaca

SEQ ID NO: 3660723 - RNA, 21 nt, Salmonella enterica enterica serovar Typhi
guguccaggucaucaccucca

SEQ ID NO: 3660724 - RNA, 13 nt, Salmonella enterica enterica serovar Typhi
gugucccgcugug

SEQ ID NO: 3660725 - RNA, 19 nt, Salmonella enterica enterica serovar Typhi
guguccggguucagcgaca

SEQ ID NO: 3660726 - RNA, 23 nt, Salmonella enterica enterica serovar Typhi
gugucgaugagcucguuauaagc

SEQ ID NO: 3660727 - RNA, 15 nt, Salmonella enterica enterica serovar Typhi
gugucgccauaaauc

SEQ ID NO: 3660728 - RNA, 14 nt, Salmonella enterica enterica serovar Typhi
gugucggccggaua

SEQ ID NO: 3660729 - RNA, 14 nt, Salmonella enterica enterica serovar Typhi
gugucguaguggca

SEQ ID NO: 3660730 - RNA, 19 nt, Salmonella enterica enterica serovar Typhi
gugucguuucauccugaca

SEQ ID NO: 3660731 - RNA, 17 nt, Salmonella enterica enterica serovar Typhi
gugucucgucgccaggg

SEQ ID NO: 3660732 - RNA, 16 nt, Salmonella enterica enterica serovar Typhi
gugucugcuucgucug

SEQ ID NO: 3660733 - RNA, 19 nt, Salmonella enterica enterica serovar Typhi
gugucuuuuucaucuuuua

SEQ ID NO: 3660734 - RNA, 13 nt, Salmonella enterica enterica serovar Typhi
gugugaccagcag

SEQ ID NO: 3660735 - RNA, 14 nt, Salmonella enterica enterica serovar Typhi
gugugcagugacag

SEQ ID NO: 3660736 - RNA, 13 nt, Salmonella enterica enterica serovar Typhi
gugugccagcaga

SEQ ID NO: 3660737 - RNA, 16 nt, Salmonella enterica enterica serovar Typhi
gugugggcacucgaag

SEQ ID NO: 3660738 - RNA, 15 nt, Salmonella enterica enterica serovar Typhi
guguguacaaccauc

SEQ ID NO: 3660739 - RNA, 23 nt, Salmonella enterica enterica serovar Typhi
guguguuauagcguuuuauccgu

SEQ ID NO: 3660740 - RNA, 18 nt, Salmonella enterica enterica serovar Typhi
guguguuuuuuaauauaa

SEQ ID NO: 3660741 - RNA, 21 nt, Salmonella enterica enterica serovar Typhi
guguuaccgccaccuuucugc

SEQ ID NO: 3660742 - RNA, 21 nt, Salmonella enterica enterica serovar Typhi
guguuauauucccgaaaggug

SEQ ID NO: 3660743 - RNA, 22 nt, Salmonella enterica enterica serovar Typhi
guguuaucgcuaucaagcugau

SEQ ID NO: 3660744 - RNA, 21 nt, Salmonella enterica enterica serovar Typhi
guguuauuuucaaaaacaagg

SEQ ID NO: 3660745 - RNA, 15 nt, Salmonella enterica enterica serovar Typhi
guguucacaauugug

SEQ ID NO: 3660746 - RNA, 15 nt, Salmonella enterica enterica serovar Typhi
guguuccauugcugc

SEQ ID NO: 3660747 - RNA, 14 nt, Salmonella enterica enterica serovar Typhi
guguucguaaagca

SEQ ID NO: 3660748 - RNA, 13 nt, Salmonella enterica enterica serovar Typhi
guguucucccugc

SEQ ID NO: 3660749 - RNA, 13 nt, Salmonella enterica enterica serovar Typhi
guguugcugccgu

SEQ ID NO: 3660750 - RNA, 19 nt, Salmonella enterica enterica serovar Typhi
guguugguacacagcacaa

SEQ ID NO: 3660751 - RNA, 14 nt, Salmonella enterica enterica serovar Typhi
guguuucagcagcc

SEQ ID NO: 3660752 - RNA, 13 nt, Salmonella enterica enterica serovar Typhi
guguuugccagac

SEQ ID NO: 3660753 - RNA, 15 nt, Salmonella enterica enterica serovar Typhi
guguuugucggcucc

SEQ ID NO: 3660754 - RNA, 18 nt, Salmonella enterica enterica serovar Typhi
guguuuucgauuucauuc

SEQ ID NO: 3660755 - RNA, 15 nt, Salmonella enterica enterica serovar Typhi
guuaaaaccggcugc

SEQ ID NO: 3660756 - RNA, 19 nt, Salmonella enterica enterica serovar Typhi
guuaaaccugguauuacaa

SEQ ID NO: 3660757 - RNA, 22 nt, Salmonella enterica enterica serovar Typhi
guuaaacguaaguuaaaacgcc

SEQ ID NO: 3660758 - RNA, 12 nt, Salmonella enterica enterica serovar Typhi
guuaaauaccag

SEQ ID NO: 3660759 - RNA, 16 nt, Salmonella enterica enterica serovar Typhi
guuaaauauaucuguu

SEQ ID NO: 3660760 - RNA, 13 nt, Salmonella enterica enterica serovar Typhi
guuaaaucauaac

SEQ ID NO: 3660761 - RNA, 23 nt, Salmonella enterica enterica serovar Typhi
guuaaaucgcgcaaauauuacaa

SEQ ID NO: 3660762 - RNA, 19 nt, Salmonella enterica enterica serovar Typhi
guuaacaucaucaggccug

SEQ ID NO: 3660763 - RNA, 20 nt, Salmonella enterica enterica serovar Typhi
guuaacaucaucaggccuga

SEQ ID NO: 3660764 - RNA, 14 nt, Salmonella enterica enterica serovar Typhi
guuaacccaaaaac

SEQ ID NO: 3660765 - RNA, 19 nt, Salmonella enterica enterica serovar Typhi
guuaacccacaacgcgcca

SEQ ID NO: 3660766 - RNA, 14 nt, Salmonella enterica enterica serovar Typhi
guuaacccggcauu

SEQ ID NO: 3660767 - RNA, 18 nt, Salmonella enterica enterica serovar Typhi
guuaacgcggccguaaua

SEQ ID NO: 3660768 - RNA, 19 nt, Salmonella enterica enterica serovar Typhi
guuaacguaaagccaucca

SEQ ID NO: 3660769 - RNA, 13 nt, Salmonella enterica enterica serovar Typhi
guuaacugcugcu

SEQ ID NO: 3660770 - RNA, 17 nt, Salmonella enterica enterica serovar Typhi
guuaacuggcgcaucug

SEQ ID NO: 3660771 - RNA, 15 nt, Salmonella enterica enterica serovar Typhi
guuaacuucggcaaa

SEQ ID NO: 3660772 - RNA, 17 nt, Salmonella enterica enterica serovar Typhi
guuaacuucuccgccau

SEQ ID NO: 3660773 - RNA, 16 nt, Salmonella enterica enterica serovar Typhi
guuaagaagucuguga

SEQ ID NO: 3660774 - RNA, 19 nt, Salmonella enterica enterica serovar Typhi
guuaagaggauugcguaau

SEQ ID NO: 3660775 - RNA, 19 nt, Salmonella enterica enterica serovar Typhi
guuaaggggcaggcgucaa

SEQ ID NO: 3660776 - RNA, 21 nt, Salmonella enterica enterica serovar Typhi
guucagauggccaaugaugcg

SEQ ID NO: 3660777 - RNA, 20 nt, Salmonella enterica enterica serovar Typhi
guucagcaacgugaacugcg

SEQ ID NO: 3660778 - RNA, 12 nt, Salmonella enterica enterica serovar Typhi
guucagccagca

SEQ ID NO: 3660779 - RNA, 12 nt, Salmonella enterica enterica serovar Typhi
guucagccgcca

SEQ ID NO: 3660780 - RNA, 14 nt, Salmonella enterica enterica serovar Typhi
guucagccgccagu

SEQ ID NO: 3660781 - RNA, 14 nt, Salmonella enterica enterica serovar Typhi
guucaggcggcaaa

SEQ ID NO: 3660782 - RNA, 17 nt, Salmonella enterica enterica serovar Typhi
guucaggcggcaaaaaa

SEQ ID NO: 3660783 - RNA, 17 nt, Salmonella enterica enterica serovar Typhi
guucagguuggcgacau

SEQ ID NO: 3660784 - RNA, 13 nt, Salmonella enterica enterica serovar Typhi
guucagguuuuuu

SEQ ID NO: 3660785 - RNA, 13 nt, Salmonella enterica enterica serovar Typhi
guucaguaggaca

SEQ ID NO: 3660786 - RNA, 16 nt, Salmonella enterica enterica serovar Typhi
guucaguaugaucaug

SEQ ID NO: 3660787 - RNA, 16 nt, Salmonella enterica enterica serovar Typhi
guucagucagcgcgag

SEQ ID NO: 3660788 - RNA, 15 nt, Salmonella enterica enterica serovar Typhi
guucauaccggauau

SEQ ID NO: 3660789 - RNA, 12 nt, Salmonella enterica enterica serovar Typhi
guucauagccgu

SEQ ID NO: 3660790 - RNA, 17 nt, Salmonella enterica enterica serovar Typhi
guucauaucgauaccga

SEQ ID NO: 3660791 - RNA, 19 nt, Salmonella enterica enterica serovar Typhi
guucaucaggccugcaaac

SEQ ID NO: 3660792 - RNA, 17 nt, Salmonella enterica enterica serovar Typhi
guucaucauccugcagg

SEQ ID NO: 3660793 - RNA, 16 nt, Salmonella enterica enterica serovar Typhi
guucauccugcgccau

SEQ ID NO: 3660794 - RNA, 21 nt, Salmonella enterica enterica serovar Typhi
guucaucgcuggcguacgcca

SEQ ID NO: 3660795 - RNA, 22 nt, Salmonella enterica enterica serovar Typhi
guucaucgcuggcguacgccau

SEQ ID NO: 3660796 - RNA, 13 nt, Salmonella enterica enterica serovar Typhi
guucaucgguuuu

SEQ ID NO: 3660797 - RNA, 16 nt, Salmonella enterica enterica serovar Typhi
guucaucuaucgccag

SEQ ID NO: 3660798 - RNA, 13 nt, Salmonella enterica enterica serovar Typhi
guucaucucuucc

SEQ ID NO: 3660799 - RNA, 15 nt, Salmonella enterica enterica serovar Typhi
guucaucucuucccg

SEQ ID NO: 3660800 - RNA, 22 nt, Salmonella enterica enterica serovar Typhi
guucaugccgacgauuugcgcu

SEQ ID NO: 3660801 - RNA, 15 nt, Salmonella enterica enterica serovar Typhi
guucaugcgcggcgg

SEQ ID NO: 3660802 - RNA, 14 nt, Salmonella enterica enterica serovar Typhi
guucauggcaaaag

SEQ ID NO: 3660803 - RNA, 16 nt, Salmonella enterica enterica serovar Typhi
guucauuaacaucugu

SEQ ID NO: 3660804 - RNA, 16 nt, Salmonella enterica enterica serovar Typhi
guucauugcuuucuug

SEQ ID NO: 3660805 - RNA, 21 nt, Salmonella enterica enterica serovar Typhi
guucauuucaggcaaaggaau

SEQ ID NO: 3660806 - RNA, 22 nt, Salmonella enterica enterica serovar Typhi
guuccacaaucaaauggcuggc

SEQ ID NO: 3660807 - RNA, 20 nt, Salmonella enterica enterica serovar Typhi
guuccaccgccaauaaaaac

SEQ ID NO: 3660808 - RNA, 20 nt, Salmonella enterica enterica serovar Typhi
guuccaccgucuaucgugga

SEQ ID NO: 3660809 - RNA, 21 nt, Salmonella enterica enterica serovar Typhi
guuccacgggaucguuuuauc

SEQ ID NO: 3660810 - RNA, 22 nt, Salmonella enterica enterica serovar Typhi
guuccacgggaucguuuuaucu

SEQ ID NO: 3660811 - RNA, 15 nt, Salmonella enterica enterica serovar Typhi
guuccagaaugguua

SEQ ID NO: 3660812 - RNA, 17 nt, Salmonella enterica enterica serovar Typhi
guuccagaggcauuauu

SEQ ID NO: 3660813 - RNA, 21 nt, Salmonella enterica enterica serovar Typhi
guuccagcagcgcaucauggu

SEQ ID NO: 3660814 - RNA, 12 nt, Salmonella enterica enterica serovar Typhi
guuccagcagcu

SEQ ID NO: 3660815 - RNA, 17 nt, Salmonella enterica enterica serovar Typhi
guuccagccgccaggca

SEQ ID NO: 3660816 - RNA, 21 nt, Salmonella enterica enterica serovar Typhi
guuccagccguaacuaugcca

SEQ ID NO: 3660817 - RNA, 14 nt, Salmonella enterica enterica serovar Typhi
guuccagcgccacg

SEQ ID NO: 3660818 - RNA, 22 nt, Salmonella enterica enterica serovar Typhi
guuccaggcgaaccauaauaaa

SEQ ID NO: 3660819 - RNA, 23 nt, Salmonella enterica enterica serovar Typhi
guucccagcgggaacaucacgga

SEQ ID NO: 3660820 - RNA, 22 nt, Salmonella enterica enterica serovar Typhi
guuccccaacagcgaccacgcc

SEQ ID NO: 3660821 - RNA, 14 nt, Salmonella enterica enterica serovar Typhi
guucccgaaaaucc

SEQ ID NO: 3660822 - RNA, 15 nt, Salmonella enterica enterica serovar Typhi
guucccgagcggcca

SEQ ID NO: 3660823 - RNA, 20 nt, Salmonella enterica enterica serovar Typhi
guucccgagcggccaaaggg

SEQ ID NO: 3660824 - RNA, 15 nt, Salmonella enterica enterica serovar Typhi
guucccgccugcugc

SEQ ID NO: 3660825 - RNA, 14 nt, Salmonella enterica enterica serovar Typhi
guucccuacgccca

SEQ ID NO: 3660826 - RNA, 16 nt, Salmonella enterica enterica serovar Typhi
guuccgccagauacaa

SEQ ID NO: 3660827 - RNA, 17 nt, Salmonella enterica enterica serovar Typhi
guuccgcgauuuccugu

SEQ ID NO: 3660828 - RNA, 20 nt, Salmonella enterica enterica serovar Typhi
guuccgcuuuucuggcuuca

SEQ ID NO: 3660829 - RNA, 16 nt, Salmonella enterica enterica serovar Typhi
guuccggcagacggcu

SEQ ID NO: 3660830 - RNA, 18 nt, Salmonella enterica enterica serovar Typhi
guuccggcggucagccag

SEQ ID NO: 3660831 - RNA, 19 nt, Salmonella enterica enterica serovar Typhi
guuccggcggucagccagc

SEQ ID NO: 3660832 - RNA, 16 nt, Salmonella enterica enterica serovar Typhi
guuccugagcagacau

SEQ ID NO: 3660833 - RNA, 19 nt, Salmonella enterica enterica serovar Typhi
guuccugcacccgaauaaa

SEQ ID NO: 3660834 - RNA, 16 nt, Salmonella enterica enterica serovar Typhi
guuccugcuggcaaaa

SEQ ID NO: 3660835 - RNA, 16 nt, Salmonella enterica enterica serovar Typhi
guuccuuuacuucuuu

SEQ ID NO: 3660836 - RNA, 22 nt, Salmonella enterica enterica serovar Typhi
guuccuuuacuucuuugcgauu

SEQ ID NO: 3660837 - RNA, 20 nt, Salmonella enterica enterica serovar Typhi
guucgaauccagguacccca

SEQ ID NO: 3660838 - RNA, 24 nt, Salmonella enterica enterica serovar Typhi
guucgaaucccgucguagccacca

SEQ ID NO: 3660839 - RNA, 20 nt, Salmonella enterica enterica serovar Typhi
guucgacaauguccgccaga

SEQ ID NO: 3660840 - RNA, 11 nt, Salmonella enterica enterica serovar Typhi
guucgacggcu

SEQ ID NO: 3660841 - RNA, 15 nt, Salmonella enterica enterica serovar Typhi
guucgagggcgauuu

SEQ ID NO: 3660842 - RNA, 20 nt, Salmonella enterica enterica serovar Typhi
guucgauaaucccggcgcgc

SEQ ID NO: 3660843 - RNA, 12 nt, Salmonella enterica enterica serovar Typhi
guucgauagcgu

SEQ ID NO: 3660844 - RNA, 23 nt, Salmonella enterica enterica serovar Typhi
guucgcccggcaugacaucagaa

SEQ ID NO: 3660845 - RNA, 15 nt, Salmonella enterica enterica serovar Typhi
guucgccgcgcgcau

SEQ ID NO: 3660846 - RNA, 17 nt, Salmonella enterica enterica serovar Typhi
guucgccggcaaucugu

SEQ ID NO: 3660847 - RNA, 20 nt, Salmonella enterica enterica serovar Typhi
guucgccgggaugcuuuccg

SEQ ID NO: 3660848 - RNA, 19 nt, Salmonella enterica enterica serovar Typhi
guucgccuucguuauaagg

SEQ ID NO: 3660849 - RNA, 13 nt, Salmonella enterica enterica serovar Typhi
guucgcgacugau

SEQ ID NO: 3660850 - RNA, 16 nt, Salmonella enterica enterica serovar Typhi
guucgcgauuuucauc

SEQ ID NO: 3660851 - RNA, 18 nt, Salmonella enterica enterica serovar Typhi
guucgcgcaauucuucua

SEQ ID NO: 3660852 - RNA, 15 nt, Salmonella enterica enterica serovar Typhi
guucgcgcauaccuu

SEQ ID NO: 3660853 - RNA, 17 nt, Salmonella enterica enterica serovar Typhi
guucgcggggguuauuc

SEQ ID NO: 3660854 - RNA, 13 nt, Salmonella enterica enterica serovar Typhi
guucgcguacgca

SEQ ID NO: 3660855 - RNA, 22 nt, Salmonella enterica enterica serovar Typhi
guucgcguauuggcgcgaucag

SEQ ID NO: 3660856 - RNA, 15 nt, Salmonella enterica enterica serovar Typhi
guucggaagacugcu

SEQ ID NO: 3660857 - RNA, 23 nt, Salmonella enterica enterica serovar Typhi
guucggaagacugcuccggcaag

SEQ ID NO: 3660858 - RNA, 17 nt, Salmonella enterica enterica serovar Typhi
guucggauaaacgcugc

SEQ ID NO: 3660859 - RNA, 17 nt, Salmonella enterica enterica serovar Typhi
guucguacccgcaggcc

SEQ ID NO: 3660860 - RNA, 21 nt, Salmonella enterica enterica serovar Typhi
guucgucccugcaacgccugc

SEQ ID NO: 3660861 - RNA, 22 nt, Salmonella enterica enterica serovar Typhi
guucguucaacguaaagcuggc

SEQ ID NO: 3660862 - RNA, 17 nt, Salmonella enterica enterica serovar Typhi
guuuaauuccaucggca

SEQ ID NO: 3660863 - RNA, 19 nt, Salmonella enterica enterica serovar Typhi
guuuaauucuuugagcauc

SEQ ID NO: 3660864 - RNA, 20 nt, Salmonella enterica enterica serovar Typhi
guuuacaccgccauccggca

SEQ ID NO: 3660865 - RNA, 20 nt, Salmonella enterica enterica serovar Typhi
guuuaccauuacgcuauaaa

SEQ ID NO: 3660866 - RNA, 18 nt, Salmonella enterica enterica serovar Typhi
guuuacccaggaagagua

SEQ ID NO: 3660867 - RNA, 21 nt, Salmonella enterica enterica serovar Typhi
guuuaccggugcagaccucug

SEQ ID NO: 3660868 - RNA, 16 nt, Salmonella enterica enterica serovar Typhi
guuuaccugcaaaaac

SEQ ID NO: 3660869 - RNA, 22 nt, Salmonella enterica enterica serovar Typhi
guuuacgagccauuaaugcagg

SEQ ID NO: 3660870 - RNA, 19 nt, Salmonella enterica enterica serovar Typhi
guuuacgagugcguucuuc

SEQ ID NO: 3660871 - RNA, 18 nt, Salmonella enterica enterica serovar Typhi
guuuacgcccucaucggc

SEQ ID NO: 3660872 - RNA, 20 nt, Salmonella enterica enterica serovar Typhi
guuuacgcugcuauccggca

SEQ ID NO: 3660873 - RNA, 14 nt, Salmonella enterica enterica serovar Typhi
guuuacgcugcucc

SEQ ID NO: 3660874 - RNA, 23 nt, Salmonella enterica enterica serovar Typhi
guuuacguagcaaauagauaaag

SEQ ID NO: 3660875 - RNA, 13 nt, Salmonella enterica enterica serovar Typhi
guuuacuccauuc

SEQ ID NO: 3660876 - RNA, 20 nt, Salmonella enterica enterica serovar Typhi
guuuacuccauucccagcuc

SEQ ID NO: 3660877 - RNA, 14 nt, Salmonella enterica enterica serovar Typhi
guuuagaaaauaua

SEQ ID NO: 3660878 - RNA, 22 nt, Salmonella enterica enterica serovar Typhi
guuuagacagacagcguaaaua

SEQ ID NO: 3660879 - RNA, 18 nt, Salmonella enterica enterica serovar Typhi
guuuagccugcgcguaaa

SEQ ID NO: 3660880 - RNA, 17 nt, Salmonella enterica enterica serovar Typhi
guuuagcgccagcagca

SEQ ID NO: 3660881 - RNA, 14 nt, Salmonella enterica enterica serovar Typhi
guuuauauaaaaau

SEQ ID NO: 3660882 - RNA, 17 nt, Salmonella enterica enterica serovar Typhi
guuuauauaaaaauagc

SEQ ID NO: 3660883 - RNA, 14 nt, Salmonella enterica enterica serovar Typhi
guuuauccacaggc

SEQ ID NO: 3660884 - RNA, 12 nt, Salmonella enterica enterica serovar Typhi
guuuauccggca

SEQ ID NO: 3660885 - RNA, 13 nt, Salmonella enterica enterica serovar Typhi
guuuauccggcac

SEQ ID NO: 3660886 - RNA, 19 nt, Salmonella enterica enterica serovar Typhi
guuuauccggcacgguaaa

SEQ ID NO: 3660887 - RNA, 21 nt, Salmonella enterica enterica serovar Typhi
guuuaucuggcuuacaggcac

SEQ ID NO: 3660888 - RNA, 16 nt, Salmonella enterica enterica serovar Typhi
guuuauuaggccuaca

SEQ ID NO: 3660889 - RNA, 18 nt, Salmonella enterica enterica serovar Typhi
guuuauucaucuccucuu

SEQ ID NO: 3660890 - RNA, 17 nt, Salmonella enterica enterica serovar Typhi
guuuauuuaagcuuacu

SEQ ID NO: 3660891 - RNA, 21 nt, Salmonella enterica enterica serovar Typhi
guuucaacccccucagcaaug

SEQ ID NO: 3660892 - RNA, 22 nt, Salmonella enterica enterica serovar Typhi
guuucaacuuccaccaccuccu

SEQ ID NO: 3660893 - RNA, 19 nt, Salmonella enterica enterica serovar Typhi
guuucaagcaguuccagca

SEQ ID NO: 3660894 - RNA, 23 nt, Salmonella enterica enterica serovar Typhi
guuucaauauagccguggcuggc

SEQ ID NO: 3660895 - RNA, 19 nt, Salmonella enterica enterica serovar Typhi
guuucaaugcccaggcgcc

SEQ ID NO: 3660896 - RNA, 13 nt, Salmonella enterica enterica serovar Typhi
guuucaccagcac

SEQ ID NO: 3660897 - RNA, 19 nt, Salmonella enterica enterica serovar Typhi
guuucaccguuuucgucaa

SEQ ID NO: 3660898 - RNA, 12 nt, Salmonella enterica enterica serovar Typhi
guuucaccuucu

SEQ ID NO: 3660899 - RNA, 17 nt, Salmonella enterica enterica serovar Typhi
guuucacgcucuucgcc

SEQ ID NO: 3660900 - RNA, 22 nt, Salmonella enterica enterica serovar Typhi
guuucaggacggcauaagccag

SEQ ID NO: 3660901 - RNA, 14 nt, Salmonella enterica enterica serovar Typhi
guuucagugauaaa

SEQ ID NO: 3660902 - RNA, 21 nt, Salmonella enterica enterica serovar Typhi
guuucaguucggagaucagcg

SEQ ID NO: 3660903 - RNA, 14 nt, Salmonella enterica enterica serovar Typhi
guuucaucucuccg

SEQ ID NO: 3660904 - RNA, 19 nt, Salmonella enterica enterica serovar Typhi
guuucauggagauccagua

SEQ ID NO: 3660905 - RNA, 16 nt, Salmonella enterica enterica serovar Typhi
guuucauggcuuuguu

SEQ ID NO: 3660906 - RNA, 17 nt, Salmonella enterica enterica serovar Typhi
guuuccacugagcuuca

SEQ ID NO: 3660907 - RNA, 22 nt, Salmonella enterica enterica serovar Typhi
guuuccacugagcuucaccgcc

SEQ ID NO: 3660908 - RNA, 21 nt, Salmonella enterica enterica serovar Typhi
guuuccagcaucgaccaggau

SEQ ID NO: 3660909 - RNA, 14 nt, Salmonella enterica enterica serovar Typhi
guuuccagccaguc

SEQ ID NO: 3660910 - RNA, 21 nt, Salmonella enterica enterica serovar Typhi
guuucccccuccauacccuau

SEQ ID NO: 3660911 - RNA, 21 nt, Salmonella enterica enterica serovar Typhi
guuucccgcgcggaaggcgcc

SEQ ID NO: 3660912 - RNA, 16 nt, Salmonella enterica enterica serovar Typhi
guuucccucauauuug

SEQ ID NO: 3660913 - RNA, 12 nt, Salmonella enterica enterica serovar Typhi
guuucccugacc

SEQ ID NO: 3660914 - RNA, 19 nt, Salmonella enterica enterica serovar Typhi
guuuccgcuagggcaucag

SEQ ID NO: 3660915 - RNA, 21 nt, Salmonella enterica enterica serovar Typhi
guuuccgcuagggcaucagac

SEQ ID NO: 3660916 - RNA, 19 nt, Salmonella enterica enterica serovar Typhi
guuuccggcauccagcgcu

SEQ ID NO: 3660917 - RNA, 19 nt, Salmonella enterica enterica serovar Typhi
guuuccguuuguaacauau

SEQ ID NO: 3660918 - RNA, 21 nt, Salmonella enterica enterica serovar Typhi
guuuccguuuguaacauauuu

SEQ ID NO: 3660919 - RNA, 17 nt, Salmonella enterica enterica serovar Typhi
guuucgacgggagguga

SEQ ID NO: 3660920 - RNA, 13 nt, Salmonella enterica enterica serovar Typhi
guuucgccagcgc

SEQ ID NO: 3660921 - RNA, 14 nt, Salmonella enterica enterica serovar Typhi
guuucgccagcgcg

SEQ ID NO: 3660922 - RNA, 13 nt, Salmonella enterica enterica serovar Typhi
guuucgccaggcc

SEQ ID NO: 3660923 - RNA, 14 nt, Salmonella enterica enterica serovar Typhi
guuucggcauccca

SEQ ID NO: 3660924 - RNA, 15 nt, Salmonella enterica enterica serovar Typhi
guuucguggcgcugu

SEQ ID NO: 3660925 - RNA, 15 nt, Salmonella enterica enterica serovar Typhi
guuucuacaauagag

SEQ ID NO: 3660926 - RNA, 21 nt, Salmonella enterica enterica serovar Typhi
guuucuacaccuucuucgcca

SEQ ID NO: 3660927 - RNA, 19 nt, Salmonella enterica enterica serovar Typhi
guuucucccgccagaugca

SEQ ID NO: 3660928 - RNA, 17 nt, Salmonella enterica enterica serovar Typhi
guuucucuuccgccagc

SEQ ID NO: 3660929 - RNA, 19 nt, Salmonella enterica enterica serovar Typhi
guuucucuugugcuuccag

SEQ ID NO: 3660930 - RNA, 23 nt, Salmonella enterica enterica serovar Typhi
guuucugccgguucggcaucgcc

SEQ ID NO: 3660931 - RNA, 18 nt, Salmonella enterica enterica serovar Typhi
guuucuggcaacagccau

SEQ ID NO: 3660932 - RNA, 13 nt, Salmonella enterica enterica serovar Typhi
guuucuucaucaa

SEQ ID NO: 3660933 - RNA, 15 nt, Salmonella enterica enterica serovar Typhi
guuucuucgcuggcg

SEQ ID NO: 3660934 - RNA, 14 nt, Salmonella enterica enterica serovar Typhi
guuucuuucaucag

SEQ ID NO: 3660935 - RNA, 15 nt, Salmonella enterica enterica serovar Typhi
guuugaacagcaguu

SEQ ID NO: 3660936 - RNA, 17 nt, Salmonella enterica enterica serovar Typhi
guuugacgaaaucgcau

SEQ ID NO: 3660937 - RNA, 13 nt, Salmonella enterica enterica serovar Typhi
guuugacggcugc

SEQ ID NO: 3660938 - RNA, 19 nt, Salmonella enterica enterica serovar Typhi
guuugagaaaaacaucaug

SEQ ID NO: 3660939 - RNA, 21 nt, Salmonella enterica enterica serovar Typhi
guuugaggaaaccuuucuucu

SEQ ID NO: 3660940 - RNA, 18 nt, Salmonella enterica enterica serovar Typhi
guuugauaaacugcgcca

SEQ ID NO: 3660941 - RNA, 18 nt, Salmonella enterica enterica serovar Typhi
guuugccagcaccagcag

SEQ ID NO: 3660942 - RNA, 21 nt, Salmonella enterica enterica serovar Typhi
guuugcccaucauucaacgca

SEQ ID NO: 3660943 - RNA, 21 nt, Salmonella enterica enterica serovar Typhi
guuugccgcauacaucgcaga

SEQ ID NO: 3660944 - RNA, 15 nt, Salmonella enterica enterica serovar Typhi
guuugcgauccagua

SEQ ID NO: 3660945 - RNA, 14 nt, Salmonella enterica enterica serovar Typhi
guuugcgccgguuu

SEQ ID NO: 3660946 - RNA, 19 nt, Salmonella enterica enterica serovar Typhi
guuugcgcuccggcgcugg

SEQ ID NO: 3660947 - RNA, 23 nt, Salmonella enterica enterica serovar Typhi
uaaaaccguagauuuucaucaua

SEQ ID NO: 3660948 - RNA, 12 nt, Salmonella enterica enterica serovar Typhi
uaaaaccuggca

SEQ ID NO: 3660949 - RNA, 16 nt, Salmonella enterica enterica serovar Typhi
uaaaacgacucaucag

SEQ ID NO: 3660950 - RNA, 22 nt, Salmonella enterica enterica serovar Typhi
uaaaacgcauacugagcaucca

SEQ ID NO: 3660951 - RNA, 14 nt, Salmonella enterica enterica serovar Typhi
uaaaacgccauugu

SEQ ID NO: 3660952 - RNA, 21 nt, Salmonella enterica enterica serovar Typhi
uaaaacuucccgcgcagugca

SEQ ID NO: 3660953 - RNA, 15 nt, Salmonella enterica enterica serovar Typhi
uaaaagaaaaccgua

SEQ ID NO: 3660954 - RNA, 23 nt, Salmonella enterica enterica serovar Typhi
uaaaagaagaaaccgcagaaaaa

SEQ ID NO: 3660955 - RNA, 13 nt, Salmonella enterica enterica serovar Typhi
uaaaauaaacacu

SEQ ID NO: 3660956 - RNA, 14 nt, Salmonella enterica enterica serovar Typhi
uaaaauaaacacua

SEQ ID NO: 3660957 - RNA, 20 nt, Salmonella enterica enterica serovar Typhi
uaaaauaaacacuaaaucau

SEQ ID NO: 3660958 - RNA, 15 nt, Salmonella enterica enterica serovar Typhi
uaaaauaacuauaau

SEQ ID NO: 3660959 - RNA, 12 nt, Salmonella enterica enterica serovar Typhi
uaaaauaagaau

SEQ ID NO: 3660960 - RNA, 13 nt, Salmonella enterica enterica serovar Typhi
uaaaauagccauc

SEQ ID NO: 3660961 - RNA, 20 nt, Salmonella enterica enterica serovar Typhi
uaaaauauccaugcuuucaa

SEQ ID NO: 3660962 - RNA, 23 nt, Salmonella enterica enterica serovar Typhi
uaaaauauccaugcuuucaauaa

SEQ ID NO: 3660963 - RNA, 23 nt, Salmonella enterica enterica serovar Typhi
uaaaaucacuaagaccagcauca

SEQ ID NO: 3660964 - RNA, 23 nt, Salmonella enterica enterica serovar Typhi
uaaaauccggcaggcagccggau

SEQ ID NO: 3660965 - RNA, 19 nt, Salmonella enterica enterica serovar Typhi
uaaaauccggcugccugcc

SEQ ID NO: 3660966 - RNA, 20 nt, Salmonella enterica enterica serovar Typhi
uaaaauccugguaacggcac

SEQ ID NO: 3660967 - RNA, 17 nt, Salmonella enterica enterica serovar Typhi
uaaaauccuuuuucaug

SEQ ID NO: 3660968 - RNA, 11 nt, Salmonella enterica enterica serovar Typhi
uaaaaucgcgu

SEQ ID NO: 3660969 - RNA, 23 nt, Salmonella enterica enterica serovar Typhi
uaaaaucggggucuuccagcaga

SEQ ID NO: 3660970 - RNA, 18 nt, Salmonella enterica enterica serovar Typhi
uaaaaugcccgucucauu

SEQ ID NO: 3660971 - RNA, 17 nt, Salmonella enterica enterica serovar Typhi
uaaaauggcuugugaau

SEQ ID NO: 3660972 - RNA, 15 nt, Salmonella enterica enterica serovar Typhi
uaaaaugucuuuucg

SEQ ID NO: 3660973 - RNA, 23 nt, Salmonella enterica enterica serovar Typhi
uaaaauguuuuuguuguuaauuu

SEQ ID NO: 3660974 - RNA, 13 nt, Salmonella enterica enterica serovar Typhi
uaaaauuauaaac

SEQ ID NO: 3660975 - RNA, 17 nt, Salmonella enterica enterica serovar Typhi
uaaaauuauuuuuacuu

SEQ ID NO: 3660976 - RNA, 21 nt, Salmonella enterica enterica serovar Typhi
uaaaauuauuuuuacuuaaaa

SEQ ID NO: 3660977 - RNA, 22 nt, Salmonella enterica enterica serovar Typhi
uaaaauuauuuuuacuuaaaau

SEQ ID NO: 3660978 - RNA, 17 nt, Salmonella enterica enterica serovar Typhi
uaaacaacgccauaaua

SEQ ID NO: 3660979 - RNA, 19 nt, Salmonella enterica enterica serovar Typhi
uaaacacagcaaacauccc

SEQ ID NO: 3660980 - RNA, 20 nt, Salmonella enterica enterica serovar Typhi
uaaacacgauggcaaauaau

SEQ ID NO: 3660981 - RNA, 23 nt, Salmonella enterica enterica serovar Typhi
uaaacacgccgcgcuggauagcg

SEQ ID NO: 3660982 - RNA, 15 nt, Salmonella enterica enterica serovar Typhi
uaaacacuaaaucau

SEQ ID NO: 3660983 - RNA, 16 nt, Salmonella enterica enterica serovar Typhi
uaaacagacaauuagc

SEQ ID NO: 3660984 - RNA, 12 nt, Salmonella enterica enterica serovar Typhi
uaaacagcagcg

SEQ ID NO: 3660985 - RNA, 15 nt, Salmonella enterica enterica serovar Typhi
uaaacagcgccgcga

SEQ ID NO: 3660986 - RNA, 16 nt, Salmonella enterica enterica serovar Typhi
uaaacagcuccgcaaa

SEQ ID NO: 3660987 - RNA, 16 nt, Salmonella enterica enterica serovar Typhi
uaaacagcuugucgcc

SEQ ID NO: 3660988 - RNA, 17 nt, Salmonella enterica enterica serovar Typhi
uaaacaggcgcggcgcg

SEQ ID NO: 3660989 - RNA, 17 nt, Salmonella enterica enterica serovar Typhi
uaaaccaaacuuaucuc

SEQ ID NO: 3660990 - RNA, 15 nt, Salmonella enterica enterica serovar Typhi
uaaaccaaagcagag

SEQ ID NO: 3660991 - RNA, 16 nt, Salmonella enterica enterica serovar Typhi
uaaaccauuucuccug

SEQ ID NO: 3660992 - RNA, 19 nt, Salmonella enterica enterica serovar Typhi
uaaacccccuggccggaaa

SEQ ID NO: 3660993 - RNA, 18 nt, Salmonella enterica enterica serovar Typhi
uaaaccccgauaaaccag

SEQ ID NO: 3660994 - RNA, 15 nt, Salmonella enterica enterica serovar Typhi
uaaaccguuaugaau

SEQ ID NO: 3660995 - RNA, 12 nt, Salmonella enterica enterica serovar Typhi
uaaaccucuuug

SEQ ID NO: 3660996 - RNA, 20 nt, Salmonella enterica enterica serovar Typhi
uaaaccuguuuguuuauugu

SEQ ID NO: 3660997 - RNA, 21 nt, Salmonella enterica enterica serovar Typhi
uaaacgaucgguuaucacggu

SEQ ID NO: 3660998 - RNA, 18 nt, Salmonella enterica enterica serovar Typhi
uaaacgccaguggaugcg

SEQ ID NO: 3660999 - RNA, 14 nt, Salmonella enterica enterica serovar Typhi
uaaacgccccuucg

SEQ ID NO: 3661000 - RNA, 12 nt, Salmonella enterica enterica serovar Typhi
uaaacgccggau

SEQ ID NO: 3661001 - RNA, 16 nt, Salmonella enterica enterica serovar Typhi
uaaacgccucauccgg

SEQ ID NO: 3661002 - RNA, 13 nt, Salmonella enterica enterica serovar Typhi
uaaacgccugcac

SEQ ID NO: 3661003 - RNA, 21 nt, Salmonella enterica enterica serovar Typhi
uaaacggcagccgccaccaca

SEQ ID NO: 3661004 - RNA, 22 nt, Salmonella enterica enterica serovar Typhi
uaaacggcagccgccaccacaa

SEQ ID NO: 3661005 - RNA, 12 nt, Salmonella enterica enterica serovar Typhi
uaaacgggcugc

SEQ ID NO: 3661006 - RNA, 14 nt, Salmonella enterica enterica serovar Typhi
uaaacgucaugcug

SEQ ID NO: 3661007 - RNA, 16 nt, Salmonella enterica enterica serovar Typhi
uaaacgugcuggaugg

SEQ ID NO: 3661008 - RNA, 17 nt, Salmonella enterica enterica serovar Typhi
uaaacguuccugccagc

SEQ ID NO: 3661009 - RNA, 13 nt, Salmonella enterica enterica serovar Typhi
uaaacuaucgucu

SEQ ID NO: 3661010 - RNA, 18 nt, Salmonella enterica enterica serovar Typhi
uaaacucaucuuuauuca

SEQ ID NO: 3661011 - RNA, 19 nt, Salmonella enterica enterica serovar Typhi
uaaacuccauuaaauuacu

SEQ ID NO: 3661012 - RNA, 11 nt, Salmonella enterica enterica serovar Typhi
uaaacugccuu

SEQ ID NO: 3661013 - RNA, 20 nt, Salmonella enterica enterica serovar Typhi
uaaacugcgcgauaucugcc

SEQ ID NO: 3661014 - RNA, 22 nt, Salmonella enterica enterica serovar Typhi
uaaacuguccaguuuuugcauu

SEQ ID NO: 3661015 - RNA, 21 nt, Salmonella enterica enterica serovar Typhi
uaaacuucacgucgcucacau

SEQ ID NO: 3661016 - RNA, 11 nt, Salmonella enterica enterica serovar Typhi
uaaagaaaaac

SEQ ID NO: 3661017 - RNA, 12 nt, Salmonella enterica enterica serovar Typhi
uaaagaaaaacg

SEQ ID NO: 3661018 - RNA, 13 nt, Salmonella enterica enterica serovar Typhi
uaaagaaauuuaa

SEQ ID NO: 3661019 - RNA, 19 nt, Salmonella enterica enterica serovar Typhi
uaaagaaugaaaaaaaaau

SEQ ID NO: 3661020 - RNA, 21 nt, Salmonella enterica enterica serovar Typhi
uaaagacgugccggaagcgau

SEQ ID NO: 3661021 - RNA, 23 nt, Salmonella enterica enterica serovar Typhi
uaaagauuagcguuuuuaucuuu

SEQ ID NO: 3661022 - RNA, 14 nt, Salmonella enterica enterica serovar Typhi
uaaagauuggcauc

SEQ ID NO: 3661023 - RNA, 16 nt, Salmonella enterica enterica serovar Typhi
uaaagcacaagaacuu

SEQ ID NO: 3661024 - RNA, 22 nt, Salmonella enterica enterica serovar Typhi
uaaagcacaagaacuuaaauua

SEQ ID NO: 3661025 - RNA, 17 nt, Salmonella enterica enterica serovar Typhi
uaaagcacugguggaau

SEQ ID NO: 3661026 - RNA, 18 nt, Salmonella enterica enterica serovar Typhi
uaaagcagaccaccccac

SEQ ID NO: 3661027 - RNA, 13 nt, Salmonella enterica enterica serovar Typhi
uaaagcagugcag

SEQ ID NO: 3661028 - RNA, 19 nt, Salmonella enterica enterica serovar Typhi
uaaagcagugcaguauugc

SEQ ID NO: 3661029 - RNA, 17 nt, Salmonella enterica enterica serovar Typhi
uaaagcccagcacggca

SEQ ID NO: 3661030 - RNA, 14 nt, Salmonella enterica enterica serovar Typhi
uaaagcccugacag

SEQ ID NO: 3661031 - RNA, 21 nt, Salmonella enterica enterica serovar Typhi
uaaagccgccauccggcauuu

SEQ ID NO: 3661032 - RNA, 19 nt, Salmonella enterica enterica serovar Typhi
uaaagccgccgugcucacu

SEQ ID NO: 3661033 - RNA, 23 nt, Salmonella enterica enterica serovar Typhi
uaacaaaccgguaaucccuucac

SEQ ID NO: 3661034 - RNA, 11 nt, Salmonella enterica enterica serovar Typhi
uaacaaaucau

SEQ ID NO: 3661035 - RNA, 14 nt, Salmonella enterica enterica serovar Typhi
uaacaaaugaagca

SEQ ID NO: 3661036 - RNA, 16 nt, Salmonella enterica enterica serovar Typhi
uaacaacuguuuuuca

SEQ ID NO: 3661037 - RNA, 17 nt, Salmonella enterica enterica serovar Typhi
uaacaacuguuuuucac

SEQ ID NO: 3661038 - RNA, 17 nt, Salmonella enterica enterica serovar Typhi
uaacaauagaccugaaa

SEQ ID NO: 3661039 - RNA, 18 nt, Salmonella enterica enterica serovar Typhi
uaacaauauuaaauaaau

SEQ ID NO: 3661040 - RNA, 20 nt, Salmonella enterica enterica serovar Typhi
uaacaauccuaccguaacgu

SEQ ID NO: 3661041 - RNA, 17 nt, Salmonella enterica enterica serovar Typhi
uaacacaaucaggcgca

SEQ ID NO: 3661042 - RNA, 17 nt, Salmonella enterica enterica serovar Typhi
uaacacacuuucugcuu

SEQ ID NO: 3661043 - RNA, 12 nt, Salmonella enterica enterica serovar Typhi
uaacacaugcaa

SEQ ID NO: 3661044 - RNA, 19 nt, Salmonella enterica enterica serovar Typhi
uaacaccgcauggcuggca

SEQ ID NO: 3661045 - RNA, 23 nt, Salmonella enterica enterica serovar Typhi
uaacaccgcauggcuggcauauu

SEQ ID NO: 3661046 - RNA, 17 nt, Salmonella enterica enterica serovar Typhi
uaacaccguuggcguca

SEQ ID NO: 3661047 - RNA, 13 nt, Salmonella enterica enterica serovar Typhi
uaacacuaacuaa

SEQ ID NO: 3661048 - RNA, 13 nt, Salmonella enterica enterica serovar Typhi
uaacacugccgaa

SEQ ID NO: 3661049 - RNA, 21 nt, Salmonella enterica enterica serovar Typhi
uaacacuuugaacgagucuua

SEQ ID NO: 3661050 - RNA, 19 nt, Salmonella enterica enterica serovar Typhi
uaacagacgcaucuuuuuc

SEQ ID NO: 3661051 - RNA, 18 nt, Salmonella enterica enterica serovar Typhi
uaacagagagggaaaaaa

SEQ ID NO: 3661052 - RNA, 20 nt, Salmonella enterica enterica serovar Typhi
uaacagagagggaaaaaaau

SEQ ID NO: 3661053 - RNA, 15 nt, Salmonella enterica enterica serovar Typhi
uaacagcagcagcaa

SEQ ID NO: 3661054 - RNA, 19 nt, Salmonella enterica enterica serovar Typhi
uaacagccgcggaccuuuu

SEQ ID NO: 3661055 - RNA, 22 nt, Salmonella enterica enterica serovar Typhi
uaacagcgccgcgccgauagcg

SEQ ID NO: 3661056 - RNA, 19 nt, Salmonella enterica enterica serovar Typhi
uaacagcgcgaccagcgug

SEQ ID NO: 3661057 - RNA, 19 nt, Salmonella enterica enterica serovar Typhi
uaacagcgcgaccaggaaa

SEQ ID NO: 3661058 - RNA, 19 nt, Salmonella enterica enterica serovar Typhi
uaacagcgcuaucaggaag

SEQ ID NO: 3661059 - RNA, 21 nt, Salmonella enterica enterica serovar Typhi
uaacagcgcugguagcaccga

SEQ ID NO: 3661060 - RNA, 22 nt, Salmonella enterica enterica serovar Typhi
uaacagcgguauacaccagcuc

SEQ ID NO: 3661061 - RNA, 18 nt, Salmonella enterica enterica serovar Typhi
uaacagcuugaucaucag

SEQ ID NO: 3661062 - RNA, 19 nt, Salmonella enterica enterica serovar Typhi
uaacagcuugaucaucagg

SEQ ID NO: 3661063 - RNA, 19 nt, Salmonella enterica enterica serovar Typhi
uaacaggcgccggggcagc

SEQ ID NO: 3661064 - RNA, 21 nt, Salmonella enterica enterica serovar Typhi
uaacagggugauggugucaau

SEQ ID NO: 3661065 - RNA, 14 nt, Salmonella enterica enterica serovar Typhi
uaacagucgcgccg

SEQ ID NO: 3661066 - RNA, 22 nt, Salmonella enterica enterica serovar Typhi
uaacauaaauaguauuaguuga

SEQ ID NO: 3661067 - RNA, 12 nt, Salmonella enterica enterica serovar Typhi
uaacauaaccgg

SEQ ID NO: 3661068 - RNA, 18 nt, Salmonella enterica enterica serovar Typhi
uaacauaucgacauaagu

SEQ ID NO: 3661069 - RNA, 14 nt, Salmonella enterica enterica serovar Typhi
uaacaucaaguaca

SEQ ID NO: 3661070 - RNA, 21 nt, Salmonella enterica enterica serovar Typhi
uaacaucaccuuucauuuuau

SEQ ID NO: 3661071 - RNA, 18 nt, Salmonella enterica enterica serovar Typhi
uaacauuuaagaaacaau

SEQ ID NO: 3661072 - RNA, 15 nt, Salmonella enterica enterica serovar Typhi
uaacauuucagucua

SEQ ID NO: 3661073 - RNA, 22 nt, Salmonella enterica enterica serovar Typhi
uaacauuugccgggccaacaga

SEQ ID NO: 3661074 - RNA, 13 nt, Salmonella enterica enterica serovar Typhi
uaaccaaaccaga

SEQ ID NO: 3661075 - RNA, 16 nt, Salmonella enterica enterica serovar Typhi
uaaccaaagcaccauu

SEQ ID NO: 3661076 - RNA, 14 nt, Salmonella enterica enterica serovar Typhi
uaaccacagccuua

SEQ ID NO: 3661077 - RNA, 15 nt, Salmonella enterica enterica serovar Typhi
uaaccaccuguucgc

SEQ ID NO: 3661078 - RNA, 17 nt, Salmonella enterica enterica serovar Typhi
uaaccacgaaaauuauu

SEQ ID NO: 3661079 - RNA, 21 nt, Salmonella enterica enterica serovar Typhi
uaaccagaaaaccgacagcaa

SEQ ID NO: 3661080 - RNA, 17 nt, Salmonella enterica enterica serovar Typhi
uaaccagauaagccugu

SEQ ID NO: 3661081 - RNA, 21 nt, Salmonella enterica enterica serovar Typhi
uaaccagggaggacgcaagag

SEQ ID NO: 3661082 - RNA, 21 nt, Salmonella enterica enterica serovar Typhi
uaaccagucguuaucugacau

SEQ ID NO: 3661083 - RNA, 14 nt, Salmonella enterica enterica serovar Typhi
uaaccaucacgauc

SEQ ID NO: 3661084 - RNA, 18 nt, Salmonella enterica enterica serovar Typhi
uaaccauucccgauaaug

SEQ ID NO: 3661085 - RNA, 22 nt, Salmonella enterica enterica serovar Typhi
uaacccacaagaaaugcaggcg

SEQ ID NO: 3661086 - RNA, 19 nt, Salmonella enterica enterica serovar Typhi
uaacccaguucaaaucgau

SEQ ID NO: 3661087 - RNA, 16 nt, Salmonella enterica enterica serovar Typhi
uaacccgauacccuga

SEQ ID NO: 3661088 - RNA, 19 nt, Salmonella enterica enterica serovar Typhi
uaaccgauaacgcggcccg

SEQ ID NO: 3661089 - RNA, 16 nt, Salmonella enterica enterica serovar Typhi
uaaccgaugcaaccgc

SEQ ID NO: 3661090 - RNA, 20 nt, Salmonella enterica enterica serovar Typhi
uaaccgauuguguguuaaug

SEQ ID NO: 3661091 - RNA, 15 nt, Salmonella enterica enterica serovar Typhi
uaaccgcaaaugcca

SEQ ID NO: 3661092 - RNA, 17 nt, Salmonella enterica enterica serovar Typhi
uaaccgcagcgcggccu

SEQ ID NO: 3661093 - RNA, 15 nt, Salmonella enterica enterica serovar Typhi
uaaccgcccgcggcg

SEQ ID NO: 3661094 - RNA, 17 nt, Salmonella enterica enterica serovar Typhi
uaaccgcgaucgaugug

SEQ ID NO: 3661095 - RNA, 20 nt, Salmonella enterica enterica serovar Typhi
uaaccgcgcaaucaaaacau

SEQ ID NO: 3661096 - RNA, 12 nt, Salmonella enterica enterica serovar Typhi
uaaccgcuuuuu

SEQ ID NO: 3661097 - RNA, 22 nt, Salmonella enterica enterica serovar Typhi
uaaccggacgauuuaagcuuaa

SEQ ID NO: 3661098 - RNA, 22 nt, Salmonella enterica enterica serovar Typhi
uaaccgucuggcugccaucggc

SEQ ID NO: 3661099 - RNA, 15 nt, Salmonella enterica enterica serovar Typhi
uaaccguucuuccug

SEQ ID NO: 3661100 - RNA, 16 nt, Salmonella enterica enterica serovar Typhi
uaaccguucuuccugg

SEQ ID NO: 3661101 - RNA, 18 nt, Salmonella enterica enterica serovar Typhi
uaaccuauuuuacaaaau

SEQ ID NO: 3661102 - RNA, 17 nt, Salmonella enterica enterica serovar Typhi
uaaccucuauaguaaau

SEQ ID NO: 3661103 - RNA, 18 nt, Salmonella enterica enterica serovar Typhi
uaaccucuauaguaaauu

SEQ ID NO: 3661104 - RNA, 17 nt, Salmonella enterica enterica serovar Typhi
uaaccuguaaauaauag

SEQ ID NO: 3661105 - RNA, 19 nt, Salmonella enterica enterica serovar Typhi
uaaccuguaucugcugaca

SEQ ID NO: 3661106 - RNA, 19 nt, Salmonella enterica enterica serovar Typhi
uaaccuguuccucacugag

SEQ ID NO: 3661107 - RNA, 22 nt, Salmonella enterica enterica serovar Typhi
uaacgaaaagggucauaaccgg

SEQ ID NO: 3661108 - RNA, 17 nt, Salmonella enterica enterica serovar Typhi
uaacgacgcuccagaau

SEQ ID NO: 3661109 - RNA, 18 nt, Salmonella enterica enterica serovar Typhi
uaacgaugauuauuguua

SEQ ID NO: 3661110 - RNA, 15 nt, Salmonella enterica enterica serovar Typhi
uaacgcaacaacagu

SEQ ID NO: 3661111 - RNA, 23 nt, Salmonella enterica enterica serovar Typhi
uaacgcacuggucgggcaggcuu

SEQ ID NO: 3661112 - RNA, 17 nt, Salmonella enterica enterica serovar Typhi
uaacgcacuuuuccagc

SEQ ID NO: 3661113 - RNA, 14 nt, Salmonella enterica enterica serovar Typhi
uaacgcagaagaca

SEQ ID NO: 3661114 - RNA, 18 nt, Salmonella enterica enterica serovar Typhi
uaacgcauacauucuguu

SEQ ID NO: 3661115 - RNA, 13 nt, Salmonella enterica enterica serovar Typhi
uaacgcaucgcgg

SEQ ID NO: 3661116 - RNA, 15 nt, Salmonella enterica enterica serovar Typhi
uaacgcaucgcggau

SEQ ID NO: 3661117 - RNA, 16 nt, Salmonella enterica enterica serovar Typhi
uaacgccgcguucgcg

SEQ ID NO: 3661118 - RNA, 17 nt, Salmonella enterica enterica serovar Typhi
uaagccagacgcgcagc

SEQ ID NO: 3661119 - RNA, 19 nt, Salmonella enterica enterica serovar Typhi
uaagccaugugacggcaug

SEQ ID NO: 3661120 - RNA, 20 nt, Salmonella enterica enterica serovar Typhi
uaagcccauggcaggcagca

SEQ ID NO: 3661121 - RNA, 16 nt, Salmonella enterica enterica serovar Typhi
uaagccgauugaauaa

SEQ ID NO: 3661122 - RNA, 23 nt, Salmonella enterica enterica serovar Typhi
uaagccggcaggcagcgccagcg

SEQ ID NO: 3661123 - RNA, 17 nt, Salmonella enterica enterica serovar Typhi
uaagccgguaaucacug

SEQ ID NO: 3661124 - RNA, 20 nt, Salmonella enterica enterica serovar Typhi
uaagcgaaccuuaagcgcga

SEQ ID NO: 3661125 - RNA, 18 nt, Salmonella enterica enterica serovar Typhi
uaagcgcaaacuuccaca

SEQ ID NO: 3661126 - RNA, 20 nt, Salmonella enterica enterica serovar Typhi
uaagcgcagcgccauugagc

SEQ ID NO: 3661127 - RNA, 14 nt, Salmonella enterica enterica serovar Typhi
uaagcgcccgucca

SEQ ID NO: 3661128 - RNA, 13 nt, Salmonella enterica enterica serovar Typhi
uaagcgccgcuga

SEQ ID NO: 3661129 - RNA, 19 nt, Salmonella enterica enterica serovar Typhi
uaagcgccugcugcgcaac

SEQ ID NO: 3661130 - RNA, 16 nt, Salmonella enterica enterica serovar Typhi
uaagcgcgaaauuuau

SEQ ID NO: 3661131 - RNA, 19 nt, Salmonella enterica enterica serovar Typhi
uaagcggcaagccgaucag

SEQ ID NO: 3661132 - RNA, 16 nt, Salmonella enterica enterica serovar Typhi
uaagcggcagcgccau

SEQ ID NO: 3661133 - RNA, 13 nt, Salmonella enterica enterica serovar Typhi
uaagcguagcgcc

SEQ ID NO: 3661134 - RNA, 13 nt, Salmonella enterica enterica serovar Typhi
uaagcgucagccc

SEQ ID NO: 3661135 - RNA, 15 nt, Salmonella enterica enterica serovar Typhi
uaagcgucgccagaa

SEQ ID NO: 3661136 - RNA, 22 nt, Salmonella enterica enterica serovar Typhi
uaagcgucugcaaugguaaaac

SEQ ID NO: 3661137 - RNA, 18 nt, Salmonella enterica enterica serovar Typhi
uaagcguggcgcaaccga

SEQ ID NO: 3661138 - RNA, 17 nt, Salmonella enterica enterica serovar Typhi
uaagcguuacggaaaaa

SEQ ID NO: 3661139 - RNA, 16 nt, Salmonella enterica enterica serovar Typhi
uaagcuauuccuguau

SEQ ID NO: 3661140 - RNA, 20 nt, Salmonella enterica enterica serovar Typhi
uaagcugcgaagccaccgga

SEQ ID NO: 3661141 - RNA, 19 nt, Salmonella enterica enterica serovar Typhi
uaagcuggaccgcagcuua

SEQ ID NO: 3661142 - RNA, 23 nt, Salmonella enterica enterica serovar Typhi
uaagcuggcgaacguuacccggc

SEQ ID NO: 3661143 - RNA, 18 nt, Salmonella enterica enterica serovar Typhi
uaagcuuaggauaagaau

SEQ ID NO: 3661144 - RNA, 20 nt, Salmonella enterica enterica serovar Typhi
uaagcuuccgccaugguugg

SEQ ID NO: 3661145 - RNA, 20 nt, Salmonella enterica enterica serovar Typhi
uaagcuuuaaccacagccuu

SEQ ID NO: 3661146 - RNA, 18 nt, Salmonella enterica enterica serovar Typhi
uaaggaaacgaaagcuca

SEQ ID NO: 3661147 - RNA, 22 nt, Salmonella enterica enterica serovar Typhi
uaaggaugaacucuaugcaaaa

SEQ ID NO: 3661148 - RNA, 23 nt, Salmonella enterica enterica serovar Typhi
uaaggcaucguugagaaaaccau

SEQ ID NO: 3661149 - RNA, 19 nt, Salmonella enterica enterica serovar Typhi
uaaggccugccguccugau

SEQ ID NO: 3661150 - RNA, 22 nt, Salmonella enterica enterica serovar Typhi
uaaggcgaaaccgcuacccggc

SEQ ID NO: 3661151 - RNA, 21 nt, Salmonella enterica enterica serovar Typhi
uaaggcgauaccuaaucccug

SEQ ID NO: 3661152 - RNA, 20 nt, Salmonella enterica enterica serovar Typhi
uaaggcgauucaacagggca

SEQ ID NO: 3661153 - RNA, 21 nt, Salmonella enterica enterica serovar Typhi
uaaggcgauucaacagggcaa

SEQ ID NO: 3661154 - RNA, 13 nt, Salmonella enterica enterica serovar Typhi
uaaggcgccuuuu

SEQ ID NO: 3661155 - RNA, 15 nt, Salmonella enterica enterica serovar Typhi
uaaggcgcggccuca

SEQ ID NO: 3661156 - RNA, 19 nt, Salmonella enterica enterica serovar Typhi
uaaggcgcuugcgccgcca

SEQ ID NO: 3661157 - RNA, 20 nt, Salmonella enterica enterica serovar Typhi
uaaggcgcuugugauaucug

SEQ ID NO: 3661158 - RNA, 17 nt, Salmonella enterica enterica serovar Typhi
uaaggcguuuacgccgc

SEQ ID NO: 3661159 - RNA, 18 nt, Salmonella enterica enterica serovar Typhi
uaaggcucucuuaccagc

SEQ ID NO: 3661160 - RNA, 16 nt, Salmonella enterica enterica serovar Typhi
uaaggcuggcacguuc

SEQ ID NO: 3661161 - RNA, 16 nt, Salmonella enterica enterica serovar Typhi
uaagggcuggaaaauc

SEQ ID NO: 3661162 - RNA, 22 nt, Salmonella enterica enterica serovar Typhi
uaaggggcaggcgucaaaacag

SEQ ID NO: 3661163 - RNA, 20 nt, Salmonella enterica enterica serovar Typhi
uaagguaacgcgaaaaaaga

SEQ ID NO: 3661164 - RNA, 16 nt, Salmonella enterica enterica serovar Typhi
uaagguccagggaaaa

SEQ ID NO: 3661165 - RNA, 19 nt, Salmonella enterica enterica serovar Typhi
uaaggucgcuauccagcag

SEQ ID NO: 3661166 - RNA, 19 nt, Salmonella enterica enterica serovar Typhi
uaagguuacaggugccugg

SEQ ID NO: 3661167 - RNA, 18 nt, Salmonella enterica enterica serovar Typhi
uaagguucgcuuaaucuc

SEQ ID NO: 3661168 - RNA, 15 nt, Salmonella enterica enterica serovar Typhi
uaagguucuggcauu

SEQ ID NO: 3661169 - RNA, 21 nt, Salmonella enterica enterica serovar Typhi
uaaguacaagagccgccgcca

SEQ ID NO: 3661170 - RNA, 13 nt, Salmonella enterica enterica serovar Typhi
uaaguaugccgca

SEQ ID NO: 3661171 - RNA, 14 nt, Salmonella enterica enterica serovar Typhi
uaagucauccagac

SEQ ID NO: 3661172 - RNA, 19 nt, Salmonella enterica enterica serovar Typhi
uaagucgccgcagcuccau

SEQ ID NO: 3661173 - RNA, 15 nt, Salmonella enterica enterica serovar Typhi
uaaguugaccacauc

SEQ ID NO: 3661174 - RNA, 11 nt, Salmonella enterica enterica serovar Typhi
uaauaaagaaa

SEQ ID NO: 3661175 - RNA, 20 nt, Salmonella enterica enterica serovar Typhi
uaauaaccaauaauugccga

SEQ ID NO: 3661176 - RNA, 20 nt, Salmonella enterica enterica serovar Typhi
uaauaaccccagcugcggca

SEQ ID NO: 3661177 - RNA, 23 nt, Salmonella enterica enterica serovar Typhi
uaauaagcggccuauauuagugu

SEQ ID NO: 3661178 - RNA, 13 nt, Salmonella enterica enterica serovar Typhi
uaauaauauaaag

SEQ ID NO: 3661179 - RNA, 22 nt, Salmonella enterica enterica serovar Typhi
uaauaauugagcgcaaaacgcu

SEQ ID NO: 3661180 - RNA, 20 nt, Salmonella enterica enterica serovar Typhi
uaauacaccgccauauauuu

SEQ ID NO: 3661181 - RNA, 20 nt, Salmonella enterica enterica serovar Typhi
uaauacacgguaaauucuuu

SEQ ID NO: 3661182 - RNA, 17 nt, Salmonella enterica enterica serovar Typhi
uaauacaucagaaaaca

SEQ ID NO: 3661183 - RNA, 17 nt, Salmonella enterica enterica serovar Typhi
uaauacaucaugcuugc

SEQ ID NO: 3661184 - RNA, 15 nt, Salmonella enterica enterica serovar Typhi
uaauacauugccgca

SEQ ID NO: 3661185 - RNA, 15 nt, Salmonella enterica enterica serovar Typhi
uaauaccacgauggu

SEQ ID NO: 3661186 - RNA, 19 nt, Salmonella enterica enterica serovar Typhi
uaauaccaucuccaucggg

SEQ ID NO: 3661187 - RNA, 21 nt, Salmonella enterica enterica serovar Typhi
uaauaccgugcaggacagaca

SEQ ID NO: 3661188 - RNA, 22 nt, Salmonella enterica enterica serovar Typhi
uaauacgcgaugagauaauaaa

SEQ ID NO: 3661189 - RNA, 19 nt, Salmonella enterica enterica serovar Typhi
uaauacguaaaccgcucac

SEQ ID NO: 3661190 - RNA, 19 nt, Salmonella enterica enterica serovar Typhi
uaauacguuuauucuuuuc

SEQ ID NO: 3661191 - RNA, 13 nt, Salmonella enterica enterica serovar Typhi
uaauacugccgca

SEQ ID NO: 3661192 - RNA, 15 nt, Salmonella enterica enterica serovar Typhi
uaauacuggcgccuu

SEQ ID NO: 3661193 - RNA, 21 nt, Salmonella enterica enterica serovar Typhi
uaauagagauccuggcgaaag

SEQ ID NO: 3661194 - RNA, 14 nt, Salmonella enterica enterica serovar Typhi
uaauagauugcgcc

SEQ ID NO: 3661195 - RNA, 23 nt, Salmonella enterica enterica serovar Typhi
uaauagguacggggcaucuauuu

SEQ ID NO: 3661196 - RNA, 20 nt, Salmonella enterica enterica serovar Typhi
uaauaguuucgacuuucauu

SEQ ID NO: 3661197 - RNA, 17 nt, Salmonella enterica enterica serovar Typhi
uaauauaaccaauuuaa

SEQ ID NO: 3661198 - RNA, 20 nt, Salmonella enterica enterica serovar Typhi
uaauauaaccaauuuaaaau

SEQ ID NO: 3661199 - RNA, 12 nt, Salmonella enterica enterica serovar Typhi
uaauauacauuc

SEQ ID NO: 3661200 - RNA, 21 nt, Salmonella enterica enterica serovar Typhi
uaauauaugaaccaagauaag

SEQ ID NO: 3661201 - RNA, 20 nt, Salmonella enterica enterica serovar Typhi
uaauaucgcgcucuuccgcc

SEQ ID NO: 3661202 - RNA, 23 nt, Salmonella enterica enterica serovar Typhi
uaauaucguuaagccuucaauuu

SEQ ID NO: 3661203 - RNA, 17 nt, Salmonella enterica enterica serovar Typhi
uaauggcgcgaaaacag

SEQ ID NO: 3661204 - RNA, 12 nt, Salmonella enterica enterica serovar Typhi
uaauggcgucaa

SEQ ID NO: 3661205 - RNA, 19 nt, Salmonella enterica enterica serovar Typhi
uaaugguggaaugccccag

SEQ ID NO: 3661206 - RNA, 16 nt, Salmonella enterica enterica serovar Typhi
uaaugguggcaaccug

SEQ ID NO: 3661207 - RNA, 20 nt, Salmonella enterica enterica serovar Typhi
uaauggugguugcaucaucg

SEQ ID NO: 3661208 - RNA, 16 nt, Salmonella enterica enterica serovar Typhi
uaaugugauccgcccc

SEQ ID NO: 3661209 - RNA, 18 nt, Salmonella enterica enterica serovar Typhi
uaauguucaguuuuucca

SEQ ID NO: 3661210 - RNA, 14 nt, Salmonella enterica enterica serovar Typhi
uaauguuugcgcca

SEQ ID NO: 3661211 - RNA, 17 nt, Salmonella enterica enterica serovar Typhi
uaauguuuucugccagc

SEQ ID NO: 3661212 - RNA, 12 nt, Salmonella enterica enterica serovar Typhi
uaauuaaaugcu

SEQ ID NO: 3661213 - RNA, 18 nt, Salmonella enterica enterica serovar Typhi
uaauuacuccguuuuaau

SEQ ID NO: 3661214 - RNA, 13 nt, Salmonella enterica enterica serovar Typhi
uaauuagagacau

SEQ ID NO: 3661215 - RNA, 16 nt, Salmonella enterica enterica serovar Typhi
uaauuauuacagacag

SEQ ID NO: 3661216 - RNA, 14 nt, Salmonella enterica enterica serovar Typhi
uaauucagcucaac

SEQ ID NO: 3661217 - RNA, 16 nt, Salmonella enterica enterica serovar Typhi
uaauucauaacaccaa

SEQ ID NO: 3661218 - RNA, 18 nt, Salmonella enterica enterica serovar Typhi
uaauucauaacaccaaua

SEQ ID NO: 3661219 - RNA, 14 nt, Salmonella enterica enterica serovar Typhi
uaauucaugcugua

SEQ ID NO: 3661220 - RNA, 22 nt, Salmonella enterica enterica serovar Typhi
uaauucauggccaucaacuucu

SEQ ID NO: 3661221 - RNA, 17 nt, Salmonella enterica enterica serovar Typhi
uaauuccgcaucauuca

SEQ ID NO: 3661222 - RNA, 17 nt, Salmonella enterica enterica serovar Typhi
uaauuccucagaauccg

SEQ ID NO: 3661223 - RNA, 16 nt, Salmonella enterica enterica serovar Typhi
uaauucuaaaaguaag

SEQ ID NO: 3661224 - RNA, 17 nt, Salmonella enterica enterica serovar Typhi
uaauucucacagaauca

SEQ ID NO: 3661225 - RNA, 18 nt, Salmonella enterica enterica serovar Typhi
uaauucucacagaaucau

SEQ ID NO: 3661226 - RNA, 20 nt, Salmonella enterica enterica serovar Typhi
uaauucucacagaaucauca

SEQ ID NO: 3661227 - RNA, 19 nt, Salmonella enterica enterica serovar Typhi
uaauucuuaacccacaaga

SEQ ID NO: 3661228 - RNA, 20 nt, Salmonella enterica enterica serovar Typhi
uaauugcugacgcgcuuuuu

SEQ ID NO: 3661229 - RNA, 21 nt, Salmonella enterica enterica serovar Typhi
uaauugcuuugcaauguucaa

SEQ ID NO: 3661230 - RNA, 13 nt, Salmonella enterica enterica serovar Typhi
uaauuggcuuacc

SEQ ID NO: 3661231 - RNA, 15 nt, Salmonella enterica enterica serovar Typhi
uaauuguguaaucuu

SEQ ID NO: 3661232 - RNA, 22 nt, Salmonella enterica enterica serovar Typhi
uaauuuaugauuuuaacaucac

SEQ ID NO: 3661233 - RNA, 14 nt, Salmonella enterica enterica serovar Typhi
uaauuuauuaaccc

SEQ ID NO: 3661234 - RNA, 12 nt, Salmonella enterica enterica serovar Typhi
uaauuucaauuu

SEQ ID NO: 3661235 - RNA, 16 nt, Salmonella enterica enterica serovar Typhi
uaauuucaauuuugcc

SEQ ID NO: 3661236 - RNA, 11 nt, Salmonella enterica enterica serovar Typhi
uaauuuccacg

SEQ ID NO: 3661237 - RNA, 23 nt, Salmonella enterica enterica serovar Typhi
uaauuuccagugccaguuaagca

SEQ ID NO: 3661238 - RNA, 14 nt, Salmonella enterica enterica serovar Typhi
uaauuugaaucgcc

SEQ ID NO: 3661239 - RNA, 15 nt, Salmonella enterica enterica serovar Typhi
uaauuugcaaaccau

SEQ ID NO: 3661240 - RNA, 23 nt, Salmonella enterica enterica serovar Typhi
uaauuugcaaaccaugauaauaa

SEQ ID NO: 3661241 - RNA, 17 nt, Salmonella enterica enterica serovar Typhi
uaauuuuacuuucauuc

SEQ ID NO: 3661242 - RNA, 13 nt, Salmonella enterica enterica serovar Typhi
uaauuuucaccuc

SEQ ID NO: 3661243 - RNA, 19 nt, Salmonella enterica enterica serovar Typhi
uaauuuuguuaaagugagu

SEQ ID NO: 3661244 - RNA, 15 nt, Salmonella enterica enterica serovar Typhi
uacaaaauaagucau

SEQ ID NO: 3661245 - RNA, 21 nt, Salmonella enterica enterica serovar Typhi
uacaaaauaagucauaucaau

SEQ ID NO: 3661246 - RNA, 23 nt, Salmonella enterica enterica serovar Typhi
uacaaaauaugggauuugaugcc

SEQ ID NO: 3661247 - RNA, 13 nt, Salmonella enterica enterica serovar Typhi
uacaaacaaauaa

SEQ ID NO: 3661248 - RNA, 23 nt, Salmonella enterica enterica serovar Typhi
uacaaagccaaaauuuucaauac

SEQ ID NO: 3661249 - RNA, 19 nt, Salmonella enterica enterica serovar Typhi
uacaaagggcaauauauua

SEQ ID NO: 3661250 - RNA, 20 nt, Salmonella enterica enterica serovar Typhi
uacaaagggcaauauauuau

SEQ ID NO: 3661251 - RNA, 16 nt, Salmonella enterica enterica serovar Typhi
uacaaauuuaaacaug

SEQ ID NO: 3661252 - RNA, 13 nt, Salmonella enterica enterica serovar Typhi
uacaaccgcaccg

SEQ ID NO: 3661253 - RNA, 21 nt, Salmonella enterica enterica serovar Typhi
uacaacgacuacguucaucag

SEQ ID NO: 3661254 - RNA, 21 nt, Salmonella enterica enterica serovar Typhi
uacaacguucggucauggaua

SEQ ID NO: 3661255 - RNA, 22 nt, Salmonella enterica enterica serovar Typhi
uacaacuacucguaaucuaaaa

SEQ ID NO: 3661256 - RNA, 18 nt, Salmonella enterica enterica serovar Typhi
uacaagaauuuaucgcaa

SEQ ID NO: 3661257 - RNA, 16 nt, Salmonella enterica enterica serovar Typhi
uacaagcaguuaauac

SEQ ID NO: 3661258 - RNA, 16 nt, Salmonella enterica enterica serovar Typhi
uacaaggaaagaaaau

SEQ ID NO: 3661259 - RNA, 20 nt, Salmonella enterica enterica serovar Typhi
uacaaggaaagaaaaugcca

SEQ ID NO: 3661260 - RNA, 22 nt, Salmonella enterica enterica serovar Typhi
uacaauaagggcauguuucaug

SEQ ID NO: 3661261 - RNA, 18 nt, Salmonella enterica enterica serovar Typhi
uacaaucgucuucagcaa

SEQ ID NO: 3661262 - RNA, 22 nt, Salmonella enterica enterica serovar Typhi
uacaaucgucuucagcaauuac

SEQ ID NO: 3661263 - RNA, 14 nt, Salmonella enterica enterica serovar Typhi
uacaauggcaggca

SEQ ID NO: 3661264 - RNA, 16 nt, Salmonella enterica enterica serovar Typhi
uacaauggcaggcaua

SEQ ID NO: 3661265 - RNA, 16 nt, Salmonella enterica enterica serovar Typhi
uacaauucaacucacu

SEQ ID NO: 3661266 - RNA, 14 nt, Salmonella enterica enterica serovar Typhi
uacaauuucgcaaa

SEQ ID NO: 3661267 - RNA, 15 nt, Salmonella enterica enterica serovar Typhi
uacacacucggugca

SEQ ID NO: 3661268 - RNA, 14 nt, Salmonella enterica enterica serovar Typhi
uacacagacugcuu

SEQ ID NO: 3661269 - RNA, 16 nt, Salmonella enterica enterica serovar Typhi
uacacaucaggaaugc

SEQ ID NO: 3661270 - RNA, 22 nt, Salmonella enterica enterica serovar Typhi
uacacaucauuaccauagccgu

SEQ ID NO: 3661271 - RNA, 18 nt, Salmonella enterica enterica serovar Typhi
uacaccguaaagcaccau

SEQ ID NO: 3661272 - RNA, 20 nt, Salmonella enterica enterica serovar Typhi
uacaccugacggcagccacg

SEQ ID NO: 3661273 - RNA, 20 nt, Salmonella enterica enterica serovar Typhi
uacacgauaaaccucacgca

SEQ ID NO: 3661274 - RNA, 23 nt, Salmonella enterica enterica serovar Typhi
uacacgcaucgggucgcgcgccg

SEQ ID NO: 3661275 - RNA, 18 nt, Salmonella enterica enterica serovar Typhi
uacacgcgaauagccaga

SEQ ID NO: 3661276 - RNA, 16 nt, Salmonella enterica enterica serovar Typhi
uacacucaaccaucaa

SEQ ID NO: 3661277 - RNA, 15 nt, Salmonella enterica enterica serovar Typhi
uacacucugcgcgcg

SEQ ID NO: 3661278 - RNA, 21 nt, Salmonella enterica enterica serovar Typhi
uacacugaagccuggugccca

SEQ ID NO: 3661279 - RNA, 16 nt, Salmonella enterica enterica serovar Typhi
uacacugauaccccag

SEQ ID NO: 3661280 - RNA, 17 nt, Salmonella enterica enterica serovar Typhi
uacacuucagccagacg

SEQ ID NO: 3661281 - RNA, 14 nt, Salmonella enterica enterica serovar Typhi
uacacuucauccgg

SEQ ID NO: 3661282 - RNA, 17 nt, Salmonella enterica enterica serovar Typhi
uacagaaaaccggcaaa

SEQ ID NO: 3661283 - RNA, 12 nt, Salmonella enterica enterica serovar Typhi
uacagacaucau

SEQ ID NO: 3661284 - RNA, 20 nt, Salmonella enterica enterica serovar Typhi
uacagacaucaucgaacgcc

SEQ ID NO: 3661285 - RNA, 17 nt, Salmonella enterica enterica serovar Typhi
uacagaugaacguaacg

SEQ ID NO: 3661286 - RNA, 22 nt, Salmonella enterica enterica serovar Typhi
uacagaugccguccauccggcg

SEQ ID NO: 3661287 - RNA, 22 nt, Salmonella enterica enterica serovar Typhi
uacagaugccuuguaagccgga

SEQ ID NO: 3661288 - RNA, 15 nt, Salmonella enterica enterica serovar Typhi
uacagcagcgacgca

SEQ ID NO: 3661289 - RNA, 23 nt, Salmonella enterica enterica serovar Typhi
uacccccgccauaaugcacaaua

SEQ ID NO: 3661290 - RNA, 22 nt, Salmonella enterica enterica serovar Typhi
uaccccgcacaaacgcuuuuuu

SEQ ID NO: 3661291 - RNA, 22 nt, Salmonella enterica enterica serovar Typhi
uaccccgcagcgaaaauccagu

SEQ ID NO: 3661292 - RNA, 15 nt, Salmonella enterica enterica serovar Typhi
uaccccgccagcagg

SEQ ID NO: 3661293 - RNA, 15 nt, Salmonella enterica enterica serovar Typhi
uaccccggcgcggcg

SEQ ID NO: 3661294 - RNA, 21 nt, Salmonella enterica enterica serovar Typhi
uaccccuuuuucaauuuccag

SEQ ID NO: 3661295 - RNA, 15 nt, Salmonella enterica enterica serovar Typhi
uacccgacucuuuuu

SEQ ID NO: 3661296 - RNA, 21 nt, Salmonella enterica enterica serovar Typhi
uacccgcacgcuuucuucguu

SEQ ID NO: 3661297 - RNA, 17 nt, Salmonella enterica enterica serovar Typhi
uacccgcccagaucagg

SEQ ID NO: 3661298 - RNA, 18 nt, Salmonella enterica enterica serovar Typhi
uacccgccgcuggcuguu

SEQ ID NO: 3661299 - RNA, 21 nt, Salmonella enterica enterica serovar Typhi
uacccgguguaaaaaaugggu

SEQ ID NO: 3661300 - RNA, 19 nt, Salmonella enterica enterica serovar Typhi
uacccgugagcuacagcgu

SEQ ID NO: 3661301 - RNA, 13 nt, Salmonella enterica enterica serovar Typhi
uacccucaacgcg

SEQ ID NO: 3661302 - RNA, 12 nt, Salmonella enterica enterica serovar Typhi
uacccucugcac

SEQ ID NO: 3661303 - RNA, 19 nt, Salmonella enterica enterica serovar Typhi
uacccugauuuucaaauuu

SEQ ID NO: 3661304 - RNA, 15 nt, Salmonella enterica enterica serovar Typhi
uacccuuuacacguu

SEQ ID NO: 3661305 - RNA, 19 nt, Salmonella enterica enterica serovar Typhi
uacccuuuucuuuaaacaa

SEQ ID NO: 3661306 - RNA, 17 nt, Salmonella enterica enterica serovar Typhi
uaccgaaaucgguacgc

SEQ ID NO: 3661307 - RNA, 14 nt, Salmonella enterica enterica serovar Typhi
uaccgaagaacaua

SEQ ID NO: 3661308 - RNA, 22 nt, Salmonella enterica enterica serovar Typhi
uaccgaaggcgcuuuuggcguc

SEQ ID NO: 3661309 - RNA, 17 nt, Salmonella enterica enterica serovar Typhi
uaccgacgaccauaauu

SEQ ID NO: 3661310 - RNA, 21 nt, Salmonella enterica enterica serovar Typhi
uaccgaggacgggacuugaac

SEQ ID NO: 3661311 - RNA, 19 nt, Salmonella enterica enterica serovar Typhi
uaccgauaauuaagccggu

SEQ ID NO: 3661312 - RNA, 23 nt, Salmonella enterica enterica serovar Typhi
uaccgauuguuuggugcugaaau

SEQ ID NO: 3661313 - RNA, 13 nt, Salmonella enterica enterica serovar Typhi
uaccgcacaucac

SEQ ID NO: 3661314 - RNA, 13 nt, Salmonella enterica enterica serovar Typhi
uaccgccaaucaa

SEQ ID NO: 3661315 - RNA, 16 nt, Salmonella enterica enterica serovar Typhi
uaccgccagcggcguu

SEQ ID NO: 3661316 - RNA, 16 nt, Salmonella enterica enterica serovar Typhi
uaccgccauccggcau

SEQ ID NO: 3661317 - RNA, 14 nt, Salmonella enterica enterica serovar Typhi
uaccgccgagcauu

SEQ ID NO: 3661318 - RNA, 23 nt, Salmonella enterica enterica serovar Typhi
uaccgccgagcauuuccgcagcc

SEQ ID NO: 3661319 - RNA, 17 nt, Salmonella enterica enterica serovar Typhi
uaccgccuucagcgcgc

SEQ ID NO: 3661320 - RNA, 21 nt, Salmonella enterica enterica serovar Typhi
uaccgcgucaucaaauuucaa

SEQ ID NO: 3661321 - RNA, 17 nt, Salmonella enterica enterica serovar Typhi
uaccgcguuugcgcaac

SEQ ID NO: 3661322 - RNA, 15 nt, Salmonella enterica enterica serovar Typhi
uaccgcuaaaauacc

SEQ ID NO: 3661323 - RNA, 23 nt, Salmonella enterica enterica serovar Typhi
uaccgcuuaacagcguacaggcg

SEQ ID NO: 3661324 - RNA, 20 nt, Salmonella enterica enterica serovar Typhi
uaccggaaucgccugcgucg

SEQ ID NO: 3661325 - RNA, 20 nt, Salmonella enterica enterica serovar Typhi
uaccggaucgaucccggcaa

SEQ ID NO: 3661326 - RNA, 13 nt, Salmonella enterica enterica serovar Typhi
uaccggcaaccgg

SEQ ID NO: 3661327 - RNA, 14 nt, Salmonella enterica enterica serovar Typhi
uaccggcacaccgg

SEQ ID NO: 3661328 - RNA, 23 nt, Salmonella enterica enterica serovar Typhi
uaccggcaggugauggcggcuug

SEQ ID NO: 3661329 - RNA, 18 nt, Salmonella enterica enterica serovar Typhi
uaccggcgcucagccaga

SEQ ID NO: 3661330 - RNA, 15 nt, Salmonella enterica enterica serovar Typhi
uaccgggccuacgga

SEQ ID NO: 3661331 - RNA, 19 nt, Salmonella enterica enterica serovar Typhi
uaccgggccuauauuucug

SEQ ID NO: 3661332 - RNA, 23 nt, Salmonella enterica enterica serovar Typhi
uaccgggccuccuuuccugugcu

SEQ ID NO: 3661333 - RNA, 16 nt, Salmonella enterica enterica serovar Typhi
uaccgggcuaaaccac

SEQ ID NO: 3661334 - RNA, 18 nt, Salmonella enterica enterica serovar Typhi
uaccggugcgauucagcg

SEQ ID NO: 3661335 - RNA, 20 nt, Salmonella enterica enterica serovar Typhi
uaccggugcgccccagcaug

SEQ ID NO: 3661336 - RNA, 17 nt, Salmonella enterica enterica serovar Typhi
uaccguaaaaugcuggu

SEQ ID NO: 3661337 - RNA, 22 nt, Salmonella enterica enterica serovar Typhi
uaccguaaaaugcuggugcauc

SEQ ID NO: 3661338 - RNA, 19 nt, Salmonella enterica enterica serovar Typhi
uaccguccagacuccuuuu

SEQ ID NO: 3661339 - RNA, 20 nt, Salmonella enterica enterica serovar Typhi
uaccgugcaaaaucacgcgg

SEQ ID NO: 3661340 - RNA, 21 nt, Salmonella enterica enterica serovar Typhi
uaccguugaugauuacugcug

SEQ ID NO: 3661341 - RNA, 20 nt, Salmonella enterica enterica serovar Typhi
uaccguuuggaucugucgcc

SEQ ID NO: 3661342 - RNA, 22 nt, Salmonella enterica enterica serovar Typhi
uaccguuugucuucugccagca

SEQ ID NO: 3661343 - RNA, 23 nt, Salmonella enterica enterica serovar Typhi
uaccguuugucuucugccagcaa

SEQ ID NO: 3661344 - RNA, 18 nt, Salmonella enterica enterica serovar Typhi
uaccuacaccaacggcga

SEQ ID NO: 3661345 - RNA, 13 nt, Salmonella enterica enterica serovar Typhi
uaccuauuuuaaa

SEQ ID NO: 3661346 - RNA, 20 nt, Salmonella enterica enterica serovar Typhi
uaccuauuuuaaauucccag

SEQ ID NO: 3661347 - RNA, 22 nt, Salmonella enterica enterica serovar Typhi
uaccuauuuuaaauucccagcg

SEQ ID NO: 3661348 - RNA, 22 nt, Salmonella enterica enterica serovar Typhi
uaccucagguaucauaugugcc

SEQ ID NO: 3661349 - RNA, 19 nt, Salmonella enterica enterica serovar Typhi
uaccuccuggcguuaucau

SEQ ID NO: 3661350 - RNA, 16 nt, Salmonella enterica enterica serovar Typhi
uaccucuuauccggcu

SEQ ID NO: 3661351 - RNA, 16 nt, Salmonella enterica enterica serovar Typhi
uaccugaagccauccu

SEQ ID NO: 3661352 - RNA, 14 nt, Salmonella enterica enterica serovar Typhi
uaccugauaaaauu

SEQ ID NO: 3661353 - RNA, 17 nt, Salmonella enterica enterica serovar Typhi
uaccugccugucacgca

SEQ ID NO: 3661354 - RNA, 17 nt, Salmonella enterica enterica serovar Typhi
uaccuguaucaaaccaa

SEQ ID NO: 3661355 - RNA, 22 nt, Salmonella enterica enterica serovar Typhi
uaccuguauuuucguuugcauu

SEQ ID NO: 3661356 - RNA, 14 nt, Salmonella enterica enterica serovar Typhi
uaccuguuuaucug

SEQ ID NO: 3661357 - RNA, 15 nt, Salmonella enterica enterica serovar Typhi
uaccuuaaugaugug

SEQ ID NO: 3661358 - RNA, 16 nt, Salmonella enterica enterica serovar Typhi
uaccuuauucagccca

SEQ ID NO: 3661359 - RNA, 19 nt, Salmonella enterica enterica serovar Typhi
uaccuucccgcgauaaaaa

SEQ ID NO: 3661360 - RNA, 23 nt, Salmonella enterica enterica serovar Typhi
uaccuucggccuccgcuuccugc

SEQ ID NO: 3661361 - RNA, 23 nt, Salmonella enterica enterica serovar Typhi
uaccuucuucacuaaaaacaggc

SEQ ID NO: 3661362 - RNA, 14 nt, Salmonella enterica enterica serovar Typhi
uaccuuguucuucc

SEQ ID NO: 3661363 - RNA, 15 nt, Salmonella enterica enterica serovar Typhi
uaccuuguucuucca

SEQ ID NO: 3661364 - RNA, 16 nt, Salmonella enterica enterica serovar Typhi
uaccuuguucuuccau

SEQ ID NO: 3661365 - RNA, 19 nt, Salmonella enterica enterica serovar Typhi
uaccuuuaaacuguuucca

SEQ ID NO: 3661366 - RNA, 13 nt, Salmonella enterica enterica serovar Typhi
uaccuuuacgcag

SEQ ID NO: 3661367 - RNA, 15 nt, Salmonella enterica enterica serovar Typhi
uaccuuuaucuugac

SEQ ID NO: 3661368 - RNA, 23 nt, Salmonella enterica enterica serovar Typhi
uaccuuuuccggcggcaguccca

SEQ ID NO: 3661369 - RNA, 12 nt, Salmonella enterica enterica serovar Typhi
uaccuuuuccuc

SEQ ID NO: 3661370 - RNA, 22 nt, Salmonella enterica enterica serovar Typhi
uaccuuuuccucgucauaucug

SEQ ID NO: 3661371 - RNA, 18 nt, Salmonella enterica enterica serovar Typhi
uacgaaaauacgcggaug

SEQ ID NO: 3661372 - RNA, 14 nt, Salmonella enterica enterica serovar Typhi
uacgaccgccgaca

SEQ ID NO: 3661373 - RNA, 19 nt, Salmonella enterica enterica serovar Typhi
uacgaccggucagccgguu

SEQ ID NO: 3661374 - RNA, 15 nt, Salmonella enterica enterica serovar Typhi
uacguaacaugaccu

SEQ ID NO: 3661375 - RNA, 14 nt, Salmonella enterica enterica serovar Typhi
uacguaauaaaauu

SEQ ID NO: 3661376 - RNA, 17 nt, Salmonella enterica enterica serovar Typhi
uacguacggauggcguc

SEQ ID NO: 3661377 - RNA, 16 nt, Salmonella enterica enterica serovar Typhi
uacgucauaucaucca

SEQ ID NO: 3661378 - RNA, 14 nt, Salmonella enterica enterica serovar Typhi
uacgugcgaaccac

SEQ ID NO: 3661379 - RNA, 13 nt, Salmonella enterica enterica serovar Typhi
uacguucaaauug

SEQ ID NO: 3661380 - RNA, 20 nt, Salmonella enterica enterica serovar Typhi
uacguucaccccgucauauu

SEQ ID NO: 3661381 - RNA, 20 nt, Salmonella enterica enterica serovar Typhi
uacguugauuggcugugaca

SEQ ID NO: 3661382 - RNA, 13 nt, Salmonella enterica enterica serovar Typhi
uacuaauaaaauu

SEQ ID NO: 3661383 - RNA, 14 nt, Salmonella enterica enterica serovar Typhi
uacuaauaaauauu

SEQ ID NO: 3661384 - RNA, 16 nt, Salmonella enterica enterica serovar Typhi
uacuaaugaauuuaau

SEQ ID NO: 3661385 - RNA, 17 nt, Salmonella enterica enterica serovar Typhi
uacuaaugaauuuaaua

SEQ ID NO: 3661386 - RNA, 20 nt, Salmonella enterica enterica serovar Typhi
uacuaaugaauuuaauauuu

SEQ ID NO: 3661387 - RNA, 20 nt, Salmonella enterica enterica serovar Typhi
uacuacugguggaauaaaua

SEQ ID NO: 3661388 - RNA, 20 nt, Salmonella enterica enterica serovar Typhi
uacuauucggcgcuucgcag

SEQ ID NO: 3661389 - RNA, 11 nt, Salmonella enterica enterica serovar Typhi
uacuauuuccu

SEQ ID NO: 3661390 - RNA, 14 nt, Salmonella enterica enterica serovar Typhi
uacucaacaucauu

SEQ ID NO: 3661391 - RNA, 13 nt, Salmonella enterica enterica serovar Typhi
uacucacugccgc

SEQ ID NO: 3661392 - RNA, 20 nt, Salmonella enterica enterica serovar Typhi
uacucagcgacguaaucuau

SEQ ID NO: 3661393 - RNA, 22 nt, Salmonella enterica enterica serovar Typhi
uacucagggcaaaaaugaucac

SEQ ID NO: 3661394 - RNA, 14 nt, Salmonella enterica enterica serovar Typhi
uacucaguuugccg

SEQ ID NO: 3661395 - RNA, 13 nt, Salmonella enterica enterica serovar Typhi
uacuccagcagac

SEQ ID NO: 3661396 - RNA, 16 nt, Salmonella enterica enterica serovar Typhi
uacuccauucccagcu

SEQ ID NO: 3661397 - RNA, 21 nt, Salmonella enterica enterica serovar Typhi
uacuccauucccagcucuuuc

SEQ ID NO: 3661398 - RNA, 16 nt, Salmonella enterica enterica serovar Typhi
uacuccugcaacagaa

SEQ ID NO: 3661399 - RNA, 20 nt, Salmonella enterica enterica serovar Typhi
uacucuaggcgcugcuggca

SEQ ID NO: 3661400 - RNA, 13 nt, Salmonella enterica enterica serovar Typhi
uacucuucacccu

SEQ ID NO: 3661401 - RNA, 15 nt, Salmonella enterica enterica serovar Typhi
uacucuuucccggca

SEQ ID NO: 3661402 - RNA, 23 nt, Salmonella enterica enterica serovar Typhi
uacucuuucccggcaauuaccgc

SEQ ID NO: 3661403 - RNA, 15 nt, Salmonella enterica enterica serovar Typhi
uacucuuugaugguu

SEQ ID NO: 3661404 - RNA, 20 nt, Salmonella enterica enterica serovar Typhi
uacugaaauuucuuuuccag

SEQ ID NO: 3661405 - RNA, 18 nt, Salmonella enterica enterica serovar Typhi
uacugaccaacaacagau

SEQ ID NO: 3661406 - RNA, 20 nt, Salmonella enterica enterica serovar Typhi
uacugaccaagcgucagcau

SEQ ID NO: 3661407 - RNA, 13 nt, Salmonella enterica enterica serovar Typhi
uacugaccagaca

SEQ ID NO: 3661408 - RNA, 15 nt, Salmonella enterica enterica serovar Typhi
uacugaccagacagc

SEQ ID NO: 3661409 - RNA, 17 nt, Salmonella enterica enterica serovar Typhi
uacugaccagacagccc

SEQ ID NO: 3661410 - RNA, 17 nt, Salmonella enterica enterica serovar Typhi
uacugagcauccaccgg

SEQ ID NO: 3661411 - RNA, 21 nt, Salmonella enterica enterica serovar Typhi
uacugauagcauuguauccag

SEQ ID NO: 3661412 - RNA, 18 nt, Salmonella enterica enterica serovar Typhi
uacugauuaauugcgaca

SEQ ID NO: 3661413 - RNA, 13 nt, Salmonella enterica enterica serovar Typhi
uacugauuccugc

SEQ ID NO: 3661414 - RNA, 20 nt, Salmonella enterica enterica serovar Typhi
uacugccagcgucgcugauu

SEQ ID NO: 3661415 - RNA, 16 nt, Salmonella enterica enterica serovar Typhi
uacugcccguggcgga

SEQ ID NO: 3661416 - RNA, 18 nt, Salmonella enterica enterica serovar Typhi
uacugcgcguggcaaaua

SEQ ID NO: 3661417 - RNA, 20 nt, Salmonella enterica enterica serovar Typhi
uacugcgcucuaucaccgcc

SEQ ID NO: 3661418 - RNA, 18 nt, Salmonella enterica enterica serovar Typhi
uacugcuuagcucaucag

SEQ ID NO: 3661419 - RNA, 20 nt, Salmonella enterica enterica serovar Typhi
uacugcuuagcucaucagcc

SEQ ID NO: 3661420 - RNA, 17 nt, Salmonella enterica enterica serovar Typhi
uacugcuuuaauaccgg

SEQ ID NO: 3661421 - RNA, 15 nt, Salmonella enterica enterica serovar Typhi
uacuggaucauacau

SEQ ID NO: 3661422 - RNA, 22 nt, Salmonella enterica enterica serovar Typhi
uacuggaucgcuccauucuguc

SEQ ID NO: 3661423 - RNA, 17 nt, Salmonella enterica enterica serovar Typhi
uacuggcgauuuucaua

SEQ ID NO: 3661424 - RNA, 21 nt, Salmonella enterica enterica serovar Typhi
uacuggugcccgcaaaaccuu

SEQ ID NO: 3661425 - RNA, 21 nt, Salmonella enterica enterica serovar Typhi
uacugucaucccgauauacca

SEQ ID NO: 3661426 - RNA, 16 nt, Salmonella enterica enterica serovar Typhi
uacuguuuuugcuuua

SEQ ID NO: 3661427 - RNA, 14 nt, Salmonella enterica enterica serovar Typhi
uacuuaaaauugaa

SEQ ID NO: 3661428 - RNA, 13 nt, Salmonella enterica enterica serovar Typhi
uacuuaccggcgc

SEQ ID NO: 3661429 - RNA, 19 nt, Salmonella enterica enterica serovar Typhi
uacuuauagcuggcuuuau

SEQ ID NO: 3661430 - RNA, 22 nt, Salmonella enterica enterica serovar Typhi
uacuucacaauaagaaauuuag

SEQ ID NO: 3661431 - RNA, 20 nt, Salmonella enterica enterica serovar Typhi
uacuucacaaucagcgcaau

SEQ ID NO: 3661432 - RNA, 22 nt, Salmonella enterica enterica serovar Typhi
uacuuccgguugaccgcauaau

SEQ ID NO: 3661433 - RNA, 20 nt, Salmonella enterica enterica serovar Typhi
uacuucugacagugacggca

SEQ ID NO: 3661434 - RNA, 17 nt, Salmonella enterica enterica serovar Typhi
uacuugcgccgccaucc

SEQ ID NO: 3661435 - RNA, 16 nt, Salmonella enterica enterica serovar Typhi
uacuuguugagugaau

SEQ ID NO: 3661436 - RNA, 14 nt, Salmonella enterica enterica serovar Typhi
uacuuuaaaacaua

SEQ ID NO: 3661437 - RNA, 21 nt, Salmonella enterica enterica serovar Typhi
uacuuuauaaaucaggaaaaa

SEQ ID NO: 3661438 - RNA, 12 nt, Salmonella enterica enterica serovar Typhi
uacuuucaaaau

SEQ ID NO: 3661439 - RNA, 15 nt, Salmonella enterica enterica serovar Typhi
uacuuucaaaauacu

SEQ ID NO: 3661440 - RNA, 17 nt, Salmonella enterica enterica serovar Typhi
uacuuucaaaauacugg

SEQ ID NO: 3661441 - RNA, 19 nt, Salmonella enterica enterica serovar Typhi
uacuuucagauaauucuaa

SEQ ID NO: 3661442 - RNA, 13 nt, Salmonella enterica enterica serovar Typhi
uacuuuccagcaa

SEQ ID NO: 3661443 - RNA, 16 nt, Salmonella enterica enterica serovar Typhi
uacuuuccauauacuc

SEQ ID NO: 3661444 - RNA, 16 nt, Salmonella enterica enterica serovar Typhi
uacuuucccccagauu

SEQ ID NO: 3661445 - RNA, 11 nt, Salmonella enterica enterica serovar Typhi
uacuuuccuga

SEQ ID NO: 3661446 - RNA, 14 nt, Salmonella enterica enterica serovar Typhi
uacuuucuacaaau

SEQ ID NO: 3661447 - RNA, 18 nt, Salmonella enterica enterica serovar Typhi
uacuuucuugccacuggc

SEQ ID NO: 3661448 - RNA, 14 nt, Salmonella enterica enterica serovar Typhi
uacuuuguacugua

SEQ ID NO: 3661449 - RNA, 16 nt, Salmonella enterica enterica serovar Typhi
uagaaaaggucgucag

SEQ ID NO: 3661450 - RNA, 17 nt, Salmonella enterica enterica serovar Typhi
uagaaagauuucaucag

SEQ ID NO: 3661451 - RNA, 20 nt, Salmonella enterica enterica serovar Typhi
uagaaaguacaucauuggcc

SEQ ID NO: 3661452 - RNA, 23 nt, Salmonella enterica enterica serovar Typhi
uagaaagucuuuuguuuuucucu

SEQ ID NO: 3661453 - RNA, 19 nt, Salmonella enterica enterica serovar Typhi
uagaaaguggcauaucaug

SEQ ID NO: 3661454 - RNA, 14 nt, Salmonella enterica enterica serovar Typhi
uagaacagcaugaa

SEQ ID NO: 3661455 - RNA, 13 nt, Salmonella enterica enterica serovar Typhi
uagaacgcggaag

SEQ ID NO: 3661456 - RNA, 19 nt, Salmonella enterica enterica serovar Typhi
uagaagcucaugugcagca

SEQ ID NO: 3661457 - RNA, 16 nt, Salmonella enterica enterica serovar Typhi
uagaauacuuccugcu

SEQ ID NO: 3661458 - RNA, 16 nt, Salmonella enterica enterica serovar Typhi
uagaauagaaucaauu

SEQ ID NO: 3661459 - RNA, 21 nt, Salmonella enterica enterica serovar Typhi
uagaauagaaucaauuucucu

SEQ ID NO: 3661460 - RNA, 20 nt, Salmonella enterica enterica serovar Typhi
uagccggugccgcaaucggu

SEQ ID NO: 3661461 - RNA, 18 nt, Salmonella enterica enterica serovar Typhi
uagccguuaccgccgagc

SEQ ID NO: 3661462 - RNA, 22 nt, Salmonella enterica enterica serovar Typhi
uagccguugucauggcgccacc

SEQ ID NO: 3661463 - RNA, 18 nt, Salmonella enterica enterica serovar Typhi
uagccuaucaguccgggc

SEQ ID NO: 3661464 - RNA, 13 nt, Salmonella enterica enterica serovar Typhi
uagccuguuauuc

SEQ ID NO: 3661465 - RNA, 18 nt, Salmonella enterica enterica serovar Typhi
uagccuguuauucaauuc

SEQ ID NO: 3661466 - RNA, 18 nt, Salmonella enterica enterica serovar Typhi
uagccuucccggggaaca

SEQ ID NO: 3661467 - RNA, 14 nt, Salmonella enterica enterica serovar Typhi
uagccuugacgcaa

SEQ ID NO: 3661468 - RNA, 24 nt, Salmonella enterica enterica serovar Typhi
uagccuugacgcaauagaguaaug

SEQ ID NO: 3661469 - RNA, 14 nt, Salmonella enterica enterica serovar Typhi
uagccuuuauugau

SEQ ID NO: 3661470 - RNA, 15 nt, Salmonella enterica enterica serovar Typhi
uagcgaaacaguugg

SEQ ID NO: 3661471 - RNA, 16 nt, Salmonella enterica enterica serovar Typhi
uagcgacggcgcgcca

SEQ ID NO: 3661472 - RNA, 22 nt, Salmonella enterica enterica serovar Typhi
uagcgacggcgcgccaaacggc

SEQ ID NO: 3661473 - RNA, 16 nt, Salmonella enterica enterica serovar Typhi
uagcgacugauaagcg

SEQ ID NO: 3661474 - RNA, 22 nt, Salmonella enterica enterica serovar Typhi
uagcgagaagccgauggaagua

SEQ ID NO: 3661475 - RNA, 18 nt, Salmonella enterica enterica serovar Typhi
uagcgcaaauauccuacc

SEQ ID NO: 3661476 - RNA, 19 nt, Salmonella enterica enterica serovar Typhi
uagcgcaggggggaaauga

SEQ ID NO: 3661477 - RNA, 20 nt, Salmonella enterica enterica serovar Typhi
uagcgcagucaagcuugccg

SEQ ID NO: 3661478 - RNA, 14 nt, Salmonella enterica enterica serovar Typhi
uagcgccagacaga

SEQ ID NO: 3661479 - RNA, 22 nt, Salmonella enterica enterica serovar Typhi
uagcgccagacagauaacacca

SEQ ID NO: 3661480 - RNA, 21 nt, Salmonella enterica enterica serovar Typhi
uagcgccuucaggcaucagau

SEQ ID NO: 3661481 - RNA, 16 nt, Salmonella enterica enterica serovar Typhi
uagcgcgauuuucucg

SEQ ID NO: 3661482 - RNA, 18 nt, Salmonella enterica enterica serovar Typhi
uagcgcgcccaugccgcc

SEQ ID NO: 3661483 - RNA, 21 nt, Salmonella enterica enterica serovar Typhi
uagcgcgcgcuaauuuucagg

SEQ ID NO: 3661484 - RNA, 13 nt, Salmonella enterica enterica serovar Typhi
uagcggaacugcg

SEQ ID NO: 3661485 - RNA, 24 nt, Salmonella enterica enterica serovar Typhi
uagcggauugccgcgcucaaucug

SEQ ID NO: 3661486 - RNA, 14 nt, Salmonella enterica enterica serovar Typhi
uagcggccagaugg

SEQ ID NO: 3661487 - RNA, 21 nt, Salmonella enterica enterica serovar Typhi
uagcggcguuuauauaaaaau

SEQ ID NO: 3661488 - RNA, 16 nt, Salmonella enterica enterica serovar Typhi
uagcggcugcggcgca

SEQ ID NO: 3661489 - RNA, 16 nt, Salmonella enterica enterica serovar Typhi
uagcgggcaaugccac

SEQ ID NO: 3661490 - RNA, 23 nt, Salmonella enterica enterica serovar Typhi
uagcgggcaaugccaccagcgcc

SEQ ID NO: 3661491 - RNA, 14 nt, Salmonella enterica enterica serovar Typhi
uagcgggggccggc

SEQ ID NO: 3661492 - RNA, 16 nt, Salmonella enterica enterica serovar Typhi
uagcggguaaacagau

SEQ ID NO: 3661493 - RNA, 15 nt, Salmonella enterica enterica serovar Typhi
uagcgguacgcaagc

SEQ ID NO: 3661494 - RNA, 15 nt, Salmonella enterica enterica serovar Typhi
uagcgguuugcaaac

SEQ ID NO: 3661495 - RNA, 19 nt, Salmonella enterica enterica serovar Typhi
uagcguacuuucaaauagc

SEQ ID NO: 3661496 - RNA, 19 nt, Salmonella enterica enterica serovar Typhi
uagcguauaguacgauagc

SEQ ID NO: 3661497 - RNA, 19 nt, Salmonella enterica enterica serovar Typhi
uagcguaucagacuuauac

SEQ ID NO: 3661498 - RNA, 15 nt, Salmonella enterica enterica serovar Typhi
uagcgucauccggca

SEQ ID NO: 3661499 - RNA, 13 nt, Salmonella enterica enterica serovar Typhi
uagcgucccggca

SEQ ID NO: 3661500 - RNA, 18 nt, Salmonella enterica enterica serovar Typhi
uagcgucucaucaaaaag

SEQ ID NO: 3661501 - RNA, 16 nt, Salmonella enterica enterica serovar Typhi
uagcgucugcggcuga

SEQ ID NO: 3661502 - RNA, 17 nt, Salmonella enterica enterica serovar Typhi
uagcgucuuauccggcc

SEQ ID NO: 3661503 - RNA, 14 nt, Salmonella enterica enterica serovar Typhi
uagcgucuucagua

SEQ ID NO: 3661504 - RNA, 13 nt, Salmonella enterica enterica serovar Typhi
uagcgugacggca

SEQ ID NO: 3661505 - RNA, 17 nt, Salmonella enterica enterica serovar Typhi
uagcgugccgacguuca

SEQ ID NO: 3661506 - RNA, 18 nt, Salmonella enterica enterica serovar Typhi
uagcguucauucccgcca

SEQ ID NO: 3661507 - RNA, 16 nt, Salmonella enterica enterica serovar Typhi
uagcguucuuuccagu

SEQ ID NO: 3661508 - RNA, 13 nt, Salmonella enterica enterica serovar Typhi
uagcguugauaug

SEQ ID NO: 3661509 - RNA, 20 nt, Salmonella enterica enterica serovar Typhi
uagcguugauaugcucgaca

SEQ ID NO: 3661510 - RNA, 16 nt, Salmonella enterica enterica serovar Typhi
uagcguuuuuaccggc

SEQ ID NO: 3661511 - RNA, 15 nt, Salmonella enterica enterica serovar Typhi
uagcuaaauaaaaau

SEQ ID NO: 3661512 - RNA, 12 nt, Salmonella enterica enterica serovar Typhi
uagcuaaugcaa

SEQ ID NO: 3661513 - RNA, 16 nt, Salmonella enterica enterica serovar Typhi
uagcuacgauaaagcu

SEQ ID NO: 3661514 - RNA, 22 nt, Salmonella enterica enterica serovar Typhi
uagcuacguagcgcauugcgcc

SEQ ID NO: 3661515 - RNA, 18 nt, Salmonella enterica enterica serovar Typhi
uagcuauuccaaaauaau

SEQ ID NO: 3661516 - RNA, 23 nt, Salmonella enterica enterica serovar Typhi
uagcucagcuggauagagcgcug

SEQ ID NO: 3661517 - RNA, 17 nt, Salmonella enterica enterica serovar Typhi
uagcuccagacaggacg

SEQ ID NO: 3661518 - RNA, 20 nt, Salmonella enterica enterica serovar Typhi
uagcucuucaucuuuuucau

SEQ ID NO: 3661519 - RNA, 19 nt, Salmonella enterica enterica serovar Typhi
uagcugauaagcuaguaaa

SEQ ID NO: 3661520 - RNA, 20 nt, Salmonella enterica enterica serovar Typhi
uagcugcgcaagaaacauca

SEQ ID NO: 3661521 - RNA, 14 nt, Salmonella enterica enterica serovar Typhi
uagcugcgccagcg

SEQ ID NO: 3661522 - RNA, 17 nt, Salmonella enterica enterica serovar Typhi
uagcugcguuuccagcc

SEQ ID NO: 3661523 - RNA, 15 nt, Salmonella enterica enterica serovar Typhi
uagcuguuccgcaac

SEQ ID NO: 3661524 - RNA, 18 nt, Salmonella enterica enterica serovar Typhi
uagcuguuccgcaacacg

SEQ ID NO: 3661525 - RNA, 15 nt, Salmonella enterica enterica serovar Typhi
uagcuuaaaaaaucc

SEQ ID NO: 3661526 - RNA, 19 nt, Salmonella enterica enterica serovar Typhi
uagcuuaaaaaauccugca

SEQ ID NO: 3661527 - RNA, 21 nt, Salmonella enterica enterica serovar Typhi
uagcuuacuuuuagaauuauc

SEQ ID NO: 3661528 - RNA, 11 nt, Salmonella enterica enterica serovar Typhi
uagcuuccagc

SEQ ID NO: 3661529 - RNA, 16 nt, Salmonella enterica enterica serovar Typhi
uaggaaaggcagagaa

SEQ ID NO: 3661530 - RNA, 18 nt, Salmonella enterica enterica serovar Typhi
uaggaagacgagaagcga

SEQ ID NO: 3661531 - RNA, 19 nt, Salmonella enterica enterica serovar Typhi
uaggaguaaauaauuuugu

SEQ ID NO: 3661532 - RNA, 17 nt, Salmonella enterica enterica serovar Typhi
uaggaucaaccaccuuc

SEQ ID NO: 3661533 - RNA, 18 nt, Salmonella enterica enterica serovar Typhi
uaggcaaugaucagcgac

SEQ ID NO: 3661534 - RNA, 15 nt, Salmonella enterica enterica serovar Typhi
uaggcacuuuccaga

SEQ ID NO: 3661535 - RNA, 15 nt, Salmonella enterica enterica serovar Typhi
uaggcaggaaaucca

SEQ ID NO: 3661536 - RNA, 23 nt, Salmonella enterica enterica serovar Typhi
uaggcauacacaucuucuacaug

SEQ ID NO: 3661537 - RNA, 17 nt, Salmonella enterica enterica serovar Typhi
uaggcauuaauggcgau

SEQ ID NO: 3661538 - RNA, 20 nt, Salmonella enterica enterica serovar Typhi
uaggccaaacuuacgcagcu

SEQ ID NO: 3661539 - RNA, 21 nt, Salmonella enterica enterica serovar Typhi
uaggccagacgaaguuuugcg

SEQ ID NO: 3661540 - RNA, 20 nt, Salmonella enterica enterica serovar Typhi
uaggccagccgacgcucuuc

SEQ ID NO: 3661541 - RNA, 19 nt, Salmonella enterica enterica serovar Typhi
uaggccgaauaagacgcuu

SEQ ID NO: 3661542 - RNA, 11 nt, Salmonella enterica enterica serovar Typhi
uaggccggaua

SEQ ID NO: 3661543 - RNA, 19 nt, Salmonella enterica enterica serovar Typhi
uaggccggauaaggcgcag

SEQ ID NO: 3661544 - RNA, 20 nt, Salmonella enterica enterica serovar Typhi
uaggccggauaaggcguaac

SEQ ID NO: 3661545 - RNA, 13 nt, Salmonella enterica enterica serovar Typhi
uauaaauauuaau

SEQ ID NO: 3661546 - RNA, 18 nt, Salmonella enterica enterica serovar Typhi
uauaacagaauaagccag

SEQ ID NO: 3661547 - RNA, 12 nt, Salmonella enterica enterica serovar Typhi
uauaacauaaau

SEQ ID NO: 3661548 - RNA, 21 nt, Salmonella enterica enterica serovar Typhi
uauaacgacagccuauuaauc

SEQ ID NO: 3661549 - RNA, 23 nt, Salmonella enterica enterica serovar Typhi
uauaacuaaacucaucuuuauuc

SEQ ID NO: 3661550 - RNA, 18 nt, Salmonella enterica enterica serovar Typhi
uauaacucuuaauuauaa

SEQ ID NO: 3661551 - RNA, 20 nt, Salmonella enterica enterica serovar Typhi
uauaacucuuaauuauaaag

SEQ ID NO: 3661552 - RNA, 21 nt, Salmonella enterica enterica serovar Typhi
uauaagaaccaucuaccauau

SEQ ID NO: 3661553 - RNA, 18 nt, Salmonella enterica enterica serovar Typhi
uauaagcgccgucauccg

SEQ ID NO: 3661554 - RNA, 16 nt, Salmonella enterica enterica serovar Typhi
uauaagcgugcaaccc

SEQ ID NO: 3661555 - RNA, 16 nt, Salmonella enterica enterica serovar Typhi
uauaaggucgauaucg

SEQ ID NO: 3661556 - RNA, 13 nt, Salmonella enterica enterica serovar Typhi
uauaaguaacugg

SEQ ID NO: 3661557 - RNA, 20 nt, Salmonella enterica enterica serovar Typhi
uauaaucaaacccuuccgca

SEQ ID NO: 3661558 - RNA, 16 nt, Salmonella enterica enterica serovar Typhi
uauaaucacagggguc

SEQ ID NO: 3661559 - RNA, 14 nt, Salmonella enterica enterica serovar Typhi
uauaauuaacauuu

SEQ ID NO: 3661560 - RNA, 20 nt, Salmonella enterica enterica serovar Typhi
uauaauucgucaauaccuaa

SEQ ID NO: 3661561 - RNA, 20 nt, Salmonella enterica enterica serovar Typhi
uauaauugcccgcaaucucu

SEQ ID NO: 3661562 - RNA, 18 nt, Salmonella enterica enterica serovar Typhi
uauaauugcuuuuuucca

SEQ ID NO: 3661563 - RNA, 18 nt, Salmonella enterica enterica serovar Typhi
uauaauuuuauuauauuu

SEQ ID NO: 3661564 - RNA, 20 nt, Salmonella enterica enterica serovar Typhi
uauacaaaacccauaucccc

SEQ ID NO: 3661565 - RNA, 14 nt, Salmonella enterica enterica serovar Typhi
uauacacucaacca

SEQ ID NO: 3661566 - RNA, 17 nt, Salmonella enterica enterica serovar Typhi
uauacaguaaaacgcca

SEQ ID NO: 3661567 - RNA, 22 nt, Salmonella enterica enterica serovar Typhi
uauacauacauaccacgcagcg

SEQ ID NO: 3661568 - RNA, 18 nt, Salmonella enterica enterica serovar Typhi
uauacauauuguuuucua

SEQ ID NO: 3661569 - RNA, 12 nt, Salmonella enterica enterica serovar Typhi
uauacauuucac

SEQ ID NO: 3661570 - RNA, 21 nt, Salmonella enterica enterica serovar Typhi
uauaccauaaaugaaaccuca

SEQ ID NO: 3661571 - RNA, 15 nt, Salmonella enterica enterica serovar Typhi
uauaccaugcugcca

SEQ ID NO: 3661572 - RNA, 19 nt, Salmonella enterica enterica serovar Typhi
uauacggcggcaaugccgc

SEQ ID NO: 3661573 - RNA, 15 nt, Salmonella enterica enterica serovar Typhi
uauacgguaauaacu

SEQ ID NO: 3661574 - RNA, 15 nt, Salmonella enterica enterica serovar Typhi
uauacguugauuggc

SEQ ID NO: 3661575 - RNA, 12 nt, Salmonella enterica enterica serovar Typhi
uauacucaaaaa

SEQ ID NO: 3661576 - RNA, 15 nt, Salmonella enterica enterica serovar Typhi
uauacucaaaaaauc

SEQ ID NO: 3661577 - RNA, 19 nt, Salmonella enterica enterica serovar Typhi
uauacuccgcgacgaccug

SEQ ID NO: 3661578 - RNA, 19 nt, Salmonella enterica enterica serovar Typhi
uauagagcgccauauugcu

SEQ ID NO: 3661579 - RNA, 15 nt, Salmonella enterica enterica serovar Typhi
uauagaucagacgac

SEQ ID NO: 3661580 - RNA, 12 nt, Salmonella enterica enterica serovar Typhi
uauagaugaugg

SEQ ID NO: 3661581 - RNA, 15 nt, Salmonella enterica enterica serovar Typhi
uauagcaacccacuu

SEQ ID NO: 3661582 - RNA, 15 nt, Salmonella enterica enterica serovar Typhi
uauagccaggcagau

SEQ ID NO: 3661583 - RNA, 21 nt, Salmonella enterica enterica serovar Typhi
uauagcccagaaucaccccaa

SEQ ID NO: 3661584 - RNA, 18 nt, Salmonella enterica enterica serovar Typhi
uauagccuuuauugauga

SEQ ID NO: 3661585 - RNA, 15 nt, Salmonella enterica enterica serovar Typhi
uauagccuuuuucuu

SEQ ID NO: 3661586 - RNA, 21 nt, Salmonella enterica enterica serovar Typhi
uauagcuaucaacaucgcaaa

SEQ ID NO: 3661587 - RNA, 22 nt, Salmonella enterica enterica serovar Typhi
uauagcucagcgcggcagccgg

SEQ ID NO: 3661588 - RNA, 13 nt, Salmonella enterica enterica serovar Typhi
uauaggaaaauga

SEQ ID NO: 3661589 - RNA, 23 nt, Salmonella enterica enterica serovar Typhi
uauagguguaaaccguuuuuccg

SEQ ID NO: 3661590 - RNA, 13 nt, Salmonella enterica enterica serovar Typhi
uauaguaaauuga

SEQ ID NO: 3661591 - RNA, 20 nt, Salmonella enterica enterica serovar Typhi
uauaguggaacgucaggccg

SEQ ID NO: 3661592 - RNA, 14 nt, Salmonella enterica enterica serovar Typhi
uauaguuuauugaa

SEQ ID NO: 3661593 - RNA, 21 nt, Salmonella enterica enterica serovar Typhi
uauauaacauauagcagcagu

SEQ ID NO: 3661594 - RNA, 17 nt, Salmonella enterica enterica serovar Typhi
uauauaauuuauagcca

SEQ ID NO: 3661595 - RNA, 23 nt, Salmonella enterica enterica serovar Typhi
uauauacuucaccauaaaucauu

SEQ ID NO: 3661596 - RNA, 13 nt, Salmonella enterica enterica serovar Typhi
uauaucaggcaaa

SEQ ID NO: 3661597 - RNA, 21 nt, Salmonella enterica enterica serovar Typhi
uauaucaggcaaaaaucguca

SEQ ID NO: 3661598 - RNA, 15 nt, Salmonella enterica enterica serovar Typhi
uauaucgcgauaaac

SEQ ID NO: 3661599 - RNA, 16 nt, Salmonella enterica enterica serovar Typhi
uauaucgcgauaaacu

SEQ ID NO: 3661600 - RNA, 20 nt, Salmonella enterica enterica serovar Typhi
uauaucgcgauaaacugaca

SEQ ID NO: 3661601 - RNA, 20 nt, Salmonella enterica enterica serovar Typhi
uauaucggcugcuguaacag

SEQ ID NO: 3661602 - RNA, 23 nt, Salmonella enterica enterica serovar Typhi
uauaugagcgggccgucaggccc

SEQ ID NO: 3661603 - RNA, 15 nt, Salmonella enterica enterica serovar Typhi
uauaugcaaaacugu

SEQ ID NO: 3661604 - RNA, 18 nt, Salmonella enterica enterica serovar Typhi
uauaugcaggcauaaaaa

SEQ ID NO: 3661605 - RNA, 20 nt, Salmonella enterica enterica serovar Typhi
uauaugcgacagaaauugaa

SEQ ID NO: 3661606 - RNA, 13 nt, Salmonella enterica enterica serovar Typhi
uauauucagaauu

SEQ ID NO: 3661607 - RNA, 16 nt, Salmonella enterica enterica serovar Typhi
uauauuccccuuaugg

SEQ ID NO: 3661608 - RNA, 19 nt, Salmonella enterica enterica serovar Typhi
uauauuccgcaggcaagaa

SEQ ID NO: 3661609 - RNA, 23 nt, Salmonella enterica enterica serovar Typhi
uauauucgcgaugcucaaccagu

SEQ ID NO: 3661610 - RNA, 23 nt, Salmonella enterica enterica serovar Typhi
uauauucugggcuuacuuuccaa

SEQ ID NO: 3661611 - RNA, 15 nt, Salmonella enterica enterica serovar Typhi
uauauucuucuuaga

SEQ ID NO: 3661612 - RNA, 22 nt, Salmonella enterica enterica serovar Typhi
uauauucuucuuagaauagaau

SEQ ID NO: 3661613 - RNA, 15 nt, Salmonella enterica enterica serovar Typhi
uauauugcauuuuau

SEQ ID NO: 3661614 - RNA, 11 nt, Salmonella enterica enterica serovar Typhi
uauauuuuuaa

SEQ ID NO: 3661615 - RNA, 18 nt, Salmonella enterica enterica serovar Typhi
uaucaaaaaaaaccagau

SEQ ID NO: 3661616 - RNA, 13 nt, Salmonella enterica enterica serovar Typhi
uaucaaaaagacu

SEQ ID NO: 3661617 - RNA, 20 nt, Salmonella enterica enterica serovar Typhi
uaucaaaccagcuuuucauu

SEQ ID NO: 3661618 - RNA, 17 nt, Salmonella enterica enterica serovar Typhi
uaucaaacugaaaauca

SEQ ID NO: 3661619 - RNA, 22 nt, Salmonella enterica enterica serovar Typhi
uaucaaacugaaaaucaaauaa

SEQ ID NO: 3661620 - RNA, 14 nt, Salmonella enterica enterica serovar Typhi
uaucaaauacgcua

SEQ ID NO: 3661621 - RNA, 14 nt, Salmonella enterica enterica serovar Typhi
uaucaagauaaaaa

SEQ ID NO: 3661622 - RNA, 15 nt, Salmonella enterica enterica serovar Typhi
uaucaagauaaaaag

SEQ ID NO: 3661623 - RNA, 18 nt, Salmonella enterica enterica serovar Typhi
uaucaagauaaaaagaca

SEQ ID NO: 3661624 - RNA, 23 nt, Salmonella enterica enterica serovar Typhi
uaucaagauaaaaagacagauag

SEQ ID NO: 3661625 - RNA, 15 nt, Salmonella enterica enterica serovar Typhi
uaucaagccuacacc

SEQ ID NO: 3661626 - RNA, 15 nt, Salmonella enterica enterica serovar Typhi
uaucaauuucauauu

SEQ ID NO: 3661627 - RNA, 17 nt, Salmonella enterica enterica serovar Typhi
uaucaauuucauauuau

SEQ ID NO: 3661628 - RNA, 19 nt, Salmonella enterica enterica serovar Typhi
uaucaauuucauauuauua

SEQ ID NO: 3661629 - RNA, 22 nt, Salmonella enterica enterica serovar Typhi
uaucacacauaucgccagccau

SEQ ID NO: 3661630 - RNA, 19 nt, Salmonella enterica enterica serovar Typhi
uaucaccaaguagacagag

SEQ ID NO: 3661631 - RNA, 18 nt, Salmonella enterica enterica serovar Typhi
uaucggccggaugccagu

SEQ ID NO: 3661632 - RNA, 14 nt, Salmonella enterica enterica serovar Typhi
uaucgggccuacca

SEQ ID NO: 3661633 - RNA, 19 nt, Salmonella enterica enterica serovar Typhi
uaucguaagccaccgccca

SEQ ID NO: 3661634 - RNA, 12 nt, Salmonella enterica enterica serovar Typhi
uaucgucuuauu

SEQ ID NO: 3661635 - RNA, 17 nt, Salmonella enterica enterica serovar Typhi
uaucguguuauuuucaa

SEQ ID NO: 3661636 - RNA, 18 nt, Salmonella enterica enterica serovar Typhi
uaucguugcgcgcaauca

SEQ ID NO: 3661637 - RNA, 15 nt, Salmonella enterica enterica serovar Typhi
uaucguuuacguuau

SEQ ID NO: 3661638 - RNA, 20 nt, Salmonella enterica enterica serovar Typhi
uaucuauuucuuagcgccag

SEQ ID NO: 3661639 - RNA, 22 nt, Salmonella enterica enterica serovar Typhi
uaucucuacuuuccugaaggua

SEQ ID NO: 3661640 - RNA, 15 nt, Salmonella enterica enterica serovar Typhi
uaucucucuggcgca

SEQ ID NO: 3661641 - RNA, 17 nt, Salmonella enterica enterica serovar Typhi
uaucugcauaggcuuua

SEQ ID NO: 3661642 - RNA, 21 nt, Salmonella enterica enterica serovar Typhi
uaucugccagccgauuuuucg

SEQ ID NO: 3661643 - RNA, 18 nt, Salmonella enterica enterica serovar Typhi
uaucugcccuuucuuaug

SEQ ID NO: 3661644 - RNA, 18 nt, Salmonella enterica enterica serovar Typhi
uaucugcugacacccucu

SEQ ID NO: 3661645 - RNA, 12 nt, Salmonella enterica enterica serovar Typhi
uaucugcugcug

SEQ ID NO: 3661646 - RNA, 18 nt, Salmonella enterica enterica serovar Typhi
uaucuguaauuauaaaua

SEQ ID NO: 3661647 - RNA, 17 nt, Salmonella enterica enterica serovar Typhi
uaucugucccagccuuc

SEQ ID NO: 3661648 - RNA, 22 nt, Salmonella enterica enterica serovar Typhi
uaucuucaagguuaugcgcaca

SEQ ID NO: 3661649 - RNA, 20 nt, Salmonella enterica enterica serovar Typhi
uaucuucaucgguaagcgca

SEQ ID NO: 3661650 - RNA, 12 nt, Salmonella enterica enterica serovar Typhi
uaucuuccagcg

SEQ ID NO: 3661651 - RNA, 22 nt, Salmonella enterica enterica serovar Typhi
uaucuuccggcaucacaucgcc

SEQ ID NO: 3661652 - RNA, 19 nt, Salmonella enterica enterica serovar Typhi
uaucuucgauaaacucaau

SEQ ID NO: 3661653 - RNA, 18 nt, Salmonella enterica enterica serovar Typhi
uaucuucgccguauucuu

SEQ ID NO: 3661654 - RNA, 22 nt, Salmonella enterica enterica serovar Typhi
uaucuucggucgagcuuuugcu

SEQ ID NO: 3661655 - RNA, 23 nt, Salmonella enterica enterica serovar Typhi
uaucuucggucgagcuuuugcug

SEQ ID NO: 3661656 - RNA, 18 nt, Salmonella enterica enterica serovar Typhi
uaucuugacaugaaaaau

SEQ ID NO: 3661657 - RNA, 20 nt, Salmonella enterica enterica serovar Typhi
uaucuugaugauucacccuc

SEQ ID NO: 3661658 - RNA, 12 nt, Salmonella enterica enterica serovar Typhi
uaucuugcuuua

SEQ ID NO: 3661659 - RNA, 24 nt, Salmonella enterica enterica serovar Typhi
uaucuuuaccagggaauaugauuu

SEQ ID NO: 3661660 - RNA, 14 nt, Salmonella enterica enterica serovar Typhi
uaucuuucuuuuua

SEQ ID NO: 3661661 - RNA, 23 nt, Salmonella enterica enterica serovar Typhi
uaucuuugccuuuugacagcaca

SEQ ID NO: 3661662 - RNA, 13 nt, Salmonella enterica enterica serovar Typhi
uaucuuuuuuagu

SEQ ID NO: 3661663 - RNA, 16 nt, Salmonella enterica enterica serovar Typhi
uaugaaaagcgcgucg

SEQ ID NO: 3661664 - RNA, 20 nt, Salmonella enterica enterica serovar Typhi
uaugaaaccccaaaucagca

SEQ ID NO: 3661665 - RNA, 13 nt, Salmonella enterica enterica serovar Typhi
uaugaaagagaaa

SEQ ID NO: 3661666 - RNA, 17 nt, Salmonella enterica enterica serovar Typhi
uaugaaagagaaaucuc

SEQ ID NO: 3661667 - RNA, 20 nt, Salmonella enterica enterica serovar Typhi
uaugaacaggcagcguaaua

SEQ ID NO: 3661668 - RNA, 14 nt, Salmonella enterica enterica serovar Typhi
uaugaacugcauca

SEQ ID NO: 3661669 - RNA, 14 nt, Salmonella enterica enterica serovar Typhi
uaugaagcuggagc

SEQ ID NO: 3661670 - RNA, 16 nt, Salmonella enterica enterica serovar Typhi
uaugaaucaucagaau

SEQ ID NO: 3661671 - RNA, 19 nt, Salmonella enterica enterica serovar Typhi
uaugaauuauuuucuaaaa

SEQ ID NO: 3661672 - RNA, 18 nt, Salmonella enterica enterica serovar Typhi
uaugaccgagucuacauc

SEQ ID NO: 3661673 - RNA, 22 nt, Salmonella enterica enterica serovar Typhi
uaugacguaagcggcgaaccag

SEQ ID NO: 3661674 - RNA, 18 nt, Salmonella enterica enterica serovar Typhi
uaugacugcgaauuuccu

SEQ ID NO: 3661675 - RNA, 21 nt, Salmonella enterica enterica serovar Typhi
uaugauagccguucuccagcg

SEQ ID NO: 3661676 - RNA, 17 nt, Salmonella enterica enterica serovar Typhi
uaugaucgaaaaugcgc

SEQ ID NO: 3661677 - RNA, 22 nt, Salmonella enterica enterica serovar Typhi
uaugaucgguuuuuuuagaacc

SEQ ID NO: 3661678 - RNA, 16 nt, Salmonella enterica enterica serovar Typhi
uaugaucugcacaaca

SEQ ID NO: 3661679 - RNA, 18 nt, Salmonella enterica enterica serovar Typhi
uaugaugccgcuucgcca

SEQ ID NO: 3661680 - RNA, 16 nt, Salmonella enterica enterica serovar Typhi
uaugauuauacuugcu

SEQ ID NO: 3661681 - RNA, 15 nt, Salmonella enterica enterica serovar Typhi
uaugauuuaaaaaag

SEQ ID NO: 3661682 - RNA, 15 nt, Salmonella enterica enterica serovar Typhi
uaugauuuucuuauu

SEQ ID NO: 3661683 - RNA, 14 nt, Salmonella enterica enterica serovar Typhi
uaugcaaaagaaaa

SEQ ID NO: 3661684 - RNA, 22 nt, Salmonella enterica enterica serovar Typhi
uaugcaaaagaaaaaacuuauu

SEQ ID NO: 3661685 - RNA, 11 nt, Salmonella enterica enterica serovar Typhi
uaugcaaaaua

SEQ ID NO: 3661686 - RNA, 19 nt, Salmonella enterica enterica serovar Typhi
uaugcaacacgccgaacaa

SEQ ID NO: 3661687 - RNA, 20 nt, Salmonella enterica enterica serovar Typhi
uaugcacaggcggcgguuca

SEQ ID NO: 3661688 - RNA, 13 nt, Salmonella enterica enterica serovar Typhi
uaugcaugguguu

SEQ ID NO: 3661689 - RNA, 13 nt, Salmonella enterica enterica serovar Typhi
uaugcauugcuga

SEQ ID NO: 3661690 - RNA, 23 nt, Salmonella enterica enterica serovar Typhi
uaugccacucuuuuaaggcccuc

SEQ ID NO: 3661691 - RNA, 20 nt, Salmonella enterica enterica serovar Typhi
uaugcccgccgcuggcgggc

SEQ ID NO: 3661692 - RNA, 22 nt, Salmonella enterica enterica serovar Typhi
uaugcccggaugauuaucaucu

SEQ ID NO: 3661693 - RNA, 16 nt, Salmonella enterica enterica serovar Typhi
uaugccgcacaaaauu

SEQ ID NO: 3661694 - RNA, 13 nt, Salmonella enterica enterica serovar Typhi
uaugccgccaucc

SEQ ID NO: 3661695 - RNA, 20 nt, Salmonella enterica enterica serovar Typhi
uaugccgccauccggcaaac

SEQ ID NO: 3661696 - RNA, 15 nt, Salmonella enterica enterica serovar Typhi
uaugccggagcgcuu

SEQ ID NO: 3661697 - RNA, 19 nt, Salmonella enterica enterica serovar Typhi
uaugccggaggauauuuau

SEQ ID NO: 3661698 - RNA, 20 nt, Salmonella enterica enterica serovar Typhi
uaugccggaggauauuuauu

SEQ ID NO: 3661699 - RNA, 22 nt, Salmonella enterica enterica serovar Typhi
uaugccugauggcgcuacgcuu

SEQ ID NO: 3661700 - RNA, 19 nt, Salmonella enterica enterica serovar Typhi
uaugccugcacuaaaccag

SEQ ID NO: 3661701 - RNA, 13 nt, Salmonella enterica enterica serovar Typhi
uaugccuuccaga

SEQ ID NO: 3661702 - RNA, 21 nt, Salmonella enterica enterica serovar Typhi
uaugccuuccagaaauaaaau

SEQ ID NO: 3661703 - RNA, 18 nt, Salmonella enterica enterica serovar Typhi
uaugcgauuucgucaaac

SEQ ID NO: 3661704 - RNA, 19 nt, Salmonella enterica enterica serovar Typhi
uaugcgccuucuucgcaau

SEQ ID NO: 3661705 - RNA, 18 nt, Salmonella enterica enterica serovar Typhi
uaugcguugacccgucca

SEQ ID NO: 3661706 - RNA, 17 nt, Salmonella enterica enterica serovar Typhi
uaugcucaacuuccaga

SEQ ID NO: 3661707 - RNA, 21 nt, Salmonella enterica enterica serovar Typhi
uaugcuccaguuguuccagca

SEQ ID NO: 3661708 - RNA, 18 nt, Salmonella enterica enterica serovar Typhi
uaugcugcucgaagauga

SEQ ID NO: 3661709 - RNA, 14 nt, Salmonella enterica enterica serovar Typhi
uaugcuguuuaugg

SEQ ID NO: 3661710 - RNA, 16 nt, Salmonella enterica enterica serovar Typhi
uauggaggauauaaaa

SEQ ID NO: 3661711 - RNA, 12 nt, Salmonella enterica enterica serovar Typhi
uauggcaaugcc

SEQ ID NO: 3661712 - RNA, 22 nt, Salmonella enterica enterica serovar Typhi
uauggcgcaaguguauggcugg

SEQ ID NO: 3661713 - RNA, 12 nt, Salmonella enterica enterica serovar Typhi
uaugggcagcac

SEQ ID NO: 3661714 - RNA, 17 nt, Salmonella enterica enterica serovar Typhi
uaugguauucgugcauc

SEQ ID NO: 3661715 - RNA, 21 nt, Salmonella enterica enterica serovar Typhi
uauguaaacgcauuaauauuu

SEQ ID NO: 3661716 - RNA, 16 nt, Salmonella enterica enterica serovar Typhi
uauugaagauguagac

SEQ ID NO: 3661717 - RNA, 23 nt, Salmonella enterica enterica serovar Typhi
uauugaagugcgaaauuuaauau

SEQ ID NO: 3661718 - RNA, 16 nt, Salmonella enterica enterica serovar Typhi
uauugaauaguuacca

SEQ ID NO: 3661719 - RNA, 22 nt, Salmonella enterica enterica serovar Typhi
uauugacacuaacgcucuucuc

SEQ ID NO: 3661720 - RNA, 15 nt, Salmonella enterica enterica serovar Typhi
uauugaccaucucuu

SEQ ID NO: 3661721 - RNA, 17 nt, Salmonella enterica enterica serovar Typhi
uauugacgaaaagauaa

SEQ ID NO: 3661722 - RNA, 17 nt, Salmonella enterica enterica serovar Typhi
uauugacgcuuucuucc

SEQ ID NO: 3661723 - RNA, 12 nt, Salmonella enterica enterica serovar Typhi
uauugagauaau

SEQ ID NO: 3661724 - RNA, 21 nt, Salmonella enterica enterica serovar Typhi
uauugauaccuuuaaccucuu

SEQ ID NO: 3661725 - RNA, 14 nt, Salmonella enterica enterica serovar Typhi
uauugaucacggua

SEQ ID NO: 3661726 - RNA, 14 nt, Salmonella enterica enterica serovar Typhi
uauugauuuuuaaa

SEQ ID NO: 3661727 - RNA, 15 nt, Salmonella enterica enterica serovar Typhi
uauugcaacuauuaa

SEQ ID NO: 3661728 - RNA, 16 nt, Salmonella enterica enterica serovar Typhi
uauugcaccauuuaca

SEQ ID NO: 3661729 - RNA, 17 nt, Salmonella enterica enterica serovar Typhi
uauugccacaauaucau

SEQ ID NO: 3661730 - RNA, 22 nt, Salmonella enterica enterica serovar Typhi
uauugccacagcgguauaucug

SEQ ID NO: 3661731 - RNA, 16 nt, Salmonella enterica enterica serovar Typhi
uauugccauaaauaca

SEQ ID NO: 3661732 - RNA, 15 nt, Salmonella enterica enterica serovar Typhi
uauugcccuuuuguu

SEQ ID NO: 3661733 - RNA, 15 nt, Salmonella enterica enterica serovar Typhi
uauugccgcacggua

SEQ ID NO: 3661734 - RNA, 16 nt, Salmonella enterica enterica serovar Typhi
uauugccuaaauaacu

SEQ ID NO: 3661735 - RNA, 17 nt, Salmonella enterica enterica serovar Typhi
uauugccugaagaacau

SEQ ID NO: 3661736 - RNA, 21 nt, Salmonella enterica enterica serovar Typhi
uauugcuguaggcacuuucca

SEQ ID NO: 3661737 - RNA, 16 nt, Salmonella enterica enterica serovar Typhi
uauugcuucagccaga

SEQ ID NO: 3661738 - RNA, 22 nt, Salmonella enterica enterica serovar Typhi
uauugcuucguggcaaucagca

SEQ ID NO: 3661739 - RNA, 20 nt, Salmonella enterica enterica serovar Typhi
uauugcuuucaauuuccgca

SEQ ID NO: 3661740 - RNA, 18 nt, Salmonella enterica enterica serovar Typhi
uauugggcguaagaaaag

SEQ ID NO: 3661741 - RNA, 13 nt, Salmonella enterica enterica serovar Typhi
uauugucaugcua

SEQ ID NO: 3661742 - RNA, 23 nt, Salmonella enterica enterica serovar Typhi
uauugucgaauuccgccugcugu

SEQ ID NO: 3661743 - RNA, 22 nt, Salmonella enterica enterica serovar Typhi
uauugucgccaccgcuauucuu

SEQ ID NO: 3661744 - RNA, 17 nt, Salmonella enterica enterica serovar Typhi
uauugucgcccugcaau

SEQ ID NO: 3661745 - RNA, 22 nt, Salmonella enterica enterica serovar Typhi
uauugucgcccugcaauucaua

SEQ ID NO: 3661746 - RNA, 14 nt, Salmonella enterica enterica serovar Typhi
uauugugagaaaag

SEQ ID NO: 3661747 - RNA, 17 nt, Salmonella enterica enterica serovar Typhi
uauuguucaugcaauuc

SEQ ID NO: 3661748 - RNA, 21 nt, Salmonella enterica enterica serovar Typhi
uauuguuuaacguuucaugga

SEQ ID NO: 3661749 - RNA, 17 nt, Salmonella enterica enterica serovar Typhi
uauuguuuagacagaca

SEQ ID NO: 3661750 - RNA, 13 nt, Salmonella enterica enterica serovar Typhi
uauuuaaaauucc

SEQ ID NO: 3661751 - RNA, 20 nt, Salmonella enterica enterica serovar Typhi
uauuuaaaauuccaauauuu

SEQ ID NO: 3661752 - RNA, 22 nt, Salmonella enterica enterica serovar Typhi
uauuuaaauaucgguucaauac

SEQ ID NO: 3661753 - RNA, 12 nt, Salmonella enterica enterica serovar Typhi
uauuuaacccug

SEQ ID NO: 3661754 - RNA, 11 nt, Salmonella enterica enterica serovar Typhi
uauuuaccgcu

SEQ ID NO: 3661755 - RNA, 19 nt, Salmonella enterica enterica serovar Typhi
uauuuaccgcuggcgucug

SEQ ID NO: 3661756 - RNA, 15 nt, Salmonella enterica enterica serovar Typhi
uauuuaccuuuuccu

SEQ ID NO: 3661757 - RNA, 21 nt, Salmonella enterica enterica serovar Typhi
uauuuacugaauaaauaguau

SEQ ID NO: 3661758 - RNA, 15 nt, Salmonella enterica enterica serovar Typhi
uauuuaucaaaaaga

SEQ ID NO: 3661759 - RNA, 23 nt, Salmonella enterica enterica serovar Typhi
uauuuauuugguuucuagucgcc

SEQ ID NO: 3661760 - RNA, 14 nt, Salmonella enterica enterica serovar Typhi
uauuuauuuuuagu

SEQ ID NO: 3661761 - RNA, 14 nt, Salmonella enterica enterica serovar Typhi
uauuucaagcaaua

SEQ ID NO: 3661762 - RNA, 18 nt, Salmonella enterica enterica serovar Typhi
uauuucacguuucaucuc

SEQ ID NO: 3661763 - RNA, 23 nt, Salmonella enterica enterica serovar Typhi
uauuucagaccgugcuuuugcag

SEQ ID NO: 3661764 - RNA, 13 nt, Salmonella enterica enterica serovar Typhi
uauuucagacuua

SEQ ID NO: 3661765 - RNA, 14 nt, Salmonella enterica enterica serovar Typhi
uauuucauaaugug

SEQ ID NO: 3661766 - RNA, 18 nt, Salmonella enterica enterica serovar Typhi
uauuucauuaaucuauuu

SEQ ID NO: 3661767 - RNA, 15 nt, Salmonella enterica enterica serovar Typhi
uauuuccucagaaag

SEQ ID NO: 3661768 - RNA, 21 nt, Salmonella enterica enterica serovar Typhi
uauuucggcacugacucuucc

SEQ ID NO: 3661769 - RNA, 17 nt, Salmonella enterica enterica serovar Typhi
uauuucuaucgcuaucg

SEQ ID NO: 3661770 - RNA, 18 nt, Salmonella enterica enterica serovar Typhi
uauuucucuugcagacag

SEQ ID NO: 3661771 - RNA, 14 nt, Salmonella enterica enterica serovar Typhi
uauuucugaaaaac

SEQ ID NO: 3661772 - RNA, 19 nt, Salmonella enterica enterica serovar Typhi
uauuugguaccgccaucgg

SEQ ID NO: 3661773 - RNA, 13 nt, Salmonella enterica enterica serovar Typhi
uauuugugaccaa

SEQ ID NO: 3661774 - RNA, 15 nt, Salmonella enterica enterica serovar Typhi
uauuuguguauuuuu

SEQ ID NO: 3661775 - RNA, 14 nt, Salmonella enterica enterica serovar Typhi
uauuuguuccggca

SEQ ID NO: 3661776 - RNA, 15 nt, Salmonella enterica enterica serovar Typhi
uauuuguuccggcaa

SEQ ID NO: 3661777 - RNA, 15 nt, Salmonella enterica enterica serovar Typhi
uauuuuaaauuccca

SEQ ID NO: 3661778 - RNA, 16 nt, Salmonella enterica enterica serovar Typhi
uauuuuacuugccauu

SEQ ID NO: 3661779 - RNA, 23 nt, Salmonella enterica enterica serovar Typhi
uauuuuggcucccgaacgauaau

SEQ ID NO: 3661780 - RNA, 12 nt, Salmonella enterica enterica serovar Typhi
uauuuuuaaaua

SEQ ID NO: 3661781 - RNA, 12 nt, Salmonella enterica enterica serovar Typhi
uauuuuucagcu

SEQ ID NO: 3661782 - RNA, 17 nt, Salmonella enterica enterica serovar Typhi
uauuuuuucaggaaguu

SEQ ID NO: 3661783 - RNA, 14 nt, Salmonella enterica enterica serovar Typhi
uauuuuuucugcua

SEQ ID NO: 3661784 - RNA, 19 nt, Salmonella enterica enterica serovar Typhi
uauuuuuuuuguuuucgau

SEQ ID NO: 3661785 - RNA, 14 nt, Salmonella enterica enterica serovar Typhi
ucaaaaaaaaccag

SEQ ID NO: 3661786 - RNA, 14 nt, Salmonella enterica enterica serovar Typhi
ucaaaaaagagaag

SEQ ID NO: 3661787 - RNA, 19 nt, Salmonella enterica enterica serovar Typhi
ucaaaaaauaucucucccu

SEQ ID NO: 3661788 - RNA, 16 nt, Salmonella enterica enterica serovar Typhi
ucaaaaaaucagcaau

SEQ ID NO: 3661789 - RNA, 21 nt, Salmonella enterica enterica serovar Typhi
ucaaaaaaucgaccaacgcac

SEQ ID NO: 3661790 - RNA, 19 nt, Salmonella enterica enterica serovar Typhi
ucaaaaauagcauuaagcu

SEQ ID NO: 3661791 - RNA, 14 nt, Salmonella enterica enterica serovar Typhi
ucaaaacgacauaa

SEQ ID NO: 3661792 - RNA, 19 nt, Salmonella enterica enterica serovar Typhi
ucaaaacuacgccaaugaa

SEQ ID NO: 3661793 - RNA, 14 nt, Salmonella enterica enterica serovar Typhi
ucaaaauaaaauua

SEQ ID NO: 3661794 - RNA, 18 nt, Salmonella enterica enterica serovar Typhi
ucaaaauaacgcuucacc

SEQ ID NO: 3661795 - RNA, 16 nt, Salmonella enterica enterica serovar Typhi
ucaaaaucaucgccac

SEQ ID NO: 3661796 - RNA, 15 nt, Salmonella enterica enterica serovar Typhi
ucaaaaucgcgcccc

SEQ ID NO: 3661797 - RNA, 16 nt, Salmonella enterica enterica serovar Typhi
ucaaaauggaaaauaa

SEQ ID NO: 3661798 - RNA, 17 nt, Salmonella enterica enterica serovar Typhi
ucaaaauggaaaauaau

SEQ ID NO: 3661799 - RNA, 18 nt, Salmonella enterica enterica serovar Typhi
ucaaaauggaaaauaaua

SEQ ID NO: 3661800 - RNA, 19 nt, Salmonella enterica enterica serovar Typhi
ucaaaauggaaaauaauaa

SEQ ID NO: 3661801 - RNA, 20 nt, Salmonella enterica enterica serovar Typhi
ucaaacacaaauuucgagca

SEQ ID NO: 3661802 - RNA, 21 nt, Salmonella enterica enterica serovar Typhi
ucaagcuuugcguaaaaaaca

SEQ ID NO: 3661803 - RNA, 23 nt, Salmonella enterica enterica serovar Typhi
ucaaggauggagauaucaccauc

SEQ ID NO: 3661804 - RNA, 15 nt, Salmonella enterica enterica serovar Typhi
ucaaggcgcaaaacc

SEQ ID NO: 3661805 - RNA, 14 nt, Salmonella enterica enterica serovar Typhi
ucaagucccccccc

SEQ ID NO: 3661806 - RNA, 22 nt, Salmonella enterica enterica serovar Typhi
ucaaguuauguuauccccacuu

SEQ ID NO: 3661807 - RNA, 17 nt, Salmonella enterica enterica serovar Typhi
ucaaguuuagaaaaaau

SEQ ID NO: 3661808 - RNA, 21 nt, Salmonella enterica enterica serovar Typhi
ucaaguuuagaaaaaauuaaa

SEQ ID NO: 3661809 - RNA, 22 nt, Salmonella enterica enterica serovar Typhi
ucaaguuuagaaaaaauuaaaa

SEQ ID NO: 3661810 - RNA, 21 nt, Salmonella enterica enterica serovar Typhi
ucaauaaacauuuuuuuugca

SEQ ID NO: 3661811 - RNA, 14 nt, Salmonella enterica enterica serovar Typhi
ucaauaaacuggag

SEQ ID NO: 3661812 - RNA, 16 nt, Salmonella enterica enterica serovar Typhi
ucaauaaaucaacaua

SEQ ID NO: 3661813 - RNA, 22 nt, Salmonella enterica enterica serovar Typhi
ucaauaagaaacugcuguagca

SEQ ID NO: 3661814 - RNA, 14 nt, Salmonella enterica enterica serovar Typhi
ucaauaagauaucc

SEQ ID NO: 3661815 - RNA, 22 nt, Salmonella enterica enterica serovar Typhi
ucaauaagcgaauugccgucgc

SEQ ID NO: 3661816 - RNA, 15 nt, Salmonella enterica enterica serovar Typhi
ucaauaauauuauca

SEQ ID NO: 3661817 - RNA, 15 nt, Salmonella enterica enterica serovar Typhi
ucaauaaucccuucu

SEQ ID NO: 3661818 - RNA, 17 nt, Salmonella enterica enterica serovar Typhi
ucaauaccuuaguaaaa

SEQ ID NO: 3661819 - RNA, 21 nt, Salmonella enterica enterica serovar Typhi
ucaauacgcgacagcgcgcca

SEQ ID NO: 3661820 - RNA, 15 nt, Salmonella enterica enterica serovar Typhi
ucaauagcacaucag

SEQ ID NO: 3661821 - RNA, 16 nt, Salmonella enterica enterica serovar Typhi
ucaauaguuaauuaaa

SEQ ID NO: 3661822 - RNA, 16 nt, Salmonella enterica enterica serovar Typhi
ucaauauuaucguaau

SEQ ID NO: 3661823 - RNA, 22 nt, Salmonella enterica enterica serovar Typhi
ucaauauuccuggcgccaccca

SEQ ID NO: 3661824 - RNA, 22 nt, Salmonella enterica enterica serovar Typhi
ucaauauuggcuucuuuaacua

SEQ ID NO: 3661825 - RNA, 23 nt, Salmonella enterica enterica serovar Typhi
ucaauauuggcuucuuuaacuaa

SEQ ID NO: 3661826 - RNA, 13 nt, Salmonella enterica enterica serovar Typhi
ucaaucaacucuu

SEQ ID NO: 3661827 - RNA, 18 nt, Salmonella enterica enterica serovar Typhi
ucaaucacaaaauggcug

SEQ ID NO: 3661828 - RNA, 14 nt, Salmonella enterica enterica serovar Typhi
ucaaucacuuauca

SEQ ID NO: 3661829 - RNA, 15 nt, Salmonella enterica enterica serovar Typhi
ucaaucacuuaucaa

SEQ ID NO: 3661830 - RNA, 22 nt, Salmonella enterica enterica serovar Typhi
ucaaucacuugaagccuuucug

SEQ ID NO: 3661831 - RNA, 19 nt, Salmonella enterica enterica serovar Typhi
ucaauccaacgaaacucag

SEQ ID NO: 3661832 - RNA, 13 nt, Salmonella enterica enterica serovar Typhi
ucaaucgccaguu

SEQ ID NO: 3661833 - RNA, 12 nt, Salmonella enterica enterica serovar Typhi
ucaaucgcgccc

SEQ ID NO: 3661834 - RNA, 18 nt, Salmonella enterica enterica serovar Typhi
ucaaucgucagacggaca

SEQ ID NO: 3661835 - RNA, 19 nt, Salmonella enterica enterica serovar Typhi
ucaaucgucguuccgccag

SEQ ID NO: 3661836 - RNA, 14 nt, Salmonella enterica enterica serovar Typhi
ucaaugcacgccac

SEQ ID NO: 3661837 - RNA, 15 nt, Salmonella enterica enterica serovar Typhi
ucaaugcacgccaca

SEQ ID NO: 3661838 - RNA, 17 nt, Salmonella enterica enterica serovar Typhi
ucaaugccgucggcaau

SEQ ID NO: 3661839 - RNA, 15 nt, Salmonella enterica enterica serovar Typhi
ucaaugccuggcaga

SEQ ID NO: 3661840 - RNA, 22 nt, Salmonella enterica enterica serovar Typhi
ucaauggcgcgaagugccaggu

SEQ ID NO: 3661841 - RNA, 20 nt, Salmonella enterica enterica serovar Typhi
ucaaugggauagugccugcc

SEQ ID NO: 3661842 - RNA, 19 nt, Salmonella enterica enterica serovar Typhi
ucaaugucugauggcgcug

SEQ ID NO: 3661843 - RNA, 19 nt, Salmonella enterica enterica serovar Typhi
ucaauguuagcauuauuuu

SEQ ID NO: 3661844 - RNA, 13 nt, Salmonella enterica enterica serovar Typhi
ucaauuauguauu

SEQ ID NO: 3661845 - RNA, 18 nt, Salmonella enterica enterica serovar Typhi
ucaauucuggaaucaauu

SEQ ID NO: 3661846 - RNA, 16 nt, Salmonella enterica enterica serovar Typhi
ucaauuuuacagccuc

SEQ ID NO: 3661847 - RNA, 22 nt, Salmonella enterica enterica serovar Typhi
ucaauuuuacugccuaccgggc

SEQ ID NO: 3661848 - RNA, 18 nt, Salmonella enterica enterica serovar Typhi
ucaauuuuucgcccggcu

SEQ ID NO: 3661849 - RNA, 15 nt, Salmonella enterica enterica serovar Typhi
ucacaaaauggcuga

SEQ ID NO: 3661850 - RNA, 14 nt, Salmonella enterica enterica serovar Typhi
ucacaaacaccacc

SEQ ID NO: 3661851 - RNA, 22 nt, Salmonella enterica enterica serovar Typhi
ucacaaacaccaccaguaaccg

SEQ ID NO: 3661852 - RNA, 23 nt, Salmonella enterica enterica serovar Typhi
ucacaaacaccaccaguaaccgc

SEQ ID NO: 3661853 - RNA, 16 nt, Salmonella enterica enterica serovar Typhi
ucacaaauuaaaaauc

SEQ ID NO: 3661854 - RNA, 13 nt, Salmonella enterica enterica serovar Typhi
ucacaaccuccac

SEQ ID NO: 3661855 - RNA, 18 nt, Salmonella enterica enterica serovar Typhi
ucacaaccuccacgccca

SEQ ID NO: 3661856 - RNA, 16 nt, Salmonella enterica enterica serovar Typhi
ucacaacgucaucccg

SEQ ID NO: 3661857 - RNA, 20 nt, Salmonella enterica enterica serovar Typhi
ucacaagcuguuucuccguu

SEQ ID NO: 3661858 - RNA, 17 nt, Salmonella enterica enterica serovar Typhi
ucacaauaucgagauga

SEQ ID NO: 3661859 - RNA, 17 nt, Salmonella enterica enterica serovar Typhi
ucacaaucagccacggc

SEQ ID NO: 3661860 - RNA, 16 nt, Salmonella enterica enterica serovar Typhi
ucacaaugaccucuuu

SEQ ID NO: 3661861 - RNA, 22 nt, Salmonella enterica enterica serovar Typhi
ucacaauguuuuuguaccaggc

SEQ ID NO: 3661862 - RNA, 23 nt, Salmonella enterica enterica serovar Typhi
ucacaauguuuuuguaccaggcc

SEQ ID NO: 3661863 - RNA, 19 nt, Salmonella enterica enterica serovar Typhi
ucacaccaacgcuggcccg

SEQ ID NO: 3661864 - RNA, 18 nt, Salmonella enterica enterica serovar Typhi
ucacacuacacgaauacc

SEQ ID NO: 3661865 - RNA, 21 nt, Salmonella enterica enterica serovar Typhi
ucacacugcgccgccagcgac

SEQ ID NO: 3661866 - RNA, 15 nt, Salmonella enterica enterica serovar Typhi
ucacaggcauacaga

SEQ ID NO: 3661867 - RNA, 14 nt, Salmonella enterica enterica serovar Typhi
ucacaggcuuauac

SEQ ID NO: 3661868 - RNA, 20 nt, Salmonella enterica enterica serovar Typhi
ucacaggcuucgacaaacag

SEQ ID NO: 3661869 - RNA, 16 nt, Salmonella enterica enterica serovar Typhi
ucacaggcuuggcagc

SEQ ID NO: 3661870 - RNA, 17 nt, Salmonella enterica enterica serovar Typhi
ucacagggggaacauuu

SEQ ID NO: 3661871 - RNA, 21 nt, Salmonella enterica enterica serovar Typhi
ucacauacaaagagaaaauga

SEQ ID NO: 3661872 - RNA, 18 nt, Salmonella enterica enterica serovar Typhi
ucacauauucaauaauau

SEQ ID NO: 3661873 - RNA, 13 nt, Salmonella enterica enterica serovar Typhi
ucacauccagccc

SEQ ID NO: 3661874 - RNA, 14 nt, Salmonella enterica enterica serovar Typhi
ucacaucgccaguu

SEQ ID NO: 3661875 - RNA, 15 nt, Salmonella enterica enterica serovar Typhi
ucacaucgcccugau

SEQ ID NO: 3661876 - RNA, 19 nt, Salmonella enterica enterica serovar Typhi
ucacaucgccggagaucag

SEQ ID NO: 3661877 - RNA, 17 nt, Salmonella enterica enterica serovar Typhi
ucacaucguaaaucagc

SEQ ID NO: 3661878 - RNA, 22 nt, Salmonella enterica enterica serovar Typhi
ucacaucguuggcgccaaaacc

SEQ ID NO: 3661879 - RNA, 20 nt, Salmonella enterica enterica serovar Typhi
ucacauggcgaaaaucacua

SEQ ID NO: 3661880 - RNA, 16 nt, Salmonella enterica enterica serovar Typhi
ucacauuggcaaaccc

SEQ ID NO: 3661881 - RNA, 15 nt, Salmonella enterica enterica serovar Typhi
ucaccaaaaggcaga

SEQ ID NO: 3661882 - RNA, 14 nt, Salmonella enterica enterica serovar Typhi
ucaccacaaaggcg

SEQ ID NO: 3661883 - RNA, 16 nt, Salmonella enterica enterica serovar Typhi
ucaccaccgcaggcag

SEQ ID NO: 3661884 - RNA, 18 nt, Salmonella enterica enterica serovar Typhi
ucaccaccgcaggcagcg

SEQ ID NO: 3661885 - RNA, 16 nt, Salmonella enterica enterica serovar Typhi
ucaccaccgccgcgag

SEQ ID NO: 3661886 - RNA, 22 nt, Salmonella enterica enterica serovar Typhi
ucaccacgcgaauaccuaacag

SEQ ID NO: 3661887 - RNA, 22 nt, Salmonella enterica enterica serovar Typhi
ucacgcccgccgaaggcaacgc

SEQ ID NO: 3661888 - RNA, 15 nt, Salmonella enterica enterica serovar Typhi
ucacgccguccagca

SEQ ID NO: 3661889 - RNA, 21 nt, Salmonella enterica enterica serovar Typhi
ucacgccgugaauuucugcug

SEQ ID NO: 3661890 - RNA, 18 nt, Salmonella enterica enterica serovar Typhi
ucacgcgcaaagcugcgg

SEQ ID NO: 3661891 - RNA, 17 nt, Salmonella enterica enterica serovar Typhi
ucacgcgccagcaccac

SEQ ID NO: 3661892 - RNA, 23 nt, Salmonella enterica enterica serovar Typhi
ucacgcgcgcgaaacgcacccgc

SEQ ID NO: 3661893 - RNA, 12 nt, Salmonella enterica enterica serovar Typhi
ucacgcggcgcg

SEQ ID NO: 3661894 - RNA, 21 nt, Salmonella enterica enterica serovar Typhi
ucacgcuauguuugcugagaa

SEQ ID NO: 3661895 - RNA, 20 nt, Salmonella enterica enterica serovar Typhi
ucacgcucacgcagauauuc

SEQ ID NO: 3661896 - RNA, 20 nt, Salmonella enterica enterica serovar Typhi
ucacgcucgaguucuucacg

SEQ ID NO: 3661897 - RNA, 17 nt, Salmonella enterica enterica serovar Typhi
ucacgcucgcggaagcg

SEQ ID NO: 3661898 - RNA, 17 nt, Salmonella enterica enterica serovar Typhi
ucacgcucuucgccaau

SEQ ID NO: 3661899 - RNA, 21 nt, Salmonella enterica enterica serovar Typhi
ucacgcugacaggauacccgg

SEQ ID NO: 3661900 - RNA, 22 nt, Salmonella enterica enterica serovar Typhi
ucacgcugacaggauacccggc

SEQ ID NO: 3661901 - RNA, 15 nt, Salmonella enterica enterica serovar Typhi
ucacgcugaugcugu

SEQ ID NO: 3661902 - RNA, 12 nt, Salmonella enterica enterica serovar Typhi
ucacgcuggaua

SEQ ID NO: 3661903 - RNA, 14 nt, Salmonella enterica enterica serovar Typhi
ucacgcuuaucgcc

SEQ ID NO: 3661904 - RNA, 21 nt, Salmonella enterica enterica serovar Typhi
ucacgcuuaucgccaaaccag

SEQ ID NO: 3661905 - RNA, 23 nt, Salmonella enterica enterica serovar Typhi
ucacggaauuucucguugguaga

SEQ ID NO: 3661906 - RNA, 19 nt, Salmonella enterica enterica serovar Typhi
ucacggagagucgcaccgc

SEQ ID NO: 3661907 - RNA, 16 nt, Salmonella enterica enterica serovar Typhi
ucacggauccagaacu

SEQ ID NO: 3661908 - RNA, 18 nt, Salmonella enterica enterica serovar Typhi
ucacggcacgcccuucgu

SEQ ID NO: 3661909 - RNA, 23 nt, Salmonella enterica enterica serovar Typhi
ucacggccuucgcagaucgccug

SEQ ID NO: 3661910 - RNA, 22 nt, Salmonella enterica enterica serovar Typhi
ucacgguacgcaucaccaggca

SEQ ID NO: 3661911 - RNA, 18 nt, Salmonella enterica enterica serovar Typhi
ucacgguagaccaaaugg

SEQ ID NO: 3661912 - RNA, 18 nt, Salmonella enterica enterica serovar Typhi
ucacgguauucguuacca

SEQ ID NO: 3661913 - RNA, 13 nt, Salmonella enterica enterica serovar Typhi
ucacguaaucgcc

SEQ ID NO: 3661914 - RNA, 20 nt, Salmonella enterica enterica serovar Typhi
ucacguccugguuaccgcgc

SEQ ID NO: 3661915 - RNA, 18 nt, Salmonella enterica enterica serovar Typhi
ucacgucgcgcgccgccu

SEQ ID NO: 3661916 - RNA, 14 nt, Salmonella enterica enterica serovar Typhi
ucacguucgguacg

SEQ ID NO: 3661917 - RNA, 15 nt, Salmonella enterica enterica serovar Typhi
ucacguuuacuaaaa

SEQ ID NO: 3661918 - RNA, 15 nt, Salmonella enterica enterica serovar Typhi
ucacguuuuccaggu

SEQ ID NO: 3661919 - RNA, 18 nt, Salmonella enterica enterica serovar Typhi
ucacguuuugcagcgcca

SEQ ID NO: 3661920 - RNA, 14 nt, Salmonella enterica enterica serovar Typhi
ucacuaaaccagcu

SEQ ID NO: 3661921 - RNA, 15 nt, Salmonella enterica enterica serovar Typhi
ucacuaacgcggcau

SEQ ID NO: 3661922 - RNA, 18 nt, Salmonella enterica enterica serovar Typhi
ucacuaauccccauuuuu

SEQ ID NO: 3661923 - RNA, 18 nt, Salmonella enterica enterica serovar Typhi
ucacuacccggaggcaau

SEQ ID NO: 3661924 - RNA, 17 nt, Salmonella enterica enterica serovar Typhi
ucacuccuaagagaaaa

SEQ ID NO: 3661925 - RNA, 21 nt, Salmonella enterica enterica serovar Typhi
ucacugaacccaaacagauaa

SEQ ID NO: 3661926 - RNA, 15 nt, Salmonella enterica enterica serovar Typhi
ucacugaaccugccu

SEQ ID NO: 3661927 - RNA, 12 nt, Salmonella enterica enterica serovar Typhi
ucacugccgccc

SEQ ID NO: 3661928 - RNA, 21 nt, Salmonella enterica enterica serovar Typhi
ucacugccguacaaaccgggc

SEQ ID NO: 3661929 - RNA, 19 nt, Salmonella enterica enterica serovar Typhi
ucacuggcggcaagcugcu

SEQ ID NO: 3661930 - RNA, 21 nt, Salmonella enterica enterica serovar Typhi
ucacugguuauaugaauaaac

SEQ ID NO: 3661931 - RNA, 14 nt, Salmonella enterica enterica serovar Typhi
ucacuguaaaaggg

SEQ ID NO: 3661932 - RNA, 17 nt, Salmonella enterica enterica serovar Typhi
ucacuguuaucgccauu

SEQ ID NO: 3661933 - RNA, 18 nt, Salmonella enterica enterica serovar Typhi
ucacuguuaucgccauua

SEQ ID NO: 3661934 - RNA, 24 nt, Salmonella enterica enterica serovar Typhi
ucacuuaucaaaccagcuuuucau

SEQ ID NO: 3661935 - RNA, 14 nt, Salmonella enterica enterica serovar Typhi
ucacuuaucccugc

SEQ ID NO: 3661936 - RNA, 15 nt, Salmonella enterica enterica serovar Typhi
ucacuucaucaucau

SEQ ID NO: 3661937 - RNA, 16 nt, Salmonella enterica enterica serovar Typhi
ucacuucauccggaua

SEQ ID NO: 3661938 - RNA, 21 nt, Salmonella enterica enterica serovar Typhi
ucacuuccgccaccacgccca

SEQ ID NO: 3661939 - RNA, 23 nt, Salmonella enterica enterica serovar Typhi
ucacuucugaguucggcaugggg

SEQ ID NO: 3661940 - RNA, 13 nt, Salmonella enterica enterica serovar Typhi
ucacuuguucaau

SEQ ID NO: 3661941 - RNA, 17 nt, Salmonella enterica enterica serovar Typhi
ucacuuguucaauauuc

SEQ ID NO: 3661942 - RNA, 17 nt, Salmonella enterica enterica serovar Typhi
ucacuuguucuucuguu

SEQ ID NO: 3661943 - RNA, 14 nt, Salmonella enterica enterica serovar Typhi
ucacuuuaccaggc

SEQ ID NO: 3661944 - RNA, 20 nt, Salmonella enterica enterica serovar Typhi
ucacuuucagauuuuuaaug

SEQ ID NO: 3661945 - RNA, 15 nt, Salmonella enterica enterica serovar Typhi
ucacuuucaucagag

SEQ ID NO: 3661946 - RNA, 22 nt, Salmonella enterica enterica serovar Typhi
ucacuuucccggaaaaguauuc

SEQ ID NO: 3661947 - RNA, 14 nt, Salmonella enterica enterica serovar Typhi
ucacuuuuaccggc

SEQ ID NO: 3661948 - RNA, 18 nt, Salmonella enterica enterica serovar Typhi
ucacuuuucuuuccugca

SEQ ID NO: 3661949 - RNA, 19 nt, Salmonella enterica enterica serovar Typhi
ucagaaaaaccuccggcua

SEQ ID NO: 3661950 - RNA, 19 nt, Salmonella enterica enterica serovar Typhi
ucagaaauauucaguacug

SEQ ID NO: 3661951 - RNA, 13 nt, Salmonella enterica enterica serovar Typhi
ucagaaauccgcg

SEQ ID NO: 3661952 - RNA, 13 nt, Salmonella enterica enterica serovar Typhi
ucagaaauucgca

SEQ ID NO: 3661953 - RNA, 19 nt, Salmonella enterica enterica serovar Typhi
ucagaaccucaucccggcu

SEQ ID NO: 3661954 - RNA, 16 nt, Salmonella enterica enterica serovar Typhi
ucagaaccugcgauac

SEQ ID NO: 3661955 - RNA, 17 nt, Salmonella enterica enterica serovar Typhi
ucagaaccugcgauacc

SEQ ID NO: 3661956 - RNA, 12 nt, Salmonella enterica enterica serovar Typhi
ucagaacgccuu

SEQ ID NO: 3661957 - RNA, 16 nt, Salmonella enterica enterica serovar Typhi
ucagaauaguuuugcc

SEQ ID NO: 3661958 - RNA, 16 nt, Salmonella enterica enterica serovar Typhi
ucagaauaugccaggg

SEQ ID NO: 3661959 - RNA, 19 nt, Salmonella enterica enterica serovar Typhi
ucagaaucguccagauuga

SEQ ID NO: 3661960 - RNA, 20 nt, Salmonella enterica enterica serovar Typhi
ucagaauuuuuaaccaucac

SEQ ID NO: 3661961 - RNA, 21 nt, Salmonella enterica enterica serovar Typhi
ucagacaaguagccugccagc

SEQ ID NO: 3661962 - RNA, 20 nt, Salmonella enterica enterica serovar Typhi
ucagacacauucugugaucc

SEQ ID NO: 3661963 - RNA, 21 nt, Salmonella enterica enterica serovar Typhi
ucagacagaucgguuuauccc

SEQ ID NO: 3661964 - RNA, 11 nt, Salmonella enterica enterica serovar Typhi
ucagacaggcc

SEQ ID NO: 3661965 - RNA, 21 nt, Salmonella enterica enterica serovar Typhi
ucagacauauacucuucgcca

SEQ ID NO: 3661966 - RNA, 21 nt, Salmonella enterica enterica serovar Typhi
ucagacaugauaaguuucucu

SEQ ID NO: 3661967 - RNA, 19 nt, Salmonella enterica enterica serovar Typhi
ucagaccagucggacagcg

SEQ ID NO: 3661968 - RNA, 20 nt, Salmonella enterica enterica serovar Typhi
ucagaccggcaaucaauaca

SEQ ID NO: 3661969 - RNA, 21 nt, Salmonella enterica enterica serovar Typhi
ucagaccgugcuuuugcagau

SEQ ID NO: 3661970 - RNA, 14 nt, Salmonella enterica enterica serovar Typhi
ucagacgaggcgcg

SEQ ID NO: 3661971 - RNA, 12 nt, Salmonella enterica enterica serovar Typhi
ucagacgcauca

SEQ ID NO: 3661972 - RNA, 18 nt, Salmonella enterica enterica serovar Typhi
ucagcgcgccgcgcagca

SEQ ID NO: 3661973 - RNA, 12 nt, Salmonella enterica enterica serovar Typhi
ucagcgcgcgcu

SEQ ID NO: 3661974 - RNA, 13 nt, Salmonella enterica enterica serovar Typhi
ucagcgcggcaag

SEQ ID NO: 3661975 - RNA, 17 nt, Salmonella enterica enterica serovar Typhi
ucagcgcggcagccgga

SEQ ID NO: 3661976 - RNA, 19 nt, Salmonella enterica enterica serovar Typhi
ucagcgcggcagccggaac

SEQ ID NO: 3661977 - RNA, 19 nt, Salmonella enterica enterica serovar Typhi
ucagcgcguuuuccaucau

SEQ ID NO: 3661978 - RNA, 20 nt, Salmonella enterica enterica serovar Typhi
ucagcgcguuuuccaucauc

SEQ ID NO: 3661979 - RNA, 18 nt, Salmonella enterica enterica serovar Typhi
ucagcgcuaccagcgcgg

SEQ ID NO: 3661980 - RNA, 14 nt, Salmonella enterica enterica serovar Typhi
ucagcggccagggc

SEQ ID NO: 3661981 - RNA, 15 nt, Salmonella enterica enterica serovar Typhi
ucagcggccagggca

SEQ ID NO: 3661982 - RNA, 18 nt, Salmonella enterica enterica serovar Typhi
ucagcggcgcaggggcau

SEQ ID NO: 3661983 - RNA, 22 nt, Salmonella enterica enterica serovar Typhi
ucagcguaaaacuuuucugcgu

SEQ ID NO: 3661984 - RNA, 21 nt, Salmonella enterica enterica serovar Typhi
ucagcguaauuaagccgggua

SEQ ID NO: 3661985 - RNA, 16 nt, Salmonella enterica enterica serovar Typhi
ucagcguaccgaagaa

SEQ ID NO: 3661986 - RNA, 18 nt, Salmonella enterica enterica serovar Typhi
ucagcguaccgaagaaca

SEQ ID NO: 3661987 - RNA, 15 nt, Salmonella enterica enterica serovar Typhi
ucagcgucggugaag

SEQ ID NO: 3661988 - RNA, 17 nt, Salmonella enterica enterica serovar Typhi
ucagcgucggugaagaa

SEQ ID NO: 3661989 - RNA, 14 nt, Salmonella enterica enterica serovar Typhi
ucagcgucuuucuu

SEQ ID NO: 3661990 - RNA, 20 nt, Salmonella enterica enterica serovar Typhi
ucagcguuucgccguaaaac

SEQ ID NO: 3661991 - RNA, 14 nt, Salmonella enterica enterica serovar Typhi
ucagcuacuuuaaa

SEQ ID NO: 3661992 - RNA, 21 nt, Salmonella enterica enterica serovar Typhi
ucagcuccuuauuacauaccc

SEQ ID NO: 3661993 - RNA, 22 nt, Salmonella enterica enterica serovar Typhi
ucagcuccuuucggacuuccug

SEQ ID NO: 3661994 - RNA, 13 nt, Salmonella enterica enterica serovar Typhi
ucagcucgcugcc

SEQ ID NO: 3661995 - RNA, 19 nt, Salmonella enterica enterica serovar Typhi
ucagcugaacagucccacc

SEQ ID NO: 3661996 - RNA, 18 nt, Salmonella enterica enterica serovar Typhi
ucagcugacaaugugccg

SEQ ID NO: 3661997 - RNA, 12 nt, Salmonella enterica enterica serovar Typhi
ucagcuggcuuu

SEQ ID NO: 3661998 - RNA, 19 nt, Salmonella enterica enterica serovar Typhi
ucagcuucugucagccuug

SEQ ID NO: 3661999 - RNA, 13 nt, Salmonella enterica enterica serovar Typhi
ucaggaaaacaaa

SEQ ID NO: 3662000 - RNA, 18 nt, Salmonella enterica enterica serovar Typhi
ucaggaaaacgcuuucca

SEQ ID NO: 3662001 - RNA, 16 nt, Salmonella enterica enterica serovar Typhi
ucaggaaaucuuccag

SEQ ID NO: 3662002 - RNA, 21 nt, Salmonella enterica enterica serovar Typhi
ucaggaaauucucagaaacaa

SEQ ID NO: 3662003 - RNA, 14 nt, Salmonella enterica enterica serovar Typhi
ucaggaaccacauc

SEQ ID NO: 3662004 - RNA, 23 nt, Salmonella enterica enterica serovar Typhi
ucaggaauaacaucguaaaucaa

SEQ ID NO: 3662005 - RNA, 13 nt, Salmonella enterica enterica serovar Typhi
ucaggaggccuga

SEQ ID NO: 3662006 - RNA, 15 nt, Salmonella enterica enterica serovar Typhi
ucaggaggccugaau

SEQ ID NO: 3662007 - RNA, 16 nt, Salmonella enterica enterica serovar Typhi
ucaggaggccugaaua

SEQ ID NO: 3662008 - RNA, 22 nt, Salmonella enterica enterica serovar Typhi
ucaggaggccugaauaaugacc

SEQ ID NO: 3662009 - RNA, 18 nt, Salmonella enterica enterica serovar Typhi
ucaggauaaaauccugca

SEQ ID NO: 3662010 - RNA, 14 nt, Salmonella enterica enterica serovar Typhi
ucaggauauucgcc

SEQ ID NO: 3662011 - RNA, 17 nt, Salmonella enterica enterica serovar Typhi
ucaggaucaaaaucgcg

SEQ ID NO: 3662012 - RNA, 16 nt, Salmonella enterica enterica serovar Typhi
ucaggaucaauucuga

SEQ ID NO: 3662013 - RNA, 13 nt, Salmonella enterica enterica serovar Typhi
ucaggaucgccgg

SEQ ID NO: 3662014 - RNA, 22 nt, Salmonella enterica enterica serovar Typhi
ucaggaugcugauuaaugauuu

SEQ ID NO: 3662015 - RNA, 17 nt, Salmonella enterica enterica serovar Typhi
ucaggcaaaaaaaaacc

SEQ ID NO: 3662016 - RNA, 16 nt, Salmonella enterica enterica serovar Typhi
ucaggcaaaaaucggc

SEQ ID NO: 3662017 - RNA, 23 nt, Salmonella enterica enterica serovar Typhi
ucaggcaaaaaucgucaucagau

SEQ ID NO: 3662018 - RNA, 17 nt, Salmonella enterica enterica serovar Typhi
ucaggcaauaaacauca

SEQ ID NO: 3662019 - RNA, 23 nt, Salmonella enterica enterica serovar Typhi
ucaggcaauaaacaucagccauu

SEQ ID NO: 3662020 - RNA, 23 nt, Salmonella enterica enterica serovar Typhi
ucaggcaaucuuuaacgcuggca

SEQ ID NO: 3662021 - RNA, 14 nt, Salmonella enterica enterica serovar Typhi
ucaggcaaugucug

SEQ ID NO: 3662022 - RNA, 23 nt, Salmonella enterica enterica serovar Typhi
ucaggcacagaagcgccugucua

SEQ ID NO: 3662023 - RNA, 20 nt, Salmonella enterica enterica serovar Typhi
ucaggcacgugcauaaaacg

SEQ ID NO: 3662024 - RNA, 15 nt, Salmonella enterica enterica serovar Typhi
ucaggcagaaauaac

SEQ ID NO: 3662025 - RNA, 19 nt, Salmonella enterica enterica serovar Typhi
ucaggcaguuuauccggcg

SEQ ID NO: 3662026 - RNA, 23 nt, Salmonella enterica enterica serovar Typhi
ucaggcaucaacguuguccagcg

SEQ ID NO: 3662027 - RNA, 16 nt, Salmonella enterica enterica serovar Typhi
ucaggcaucagauaaa

SEQ ID NO: 3662028 - RNA, 16 nt, Salmonella enterica enterica serovar Typhi
ucaggcauccagaccc

SEQ ID NO: 3662029 - RNA, 14 nt, Salmonella enterica enterica serovar Typhi
ucaggcaucugaaa

SEQ ID NO: 3662030 - RNA, 18 nt, Salmonella enterica enterica serovar Typhi
ucaggcaucugaaaugcu

SEQ ID NO: 3662031 - RNA, 13 nt, Salmonella enterica enterica serovar Typhi
ucaggcauguugc

SEQ ID NO: 3662032 - RNA, 14 nt, Salmonella enterica enterica serovar Typhi
ucaggccacugccc

SEQ ID NO: 3662033 - RNA, 18 nt, Salmonella enterica enterica serovar Typhi
ucaggccgauuucauuca

SEQ ID NO: 3662034 - RNA, 16 nt, Salmonella enterica enterica serovar Typhi
ucaggccgccagcaaa

SEQ ID NO: 3662035 - RNA, 21 nt, Salmonella enterica enterica serovar Typhi
ucaggccgccgcaaaagccgg

SEQ ID NO: 3662036 - RNA, 19 nt, Salmonella enterica enterica serovar Typhi
ucaggccuacacucugcgc

SEQ ID NO: 3662037 - RNA, 16 nt, Salmonella enterica enterica serovar Typhi
ucaggccuaccaucgc

SEQ ID NO: 3662038 - RNA, 17 nt, Salmonella enterica enterica serovar Typhi
ucaggccuaccaucgcg

SEQ ID NO: 3662039 - RNA, 16 nt, Salmonella enterica enterica serovar Typhi
ucaggcgaucccggcc

SEQ ID NO: 3662040 - RNA, 16 nt, Salmonella enterica enterica serovar Typhi
ucaggcgcauaucgcc

SEQ ID NO: 3662041 - RNA, 15 nt, Salmonella enterica enterica serovar Typhi
ucaggcggcugcgca

SEQ ID NO: 3662042 - RNA, 15 nt, Salmonella enterica enterica serovar Typhi
ucaggcgugaugacu

SEQ ID NO: 3662043 - RNA, 21 nt, Salmonella enterica enterica serovar Typhi
ucaggcguuacagacgcugcg

SEQ ID NO: 3662044 - RNA, 14 nt, Salmonella enterica enterica serovar Typhi
ucaggcuaaauggc

SEQ ID NO: 3662045 - RNA, 23 nt, Salmonella enterica enterica serovar Typhi
ucaggcuaucggcgggguuuaac

SEQ ID NO: 3662046 - RNA, 21 nt, Salmonella enterica enterica serovar Typhi
ucaggcuguuguucuuuucuu

SEQ ID NO: 3662047 - RNA, 14 nt, Salmonella enterica enterica serovar Typhi
ucaggcuugucgcg

SEQ ID NO: 3662048 - RNA, 14 nt, Salmonella enterica enterica serovar Typhi
ucagggcaaggcgg

SEQ ID NO: 3662049 - RNA, 21 nt, Salmonella enterica enterica serovar Typhi
ucagggcuuacucccugguga

SEQ ID NO: 3662050 - RNA, 17 nt, Salmonella enterica enterica serovar Typhi
ucaggggcgaacccauc

SEQ ID NO: 3662051 - RNA, 20 nt, Salmonella enterica enterica serovar Typhi
ucagggucuuauuucuccug

SEQ ID NO: 3662052 - RNA, 19 nt, Salmonella enterica enterica serovar Typhi
ucaggguuauccuccagcc

SEQ ID NO: 3662053 - RNA, 21 nt, Salmonella enterica enterica serovar Typhi
ucaggguuauuuccgcuggcc

SEQ ID NO: 3662054 - RNA, 14 nt, Salmonella enterica enterica serovar Typhi
ucaggguugucuca

SEQ ID NO: 3662055 - RNA, 21 nt, Salmonella enterica enterica serovar Typhi
ucaggguuuucuaccgcagcc

SEQ ID NO: 3662056 - RNA, 14 nt, Salmonella enterica enterica serovar Typhi
ucagguaucccgcc

SEQ ID NO: 3662057 - RNA, 19 nt, Salmonella enterica enterica serovar Typhi
ucagguaucccgccagcgg

SEQ ID NO: 3662058 - RNA, 14 nt, Salmonella enterica enterica serovar Typhi
ucaucauaauucag

SEQ ID NO: 3662059 - RNA, 15 nt, Salmonella enterica enterica serovar Typhi
ucaucauaauucagc

SEQ ID NO: 3662060 - RNA, 19 nt, Salmonella enterica enterica serovar Typhi
ucaucauacugaagauaaa

SEQ ID NO: 3662061 - RNA, 16 nt, Salmonella enterica enterica serovar Typhi
ucaucaucggcacagc

SEQ ID NO: 3662062 - RNA, 18 nt, Salmonella enterica enterica serovar Typhi
ucaucaucggcacagcca

SEQ ID NO: 3662063 - RNA, 21 nt, Salmonella enterica enterica serovar Typhi
ucaucaugaaaaacaguaccg

SEQ ID NO: 3662064 - RNA, 16 nt, Salmonella enterica enterica serovar Typhi
ucaucaugauauaauu

SEQ ID NO: 3662065 - RNA, 15 nt, Salmonella enterica enterica serovar Typhi
ucaucaugcugcuga

SEQ ID NO: 3662066 - RNA, 21 nt, Salmonella enterica enterica serovar Typhi
ucaucauggacagauuuccac

SEQ ID NO: 3662067 - RNA, 17 nt, Salmonella enterica enterica serovar Typhi
ucaucauuaccuuuucc

SEQ ID NO: 3662068 - RNA, 22 nt, Salmonella enterica enterica serovar Typhi
ucaucauugaggcgcgaaaaau

SEQ ID NO: 3662069 - RNA, 23 nt, Salmonella enterica enterica serovar Typhi
ucaucauugaggcgcgaaaaaua

SEQ ID NO: 3662070 - RNA, 18 nt, Salmonella enterica enterica serovar Typhi
ucauccaacugcgccuga

SEQ ID NO: 3662071 - RNA, 19 nt, Salmonella enterica enterica serovar Typhi
ucauccaauaacguaaccg

SEQ ID NO: 3662072 - RNA, 19 nt, Salmonella enterica enterica serovar Typhi
ucauccaccagaauaaagg

SEQ ID NO: 3662073 - RNA, 15 nt, Salmonella enterica enterica serovar Typhi
ucauccaccuuaucc

SEQ ID NO: 3662074 - RNA, 11 nt, Salmonella enterica enterica serovar Typhi
ucauccagcaa

SEQ ID NO: 3662075 - RNA, 16 nt, Salmonella enterica enterica serovar Typhi
ucauccagcaaaauaa

SEQ ID NO: 3662076 - RNA, 21 nt, Salmonella enterica enterica serovar Typhi
ucauccagcaauaacaccggc

SEQ ID NO: 3662077 - RNA, 16 nt, Salmonella enterica enterica serovar Typhi
ucauccagcagcagca

SEQ ID NO: 3662078 - RNA, 20 nt, Salmonella enterica enterica serovar Typhi
ucauccagucagcaauuaac

SEQ ID NO: 3662079 - RNA, 19 nt, Salmonella enterica enterica serovar Typhi
ucaucccacuccaucgccu

SEQ ID NO: 3662080 - RNA, 21 nt, Salmonella enterica enterica serovar Typhi
ucaucccgcccagcaacacag

SEQ ID NO: 3662081 - RNA, 17 nt, Salmonella enterica enterica serovar Typhi
ucaucccgcugugaucc

SEQ ID NO: 3662082 - RNA, 22 nt, Salmonella enterica enterica serovar Typhi
ucaucccggcuuaaauuuuuaa

SEQ ID NO: 3662083 - RNA, 23 nt, Salmonella enterica enterica serovar Typhi
ucaucccgguuucccgcgugaac

SEQ ID NO: 3662084 - RNA, 23 nt, Salmonella enterica enterica serovar Typhi
ucaucccgguuugggcgcgaaac

SEQ ID NO: 3662085 - RNA, 16 nt, Salmonella enterica enterica serovar Typhi
ucauccgaccacggcc

SEQ ID NO: 3662086 - RNA, 23 nt, Salmonella enterica enterica serovar Typhi
ucauccgaccacggccacagcca

SEQ ID NO: 3662087 - RNA, 19 nt, Salmonella enterica enterica serovar Typhi
ucauccgcccggcaucaag

SEQ ID NO: 3662088 - RNA, 19 nt, Salmonella enterica enterica serovar Typhi
ucauccgcgcuuuaugcag

SEQ ID NO: 3662089 - RNA, 12 nt, Salmonella enterica enterica serovar Typhi
ucauccgcuucg

SEQ ID NO: 3662090 - RNA, 21 nt, Salmonella enterica enterica serovar Typhi
ucauccggcguugcgccgcca

SEQ ID NO: 3662091 - RNA, 17 nt, Salmonella enterica enterica serovar Typhi
ucauccgggcauaaaaa

SEQ ID NO: 3662092 - RNA, 18 nt, Salmonella enterica enterica serovar Typhi
ucauccggguuaaaccag

SEQ ID NO: 3662093 - RNA, 17 nt, Salmonella enterica enterica serovar Typhi
ucauccugauuuuacug

SEQ ID NO: 3662094 - RNA, 16 nt, Salmonella enterica enterica serovar Typhi
ucauccugcucaucga

SEQ ID NO: 3662095 - RNA, 17 nt, Salmonella enterica enterica serovar Typhi
ucaucgacuucgaaggu

SEQ ID NO: 3662096 - RNA, 17 nt, Salmonella enterica enterica serovar Typhi
ucaucgauuuccugaug

SEQ ID NO: 3662097 - RNA, 16 nt, Salmonella enterica enterica serovar Typhi
ucaucgcaaauucugu

SEQ ID NO: 3662098 - RNA, 14 nt, Salmonella enterica enterica serovar Typhi
ucaucgcauccagg

SEQ ID NO: 3662099 - RNA, 15 nt, Salmonella enterica enterica serovar Typhi
ucaucgccuucaucc

SEQ ID NO: 3662100 - RNA, 11 nt, Salmonella enterica enterica serovar Typhi
ucaucgcgcca

SEQ ID NO: 3662101 - RNA, 12 nt, Salmonella enterica enterica serovar Typhi
ucaucgcgcuga

SEQ ID NO: 3662102 - RNA, 16 nt, Salmonella enterica enterica serovar Typhi
ucaucgcuggugugca

SEQ ID NO: 3662103 - RNA, 20 nt, Salmonella enterica enterica serovar Typhi
ucaucggucaguuugcccca

SEQ ID NO: 3662104 - RNA, 16 nt, Salmonella enterica enterica serovar Typhi
ucaucgguguucacaa

SEQ ID NO: 3662105 - RNA, 18 nt, Salmonella enterica enterica serovar Typhi
ucaucgguguucacaauu

SEQ ID NO: 3662106 - RNA, 13 nt, Salmonella enterica enterica serovar Typhi
ucaucgucagcaa

SEQ ID NO: 3662107 - RNA, 15 nt, Salmonella enterica enterica serovar Typhi
ucaucgucagcuccu

SEQ ID NO: 3662108 - RNA, 20 nt, Salmonella enterica enterica serovar Typhi
ucaucgucauuaaugccuaa

SEQ ID NO: 3662109 - RNA, 17 nt, Salmonella enterica enterica serovar Typhi
ucaucuaucugcuucug

SEQ ID NO: 3662110 - RNA, 16 nt, Salmonella enterica enterica serovar Typhi
ucaucucaagccccau

SEQ ID NO: 3662111 - RNA, 15 nt, Salmonella enterica enterica serovar Typhi
ucaucucccaggccg

SEQ ID NO: 3662112 - RNA, 20 nt, Salmonella enterica enterica serovar Typhi
ucaucucccccgcauuucau

SEQ ID NO: 3662113 - RNA, 19 nt, Salmonella enterica enterica serovar Typhi
ucaucuccgauaaauaaga

SEQ ID NO: 3662114 - RNA, 16 nt, Salmonella enterica enterica serovar Typhi
ucaucugaugauuaau

SEQ ID NO: 3662115 - RNA, 12 nt, Salmonella enterica enterica serovar Typhi
ucaucugccagu

SEQ ID NO: 3662116 - RNA, 15 nt, Salmonella enterica enterica serovar Typhi
ucaucuucacuucac

SEQ ID NO: 3662117 - RNA, 17 nt, Salmonella enterica enterica serovar Typhi
ucaucuucacuucacaa

SEQ ID NO: 3662118 - RNA, 23 nt, Salmonella enterica enterica serovar Typhi
ucaucuucagcaacugcugcgcg

SEQ ID NO: 3662119 - RNA, 15 nt, Salmonella enterica enterica serovar Typhi
ucaucuuccaguacc

SEQ ID NO: 3662120 - RNA, 22 nt, Salmonella enterica enterica serovar Typhi
ucaucuucccgcagauauccgc

SEQ ID NO: 3662121 - RNA, 20 nt, Salmonella enterica enterica serovar Typhi
ucaucuucggcgggaucucc

SEQ ID NO: 3662122 - RNA, 16 nt, Salmonella enterica enterica serovar Typhi
ucaugaaaaauauaaa

SEQ ID NO: 3662123 - RNA, 14 nt, Salmonella enterica enterica serovar Typhi
ucaugaaccacgcc

SEQ ID NO: 3662124 - RNA, 19 nt, Salmonella enterica enterica serovar Typhi
ucaugacaucgcccugggu

SEQ ID NO: 3662125 - RNA, 14 nt, Salmonella enterica enterica serovar Typhi
ucaugacgcgauau

SEQ ID NO: 3662126 - RNA, 17 nt, Salmonella enterica enterica serovar Typhi
ucaugacucuuguuucu

SEQ ID NO: 3662127 - RNA, 21 nt, Salmonella enterica enterica serovar Typhi
ucaugacuuuuuucaaccuca

SEQ ID NO: 3662128 - RNA, 22 nt, Salmonella enterica enterica serovar Typhi
ucaugagucgcgcgcgccaguc

SEQ ID NO: 3662129 - RNA, 23 nt, Salmonella enterica enterica serovar Typhi
ucaugagucgcgcgcgccaguca

SEQ ID NO: 3662130 - RNA, 17 nt, Salmonella enterica enterica serovar Typhi
ucaugauacccagcguc

SEQ ID NO: 3662131 - RNA, 18 nt, Salmonella enterica enterica serovar Typhi
ucaugaucgauccgcauc

SEQ ID NO: 3662132 - RNA, 14 nt, Salmonella enterica enterica serovar Typhi
ucaugaucuuuccu

SEQ ID NO: 3662133 - RNA, 20 nt, Salmonella enterica enterica serovar Typhi
ucaugaucuuuccuuuuuca

SEQ ID NO: 3662134 - RNA, 22 nt, Salmonella enterica enterica serovar Typhi
ucaugaugaucuucagcccguu

SEQ ID NO: 3662135 - RNA, 23 nt, Salmonella enterica enterica serovar Typhi
ucaugauuucuugagcggcauca

SEQ ID NO: 3662136 - RNA, 15 nt, Salmonella enterica enterica serovar Typhi
ucaugcaagacaucu

SEQ ID NO: 3662137 - RNA, 12 nt, Salmonella enterica enterica serovar Typhi
ucaugcaauaau

SEQ ID NO: 3662138 - RNA, 16 nt, Salmonella enterica enterica serovar Typhi
ucaugcagccggcgau

SEQ ID NO: 3662139 - RNA, 18 nt, Salmonella enterica enterica serovar Typhi
ucaugcauuaaugggcga

SEQ ID NO: 3662140 - RNA, 16 nt, Salmonella enterica enterica serovar Typhi
ucaugcccggcaaacg

SEQ ID NO: 3662141 - RNA, 17 nt, Salmonella enterica enterica serovar Typhi
ucaugcgaaugcaaccg

SEQ ID NO: 3662142 - RNA, 22 nt, Salmonella enterica enterica serovar Typhi
ucaugcgcggucauucauuguc

SEQ ID NO: 3662143 - RNA, 15 nt, Salmonella enterica enterica serovar Typhi
ucaugcgggagcuug

SEQ ID NO: 3662144 - RNA, 17 nt, Salmonella enterica enterica serovar Typhi
ucaugcgguuaaaccag

SEQ ID NO: 3662145 - RNA, 15 nt, Salmonella enterica enterica serovar Typhi
ucaugcguaaaucgc

SEQ ID NO: 3662146 - RNA, 14 nt, Salmonella enterica enterica serovar Typhi
ucaugcuaaaacag

SEQ ID NO: 3662147 - RNA, 15 nt, Salmonella enterica enterica serovar Typhi
ucaugcugcaccgca

SEQ ID NO: 3662148 - RNA, 20 nt, Salmonella enterica enterica serovar Typhi
ucaugcugcguacaaucgcg

SEQ ID NO: 3662149 - RNA, 18 nt, Salmonella enterica enterica serovar Typhi
ucauggcauagccaaaga

SEQ ID NO: 3662150 - RNA, 12 nt, Salmonella enterica enterica serovar Typhi
ucauggcguaaa

SEQ ID NO: 3662151 - RNA, 21 nt, Salmonella enterica enterica serovar Typhi
ucauggcuuuuacccuucaug

SEQ ID NO: 3662152 - RNA, 16 nt, Salmonella enterica enterica serovar Typhi
ucaugggcucaucaaa

SEQ ID NO: 3662153 - RNA, 20 nt, Salmonella enterica enterica serovar Typhi
ucauggguagccguuuaaaa

SEQ ID NO: 3662154 - RNA, 18 nt, Salmonella enterica enterica serovar Typhi
ucaugguaaaauccuuuu

SEQ ID NO: 3662155 - RNA, 15 nt, Salmonella enterica enterica serovar Typhi
ucaugguaaaugccg

SEQ ID NO: 3662156 - RNA, 17 nt, Salmonella enterica enterica serovar Typhi
ucaugguagucaaauuc

SEQ ID NO: 3662157 - RNA, 13 nt, Salmonella enterica enterica serovar Typhi
ucaugguugaaaa

SEQ ID NO: 3662158 - RNA, 13 nt, Salmonella enterica enterica serovar Typhi
ucauguaaaggcg

SEQ ID NO: 3662159 - RNA, 13 nt, Salmonella enterica enterica serovar Typhi
ucauguccccagg

SEQ ID NO: 3662160 - RNA, 12 nt, Salmonella enterica enterica serovar Typhi
ucaugucgucau

SEQ ID NO: 3662161 - RNA, 19 nt, Salmonella enterica enterica serovar Typhi
ucaugugcagcauccagcu

SEQ ID NO: 3662162 - RNA, 23 nt, Salmonella enterica enterica serovar Typhi
ucauguugccggauagcucgcug

SEQ ID NO: 3662163 - RNA, 11 nt, Salmonella enterica enterica serovar Typhi
ucauuaaaaaa

SEQ ID NO: 3662164 - RNA, 13 nt, Salmonella enterica enterica serovar Typhi
ucauuaaaaaacc

SEQ ID NO: 3662165 - RNA, 17 nt, Salmonella enterica enterica serovar Typhi
ucauuaacgggaaacug

SEQ ID NO: 3662166 - RNA, 20 nt, Salmonella enterica enterica serovar Typhi
ucauuaagcccauaaagcac

SEQ ID NO: 3662167 - RNA, 13 nt, Salmonella enterica enterica serovar Typhi
ucauuaauauaau

SEQ ID NO: 3662168 - RNA, 21 nt, Salmonella enterica enterica serovar Typhi
ucauuaauuauacugucgcuc

SEQ ID NO: 3662169 - RNA, 19 nt, Salmonella enterica enterica serovar Typhi
ucauuacaggcgaauagcg

SEQ ID NO: 3662170 - RNA, 17 nt, Salmonella enterica enterica serovar Typhi
ucauuacccaauaauga

SEQ ID NO: 3662171 - RNA, 13 nt, Salmonella enterica enterica serovar Typhi
ucauuaccuuuuc

SEQ ID NO: 3662172 - RNA, 17 nt, Salmonella enterica enterica serovar Typhi
ucauuacgccugucgcg

SEQ ID NO: 3662173 - RNA, 20 nt, Salmonella enterica enterica serovar Typhi
ucauuacgccugucgcgcca

SEQ ID NO: 3662174 - RNA, 23 nt, Salmonella enterica enterica serovar Typhi
ucauuacuggaucgcuccauucu

SEQ ID NO: 3662175 - RNA, 23 nt, Salmonella enterica enterica serovar Typhi
ucauuaggcguaauuauuacaga

SEQ ID NO: 3662176 - RNA, 14 nt, Salmonella enterica enterica serovar Typhi
ucauuauucaggcc

SEQ ID NO: 3662177 - RNA, 19 nt, Salmonella enterica enterica serovar Typhi
ucauuauucaggccuccug

SEQ ID NO: 3662178 - RNA, 17 nt, Salmonella enterica enterica serovar Typhi
ucauuauuuuuaaauaa

SEQ ID NO: 3662179 - RNA, 16 nt, Salmonella enterica enterica serovar Typhi
ucauucacauuauuca

SEQ ID NO: 3662180 - RNA, 21 nt, Salmonella enterica enterica serovar Typhi
ucauucacccaauaaauaaua

SEQ ID NO: 3662181 - RNA, 14 nt, Salmonella enterica enterica serovar Typhi
ucauucagcgcgau

SEQ ID NO: 3662182 - RNA, 15 nt, Salmonella enterica enterica serovar Typhi
ucauucagcggcugc

SEQ ID NO: 3662183 - RNA, 20 nt, Salmonella enterica enterica serovar Typhi
ucauuccugcguugaccagc

SEQ ID NO: 3662184 - RNA, 18 nt, Salmonella enterica enterica serovar Typhi
ucauucgcgaauagugca

SEQ ID NO: 3662185 - RNA, 14 nt, Salmonella enterica enterica serovar Typhi
ucauucgggaugca

SEQ ID NO: 3662186 - RNA, 20 nt, Salmonella enterica enterica serovar Typhi
ucauucgguuaggaauagca

SEQ ID NO: 3662187 - RNA, 17 nt, Salmonella enterica enterica serovar Typhi
ucauucgucaaauucac

SEQ ID NO: 3662188 - RNA, 21 nt, Salmonella enterica enterica serovar Typhi
ucauucuccgggauagcaauc

SEQ ID NO: 3662189 - RNA, 15 nt, Salmonella enterica enterica serovar Typhi
ucauucugauuuuac

SEQ ID NO: 3662190 - RNA, 20 nt, Salmonella enterica enterica serovar Typhi
ucauucugcuuaccagaccg

SEQ ID NO: 3662191 - RNA, 19 nt, Salmonella enterica enterica serovar Typhi
ucauugacgguggccgcca

SEQ ID NO: 3662192 - RNA, 18 nt, Salmonella enterica enterica serovar Typhi
ucauugaguuugcaaucc

SEQ ID NO: 3662193 - RNA, 21 nt, Salmonella enterica enterica serovar Typhi
ucauugaugaugaagcugcag

SEQ ID NO: 3662194 - RNA, 17 nt, Salmonella enterica enterica serovar Typhi
ucauugccguaaauuga

SEQ ID NO: 3662195 - RNA, 17 nt, Salmonella enterica enterica serovar Typhi
ucauugcgcuaaaaucc

SEQ ID NO: 3662196 - RNA, 16 nt, Salmonella enterica enterica serovar Typhi
ucauugcguucaggcg

SEQ ID NO: 3662197 - RNA, 17 nt, Salmonella enterica enterica serovar Typhi
ucauuggggggaaauua

SEQ ID NO: 3662198 - RNA, 14 nt, Salmonella enterica enterica serovar Typhi
ucauuguaaaaccg

SEQ ID NO: 3662199 - RNA, 19 nt, Salmonella enterica enterica serovar Typhi
ucauugucggaacgcugua

SEQ ID NO: 3662200 - RNA, 14 nt, Salmonella enterica enterica serovar Typhi
ucauuucaggcaaa

SEQ ID NO: 3662201 - RNA, 13 nt, Salmonella enterica enterica serovar Typhi
ucauuucugccug

SEQ ID NO: 3662202 - RNA, 18 nt, Salmonella enterica enterica serovar Typhi
ucauuucugccugcuuca

SEQ ID NO: 3662203 - RNA, 13 nt, Salmonella enterica enterica serovar Typhi
ucauuucuuuaau

SEQ ID NO: 3662204 - RNA, 15 nt, Salmonella enterica enterica serovar Typhi
ucauuuguacaaaaa

SEQ ID NO: 3662205 - RNA, 20 nt, Salmonella enterica enterica serovar Typhi
ucauuuguacaaaaaaugug

SEQ ID NO: 3662206 - RNA, 21 nt, Salmonella enterica enterica serovar Typhi
ucauuuguacaaaaaauguga

SEQ ID NO: 3662207 - RNA, 13 nt, Salmonella enterica enterica serovar Typhi
ucauuuguuccuc

SEQ ID NO: 3662208 - RNA, 24 nt, Salmonella enterica enterica serovar Typhi
ucauuuuacugcguaaucuuuuca

SEQ ID NO: 3662209 - RNA, 18 nt, Salmonella enterica enterica serovar Typhi
ucauuuuaucgauaauau

SEQ ID NO: 3662210 - RNA, 12 nt, Salmonella enterica enterica serovar Typhi
ucauuuuccaca

SEQ ID NO: 3662211 - RNA, 15 nt, Salmonella enterica enterica serovar Typhi
uccaaaaauaaacac

SEQ ID NO: 3662212 - RNA, 20 nt, Salmonella enterica enterica serovar Typhi
uccaaaacgaacaggccgcc

SEQ ID NO: 3662213 - RNA, 12 nt, Salmonella enterica enterica serovar Typhi
uccaaaauaaua

SEQ ID NO: 3662214 - RNA, 13 nt, Salmonella enterica enterica serovar Typhi
uccaaaauaauaa

SEQ ID NO: 3662215 - RNA, 23 nt, Salmonella enterica enterica serovar Typhi
uccaaacuggcugugccaauaac

SEQ ID NO: 3662216 - RNA, 22 nt, Salmonella enterica enterica serovar Typhi
uccaaauggcguacuaaauagg

SEQ ID NO: 3662217 - RNA, 21 nt, Salmonella enterica enterica serovar Typhi
uccaacaaggauauccgccag

SEQ ID NO: 3662218 - RNA, 23 nt, Salmonella enterica enterica serovar Typhi
uccaacaaggauauccgccaguu

SEQ ID NO: 3662219 - RNA, 22 nt, Salmonella enterica enterica serovar Typhi
uccaacagaaggcuucacgcca

SEQ ID NO: 3662220 - RNA, 16 nt, Salmonella enterica enterica serovar Typhi
uccaacuguacgccac

SEQ ID NO: 3662221 - RNA, 19 nt, Salmonella enterica enterica serovar Typhi
uccaauaacguaaccgcuu

SEQ ID NO: 3662222 - RNA, 16 nt, Salmonella enterica enterica serovar Typhi
uccaauaauggagaug

SEQ ID NO: 3662223 - RNA, 20 nt, Salmonella enterica enterica serovar Typhi
uccaauagagcaguuaauaa

SEQ ID NO: 3662224 - RNA, 23 nt, Salmonella enterica enterica serovar Typhi
uccaauagagcaguuaauaauga

SEQ ID NO: 3662225 - RNA, 16 nt, Salmonella enterica enterica serovar Typhi
uccaaugcggcaucuc

SEQ ID NO: 3662226 - RNA, 22 nt, Salmonella enterica enterica serovar Typhi
uccacaaaaggauacagcgccg

SEQ ID NO: 3662227 - RNA, 20 nt, Salmonella enterica enterica serovar Typhi
uccacaaauagcauggcgug

SEQ ID NO: 3662228 - RNA, 16 nt, Salmonella enterica enterica serovar Typhi
uccacaaccggcuggc

SEQ ID NO: 3662229 - RNA, 16 nt, Salmonella enterica enterica serovar Typhi
uccagcgaaccuucca

SEQ ID NO: 3662230 - RNA, 15 nt, Salmonella enterica enterica serovar Typhi
uccagcgaauaauga

SEQ ID NO: 3662231 - RNA, 14 nt, Salmonella enterica enterica serovar Typhi
uccagcgauaaacg

SEQ ID NO: 3662232 - RNA, 22 nt, Salmonella enterica enterica serovar Typhi
uccagcgcauggaagaaaauau

SEQ ID NO: 3662233 - RNA, 14 nt, Salmonella enterica enterica serovar Typhi
uccagcgccagcgc

SEQ ID NO: 3662234 - RNA, 16 nt, Salmonella enterica enterica serovar Typhi
uccagcgccagcucca

SEQ ID NO: 3662235 - RNA, 15 nt, Salmonella enterica enterica serovar Typhi
uccagcgccugcugu

SEQ ID NO: 3662236 - RNA, 22 nt, Salmonella enterica enterica serovar Typhi
uccagcgccugcuguaaaauau

SEQ ID NO: 3662237 - RNA, 20 nt, Salmonella enterica enterica serovar Typhi
uccagcggcaggauccccau

SEQ ID NO: 3662238 - RNA, 12 nt, Salmonella enterica enterica serovar Typhi
uccagcggcgcg

SEQ ID NO: 3662239 - RNA, 15 nt, Salmonella enterica enterica serovar Typhi
uccagcgggccgacg

SEQ ID NO: 3662240 - RNA, 22 nt, Salmonella enterica enterica serovar Typhi
uccagcguaggguagaucacgc

SEQ ID NO: 3662241 - RNA, 16 nt, Salmonella enterica enterica serovar Typhi
uccagcgucgggccgc

SEQ ID NO: 3662242 - RNA, 23 nt, Salmonella enterica enterica serovar Typhi
uccagcguuucaugaaugccggg

SEQ ID NO: 3662243 - RNA, 14 nt, Salmonella enterica enterica serovar Typhi
uccagcguuucucu

SEQ ID NO: 3662244 - RNA, 16 nt, Salmonella enterica enterica serovar Typhi
uccagcuacuggccac

SEQ ID NO: 3662245 - RNA, 15 nt, Salmonella enterica enterica serovar Typhi
uccagcucagggucc

SEQ ID NO: 3662246 - RNA, 18 nt, Salmonella enterica enterica serovar Typhi
uccagcucagggucccca

SEQ ID NO: 3662247 - RNA, 14 nt, Salmonella enterica enterica serovar Typhi
uccagcucaguuuc

SEQ ID NO: 3662248 - RNA, 18 nt, Salmonella enterica enterica serovar Typhi
uccagcucaguuuccagc

SEQ ID NO: 3662249 - RNA, 19 nt, Salmonella enterica enterica serovar Typhi
uccagcuccagccgcugcc

SEQ ID NO: 3662250 - RNA, 19 nt, Salmonella enterica enterica serovar Typhi
uccagcuguuuaagcgccu

SEQ ID NO: 3662251 - RNA, 20 nt, Salmonella enterica enterica serovar Typhi
uccagcuguuuaagcgccuc

SEQ ID NO: 3662252 - RNA, 23 nt, Salmonella enterica enterica serovar Typhi
uccagcuugccgucacaggcggc

SEQ ID NO: 3662253 - RNA, 16 nt, Salmonella enterica enterica serovar Typhi
uccaggccaagcgccu

SEQ ID NO: 3662254 - RNA, 23 nt, Salmonella enterica enterica serovar Typhi
uccaggccaagcgccuguucaac

SEQ ID NO: 3662255 - RNA, 16 nt, Salmonella enterica enterica serovar Typhi
uccaggccgccagcgu

SEQ ID NO: 3662256 - RNA, 18 nt, Salmonella enterica enterica serovar Typhi
uccaggccgucggcgcca

SEQ ID NO: 3662257 - RNA, 21 nt, Salmonella enterica enterica serovar Typhi
uccaggccgucggcgccagcc

SEQ ID NO: 3662258 - RNA, 19 nt, Salmonella enterica enterica serovar Typhi
uccagggaaaccauguuga

SEQ ID NO: 3662259 - RNA, 16 nt, Salmonella enterica enterica serovar Typhi
uccaggguaauuaacg

SEQ ID NO: 3662260 - RNA, 17 nt, Salmonella enterica enterica serovar Typhi
uccagguaacauacaaa

SEQ ID NO: 3662261 - RNA, 21 nt, Salmonella enterica enterica serovar Typhi
uccaggucuuccgccgggaua

SEQ ID NO: 3662262 - RNA, 23 nt, Salmonella enterica enterica serovar Typhi
uccaggugcugccacaucgccag

SEQ ID NO: 3662263 - RNA, 15 nt, Salmonella enterica enterica serovar Typhi
uccagguuaacccac

SEQ ID NO: 3662264 - RNA, 18 nt, Salmonella enterica enterica serovar Typhi
uccagguuuuaguuucac

SEQ ID NO: 3662265 - RNA, 21 nt, Salmonella enterica enterica serovar Typhi
uccaguaaaaucggaccuccg

SEQ ID NO: 3662266 - RNA, 24 nt, Salmonella enterica enterica serovar Typhi
uccaguaacgcguccaacuggcuu

SEQ ID NO: 3662267 - RNA, 17 nt, Salmonella enterica enterica serovar Typhi
uccaguaagaucaccuu

SEQ ID NO: 3662268 - RNA, 14 nt, Salmonella enterica enterica serovar Typhi
uccaguaauuucag

SEQ ID NO: 3662269 - RNA, 16 nt, Salmonella enterica enterica serovar Typhi
uccaguacuuucuuuu

SEQ ID NO: 3662270 - RNA, 15 nt, Salmonella enterica enterica serovar Typhi
uccaguagcagcgau

SEQ ID NO: 3662271 - RNA, 16 nt, Salmonella enterica enterica serovar Typhi
uccagucagcaauuaa

SEQ ID NO: 3662272 - RNA, 12 nt, Salmonella enterica enterica serovar Typhi
uccagucccuga

SEQ ID NO: 3662273 - RNA, 17 nt, Salmonella enterica enterica serovar Typhi
uccaguccucgcccacu

SEQ ID NO: 3662274 - RNA, 14 nt, Salmonella enterica enterica serovar Typhi
uccagucgcuccac

SEQ ID NO: 3662275 - RNA, 16 nt, Salmonella enterica enterica serovar Typhi
uccagucgcuccacca

SEQ ID NO: 3662276 - RNA, 13 nt, Salmonella enterica enterica serovar Typhi
uccagugaaaccg

SEQ ID NO: 3662277 - RNA, 15 nt, Salmonella enterica enterica serovar Typhi
uccagugcagaaagu

SEQ ID NO: 3662278 - RNA, 13 nt, Salmonella enterica enterica serovar Typhi
uccaguuaccgcc

SEQ ID NO: 3662279 - RNA, 14 nt, Salmonella enterica enterica serovar Typhi
uccaguucauaagu

SEQ ID NO: 3662280 - RNA, 18 nt, Salmonella enterica enterica serovar Typhi
uccaguucauaagucauc

SEQ ID NO: 3662281 - RNA, 21 nt, Salmonella enterica enterica serovar Typhi
uccaguucauaagucauccag

SEQ ID NO: 3662282 - RNA, 22 nt, Salmonella enterica enterica serovar Typhi
uccaguucaucuacacgcacuu

SEQ ID NO: 3662283 - RNA, 16 nt, Salmonella enterica enterica serovar Typhi
uccaguucgagccgga

SEQ ID NO: 3662284 - RNA, 22 nt, Salmonella enterica enterica serovar Typhi
uccaguugaaaaccacaaucac

SEQ ID NO: 3662285 - RNA, 17 nt, Salmonella enterica enterica serovar Typhi
uccaguugcccucuuua

SEQ ID NO: 3662286 - RNA, 15 nt, Salmonella enterica enterica serovar Typhi
uccaguugcggcauc

SEQ ID NO: 3662287 - RNA, 19 nt, Salmonella enterica enterica serovar Typhi
uccaguugcggcaucagau

SEQ ID NO: 3662288 - RNA, 16 nt, Salmonella enterica enterica serovar Typhi
uccaguugcuuaccuu

SEQ ID NO: 3662289 - RNA, 21 nt, Salmonella enterica enterica serovar Typhi
uccauaaaauaaagucagcaa

SEQ ID NO: 3662290 - RNA, 12 nt, Salmonella enterica enterica serovar Typhi
uccauaaaauga

SEQ ID NO: 3662291 - RNA, 19 nt, Salmonella enterica enterica serovar Typhi
uccauaaauaacauuucag

SEQ ID NO: 3662292 - RNA, 13 nt, Salmonella enterica enterica serovar Typhi
uccauacauccau

SEQ ID NO: 3662293 - RNA, 21 nt, Salmonella enterica enterica serovar Typhi
uccauaccggacuccaggcaa

SEQ ID NO: 3662294 - RNA, 18 nt, Salmonella enterica enterica serovar Typhi
uccauaccguuucaacug

SEQ ID NO: 3662295 - RNA, 17 nt, Salmonella enterica enterica serovar Typhi
uccauagaaaucagcag

SEQ ID NO: 3662296 - RNA, 14 nt, Salmonella enterica enterica serovar Typhi
uccauagaacgcuu

SEQ ID NO: 3662297 - RNA, 22 nt, Salmonella enterica enterica serovar Typhi
uccauauaaucaaacccuuccg

SEQ ID NO: 3662298 - RNA, 18 nt, Salmonella enterica enterica serovar Typhi
uccaucacgguaaaccug

SEQ ID NO: 3662299 - RNA, 19 nt, Salmonella enterica enterica serovar Typhi
uccaucacgguaaaccugu

SEQ ID NO: 3662300 - RNA, 23 nt, Salmonella enterica enterica serovar Typhi
uccaucacgguaaaccuguuugu

SEQ ID NO: 3662301 - RNA, 14 nt, Salmonella enterica enterica serovar Typhi
uccaucagccaggc

SEQ ID NO: 3662302 - RNA, 13 nt, Salmonella enterica enterica serovar Typhi
uccaucagcgcgg

SEQ ID NO: 3662303 - RNA, 19 nt, Salmonella enterica enterica serovar Typhi
uccaucaugggcgcggcga

SEQ ID NO: 3662304 - RNA, 13 nt, Salmonella enterica enterica serovar Typhi
uccaucauuuccg

SEQ ID NO: 3662305 - RNA, 14 nt, Salmonella enterica enterica serovar Typhi
uccaucccccugcc

SEQ ID NO: 3662306 - RNA, 16 nt, Salmonella enterica enterica serovar Typhi
uccauccggguaauuu

SEQ ID NO: 3662307 - RNA, 14 nt, Salmonella enterica enterica serovar Typhi
uccaucgaauaaag

SEQ ID NO: 3662308 - RNA, 15 nt, Salmonella enterica enterica serovar Typhi
uccaucgguucucug

SEQ ID NO: 3662309 - RNA, 17 nt, Salmonella enterica enterica serovar Typhi
uccaucgguucucugcc

SEQ ID NO: 3662310 - RNA, 15 nt, Salmonella enterica enterica serovar Typhi
uccaugagaagaaaa

SEQ ID NO: 3662311 - RNA, 16 nt, Salmonella enterica enterica serovar Typhi
uccaugagaagaaaaa

SEQ ID NO: 3662312 - RNA, 20 nt, Salmonella enterica enterica serovar Typhi
uccaugaucgccuggccgau

SEQ ID NO: 3662313 - RNA, 21 nt, Salmonella enterica enterica serovar Typhi
uccaugaugaagauauucacu

SEQ ID NO: 3662314 - RNA, 15 nt, Salmonella enterica enterica serovar Typhi
uccaugccggcccga

SEQ ID NO: 3662315 - RNA, 21 nt, Salmonella enterica enterica serovar Typhi
uccgcaggcgacgugacggug

SEQ ID NO: 3662316 - RNA, 22 nt, Salmonella enterica enterica serovar Typhi
uccgcaggggauucugccaucg

SEQ ID NO: 3662317 - RNA, 15 nt, Salmonella enterica enterica serovar Typhi
uccgcauagcgcaac

SEQ ID NO: 3662318 - RNA, 14 nt, Salmonella enterica enterica serovar Typhi
uccgccaacagccg

SEQ ID NO: 3662319 - RNA, 13 nt, Salmonella enterica enterica serovar Typhi
uccgccaccauga

SEQ ID NO: 3662320 - RNA, 16 nt, Salmonella enterica enterica serovar Typhi
uccgccaccgcgcgca

SEQ ID NO: 3662321 - RNA, 18 nt, Salmonella enterica enterica serovar Typhi
uccgccacggcuuucacg

SEQ ID NO: 3662322 - RNA, 19 nt, Salmonella enterica enterica serovar Typhi
uccgccagacucagccagg

SEQ ID NO: 3662323 - RNA, 13 nt, Salmonella enterica enterica serovar Typhi
uccgccagcgccu

SEQ ID NO: 3662324 - RNA, 18 nt, Salmonella enterica enterica serovar Typhi
uccgccagguauucuaac

SEQ ID NO: 3662325 - RNA, 20 nt, Salmonella enterica enterica serovar Typhi
uccgccauaacggcugucca

SEQ ID NO: 3662326 - RNA, 14 nt, Salmonella enterica enterica serovar Typhi
uccgccauaucccc

SEQ ID NO: 3662327 - RNA, 15 nt, Salmonella enterica enterica serovar Typhi
uccgccaucgacagc

SEQ ID NO: 3662328 - RNA, 23 nt, Salmonella enterica enterica serovar Typhi
uccgcccaagaacaugacggcag

SEQ ID NO: 3662329 - RNA, 14 nt, Salmonella enterica enterica serovar Typhi
uccgcccaggcggg

SEQ ID NO: 3662330 - RNA, 19 nt, Salmonella enterica enterica serovar Typhi
uccgcccaguaccagcacu

SEQ ID NO: 3662331 - RNA, 22 nt, Salmonella enterica enterica serovar Typhi
uccgccggaaacuggcgucaug

SEQ ID NO: 3662332 - RNA, 15 nt, Salmonella enterica enterica serovar Typhi
uccgccgucgucacc

SEQ ID NO: 3662333 - RNA, 14 nt, Salmonella enterica enterica serovar Typhi
uccgccucguguaa

SEQ ID NO: 3662334 - RNA, 16 nt, Salmonella enterica enterica serovar Typhi
uccgccugcugugccg

SEQ ID NO: 3662335 - RNA, 17 nt, Salmonella enterica enterica serovar Typhi
uccgccuggaacccagg

SEQ ID NO: 3662336 - RNA, 18 nt, Salmonella enterica enterica serovar Typhi
uccgccuggaacccaggc

SEQ ID NO: 3662337 - RNA, 19 nt, Salmonella enterica enterica serovar Typhi
uccgccuuaucaggccugu

SEQ ID NO: 3662338 - RNA, 21 nt, Salmonella enterica enterica serovar Typhi
uccgcgacguacuggaacagu

SEQ ID NO: 3662339 - RNA, 23 nt, Salmonella enterica enterica serovar Typhi
uccgcgagagaaaaaaauccagu

SEQ ID NO: 3662340 - RNA, 14 nt, Salmonella enterica enterica serovar Typhi
uccgcgagcagcca

SEQ ID NO: 3662341 - RNA, 13 nt, Salmonella enterica enterica serovar Typhi
uccgcgaugugua

SEQ ID NO: 3662342 - RNA, 16 nt, Salmonella enterica enterica serovar Typhi
uccgcgcaauaugcgg

SEQ ID NO: 3662343 - RNA, 14 nt, Salmonella enterica enterica serovar Typhi
uccgcgcaaucgcc

SEQ ID NO: 3662344 - RNA, 16 nt, Salmonella enterica enterica serovar Typhi
uccgcgcaaucgccga

SEQ ID NO: 3662345 - RNA, 15 nt, Salmonella enterica enterica serovar Typhi
uccgcgccgccgccg

SEQ ID NO: 3662346 - RNA, 16 nt, Salmonella enterica enterica serovar Typhi
uccgcgcgcguaagcu

SEQ ID NO: 3662347 - RNA, 23 nt, Salmonella enterica enterica serovar Typhi
uccgcgcgcuuuuuuggcguaga

SEQ ID NO: 3662348 - RNA, 15 nt, Salmonella enterica enterica serovar Typhi
uccgcgcucauacga

SEQ ID NO: 3662349 - RNA, 15 nt, Salmonella enterica enterica serovar Typhi
uccgcgcugaugguu

SEQ ID NO: 3662350 - RNA, 20 nt, Salmonella enterica enterica serovar Typhi
uccgcgggcaaaagggccau

SEQ ID NO: 3662351 - RNA, 18 nt, Salmonella enterica enterica serovar Typhi
uccgcgguacgaaucgcc

SEQ ID NO: 3662352 - RNA, 18 nt, Salmonella enterica enterica serovar Typhi
uccgcgguagagcgcggu

SEQ ID NO: 3662353 - RNA, 14 nt, Salmonella enterica enterica serovar Typhi
uccgcguagcccag

SEQ ID NO: 3662354 - RNA, 16 nt, Salmonella enterica enterica serovar Typhi
uccgcguuuaucgcau

SEQ ID NO: 3662355 - RNA, 20 nt, Salmonella enterica enterica serovar Typhi
uccgcuaccugcgagcugua

SEQ ID NO: 3662356 - RNA, 13 nt, Salmonella enterica enterica serovar Typhi
uccgcucaugauu

SEQ ID NO: 3662357 - RNA, 16 nt, Salmonella enterica enterica serovar Typhi
uccgcuccacauccug

SEQ ID NO: 3662358 - RNA, 15 nt, Salmonella enterica enterica serovar Typhi
uccgcugaaauagcc

SEQ ID NO: 3662359 - RNA, 22 nt, Salmonella enterica enterica serovar Typhi
uccgcuggugcguaacguaacc

SEQ ID NO: 3662360 - RNA, 12 nt, Salmonella enterica enterica serovar Typhi
uccgcuuccacu

SEQ ID NO: 3662361 - RNA, 14 nt, Salmonella enterica enterica serovar Typhi
uccgcuuccagaau

SEQ ID NO: 3662362 - RNA, 18 nt, Salmonella enterica enterica serovar Typhi
uccgcuuucuucccggca

SEQ ID NO: 3662363 - RNA, 16 nt, Salmonella enterica enterica serovar Typhi
uccgcuuuucuggcuu

SEQ ID NO: 3662364 - RNA, 19 nt, Salmonella enterica enterica serovar Typhi
uccggaacagggccgcauc

SEQ ID NO: 3662365 - RNA, 20 nt, Salmonella enterica enterica serovar Typhi
uccggaaucagugcugaaaa

SEQ ID NO: 3662366 - RNA, 16 nt, Salmonella enterica enterica serovar Typhi
uccggacgcaccagcc

SEQ ID NO: 3662367 - RNA, 15 nt, Salmonella enterica enterica serovar Typhi
uccggaucaucuuuu

SEQ ID NO: 3662368 - RNA, 12 nt, Salmonella enterica enterica serovar Typhi
uccggaucgccg

SEQ ID NO: 3662369 - RNA, 19 nt, Salmonella enterica enterica serovar Typhi
uccggaucgccgaagcggc

SEQ ID NO: 3662370 - RNA, 21 nt, Salmonella enterica enterica serovar Typhi
uccggauggcaguacagggcg

SEQ ID NO: 3662371 - RNA, 23 nt, Salmonella enterica enterica serovar Typhi
uccggauucguaguucccccauc

SEQ ID NO: 3662372 - RNA, 13 nt, Salmonella enterica enterica serovar Typhi
uccggcaaugauu

SEQ ID NO: 3662373 - RNA, 15 nt, Salmonella enterica enterica serovar Typhi
uccggcacacagcgc

SEQ ID NO: 3662374 - RNA, 17 nt, Salmonella enterica enterica serovar Typhi
uccggcacacagcgcuu

SEQ ID NO: 3662375 - RNA, 18 nt, Salmonella enterica enterica serovar Typhi
uccggcacacagcgcuuu

SEQ ID NO: 3662376 - RNA, 19 nt, Salmonella enterica enterica serovar Typhi
uccggcaccucguccagau

SEQ ID NO: 3662377 - RNA, 17 nt, Salmonella enterica enterica serovar Typhi
uccggcacuacagcguu

SEQ ID NO: 3662378 - RNA, 16 nt, Salmonella enterica enterica serovar Typhi
uccggcacucuucuuc

SEQ ID NO: 3662379 - RNA, 14 nt, Salmonella enterica enterica serovar Typhi
uccggcagaaauga

SEQ ID NO: 3662380 - RNA, 17 nt, Salmonella enterica enterica serovar Typhi
uccggcagacggcuggg

SEQ ID NO: 3662381 - RNA, 18 nt, Salmonella enterica enterica serovar Typhi
uccggcaucucaaggucu

SEQ ID NO: 3662382 - RNA, 19 nt, Salmonella enterica enterica serovar Typhi
uccggcaucucaaggucug

SEQ ID NO: 3662383 - RNA, 17 nt, Salmonella enterica enterica serovar Typhi
uccggcaucuuaaagcg

SEQ ID NO: 3662384 - RNA, 19 nt, Salmonella enterica enterica serovar Typhi
uccggcauucgcacacuac

SEQ ID NO: 3662385 - RNA, 12 nt, Salmonella enterica enterica serovar Typhi
uccggcauuuuu

SEQ ID NO: 3662386 - RNA, 14 nt, Salmonella enterica enterica serovar Typhi
uccggccagcgcca

SEQ ID NO: 3662387 - RNA, 15 nt, Salmonella enterica enterica serovar Typhi
uccggccagcgccag

SEQ ID NO: 3662388 - RNA, 19 nt, Salmonella enterica enterica serovar Typhi
uccggccagcgccagcguu

SEQ ID NO: 3662389 - RNA, 17 nt, Salmonella enterica enterica serovar Typhi
uccggccuacagacugu

SEQ ID NO: 3662390 - RNA, 18 nt, Salmonella enterica enterica serovar Typhi
uccggccuaccugagaug

SEQ ID NO: 3662391 - RNA, 23 nt, Salmonella enterica enterica serovar Typhi
uccggccuaccugagaugaaauc

SEQ ID NO: 3662392 - RNA, 22 nt, Salmonella enterica enterica serovar Typhi
uccggccuacggucgguuucau

SEQ ID NO: 3662393 - RNA, 21 nt, Salmonella enterica enterica serovar Typhi
uccggccuauagcuaauggcu

SEQ ID NO: 3662394 - RNA, 18 nt, Salmonella enterica enterica serovar Typhi
uccggccugcaaaccgcc

SEQ ID NO: 3662395 - RNA, 16 nt, Salmonella enterica enterica serovar Typhi
uccggccugcaggcaa

SEQ ID NO: 3662396 - RNA, 17 nt, Salmonella enterica enterica serovar Typhi
uccggccuguaaggucu

SEQ ID NO: 3662397 - RNA, 18 nt, Salmonella enterica enterica serovar Typhi
uccggccuguaaggucuc

SEQ ID NO: 3662398 - RNA, 15 nt, Salmonella enterica enterica serovar Typhi
uccggcgauagcggc

SEQ ID NO: 3662399 - RNA, 14 nt, Salmonella enterica enterica serovar Typhi
uccggcgcaauaag

SEQ ID NO: 3662400 - RNA, 20 nt, Salmonella enterica enterica serovar Typhi
uccggcgcgagccacgcggc

SEQ ID NO: 3662401 - RNA, 17 nt, Salmonella enterica enterica serovar Typhi
uccugcaggcggcaaaa

SEQ ID NO: 3662402 - RNA, 23 nt, Salmonella enterica enterica serovar Typhi
uccugcaggguaauuagccccug

SEQ ID NO: 3662403 - RNA, 24 nt, Salmonella enterica enterica serovar Typhi
uccugcauaauccaacgaaacgca

SEQ ID NO: 3662404 - RNA, 11 nt, Salmonella enterica enterica serovar Typhi
uccugccagac

SEQ ID NO: 3662405 - RNA, 15 nt, Salmonella enterica enterica serovar Typhi
uccugccagacccca

SEQ ID NO: 3662406 - RNA, 21 nt, Salmonella enterica enterica serovar Typhi
uccugccagauuuucuuuaau

SEQ ID NO: 3662407 - RNA, 20 nt, Salmonella enterica enterica serovar Typhi
uccugccagccgcucugcug

SEQ ID NO: 3662408 - RNA, 20 nt, Salmonella enterica enterica serovar Typhi
uccugcccuggugagcucca

SEQ ID NO: 3662409 - RNA, 21 nt, Salmonella enterica enterica serovar Typhi
uccugccgaugccgccgcaac

SEQ ID NO: 3662410 - RNA, 21 nt, Salmonella enterica enterica serovar Typhi
uccugccgcaaacgccugcuc

SEQ ID NO: 3662411 - RNA, 13 nt, Salmonella enterica enterica serovar Typhi
uccugccgccgca

SEQ ID NO: 3662412 - RNA, 14 nt, Salmonella enterica enterica serovar Typhi
uccugcgccagccg

SEQ ID NO: 3662413 - RNA, 14 nt, Salmonella enterica enterica serovar Typhi
uccugcgccggacg

SEQ ID NO: 3662414 - RNA, 17 nt, Salmonella enterica enterica serovar Typhi
uccugcgcggauaccgg

SEQ ID NO: 3662415 - RNA, 22 nt, Salmonella enterica enterica serovar Typhi
uccugcgcuuuuugcuucgcca

SEQ ID NO: 3662416 - RNA, 15 nt, Salmonella enterica enterica serovar Typhi
uccugcggcaguucu

SEQ ID NO: 3662417 - RNA, 19 nt, Salmonella enterica enterica serovar Typhi
uccugcgguaaacgcucgc

SEQ ID NO: 3662418 - RNA, 19 nt, Salmonella enterica enterica serovar Typhi
uccugcgguacggccagcg

SEQ ID NO: 3662419 - RNA, 22 nt, Salmonella enterica enterica serovar Typhi
uccugcgugccguugaccagcu

SEQ ID NO: 3662420 - RNA, 17 nt, Salmonella enterica enterica serovar Typhi
uccugcuccaugcuguc

SEQ ID NO: 3662421 - RNA, 14 nt, Salmonella enterica enterica serovar Typhi
uccugcuccugcgg

SEQ ID NO: 3662422 - RNA, 17 nt, Salmonella enterica enterica serovar Typhi
uccugcugcgccagcgc

SEQ ID NO: 3662423 - RNA, 13 nt, Salmonella enterica enterica serovar Typhi
uccuggaacugac

SEQ ID NO: 3662424 - RNA, 19 nt, Salmonella enterica enterica serovar Typhi
uccuggcgccacccaacau

SEQ ID NO: 3662425 - RNA, 20 nt, Salmonella enterica enterica serovar Typhi
uccuggcguaugcuuucagc

SEQ ID NO: 3662426 - RNA, 12 nt, Salmonella enterica enterica serovar Typhi
uccuggcuucaa

SEQ ID NO: 3662427 - RNA, 16 nt, Salmonella enterica enterica serovar Typhi
uccuggcuugccagau

SEQ ID NO: 3662428 - RNA, 22 nt, Salmonella enterica enterica serovar Typhi
uccugggcaaaauagcccggcu

SEQ ID NO: 3662429 - RNA, 18 nt, Salmonella enterica enterica serovar Typhi
uccugguccggcagguag

SEQ ID NO: 3662430 - RNA, 23 nt, Salmonella enterica enterica serovar Typhi
uccuggugcgacaccacgcaggc

SEQ ID NO: 3662431 - RNA, 15 nt, Salmonella enterica enterica serovar Typhi
uccuguaacaacugu

SEQ ID NO: 3662432 - RNA, 19 nt, Salmonella enterica enterica serovar Typhi
uccuguacaaaaucaucau

SEQ ID NO: 3662433 - RNA, 18 nt, Salmonella enterica enterica serovar Typhi
uccugucgucaccagcag

SEQ ID NO: 3662434 - RNA, 16 nt, Salmonella enterica enterica serovar Typhi
uccugugaaguaaaaa

SEQ ID NO: 3662435 - RNA, 12 nt, Salmonella enterica enterica serovar Typhi
uccuguuccuga

SEQ ID NO: 3662436 - RNA, 22 nt, Salmonella enterica enterica serovar Typhi
uccuguugaugauggcuccugu

SEQ ID NO: 3662437 - RNA, 20 nt, Salmonella enterica enterica serovar Typhi
uccuguuuaagcccggccuu

SEQ ID NO: 3662438 - RNA, 17 nt, Salmonella enterica enterica serovar Typhi
uccuuauaaugcuuacg

SEQ ID NO: 3662439 - RNA, 18 nt, Salmonella enterica enterica serovar Typhi
uccuuauaaugcuuacgg

SEQ ID NO: 3662440 - RNA, 15 nt, Salmonella enterica enterica serovar Typhi
uccuuaucacauuuu

SEQ ID NO: 3662441 - RNA, 13 nt, Salmonella enterica enterica serovar Typhi
uccuuaucagacu

SEQ ID NO: 3662442 - RNA, 16 nt, Salmonella enterica enterica serovar Typhi
uccuuaugaccgaguc

SEQ ID NO: 3662443 - RNA, 22 nt, Salmonella enterica enterica serovar Typhi
uccuuaugggucacauccagac

SEQ ID NO: 3662444 - RNA, 21 nt, Salmonella enterica enterica serovar Typhi
uccuuauuuaauacaucagaa

SEQ ID NO: 3662445 - RNA, 17 nt, Salmonella enterica enterica serovar Typhi
uccuucacaaacuucuc

SEQ ID NO: 3662446 - RNA, 18 nt, Salmonella enterica enterica serovar Typhi
uccuucagcguuugcgcc

SEQ ID NO: 3662447 - RNA, 17 nt, Salmonella enterica enterica serovar Typhi
uccuuccagcccguucu

SEQ ID NO: 3662448 - RNA, 15 nt, Salmonella enterica enterica serovar Typhi
uccuucccccaccac

SEQ ID NO: 3662449 - RNA, 21 nt, Salmonella enterica enterica serovar Typhi
uccuuccgccggggagggaug

SEQ ID NO: 3662450 - RNA, 16 nt, Salmonella enterica enterica serovar Typhi
uccuuccgcuuuaagc

SEQ ID NO: 3662451 - RNA, 17 nt, Salmonella enterica enterica serovar Typhi
uccuucguuacuuucau

SEQ ID NO: 3662452 - RNA, 14 nt, Salmonella enterica enterica serovar Typhi
uccuucuucccccu

SEQ ID NO: 3662453 - RNA, 11 nt, Salmonella enterica enterica serovar Typhi
uccuucuuccg

SEQ ID NO: 3662454 - RNA, 14 nt, Salmonella enterica enterica serovar Typhi
uccuucuucgccgu

SEQ ID NO: 3662455 - RNA, 15 nt, Salmonella enterica enterica serovar Typhi
uccuugauuucauug

SEQ ID NO: 3662456 - RNA, 23 nt, Salmonella enterica enterica serovar Typhi
uccuugcagccagaacucaucuu

SEQ ID NO: 3662457 - RNA, 20 nt, Salmonella enterica enterica serovar Typhi
uccuugccagugaaaaaaag

SEQ ID NO: 3662458 - RNA, 19 nt, Salmonella enterica enterica serovar Typhi
uccuugcggugagaaacgc

SEQ ID NO: 3662459 - RNA, 21 nt, Salmonella enterica enterica serovar Typhi
uccuugcuucgauggccucau

SEQ ID NO: 3662460 - RNA, 15 nt, Salmonella enterica enterica serovar Typhi
uccuuguaggccgga

SEQ ID NO: 3662461 - RNA, 22 nt, Salmonella enterica enterica serovar Typhi
uccuuguuuuaacggaaucaga

SEQ ID NO: 3662462 - RNA, 18 nt, Salmonella enterica enterica serovar Typhi
uccuuuaaucgccgugcc

SEQ ID NO: 3662463 - RNA, 20 nt, Salmonella enterica enterica serovar Typhi
uccuuuaggguugacugcca

SEQ ID NO: 3662464 - RNA, 15 nt, Salmonella enterica enterica serovar Typhi
uccuuuaucugcccu

SEQ ID NO: 3662465 - RNA, 19 nt, Salmonella enterica enterica serovar Typhi
uccuuuaucugcccuuucu

SEQ ID NO: 3662466 - RNA, 22 nt, Salmonella enterica enterica serovar Typhi
uccuuuccugugcucgauauau

SEQ ID NO: 3662467 - RNA, 18 nt, Salmonella enterica enterica serovar Typhi
uccuuucgagaagcccag

SEQ ID NO: 3662468 - RNA, 19 nt, Salmonella enterica enterica serovar Typhi
uccuuucggacuuccugua

SEQ ID NO: 3662469 - RNA, 14 nt, Salmonella enterica enterica serovar Typhi
uccuuugccuuucu

SEQ ID NO: 3662470 - RNA, 15 nt, Salmonella enterica enterica serovar Typhi
uccuuugccuuucuu

SEQ ID NO: 3662471 - RNA, 23 nt, Salmonella enterica enterica serovar Typhi
uccuuuguuugccgcgaccacgc

SEQ ID NO: 3662472 - RNA, 19 nt, Salmonella enterica enterica serovar Typhi
uccuuuuaauaaagaaagc

SEQ ID NO: 3662473 - RNA, 15 nt, Salmonella enterica enterica serovar Typhi
uccuuuuucaggcac

SEQ ID NO: 3662474 - RNA, 15 nt, Salmonella enterica enterica serovar Typhi
uccuuuuuccgccac

SEQ ID NO: 3662475 - RNA, 14 nt, Salmonella enterica enterica serovar Typhi
ucgaaaccagcaua

SEQ ID NO: 3662476 - RNA, 20 nt, Salmonella enterica enterica serovar Typhi
ucgaaacuggcauugugagc

SEQ ID NO: 3662477 - RNA, 16 nt, Salmonella enterica enterica serovar Typhi
ucgaaauaaagaaagu

SEQ ID NO: 3662478 - RNA, 20 nt, Salmonella enterica enterica serovar Typhi
ucgaaaugccuuaccuggca

SEQ ID NO: 3662479 - RNA, 17 nt, Salmonella enterica enterica serovar Typhi
ucgaacagcggcaggcg

SEQ ID NO: 3662480 - RNA, 19 nt, Salmonella enterica enterica serovar Typhi
ucgaacagcggcaggcgga

SEQ ID NO: 3662481 - RNA, 16 nt, Salmonella enterica enterica serovar Typhi
ucgaacgguaacagga

SEQ ID NO: 3662482 - RNA, 19 nt, Salmonella enterica enterica serovar Typhi
ucgaagaugaggagcugga

SEQ ID NO: 3662483 - RNA, 21 nt, Salmonella enterica enterica serovar Typhi
ucgaauaaagacacugcugcu

SEQ ID NO: 3662484 - RNA, 12 nt, Salmonella enterica enterica serovar Typhi
ucgaauccagca

SEQ ID NO: 3662485 - RNA, 17 nt, Salmonella enterica enterica serovar Typhi
ucgaaucgccucaacca

SEQ ID NO: 3662486 - RNA, 15 nt, Salmonella enterica enterica serovar Typhi
ucgccaaagauauag

SEQ ID NO: 3662487 - RNA, 22 nt, Salmonella enterica enterica serovar Typhi
ucgccaaagcagcggaaaauau

SEQ ID NO: 3662488 - RNA, 17 nt, Salmonella enterica enterica serovar Typhi
ucgccaaagcagugaau

SEQ ID NO: 3662489 - RNA, 16 nt, Salmonella enterica enterica serovar Typhi
ucgccaaagcguaaac

SEQ ID NO: 3662490 - RNA, 22 nt, Salmonella enterica enterica serovar Typhi
ucgccaacaccgauccgaagaa

SEQ ID NO: 3662491 - RNA, 20 nt, Salmonella enterica enterica serovar Typhi
ucgccaacuuuuugcgcaau

SEQ ID NO: 3662492 - RNA, 17 nt, Salmonella enterica enterica serovar Typhi
ucgccaagaucgccaag

SEQ ID NO: 3662493 - RNA, 15 nt, Salmonella enterica enterica serovar Typhi
ucgccacagcggaau

SEQ ID NO: 3662494 - RNA, 13 nt, Salmonella enterica enterica serovar Typhi
ucgccaccaggcu

SEQ ID NO: 3662495 - RNA, 17 nt, Salmonella enterica enterica serovar Typhi
ucgccaccaugcugguu

SEQ ID NO: 3662496 - RNA, 18 nt, Salmonella enterica enterica serovar Typhi
ucgccaccgcauuuucag

SEQ ID NO: 3662497 - RNA, 16 nt, Salmonella enterica enterica serovar Typhi
ucgccacgacgcuggu

SEQ ID NO: 3662498 - RNA, 22 nt, Salmonella enterica enterica serovar Typhi
ucgccacguauuucgcagcggu

SEQ ID NO: 3662499 - RNA, 17 nt, Salmonella enterica enterica serovar Typhi
ucgccagaaggcaggcu

SEQ ID NO: 3662500 - RNA, 17 nt, Salmonella enterica enterica serovar Typhi
ucgccagacccagcgcu

SEQ ID NO: 3662501 - RNA, 18 nt, Salmonella enterica enterica serovar Typhi
ucgccagaccgaaaagcc

SEQ ID NO: 3662502 - RNA, 11 nt, Salmonella enterica enterica serovar Typhi
ucgccagcaac

SEQ ID NO: 3662503 - RNA, 13 nt, Salmonella enterica enterica serovar Typhi
ucgccagcaacag

SEQ ID NO: 3662504 - RNA, 18 nt, Salmonella enterica enterica serovar Typhi
ucgccagcaacgcccaga

SEQ ID NO: 3662505 - RNA, 13 nt, Salmonella enterica enterica serovar Typhi
ucgccagcacguu

SEQ ID NO: 3662506 - RNA, 22 nt, Salmonella enterica enterica serovar Typhi
ucgccagcauacgucugcgcug

SEQ ID NO: 3662507 - RNA, 16 nt, Salmonella enterica enterica serovar Typhi
ucgccagccccagccc

SEQ ID NO: 3662508 - RNA, 20 nt, Salmonella enterica enterica serovar Typhi
ucgccagcggaucgcgucca

SEQ ID NO: 3662509 - RNA, 21 nt, Salmonella enterica enterica serovar Typhi
ucgccagcgucucagcaggcg

SEQ ID NO: 3662510 - RNA, 15 nt, Salmonella enterica enterica serovar Typhi
ucgccaguaagggga

SEQ ID NO: 3662511 - RNA, 18 nt, Salmonella enterica enterica serovar Typhi
ucgccauauccaagcccc

SEQ ID NO: 3662512 - RNA, 19 nt, Salmonella enterica enterica serovar Typhi
ucgccauaucuucgcgcgu

SEQ ID NO: 3662513 - RNA, 18 nt, Salmonella enterica enterica serovar Typhi
ucgccauauguuccaccg

SEQ ID NO: 3662514 - RNA, 20 nt, Salmonella enterica enterica serovar Typhi
ucgccauccggcaaauccuc

SEQ ID NO: 3662515 - RNA, 22 nt, Salmonella enterica enterica serovar Typhi
ucgccauccggcaaugauuaga

SEQ ID NO: 3662516 - RNA, 18 nt, Salmonella enterica enterica serovar Typhi
ucgccaucgauagcagcg

SEQ ID NO: 3662517 - RNA, 20 nt, Salmonella enterica enterica serovar Typhi
ucgccaucgauagcagcgcu

SEQ ID NO: 3662518 - RNA, 17 nt, Salmonella enterica enterica serovar Typhi
ucgccaugcaccacgac

SEQ ID NO: 3662519 - RNA, 15 nt, Salmonella enterica enterica serovar Typhi
ucgccaugucaaaug

SEQ ID NO: 3662520 - RNA, 20 nt, Salmonella enterica enterica serovar Typhi
ucgccauucccgcgacguca

SEQ ID NO: 3662521 - RNA, 21 nt, Salmonella enterica enterica serovar Typhi
ucgcccagguuguaucauguu

SEQ ID NO: 3662522 - RNA, 11 nt, Salmonella enterica enterica serovar Typhi
ucgccccacac

SEQ ID NO: 3662523 - RNA, 13 nt, Salmonella enterica enterica serovar Typhi
ucgccccagcaua

SEQ ID NO: 3662524 - RNA, 21 nt, Salmonella enterica enterica serovar Typhi
ucgccccguaaaccaauacgc

SEQ ID NO: 3662525 - RNA, 21 nt, Salmonella enterica enterica serovar Typhi
ucgcccgcaaccacggcgcag

SEQ ID NO: 3662526 - RNA, 13 nt, Salmonella enterica enterica serovar Typhi
ucgcccgccagau

SEQ ID NO: 3662527 - RNA, 14 nt, Salmonella enterica enterica serovar Typhi
ucgcccggaaaugg

SEQ ID NO: 3662528 - RNA, 16 nt, Salmonella enterica enterica serovar Typhi
ucgcccggcaugacau

SEQ ID NO: 3662529 - RNA, 18 nt, Salmonella enterica enterica serovar Typhi
ucgcccggcguaacgcca

SEQ ID NO: 3662530 - RNA, 22 nt, Salmonella enterica enterica serovar Typhi
ucgcccgggcgauaucacggaa

SEQ ID NO: 3662531 - RNA, 14 nt, Salmonella enterica enterica serovar Typhi
ucgcccguuuuacc

SEQ ID NO: 3662532 - RNA, 14 nt, Salmonella enterica enterica serovar Typhi
ucgcccucgccagc

SEQ ID NO: 3662533 - RNA, 16 nt, Salmonella enterica enterica serovar Typhi
ucgcccucgccagcaa

SEQ ID NO: 3662534 - RNA, 20 nt, Salmonella enterica enterica serovar Typhi
ucgcccucgccagcaacagg

SEQ ID NO: 3662535 - RNA, 14 nt, Salmonella enterica enterica serovar Typhi
ucgcccugauggcg

SEQ ID NO: 3662536 - RNA, 18 nt, Salmonella enterica enterica serovar Typhi
ucgcccugcgccagacgc

SEQ ID NO: 3662537 - RNA, 13 nt, Salmonella enterica enterica serovar Typhi
ucgcccugcggua

SEQ ID NO: 3662538 - RNA, 15 nt, Salmonella enterica enterica serovar Typhi
ucgcccugcgguagc

SEQ ID NO: 3662539 - RNA, 14 nt, Salmonella enterica enterica serovar Typhi
ucgcccugcgucgc

SEQ ID NO: 3662540 - RNA, 14 nt, Salmonella enterica enterica serovar Typhi
ucgcccuuuucgca

SEQ ID NO: 3662541 - RNA, 15 nt, Salmonella enterica enterica serovar Typhi
ucgcccuuuucgcaa

SEQ ID NO: 3662542 - RNA, 19 nt, Salmonella enterica enterica serovar Typhi
ucgccgacaugcuccugca

SEQ ID NO: 3662543 - RNA, 14 nt, Salmonella enterica enterica serovar Typhi
ucgccgcaaugacc

SEQ ID NO: 3662544 - RNA, 13 nt, Salmonella enterica enterica serovar Typhi
ucgccgcaucggc

SEQ ID NO: 3662545 - RNA, 14 nt, Salmonella enterica enterica serovar Typhi
ucgccgccauccgg

SEQ ID NO: 3662546 - RNA, 22 nt, Salmonella enterica enterica serovar Typhi
ucgccgccgccagauuauccag

SEQ ID NO: 3662547 - RNA, 19 nt, Salmonella enterica enterica serovar Typhi
ucgccgccgccgcgaccgc

SEQ ID NO: 3662548 - RNA, 17 nt, Salmonella enterica enterica serovar Typhi
ucgccgccgcgagcagc

SEQ ID NO: 3662549 - RNA, 22 nt, Salmonella enterica enterica serovar Typhi
ucgccgcgauaauaauuaccac

SEQ ID NO: 3662550 - RNA, 12 nt, Salmonella enterica enterica serovar Typhi
ucgccgcgcgca

SEQ ID NO: 3662551 - RNA, 17 nt, Salmonella enterica enterica serovar Typhi
ucgccgcgcgcauaggc

SEQ ID NO: 3662552 - RNA, 16 nt, Salmonella enterica enterica serovar Typhi
ucgccgcgcggaucgc

SEQ ID NO: 3662553 - RNA, 22 nt, Salmonella enterica enterica serovar Typhi
ucgccgcguuuaagucccuggc

SEQ ID NO: 3662554 - RNA, 12 nt, Salmonella enterica enterica serovar Typhi
ucgccgcuaucg

SEQ ID NO: 3662555 - RNA, 18 nt, Salmonella enterica enterica serovar Typhi
ucgccgcugccgcuauug

SEQ ID NO: 3662556 - RNA, 19 nt, Salmonella enterica enterica serovar Typhi
ucgccgcuuucugagccgc

SEQ ID NO: 3662557 - RNA, 20 nt, Salmonella enterica enterica serovar Typhi
ucgccggaaagaaacgccgc

SEQ ID NO: 3662558 - RNA, 15 nt, Salmonella enterica enterica serovar Typhi
ucgccggaaugcgaa

SEQ ID NO: 3662559 - RNA, 21 nt, Salmonella enterica enterica serovar Typhi
ucgccggagccgccuggccug

SEQ ID NO: 3662560 - RNA, 20 nt, Salmonella enterica enterica serovar Typhi
ucgccggcagacgauagcgg

SEQ ID NO: 3662561 - RNA, 21 nt, Salmonella enterica enterica serovar Typhi
ucgccgggaugcuuuccgguu

SEQ ID NO: 3662562 - RNA, 15 nt, Salmonella enterica enterica serovar Typhi
ucgccgggcggcgca

SEQ ID NO: 3662563 - RNA, 19 nt, Salmonella enterica enterica serovar Typhi
ucgccgggcuauccggcug

SEQ ID NO: 3662564 - RNA, 18 nt, Salmonella enterica enterica serovar Typhi
ucgccggggaaaauauua

SEQ ID NO: 3662565 - RNA, 14 nt, Salmonella enterica enterica serovar Typhi
ucgccggggcgcug

SEQ ID NO: 3662566 - RNA, 16 nt, Salmonella enterica enterica serovar Typhi
ucgccgguuuugguau

SEQ ID NO: 3662567 - RNA, 21 nt, Salmonella enterica enterica serovar Typhi
ucgccguaggcgugggugaag

SEQ ID NO: 3662568 - RNA, 14 nt, Salmonella enterica enterica serovar Typhi
ucgccguccauuuc

SEQ ID NO: 3662569 - RNA, 19 nt, Salmonella enterica enterica serovar Typhi
ucgccgucguucagccagc

SEQ ID NO: 3662570 - RNA, 17 nt, Salmonella enterica enterica serovar Typhi
ucgccguguaagagcug

SEQ ID NO: 3662571 - RNA, 20 nt, Salmonella enterica enterica serovar Typhi
ucgccguuaacuggcgcauc

SEQ ID NO: 3662572 - RNA, 16 nt, Salmonella enterica enterica serovar Typhi
ucgcugccgaccuggc

SEQ ID NO: 3662573 - RNA, 20 nt, Salmonella enterica enterica serovar Typhi
ucgcugcugaugauaugggu

SEQ ID NO: 3662574 - RNA, 23 nt, Salmonella enterica enterica serovar Typhi
ucgcuggccauauuuuuucagga

SEQ ID NO: 3662575 - RNA, 18 nt, Salmonella enterica enterica serovar Typhi
ucgcuggcguagauauuc

SEQ ID NO: 3662576 - RNA, 17 nt, Salmonella enterica enterica serovar Typhi
ucgcuggugugcagcca

SEQ ID NO: 3662577 - RNA, 20 nt, Salmonella enterica enterica serovar Typhi
ucgcugucggucagauucag

SEQ ID NO: 3662578 - RNA, 13 nt, Salmonella enterica enterica serovar Typhi
ucgcuuaccgggc

SEQ ID NO: 3662579 - RNA, 16 nt, Salmonella enterica enterica serovar Typhi
ucgcuuacgcggcgcg

SEQ ID NO: 3662580 - RNA, 18 nt, Salmonella enterica enterica serovar Typhi
ucgcuuauuccuccgccg

SEQ ID NO: 3662581 - RNA, 21 nt, Salmonella enterica enterica serovar Typhi
ucgcuucaaucgugguuggca

SEQ ID NO: 3662582 - RNA, 14 nt, Salmonella enterica enterica serovar Typhi
ucgcuuccagcgcc

SEQ ID NO: 3662583 - RNA, 18 nt, Salmonella enterica enterica serovar Typhi
ucgcuuccuuuauugguu

SEQ ID NO: 3662584 - RNA, 21 nt, Salmonella enterica enterica serovar Typhi
ucgcuucggcaauggccagau

SEQ ID NO: 3662585 - RNA, 14 nt, Salmonella enterica enterica serovar Typhi
ucgcuugauacgcc

SEQ ID NO: 3662586 - RNA, 19 nt, Salmonella enterica enterica serovar Typhi
ucgcuugcccagcauauua

SEQ ID NO: 3662587 - RNA, 23 nt, Salmonella enterica enterica serovar Typhi
ucgcuuguugacgacuuuugcaa

SEQ ID NO: 3662588 - RNA, 12 nt, Salmonella enterica enterica serovar Typhi
ucgcuuguuuca

SEQ ID NO: 3662589 - RNA, 17 nt, Salmonella enterica enterica serovar Typhi
ucgcuuuacccgggcca

SEQ ID NO: 3662590 - RNA, 23 nt, Salmonella enterica enterica serovar Typhi
ucgcuuuuacucuuccugcugcg

SEQ ID NO: 3662591 - RNA, 19 nt, Salmonella enterica enterica serovar Typhi
ucgcuuuuauguuacccag

SEQ ID NO: 3662592 - RNA, 19 nt, Salmonella enterica enterica serovar Typhi
ucgcuuuuugcgccagcgc

SEQ ID NO: 3662593 - RNA, 19 nt, Salmonella enterica enterica serovar Typhi
ucggaaaucuguuccagcg

SEQ ID NO: 3662594 - RNA, 21 nt, Salmonella enterica enterica serovar Typhi
ucggaagacugcuccggcaag

SEQ ID NO: 3662595 - RNA, 18 nt, Salmonella enterica enterica serovar Typhi
ucggaagacuggcgcagc

SEQ ID NO: 3662596 - RNA, 22 nt, Salmonella enterica enterica serovar Typhi
ucggaaguauacauccacuggu

SEQ ID NO: 3662597 - RNA, 20 nt, Salmonella enterica enterica serovar Typhi
ucggaauaauguaaaaaaau

SEQ ID NO: 3662598 - RNA, 20 nt, Salmonella enterica enterica serovar Typhi
ucggaaugacaaacgccacc

SEQ ID NO: 3662599 - RNA, 21 nt, Salmonella enterica enterica serovar Typhi
ucggagagaguauaagcgccg

SEQ ID NO: 3662600 - RNA, 19 nt, Salmonella enterica enterica serovar Typhi
ucggauaaggcguuuacgc

SEQ ID NO: 3662601 - RNA, 16 nt, Salmonella enterica enterica serovar Typhi
ucggaugaucgucaac

SEQ ID NO: 3662602 - RNA, 14 nt, Salmonella enterica enterica serovar Typhi
ucggauguacugua

SEQ ID NO: 3662603 - RNA, 17 nt, Salmonella enterica enterica serovar Typhi
ucggcaaacagcuucau

SEQ ID NO: 3662604 - RNA, 18 nt, Salmonella enterica enterica serovar Typhi
ucggcaaaccaugaucgu

SEQ ID NO: 3662605 - RNA, 14 nt, Salmonella enterica enterica serovar Typhi
ucggcaaagucuuu

SEQ ID NO: 3662606 - RNA, 17 nt, Salmonella enterica enterica serovar Typhi
ucggcaauaaacucccg

SEQ ID NO: 3662607 - RNA, 19 nt, Salmonella enterica enterica serovar Typhi
ucggcaauaaacucccgca

SEQ ID NO: 3662608 - RNA, 17 nt, Salmonella enterica enterica serovar Typhi
ucggcaauaugcuguuu

SEQ ID NO: 3662609 - RNA, 18 nt, Salmonella enterica enterica serovar Typhi
ucggcaauggccagauga

SEQ ID NO: 3662610 - RNA, 18 nt, Salmonella enterica enterica serovar Typhi
ucggcaauuuccggcgac

SEQ ID NO: 3662611 - RNA, 14 nt, Salmonella enterica enterica serovar Typhi
ucggcaauuucuuu

SEQ ID NO: 3662612 - RNA, 19 nt, Salmonella enterica enterica serovar Typhi
ucggcacagccaguaagaa

SEQ ID NO: 3662613 - RNA, 15 nt, Salmonella enterica enterica serovar Typhi
ucggcaccauuccca

SEQ ID NO: 3662614 - RNA, 19 nt, Salmonella enterica enterica serovar Typhi
ucggcaccauucccacgca

SEQ ID NO: 3662615 - RNA, 21 nt, Salmonella enterica enterica serovar Typhi
ucggcacugacucuuccgggc

SEQ ID NO: 3662616 - RNA, 13 nt, Salmonella enterica enterica serovar Typhi
ucggcauaucgcc

SEQ ID NO: 3662617 - RNA, 22 nt, Salmonella enterica enterica serovar Typhi
ucggcaugauggcgaacagccc

SEQ ID NO: 3662618 - RNA, 17 nt, Salmonella enterica enterica serovar Typhi
ucggcaugcaucucuuc

SEQ ID NO: 3662619 - RNA, 15 nt, Salmonella enterica enterica serovar Typhi
ucggccaaccgccac

SEQ ID NO: 3662620 - RNA, 12 nt, Salmonella enterica enterica serovar Typhi
ucggccaccauu

SEQ ID NO: 3662621 - RNA, 15 nt, Salmonella enterica enterica serovar Typhi
ucggccagcgccagc

SEQ ID NO: 3662622 - RNA, 18 nt, Salmonella enterica enterica serovar Typhi
ucggccggauagggcgua

SEQ ID NO: 3662623 - RNA, 23 nt, Salmonella enterica enterica serovar Typhi
ucggcgaccagcagcgcggcgua

SEQ ID NO: 3662624 - RNA, 15 nt, Salmonella enterica enterica serovar Typhi
ucggcgacuuucacg

SEQ ID NO: 3662625 - RNA, 17 nt, Salmonella enterica enterica serovar Typhi
ucggcgaggggcaggcg

SEQ ID NO: 3662626 - RNA, 18 nt, Salmonella enterica enterica serovar Typhi
ucggcgauugucaucauu

SEQ ID NO: 3662627 - RNA, 22 nt, Salmonella enterica enterica serovar Typhi
ucggcgcaaccauuaccgcuaa

SEQ ID NO: 3662628 - RNA, 23 nt, Salmonella enterica enterica serovar Typhi
ucggcgcagggaucguuuuucuu

SEQ ID NO: 3662629 - RNA, 20 nt, Salmonella enterica enterica serovar Typhi
ucggcgcccagcuuacgcgc

SEQ ID NO: 3662630 - RNA, 23 nt, Salmonella enterica enterica serovar Typhi
ucggcgcccggacgaaccuggcg

SEQ ID NO: 3662631 - RNA, 14 nt, Salmonella enterica enterica serovar Typhi
ucggcgccggcguc

SEQ ID NO: 3662632 - RNA, 12 nt, Salmonella enterica enterica serovar Typhi
ucggcgcgcugg

SEQ ID NO: 3662633 - RNA, 22 nt, Salmonella enterica enterica serovar Typhi
ucggcggcccacucauccagca

SEQ ID NO: 3662634 - RNA, 20 nt, Salmonella enterica enterica serovar Typhi
ucggcgggcaggucgucuuc

SEQ ID NO: 3662635 - RNA, 14 nt, Salmonella enterica enterica serovar Typhi
ucggcggucgcggc

SEQ ID NO: 3662636 - RNA, 13 nt, Salmonella enterica enterica serovar Typhi
ucggcgucauccc

SEQ ID NO: 3662637 - RNA, 22 nt, Salmonella enterica enterica serovar Typhi
ucggcgucgcgaauaauuauuu

SEQ ID NO: 3662638 - RNA, 13 nt, Salmonella enterica enterica serovar Typhi
ucggcgucgcggc

SEQ ID NO: 3662639 - RNA, 16 nt, Salmonella enterica enterica serovar Typhi
ucggcgucgcggcaau

SEQ ID NO: 3662640 - RNA, 19 nt, Salmonella enterica enterica serovar Typhi
ucggcgucgugcugggcgc

SEQ ID NO: 3662641 - RNA, 20 nt, Salmonella enterica enterica serovar Typhi
ucggcgucugaugaauacgc

SEQ ID NO: 3662642 - RNA, 17 nt, Salmonella enterica enterica serovar Typhi
ucggcgugaauaaaaua

SEQ ID NO: 3662643 - RNA, 14 nt, Salmonella enterica enterica serovar Typhi
ucggcuccugguga

SEQ ID NO: 3662644 - RNA, 13 nt, Salmonella enterica enterica serovar Typhi
ucggcuuacccaa

SEQ ID NO: 3662645 - RNA, 20 nt, Salmonella enterica enterica serovar Typhi
ucggcuugcuucaucugguu

SEQ ID NO: 3662646 - RNA, 14 nt, Salmonella enterica enterica serovar Typhi
ucggcuuuaucgcc

SEQ ID NO: 3662647 - RNA, 21 nt, Salmonella enterica enterica serovar Typhi
ucggcuuuuuuuuaugccucu

SEQ ID NO: 3662648 - RNA, 14 nt, Salmonella enterica enterica serovar Typhi
ucgggaacgcuguc

SEQ ID NO: 3662649 - RNA, 21 nt, Salmonella enterica enterica serovar Typhi
ucgggaaucaucgaggccacc

SEQ ID NO: 3662650 - RNA, 20 nt, Salmonella enterica enterica serovar Typhi
ucgggaugguuaaauucaua

SEQ ID NO: 3662651 - RNA, 18 nt, Salmonella enterica enterica serovar Typhi
ucgggcaaaaugcgucgg

SEQ ID NO: 3662652 - RNA, 20 nt, Salmonella enterica enterica serovar Typhi
ucgggcaacugauaugacgu

SEQ ID NO: 3662653 - RNA, 19 nt, Salmonella enterica enterica serovar Typhi
ucgggcaggcuuccacgca

SEQ ID NO: 3662654 - RNA, 13 nt, Salmonella enterica enterica serovar Typhi
ucgggccaaucgg

SEQ ID NO: 3662655 - RNA, 16 nt, Salmonella enterica enterica serovar Typhi
ucggggucuuccagca

SEQ ID NO: 3662656 - RNA, 21 nt, Salmonella enterica enterica serovar Typhi
ucggguacggaauaucccgca

SEQ ID NO: 3662657 - RNA, 20 nt, Salmonella enterica enterica serovar Typhi
ucguuuaaguaagguaaagc

SEQ ID NO: 3662658 - RNA, 20 nt, Salmonella enterica enterica serovar Typhi
ucguuuacaccuauuccucc

SEQ ID NO: 3662659 - RNA, 14 nt, Salmonella enterica enterica serovar Typhi
ucguuuccagcgaa

SEQ ID NO: 3662660 - RNA, 15 nt, Salmonella enterica enterica serovar Typhi
ucguuugcaguuccg

SEQ ID NO: 3662661 - RNA, 17 nt, Salmonella enterica enterica serovar Typhi
ucguuugcaguuccgca

SEQ ID NO: 3662662 - RNA, 13 nt, Salmonella enterica enterica serovar Typhi
ucguuugcgcgca

SEQ ID NO: 3662663 - RNA, 13 nt, Salmonella enterica enterica serovar Typhi
ucguuuuccgcaa

SEQ ID NO: 3662664 - RNA, 12 nt, Salmonella enterica enterica serovar Typhi
ucuaaaaaggaa

SEQ ID NO: 3662665 - RNA, 23 nt, Salmonella enterica enterica serovar Typhi
ucuaaaauuauuuuuacuuaaaa

SEQ ID NO: 3662666 - RNA, 21 nt, Salmonella enterica enterica serovar Typhi
ucuaacgcaacggaaggaaau

SEQ ID NO: 3662667 - RNA, 23 nt, Salmonella enterica enterica serovar Typhi
ucuaacgcaacggaaggaaauaa

SEQ ID NO: 3662668 - RNA, 23 nt, Salmonella enterica enterica serovar Typhi
ucuaauucccaguaaccuauuuu

SEQ ID NO: 3662669 - RNA, 18 nt, Salmonella enterica enterica serovar Typhi
ucuacaccguagaucgcc

SEQ ID NO: 3662670 - RNA, 21 nt, Salmonella enterica enterica serovar Typhi
ucuacauuuucguaaaauaua

SEQ ID NO: 3662671 - RNA, 20 nt, Salmonella enterica enterica serovar Typhi
ucuaccaacugagcuaacga

SEQ ID NO: 3662672 - RNA, 14 nt, Salmonella enterica enterica serovar Typhi
ucuaccauaucgcc

SEQ ID NO: 3662673 - RNA, 18 nt, Salmonella enterica enterica serovar Typhi
ucuaccuggaaccaggcg

SEQ ID NO: 3662674 - RNA, 15 nt, Salmonella enterica enterica serovar Typhi
ucuacgcgccagcag

SEQ ID NO: 3662675 - RNA, 19 nt, Salmonella enterica enterica serovar Typhi
ucuacgcugccauccucau

SEQ ID NO: 3662676 - RNA, 16 nt, Salmonella enterica enterica serovar Typhi
ucuacuaacuggcaau

SEQ ID NO: 3662677 - RNA, 14 nt, Salmonella enterica enterica serovar Typhi
ucuacuacaacugu

SEQ ID NO: 3662678 - RNA, 20 nt, Salmonella enterica enterica serovar Typhi
ucuacuuuccugaagguaga

SEQ ID NO: 3662679 - RNA, 22 nt, Salmonella enterica enterica serovar Typhi
ucuacuuuucggguguccacuc

SEQ ID NO: 3662680 - RNA, 13 nt, Salmonella enterica enterica serovar Typhi
ucuaggcgcugcu

SEQ ID NO: 3662681 - RNA, 18 nt, Salmonella enterica enterica serovar Typhi
ucuaggcgcugcuggcag

SEQ ID NO: 3662682 - RNA, 15 nt, Salmonella enterica enterica serovar Typhi
ucuauacggcgcgca

SEQ ID NO: 3662683 - RNA, 14 nt, Salmonella enterica enterica serovar Typhi
ucuauagauuucgc

SEQ ID NO: 3662684 - RNA, 13 nt, Salmonella enterica enterica serovar Typhi
ucuauauccugcc

SEQ ID NO: 3662685 - RNA, 22 nt, Salmonella enterica enterica serovar Typhi
ucuaucacuucaauguuagcau

SEQ ID NO: 3662686 - RNA, 19 nt, Salmonella enterica enterica serovar Typhi
ucuaucagguaucccgcca

SEQ ID NO: 3662687 - RNA, 14 nt, Salmonella enterica enterica serovar Typhi
ucuaucgccagcgc

SEQ ID NO: 3662688 - RNA, 16 nt, Salmonella enterica enterica serovar Typhi
ucuaucgccuggagcu

SEQ ID NO: 3662689 - RNA, 15 nt, Salmonella enterica enterica serovar Typhi
ucuaucgcuccuccc

SEQ ID NO: 3662690 - RNA, 16 nt, Salmonella enterica enterica serovar Typhi
ucuaucggcaaaccau

SEQ ID NO: 3662691 - RNA, 17 nt, Salmonella enterica enterica serovar Typhi
ucuaucuguaacuucgg

SEQ ID NO: 3662692 - RNA, 19 nt, Salmonella enterica enterica serovar Typhi
ucuaucuguuuuaauuccu

SEQ ID NO: 3662693 - RNA, 13 nt, Salmonella enterica enterica serovar Typhi
ucuaucuuuucaa

SEQ ID NO: 3662694 - RNA, 16 nt, Salmonella enterica enterica serovar Typhi
ucuauuaaaucagaua

SEQ ID NO: 3662695 - RNA, 13 nt, Salmonella enterica enterica serovar Typhi
ucuauugauuggc

SEQ ID NO: 3662696 - RNA, 23 nt, Salmonella enterica enterica serovar Typhi
ucuauugauuggcaagaauuauu

SEQ ID NO: 3662697 - RNA, 16 nt, Salmonella enterica enterica serovar Typhi
ucuauugccuaaauaa

SEQ ID NO: 3662698 - RNA, 18 nt, Salmonella enterica enterica serovar Typhi
ucuauugccuaaauaacu

SEQ ID NO: 3662699 - RNA, 16 nt, Salmonella enterica enterica serovar Typhi
ucuauuuauugaagau

SEQ ID NO: 3662700 - RNA, 14 nt, Salmonella enterica enterica serovar Typhi
ucucaaaaaauauc

SEQ ID NO: 3662701 - RNA, 15 nt, Salmonella enterica enterica serovar Typhi
ucucaaacacuucua

SEQ ID NO: 3662702 - RNA, 19 nt, Salmonella enterica enterica serovar Typhi
ucucaaggucugucaggac

SEQ ID NO: 3662703 - RNA, 16 nt, Salmonella enterica enterica serovar Typhi
ucucaauaaaaugucu

SEQ ID NO: 3662704 - RNA, 19 nt, Salmonella enterica enterica serovar Typhi
ucucaauaucguugccgcc

SEQ ID NO: 3662705 - RNA, 13 nt, Salmonella enterica enterica serovar Typhi
ucucaaugaacag

SEQ ID NO: 3662706 - RNA, 13 nt, Salmonella enterica enterica serovar Typhi
ucucacacauugg

SEQ ID NO: 3662707 - RNA, 17 nt, Salmonella enterica enterica serovar Typhi
ucucacagaaucaucag

SEQ ID NO: 3662708 - RNA, 18 nt, Salmonella enterica enterica serovar Typhi
ucucacccguuuucuccu

SEQ ID NO: 3662709 - RNA, 22 nt, Salmonella enterica enterica serovar Typhi
ucucaccgccuaggccagugcc

SEQ ID NO: 3662710 - RNA, 13 nt, Salmonella enterica enterica serovar Typhi
ucucaccguggca

SEQ ID NO: 3662711 - RNA, 20 nt, Salmonella enterica enterica serovar Typhi
ucucagauggaaaaaaagaa

SEQ ID NO: 3662712 - RNA, 21 nt, Salmonella enterica enterica serovar Typhi
ucucagauggaaaaaaagaau

SEQ ID NO: 3662713 - RNA, 16 nt, Salmonella enterica enterica serovar Typhi
ucucagcgucggugaa

SEQ ID NO: 3662714 - RNA, 16 nt, Salmonella enterica enterica serovar Typhi
ucucaggacgccagug

SEQ ID NO: 3662715 - RNA, 14 nt, Salmonella enterica enterica serovar Typhi
ucucaggagugaac

SEQ ID NO: 3662716 - RNA, 23 nt, Salmonella enterica enterica serovar Typhi
ucucaggguguuuuuauacaucc

SEQ ID NO: 3662717 - RNA, 22 nt, Salmonella enterica enterica serovar Typhi
ucucauaaaccgccgcuuugau

SEQ ID NO: 3662718 - RNA, 17 nt, Salmonella enterica enterica serovar Typhi
ucucaucagaccgugaa

SEQ ID NO: 3662719 - RNA, 13 nt, Salmonella enterica enterica serovar Typhi
ucucaucagacug

SEQ ID NO: 3662720 - RNA, 12 nt, Salmonella enterica enterica serovar Typhi
ucucauccagcu

SEQ ID NO: 3662721 - RNA, 19 nt, Salmonella enterica enterica serovar Typhi
ucucauccagcuugccguc

SEQ ID NO: 3662722 - RNA, 15 nt, Salmonella enterica enterica serovar Typhi
ucucaucgacgauaa

SEQ ID NO: 3662723 - RNA, 17 nt, Salmonella enterica enterica serovar Typhi
ucucauuauuaaauuaa

SEQ ID NO: 3662724 - RNA, 15 nt, Salmonella enterica enterica serovar Typhi
ucucauugaucaguu

SEQ ID NO: 3662725 - RNA, 18 nt, Salmonella enterica enterica serovar Typhi
ucucauuguguacaucca

SEQ ID NO: 3662726 - RNA, 19 nt, Salmonella enterica enterica serovar Typhi
ucucauuuucuuuacgcua

SEQ ID NO: 3662727 - RNA, 19 nt, Salmonella enterica enterica serovar Typhi
ucuccagaucgcauaaaau

SEQ ID NO: 3662728 - RNA, 14 nt, Salmonella enterica enterica serovar Typhi
ucuccaguuugcgu

SEQ ID NO: 3662729 - RNA, 20 nt, Salmonella enterica enterica serovar Typhi
ucuccaucgggcucggcgcu

SEQ ID NO: 3662730 - RNA, 22 nt, Salmonella enterica enterica serovar Typhi
ucuccaugucacuggcggcggu

SEQ ID NO: 3662731 - RNA, 15 nt, Salmonella enterica enterica serovar Typhi
ucucccaaaugaaaa

SEQ ID NO: 3662732 - RNA, 12 nt, Salmonella enterica enterica serovar Typhi
ucucccagcaug

SEQ ID NO: 3662733 - RNA, 12 nt, Salmonella enterica enterica serovar Typhi
ucucccagcuga

SEQ ID NO: 3662734 - RNA, 17 nt, Salmonella enterica enterica serovar Typhi
ucucccaggccgccacc

SEQ ID NO: 3662735 - RNA, 14 nt, Salmonella enterica enterica serovar Typhi
ucucccaucaauaa

SEQ ID NO: 3662736 - RNA, 19 nt, Salmonella enterica enterica serovar Typhi
ucucccguuuguauaaauu

SEQ ID NO: 3662737 - RNA, 22 nt, Salmonella enterica enterica serovar Typhi
ucucccuacugcuuagcucauc

SEQ ID NO: 3662738 - RNA, 15 nt, Salmonella enterica enterica serovar Typhi
ucucccuccccauuc

SEQ ID NO: 3662739 - RNA, 16 nt, Salmonella enterica enterica serovar Typhi
ucucccugccagugaa

SEQ ID NO: 3662740 - RNA, 13 nt, Salmonella enterica enterica serovar Typhi
ucucccuggcagu

SEQ ID NO: 3662741 - RNA, 15 nt, Salmonella enterica enterica serovar Typhi
ucuccgccgccuggc

SEQ ID NO: 3662742 - RNA, 19 nt, Salmonella enterica enterica serovar Typhi
ucuccggcagcgaauguau

SEQ ID NO: 3662743 - RNA, 17 nt, Salmonella enterica enterica serovar Typhi
ucugcgccuuuuaccuu

SEQ ID NO: 3662744 - RNA, 23 nt, Salmonella enterica enterica serovar Typhi
ucugcgcuaagcguuacggaaaa

SEQ ID NO: 3662745 - RNA, 22 nt, Salmonella enterica enterica serovar Typhi
ucugcgcuggguuuuuccgcuu

SEQ ID NO: 3662746 - RNA, 19 nt, Salmonella enterica enterica serovar Typhi
ucugcgucaguaccugaug

SEQ ID NO: 3662747 - RNA, 21 nt, Salmonella enterica enterica serovar Typhi
ucugcguccugcuuaugaaac

SEQ ID NO: 3662748 - RNA, 22 nt, Salmonella enterica enterica serovar Typhi
ucugcgugagccggacacugcg

SEQ ID NO: 3662749 - RNA, 17 nt, Salmonella enterica enterica serovar Typhi
ucugcucagaaauauuc

SEQ ID NO: 3662750 - RNA, 17 nt, Salmonella enterica enterica serovar Typhi
ucugcuccgccagcaau

SEQ ID NO: 3662751 - RNA, 14 nt, Salmonella enterica enterica serovar Typhi
ucugcuccggcgua

SEQ ID NO: 3662752 - RNA, 23 nt, Salmonella enterica enterica serovar Typhi
ucugcugacacccucugcgccuu

SEQ ID NO: 3662753 - RNA, 16 nt, Salmonella enterica enterica serovar Typhi
ucugcugauaauacug

SEQ ID NO: 3662754 - RNA, 22 nt, Salmonella enterica enterica serovar Typhi
ucugcugaugcugguuuuagcu

SEQ ID NO: 3662755 - RNA, 19 nt, Salmonella enterica enterica serovar Typhi
ucugcugccucaucaauuc

SEQ ID NO: 3662756 - RNA, 21 nt, Salmonella enterica enterica serovar Typhi
ucugcugggcgauuucacgaa

SEQ ID NO: 3662757 - RNA, 18 nt, Salmonella enterica enterica serovar Typhi
ucugcuuguucuuuucaa

SEQ ID NO: 3662758 - RNA, 14 nt, Salmonella enterica enterica serovar Typhi
ucugcuuuucucac

SEQ ID NO: 3662759 - RNA, 23 nt, Salmonella enterica enterica serovar Typhi
ucugcuuuuugauacagcagcac

SEQ ID NO: 3662760 - RNA, 16 nt, Salmonella enterica enterica serovar Typhi
ucuggaaucaauuucc

SEQ ID NO: 3662761 - RNA, 15 nt, Salmonella enterica enterica serovar Typhi
ucuggaguacgggca

SEQ ID NO: 3662762 - RNA, 17 nt, Salmonella enterica enterica serovar Typhi
ucuggauagucuucaag

SEQ ID NO: 3662763 - RNA, 15 nt, Salmonella enterica enterica serovar Typhi
ucuggaucaguuccg

SEQ ID NO: 3662764 - RNA, 22 nt, Salmonella enterica enterica serovar Typhi
ucuggaugcguucaaagaucuc

SEQ ID NO: 3662765 - RNA, 17 nt, Salmonella enterica enterica serovar Typhi
ucuggauuacaaaaaua

SEQ ID NO: 3662766 - RNA, 17 nt, Salmonella enterica enterica serovar Typhi
ucuggccaauuuuucac

SEQ ID NO: 3662767 - RNA, 15 nt, Salmonella enterica enterica serovar Typhi
ucuggccaguuucaa

SEQ ID NO: 3662768 - RNA, 14 nt, Salmonella enterica enterica serovar Typhi
ucuggccauuucau

SEQ ID NO: 3662769 - RNA, 18 nt, Salmonella enterica enterica serovar Typhi
ucuggcgacgccaaucgg

SEQ ID NO: 3662770 - RNA, 23 nt, Salmonella enterica enterica serovar Typhi
ucuggcgcagauacgcgucaaag

SEQ ID NO: 3662771 - RNA, 14 nt, Salmonella enterica enterica serovar Typhi
ucuggcgcauaaug

SEQ ID NO: 3662772 - RNA, 19 nt, Salmonella enterica enterica serovar Typhi
ucuggcgcauuccagaccc

SEQ ID NO: 3662773 - RNA, 18 nt, Salmonella enterica enterica serovar Typhi
ucuggcgcuuuuccagca

SEQ ID NO: 3662774 - RNA, 14 nt, Salmonella enterica enterica serovar Typhi
ucuggcggcguaau

SEQ ID NO: 3662775 - RNA, 14 nt, Salmonella enterica enterica serovar Typhi
ucuggcucagacca

SEQ ID NO: 3662776 - RNA, 14 nt, Salmonella enterica enterica serovar Typhi
ucuggcugcugaug

SEQ ID NO: 3662777 - RNA, 17 nt, Salmonella enterica enterica serovar Typhi
ucuggguaacgcucuua

SEQ ID NO: 3662778 - RNA, 18 nt, Salmonella enterica enterica serovar Typhi
ucuggguuagcuguaucc

SEQ ID NO: 3662779 - RNA, 22 nt, Salmonella enterica enterica serovar Typhi
ucugguaagacgggugcgccca

SEQ ID NO: 3662780 - RNA, 20 nt, Salmonella enterica enterica serovar Typhi
ucugguacggccaccaggcc

SEQ ID NO: 3662781 - RNA, 20 nt, Salmonella enterica enterica serovar Typhi
ucuggucagcgaugacgccu

SEQ ID NO: 3662782 - RNA, 12 nt, Salmonella enterica enterica serovar Typhi
ucuggugcagca

SEQ ID NO: 3662783 - RNA, 22 nt, Salmonella enterica enterica serovar Typhi
ucugguuguuucgguuuccguu

SEQ ID NO: 3662784 - RNA, 21 nt, Salmonella enterica enterica serovar Typhi
ucuguaagagacugacaauga

SEQ ID NO: 3662785 - RNA, 15 nt, Salmonella enterica enterica serovar Typhi
ucuguaauuauaaau

SEQ ID NO: 3662786 - RNA, 21 nt, Salmonella enterica enterica serovar Typhi
ucuguaauucucccaaauuuu

SEQ ID NO: 3662787 - RNA, 21 nt, Salmonella enterica enterica serovar Typhi
ucuguacagcgucgacagccc

SEQ ID NO: 3662788 - RNA, 18 nt, Salmonella enterica enterica serovar Typhi
ucuguacgcugaauaacc

SEQ ID NO: 3662789 - RNA, 16 nt, Salmonella enterica enterica serovar Typhi
ucuguacggcauauuc

SEQ ID NO: 3662790 - RNA, 21 nt, Salmonella enterica enterica serovar Typhi
ucuguaggccggauaaggcgu

SEQ ID NO: 3662791 - RNA, 20 nt, Salmonella enterica enterica serovar Typhi
ucuguaggccugauaagcgc

SEQ ID NO: 3662792 - RNA, 13 nt, Salmonella enterica enterica serovar Typhi
ucuguauaaaaua

SEQ ID NO: 3662793 - RNA, 18 nt, Salmonella enterica enterica serovar Typhi
ucuguauaaaauauuugg

SEQ ID NO: 3662794 - RNA, 13 nt, Salmonella enterica enterica serovar Typhi
ucuguauuuaaua

SEQ ID NO: 3662795 - RNA, 17 nt, Salmonella enterica enterica serovar Typhi
ucugucagaaaucugaa

SEQ ID NO: 3662796 - RNA, 19 nt, Salmonella enterica enterica serovar Typhi
ucuguccgaugagaaguag

SEQ ID NO: 3662797 - RNA, 19 nt, Salmonella enterica enterica serovar Typhi
ucuguccgcuuuuuuauug

SEQ ID NO: 3662798 - RNA, 21 nt, Salmonella enterica enterica serovar Typhi
ucuguccuuucugcugccgca

SEQ ID NO: 3662799 - RNA, 23 nt, Salmonella enterica enterica serovar Typhi
ucugucgccgcguaaauccacau

SEQ ID NO: 3662800 - RNA, 19 nt, Salmonella enterica enterica serovar Typhi
ucuguggggcuuaacccac

SEQ ID NO: 3662801 - RNA, 22 nt, Salmonella enterica enterica serovar Typhi
ucugugucguccaggccugaua

SEQ ID NO: 3662802 - RNA, 15 nt, Salmonella enterica enterica serovar Typhi
ucuguguugaauaaa

SEQ ID NO: 3662803 - RNA, 11 nt, Salmonella enterica enterica serovar Typhi
ucuguuauuuc

SEQ ID NO: 3662804 - RNA, 18 nt, Salmonella enterica enterica serovar Typhi
ucuguucuacuacagaaa

SEQ ID NO: 3662805 - RNA, 21 nt, Salmonella enterica enterica serovar Typhi
ucuguucuacuacagaaagcc

SEQ ID NO: 3662806 - RNA, 23 nt, Salmonella enterica enterica serovar Typhi
ucuguucuacuacagaaagccau

SEQ ID NO: 3662807 - RNA, 15 nt, Salmonella enterica enterica serovar Typhi
ucuguugcgccaggg

SEQ ID NO: 3662808 - RNA, 21 nt, Salmonella enterica enterica serovar Typhi
ucuguuucaguucggagauca

SEQ ID NO: 3662809 - RNA, 14 nt, Salmonella enterica enterica serovar Typhi
ucuguuuguucgca

SEQ ID NO: 3662810 - RNA, 17 nt, Salmonella enterica enterica serovar Typhi
ucuguuuuagcaugaca

SEQ ID NO: 3662811 - RNA, 23 nt, Salmonella enterica enterica serovar Typhi
ucuguuuuuggaaacuaugcaaa

SEQ ID NO: 3662812 - RNA, 15 nt, Salmonella enterica enterica serovar Typhi
ucuuaaaauagccau

SEQ ID NO: 3662813 - RNA, 14 nt, Salmonella enterica enterica serovar Typhi
ucuuaaaucaugaa

SEQ ID NO: 3662814 - RNA, 16 nt, Salmonella enterica enterica serovar Typhi
ucuuaaugccagcggc

SEQ ID NO: 3662815 - RNA, 15 nt, Salmonella enterica enterica serovar Typhi
ucuuaauuauaaagc

SEQ ID NO: 3662816 - RNA, 16 nt, Salmonella enterica enterica serovar Typhi
ucuuacacuuagcaca

SEQ ID NO: 3662817 - RNA, 12 nt, Salmonella enterica enterica serovar Typhi
ucuuacauaaga

SEQ ID NO: 3662818 - RNA, 13 nt, Salmonella enterica enterica serovar Typhi
ucuuaccacgccg

SEQ ID NO: 3662819 - RNA, 21 nt, Salmonella enterica enterica serovar Typhi
ucuuaccaggucuuaccuauu

SEQ ID NO: 3662820 - RNA, 23 nt, Salmonella enterica enterica serovar Typhi
ucuuaccgcuaaaauacccgacc

SEQ ID NO: 3662821 - RNA, 20 nt, Salmonella enterica enterica serovar Typhi
ucuuacuaauaaauauucau

SEQ ID NO: 3662822 - RNA, 21 nt, Salmonella enterica enterica serovar Typhi
ucuuacuaauaaauauucauc

SEQ ID NO: 3662823 - RNA, 23 nt, Salmonella enterica enterica serovar Typhi
ucuuacuaauaaauauucaucaa

SEQ ID NO: 3662824 - RNA, 16 nt, Salmonella enterica enterica serovar Typhi
ucuuacugaccggccc

SEQ ID NO: 3662825 - RNA, 23 nt, Salmonella enterica enterica serovar Typhi
ucuuagaauagaaucaauuucuc

SEQ ID NO: 3662826 - RNA, 24 nt, Salmonella enterica enterica serovar Typhi
ucuuagguucguagcgcaaauauc

SEQ ID NO: 3662827 - RNA, 14 nt, Salmonella enterica enterica serovar Typhi
ucuuaguaacauaa

SEQ ID NO: 3662828 - RNA, 22 nt, Salmonella enterica enterica serovar Typhi
ucuuuaaacaacgccauaauac

SEQ ID NO: 3662829 - RNA, 23 nt, Salmonella enterica enterica serovar Typhi
ucuuuaaugcccgguauuuuuuc

SEQ ID NO: 3662830 - RNA, 20 nt, Salmonella enterica enterica serovar Typhi
ucuuuaauuugugccagcgu

SEQ ID NO: 3662831 - RNA, 22 nt, Salmonella enterica enterica serovar Typhi
ucuuuacacucgcggauaaugu

SEQ ID NO: 3662832 - RNA, 16 nt, Salmonella enterica enterica serovar Typhi
ucuuuacgcagcaaga

SEQ ID NO: 3662833 - RNA, 22 nt, Salmonella enterica enterica serovar Typhi
ucuuuacgcagcaagaacagag

SEQ ID NO: 3662834 - RNA, 20 nt, Salmonella enterica enterica serovar Typhi
ucuuuacgcuuauacggcug

SEQ ID NO: 3662835 - RNA, 15 nt, Salmonella enterica enterica serovar Typhi
ucuuuacuaauaccu

SEQ ID NO: 3662836 - RNA, 16 nt, Salmonella enterica enterica serovar Typhi
ucuuuagauaauuucg

SEQ ID NO: 3662837 - RNA, 17 nt, Salmonella enterica enterica serovar Typhi
ucuuuagauaauuucgc

SEQ ID NO: 3662838 - RNA, 21 nt, Salmonella enterica enterica serovar Typhi
ucuuuagcgcuaauuccuguc

SEQ ID NO: 3662839 - RNA, 12 nt, Salmonella enterica enterica serovar Typhi
ucuuuaucaaac

SEQ ID NO: 3662840 - RNA, 23 nt, Salmonella enterica enterica serovar Typhi
ucuuuaugcgagaguuuuucagc

SEQ ID NO: 3662841 - RNA, 23 nt, Salmonella enterica enterica serovar Typhi
ucuuuaugcggcgcuuccagacu

SEQ ID NO: 3662842 - RNA, 12 nt, Salmonella enterica enterica serovar Typhi
ucuuuauucgcg

SEQ ID NO: 3662843 - RNA, 14 nt, Salmonella enterica enterica serovar Typhi
ucuuucaacuuccg

SEQ ID NO: 3662844 - RNA, 17 nt, Salmonella enterica enterica serovar Typhi
ucuuucaauaauggcgc

SEQ ID NO: 3662845 - RNA, 12 nt, Salmonella enterica enterica serovar Typhi
ucuuucaauccu

SEQ ID NO: 3662846 - RNA, 19 nt, Salmonella enterica enterica serovar Typhi
ucuuucaauccuucuucug

SEQ ID NO: 3662847 - RNA, 13 nt, Salmonella enterica enterica serovar Typhi
ucuuucauuucug

SEQ ID NO: 3662848 - RNA, 15 nt, Salmonella enterica enterica serovar Typhi
ucuuuccuuuuucag

SEQ ID NO: 3662849 - RNA, 18 nt, Salmonella enterica enterica serovar Typhi
ucuuucugcgcacgagug

SEQ ID NO: 3662850 - RNA, 14 nt, Salmonella enterica enterica serovar Typhi
ucuuucuuuuuaua

SEQ ID NO: 3662851 - RNA, 15 nt, Salmonella enterica enterica serovar Typhi
ucuuugaccagcgac

SEQ ID NO: 3662852 - RNA, 20 nt, Salmonella enterica enterica serovar Typhi
ucuuugacccacgccagcag

SEQ ID NO: 3662853 - RNA, 18 nt, Salmonella enterica enterica serovar Typhi
ucuuugagcaucaaacuu

SEQ ID NO: 3662854 - RNA, 20 nt, Salmonella enterica enterica serovar Typhi
ucuuugcagcuccuuuuaau

SEQ ID NO: 3662855 - RNA, 15 nt, Salmonella enterica enterica serovar Typhi
ucuuuggacggcauc

SEQ ID NO: 3662856 - RNA, 17 nt, Salmonella enterica enterica serovar Typhi
ucuuuggacggcaucag

SEQ ID NO: 3662857 - RNA, 12 nt, Salmonella enterica enterica serovar Typhi
ucuuuggcgauu

SEQ ID NO: 3662858 - RNA, 13 nt, Salmonella enterica enterica serovar Typhi
ucuuuuaaaaauc

SEQ ID NO: 3662859 - RNA, 15 nt, Salmonella enterica enterica serovar Typhi
ucuuuuaacauaagu

SEQ ID NO: 3662860 - RNA, 18 nt, Salmonella enterica enterica serovar Typhi
ucuuuuacgaucgccacc

SEQ ID NO: 3662861 - RNA, 15 nt, Salmonella enterica enterica serovar Typhi
ucuuuuauauguuga

SEQ ID NO: 3662862 - RNA, 16 nt, Salmonella enterica enterica serovar Typhi
ucuuuuaucacccgga

SEQ ID NO: 3662863 - RNA, 20 nt, Salmonella enterica enterica serovar Typhi
ucuuuuaucguugcuucgcg

SEQ ID NO: 3662864 - RNA, 12 nt, Salmonella enterica enterica serovar Typhi
ucuuuuauuauu

SEQ ID NO: 3662865 - RNA, 13 nt, Salmonella enterica enterica serovar Typhi
ucuuuucaauaaa

SEQ ID NO: 3662866 - RNA, 22 nt, Salmonella enterica enterica serovar Typhi
ucuuuucguuucuugauguguc

SEQ ID NO: 3662867 - RNA, 23 nt, Salmonella enterica enterica serovar Typhi
ucuuuucugucguguccuugcca

SEQ ID NO: 3662868 - RNA, 20 nt, Salmonella enterica enterica serovar Typhi
ucuuuugucguccccuggac

SEQ ID NO: 3662869 - RNA, 17 nt, Salmonella enterica enterica serovar Typhi
ucuuuuguuuuucucuu

SEQ ID NO: 3662870 - RNA, 23 nt, Salmonella enterica enterica serovar Typhi
ucuuuuucgaucagcauaucgau

SEQ ID NO: 3662871 - RNA, 11 nt, Salmonella enterica enterica serovar Typhi
ugaaaaaaacg

SEQ ID NO: 3662872 - RNA, 13 nt, Salmonella enterica enterica serovar Typhi
ugaaaaaacgggc

SEQ ID NO: 3662873 - RNA, 12 nt, Salmonella enterica enterica serovar Typhi
ugaaaaaauuuc

SEQ ID NO: 3662874 - RNA, 13 nt, Salmonella enterica enterica serovar Typhi
ugaaaaacgggag

SEQ ID NO: 3662875 - RNA, 11 nt, Salmonella enterica enterica serovar Typhi
ugaaaaagaau

SEQ ID NO: 3662876 - RNA, 16 nt, Salmonella enterica enterica serovar Typhi
ugaaaaagauagacca

SEQ ID NO: 3662877 - RNA, 13 nt, Salmonella enterica enterica serovar Typhi
ugaaaaauguuca

SEQ ID NO: 3662878 - RNA, 13 nt, Salmonella enterica enterica serovar Typhi
ugaaaacaccagg

SEQ ID NO: 3662879 - RNA, 21 nt, Salmonella enterica enterica serovar Typhi
ugaaaacgcagccccaguugg

SEQ ID NO: 3662880 - RNA, 15 nt, Salmonella enterica enterica serovar Typhi
ugaaaacggcaucaa

SEQ ID NO: 3662881 - RNA, 15 nt, Salmonella enterica enterica serovar Typhi
ugaaaagcagccaga

SEQ ID NO: 3662882 - RNA, 12 nt, Salmonella enterica enterica serovar Typhi
ugaaaagggacu

SEQ ID NO: 3662883 - RNA, 23 nt, Salmonella enterica enterica serovar Typhi
ugaaaaggggaucguguaacaau

SEQ ID NO: 3662884 - RNA, 13 nt, Salmonella enterica enterica serovar Typhi
ugaaaauaauuga

SEQ ID NO: 3662885 - RNA, 18 nt, Salmonella enterica enterica serovar Typhi
ugaaaauaauuuuuauca

SEQ ID NO: 3662886 - RNA, 15 nt, Salmonella enterica enterica serovar Typhi
ugaaaaucaaaaaca

SEQ ID NO: 3662887 - RNA, 21 nt, Salmonella enterica enterica serovar Typhi
ugaaaaugcguccagaggauc

SEQ ID NO: 3662888 - RNA, 18 nt, Salmonella enterica enterica serovar Typhi
ugaaacccauaauaauga

SEQ ID NO: 3662889 - RNA, 20 nt, Salmonella enterica enterica serovar Typhi
ugaaacccauaauaaugacu

SEQ ID NO: 3662890 - RNA, 14 nt, Salmonella enterica enterica serovar Typhi
ugaaaccccaaauc

SEQ ID NO: 3662891 - RNA, 20 nt, Salmonella enterica enterica serovar Typhi
ugaaaccccaaaucagcaaa

SEQ ID NO: 3662892 - RNA, 23 nt, Salmonella enterica enterica serovar Typhi
ugaaaccggcgcgccuuccagca

SEQ ID NO: 3662893 - RNA, 18 nt, Salmonella enterica enterica serovar Typhi
ugaaacgaaaacugggca

SEQ ID NO: 3662894 - RNA, 11 nt, Salmonella enterica enterica serovar Typhi
ugaaacgccga

SEQ ID NO: 3662895 - RNA, 18 nt, Salmonella enterica enterica serovar Typhi
ugaaacgccguuuguuua

SEQ ID NO: 3662896 - RNA, 17 nt, Salmonella enterica enterica serovar Typhi
ugaaacguguuuauccc

SEQ ID NO: 3662897 - RNA, 21 nt, Salmonella enterica enterica serovar Typhi
ugaaacguguuuauccccgcu

SEQ ID NO: 3662898 - RNA, 14 nt, Salmonella enterica enterica serovar Typhi
ugaaacucacugaa

SEQ ID NO: 3662899 - RNA, 18 nt, Salmonella enterica enterica serovar Typhi
ugaaacucgacacacuca

SEQ ID NO: 3662900 - RNA, 17 nt, Salmonella enterica enterica serovar Typhi
ugaaacucgccaugcca

SEQ ID NO: 3662901 - RNA, 19 nt, Salmonella enterica enterica serovar Typhi
ugaaacucgccaugccauc

SEQ ID NO: 3662902 - RNA, 18 nt, Salmonella enterica enterica serovar Typhi
ugaaaggaagugcaacug

SEQ ID NO: 3662903 - RNA, 22 nt, Salmonella enterica enterica serovar Typhi
ugaaaguuugaaguguuccuga

SEQ ID NO: 3662904 - RNA, 16 nt, Salmonella enterica enterica serovar Typhi
ugaaauaacagacucc

SEQ ID NO: 3662905 - RNA, 19 nt, Salmonella enterica enterica serovar Typhi
ugaaauaauuguguaaucu

SEQ ID NO: 3662906 - RNA, 14 nt, Salmonella enterica enterica serovar Typhi
ugaaauacagccag

SEQ ID NO: 3662907 - RNA, 22 nt, Salmonella enterica enterica serovar Typhi
ugaaauaccaggcggcuuuuuc

SEQ ID NO: 3662908 - RNA, 13 nt, Salmonella enterica enterica serovar Typhi
ugaaaucacgcca

SEQ ID NO: 3662909 - RNA, 12 nt, Salmonella enterica enterica serovar Typhi
ugaaauccucua

SEQ ID NO: 3662910 - RNA, 19 nt, Salmonella enterica enterica serovar Typhi
ugaaauccucuauuuuuua

SEQ ID NO: 3662911 - RNA, 20 nt, Salmonella enterica enterica serovar Typhi
ugaaaucgccuguuaauggu

SEQ ID NO: 3662912 - RNA, 22 nt, Salmonella enterica enterica serovar Typhi
ugaaaucgucagacggcuccag

SEQ ID NO: 3662913 - RNA, 15 nt, Salmonella enterica enterica serovar Typhi
ugaaaucgucgccaa

SEQ ID NO: 3662914 - RNA, 21 nt, Salmonella enterica enterica serovar Typhi
ugaaucguagcgugcgcaaua

SEQ ID NO: 3662915 - RNA, 17 nt, Salmonella enterica enterica serovar Typhi
ugaaucucuucccagcg

SEQ ID NO: 3662916 - RNA, 22 nt, Salmonella enterica enterica serovar Typhi
ugaaucuggucggugauauauu

SEQ ID NO: 3662917 - RNA, 24 nt, Salmonella enterica enterica serovar Typhi
ugaaucuggucggugauauauuca

SEQ ID NO: 3662918 - RNA, 13 nt, Salmonella enterica enterica serovar Typhi
ugaaugcaaagaa

SEQ ID NO: 3662919 - RNA, 19 nt, Salmonella enterica enterica serovar Typhi
ugaaugccccagcgcugcu

SEQ ID NO: 3662920 - RNA, 16 nt, Salmonella enterica enterica serovar Typhi
ugaaugccggauggcg

SEQ ID NO: 3662921 - RNA, 21 nt, Salmonella enterica enterica serovar Typhi
ugaaugcucucauauuccagc

SEQ ID NO: 3662922 - RNA, 20 nt, Salmonella enterica enterica serovar Typhi
ugaauggcggagaucuccag

SEQ ID NO: 3662923 - RNA, 11 nt, Salmonella enterica enterica serovar Typhi
ugaauguuuug

SEQ ID NO: 3662924 - RNA, 22 nt, Salmonella enterica enterica serovar Typhi
ugaauuacagcucauaaacgcg

SEQ ID NO: 3662925 - RNA, 17 nt, Salmonella enterica enterica serovar Typhi
ugaauuauuuuuucaug

SEQ ID NO: 3662926 - RNA, 14 nt, Salmonella enterica enterica serovar Typhi
ugaauucaacgucc

SEQ ID NO: 3662927 - RNA, 15 nt, Salmonella enterica enterica serovar Typhi
ugaauucaccgcaug

SEQ ID NO: 3662928 - RNA, 14 nt, Salmonella enterica enterica serovar Typhi
ugaauucguuaccu

SEQ ID NO: 3662929 - RNA, 18 nt, Salmonella enterica enterica serovar Typhi
ugaauugccauuguucgc

SEQ ID NO: 3662930 - RNA, 17 nt, Salmonella enterica enterica serovar Typhi
ugaauugcgguuuaucc

SEQ ID NO: 3662931 - RNA, 22 nt, Salmonella enterica enterica serovar Typhi
ugaauugcgguuuauccccgcu

SEQ ID NO: 3662932 - RNA, 22 nt, Salmonella enterica enterica serovar Typhi
ugaauuuaauggucuuaaaugc

SEQ ID NO: 3662933 - RNA, 20 nt, Salmonella enterica enterica serovar Typhi
ugaauuuaucccgugguggg

SEQ ID NO: 3662934 - RNA, 20 nt, Salmonella enterica enterica serovar Typhi
ugaauuugcugcauuucuug

SEQ ID NO: 3662935 - RNA, 16 nt, Salmonella enterica enterica serovar Typhi
ugacaaaaauuaaaac

SEQ ID NO: 3662936 - RNA, 20 nt, Salmonella enterica enterica serovar Typhi
ugacaaauuguuuaaaaaca

SEQ ID NO: 3662937 - RNA, 17 nt, Salmonella enterica enterica serovar Typhi
ugacaacacucacaaaa

SEQ ID NO: 3662938 - RNA, 23 nt, Salmonella enterica enterica serovar Typhi
ugacaacacucacaaaacuauuu

SEQ ID NO: 3662939 - RNA, 11 nt, Salmonella enterica enterica serovar Typhi
ugacaauaagu

SEQ ID NO: 3662940 - RNA, 16 nt, Salmonella enterica enterica serovar Typhi
ugacaauauugccaua

SEQ ID NO: 3662941 - RNA, 20 nt, Salmonella enterica enterica serovar Typhi
ugacaauauugccauaaaua

SEQ ID NO: 3662942 - RNA, 14 nt, Salmonella enterica enterica serovar Typhi
ugacaaucacucuc

SEQ ID NO: 3662943 - RNA, 21 nt, Salmonella enterica enterica serovar Typhi
ugacaaucuccuccggcuuca

SEQ ID NO: 3662944 - RNA, 12 nt, Salmonella enterica enterica serovar Typhi
ugacaaucugcu

SEQ ID NO: 3662945 - RNA, 22 nt, Salmonella enterica enterica serovar Typhi
ugacaauuuccagaugcggcgc
